United States Patent 10,336,808 (MHC PEPTIDE COMPLEXES AND USES THEREOF IN INFECTIOUS DISEASES) - sequence listing, part 2

SEQ ID NO: 14218 - protein, 9 aa, BK virus
TKAAFIKCI

SEQ ID NO: 14219 - protein, 9 aa, BK virus
KAAFIKCIC

SEQ ID NO: 14220 - protein, 9 aa, BK virus
AAFIKCICT

SEQ ID NO: 14221 - protein, 9 aa, BK virus
AFIKCICTI

SEQ ID NO: 14222 - protein, 9 aa, BK virus
FIKCICTIK

SEQ ID NO: 14223 - protein, 9 aa, BK virus
IKCICTIKA

SEQ ID NO: 14224 - protein, 9 aa, BK virus
KCICTIKAP

SEQ ID NO: 14225 - protein, 9 aa, BK virus
CICTIKAPV

SEQ ID NO: 14226 - protein, 9 aa, BK virus
SILVCNCPC

SEQ ID NO: 14227 - protein, 9 aa, BK virus
ILVCNCPCL

SEQ ID NO: 14228 - protein, 9 aa, BK virus
LVCNCPCLS

SEQ ID NO: 14229 - protein, 9 aa, BK virus
VCNCPCLSI

SEQ ID NO: 14230 - protein, 9 aa, BK virus
CNCPCLSIY

SEQ ID NO: 14231 - protein, 9 aa, BK virus
NCPCLSIYL

SEQ ID NO: 14232 - protein, 9 aa, BK virus
CPCLSIYLI

SEQ ID NO: 14233 - protein, 9 aa, BK virus
PCLSIYLII

SEQ ID NO: 14234 - protein, 9 aa, BK virus
CLSIYLIIS

SEQ ID NO: 14235 - protein, 9 aa, BK virus
LSIYLIISG

SEQ ID NO: 14236 - protein, 9 aa, BK virus
SIYLIISGS

SEQ ID NO: 14237 - protein, 9 aa, BK virus
IYLIISGSP

SEQ ID NO: 14238 - protein, 9 aa, BK virus
YLIISGSPG

SEQ ID NO: 14239 - protein, 9 aa, BK virus
LIISGSPGS

SEQ ID NO: 14240 - protein, 9 aa, BK virus
IISGSPGSL

SEQ ID NO: 14241 - protein, 9 aa, BK virus
ISGSPGSLS

SEQ ID NO: 14242 - protein, 9 aa, BK virus
SGSPGSLSV

SEQ ID NO: 14243 - protein, 9 aa, BK virus
GSPGSLSVP

SEQ ID NO: 14244 - protein, 9 aa, BK virus
SPGSLSVPS

SEQ ID NO: 14245 - protein, 9 aa, BK virus
PGSLSVPSN

SEQ ID NO: 14246 - protein, 9 aa, BK virus
GSLSVPSNT

SEQ ID NO: 14247 - protein, 9 aa, BK virus
SLSVPSNTL

SEQ ID NO: 14248 - protein, 9 aa, BK virus
LSVPSNTLT

SEQ ID NO: 14249 - protein, 9 aa, BK virus
SVPSNTLTS

SEQ ID NO: 14250 - protein, 9 aa, BK virus
VPSNTLTSS

SEQ ID NO: 14251 - protein, 9 aa, BK virus
PSNTLTSST

SEQ ID NO: 14252 - protein, 9 aa, BK virus
SNTLTSSTW

SEQ ID NO: 14253 - protein, 9 aa, BK virus
NTLTSSTWD

SEQ ID NO: 14254 - protein, 9 aa, BK virus
TLTSSTWDS

SEQ ID NO: 14255 - protein, 9 aa, BK virus
LTSSTWDSI

SEQ ID NO: 14256 - protein, 9 aa, BK virus
TSSTWDSIP

SEQ ID NO: 14257 - protein, 9 aa, BK virus
SSTWDSIPY

SEQ ID NO: 14258 - protein, 9 aa, BK virus
STWDSIPYI

SEQ ID NO: 14259 - protein, 9 aa, BK virus
TWDSIPYIG

SEQ ID NO: 14260 - protein, 9 aa, BK virus
WDSIPYIGC

SEQ ID NO: 14261 - protein, 9 aa, BK virus
DSIPYIGCP

SEQ ID NO: 14262 - protein, 9 aa, BK virus
SIPYIGCPS

SEQ ID NO: 14263 - protein, 9 aa, BK virus
IPYIGCPST

SEQ ID NO: 14264 - protein, 9 aa, BK virus
PYIGCPSTL

SEQ ID NO: 14265 - protein, 9 aa, BK virus
YIGCPSTLW

SEQ ID NO: 14266 - protein, 9 aa, BK virus
IGCPSTLWV

SEQ ID NO: 14267 - protein, 9 aa, BK virus
GCPSTLWVL

SEQ ID NO: 14268 - protein, 9 aa, BK virus
CPSTLWVLL

SEQ ID NO: 14269 - protein, 9 aa, BK virus
PSTLWVLLF

SEQ ID NO: 14270 - protein, 9 aa, BK virus
STLWVLLFI

SEQ ID NO: 14271 - protein, 9 aa, BK virus
TLWVLLFIR

SEQ ID NO: 14272 - protein, 9 aa, BK virus
LWVLLFIRS

SEQ ID NO: 14273 - protein, 9 aa, BK virus
WVLLFIRSL

SEQ ID NO: 14274 - protein, 9 aa, BK virus
VLLFIRSLS

SEQ ID NO: 14275 - protein, 9 aa, BK virus
LLFIRSLSK

SEQ ID NO: 14276 - protein, 9 aa, BK virus
LFIRSLSKK

SEQ ID NO: 14277 - protein, 9 aa, BK virus
FIRSLSKKE

SEQ ID NO: 14278 - protein, 9 aa, BK virus
IRSLSKKEI

SEQ ID NO: 14279 - protein, 9 aa, BK virus
RSLSKKEIG

SEQ ID NO: 14280 - protein, 9 aa, BK virus
GFFTDLFLR

SEQ ID NO: 14281 - protein, 9 aa, BK virus
FFTDLFLRR

SEQ ID NO: 14282 - protein, 9 aa, BK virus
FTDLFLRRI

SEQ ID NO: 14283 - protein, 9 aa, BK virus
TDLFLRRIL

SEQ ID NO: 14284 - protein, 9 aa, BK virus
DLFLRRILK

SEQ ID NO: 14285 - protein, 9 aa, BK virus
LFLRRILKY

SEQ ID NO: 14286 - protein, 9 aa, BK virus
FLRRILKYL

SEQ ID NO: 14287 - protein, 9 aa, BK virus
LRRILKYLA

SEQ ID NO: 14288 - protein, 9 aa, BK virus
RRILKYLAR

SEQ ID NO: 14289 - protein, 9 aa, BK virus
RILKYLARP

SEQ ID NO: 14290 - protein, 9 aa, BK virus
ILKYLARPL

SEQ ID NO: 14291 - protein, 9 aa, BK virus
LKYLARPLH

SEQ ID NO: 14292 - protein, 9 aa, BK virus
KYLARPLHC

SEQ ID NO: 14293 - protein, 9 aa, BK virus
YLARPLHCC

SEQ ID NO: 14294 - protein, 9 aa, BK virus
LARPLHCCV

SEQ ID NO: 14295 - protein, 9 aa, BK virus
ARPLHCCVP

SEQ ID NO: 14296 - protein, 9 aa, BK virus
RPLHCCVPE

SEQ ID NO: 14297 - protein, 9 aa, BK virus
PLHCCVPEL

SEQ ID NO: 14298 - protein, 9 aa, BK virus
LHCCVPELL

SEQ ID NO: 14299 - protein, 9 aa, BK virus
HCCVPELLV

SEQ ID NO: 14300 - protein, 9 aa, BK virus
CCVPELLVN

SEQ ID NO: 14301 - protein, 9 aa, BK virus
CVPELLVNR

SEQ ID NO: 14302 - protein, 9 aa, BK virus
VPELLVNRP

SEQ ID NO: 14303 - protein, 9 aa, BK virus
PELLVNRPQ

SEQ ID NO: 14304 - protein, 9 aa, BK virus
ELLVNRPQI

SEQ ID NO: 14305 - protein, 9 aa, BK virus
LLVNRPQIS

SEQ ID NO: 14306 - protein, 9 aa, BK virus
LVNRPQISA

SEQ ID NO: 14307 - protein, 9 aa, BK virus
VNRPQISAA

SEQ ID NO: 14308 - protein, 9 aa, BK virus
NRPQISAAE

SEQ ID NO: 14309 - protein, 9 aa, BK virus
RPQISAAET

SEQ ID NO: 14310 - protein, 9 aa, BK virus
PQISAAETY

SEQ ID NO: 14311 - protein, 9 aa, BK virus
QISAAETYR

SEQ ID NO: 14312 - protein, 9 aa, BK virus
ISAAETYRL

SEQ ID NO: 14313 - protein, 9 aa, BK virus
SAAETYRLS

SEQ ID NO: 14314 - protein, 9 aa, BK virus
AAETYRLSA

SEQ ID NO: 14315 - protein, 9 aa, BK virus
AETYRLSAL

SEQ ID NO: 14316 - protein, 9 aa, BK virus
ETYRLSALQ

SEQ ID NO: 14317 - protein, 9 aa, BK virus
TYRLSALQR

SEQ ID NO: 14318 - protein, 9 aa, BK virus
YRLSALQRG

SEQ ID NO: 14319 - protein, 9 aa, BK virus
RLSALQRGP

SEQ ID NO: 14320 - protein, 9 aa, BK virus
LSALQRGPT

SEQ ID NO: 14321 - protein, 9 aa, BK virus
SALQRGPTP

SEQ ID NO: 14322 - protein, 9 aa, BK virus
ALQRGPTPC

SEQ ID NO: 14323 - protein, 9 aa, BK virus
LQRGPTPCS

SEQ ID NO: 14324 - protein, 9 aa, BK virus
QRGPTPCSS

SEQ ID NO: 14325 - protein, 9 aa, BK virus
RGPTPCSSS

SEQ ID NO: 14326 - protein, 9 aa, BK virus
GPTPCSSSN

SEQ ID NO: 14327 - protein, 9 aa, BK virus
PTPCSSSNT

SEQ ID NO: 14328 - protein, 9 aa, BK virus
TPCSSSNTV

SEQ ID NO: 14329 - protein, 9 aa, BK virus
PCSSSNTVV

SEQ ID NO: 14330 - protein, 9 aa, BK virus
CSSSNTVVA

SEQ ID NO: 14331 - protein, 9 aa, BK virus
SSSNTVVAV

SEQ ID NO: 14332 - protein, 9 aa, BK virus
SSNTVVAVL

SEQ ID NO: 14333 - protein, 9 aa, BK virus
SNTVVAVLV

SEQ ID NO: 14334 - protein, 9 aa, BK virus
NTVVAVLVT

SEQ ID NO: 14335 - protein, 9 aa, BK virus
STGGTFSPP

SEQ ID NO: 14336 - protein, 9 aa, BK virus
TGGTFSPPV

SEQ ID NO: 14337 - protein, 9 aa, BK virus
GGTFSPPVK

SEQ ID NO: 14338 - protein, 9 aa, BK virus
GTFSPPVKV

SEQ ID NO: 14339 - protein, 9 aa, BK virus
TFSPPVKVP

SEQ ID NO: 14340 - protein, 9 aa, BK virus
FSPPVKVPK

SEQ ID NO: 14341 - protein, 9 aa, BK virus
SPPVKVPKY

SEQ ID NO: 14342 - protein, 9 aa, BK virus
PPVKVPKYL

SEQ ID NO: 14343 - protein, 9 aa, BK virus
PVKVPKYLA

SEQ ID NO: 14344 - protein, 9 aa, BK virus
VKVPKYLAF

SEQ ID NO: 14345 - protein, 9 aa, BK virus
KVPKYLAFS

SEQ ID NO: 14346 - protein, 9 aa, BK virus
VPKYLAFSF

SEQ ID NO: 14347 - protein, 9 aa, BK virus
PKYLAFSFL

SEQ ID NO: 14348 - protein, 9 aa, BK virus
KYLAFSFLL

SEQ ID NO: 14349 - protein, 9 aa, BK virus
YLAFSFLLG

SEQ ID NO: 14350 - protein, 9 aa, BK virus
LAFSFLLGS

SEQ ID NO: 14351 - protein, 9 aa, BK virus
AFSFLLGSG

SEQ ID NO: 14352 - protein, 9 aa, BK virus
FSFLLGSGT

SEQ ID NO: 14353 - protein, 9 aa, BK virus
SFLLGSGTQ

SEQ ID NO: 14354 - protein, 9 aa, BK virus
FLLGSGTQH

SEQ ID NO: 14355 - protein, 9 aa, BK virus
LLGSGTQHS

SEQ ID NO: 14356 - protein, 9 aa, BK virus
LGSGTQHST

SEQ ID NO: 14357 - protein, 9 aa, BK virus
GSGTQHSTG

SEQ ID NO: 14358 - protein, 9 aa, BK virus
ALWSVFITW

SEQ ID NO: 14359 - protein, 9 aa, BK virus
LWSVFITWD

SEQ ID NO: 14360 - protein, 9 aa, BK virus
WSVFITWDW

SEQ ID NO: 14361 - protein, 9 aa, BK virus
SVFITWDWA

SEQ ID NO: 14362 - protein, 9 aa, BK virus
VFITWDWAV

SEQ ID NO: 14363 - protein, 9 aa, BK virus
FITWDWAVG

SEQ ID NO: 14364 - protein, 9 aa, BK virus
ITWDWAVGF

SEQ ID NO: 14365 - protein, 9 aa, BK virus
TWDWAVGFL

SEQ ID NO: 14366 - protein, 9 aa, BK virus
WDWAVGFLG

SEQ ID NO: 14367 - protein, 9 aa, BK virus
DWAVGFLGV

SEQ ID NO: 14368 - protein, 9 aa, BK virus
WAVGFLGVI

SEQ ID NO: 14369 - protein, 9 aa, BK virus
AVGFLGVIV

SEQ ID NO: 14370 - protein, 9 aa, BK virus
VGFLGVIVP

SEQ ID NO: 14371 - protein, 9 aa, BK virus
GFLGVIVPS

SEQ ID NO: 14372 - protein, 9 aa, BK virus
FLGVIVPSG

SEQ ID NO: 14373 - protein, 9 aa, BK virus
LGVIVPSGY

SEQ ID NO: 14374 - protein, 9 aa, BK virus
GVIVPSGYF

SEQ ID NO: 14375 - protein, 9 aa, BK virus
VIVPSGYFD

SEQ ID NO: 14376 - protein, 9 aa, BK virus
IVPSGYFDL

SEQ ID NO: 14377 - protein, 9 aa, BK virus
FISTPCISK

SEQ ID NO: 14378 - protein, 9 aa, BK virus
ISTPCISKG

SEQ ID NO: 14379 - protein, 9 aa, BK virus
STPCISKGS

SEQ ID NO: 14380 - protein, 9 aa, BK virus
TPCISKGSP

SEQ ID NO: 14381 - protein, 9 aa, BK virus
PCISKGSPP

SEQ ID NO: 14382 - protein, 9 aa, BK virus
CISKGSPPT

SEQ ID NO: 14383 - protein, 9 aa, BK virus
ISKGSPPTA

SEQ ID NO: 14384 - protein, 9 aa, BK virus
SKGSPPTAK

SEQ ID NO: 14385 - protein, 9 aa, BK virus
KGSPPTAKK

SEQ ID NO: 14386 - protein, 9 aa, BK virus
GSPPTAKKW

SEQ ID NO: 14387 - protein, 9 aa, BK virus
SPPTAKKWK

SEQ ID NO: 14388 - protein, 9 aa, BK virus
PPTAKKWKL

SEQ ID NO: 14389 - protein, 9 aa, BK virus
PTAKKWKLL

SEQ ID NO: 14390 - protein, 9 aa, BK virus
TAKKWKLLP

SEQ ID NO: 14391 - protein, 9 aa, BK virus
IGFPPPCSC

SEQ ID NO: 14392 - protein, 9 aa, BK virus
GFPPPCSCT

SEQ ID NO: 14393 - protein, 9 aa, BK virus
FPPPCSCTF

SEQ ID NO: 14394 - protein, 9 aa, BK virus
PPPCSCTFC

SEQ ID NO: 14395 - protein, 9 aa, BK virus
PPCSCTFCD

SEQ ID NO: 14396 - protein, 9 aa, BK virus
PCSCTFCDP

SEQ ID NO: 14397 - protein, 9 aa, BK virus
CSCTFCDPA

SEQ ID NO: 14398 - protein, 9 aa, BK virus
RLSMLVIPI

SEQ ID NO: 14399 - protein, 9 aa, BK virus
LSMLVIPIT

SEQ ID NO: 14400 - protein, 9 aa, BK virus
SMLVIPITS

SEQ ID NO: 14401 - protein, 9 aa, BK virus
MLVIPITSV

SEQ ID NO: 14402 - protein, 9 aa, BK virus
LVIPITSVC

SEQ ID NO: 14403 - protein, 9 aa, BK virus
VIPITSVCT

SEQ ID NO: 14404 - protein, 9 aa, BK virus
IPITSVCTV

SEQ ID NO: 14405 - protein, 9 aa, BK virus
PITSVCTVT

SEQ ID NO: 14406 - protein, 9 aa, BK virus
ITSVCTVTA

SEQ ID NO: 14407 - protein, 9 aa, BK virus
TSVCTVTAS

SEQ ID NO: 14408 - protein, 9 aa, BK virus
SVCTVTASH

SEQ ID NO: 14409 - protein, 9 aa, BK virus
VCTVTASHI

SEQ ID NO: 14410 - protein, 9 aa, BK virus
CTVTASHIS

SEQ ID NO: 14411 - protein, 9 aa, BK virus
TVTASHISR

SEQ ID NO: 14412 - protein, 9 aa, BK virus
VTASHISRF

SEQ ID NO: 14413 - protein, 9 aa, BK virus
TASHISRFP

SEQ ID NO: 14414 - protein, 9 aa, BK virus
ASHISRFPQ

SEQ ID NO: 14415 - protein, 9 aa, BK virus
SHISRFPQV

SEQ ID NO: 14416 - protein, 9 aa, BK virus
HISRFPQVR

SEQ ID NO: 14417 - protein, 9 aa, BK virus
ISRFPQVRS

SEQ ID NO: 14418 - protein, 9 aa, BK virus
SRFPQVRSS

SEQ ID NO: 14419 - protein, 9 aa, BK virus
RFPQVRSSF

SEQ ID NO: 14420 - protein, 9 aa, BK virus
FPQVRSSFK

SEQ ID NO: 14421 - protein, 9 aa, BK virus
PQVRSSFKL

SEQ ID NO: 14422 - protein, 9 aa, BK virus
QVRSSFKLG

SEQ ID NO: 14423 - protein, 9 aa, BK virus
VRSSFKLGR

SEQ ID NO: 14424 - protein, 9 aa, BK virus
RSSFKLGRG

SEQ ID NO: 14425 - protein, 9 aa, BK virus
SSFKLGRGI

SEQ ID NO: 14426 - protein, 9 aa, BK virus
SFKLGRGIL

SEQ ID NO: 14427 - protein, 9 aa, BK virus
FKLGRGILA

SEQ ID NO: 14428 - protein, 9 aa, BK virus
KLGRGILAV

SEQ ID NO: 14429 - protein, 9 aa, BK virus
LGRGILAVL

SEQ ID NO: 14430 - protein, 9 aa, BK virus
QGSIFLSGL

SEQ ID NO: 14431 - protein, 9 aa, BK virus
GSIFLSGLS

SEQ ID NO: 14432 - protein, 9 aa, BK virus
SIFLSGLSL

SEQ ID NO: 14433 - protein, 9 aa, BK virus
IFLSGLSLL

SEQ ID NO: 14434 - protein, 9 aa, BK virus
FLSGLSLLK

SEQ ID NO: 14435 - protein, 9 aa, BK virus
LSGLSLLKS

SEQ ID NO: 14436 - protein, 9 aa, BK virus
SGLSLLKSF

SEQ ID NO: 14437 - protein, 9 aa, BK virus
GLSLLKSFS

SEQ ID NO: 14438 - protein, 9 aa, BK virus
LSLLKSFSA

SEQ ID NO: 14439 - protein, 9 aa, BK virus
SLLKSFSAL

SEQ ID NO: 14440 - protein, 9 aa, BK virus
LLKSFSALS

SEQ ID NO: 14441 - protein, 9 aa, BK virus
LKSFSALSF

SEQ ID NO: 14442 - protein, 9 aa, BK virus
KSFSALSFR

SEQ ID NO: 14443 - protein, 9 aa, BK virus
SFSALSFRL

SEQ ID NO: 14444 - protein, 9 aa, BK virus
FSALSFRLK

SEQ ID NO: 14445 - protein, 9 aa, BK virus
SALSFRLKP

SEQ ID NO: 14446 - protein, 9 aa, BK virus
ALSFRLKPL

SEQ ID NO: 14447 - protein, 9 aa, BK virus
LSFRLKPLR

SEQ ID NO: 14448 - protein, 9 aa, BK virus
SFRLKPLRF

SEQ ID NO: 14449 - protein, 9 aa, BK virus
FRLKPLRFS

SEQ ID NO: 14450 - protein, 9 aa, BK virus
RLKPLRFSS

SEQ ID NO: 14451 - protein, 9 aa, BK virus
LKPLRFSSG

SEQ ID NO: 14452 - protein, 9 aa, BK virus
KPLRFSSGS

SEQ ID NO: 14453 - protein, 9 aa, BK virus
PLRFSSGSP

SEQ ID NO: 14454 - protein, 9 aa, BK virus
LRFSSGSPI

SEQ ID NO: 14455 - protein, 9 aa, BK virus
RFSSGSPIS

SEQ ID NO: 14456 - protein, 9 aa, BK virus
FSSGSPISG

SEQ ID NO: 14457 - protein, 9 aa, BK virus
SSGSPISGF

SEQ ID NO: 14458 - protein, 9 aa, BK virus
SGSPISGFR

SEQ ID NO: 14459 - protein, 9 aa, BK virus
GSPISGFRK

SEQ ID NO: 14460 - protein, 9 aa, BK virus
SPISGFRKH

SEQ ID NO: 14461 - protein, 9 aa, BK virus
PISGFRKHS

SEQ ID NO: 14462 - protein, 9 aa, BK virus
ISGFRKHST

SEQ ID NO: 14463 - protein, 9 aa, BK virus
SGFRKHSTS

SEQ ID NO: 14464 - protein, 9 aa, BK virus
GFRKHSTSV

SEQ ID NO: 14465 - protein, 9 aa, BK virus
FRKHSTSVI

SEQ ID NO: 14466 - protein, 9 aa, BK virus
RKHSTSVIA

SEQ ID NO: 14467 - protein, 9 aa, BK virus
KHSTSVIAS

SEQ ID NO: 14468 - protein, 9 aa, BK virus
HSTSVIAST

SEQ ID NO: 14469 - protein, 9 aa, BK virus
STSVIASTP

SEQ ID NO: 14470 - protein, 9 aa, BK virus
TSVIASTPV

SEQ ID NO: 14471 - protein, 9 aa, BK virus
SVIASTPVL

SEQ ID NO: 14472 - protein, 9 aa, BK virus
VIASTPVLT

SEQ ID NO: 14473 - protein, 9 aa, BK virus
IASTPVLTS

SEQ ID NO: 14474 - protein, 9 aa, BK virus
ASTPVLTSR

SEQ ID NO: 14475 - protein, 9 aa, BK virus
STPVLTSRT

SEQ ID NO: 14476 - protein, 9 aa, BK virus
TPVLTSRTS

SEQ ID NO: 14477 - protein, 9 aa, BK virus
PVLTSRTST

SEQ ID NO: 14478 - protein, 9 aa, BK virus
VLTSRTSTP

SEQ ID NO: 14479 - protein, 9 aa, BK virus
LTSRTSTPP

SEQ ID NO: 14480 - protein, 9 aa, BK virus
TSRTSTPPF

SEQ ID NO: 14481 - protein, 9 aa, BK virus
SRTSTPPFI

SEQ ID NO: 14482 - protein, 9 aa, BK virus
RTSTPPFIS

SEQ ID NO: 14483 - protein, 9 aa, BK virus
TSTPPFISS

SEQ ID NO: 14484 - protein, 9 aa, BK virus
STPPFISSF

SEQ ID NO: 14485 - protein, 9 aa, BK virus
TPPFISSFG

SEQ ID NO: 14486 - protein, 9 aa, BK virus
PPFISSFGT

SEQ ID NO: 14487 - protein, 9 aa, BK virus
PFISSFGTC

SEQ ID NO: 14488 - protein, 9 aa, BK virus
FISSFGTCT

SEQ ID NO: 14489 - protein, 9 aa, BK virus
ISSFGTCTG

SEQ ID NO: 14490 - protein, 9 aa, BK virus
SSFGTCTGS

SEQ ID NO: 14491 - protein, 9 aa, BK virus
SFGTCTGSF

SEQ ID NO: 14492 - protein, 9 aa, BK virus
FGTCTGSFG

SEQ ID NO: 14493 - protein, 9 aa, BK virus
GTCTGSFGF

SEQ ID NO: 14494 - protein, 9 aa, BK virus
TCTGSFGFL

SEQ ID NO: 14495 - protein, 9 aa, BK virus
CTGSFGFLG

SEQ ID NO: 14496 - protein, 9 aa, BK virus
TGSFGFLGA

SEQ ID NO: 14497 - protein, 9 aa, BK virus
GSFGFLGAA

SEQ ID NO: 14498 - protein, 9 aa, BK virus
SFGFLGAAP

SEQ ID NO: 14499 - protein, 9 aa, BK virus
FGFLGAAPG

SEQ ID NO: 14500 - protein, 9 aa, BK virus
GFLGAAPGH

SEQ ID NO: 14501 - protein, 9 aa, BK virus
FLGAAPGHS

SEQ ID NO: 14502 - protein, 9 aa, BK virus
LGAAPGHSP

SEQ ID NO: 14503 - protein, 9 aa, BK virus
GAAPGHSPF

SEQ ID NO: 14504 - protein, 9 aa, BK virus
AAPGHSPFL

SEQ ID NO: 14505 - protein, 9 aa, BK virus
APGHSPFLL

SEQ ID NO: 14506 - protein, 9 aa, BK virus
PGHSPFLLV

SEQ ID NO: 14507 - protein, 9 aa, BK virus
GHSPFLLVG

SEQ ID NO: 14508 - protein, 9 aa, BK virus
HSPFLLVGA

SEQ ID NO: 14509 - protein, 9 aa, BK virus
SPFLLVGAI

SEQ ID NO: 14510 - protein, 9 aa, BK virus
PFLLVGAIF

SEQ ID NO: 14511 - protein, 9 aa, BK virus
FLLVGAIFI

SEQ ID NO: 14512 - protein, 9 aa, BK virus
LLVGAIFIC

SEQ ID NO: 14513 - protein, 9 aa, BK virus
LVGAIFICF

SEQ ID NO: 14514 - protein, 9 aa, BK virus
VGAIFICFK

SEQ ID NO: 14515 - protein, 9 aa, BK virus
GAIFICFKS

SEQ ID NO: 14516 - protein, 9 aa, BK virus
AIFICFKSR

SEQ ID NO: 14517 - protein, 9 aa, BK virus
IFICFKSRC

SEQ ID NO: 14518 - protein, 9 aa, BK virus
FICFKSRCY

SEQ ID NO: 14519 - protein, 9 aa, BK virus
ICFKSRCYS

SEQ ID NO: 14520 - protein, 9 aa, BK virus
CFKSRCYSP

SEQ ID NO: 14521 - protein, 9 aa, BK virus
FKSRCYSPV

SEQ ID NO: 14522 - protein, 9 aa, BK virus
KSRCYSPVQ

SEQ ID NO: 14523 - protein, 9 aa, BK virus
SRCYSPVQA

SEQ ID NO: 14524 - protein, 9 aa, BK virus
RQHPLRSSS

SEQ ID NO: 14525 - protein, 9 aa, BK virus
QHPLRSSSL

SEQ ID NO: 14526 - protein, 9 aa, BK virus
HPLRSSSLI

SEQ ID NO: 14527 - protein, 9 aa, BK virus
PLRSSSLIS

SEQ ID NO: 14528 - protein, 9 aa, BK virus
LRSSSLIST

SEQ ID NO: 14529 - protein, 9 aa, BK virus
RSSSLISTS

SEQ ID NO: 14530 - protein, 9 aa, BK virus
SSSLISTSW

SEQ ID NO: 14531 - protein, 9 aa, BK virus
SSLISTSWG

SEQ ID NO: 14532 - protein, 9 aa, BK virus
SLISTSWGN

SEQ ID NO: 14533 - protein, 9 aa, BK virus
LISTSWGNS

SEQ ID NO: 14534 - protein, 9 aa, BK virus
ISTSWGNSF

SEQ ID NO: 14535 - protein, 9 aa, BK virus
STSWGNSFF

SEQ ID NO: 14536 - protein, 9 aa, BK virus
TSWGNSFFY

SEQ ID NO: 14537 - protein, 9 aa, BK virus
SWGNSFFYK

SEQ ID NO: 14538 - protein, 9 aa, BK virus
WGNSFFYKL

SEQ ID NO: 14539 - protein, 9 aa, BK virus
GNSFFYKLS

SEQ ID NO: 14540 - protein, 9 aa, BK virus
VHSLCNFFY

SEQ ID NO: 14541 - protein, 9 aa, BK virus
HSLCNFFYT

SEQ ID NO: 14542 - protein, 9 aa, BK virus
SLCNFFYTV

SEQ ID NO: 14543 - protein, 9 aa, BK virus
LCNFFYTVS

SEQ ID NO: 14544 - protein, 9 aa, BK virus
CNFFYTVSI

SEQ ID NO: 14545 - protein, 9 aa, BK virus
NFFYTVSII

SEQ ID NO: 14546 - protein, 9 aa, BK virus
FFYTVSIIY

SEQ ID NO: 14547 - protein, 9 aa, BK virus
FYTVSIIYT

SEQ ID NO: 14548 - protein, 9 aa, BK virus
YTVSIIYTI

SEQ ID NO: 14549 - protein, 9 aa, BK virus
TVSIIYTIS

SEQ ID NO: 14550 - protein, 9 aa, BK virus
VSIIYTISM

SEQ ID NO: 14551 - protein, 9 aa, BK virus
SIIYTISMA

SEQ ID NO: 14552 - protein, 9 aa, BK virus
IIYTISMAK

SEQ ID NO: 14553 - protein, 9 aa, BK virus
IYTISMAKM

SEQ ID NO: 14554 - protein, 9 aa, BK virus
YTISMAKMY

SEQ ID NO: 14555 - protein, 9 aa, BK virus
TISMAKMYT

SEQ ID NO: 14556 - protein, 9 aa, BK virus
ISMAKMYTG

SEQ ID NO: 14557 - protein, 9 aa, BK virus
SMAKMYTGT

SEQ ID NO: 14558 - protein, 9 aa, BK virus
MAKMYTGTF

SEQ ID NO: 14559 - protein, 9 aa, BK virus
AKMYTGTFP

SEQ ID NO: 14560 - protein, 9 aa, BK virus
KMYTGTFPF

SEQ ID NO: 14561 - protein, 9 aa, BK virus
MYTGTFPFS

SEQ ID NO: 14562 - protein, 9 aa, BK virus
YTGTFPFSY

SEQ ID NO: 14563 - protein, 9 aa, BK virus
TGTFPFSYL

SEQ ID NO: 14564 - protein, 9 aa, BK virus
GTFPFSYLS

SEQ ID NO: 14565 - protein, 9 aa, BK virus
TFPFSYLSN

SEQ ID NO: 14566 - protein, 9 aa, BK virus
FPFSYLSNH

SEQ ID NO: 14567 - protein, 9 aa, BK virus
GPNRGKIRI

SEQ ID NO: 14568 - protein, 9 aa, BK virus
PNRGKIRII

SEQ ID NO: 14569 - protein, 9 aa, BK virus
NRGKIRIIL

SEQ ID NO: 14570 - protein, 9 aa, BK virus
RGKIRIILL

SEQ ID NO: 14571 - protein, 9 aa, BK virus
GKIRIILLN

SEQ ID NO: 14572 - protein, 9 aa, BK virus
KIRIILLNI

SEQ ID NO: 14573 - protein, 9 aa, BK virus
IRIILLNII

SEQ ID NO: 14574 - protein, 9 aa, BK virus
RIILLNIII

SEQ ID NO: 14575 - protein, 9 aa, BK virus
IILLNIIIK

SEQ ID NO: 14576 - protein, 9 aa, BK virus
ILLNIIIKV

SEQ ID NO: 14577 - protein, 9 aa, BK virus
LLNIIIKVY

SEQ ID NO: 14578 - protein, 9 aa, BK virus
LNIIIKVYR

SEQ ID NO: 14579 - protein, 9 aa, BK virus
NIIIKVYRG

SEQ ID NO: 14580 - protein, 9 aa, BK virus
IIIKVYRGI

SEQ ID NO: 14581 - protein, 9 aa, BK virus
IIKVYRGIY

SEQ ID NO: 14582 - protein, 9 aa, BK virus
IKVYRGIYN

SEQ ID NO: 14583 - protein, 9 aa, BK virus
KVYRGIYNC

SEQ ID NO: 14584 - protein, 9 aa, BK virus
VYRGIYNCP

SEQ ID NO: 14585 - protein, 9 aa, BK virus
YRGIYNCPG

SEQ ID NO: 14586 - protein, 9 aa, BK virus
RGIYNCPGS

SEQ ID NO: 14587 - protein, 9 aa, BK virus
GIYNCPGSF

SEQ ID NO: 14588 - protein, 9 aa, BK virus
IYNCPGSFL

SEQ ID NO: 14589 - protein, 9 aa, BK virus
YNCPGSFLQ

SEQ ID NO: 14590 - protein, 9 aa, BK virus
NCPGSFLQK

SEQ ID NO: 14591 - protein, 9 aa, BK virus
CPGSFLQKS

SEQ ID NO: 14592 - protein, 9 aa, BK virus
PGSFLQKSS

SEQ ID NO: 14593 - protein, 9 aa, BK virus
GSFLQKSSQ

SEQ ID NO: 14594 - protein, 9 aa, BK virus
SFLQKSSQG

SEQ ID NO: 14595 - protein, 9 aa, BK virus
FLQKSSQGV

SEQ ID NO: 14596 - protein, 9 aa, BK virus
LQKSSQGVS

SEQ ID NO: 14597 - protein, 9 aa, BK virus
QKSSQGVSK

SEQ ID NO: 14598 - protein, 9 aa, BK virus
KSSQGVSKK

SEQ ID NO: 14599 - protein, 9 aa, BK virus
SSQGVSKKS

SEQ ID NO: 14600 - protein, 9 aa, BK virus
SQGVSKKSF

SEQ ID NO: 14601 - protein, 9 aa, BK virus
QGVSKKSFC

SEQ ID NO: 14602 - protein, 9 aa, BK virus
GVSKKSFCS

SEQ ID NO: 14603 - protein, 9 aa, BK virus
VSKKSFCSS

SEQ ID NO: 14604 - protein, 9 aa, BK virus
SKKSFCSSL

SEQ ID NO: 14605 - protein, 9 aa, BK virus
KKSFCSSLQ

SEQ ID NO: 14606 - protein, 9 aa, BK virus
KSFCSSLQF

SEQ ID NO: 14607 - protein, 9 aa, BK virus
SFCSSLQFL

SEQ ID NO: 14608 - protein, 9 aa, BK virus
GYRRYIIPN

SEQ ID NO: 14609 - protein, 9 aa, BK virus
YRRYIIPNN

SEQ ID NO: 14610 - protein, 9 aa, BK virus
RRYIIPNNM

SEQ ID NO: 14611 - protein, 9 aa, BK virus
RYIIPNNMP

SEQ ID NO: 14612 - protein, 9 aa, BK virus
YIIPNNMPQ

SEQ ID NO: 14613 - protein, 9 aa, BK virus
IIPNNMPQS

SEQ ID NO: 14614 - protein, 9 aa, BK virus
IPNNMPQSL

SEQ ID NO: 14615 - protein, 9 aa, BK virus
PNNMPQSLG

SEQ ID NO: 14616 - protein, 9 aa, BK virus
NNMPQSLGN

SEQ ID NO: 14617 - protein, 9 aa, BK virus
NMPQSLGNS

SEQ ID NO: 14618 - protein, 9 aa, BK virus
MPQSLGNSS

SEQ ID NO: 14619 - protein, 9 aa, BK virus
PQSLGNSSK

SEQ ID NO: 14620 - protein, 9 aa, BK virus
QSLGNSSKQ

SEQ ID NO: 14621 - protein, 9 aa, BK virus
SLGNSSKQR

SEQ ID NO: 14622 - protein, 9 aa, BK virus
LGNSSKQRR

SEQ ID NO: 14623 - protein, 9 aa, BK virus
GNSSKQRRT

SEQ ID NO: 14624 - protein, 9 aa, BK virus
NSSKQRRTP

SEQ ID NO: 14625 - protein, 9 aa, BK virus
SSKQRRTPM

SEQ ID NO: 14626 - protein, 9 aa, BK virus
SKQRRTPMP

SEQ ID NO: 14627 - protein, 9 aa, BK virus
KQRRTPMPR

SEQ ID NO: 14628 - protein, 9 aa, BK virus
QRRTPMPRI

SEQ ID NO: 14629 - protein, 9 aa, BK virus
RRTPMPRIK

SEQ ID NO: 14630 - protein, 9 aa, BK virus
RTPMPRIKV

SEQ ID NO: 14631 - protein, 9 aa, BK virus
TPMPRIKVL

SEQ ID NO: 14632 - protein, 9 aa, BK virus
PMPRIKVLN

SEQ ID NO: 14633 - protein, 9 aa, BK virus
MPRIKVLNI

SEQ ID NO: 14634 - protein, 9 aa, BK virus
PRIKVLNII

SEQ ID NO: 14635 - protein, 9 aa, BK virus
RIKVLNIIN

SEQ ID NO: 14636 - protein, 9 aa, BK virus
IKVLNIINK

SEQ ID NO: 14637 - protein, 9 aa, BK virus
KVLNIINKS

SEQ ID NO: 14638 - protein, 9 aa, BK virus
VLNIINKSI

SEQ ID NO: 14639 - protein, 9 aa, BK virus
LNIINKSIY

SEQ ID NO: 14640 - protein, 9 aa, BK virus
NIINKSIYT

SEQ ID NO: 14641 - protein, 9 aa, BK virus
IINKSIYTR

SEQ ID NO: 14642 - protein, 9 aa, BK virus
INKSIYTRK

SEQ ID NO: 14643 - protein, 9 aa, BK virus
NKSIYTRKQ

SEQ ID NO: 14644 - protein, 9 aa, BK virus
KSIYTRKQN

SEQ ID NO: 14645 - protein, 9 aa, BK virus
SIYTRKQNI

SEQ ID NO: 14646 - protein, 9 aa, BK virus
IYTRKQNII

SEQ ID NO: 14647 - protein, 9 aa, BK virus
YTRKQNIIV

SEQ ID NO: 14648 - protein, 9 aa, BK virus
TRKQNIIVL

SEQ ID NO: 14649 - protein, 9 aa, BK virus
RKQNIIVLI

SEQ ID NO: 14650 - protein, 9 aa, BK virus
KQNIIVLIW

SEQ ID NO: 14651 - protein, 9 aa, BK virus
QNIIVLIWV

SEQ ID NO: 14652 - protein, 9 aa, BK virus
NIIVLIWVK

SEQ ID NO: 14653 - protein, 9 aa, BK virus
IIVLIWVKQ

SEQ ID NO: 14654 - protein, 9 aa, BK virus
IVLIWVKQF

SEQ ID NO: 14655 - protein, 9 aa, BK virus
VLIWVKQFQ

SEQ ID NO: 14656 - protein, 9 aa, BK virus
LIWVKQFQS

SEQ ID NO: 14657 - protein, 9 aa, BK virus
IWVKQFQSH

SEQ ID NO: 14658 - protein, 9 aa, BK virus
WVKQFQSHA

SEQ ID NO: 14659 - protein, 9 aa, BK virus
LLIEAYSGN

SEQ ID NO: 14660 - protein, 9 aa, BK virus
LIEAYSGNF

SEQ ID NO: 14661 - protein, 9 aa, BK virus
IEAYSGNFV

SEQ ID NO: 14662 - protein, 9 aa, BK virus
EAYSGNFVI

SEQ ID NO: 14663 - protein, 9 aa, BK virus
AYSGNFVIP

SEQ ID NO: 14664 - protein, 9 aa, BK virus
YSGNFVIPI

SEQ ID NO: 14665 - protein, 9 aa, BK virus
SGNFVIPII

SEQ ID NO: 14666 - protein, 9 aa, BK virus
GNFVIPIIK

SEQ ID NO: 14667 - protein, 9 aa, BK virus
NFVIPIIKE

SEQ ID NO: 14668 - protein, 9 aa, BK virus
FVIPIIKEL

SEQ ID NO: 14669 - protein, 9 aa, BK virus
VIPIIKELI

SEQ ID NO: 14670 - protein, 9 aa, BK virus
IPIIKELIP

SEQ ID NO: 14671 - protein, 9 aa, BK virus
PIIKELIPY

SEQ ID NO: 14672 - protein, 9 aa, BK virus
IIKELIPYL

SEQ ID NO: 14673 - protein, 9 aa, BK virus
IKELIPYLS

SEQ ID NO: 14674 - protein, 9 aa, BK virus
GTNTTNSLN

SEQ ID NO: 14675 - protein, 9 aa, BK virus
SSKPSNSPR

SEQ ID NO: 14676 - protein, 9 aa, BK virus
SKPSNSPRS

SEQ ID NO: 14677 - protein, 9 aa, BK virus
KPSNSPRST

SEQ ID NO: 14678 - protein, 9 aa, BK virus
PSNSPRSTS

SEQ ID NO: 14679 - protein, 9 aa, BK virus
SNSPRSTSN

SEQ ID NO: 14680 - protein, 9 aa, BK virus
NSPRSTSNY

SEQ ID NO: 14681 - protein, 9 aa, BK virus
SPRSTSNYS

SEQ ID NO: 14682 - protein, 9 aa, BK virus
PRSTSNYSI

SEQ ID NO: 14683 - protein, 9 aa, BK virus
RSTSNYSIC

SEQ ID NO: 14684 - protein, 9 aa, BK virus
STSNYSICL

SEQ ID NO: 14685 - protein, 9 aa, BK virus
TSNYSICLR

SEQ ID NO: 14686 - protein, 9 aa, BK virus
SNYSICLRS

SEQ ID NO: 14687 - protein, 9 aa, BK virus
GTCYALYSS

SEQ ID NO: 14688 - protein, 9 aa, BK virus
TCYALYSSK

SEQ ID NO: 14689 - protein, 9 aa, BK virus
CYALYSSKG

SEQ ID NO: 14690 - protein, 9 aa, BK virus
YALYSSKGC

SEQ ID NO: 14691 - protein, 9 aa, BK virus
ALYSSKGCN

SEQ ID NO: 14692 - protein, 9 aa, BK virus
LYSSKGCNL

SEQ ID NO: 14693 - protein, 9 aa, BK virus
YSSKGCNLN

SEQ ID NO: 14694 - protein, 9 aa, BK virus
SSKGCNLNF

SEQ ID NO: 14695 - protein, 9 aa, BK virus
SKGCNLNFY

SEQ ID NO: 14696 - protein, 9 aa, BK virus
KGCNLNFYS

SEQ ID NO: 14697 - protein, 9 aa, BK virus
GCNLNFYSS

SEQ ID NO: 14698 - protein, 9 aa, BK virus
CNLNFYSSS

SEQ ID NO: 14699 - protein, 9 aa, BK virus
NLNFYSSSS

SEQ ID NO: 14700 - protein, 9 aa, BK virus
LNFYSSSSL

SEQ ID NO: 14701 - protein, 9 aa, BK virus
NFYSSSSLP

SEQ ID NO: 14702 - protein, 9 aa, BK virus
FYSSSSLPS

SEQ ID NO: 14703 - protein, 9 aa, BK virus
YSSSSLPSS

SEQ ID NO: 14704 - protein, 9 aa, BK virus
SSSSLPSSN

SEQ ID NO: 14705 - protein, 9 aa, BK virus
SSSLPSSNF

SEQ ID NO: 14706 - protein, 9 aa, BK virus
SSLPSSNFS

SEQ ID NO: 14707 - protein, 9 aa, BK virus
SLPSSNFSH

SEQ ID NO: 14708 - protein, 9 aa, BK virus
KSCGSSSLR

SEQ ID NO: 14709 - protein, 9 aa, BK virus
SCGSSSLRY

SEQ ID NO: 14710 - protein, 9 aa, BK virus
CGSSSLRYT

SEQ ID NO: 14711 - protein, 9 aa, BK virus
GSSSLRYTG

SEQ ID NO: 14712 - protein, 9 aa, BK virus
SSSLRYTGN

SEQ ID NO: 14713 - protein, 9 aa, BK virus
SSTHEPGNT

SEQ ID NO: 14714 - protein, 9 aa, BK virus
STHEPGNTK

SEQ ID NO: 14715 - protein, 9 aa, BK virus
THEPGNTKK

SEQ ID NO: 14716 - protein, 9 aa, BK virus
HEPGNTKKK

SEQ ID NO: 14717 - protein, 9 aa, BK virus
EPGNTKKKG

SEQ ID NO: 14718 - protein, 9 aa, BK virus
PGNTKKKGL

SEQ ID NO: 14719 - protein, 9 aa, BK virus
GNTKKKGLL

SEQ ID NO: 14720 - protein, 9 aa, BK virus
NTKKKGLLT

SEQ ID NO: 14721 - protein, 9 aa, BK virus
ESFTESFTA

SEQ ID NO: 14722 - protein, 9 aa, BK virus
SFTESFTAG

SEQ ID NO: 14723 - protein, 9 aa, BK virus
FTESFTAGK

SEQ ID NO: 14724 - protein, 9 aa, BK virus
TESFTAGKA

SEQ ID NO: 14725 - protein, 9 aa, BK virus
ESFTAGKAV

SEQ ID NO: 14726 - protein, 9 aa, BK virus
SFTAGKAVV

SEQ ID NO: 14727 - protein, 9 aa, BK virus
FTAGKAVVL

SEQ ID NO: 14728 - protein, 9 aa, BK virus
TAGKAVVLL

SEQ ID NO: 14729 - protein, 9 aa, BK virus
AGKAVVLLF

SEQ ID NO: 14730 - protein, 9 aa, BK virus
GKAVVLLFF

SEQ ID NO: 14731 - protein, 9 aa, BK virus
KAVVLLFFP

SEQ ID NO: 14732 - protein, 9 aa, BK virus
AVVLLFFPS

SEQ ID NO: 14733 - protein, 9 aa, BK virus
VVLLFFPST

SEQ ID NO: 14734 - protein, 9 aa, BK virus
VLLFFPSTL

SEQ ID NO: 14735 - protein, 9 aa, BK virus
LLFFPSTLS

SEQ ID NO: 14736 - protein, 9 aa, BK virus
LFFPSTLSS

SEQ ID NO: 14737 - protein, 9 aa, BK virus
FFPSTLSSP

SEQ ID NO: 14738 - protein, 9 aa, BK virus
FPSTLSSPL

SEQ ID NO: 14739 - protein, 9 aa, BK virus
PSTLSSPLQ

SEQ ID NO: 14740 - protein, 9 aa, BK virus
STLSSPLQN

SEQ ID NO: 14741 - protein, 9 aa, BK virus
TLSSPLQNS

SEQ ID NO: 14742 - protein, 9 aa, BK virus
LSSPLQNSS

SEQ ID NO: 14743 - protein, 9 aa, BK virus
SSPLQNSSK

SEQ ID NO: 14744 - protein, 9 aa, BK virus
SPLQNSSKS

SEQ ID NO: 14745 - protein, 9 aa, BK virus
PLQNSSKSS

SEQ ID NO: 14746 - protein, 9 aa, BK virus
LQNSSKSSK

SEQ ID NO: 14747 - protein, 9 aa, BK virus
QNSSKSSKI

SEQ ID NO: 14748 - protein, 9 aa, BK virus
NSSKSSKIK

SEQ ID NO: 14749 - protein, 9 aa, BK virus
SSKSSKIKI

SEQ ID NO: 14750 - protein, 9 aa, BK virus
SKSSKIKIK

SEQ ID NO: 14751 - protein, 9 aa, BK virus
KSSKIKIKI

SEQ ID NO: 14752 - protein, 9 aa, BK virus
SSKIKIKIL

SEQ ID NO: 14753 - protein, 9 aa, BK virus
ALFFVPVQV

SEQ ID NO: 14754 - protein, 9 aa, BK virus
LFFVPVQVL

SEQ ID NO: 14755 - protein, 9 aa, BK virus
FFVPVQVLP

SEQ ID NO: 14756 - protein, 9 aa, BK virus
FVPVQVLPT

SEQ ID NO: 14757 - protein, 9 aa, BK virus
VPVQVLPTF

SEQ ID NO: 14758 - protein, 9 aa, BK virus
PVQVLPTFT

SEQ ID NO: 14759 - protein, 9 aa, BK virus
VQVLPTFTE

SEQ ID NO: 14760 - protein, 9 aa, BK virus
QVLPTFTEA

SEQ ID NO: 14761 - protein, 9 aa, BK virus
VLPTFTEAC

SEQ ID NO: 14762 - protein, 9 aa, BK virus
LPTFTEACR

SEQ ID NO: 14763 - protein, 9 aa, BK virus
PTFTEACRD

SEQ ID NO: 14764 - protein, 9 aa, BK virus
TFTEACRDS

SEQ ID NO: 14765 - protein, 9 aa, BK virus
FTEACRDSW

SEQ ID NO: 14766 - protein, 9 aa, BK virus
TEACRDSWR

SEQ ID NO: 14767 - protein, 9 aa, BK virus
EACRDSWRR

SEQ ID NO: 14768 - protein, 9 aa, BK virus
ACRDSWRRT

SEQ ID NO: 14769 - protein, 9 aa, BK virus
CRDSWRRTM

SEQ ID NO: 14770 - protein, 9 aa, BK virus
RDSWRRTMA

SEQ ID NO: 14771 - protein, 9 aa, BK virus
DSWRRTMAF

SEQ ID NO: 14772 - protein, 9 aa, BK virus
SWRRTMAFV

SEQ ID NO: 14773 - protein, 9 aa, BK virus
WRRTMAFVQ

SEQ ID NO: 14774 - protein, 9 aa, BK virus
RRTMAFVQF

SEQ ID NO: 14775 - protein, 9 aa, BK virus
RTMAFVQFN

SEQ ID NO: 14776 - protein, 9 aa, BK virus
TMAFVQFNW

SEQ ID NO: 14777 - protein, 9 aa, BK virus
MAFVQFNWG

SEQ ID NO: 14778 - protein, 9 aa, BK virus
AFVQFNWGQ

SEQ ID NO: 14779 - protein, 9 aa, BK virus
FVQFNWGQG

SEQ ID NO: 14780 - protein, 9 aa, BK virus
VQFNWGQGQ

SEQ ID NO: 14781 - protein, 9 aa, BK virus
QFNWGQGQD

SEQ ID NO: 14782 - protein, 9 aa, BK virus
FNWGQGQDS

SEQ ID NO: 14783 - protein, 9 aa, BK virus
ARKTCLSCT

SEQ ID NO: 14784 - protein, 9 aa, BK virus
RKTCLSCTF

SEQ ID NO: 14785 - protein, 9 aa, BK virus
KTCLSCTFL

SEQ ID NO: 14786 - protein, 9 aa, BK virus
TCLSCTFLP

SEQ ID NO: 14787 - protein, 9 aa, BK virus
CLSCTFLPE

SEQ ID NO: 14788 - protein, 9 aa, BK virus
LSCTFLPEV

SEQ ID NO: 14789 - protein, 9 aa, BK virus
SCTFLPEVM

SEQ ID NO: 14790 - protein, 9 aa, BK virus
CTFLPEVMV

SEQ ID NO: 14791 - protein, 9 aa, BK virus
TFLPEVMVW

SEQ ID NO: 14792 - protein, 9 aa, BK virus
FLPEVMVWL

SEQ ID NO: 14793 - protein, 9 aa, BK virus
LPEVMVWLH

SEQ ID NO: 14794 - protein, 9 aa, BK virus
PEVMVWLHS

SEQ ID NO: 14795 - protein, 9 aa, BK virus
EVMVWLHSM

SEQ ID NO: 14796 - protein, 9 aa, BK virus
VMVWLHSMG

SEQ ID NO: 14797 - protein, 9 aa, BK virus
MVWLHSMGK

SEQ ID NO: 14798 - protein, 9 aa, BK virus
VWLHSMGKQ

SEQ ID NO: 14799 - protein, 9 aa, BK virus
WLHSMGKQL

SEQ ID NO: 14800 - protein, 9 aa, BK virus
LHSMGKQLL

SEQ ID NO: 14801 - protein, 9 aa, BK virus
HSMGKQLLP

SEQ ID NO: 14802 - protein, 9 aa, BK virus
SMGKQLLPV

SEQ ID NO: 14803 - protein, 9 aa, BK virus
MGKQLLPVS

SEQ ID NO: 14804 - protein, 9 aa, BK virus
GKQLLPVSH

SEQ ID NO: 14805 - protein, 9 aa, BK virus
KQLLPVSHA

SEQ ID NO: 14806 - protein, 9 aa, BK virus
QLLPVSHAL

SEQ ID NO: 14807 - protein, 9 aa, BK virus
LLPVSHALS

SEQ ID NO: 14808 - protein, 9 aa, BK virus
LPVSHALSF

SEQ ID NO: 14809 - protein, 9 aa, BK virus
PVSHALSFL

SEQ ID NO: 14810 - protein, 9 aa, BK virus
VSHALSFLR

SEQ ID NO: 14811 - protein, 9 aa, BK virus
SHALSFLRS

SEQ ID NO: 14812 - protein, 9 aa, BK virus
HALSFLRSW

SEQ ID NO: 14813 - protein, 9 aa, BK virus
ALSFLRSWF

SEQ ID NO: 14814 - protein, 9 aa, BK virus
LSFLRSWFG

SEQ ID NO: 14815 - protein, 9 aa, BK virus
SFLRSWFGC

SEQ ID NO: 14816 - protein, 9 aa, BK virus
FLRSWFGCI

SEQ ID NO: 14817 - protein, 9 aa, BK virus
LRSWFGCIP

SEQ ID NO: 14818 - protein, 9 aa, BK virus
RSWFGCIPL

SEQ ID NO: 14819 - protein, 9 aa, BK virus
GHGLAAFHG

SEQ ID NO: 14820 - protein, 9 aa, BK virus
AAPPCGLFF

SEQ ID NO: 14821 - protein, 9 aa, BK virus
APPCGLFFY

SEQ ID NO: 14822 - protein, 9 aa, BK virus
PPCGLFFYN

SEQ ID NO: 14823 - protein, 9 aa, BK virus
PCGLFFYNI

SEQ ID NO: 14824 - protein, 9 aa, BK virus
EAEAASAST

SEQ ID NO: 14825 - protein, 9 aa, BK virus
AEAASASTL

SEQ ID NO: 14826 - protein, 9 aa, BK virus
EAASASTLS

SEQ ID NO: 14827 - protein, 9 aa, BK virus
AASASTLSL

SEQ ID NO: 14828 - protein, 9 aa, BK virus
ASASTLSLK

SEQ ID NO: 14829 - protein, 9 aa, BK virus
GLAKLFGEI

SEQ ID NO: 14830 - protein, 9 aa, BK virus
LAKLFGEIP

SEQ ID NO: 14831 - protein, 9 aa, BK virus
AKLFGEIPI

SEQ ID NO: 14832 - protein, 9 aa, BK virus
KLFGEIPIL

SEQ ID NO: 14833 - protein, 9 aa, BK virus
LFGEIPILL

SEQ ID NO: 14834 - protein, 9 aa, BK virus
FGEIPILLQ

SEQ ID NO: 14835 - protein, 9 aa, BK virus
GEIPILLQF

SEQ ID NO: 14836 - protein, 9 aa, BK virus
EIPILLQFL

SEQ ID NO: 14837 - protein, 9 aa, BK virus
IPILLQFLQ

SEQ ID NO: 14838 - protein, 10 aa, BK virus
MDKVLNREES

SEQ ID NO: 14839 - protein, 10 aa, BK virus
DKVLNREESM

SEQ ID NO: 14840 - protein, 10 aa, BK virus
KVLNREESME

SEQ ID NO: 14841 - protein, 10 aa, BK virus
VLNREESMEL

SEQ ID NO: 14842 - protein, 10 aa, BK virus
LNREESMELM

SEQ ID NO: 14843 - protein, 10 aa, BK virus
NREESMELMD

SEQ ID NO: 14844 - protein, 10 aa, BK virus
REESMELMDL

SEQ ID NO: 14845 - protein, 10 aa, BK virus
EESMELMDLL

SEQ ID NO: 14846 - protein, 10 aa, BK virus
ESMELMDLLG

SEQ ID NO: 14847 - protein, 10 aa, BK virus
SMELMDLLGL

SEQ ID NO: 14848 - protein, 10 aa, BK virus
MELMDLLGLE

SEQ ID NO: 14849 - protein, 10 aa, BK virus
ELMDLLGLER

SEQ ID NO: 14850 - protein, 10 aa, BK virus
LMDLLGLERA

SEQ ID NO: 14851 - protein, 10 aa, BK virus
MDLLGLERAA

SEQ ID NO: 14852 - protein, 10 aa, BK virus
DLLGLERAAW

SEQ ID NO: 14853 - protein, 10 aa, BK virus
LLGLERAAWG

SEQ ID NO: 14854 - protein, 10 aa, BK virus
LGLERAAWGN

SEQ ID NO: 14855 - protein, 10 aa, BK virus
GLERAAWGNL

SEQ ID NO: 14856 - protein, 10 aa, BK virus
LERAAWGNLP

SEQ ID NO: 14857 - protein, 10 aa, BK virus
ERAAWGNLPL

SEQ ID NO: 14858 - protein, 10 aa, BK virus
RAAWGNLPLM

SEQ ID NO: 14859 - protein, 10 aa, BK virus
AAWGNLPLMR

SEQ ID NO: 14860 - protein, 10 aa, BK virus
AWGNLPLMRK

SEQ ID NO: 14861 - protein, 10 aa, BK virus
WGNLPLMRKA

SEQ ID NO: 14862 - protein, 10 aa, BK virus
GNLPLMRKAY

SEQ ID NO: 14863 - protein, 10 aa, BK virus
NLPLMRKAYL

SEQ ID NO: 14864 - protein, 10 aa, BK virus
LPLMRKAYLR

SEQ ID NO: 14865 - protein, 10 aa, BK virus
PLMRKAYLRK

SEQ ID NO: 14866 - protein, 10 aa, BK virus
LMRKAYLRKC

SEQ ID NO: 14867 - protein, 10 aa, BK virus
MRKAYLRKCK

SEQ ID NO: 14868 - protein, 10 aa, BK virus
RKAYLRKCKE

SEQ ID NO: 14869 - protein, 10 aa, BK virus
KAYLRKCKEF

SEQ ID NO: 14870 - protein, 10 aa, BK virus
AYLRKCKEFH

SEQ ID NO: 14871 - protein, 10 aa, BK virus
YLRKCKEFHP

SEQ ID NO: 14872 - protein, 10 aa, BK virus
LRKCKEFHPD

SEQ ID NO: 14873 - protein, 10 aa, BK virus
RKCKEFHPDK

SEQ ID NO: 14874 - protein, 10 aa, BK virus
KCKEFHPDKG

SEQ ID NO: 14875 - protein, 10 aa, BK virus
CKEFHPDKGG

SEQ ID NO: 14876 - protein, 10 aa, BK virus
KEFHPDKGGD

SEQ ID NO: 14877 - protein, 10 aa, BK virus
EFHPDKGGDE

SEQ ID NO: 14878 - protein, 10 aa, BK virus
FHPDKGGDED

SEQ ID NO: 14879 - protein, 10 aa, BK virus
HPDKGGDEDK

SEQ ID NO: 14880 - protein, 10 aa, BK virus
PDKGGDEDKM

SEQ ID NO: 14881 - protein, 10 aa, BK virus
DKGGDEDKMK

SEQ ID NO: 14882 - protein, 10 aa, BK virus
KGGDEDKMKR

SEQ ID NO: 14883 - protein, 10 aa, BK virus
GGDEDKMKRM

SEQ ID NO: 14884 - protein, 10 aa, BK virus
GDEDKMKRMN

SEQ ID NO: 14885 - protein, 10 aa, BK virus
DEDKMKRMNT

SEQ ID NO: 14886 - protein, 10 aa, BK virus
EDKMKRMNTL

SEQ ID NO: 14887 - protein, 10 aa, BK virus
DKMKRMNTLY

SEQ ID NO: 14888 - protein, 10 aa, BK virus
KMKRMNTLYK

SEQ ID NO: 14889 - protein, 10 aa, BK virus
MKRMNTLYKK

SEQ ID NO: 14890 - protein, 10 aa, BK virus
KRMNTLYKKM

SEQ ID NO: 14891 - protein, 10 aa, BK virus
RMNTLYKKME

SEQ ID NO: 14892 - protein, 10 aa, BK virus
MNTLYKKMEQ

SEQ ID NO: 14893 - protein, 10 aa, BK virus
NTLYKKMEQD

SEQ ID NO: 14894 - protein, 10 aa, BK virus
TLYKKMEQDV

SEQ ID NO: 14895 - protein, 10 aa, BK virus
LYKKMEQDVK

SEQ ID NO: 14896 - protein, 10 aa, BK virus
YKKMEQDVKV

SEQ ID NO: 14897 - protein, 10 aa, BK virus
KKMEQDVKVA

SEQ ID NO: 14898 - protein, 10 aa, BK virus
KMEQDVKVAH

SEQ ID NO: 14899 - protein, 10 aa, BK virus
MEQDVKVAHQ

SEQ ID NO: 14900 - protein, 10 aa, BK virus
EQDVKVAHQP

SEQ ID NO: 14901 - protein, 10 aa, BK virus
QDVKVAHQPD

SEQ ID NO: 14902 - protein, 10 aa, BK virus
DVKVAHQPDF

SEQ ID NO: 14903 - protein, 10 aa, BK virus
VKVAHQPDFG

SEQ ID NO: 14904 - protein, 10 aa, BK virus
KVAHQPDFGT

SEQ ID NO: 14905 - protein, 10 aa, BK virus
VAHQPDFGTW

SEQ ID NO: 14906 - protein, 10 aa, BK virus
AHQPDFGTWS

SEQ ID NO: 14907 - protein, 10 aa, BK virus
HQPDFGTWSS

SEQ ID NO: 14908 - protein, 10 aa, BK virus
QPDFGTWSSS

SEQ ID NO: 14909 - protein, 10 aa, BK virus
PDFGTWSSSE

SEQ ID NO: 14910 - protein, 10 aa, BK virus
DFGTWSSSEV

SEQ ID NO: 14911 - protein, 10 aa, BK virus
FGTWSSSEVC

SEQ ID NO: 14912 - protein, 10 aa, BK virus
GTWSSSEVCA

SEQ ID NO: 14913 - protein, 10 aa, BK virus
TWSSSEVCAD

SEQ ID NO: 14914 - protein, 10 aa, BK virus
WSSSEVCADF

SEQ ID NO: 14915 - protein, 10 aa, BK virus
SSSEVCADFP

SEQ ID NO: 14916 - protein, 10 aa, BK virus
SSEVCADFPL

SEQ ID NO: 14917 - protein, 10 aa, BK virus
SEVCADFPLC

SEQ ID NO: 14918 - protein, 10 aa, BK virus
EVCADFPLCP

SEQ ID NO: 14919 - protein, 10 aa, BK virus
VCADFPLCPD

SEQ ID NO: 14920 - protein, 10 aa, BK virus
CADFPLCPDT

SEQ ID NO: 14921 - protein, 10 aa, BK virus
ADFPLCPDTL

SEQ ID NO: 14922 - protein, 10 aa, BK virus
DFPLCPDTLY

SEQ ID NO: 14923 - protein, 10 aa, BK virus
FPLCPDTLYC

SEQ ID NO: 14924 - protein, 10 aa, BK virus
PLCPDTLYCK

SEQ ID NO: 14925 - protein, 10 aa, BK virus
LCPDTLYCKE

SEQ ID NO: 14926 - protein, 10 aa, BK virus
CPDTLYCKEW

SEQ ID NO: 14927 - protein, 10 aa, BK virus
PDTLYCKEWP

SEQ ID NO: 14928 - protein, 10 aa, BK virus
DTLYCKEWPI

SEQ ID NO: 14929 - protein, 10 aa, BK virus
TLYCKEWPIC

SEQ ID NO: 14930 - protein, 10 aa, BK virus
LYCKEWPICS

SEQ ID NO: 14931 - protein, 10 aa, BK virus
YCKEWPICSK

SEQ ID NO: 14932 - protein, 10 aa, BK virus
CKEWPICSKK

SEQ ID NO: 14933 - protein, 10 aa, BK virus
KEWPICSKKP

SEQ ID NO: 14934 - protein, 10 aa, BK virus
EWPICSKKPS

SEQ ID NO: 14935 - protein, 10 aa, BK virus
WPICSKKPSV

SEQ ID NO: 14936 - protein, 10 aa, BK virus
PICSKKPSVH

SEQ ID NO: 14937 - protein, 10 aa, BK virus
ICSKKPSVHC

SEQ ID NO: 14938 - protein, 10 aa, BK virus
CSKKPSVHCP

SEQ ID NO: 14939 - protein, 10 aa, BK virus
SKKPSVHCPC

SEQ ID NO: 14940 - protein, 10 aa, BK virus
KKPSVHCPCM

SEQ ID NO: 14941 - protein, 10 aa, BK virus
KPSVHCPCML

SEQ ID NO: 14942 - protein, 10 aa, BK virus
PSVHCPCMLC

SEQ ID NO: 14943 - protein, 10 aa, BK virus
SVHCPCMLCQ

SEQ ID NO: 14944 - protein, 10 aa, BK virus
VHCPCMLCQL

SEQ ID NO: 14945 - protein, 10 aa, BK virus
HCPCMLCQLR

SEQ ID NO: 14946 - protein, 10 aa, BK virus
CPCMLCQLRL

SEQ ID NO: 14947 - protein, 10 aa, BK virus
PCMLCQLRLR

SEQ ID NO: 14948 - protein, 10 aa, BK virus
CMLCQLRLRH

SEQ ID NO: 14949 - protein, 10 aa, BK virus
MLCQLRLRHL

SEQ ID NO: 14950 - protein, 10 aa, BK virus
LCQLRLRHLN

SEQ ID NO: 14951 - protein, 10 aa, BK virus
CQLRLRHLNR

SEQ ID NO: 14952 - protein, 10 aa, BK virus
QLRLRHLNRK

SEQ ID NO: 14953 - protein, 10 aa, BK virus
LRLRHLNRKF

SEQ ID NO: 14954 - protein, 10 aa, BK virus
RLRHLNRKFL

SEQ ID NO: 14955 - protein, 10 aa, BK virus
LRHLNRKFLR

SEQ ID NO: 14956 - protein, 10 aa, BK virus
RHLNRKFLRK

SEQ ID NO: 14957 - protein, 10 aa, BK virus
HLNRKFLRKE

SEQ ID NO: 14958 - protein, 10 aa, BK virus
LNRKFLRKEP

SEQ ID NO: 14959 - protein, 10 aa, BK virus
NRKFLRKEPL

SEQ ID NO: 14960 - protein, 10 aa, BK virus
RKFLRKEPLV

SEQ ID NO: 14961 - protein, 10 aa, BK virus
KFLRKEPLVW

SEQ ID NO: 14962 - protein, 10 aa, BK virus
FLRKEPLVWI

SEQ ID NO: 14963 - protein, 10 aa, BK virus
LRKEPLVWID

SEQ ID NO: 14964 - protein, 10 aa, BK virus
RKEPLVWIDC

SEQ ID NO: 14965 - protein, 10 aa, BK virus
KEPLVWIDCY

SEQ ID NO: 14966 - protein, 10 aa, BK virus
EPLVWIDCYC

SEQ ID NO: 14967 - protein, 10 aa, BK virus
PLVWIDCYCI

SEQ ID NO: 14968 - protein, 10 aa, BK virus
LVWIDCYCID

SEQ ID NO: 14969 - protein, 10 aa, BK virus
VWIDCYCIDC

SEQ ID NO: 14970 - protein, 10 aa, BK virus
WIDCYCIDCF

SEQ ID NO: 14971 - protein, 10 aa, BK virus
IDCYCIDCFT

SEQ ID NO: 14972 - protein, 10 aa, BK virus
DCYCIDCFTQ

SEQ ID NO: 14973 - protein, 10 aa, BK virus
CYCIDCFTQW

SEQ ID NO: 14974 - protein, 10 aa, BK virus
YCIDCFTQWF

SEQ ID NO: 14975 - protein, 10 aa, BK virus
CIDCFTQWFG

SEQ ID NO: 14976 - protein, 10 aa, BK virus
IDCFTQWFGL

SEQ ID NO: 14977 - protein, 10 aa, BK virus
DCFTQWFGLD

SEQ ID NO: 14978 - protein, 10 aa, BK virus
CFTQWFGLDL

SEQ ID NO: 14979 - protein, 10 aa, BK virus
FTQWFGLDLT

SEQ ID NO: 14980 - protein, 10 aa, BK virus
TQWFGLDLTE

SEQ ID NO: 14981 - protein, 10 aa, BK virus
QWFGLDLTEE

SEQ ID NO: 14982 - protein, 10 aa, BK virus
WFGLDLTEET

SEQ ID NO: 14983 - protein, 10 aa, BK virus
FGLDLTEETL

SEQ ID NO: 14984 - protein, 10 aa, BK virus
GLDLTEETLQ

SEQ ID NO: 14985 - protein, 10 aa, BK virus
LDLTEETLQW

SEQ ID NO: 14986 - protein, 10 aa, BK virus
DLTEETLQWW

SEQ ID NO: 14987 - protein, 10 aa, BK virus
LTEETLQWWV

SEQ ID NO: 14988 - protein, 10 aa, BK virus
TEETLQWWVQ

SEQ ID NO: 14989 - protein, 10 aa, BK virus
EETLQWWVQI

SEQ ID NO: 14990 - protein, 10 aa, BK virus
ETLQWWVQII

SEQ ID NO: 14991 - protein, 10 aa, BK virus
TLQWWVQIIG

SEQ ID NO: 14992 - protein, 10 aa, BK virus
LQWWVQIIGE

SEQ ID NO: 14993 - protein, 10 aa, BK virus
QWWVQIIGET

SEQ ID NO: 14994 - protein, 10 aa, BK virus
WWVQIIGETP

SEQ ID NO: 14995 - protein, 10 aa, BK virus
WVQIIGETPF

SEQ ID NO: 14996 - protein, 10 aa, BK virus
VQIIGETPFR

SEQ ID NO: 14997 - protein, 10 aa, BK virus
QIIGETPFRD

SEQ ID NO: 14998 - protein, 10 aa, BK virus
IIGETPFRDL

SEQ ID NO: 14999 - protein, 10 aa, BK virus
IGETPFRDLK

SEQ ID NO: 15000 - protein, 10 aa, BK virus
GETPFRDLKL

SEQ ID NO: 15001 - protein, 10 aa, BK virus
KALSNYFFYR

SEQ ID NO: 15002 - protein, 10 aa, BK virus
ALSNYFFYRC

SEQ ID NO: 15003 - protein, 10 aa, BK virus
LSNYFFYRCQ

SEQ ID NO: 15004 - protein, 10 aa, BK virus
SNYFFYRCQP

SEQ ID NO: 15005 - protein, 10 aa, BK virus
NYFFYRCQPM

SEQ ID NO: 15006 - protein, 10 aa, BK virus
YFFYRCQPME

SEQ ID NO: 15007 - protein, 10 aa, BK virus
FFYRCQPMEQ

SEQ ID NO: 15008 - protein, 10 aa, BK virus
FYRCQPMEQK

SEQ ID NO: 15009 - protein, 10 aa, BK virus
YRCQPMEQKS

SEQ ID NO: 15010 - protein, 10 aa, BK virus
RCQPMEQKSG

SEQ ID NO: 15011 - protein, 10 aa, BK virus
CQPMEQKSGS

SEQ ID NO: 15012 - protein, 10 aa, BK virus
QPMEQKSGSP

SEQ ID NO: 15013 - protein, 10 aa, BK virus
PMEQKSGSPG

SEQ ID NO: 15014 - protein, 10 aa, BK virus
MEQKSGSPGG

SEQ ID NO: 15015 - protein, 10 aa, BK virus
EQKSGSPGGV

SEQ ID NO: 15016 - protein, 10 aa, BK virus
QKSGSPGGVP

SEQ ID NO: 15017 - protein, 10 aa, BK virus
KSGSPGGVPL

SEQ ID NO: 15018 - protein, 10 aa, BK virus
SGSPGGVPLM

SEQ ID NO: 15019 - protein, 10 aa, BK virus
GSPGGVPLMK

SEQ ID NO: 15020 - protein, 10 aa, BK virus
SPGGVPLMKN

SEQ ID NO: 15021 - protein, 10 aa, BK virus
PGGVPLMKNG

SEQ ID NO: 15022 - protein, 10 aa, BK virus
GGVPLMKNGM

SEQ ID NO: 15023 - protein, 10 aa, BK virus
GVPLMKNGMK

SEQ ID NO: 15024 - protein, 10 aa, BK virus
VPLMKNGMKI

SEQ ID NO: 15025 - protein, 10 aa, BK virus
PLMKNGMKIY

SEQ ID NO: 15026 - protein, 10 aa, BK virus
LMKNGMKIYF

SEQ ID NO: 15027 - protein, 10 aa, BK virus
MKNGMKIYFA

SEQ ID NO: 15028 - protein, 10 aa, BK virus
KNGMKIYFAM

SEQ ID NO: 15029 - protein, 10 aa, BK virus
NGMKIYFAMK

SEQ ID NO: 15030 - protein, 10 aa, BK virus
GMKIYFAMKI

SEQ ID NO: 15031 - protein, 10 aa, BK virus
MKIYFAMKIC

SEQ ID NO: 15032 - protein, 10 aa, BK virus
KIYFAMKICL

SEQ ID NO: 15033 - protein, 10 aa, BK virus
IYFAMKICLP

SEQ ID NO: 15034 - protein, 10 aa, BK virus
YFAMKICLPV

SEQ ID NO: 15035 - protein, 10 aa, BK virus
FAMKICLPVM

SEQ ID NO: 15036 - protein, 10 aa, BK virus
AMKICLPVMK

SEQ ID NO: 15037 - protein, 10 aa, BK virus
MKICLPVMKK

SEQ ID NO: 15038 - protein, 10 aa, BK virus
KICLPVMKKQ

SEQ ID NO: 15039 - protein, 10 aa, BK virus
ICLPVMKKQQ

SEQ ID NO: 15040 - protein, 10 aa, BK virus
CLPVMKKQQQ

SEQ ID NO: 15041 - protein, 10 aa, BK virus
LPVMKKQQQI

SEQ ID NO: 15042 - protein, 10 aa, BK virus
PVMKKQQQIL

SEQ ID NO: 15043 - protein, 10 aa, BK virus
VMKKQQQILN

SEQ ID NO: 15044 - protein, 10 aa, BK virus
MKKQQQILNT

SEQ ID NO: 15045 - protein, 10 aa, BK virus
KKQQQILNTQ

SEQ ID NO: 15046 - protein, 10 aa, BK virus
KQQQILNTQH

SEQ ID NO: 15047 - protein, 10 aa, BK virus
QQQILNTQHH

SEQ ID NO: 15048 - protein, 10 aa, BK virus
QQILNTQHHP

SEQ ID NO: 15049 - protein, 10 aa, BK virus
QILNTQHHPK

SEQ ID NO: 15050 - protein, 10 aa, BK virus
ILNTQHHPKK

SEQ ID NO: 15051 - protein, 10 aa, BK virus
LNTQHHPKKK

SEQ ID NO: 15052 - protein, 10 aa, BK virus
NTQHHPKKKE

SEQ ID NO: 15053 - protein, 10 aa, BK virus
TQHHPKKKER

SEQ ID NO: 15054 - protein, 10 aa, BK virus
KTLKTFPLIY

SEQ ID NO: 15055 - protein, 10 aa, BK virus
TLKTFPLIYT

SEQ ID NO: 15056 - protein, 10 aa, BK virus
LKTFPLIYTS

SEQ ID NO: 15057 - protein, 10 aa, BK virus
KTFPLIYTSF

SEQ ID NO: 15058 - protein, 10 aa, BK virus
TFPLIYTSFL

SEQ ID NO: 15059 - protein, 10 aa, BK virus
FPLIYTSFLV

SEQ ID NO: 15060 - protein, 10 aa, BK virus
PLIYTSFLVK

SEQ ID NO: 15061 - protein, 10 aa, BK virus
LIYTSFLVKL

SEQ ID NO: 15062 - protein, 10 aa, BK virus
IYTSFLVKLY

SEQ ID NO: 15063 - protein, 10 aa, BK virus
YTSFLVKLYL

SEQ ID NO: 15064 - protein, 10 aa, BK virus
TSFLVKLYLV

SEQ ID NO: 15065 - protein, 10 aa, BK virus
SFLVKLYLVI

SEQ ID NO: 15066 - protein, 10 aa, BK virus
FLVKLYLVIE

SEQ ID NO: 15067 - protein, 10 aa, BK virus
LVKLYLVIEP

SEQ ID NO: 15068 - protein, 10 aa, BK virus
VKLYLVIEPL

SEQ ID NO: 15069 - protein, 10 aa, BK virus
KLYLVIEPLP

SEQ ID NO: 15070 - protein, 10 aa, BK virus
LYLVIEPLPA

SEQ ID NO: 15071 - protein, 10 aa, BK virus
YLVIEPLPAL

SEQ ID NO: 15072 - protein, 10 aa, BK virus
LVIEPLPALL

SEQ ID NO: 15073 - protein, 10 aa, BK virus
VIEPLPALLC

SEQ ID NO: 15074 - protein, 10 aa, BK virus
IEPLPALLCI

SEQ ID NO: 15075 - protein, 10 aa, BK virus
EPLPALLCIL

SEQ ID NO: 15076 - protein, 10 aa, BK virus
PLPALLCILL

SEQ ID NO: 15077 - protein, 10 aa, BK virus
LPALLCILLK

SEQ ID NO: 15078 - protein, 10 aa, BK virus
PALLCILLKK

SEQ ID NO: 15079 - protein, 10 aa, BK virus
ALLCILLKKK

SEQ ID NO: 15080 - protein, 10 aa, BK virus
LLCILLKKKL

SEQ ID NO: 15081 - protein, 10 aa, BK virus
LCILLKKKLK

SEQ ID NO: 15082 - protein, 10 aa, BK virus
CILLKKKLKF

SEQ ID NO: 15083 - protein, 10 aa, BK virus
ILLKKKLKFC

SEQ ID NO: 15084 - protein, 10 aa, BK virus
LLKKKLKFCI

SEQ ID NO: 15085 - protein, 10 aa, BK virus
LKKKLKFCIK

SEQ ID NO: 15086 - protein, 10 aa, BK virus
KKKLKFCIKN

SEQ ID NO: 15087 - protein, 10 aa, BK virus
KKLKFCIKNL

SEQ ID NO: 15088 - protein, 10 aa, BK virus
KLKFCIKNLW

SEQ ID NO: 15089 - protein, 10 aa, BK virus
LKFCIKNLWK

SEQ ID NO: 15090 - protein, 10 aa, BK virus
KFCIKNLWKN

SEQ ID NO: 15091 - protein, 10 aa, BK virus
FCIKNLWKNI

SEQ ID NO: 15092 - protein, 10 aa, BK virus
CIKNLWKNIL

SEQ ID NO: 15093 - protein, 10 aa, BK virus
LLLVDTCVLG

SEQ ID NO: 15094 - protein, 10 aa, BK virus
LLVDTCVLGI

SEQ ID NO: 15095 - protein, 10 aa, BK virus
LVDTCVLGII

SEQ ID NO: 15096 - protein, 10 aa, BK virus
VDTCVLGIIL

SEQ ID NO: 15097 - protein, 10 aa, BK virus
DTCVLGIILY

SEQ ID NO: 15098 - protein, 10 aa, BK virus
TCVLGIILYS

SEQ ID NO: 15099 - protein, 10 aa, BK virus
CVLGIILYSF

SEQ ID NO: 15100 - protein, 10 aa, BK virus
LHIDIEFLQL

SEQ ID NO: 15101 - protein, 10 aa, BK virus
HIDIEFLQLI

SEQ ID NO: 15102 - protein, 10 aa, BK virus
IDIEFLQLII

SEQ ID NO: 15103 - protein, 10 aa, BK virus
DIEFLQLIIS

SEQ ID NO: 15104 - protein, 10 aa, BK virus
IEFLQLIISV

SEQ ID NO: 15105 - protein, 10 aa, BK virus
EFLQLIISVK

SEQ ID NO: 15106 - protein, 10 aa, BK virus
FLQLIISVKS

SEQ ID NO: 15107 - protein, 10 aa, BK virus
LQLIISVKSC

SEQ ID NO: 15108 - protein, 10 aa, BK virus
QLIISVKSCV

SEQ ID NO: 15109 - protein, 10 aa, BK virus
LIISVKSCVP

SEQ ID NO: 15110 - protein, 10 aa, BK virus
IISVKSCVPL

SEQ ID NO: 15111 - protein, 10 aa, BK virus
ISVKSCVPLV

SEQ ID NO: 15112 - protein, 10 aa, BK virus
SVKSCVPLVF

SEQ ID NO: 15113 - protein, 10 aa, BK virus
FVRVLIRNTY

SEQ ID NO: 15114 - protein, 10 aa, BK virus
VRVLIRNTYY

SEQ ID NO: 15115 - protein, 10 aa, BK virus
RVLIRNTYYI

SEQ ID NO: 15116 - protein, 10 aa, BK virus
VLIRNTYYIV

SEQ ID NO: 15117 - protein, 10 aa, BK virus
LIRNTYYIVP

SEQ ID NO: 15118 - protein, 10 aa, BK virus
RSMILAQKSL

SEQ ID NO: 15119 - protein, 10 aa, BK virus
SMILAQKSLK

SEQ ID NO: 15120 - protein, 10 aa, BK virus
MILAQKSLKK

SEQ ID NO: 15121 - protein, 10 aa, BK virus
ILAQKSLKKQ

SEQ ID NO: 15122 - protein, 10 aa, BK virus
LAQKSLKKQS

SEQ ID NO: 15123 - protein, 10 aa, BK virus
AQKSLKKQSR

SEQ ID NO: 15124 - protein, 10 aa, BK virus
QKSLKKQSRC

SEQ ID NO: 15125 - protein, 10 aa, BK virus
KSLKKQSRCL

SEQ ID NO: 15126 - protein, 10 aa, BK virus
SLKKQSRCLG

SEQ ID NO: 15127 - protein, 10 aa, BK virus
LKKQSRCLGN

SEQ ID NO: 15128 - protein, 10 aa, BK virus
RQSVRMCFYY

SEQ ID NO: 15129 - protein, 10 aa, BK virus
RSVKSVRKKT

SEQ ID NO: 15130 - protein, 10 aa, BK virus
SVKSVRKKTS

SEQ ID NO: 15131 - protein, 10 aa, BK virus
VKSVRKKTSL

SEQ ID NO: 15132 - protein, 10 aa, BK virus
KSVRKKTSLI

SEQ ID NO: 15133 - protein, 10 aa, BK virus
SVRKKTSLIT

SEQ ID NO: 15134 - protein, 10 aa, BK virus
VRKKTSLITL

SEQ ID NO: 15135 - protein, 10 aa, BK virus
RKKTSLITLS

SEQ ID NO: 15136 - protein, 10 aa, BK virus
KKTSLITLSI

SEQ ID NO: 15137 - protein, 10 aa, BK virus
KTSLITLSIM

SEQ ID NO: 15138 - protein, 10 aa, BK virus
TSLITLSIMK

SEQ ID NO: 15139 - protein, 10 aa, BK virus
SLITLSIMKS

SEQ ID NO: 15140 - protein, 10 aa, BK virus
LITLSIMKST

SEQ ID NO: 15141 - protein, 10 aa, BK virus
ITLSIMKSTL

SEQ ID NO: 15142 - protein, 10 aa, BK virus
TLSIMKSTLQ

SEQ ID NO: 15143 - protein, 10 aa, BK virus
LSIMKSTLQM

SEQ ID NO: 15144 - protein, 10 aa, BK virus
SIMKSTLQML

SEQ ID NO: 15145 - protein, 10 aa, BK virus
IMKSTLQMLL

SEQ ID NO: 15146 - protein, 10 aa, BK virus
MKSTLQMLLF

SEQ ID NO: 15147 - protein, 10 aa, BK virus
KSTLQMLLFL

SEQ ID NO: 15148 - protein, 10 aa, BK virus
STLQMLLFLQ

SEQ ID NO: 15149 - protein, 10 aa, BK virus
TLQMLLFLQK

SEQ ID NO: 15150 - protein, 10 aa, BK virus
LQMLLFLQKV

SEQ ID NO: 15151 - protein, 10 aa, BK virus
QMLLFLQKVK

SEQ ID NO: 15152 - protein, 10 aa, BK virus
MLLFLQKVKI

SEQ ID NO: 15153 - protein, 10 aa, BK virus
LLFLQKVKIK

SEQ ID NO: 15154 - protein, 10 aa, BK virus
LFLQKVKIKK

SEQ ID NO: 15155 - protein, 10 aa, BK virus
FLQKVKIKKV

SEQ ID NO: 15156 - protein, 10 aa, BK virus
LQKVKIKKVF

SEQ ID NO: 15157 - protein, 10 aa, BK virus
QKVKIKKVFV

SEQ ID NO: 15158 - protein, 10 aa, BK virus
KVKIKKVFVS

SEQ ID NO: 15159 - protein, 10 aa, BK virus
VKIKKVFVSK

SEQ ID NO: 15160 - protein, 10 aa, BK virus
KIKKVFVSKQ

SEQ ID NO: 15161 - protein, 10 aa, BK virus
NNIWQVLLGC

SEQ ID NO: 15162 - protein, 10 aa, BK virus
NIWQVLLGCT

SEQ ID NO: 15163 - protein, 10 aa, BK virus
IWQVLLGCTV

SEQ ID NO: 15164 - protein, 10 aa, BK virus
WQVLLGCTVC

SEQ ID NO: 15165 - protein, 10 aa, BK virus
QVLLGCTVCY

SEQ ID NO: 15166 - protein, 10 aa, BK virus
VLLGCTVCYL

SEQ ID NO: 15167 - protein, 10 aa, BK virus
LLGCTVCYLK

SEQ ID NO: 15168 - protein, 10 aa, BK virus
LGCTVCYLKW

SEQ ID NO: 15169 - protein, 10 aa, BK virus
GCTVCYLKWI

SEQ ID NO: 15170 - protein, 10 aa, BK virus
CTVCYLKWIL

SEQ ID NO: 15171 - protein, 10 aa, BK virus
YLIFCTVLFS

SEQ ID NO: 15172 - protein, 10 aa, BK virus
LIFCTVLFSM

SEQ ID NO: 15173 - protein, 10 aa, BK virus
IFCTVLFSMY

SEQ ID NO: 15174 - protein, 10 aa, BK virus
FCTVLFSMYL

SEQ ID NO: 15175 - protein, 10 aa, BK virus
CTVLFSMYLK

SEQ ID NO: 15176 - protein, 10 aa, BK virus
TVLFSMYLKE

SEQ ID NO: 15177 - protein, 10 aa, BK virus
VLFSMYLKED

SEQ ID NO: 15178 - protein, 10 aa, BK virus
LFSMYLKEDT

SEQ ID NO: 15179 - protein, 10 aa, BK virus
FSMYLKEDTG

SEQ ID NO: 15180 - protein, 10 aa, BK virus
SMYLKEDTGY

SEQ ID NO: 15181 - protein, 10 aa, BK virus
MYLKEDTGYL

SEQ ID NO: 15182 - protein, 10 aa, BK virus
YLKEDTGYLK

SEQ ID NO: 15183 - protein, 10 aa, BK virus
LKEDTGYLKV

SEQ ID NO: 15184 - protein, 10 aa, BK virus
KEDTGYLKVP

SEQ ID NO: 15185 - protein, 10 aa, BK virus
EDTGYLKVPL

SEQ ID NO: 15186 - protein, 10 aa, BK virus
DTGYLKVPLI

SEQ ID NO: 15187 - protein, 10 aa, BK virus
TGYLKVPLIV

SEQ ID NO: 15188 - protein, 10 aa, BK virus
GYLKVPLIVE

SEQ ID NO: 15189 - protein, 10 aa, BK virus
YLKVPLIVEK

SEQ ID NO: 15190 - protein, 10 aa, BK virus
LKVPLIVEKQ

SEQ ID NO: 15191 - protein, 10 aa, BK virus
KVPLIVEKQH

SEQ ID NO: 15192 - protein, 10 aa, BK virus
KGQELNQRIC

SEQ ID NO: 15193 - protein, 10 aa, BK virus
GQELNQRICL

SEQ ID NO: 15194 - protein, 10 aa, BK virus
QELNQRICLQ

SEQ ID NO: 15195 - protein, 10 aa, BK virus
ELNQRICLQD

SEQ ID NO: 15196 - protein, 10 aa, BK virus
LNQRICLQDM

SEQ ID NO: 15197 - protein, 10 aa, BK virus
NQRICLQDME

SEQ ID NO: 15198 - protein, 10 aa, BK virus
TKEPKYFHQA

SEQ ID NO: 15199 - protein, 10 aa, BK virus
KEPKYFHQAW

SEQ ID NO: 15200 - protein, 10 aa, BK virus
EPKYFHQAWL

SEQ ID NO: 15201 - protein, 10 aa, BK virus
PKYFHQAWLQ

SEQ ID NO: 15202 - protein, 10 aa, BK virus
MSILSLKPCK

SEQ ID NO: 15203 - protein, 10 aa, BK virus
SILSLKPCKL

SEQ ID NO: 15204 - protein, 10 aa, BK virus
ILSLKPCKLD

SEQ ID NO: 15205 - protein, 10 aa, BK virus
LSLKPCKLDL

SEQ ID NO: 15206 - protein, 10 aa, BK virus
ENPYKTQSSY

SEQ ID NO: 15207 - protein, 10 aa, BK virus
NPYKTQSSYL

SEQ ID NO: 15208 - protein, 10 aa, BK virus
PYKTQSSYLK

SEQ ID NO: 15209 - protein, 10 aa, BK virus
YKTQSSYLKK

SEQ ID NO: 15210 - protein, 10 aa, BK virus
KTQSSYLKKE

SEQ ID NO: 15211 - protein, 10 aa, BK virus
TQSSYLKKEF

SEQ ID NO: 15212 - protein, 10 aa, BK virus
QSSYLKKEFY

SEQ ID NO: 15213 - protein, 10 aa, BK virus
SSYLKKEFYK

SEQ ID NO: 15214 - protein, 10 aa, BK virus
SYLKKEFYKV

SEQ ID NO: 15215 - protein, 10 aa, BK virus
YLKKEFYKVE

SEQ ID NO: 15216 - protein, 10 aa, BK virus
LILQLIYNLE

SEQ ID NO: 15217 - protein, 10 aa, BK virus
ILQLIYNLEL

SEQ ID NO: 15218 - protein, 10 aa, BK virus
LQLIYNLELL

SEQ ID NO: 15219 - protein, 10 aa, BK virus
QLIYNLELLN

SEQ ID NO: 15220 - protein, 10 aa, BK virus
LIYNLELLNG

SEQ ID NO: 15221 - protein, 10 aa, BK virus
IYNLELLNGR

SEQ ID NO: 15222 - protein, 10 aa, BK virus
YNLELLNGRK

SEQ ID NO: 15223 - protein, 10 aa, BK virus
NLELLNGRKG

SEQ ID NO: 15224 - protein, 10 aa, BK virus
LELLNGRKGW

SEQ ID NO: 15225 - protein, 10 aa, BK virus
ELLNGRKGWI

SEQ ID NO: 15226 - protein, 10 aa, BK virus
LLNGRKGWIL

SEQ ID NO: 15227 - protein, 10 aa, BK virus
LNGRKGWILR

SEQ ID NO: 15228 - protein, 10 aa, BK virus
NIIYAWGNVF

SEQ ID NO: 15229 - protein, 10 aa, BK virus
IIYAWGNVFL

SEQ ID NO: 15230 - protein, 10 aa, BK virus
IYAWGNVFLI

SEQ ID NO: 15231 - protein, 10 aa, BK virus
YAWGNVFLIL

SEQ ID NO: 15232 - protein, 10 aa, BK virus
AWGNVFLILQ

SEQ ID NO: 15233 - protein, 10 aa, BK virus
WGNVFLILQE

SEQ ID NO: 15234 - protein, 10 aa, BK virus
GNVFLILQEK

SEQ ID NO: 15235 - protein, 10 aa, BK virus
NVFLILQEKR

SEQ ID NO: 15236 - protein, 10 aa, BK virus
VFLILQEKRI

SEQ ID NO: 15237 - protein, 10 aa, BK virus
FLILQEKRIQ

SEQ ID NO: 15238 - protein, 10 aa, BK virus
LILQEKRIQK

SEQ ID NO: 15239 - protein, 10 aa, BK virus
ILQEKRIQKL

SEQ ID NO: 15240 - protein, 10 aa, BK virus
LQEKRIQKLK

SEQ ID NO: 15241 - protein, 10 aa, BK virus
QEKRIQKLKT

SEQ ID NO: 15242 - protein, 10 aa, BK virus
EKRIQKLKTL

SEQ ID NO: 15243 - protein, 10 aa, BK virus
KRIQKLKTLD

SEQ ID NO: 15244 - protein, 10 aa, BK virus
RIQKLKTLDM

SEQ ID NO: 15245 - protein, 10 aa, BK virus
IQKLKTLDMD

SEQ ID NO: 15246 - protein, 10 aa, BK virus
QKLKTLDMDQ

SEQ ID NO: 15247 - protein, 10 aa, BK virus
KLKTLDMDQA

SEQ ID NO: 15248 - protein, 10 aa, BK virus
LKTLDMDQAL

SEQ ID NO: 15249 - protein, 10 aa, BK virus
KTLDMDQALN

SEQ ID NO: 15250 - protein, 10 aa, BK virus
TLDMDQALNP

SEQ ID NO: 15251 - protein, 10 aa, BK virus
LDMDQALNPN

SEQ ID NO: 15252 - protein, 10 aa, BK virus
DMDQALNPNH

SEQ ID NO: 15253 - protein, 10 aa, BK virus
MDQALNPNHN

SEQ ID NO: 15254 - protein, 10 aa, BK virus
DQALNPNHNA

SEQ ID NO: 15255 - protein, 10 aa, BK virus
QALNPNHNAL

SEQ ID NO: 15256 - protein, 10 aa, BK virus
ALNPNHNALP

SEQ ID NO: 15257 - protein, 10 aa, BK virus
LNPNHNALPK

SEQ ID NO: 15258 - protein, 10 aa, BK virus
NPNHNALPKS

SEQ ID NO: 15259 - protein, 10 aa, BK virus
PNHNALPKSQ

SEQ ID NO: 15260 - protein, 10 aa, BK virus
NHNALPKSQI

SEQ ID NO: 15261 - protein, 10 aa, BK virus
HNALPKSQIL

SEQ ID NO: 15262 - protein, 10 aa, BK virus
NALPKSQILQ

SEQ ID NO: 15263 - protein, 10 aa, BK virus
ALPKSQILQP

SEQ ID NO: 15264 - protein, 10 aa, BK virus
LPKSQILQPL

SEQ ID NO: 15265 - protein, 10 aa, BK virus
PKSQILQPLL

SEQ ID NO: 15266 - protein, 10 aa, BK virus
KSQILQPLLK

SEQ ID NO: 15267 - protein, 10 aa, BK virus
SQILQPLLKI

SEQ ID NO: 15268 - protein, 10 aa, BK virus
QILQPLLKIP

SEQ ID NO: 15269 - protein, 10 aa, BK virus
ILQPLLKIPK

SEQ ID NO: 15270 - protein, 10 aa, BK virus
LQPLLKIPKG

SEQ ID NO: 15271 - protein, 10 aa, BK virus
QPLLKIPKGQ

SEQ ID NO: 15272 - protein, 10 aa, BK virus
PLLKIPKGQT

SEQ ID NO: 15273 - protein, 10 aa, BK virus
LLKIPKGQTP

SEQ ID NO: 15274 - protein, 10 aa, BK virus
LKIPKGQTPI

SEQ ID NO: 15275 - protein, 10 aa, BK virus
KIPKGQTPIV

SEQ ID NO: 15276 - protein, 10 aa, BK virus
IPKGQTPIVK

SEQ ID NO: 15277 - protein, 10 aa, BK virus
PKGQTPIVKS

SEQ ID NO: 15278 - protein, 10 aa, BK virus
KGQTPIVKSC

SEQ ID NO: 15279 - protein, 10 aa, BK virus
GQTPIVKSCI

SEQ ID NO: 15280 - protein, 10 aa, BK virus
QTPIVKSCIC

SEQ ID NO: 15281 - protein, 10 aa, BK virus
TPIVKSCICV

SEQ ID NO: 15282 - protein, 10 aa, BK virus
PIVKSCICVK

SEQ ID NO: 15283 - protein, 10 aa, BK virus
IVKSCICVKA

SEQ ID NO: 15284 - protein, 10 aa, BK virus
VKSCICVKAF

SEQ ID NO: 15285 - protein, 10 aa, BK virus
KSCICVKAFS

SEQ ID NO: 15286 - protein, 10 aa, BK virus
SCICVKAFSV

SEQ ID NO: 15287 - protein, 10 aa, BK virus
CICVKAFSVL

SEQ ID NO: 15288 - protein, 10 aa, BK virus
ICVKAFSVLK

SEQ ID NO: 15289 - protein, 10 aa, BK virus
CVKAFSVLKG

SEQ ID NO: 15290 - protein, 10 aa, BK virus
VKAFSVLKGL

SEQ ID NO: 15291 - protein, 10 aa, BK virus
KAFSVLKGLK

SEQ ID NO: 15292 - protein, 10 aa, BK virus
AFSVLKGLKH

SEQ ID NO: 15293 - protein, 10 aa, BK virus
FSVLKGLKHH

SEQ ID NO: 15294 - protein, 10 aa, BK virus
SVLKGLKHHP

SEQ ID NO: 15295 - protein, 10 aa, BK virus
VLKGLKHHPQ

SEQ ID NO: 15296 - protein, 10 aa, BK virus
LKGLKHHPQN

SEQ ID NO: 15297 - protein, 10 aa, BK virus
KGLKHHPQNN

SEQ ID NO: 15298 - protein, 10 aa, BK virus
GLKHHPQNNT

SEQ ID NO: 15299 - protein, 10 aa, BK virus
LKHHPQNNTS

SEQ ID NO: 15300 - protein, 10 aa, BK virus
KHHPQNNTSL

SEQ ID NO: 15301 - protein, 10 aa, BK virus
HHPQNNTSLK

SEQ ID NO: 15302 - protein, 10 aa, BK virus
HPQNNTSLKV

SEQ ID NO: 15303 - protein, 10 aa, BK virus
PQNNTSLKVA

SEQ ID NO: 15304 - protein, 10 aa, BK virus
QNNTSLKVAY

SEQ ID NO: 15305 - protein, 10 aa, BK virus
NNTSLKVAYT

SEQ ID NO: 15306 - protein, 10 aa, BK virus
NTSLKVAYTK

SEQ ID NO: 15307 - protein, 10 aa, BK virus
TSLKVAYTKA

SEQ ID NO: 15308 - protein, 10 aa, BK virus
SLKVAYTKAA

SEQ ID NO: 15309 - protein, 10 aa, BK virus
LKVAYTKAAF

SEQ ID NO: 15310 - protein, 10 aa, BK virus
KVAYTKAAFI

SEQ ID NO: 15311 - protein, 10 aa, BK virus
VAYTKAAFIK

SEQ ID NO: 15312 - protein, 10 aa, BK virus
AYTKAAFIKC

SEQ ID NO: 15313 - protein, 10 aa, BK virus
YTKAAFIKCI

SEQ ID NO: 15314 - protein, 10 aa, BK virus
TKAAFIKCIC

SEQ ID NO: 15315 - protein, 10 aa, BK virus
KAAFIKCICT

SEQ ID NO: 15316 - protein, 10 aa, BK virus
AAFIKCICTI

SEQ ID NO: 15317 - protein, 10 aa, BK virus
AFIKCICTIK

SEQ ID NO: 15318 - protein, 10 aa, BK virus
FIKCICTIKA

SEQ ID NO: 15319 - protein, 10 aa, BK virus
IKCICTIKAP

SEQ ID NO: 15320 - protein, 10 aa, BK virus
KCICTIKAPV

SEQ ID NO: 15321 - protein, 10 aa, BK virus
SILVCNCPCL

SEQ ID NO: 15322 - protein, 10 aa, BK virus
ILVCNCPCLS

SEQ ID NO: 15323 - protein, 10 aa, BK virus
LVCNCPCLSI

SEQ ID NO: 15324 - protein, 10 aa, BK virus
VCNCPCLSIY

SEQ ID NO: 15325 - protein, 10 aa, BK virus
CNCPCLSIYL

SEQ ID NO: 15326 - protein, 10 aa, BK virus
NCPCLSIYLI

SEQ ID NO: 15327 - protein, 10 aa, BK virus
CPCLSIYLII

SEQ ID NO: 15328 - protein, 10 aa, BK virus
PCLSIYLIIS

SEQ ID NO: 15329 - protein, 10 aa, BK virus
CLSIYLIISG

SEQ ID NO: 15330 - protein, 10 aa, BK virus
LSIYLIISGS

SEQ ID NO: 15331 - protein, 10 aa, BK virus
SIYLIISGSP

SEQ ID NO: 15332 - protein, 10 aa, BK virus
IYLIISGSPG

SEQ ID NO: 15333 - protein, 10 aa, BK virus
YLIISGSPGS

SEQ ID NO: 15334 - protein, 10 aa, BK virus
LIISGSPGSL

SEQ ID NO: 15335 - protein, 10 aa, BK virus
IISGSPGSLS

SEQ ID NO: 15336 - protein, 10 aa, BK virus
ISGSPGSLSV

SEQ ID NO: 15337 - protein, 10 aa, BK virus
SGSPGSLSVP

SEQ ID NO: 15338 - protein, 10 aa, BK virus
GSPGSLSVPS

SEQ ID NO: 15339 - protein, 10 aa, BK virus
SPGSLSVPSN

SEQ ID NO: 15340 - protein, 10 aa, BK virus
PGSLSVPSNT

SEQ ID NO: 15341 - protein, 10 aa, BK virus
GSLSVPSNTL

SEQ ID NO: 15342 - protein, 10 aa, BK virus
SLSVPSNTLT

SEQ ID NO: 15343 - protein, 10 aa, BK virus
LSVPSNTLTS

SEQ ID NO: 15344 - protein, 10 aa, BK virus
SVPSNTLTSS

SEQ ID NO: 15345 - protein, 10 aa, BK virus
VPSNTLTSST

SEQ ID NO: 15346 - protein, 10 aa, BK virus
PSNTLTSSTW

SEQ ID NO: 15347 - protein, 10 aa, BK virus
SNTLTSSTWD

SEQ ID NO: 15348 - protein, 10 aa, BK virus
NTLTSSTWDS

SEQ ID NO: 15349 - protein, 10 aa, BK virus
TLTSSTWDSI

SEQ ID NO: 15350 - protein, 10 aa, BK virus
LTSSTWDSIP

SEQ ID NO: 15351 - protein, 10 aa, BK virus
TSSTWDSIPY

SEQ ID NO: 15352 - protein, 10 aa, BK virus
SSTWDSIPYI

SEQ ID NO: 15353 - protein, 10 aa, BK virus
STWDSIPYIG

SEQ ID NO: 15354 - protein, 10 aa, BK virus
TWDSIPYIGC

SEQ ID NO: 15355 - protein, 10 aa, BK virus
WDSIPYIGCP

SEQ ID NO: 15356 - protein, 10 aa, BK virus
DSIPYIGCPS

SEQ ID NO: 15357 - protein, 10 aa, BK virus
SIPYIGCPST

SEQ ID NO: 15358 - protein, 10 aa, BK virus
IPYIGCPSTL

SEQ ID NO: 15359 - protein, 10 aa, BK virus
PYIGCPSTLW

SEQ ID NO: 15360 - protein, 10 aa, BK virus
YIGCPSTLWV

SEQ ID NO: 15361 - protein, 10 aa, BK virus
IGCPSTLWVL

SEQ ID NO: 15362 - protein, 10 aa, BK virus
GCPSTLWVLL

SEQ ID NO: 15363 - protein, 10 aa, BK virus
CPSTLWVLLF

SEQ ID NO: 15364 - protein, 10 aa, BK virus
PSTLWVLLFI

SEQ ID NO: 15365 - protein, 10 aa, BK virus
STLWVLLFIR

SEQ ID NO: 15366 - protein, 10 aa, BK virus
TLWVLLFIRS

SEQ ID NO: 15367 - protein, 10 aa, BK virus
LWVLLFIRSL

SEQ ID NO: 15368 - protein, 10 aa, BK virus
WVLLFIRSLS

SEQ ID NO: 15369 - protein, 10 aa, BK virus
VLLFIRSLSK

SEQ ID NO: 15370 - protein, 10 aa, BK virus
LLFIRSLSKK

SEQ ID NO: 15371 - protein, 10 aa, BK virus
LFIRSLSKKE

SEQ ID NO: 15372 - protein, 10 aa, BK virus
FIRSLSKKEI

SEQ ID NO: 15373 - protein, 10 aa, BK virus
IRSLSKKEIG

SEQ ID NO: 15374 - protein, 10 aa, BK virus
GFFTDLFLRR

SEQ ID NO: 15375 - protein, 10 aa, BK virus
FFTDLFLRRI

SEQ ID NO: 15376 - protein, 10 aa, BK virus
FTDLFLRRIL

SEQ ID NO: 15377 - protein, 10 aa, BK virus
TDLFLRRILK

SEQ ID NO: 15378 - protein, 10 aa, BK virus
DLFLRRILKY

SEQ ID NO: 15379 - protein, 10 aa, BK virus
LFLRRILKYL

SEQ ID NO: 15380 - protein, 10 aa, BK virus
FLRRILKYLA

SEQ ID NO: 15381 - protein, 10 aa, BK virus
LRRILKYLAR

SEQ ID NO: 15382 - protein, 10 aa, BK virus
RRILKYLARP

SEQ ID NO: 15383 - protein, 10 aa, BK virus
RILKYLARPL

SEQ ID NO: 15384 - protein, 10 aa, BK virus
ILKYLARPLH

SEQ ID NO: 15385 - protein, 10 aa, BK virus
LKYLARPLHC

SEQ ID NO: 15386 - protein, 10 aa, BK virus
KYLARPLHCC

SEQ ID NO: 15387 - protein, 10 aa, BK virus
YLARPLHCCV

SEQ ID NO: 15388 - protein, 10 aa, BK virus
LARPLHCCVP

SEQ ID NO: 15389 - protein, 10 aa, BK virus
ARPLHCCVPE

SEQ ID NO: 15390 - protein, 10 aa, BK virus
RPLHCCVPEL

SEQ ID NO: 15391 - protein, 10 aa, BK virus
PLHCCVPELL

SEQ ID NO: 15392 - protein, 10 aa, BK virus
LHCCVPELLV

SEQ ID NO: 15393 - protein, 10 aa, BK virus
HCCVPELLVN

SEQ ID NO: 15394 - protein, 10 aa, BK virus
CCVPELLVNR

SEQ ID NO: 15395 - protein, 10 aa, BK virus
CVPELLVNRP

SEQ ID NO: 15396 - protein, 10 aa, BK virus
VPELLVNRPQ

SEQ ID NO: 15397 - protein, 10 aa, BK virus
PELLVNRPQI

SEQ ID NO: 15398 - protein, 10 aa, BK virus
ELLVNRPQIS

SEQ ID NO: 15399 - protein, 10 aa, BK virus
LLVNRPQISA

SEQ ID NO: 15400 - protein, 10 aa, BK virus
LVNRPQISAA

SEQ ID NO: 15401 - protein, 10 aa, BK virus
VNRPQISAAE

SEQ ID NO: 15402 - protein, 10 aa, BK virus
NRPQISAAET

SEQ ID NO: 15403 - protein, 10 aa, BK virus
RPQISAAETY

SEQ ID NO: 15404 - protein, 10 aa, BK virus
PQISAAETYR

SEQ ID NO: 15405 - protein, 10 aa, BK virus
QISAAETYRL

SEQ ID NO: 15406 - protein, 10 aa, BK virus
ISAAETYRLS

SEQ ID NO: 15407 - protein, 10 aa, BK virus
SAAETYRLSA

SEQ ID NO: 15408 - protein, 10 aa, BK virus
AAETYRLSAL

SEQ ID NO: 15409 - protein, 10 aa, BK virus
AETYRLSALQ

SEQ ID NO: 15410 - protein, 10 aa, BK virus
ETYRLSALQR

SEQ ID NO: 15411 - protein, 10 aa, BK virus
TYRLSALQRG

SEQ ID NO: 15412 - protein, 10 aa, BK virus
YRLSALQRGP

SEQ ID NO: 15413 - protein, 10 aa, BK virus
RLSALQRGPT

SEQ ID NO: 15414 - protein, 10 aa, BK virus
LSALQRGPTP

SEQ ID NO: 15415 - protein, 10 aa, BK virus
SALQRGPTPC

SEQ ID NO: 15416 - protein, 10 aa, BK virus
ALQRGPTPCS

SEQ ID NO: 15417 - protein, 10 aa, BK virus
LQRGPTPCSS

SEQ ID NO: 15418 - protein, 10 aa, BK virus
QRGPTPCSSS

SEQ ID NO: 15419 - protein, 10 aa, BK virus
RGPTPCSSSN

SEQ ID NO: 15420 - protein, 10 aa, BK virus
GPTPCSSSNT

SEQ ID NO: 15421 - protein, 10 aa, BK virus
PTPCSSSNTV

SEQ ID NO: 15422 - protein, 10 aa, BK virus
TPCSSSNTVV

SEQ ID NO: 15423 - protein, 10 aa, BK virus
PCSSSNTVVA

SEQ ID NO: 15424 - protein, 10 aa, BK virus
CSSSNTVVAV

SEQ ID NO: 15425 - protein, 10 aa, BK virus
SSSNTVVAVL

SEQ ID NO: 15426 - protein, 10 aa, BK virus
SSNTVVAVLV

SEQ ID NO: 15427 - protein, 10 aa, BK virus
SNTVVAVLVT

SEQ ID NO: 15428 - protein, 10 aa, BK virus
STGGTFSPPV

SEQ ID NO: 15429 - protein, 10 aa, BK virus
TGGTFSPPVK

SEQ ID NO: 15430 - protein, 10 aa, BK virus
GGTFSPPVKV

SEQ ID NO: 15431 - protein, 10 aa, BK virus
GTFSPPVKVP

SEQ ID NO: 15432 - protein, 10 aa, BK virus
TFSPPVKVPK

SEQ ID NO: 15433 - protein, 10 aa, BK virus
FSPPVKVPKY

SEQ ID NO: 15434 - protein, 10 aa, BK virus
SPPVKVPKYL

SEQ ID NO: 15435 - protein, 10 aa, BK virus
PPVKVPKYLA

SEQ ID NO: 15436 - protein, 10 aa, BK virus
PVKVPKYLAF

SEQ ID NO: 15437 - protein, 10 aa, BK virus
VKVPKYLAFS

SEQ ID NO: 15438 - protein, 10 aa, BK virus
KVPKYLAFSF

SEQ ID NO: 15439 - protein, 10 aa, BK virus
VPKYLAFSFL

SEQ ID NO: 15440 - protein, 10 aa, BK virus
PKYLAFSFLL

SEQ ID NO: 15441 - protein, 10 aa, BK virus
KYLAFSFLLG

SEQ ID NO: 15442 - protein, 10 aa, BK virus
YLAFSFLLGS

SEQ ID NO: 15443 - protein, 10 aa, BK virus
LAFSFLLGSG

SEQ ID NO: 15444 - protein, 10 aa, BK virus
AFSFLLGSGT

SEQ ID NO: 15445 - protein, 10 aa, BK virus
FSFLLGSGTQ

SEQ ID NO: 15446 - protein, 10 aa, BK virus
SFLLGSGTQH

SEQ ID NO: 15447 - protein, 10 aa, BK virus
FLLGSGTQHS

SEQ ID NO: 15448 - protein, 10 aa, BK virus
LLGSGTQHST

SEQ ID NO: 15449 - protein, 10 aa, BK virus
LGSGTQHSTG

SEQ ID NO: 15450 - protein, 10 aa, BK virus
ALWSVFITWD

SEQ ID NO: 15451 - protein, 10 aa, BK virus
LWSVFITWDW

SEQ ID NO: 15452 - protein, 10 aa, BK virus
WSVFITWDWA

SEQ ID NO: 15453 - protein, 10 aa, BK virus
SVFITWDWAV

SEQ ID NO: 15454 - protein, 10 aa, BK virus
VFITWDWAVG

SEQ ID NO: 15455 - protein, 10 aa, BK virus
FITWDWAVGF

SEQ ID NO: 15456 - protein, 10 aa, BK virus
ITWDWAVGFL

SEQ ID NO: 15457 - protein, 10 aa, BK virus
TWDWAVGFLG

SEQ ID NO: 15458 - protein, 10 aa, BK virus
WDWAVGFLGV

SEQ ID NO: 15459 - protein, 10 aa, BK virus
DWAVGFLGVI

SEQ ID NO: 15460 - protein, 10 aa, BK virus
WAVGFLGVIV

SEQ ID NO: 15461 - protein, 10 aa, BK virus
AVGFLGVIVP

SEQ ID NO: 15462 - protein, 10 aa, BK virus
VGFLGVIVPS

SEQ ID NO: 15463 - protein, 10 aa, BK virus
GFLGVIVPSG

SEQ ID NO: 15464 - protein, 10 aa, BK virus
FLGVIVPSGY

SEQ ID NO: 15465 - protein, 10 aa, BK virus
LGVIVPSGYF

SEQ ID NO: 15466 - protein, 10 aa, BK virus
GVIVPSGYFD

SEQ ID NO: 15467 - protein, 10 aa, BK virus
VIVPSGYFDL

SEQ ID NO: 15468 - protein, 10 aa, BK virus
FISTPCISKG

SEQ ID NO: 15469 - protein, 10 aa, BK virus
ISTPCISKGS

SEQ ID NO: 15470 - protein, 10 aa, BK virus
STPCISKGSP

SEQ ID NO: 15471 - protein, 10 aa, BK virus
TPCISKGSPP

SEQ ID NO: 15472 - protein, 10 aa, BK virus
PCISKGSPPT

SEQ ID NO: 15473 - protein, 10 aa, BK virus
CISKGSPPTA

SEQ ID NO: 15474 - protein, 10 aa, BK virus
ISKGSPPTAK

SEQ ID NO: 15475 - protein, 10 aa, BK virus
SKGSPPTAKK

SEQ ID NO: 15476 - protein, 10 aa, BK virus
KGSPPTAKKW

SEQ ID NO: 15477 - protein, 10 aa, BK virus
GSPPTAKKWK

SEQ ID NO: 15478 - protein, 10 aa, BK virus
SPPTAKKWKL

SEQ ID NO: 15479 - protein, 10 aa, BK virus
PPTAKKWKLL

SEQ ID NO: 15480 - protein, 10 aa, BK virus
PTAKKWKLLP

SEQ ID NO: 15481 - protein, 10 aa, BK virus
IGFPPPCSCT

SEQ ID NO: 15482 - protein, 10 aa, BK virus
GFPPPCSCTF

SEQ ID NO: 15483 - protein, 10 aa, BK virus
FPPPCSCTFC

SEQ ID NO: 15484 - protein, 10 aa, BK virus
PPPCSCTFCD

SEQ ID NO: 15485 - protein, 10 aa, BK virus
PPCSCTFCDP

SEQ ID NO: 15486 - protein, 10 aa, BK virus
PCSCTFCDPA

SEQ ID NO: 15487 - protein, 10 aa, BK virus
RLSMLVIPIT

SEQ ID NO: 15488 - protein, 10 aa, BK virus
LSMLVIPITS

SEQ ID NO: 15489 - protein, 10 aa, BK virus
SMLVIPITSV

SEQ ID NO: 15490 - protein, 10 aa, BK virus
MLVIPITSVC

SEQ ID NO: 15491 - protein, 10 aa, BK virus
LVIPITSVCT

SEQ ID NO: 15492 - protein, 10 aa, BK virus
VIPITSVCTV

SEQ ID NO: 15493 - protein, 10 aa, BK virus
IPITSVCTVT

SEQ ID NO: 15494 - protein, 10 aa, BK virus
PITSVCTVTA

SEQ ID NO: 15495 - protein, 10 aa, BK virus
ITSVCTVTAS

SEQ ID NO: 15496 - protein, 10 aa, BK virus
TSVCTVTASH

SEQ ID NO: 15497 - protein, 10 aa, BK virus
SVCTVTASHI

SEQ ID NO: 15498 - protein, 10 aa, BK virus
VCTVTASHIS

SEQ ID NO: 15499 - protein, 10 aa, BK virus
CTVTASHISR

SEQ ID NO: 15500 - protein, 10 aa, BK virus
TVTASHISRF

SEQ ID NO: 15501 - protein, 10 aa, BK virus
VTASHISRFP

SEQ ID NO: 15502 - protein, 10 aa, BK virus
TASHISRFPQ

SEQ ID NO: 15503 - protein, 10 aa, BK virus
ASHISRFPQV

SEQ ID NO: 15504 - protein, 10 aa, BK virus
SHISRFPQVR

SEQ ID NO: 15505 - protein, 10 aa, BK virus
HISRFPQVRS

SEQ ID NO: 15506 - protein, 10 aa, BK virus
ISRFPQVRSS

SEQ ID NO: 15507 - protein, 10 aa, BK virus
SRFPQVRSSF

SEQ ID NO: 15508 - protein, 10 aa, BK virus
RFPQVRSSFK

SEQ ID NO: 15509 - protein, 10 aa, BK virus
FPQVRSSFKL

SEQ ID NO: 15510 - protein, 10 aa, BK virus
PQVRSSFKLG

SEQ ID NO: 15511 - protein, 10 aa, BK virus
QVRSSFKLGR

SEQ ID NO: 15512 - protein, 10 aa, BK virus
VRSSFKLGRG

SEQ ID NO: 15513 - protein, 10 aa, BK virus
RSSFKLGRGI

SEQ ID NO: 15514 - protein, 10 aa, BK virus
SSFKLGRGIL

SEQ ID NO: 15515 - protein, 10 aa, BK virus
SFKLGRGILA

SEQ ID NO: 15516 - protein, 10 aa, BK virus
FKLGRGILAV

SEQ ID NO: 15517 - protein, 10 aa, BK virus
KLGRGILAVL

SEQ ID NO: 15518 - protein, 10 aa, BK virus
QGSIFLSGLS

SEQ ID NO: 15519 - protein, 10 aa, BK virus
GSIFLSGLSL

SEQ ID NO: 15520 - protein, 10 aa, BK virus
SIFLSGLSLL

SEQ ID NO: 15521 - protein, 10 aa, BK virus
IFLSGLSLLK

SEQ ID NO: 15522 - protein, 10 aa, BK virus
FLSGLSLLKS

SEQ ID NO: 15523 - protein, 10 aa, BK virus
LSGLSLLKSF

SEQ ID NO: 15524 - protein, 10 aa, BK virus
SGLSLLKSFS

SEQ ID NO: 15525 - protein, 10 aa, BK virus
GLSLLKSFSA

SEQ ID NO: 15526 - protein, 10 aa, BK virus
LSLLKSFSAL

SEQ ID NO: 15527 - protein, 10 aa, BK virus
SLLKSFSALS

SEQ ID NO: 15528 - protein, 10 aa, BK virus
LLKSFSALSF

SEQ ID NO: 15529 - protein, 10 aa, BK virus
LKSFSALSFR

SEQ ID NO: 15530 - protein, 10 aa, BK virus
KSFSALSFRL

SEQ ID NO: 15531 - protein, 10 aa, BK virus
SFSALSFRLK

SEQ ID NO: 15532 - protein, 10 aa, BK virus
FSALSFRLKP

SEQ ID NO: 15533 - protein, 10 aa, BK virus
SALSFRLKPL

SEQ ID NO: 15534 - protein, 10 aa, BK virus
ALSFRLKPLR

SEQ ID NO: 15535 - protein, 10 aa, BK virus
LSFRLKPLRF

SEQ ID NO: 15536 - protein, 10 aa, BK virus
SFRLKPLRFS

SEQ ID NO: 15537 - protein, 10 aa, BK virus
FRLKPLRFSS

SEQ ID NO: 15538 - protein, 10 aa, BK virus
RLKPLRFSSG

SEQ ID NO: 15539 - protein, 10 aa, BK virus
LKPLRFSSGS

SEQ ID NO: 15540 - protein, 10 aa, BK virus
KPLRFSSGSP

SEQ ID NO: 15541 - protein, 10 aa, BK virus
PLRFSSGSPI

SEQ ID NO: 15542 - protein, 10 aa, BK virus
LRFSSGSPIS

SEQ ID NO: 15543 - protein, 10 aa, BK virus
RFSSGSPISG

SEQ ID NO: 15544 - protein, 10 aa, BK virus
FSSGSPISGF

SEQ ID NO: 15545 - protein, 10 aa, BK virus
SSGSPISGFR

SEQ ID NO: 15546 - protein, 10 aa, BK virus
SGSPISGFRK

SEQ ID NO: 15547 - protein, 10 aa, BK virus
GSPISGFRKH

SEQ ID NO: 15548 - protein, 10 aa, BK virus
SPISGFRKHS

SEQ ID NO: 15549 - protein, 10 aa, BK virus
PISGFRKHST

SEQ ID NO: 15550 - protein, 10 aa, BK virus
ISGFRKHSTS

SEQ ID NO: 15551 - protein, 10 aa, BK virus
SGFRKHSTSV

SEQ ID NO: 15552 - protein, 10 aa, BK virus
GFRKHSTSVI

SEQ ID NO: 15553 - protein, 10 aa, BK virus
FRKHSTSVIA

SEQ ID NO: 15554 - protein, 10 aa, BK virus
RKHSTSVIAS

SEQ ID NO: 15555 - protein, 10 aa, BK virus
KHSTSVIAST

SEQ ID NO: 15556 - protein, 10 aa, BK virus
HSTSVIASTP

SEQ ID NO: 15557 - protein, 10 aa, BK virus
STSVIASTPV

SEQ ID NO: 15558 - protein, 10 aa, BK virus
TSVIASTPVL

SEQ ID NO: 15559 - protein, 10 aa, BK virus
SVIASTPVLT

SEQ ID NO: 15560 - protein, 10 aa, BK virus
VIASTPVLTS

SEQ ID NO: 15561 - protein, 10 aa, BK virus
IASTPVLTSR

SEQ ID NO: 15562 - protein, 10 aa, BK virus
ASTPVLTSRT

SEQ ID NO: 15563 - protein, 10 aa, BK virus
STPVLTSRTS

SEQ ID NO: 15564 - protein, 10 aa, BK virus
TPVLTSRTST

SEQ ID NO: 15565 - protein, 10 aa, BK virus
PVLTSRTSTP

SEQ ID NO: 15566 - protein, 10 aa, BK virus
VLTSRTSTPP

SEQ ID NO: 15567 - protein, 10 aa, BK virus
LTSRTSTPPF

SEQ ID NO: 15568 - protein, 10 aa, BK virus
TSRTSTPPFI

SEQ ID NO: 15569 - protein, 10 aa, BK virus
SRTSTPPFIS

SEQ ID NO: 15570 - protein, 10 aa, BK virus
RTSTPPFISS

SEQ ID NO: 15571 - protein, 10 aa, BK virus
TSTPPFISSF

SEQ ID NO: 15572 - protein, 10 aa, BK virus
STPPFISSFG

SEQ ID NO: 15573 - protein, 10 aa, BK virus
TPPFISSFGT

SEQ ID NO: 15574 - protein, 10 aa, BK virus
PPFISSFGTC

SEQ ID NO: 15575 - protein, 10 aa, BK virus
PFISSFGTCT

SEQ ID NO: 15576 - protein, 10 aa, BK virus
FISSFGTCTG

SEQ ID NO: 15577 - protein, 10 aa, BK virus
ISSFGTCTGS

SEQ ID NO: 15578 - protein, 10 aa, BK virus
SSFGTCTGSF

SEQ ID NO: 15579 - protein, 10 aa, BK virus
SFGTCTGSFG

SEQ ID NO: 15580 - protein, 10 aa, BK virus
FGTCTGSFGF

SEQ ID NO: 15581 - protein, 10 aa, BK virus
GTCTGSFGFL

SEQ ID NO: 15582 - protein, 10 aa, BK virus
TCTGSFGFLG

SEQ ID NO: 15583 - protein, 10 aa, BK virus
CTGSFGFLGA

SEQ ID NO: 15584 - protein, 10 aa, BK virus
TGSFGFLGAA

SEQ ID NO: 15585 - protein, 10 aa, BK virus
GSFGFLGAAP

SEQ ID NO: 15586 - protein, 10 aa, BK virus
SFGFLGAAPG

SEQ ID NO: 15587 - protein, 10 aa, BK virus
FGFLGAAPGH

SEQ ID NO: 15588 - protein, 10 aa, BK virus
GFLGAAPGHS

SEQ ID NO: 15589 - protein, 10 aa, BK virus
FLGAAPGHSP

SEQ ID NO: 15590 - protein, 10 aa, BK virus
LGAAPGHSPF

SEQ ID NO: 15591 - protein, 10 aa, BK virus
GAAPGHSPFL

SEQ ID NO: 15592 - protein, 10 aa, BK virus
AAPGHSPFLL

SEQ ID NO: 15593 - protein, 10 aa, BK virus
APGHSPFLLV

SEQ ID NO: 15594 - protein, 10 aa, BK virus
PGHSPFLLVG

SEQ ID NO: 15595 - protein, 10 aa, BK virus
GHSPFLLVGA

SEQ ID NO: 15596 - protein, 10 aa, BK virus
HSPFLLVGAI

SEQ ID NO: 15597 - protein, 10 aa, BK virus
SPFLLVGAIF

SEQ ID NO: 15598 - protein, 10 aa, BK virus
PFLLVGAIFI

SEQ ID NO: 15599 - protein, 10 aa, BK virus
FLLVGAIFIC

SEQ ID NO: 15600 - protein, 10 aa, BK virus
LLVGAIFICF

SEQ ID NO: 15601 - protein, 10 aa, BK virus
LVGAIFICFK

SEQ ID NO: 15602 - protein, 10 aa, BK virus
VGAIFICFKS

SEQ ID NO: 15603 - protein, 10 aa, BK virus
GAIFICFKSR

SEQ ID NO: 15604 - protein, 10 aa, BK virus
AIFICFKSRC

SEQ ID NO: 15605 - protein, 10 aa, BK virus
IFICFKSRCY

SEQ ID NO: 15606 - protein, 10 aa, BK virus
FICFKSRCYS

SEQ ID NO: 15607 - protein, 10 aa, BK virus
ICFKSRCYSP

SEQ ID NO: 15608 - protein, 10 aa, BK virus
CFKSRCYSPV

SEQ ID NO: 15609 - protein, 10 aa, BK virus
FKSRCYSPVQ

SEQ ID NO: 15610 - protein, 10 aa, BK virus
KSRCYSPVQA

SEQ ID NO: 15611 - protein, 10 aa, BK virus
RQHPLRSSSL

SEQ ID NO: 15612 - protein, 10 aa, BK virus
QHPLRSSSLI

SEQ ID NO: 15613 - protein, 10 aa, BK virus
HPLRSSSLIS

SEQ ID NO: 15614 - protein, 10 aa, BK virus
PLRSSSLIST

SEQ ID NO: 15615 - protein, 10 aa, BK virus
LRSSSLISTS

SEQ ID NO: 15616 - protein, 10 aa, BK virus
RSSSLISTSW

SEQ ID NO: 15617 - protein, 10 aa, BK virus
SSSLISTSWG

SEQ ID NO: 15618 - protein, 10 aa, BK virus
SSLISTSWGN

SEQ ID NO: 15619 - protein, 10 aa, BK virus
SLISTSWGNS

SEQ ID NO: 15620 - protein, 10 aa, BK virus
LISTSWGNSF

SEQ ID NO: 15621 - protein, 10 aa, BK virus
ISTSWGNSFF

SEQ ID NO: 15622 - protein, 10 aa, BK virus
STSWGNSFFY

SEQ ID NO: 15623 - protein, 10 aa, BK virus
TSWGNSFFYK

SEQ ID NO: 15624 - protein, 10 aa, BK virus
SWGNSFFYKL

SEQ ID NO: 15625 - protein, 10 aa, BK virus
WGNSFFYKLS

SEQ ID NO: 15626 - protein, 10 aa, BK virus
VHSLCNFFYT

SEQ ID NO: 15627 - protein, 10 aa, BK virus
HSLCNFFYTV

SEQ ID NO: 15628 - protein, 10 aa, BK virus
SLCNFFYTVS

SEQ ID NO: 15629 - protein, 10 aa, BK virus
LCNFFYTVSI

SEQ ID NO: 15630 - protein, 10 aa, BK virus
CNFFYTVSII

SEQ ID NO: 15631 - protein, 10 aa, BK virus
NFFYTVSIIY

SEQ ID NO: 15632 - protein, 10 aa, BK virus
FFYTVSIIYT

SEQ ID NO: 15633 - protein, 10 aa, BK virus
FYTVSIIYTI

SEQ ID NO: 15634 - protein, 10 aa, BK virus
YTVSIIYTIS

SEQ ID NO: 15635 - protein, 10 aa, BK virus
TVSIIYTISM

SEQ ID NO: 15636 - protein, 10 aa, BK virus
VSIIYTISMA

SEQ ID NO: 15637 - protein, 10 aa, BK virus
SIIYTISMAK

SEQ ID NO: 15638 - protein, 10 aa, BK virus
IIYTISMAKM

SEQ ID NO: 15639 - protein, 10 aa, BK virus
IYTISMAKMY

SEQ ID NO: 15640 - protein, 10 aa, BK virus
YTISMAKMYT

SEQ ID NO: 15641 - protein, 10 aa, BK virus
TISMAKMYTG

SEQ ID NO: 15642 - protein, 10 aa, BK virus
ISMAKMYTGT

SEQ ID NO: 15643 - protein, 10 aa, BK virus
SMAKMYTGTF

SEQ ID NO: 15644 - protein, 10 aa, BK virus
MAKMYTGTFP

SEQ ID NO: 15645 - protein, 10 aa, BK virus
AKMYTGTFPF

SEQ ID NO: 15646 - protein, 10 aa, BK virus
KMYTGTFPFS

SEQ ID NO: 15647 - protein, 10 aa, BK virus
MYTGTFPFSY

SEQ ID NO: 15648 - protein, 10 aa, BK virus
YTGTFPFSYL

SEQ ID NO: 15649 - protein, 10 aa, BK virus
TGTFPFSYLS

SEQ ID NO: 15650 - protein, 10 aa, BK virus
GTFPFSYLSN

SEQ ID NO: 15651 - protein, 10 aa, BK virus
TFPFSYLSNH

SEQ ID NO: 15652 - protein, 10 aa, BK virus
GPNRGKIRII

SEQ ID NO: 15653 - protein, 10 aa, BK virus
PNRGKIRIIL

SEQ ID NO: 15654 - protein, 10 aa, BK virus
NRGKIRIILL

SEQ ID NO: 15655 - protein, 10 aa, BK virus
RGKIRIILLN

SEQ ID NO: 15656 - protein, 10 aa, BK virus
GKIRIILLNI

SEQ ID NO: 15657 - protein, 10 aa, BK virus
KIRIILLNII

SEQ ID NO: 15658 - protein, 10 aa, BK virus
IRIILLNIII

SEQ ID NO: 15659 - protein, 10 aa, BK virus
RIILLNIIIK

SEQ ID NO: 15660 - protein, 10 aa, BK virus
IILLNIIIKV

SEQ ID NO: 15661 - protein, 10 aa, BK virus
ILLNIIIKVY

SEQ ID NO: 15662 - protein, 10 aa, BK virus
LLNIIIKVYR

SEQ ID NO: 15663 - protein, 10 aa, BK virus
LNIIIKVYRG

SEQ ID NO: 15664 - protein, 10 aa, BK virus
NIIIKVYRGI

SEQ ID NO: 15665 - protein, 10 aa, BK virus
IIIKVYRGIY

SEQ ID NO: 15666 - protein, 10 aa, BK virus
IIKVYRGIYN

SEQ ID NO: 15667 - protein, 10 aa, BK virus
IKVYRGIYNC

SEQ ID NO: 15668 - protein, 10 aa, BK virus
KVYRGIYNCP

SEQ ID NO: 15669 - protein, 10 aa, BK virus
VYRGIYNCPG

SEQ ID NO: 15670 - protein, 10 aa, BK virus
YRGIYNCPGS

SEQ ID NO: 15671 - protein, 10 aa, BK virus
RGIYNCPGSF

SEQ ID NO: 15672 - protein, 10 aa, BK virus
GIYNCPGSFL

SEQ ID NO: 15673 - protein, 10 aa, BK virus
IYNCPGSFLQ

SEQ ID NO: 15674 - protein, 10 aa, BK virus
YNCPGSFLQK

SEQ ID NO: 15675 - protein, 10 aa, BK virus
NCPGSFLQKS

SEQ ID NO: 15676 - protein, 10 aa, BK virus
CPGSFLQKSS

SEQ ID NO: 15677 - protein, 10 aa, BK virus
PGSFLQKSSQ

SEQ ID NO: 15678 - protein, 10 aa, BK virus
GSFLQKSSQG

SEQ ID NO: 15679 - protein, 10 aa, BK virus
SFLQKSSQGV

SEQ ID NO: 15680 - protein, 10 aa, BK virus
FLQKSSQGVS

SEQ ID NO: 15681 - protein, 10 aa, BK virus
LQKSSQGVSK

SEQ ID NO: 15682 - protein, 10 aa, BK virus
QKSSQGVSKK

SEQ ID NO: 15683 - protein, 10 aa, BK virus
KSSQGVSKKS

SEQ ID NO: 15684 - protein, 10 aa, BK virus
SSQGVSKKSF

SEQ ID NO: 15685 - protein, 10 aa, BK virus
SQGVSKKSFC

SEQ ID NO: 15686 - protein, 10 aa, BK virus
QGVSKKSFCS

SEQ ID NO: 15687 - protein, 10 aa, BK virus
GVSKKSFCSS

SEQ ID NO: 15688 - protein, 10 aa, BK virus
VSKKSFCSSL

SEQ ID NO: 15689 - protein, 10 aa, BK virus
SKKSFCSSLQ

SEQ ID NO: 15690 - protein, 10 aa, BK virus
KKSFCSSLQF

SEQ ID NO: 15691 - protein, 10 aa, BK virus
KSFCSSLQFL

SEQ ID NO: 15692 - protein, 10 aa, BK virus
GYRRYIIPNN

SEQ ID NO: 15693 - protein, 10 aa, BK virus
YRRYIIPNNM

SEQ ID NO: 15694 - protein, 10 aa, BK virus
RRYIIPNNMP

SEQ ID NO: 15695 - protein, 10 aa, BK virus
RYIIPNNMPQ

SEQ ID NO: 15696 - protein, 10 aa, BK virus
YIIPNNMPQS

SEQ ID NO: 15697 - protein, 10 aa, BK virus
IIPNNMPQSL

SEQ ID NO: 15698 - protein, 10 aa, BK virus
IPNNMPQSLG

SEQ ID NO: 15699 - protein, 10 aa, BK virus
PNNMPQSLGN

SEQ ID NO: 15700 - protein, 10 aa, BK virus
NNMPQSLGNS

SEQ ID NO: 15701 - protein, 10 aa, BK virus
NMPQSLGNSS

SEQ ID NO: 15702 - protein, 10 aa, BK virus
MPQSLGNSSK

SEQ ID NO: 15703 - protein, 10 aa, BK virus
PQSLGNSSKQ

SEQ ID NO: 15704 - protein, 10 aa, BK virus
QSLGNSSKQR

SEQ ID NO: 15705 - protein, 10 aa, BK virus
SLGNSSKQRR

SEQ ID NO: 15706 - protein, 10 aa, BK virus
LGNSSKQRRT

SEQ ID NO: 15707 - protein, 10 aa, BK virus
GNSSKQRRTP

SEQ ID NO: 15708 - protein, 10 aa, BK virus
NSSKQRRTPM

SEQ ID NO: 15709 - protein, 10 aa, BK virus
SSKQRRTPMP

SEQ ID NO: 15710 - protein, 10 aa, BK virus
SKQRRTPMPR

SEQ ID NO: 15711 - protein, 10 aa, BK virus
KQRRTPMPRI

SEQ ID NO: 15712 - protein, 10 aa, BK virus
QRRTPMPRIK

SEQ ID NO: 15713 - protein, 10 aa, BK virus
RRTPMPRIKV

SEQ ID NO: 15714 - protein, 10 aa, BK virus
RTPMPRIKVL

SEQ ID NO: 15715 - protein, 10 aa, BK virus
TPMPRIKVLN

SEQ ID NO: 15716 - protein, 10 aa, BK virus
PMPRIKVLNI

SEQ ID NO: 15717 - protein, 10 aa, BK virus
MPRIKVLNII

SEQ ID NO: 15718 - protein, 10 aa, BK virus
PRIKVLNIIN

SEQ ID NO: 15719 - protein, 10 aa, BK virus
RIKVLNIINK

SEQ ID NO: 15720 - protein, 10 aa, BK virus
IKVLNIINKS

SEQ ID NO: 15721 - protein, 10 aa, BK virus
KVLNIINKSI

SEQ ID NO: 15722 - protein, 10 aa, BK virus
VLNIINKSIY

SEQ ID NO: 15723 - protein, 10 aa, BK virus
LNIINKSIYT

SEQ ID NO: 15724 - protein, 10 aa, BK virus
NIINKSIYTR

SEQ ID NO: 15725 - protein, 10 aa, BK virus
IINKSIYTRK

SEQ ID NO: 15726 - protein, 10 aa, BK virus
INKSIYTRKQ

SEQ ID NO: 15727 - protein, 10 aa, BK virus
NKSIYTRKQN

SEQ ID NO: 15728 - protein, 10 aa, BK virus
KSIYTRKQNI

SEQ ID NO: 15729 - protein, 10 aa, BK virus
SIYTRKQNII

SEQ ID NO: 15730 - protein, 10 aa, BK virus
IYTRKQNIIV

SEQ ID NO: 15731 - protein, 10 aa, BK virus
YTRKQNIIVL

SEQ ID NO: 15732 - protein, 10 aa, BK virus
TRKQNIIVLI

SEQ ID NO: 15733 - protein, 10 aa, BK virus
RKQNIIVLIW

SEQ ID NO: 15734 - protein, 10 aa, BK virus
KQNIIVLIWV

SEQ ID NO: 15735 - protein, 10 aa, BK virus
QNIIVLIWVK

SEQ ID NO: 15736 - protein, 10 aa, BK virus
NIIVLIWVKQ

SEQ ID NO: 15737 - protein, 10 aa, BK virus
IIVLIWVKQF

SEQ ID NO: 15738 - protein, 10 aa, BK virus
IVLIWVKQFQ

SEQ ID NO: 15739 - protein, 10 aa, BK virus
VLIWVKQFQS

SEQ ID NO: 15740 - protein, 10 aa, BK virus
LIWVKQFQSH

SEQ ID NO: 15741 - protein, 10 aa, BK virus
IWVKQFQSHA

SEQ ID NO: 15742 - protein, 10 aa, BK virus
LLIEAYSGNF

SEQ ID NO: 15743 - protein, 10 aa, BK virus
LIEAYSGNFV

SEQ ID NO: 15744 - protein, 10 aa, BK virus
IEAYSGNFVI

SEQ ID NO: 15745 - protein, 10 aa, BK virus
EAYSGNFVIP

SEQ ID NO: 15746 - protein, 10 aa, BK virus
AYSGNFVIPI

SEQ ID NO: 15747 - protein, 10 aa, BK virus
YSGNFVIPII

SEQ ID NO: 15748 - protein, 10 aa, BK virus
SGNFVIPIIK

SEQ ID NO: 15749 - protein, 10 aa, BK virus
GNFVIPIIKE

SEQ ID NO: 15750 - protein, 10 aa, BK virus
NFVIPIIKEL

SEQ ID NO: 15751 - protein, 10 aa, BK virus
FVIPIIKELI

SEQ ID NO: 15752 - protein, 10 aa, BK virus
VIPIIKELIP

SEQ ID NO: 15753 - protein, 10 aa, BK virus
IPIIKELIPY

SEQ ID NO: 15754 - protein, 10 aa, BK virus
PIIKELIPYL

SEQ ID NO: 15755 - protein, 10 aa, BK virus
IIKELIPYLS

SEQ ID NO: 15756 - protein, 10 aa, BK virus
SSKPSNSPRS

SEQ ID NO: 15757 - protein, 10 aa, BK virus
SKPSNSPRST

SEQ ID NO: 15758 - protein, 10 aa, BK virus
KPSNSPRSTS

SEQ ID NO: 15759 - protein, 10 aa, BK virus
PSNSPRSTSN

SEQ ID NO: 15760 - protein, 10 aa, BK virus
SNSPRSTSNY

SEQ ID NO: 15761 - protein, 10 aa, BK virus
NSPRSTSNYS

SEQ ID NO: 15762 - protein, 10 aa, BK virus
SPRSTSNYSI

SEQ ID NO: 15763 - protein, 10 aa, BK virus
PRSTSNYSIC

SEQ ID NO: 15764 - protein, 10 aa, BK virus
RSTSNYSICL

SEQ ID NO: 15765 - protein, 10 aa, BK virus
STSNYSICLR

SEQ ID NO: 15766 - protein, 10 aa, BK virus
TSNYSICLRS

SEQ ID NO: 15767 - protein, 10 aa, BK virus
GTCYALYSSK

SEQ ID NO: 15768 - protein, 10 aa, BK virus
TCYALYSSKG

SEQ ID NO: 15769 - protein, 10 aa, BK virus
CYALYSSKGC

SEQ ID NO: 15770 - protein, 10 aa, BK virus
YALYSSKGCN

SEQ ID NO: 15771 - protein, 10 aa, BK virus
ALYSSKGCNL

SEQ ID NO: 15772 - protein, 10 aa, BK virus
LYSSKGCNLN

SEQ ID NO: 15773 - protein, 10 aa, BK virus
YSSKGCNLNF

SEQ ID NO: 15774 - protein, 10 aa, BK virus
SSKGCNLNFY

SEQ ID NO: 15775 - protein, 10 aa, BK virus
SKGCNLNFYS

SEQ ID NO: 15776 - protein, 10 aa, BK virus
KGCNLNFYSS

SEQ ID NO: 15777 - protein, 10 aa, BK virus
GCNLNFYSSS

SEQ ID NO: 15778 - protein, 10 aa, BK virus
CNLNFYSSSS

SEQ ID NO: 15779 - protein, 10 aa, BK virus
NLNFYSSSSL

SEQ ID NO: 15780 - protein, 10 aa, BK virus
LNFYSSSSLP

SEQ ID NO: 15781 - protein, 10 aa, BK virus
NFYSSSSLPS

SEQ ID NO: 15782 - protein, 10 aa, BK virus
FYSSSSLPSS

SEQ ID NO: 15783 - protein, 10 aa, BK virus
YSSSSLPSSN

SEQ ID NO: 15784 - protein, 10 aa, BK virus
SSSSLPSSNF

SEQ ID NO: 15785 - protein, 10 aa, BK virus
SSSLPSSNFS

SEQ ID NO: 15786 - protein, 10 aa, BK virus
SSLPSSNFSH

SEQ ID NO: 15787 - protein, 10 aa, BK virus
KSCGSSSLRY

SEQ ID NO: 15788 - protein, 10 aa, BK virus
SCGSSSLRYT

SEQ ID NO: 15789 - protein, 10 aa, BK virus
CGSSSLRYTG

SEQ ID NO: 15790 - protein, 10 aa, BK virus
GSSSLRYTGN

SEQ ID NO: 15791 - protein, 10 aa, BK virus
SSTHEPGNTK

SEQ ID NO: 15792 - protein, 10 aa, BK virus
STHEPGNTKK

SEQ ID NO: 15793 - protein, 10 aa, BK virus
THEPGNTKKK

SEQ ID NO: 15794 - protein, 10 aa, BK virus
HEPGNTKKKG

SEQ ID NO: 15795 - protein, 10 aa, BK virus
EPGNTKKKGL

SEQ ID NO: 15796 - protein, 10 aa, BK virus
PGNTKKKGLL

SEQ ID NO: 15797 - protein, 10 aa, BK virus
GNTKKKGLLT

SEQ ID NO: 15798 - protein, 10 aa, BK virus
ESFTESFTAG

SEQ ID NO: 15799 - protein, 10 aa, BK virus
SFTESFTAGK

SEQ ID NO: 15800 - protein, 10 aa, BK virus
FTESFTAGKA

SEQ ID NO: 15801 - protein, 10 aa, BK virus
TESFTAGKAV

SEQ ID NO: 15802 - protein, 10 aa, BK virus
ESFTAGKAVV

SEQ ID NO: 15803 - protein, 10 aa, BK virus
SFTAGKAVVL

SEQ ID NO: 15804 - protein, 10 aa, BK virus
FTAGKAVVLL

SEQ ID NO: 15805 - protein, 10 aa, BK virus
TAGKAVVLLF

SEQ ID NO: 15806 - protein, 10 aa, BK virus
AGKAVVLLFF

SEQ ID NO: 15807 - protein, 10 aa, BK virus
GKAVVLLFFP

SEQ ID NO: 15808 - protein, 10 aa, BK virus
KAVVLLFFPS

SEQ ID NO: 15809 - protein, 10 aa, BK virus
AVVLLFFPST

SEQ ID NO: 15810 - protein, 10 aa, BK virus
VVLLFFPSTL

SEQ ID NO: 15811 - protein, 10 aa, BK virus
VLLFFPSTLS

SEQ ID NO: 15812 - protein, 10 aa, BK virus
LLFFPSTLSS

SEQ ID NO: 15813 - protein, 10 aa, BK virus
LFFPSTLSSP

SEQ ID NO: 15814 - protein, 10 aa, BK virus
FFPSTLSSPL

SEQ ID NO: 15815 - protein, 10 aa, BK virus
FPSTLSSPLQ

SEQ ID NO: 15816 - protein, 10 aa, BK virus
PSTLSSPLQN

SEQ ID NO: 15817 - protein, 10 aa, BK virus
STLSSPLQNS

SEQ ID NO: 15818 - protein, 10 aa, BK virus
TLSSPLQNSS

SEQ ID NO: 15819 - protein, 10 aa, BK virus
LSSPLQNSSK

SEQ ID NO: 15820 - protein, 10 aa, BK virus
SSPLQNSSKS

SEQ ID NO: 15821 - protein, 10 aa, BK virus
SPLQNSSKSS

SEQ ID NO: 15822 - protein, 10 aa, BK virus
PLQNSSKSSK

SEQ ID NO: 15823 - protein, 10 aa, BK virus
LQNSSKSSKI

SEQ ID NO: 15824 - protein, 10 aa, BK virus
QNSSKSSKIK

SEQ ID NO: 15825 - protein, 10 aa, BK virus
NSSKSSKIKI

SEQ ID NO: 15826 - protein, 10 aa, BK virus
SSKSSKIKIK

SEQ ID NO: 15827 - protein, 10 aa, BK virus
SKSSKIKIKI

SEQ ID NO: 15828 - protein, 10 aa, BK virus
KSSKIKIKIL

SEQ ID NO: 15829 - protein, 10 aa, BK virus
ALFFVPVQVL

SEQ ID NO: 15830 - protein, 10 aa, BK virus
LFFVPVQVLP

SEQ ID NO: 15831 - protein, 10 aa, BK virus
FFVPVQVLPT

SEQ ID NO: 15832 - protein, 10 aa, BK virus
FVPVQVLPTF

SEQ ID NO: 15833 - protein, 10 aa, BK virus
VPVQVLPTFT

SEQ ID NO: 15834 - protein, 10 aa, BK virus
PVQVLPTFTE

SEQ ID NO: 15835 - protein, 10 aa, BK virus
VQVLPTFTEA

SEQ ID NO: 15836 - protein, 10 aa, BK virus
QVLPTFTEAC

SEQ ID NO: 15837 - protein, 10 aa, BK virus
VLPTFTEACR

SEQ ID NO: 15838 - protein, 10 aa, BK virus
LPTFTEACRD

SEQ ID NO: 15839 - protein, 10 aa, BK virus
PTFTEACRDS

SEQ ID NO: 15840 - protein, 10 aa, BK virus
TFTEACRDSW

SEQ ID NO: 15841 - protein, 10 aa, BK virus
FTEACRDSWR

SEQ ID NO: 15842 - protein, 10 aa, BK virus
TEACRDSWRR

SEQ ID NO: 15843 - protein, 10 aa, BK virus
EACRDSWRRT

SEQ ID NO: 15844 - protein, 10 aa, BK virus
ACRDSWRRTM

SEQ ID NO: 15845 - protein, 10 aa, BK virus
CRDSWRRTMA

SEQ ID NO: 15846 - protein, 10 aa, BK virus
RDSWRRTMAF

SEQ ID NO: 15847 - protein, 10 aa, BK virus
DSWRRTMAFV

SEQ ID NO: 15848 - protein, 10 aa, BK virus
SWRRTMAFVQ

SEQ ID NO: 15849 - protein, 10 aa, BK virus
WRRTMAFVQF

SEQ ID NO: 15850 - protein, 10 aa, BK virus
RRTMAFVQFN

SEQ ID NO: 15851 - protein, 10 aa, BK virus
RTMAFVQFNW

SEQ ID NO: 15852 - protein, 10 aa, BK virus
TMAFVQFNWG

SEQ ID NO: 15853 - protein, 10 aa, BK virus
MAFVQFNWGQ

SEQ ID NO: 15854 - protein, 10 aa, BK virus
AFVQFNWGQG

SEQ ID NO: 15855 - protein, 10 aa, BK virus
FVQFNWGQGQ

SEQ ID NO: 15856 - protein, 10 aa, BK virus
VQFNWGQGQD

SEQ ID NO: 15857 - protein, 10 aa, BK virus
QFNWGQGQDS

SEQ ID NO: 15858 - protein, 10 aa, BK virus
ARKTCLSCTF

SEQ ID NO: 15859 - protein, 10 aa, BK virus
RKTCLSCTFL

SEQ ID NO: 15860 - protein, 10 aa, BK virus
KTCLSCTFLP

SEQ ID NO: 15861 - protein, 10 aa, BK virus
TCLSCTFLPE

SEQ ID NO: 15862 - protein, 10 aa, BK virus
CLSCTFLPEV

SEQ ID NO: 15863 - protein, 10 aa, BK virus
LSCTFLPEVM

SEQ ID NO: 15864 - protein, 10 aa, BK virus
SCTFLPEVMV

SEQ ID NO: 15865 - protein, 10 aa, BK virus
CTFLPEVMVW

SEQ ID NO: 15866 - protein, 10 aa, BK virus
TFLPEVMVWL

SEQ ID NO: 15867 - protein, 10 aa, BK virus
FLPEVMVWLH

SEQ ID NO: 15868 - protein, 10 aa, BK virus
LPEVMVWLHS

SEQ ID NO: 15869 - protein, 10 aa, BK virus
PEVMVWLHSM

SEQ ID NO: 15870 - protein, 10 aa, BK virus
EVMVWLHSMG

SEQ ID NO: 15871 - protein, 10 aa, BK virus
VMVWLHSMGK

SEQ ID NO: 15872 - protein, 10 aa, BK virus
MVWLHSMGKQ

SEQ ID NO: 15873 - protein, 10 aa, BK virus
VWLHSMGKQL

SEQ ID NO: 15874 - protein, 10 aa, BK virus
WLHSMGKQLL

SEQ ID NO: 15875 - protein, 10 aa, BK virus
LHSMGKQLLP

SEQ ID NO: 15876 - protein, 10 aa, BK virus
HSMGKQLLPV

SEQ ID NO: 15877 - protein, 10 aa, BK virus
SMGKQLLPVS

SEQ ID NO: 15878 - protein, 10 aa, BK virus
MGKQLLPVSH

SEQ ID NO: 15879 - protein, 10 aa, BK virus
GKQLLPVSHA

SEQ ID NO: 15880 - protein, 10 aa, BK virus
KQLLPVSHAL

SEQ ID NO: 15881 - protein, 10 aa, BK virus
QLLPVSHALS

SEQ ID NO: 15882 - protein, 10 aa, BK virus
LLPVSHALSF

SEQ ID NO: 15883 - protein, 10 aa, BK virus
LPVSHALSFL

SEQ ID NO: 15884 - protein, 10 aa, BK virus
PVSHALSFLR

SEQ ID NO: 15885 - protein, 10 aa, BK virus
VSHALSFLRS

SEQ ID NO: 15886 - protein, 10 aa, BK virus
SHALSFLRSW

SEQ ID NO: 15887 - protein, 10 aa, BK virus
HALSFLRSWF

SEQ ID NO: 15888 - protein, 10 aa, BK virus
ALSFLRSWFG

SEQ ID NO: 15889 - protein, 10 aa, BK virus
LSFLRSWFGC

SEQ ID NO: 15890 - protein, 10 aa, BK virus
SFLRSWFGCI

SEQ ID NO: 15891 - protein, 10 aa, BK virus
FLRSWFGCIP

SEQ ID NO: 15892 - protein, 10 aa, BK virus
LRSWFGCIPL

SEQ ID NO: 15893 - protein, 10 aa, BK virus
AAPPCGLFFY

SEQ ID NO: 15894 - protein, 10 aa, BK virus
APPCGLFFYN

SEQ ID NO: 15895 - protein, 10 aa, BK virus
PPCGLFFYNI

SEQ ID NO: 15896 - protein, 10 aa, BK virus
EAEAASASTL

SEQ ID NO: 15897 - protein, 10 aa, BK virus
AEAASASTLS

SEQ ID NO: 15898 - protein, 10 aa, BK virus
EAASASTLSL

SEQ ID NO: 15899 - protein, 10 aa, BK virus
AASASTLSLK

SEQ ID NO: 15900 - protein, 10 aa, BK virus
GLAKLFGEIP

SEQ ID NO: 15901 - protein, 10 aa, BK virus
LAKLFGEIPI

SEQ ID NO: 15902 - protein, 10 aa, BK virus
AKLFGEIPIL

SEQ ID NO: 15903 - protein, 10 aa, BK virus
KLFGEIPILL

SEQ ID NO: 15904 - protein, 10 aa, BK virus
LFGEIPILLQ

SEQ ID NO: 15905 - protein, 10 aa, BK virus
FGEIPILLQF

SEQ ID NO: 15906 - protein, 10 aa, BK virus
GEIPILLQFL

SEQ ID NO: 15907 - protein, 10 aa, BK virus
EIPILLQFLQ

SEQ ID NO: 15908 - protein, 11 aa, BK virus
MDKVLNREESM

SEQ ID NO: 15909 - protein, 11 aa, BK virus
DKVLNREESME

SEQ ID NO: 15910 - protein, 11 aa, BK virus
KVLNREESMEL

SEQ ID NO: 15911 - protein, 11 aa, BK virus
VLNREESMELM

SEQ ID NO: 15912 - protein, 11 aa, BK virus
LNREESMELMD

SEQ ID NO: 15913 - protein, 11 aa, BK virus
NREESMELMDL

SEQ ID NO: 15914 - protein, 11 aa, BK virus
REESMELMDLL

SEQ ID NO: 15915 - protein, 11 aa, BK virus
EESMELMDLLG

SEQ ID NO: 15916 - protein, 11 aa, BK virus
ESMELMDLLGL

SEQ ID NO: 15917 - protein, 11 aa, BK virus
SMELMDLLGLE

SEQ ID NO: 15918 - protein, 11 aa, BK virus
MELMDLLGLER

SEQ ID NO: 15919 - protein, 11 aa, BK virus
ELMDLLGLERA

SEQ ID NO: 15920 - protein, 11 aa, BK virus
LMDLLGLERAA

SEQ ID NO: 15921 - protein, 11 aa, BK virus
MDLLGLERAAW

SEQ ID NO: 15922 - protein, 11 aa, BK virus
DLLGLERAAWG

SEQ ID NO: 15923 - protein, 11 aa, BK virus
LLGLERAAWGN

SEQ ID NO: 15924 - protein, 11 aa, BK virus
LGLERAAWGNL

SEQ ID NO: 15925 - protein, 11 aa, BK virus
GLERAAWGNLP

SEQ ID NO: 15926 - protein, 11 aa, BK virus
LERAAWGNLPL

SEQ ID NO: 15927 - protein, 11 aa, BK virus
ERAAWGNLPLM

SEQ ID NO: 15928 - protein, 11 aa, BK virus
RAAWGNLPLMR

SEQ ID NO: 15929 - protein, 11 aa, BK virus
AAWGNLPLMRK

SEQ ID NO: 15930 - protein, 11 aa, BK virus
AWGNLPLMRKA

SEQ ID NO: 15931 - protein, 11 aa, BK virus
WGNLPLMRKAY

SEQ ID NO: 15932 - protein, 11 aa, BK virus
GNLPLMRKAYL

SEQ ID NO: 15933 - protein, 11 aa, BK virus
NLPLMRKAYLR

SEQ ID NO: 15934 - protein, 11 aa, BK virus
LPLMRKAYLRK

SEQ ID NO: 15935 - protein, 11 aa, BK virus
PLMRKAYLRKC

SEQ ID NO: 15936 - protein, 11 aa, BK virus
LMRKAYLRKCK

SEQ ID NO: 15937 - protein, 11 aa, BK virus
MRKAYLRKCKE

SEQ ID NO: 15938 - protein, 11 aa, BK virus
RKAYLRKCKEF

SEQ ID NO: 15939 - protein, 11 aa, BK virus
KAYLRKCKEFH

SEQ ID NO: 15940 - protein, 11 aa, BK virus
AYLRKCKEFHP

SEQ ID NO: 15941 - protein, 11 aa, BK virus
YLRKCKEFHPD

SEQ ID NO: 15942 - protein, 11 aa, BK virus
LRKCKEFHPDK

SEQ ID NO: 15943 - protein, 11 aa, BK virus
RKCKEFHPDKG

SEQ ID NO: 15944 - protein, 11 aa, BK virus
KCKEFHPDKGG

SEQ ID NO: 15945 - protein, 11 aa, BK virus
CKEFHPDKGGD

SEQ ID NO: 15946 - protein, 11 aa, BK virus
KEFHPDKGGDE

SEQ ID NO: 15947 - protein, 11 aa, BK virus
EFHPDKGGDED

SEQ ID NO: 15948 - protein, 11 aa, BK virus
FHPDKGGDEDK

SEQ ID NO: 15949 - protein, 11 aa, BK virus
HPDKGGDEDKM

SEQ ID NO: 15950 - protein, 11 aa, BK virus
PDKGGDEDKMK

SEQ ID NO: 15951 - protein, 11 aa, BK virus
DKGGDEDKMKR

SEQ ID NO: 15952 - protein, 11 aa, BK virus
KGGDEDKMKRM

SEQ ID NO: 15953 - protein, 11 aa, BK virus
GGDEDKMKRMN

SEQ ID NO: 15954 - protein, 11 aa, BK virus
GDEDKMKRMNT

SEQ ID NO: 15955 - protein, 11 aa, BK virus
DEDKMKRMNTL

SEQ ID NO: 15956 - protein, 11 aa, BK virus
EDKMKRMNTLY

SEQ ID NO: 15957 - protein, 11 aa, BK virus
DKMKRMNTLYK

SEQ ID NO: 15958 - protein, 11 aa, BK virus
KMKRMNTLYKK

SEQ ID NO: 15959 - protein, 11 aa, BK virus
MKRMNTLYKKM

SEQ ID NO: 15960 - protein, 11 aa, BK virus
KRMNTLYKKME

SEQ ID NO: 15961 - protein, 11 aa, BK virus
RMNTLYKKMEQ

SEQ ID NO: 15962 - protein, 11 aa, BK virus
MNTLYKKMEQD

SEQ ID NO: 15963 - protein, 11 aa, BK virus
NTLYKKMEQDV

SEQ ID NO: 15964 - protein, 11 aa, BK virus
TLYKKMEQDVK

SEQ ID NO: 15965 - protein, 11 aa, BK virus
LYKKMEQDVKV

SEQ ID NO: 15966 - protein, 11 aa, BK virus
YKKMEQDVKVA

SEQ ID NO: 15967 - protein, 11 aa, BK virus
KKMEQDVKVAH

SEQ ID NO: 15968 - protein, 11 aa, BK virus
KMEQDVKVAHQ

SEQ ID NO: 15969 - protein, 11 aa, BK virus
MEQDVKVAHQP

SEQ ID NO: 15970 - protein, 11 aa, BK virus
EQDVKVAHQPD

SEQ ID NO: 15971 - protein, 11 aa, BK virus
QDVKVAHQPDF

SEQ ID NO: 15972 - protein, 11 aa, BK virus
DVKVAHQPDFG

SEQ ID NO: 15973 - protein, 11 aa, BK virus
VKVAHQPDFGT

SEQ ID NO: 15974 - protein, 11 aa, BK virus
KVAHQPDFGTW

SEQ ID NO: 15975 - protein, 11 aa, BK virus
VAHQPDFGTWS

SEQ ID NO: 15976 - protein, 11 aa, BK virus
AHQPDFGTWSS

SEQ ID NO: 15977 - protein, 11 aa, BK virus
HQPDFGTWSSS

SEQ ID NO: 15978 - protein, 11 aa, BK virus
QPDFGTWSSSE

SEQ ID NO: 15979 - protein, 11 aa, BK virus
PDFGTWSSSEV

SEQ ID NO: 15980 - protein, 11 aa, BK virus
DFGTWSSSEVC

SEQ ID NO: 15981 - protein, 11 aa, BK virus
FGTWSSSEVCA

SEQ ID NO: 15982 - protein, 11 aa, BK virus
GTWSSSEVCAD

SEQ ID NO: 15983 - protein, 11 aa, BK virus
TWSSSEVCADF

SEQ ID NO: 15984 - protein, 11 aa, BK virus
WSSSEVCADFP

SEQ ID NO: 15985 - protein, 11 aa, BK virus
SSSEVCADFPL

SEQ ID NO: 15986 - protein, 11 aa, BK virus
SSEVCADFPLC

SEQ ID NO: 15987 - protein, 11 aa, BK virus
SEVCADFPLCP

SEQ ID NO: 15988 - protein, 11 aa, BK virus
EVCADFPLCPD

SEQ ID NO: 15989 - protein, 11 aa, BK virus
VCADFPLCPDT

SEQ ID NO: 15990 - protein, 11 aa, BK virus
CADFPLCPDTL

SEQ ID NO: 15991 - protein, 11 aa, BK virus
ADFPLCPDTLY

SEQ ID NO: 15992 - protein, 11 aa, BK virus
DFPLCPDTLYC

SEQ ID NO: 15993 - protein, 11 aa, BK virus
FPLCPDTLYCK

SEQ ID NO: 15994 - protein, 11 aa, BK virus
PLCPDTLYCKE

SEQ ID NO: 15995 - protein, 11 aa, BK virus
LCPDTLYCKEW

SEQ ID NO: 15996 - protein, 11 aa, BK virus
CPDTLYCKEWP

SEQ ID NO: 15997 - protein, 11 aa, BK virus
PDTLYCKEWPI

SEQ ID NO: 15998 - protein, 11 aa, BK virus
DTLYCKEWPIC

SEQ ID NO: 15999 - protein, 11 aa, BK virus
TLYCKEWPICS

SEQ ID NO: 16000 - protein, 11 aa, BK virus
LYCKEWPICSK

SEQ ID NO: 16001 - protein, 11 aa, BK virus
YCKEWPICSKK

SEQ ID NO: 16002 - protein, 11 aa, BK virus
CKEWPICSKKP

SEQ ID NO: 16003 - protein, 11 aa, BK virus
KEWPICSKKPS

SEQ ID NO: 16004 - protein, 11 aa, BK virus
EWPICSKKPSV

SEQ ID NO: 16005 - protein, 11 aa, BK virus
WPICSKKPSVH

SEQ ID NO: 16006 - protein, 11 aa, BK virus
PICSKKPSVHC

SEQ ID NO: 16007 - protein, 11 aa, BK virus
ICSKKPSVHCP

SEQ ID NO: 16008 - protein, 11 aa, BK virus
CSKKPSVHCPC

SEQ ID NO: 16009 - protein, 11 aa, BK virus
SKKPSVHCPCM

SEQ ID NO: 16010 - protein, 11 aa, BK virus
KKPSVHCPCML

SEQ ID NO: 16011 - protein, 11 aa, BK virus
KPSVHCPCMLC

SEQ ID NO: 16012 - protein, 11 aa, BK virus
PSVHCPCMLCQ

SEQ ID NO: 16013 - protein, 11 aa, BK virus
SVHCPCMLCQL

SEQ ID NO: 16014 - protein, 11 aa, BK virus
VHCPCMLCQLR

SEQ ID NO: 16015 - protein, 11 aa, BK virus
HCPCMLCQLRL

SEQ ID NO: 16016 - protein, 11 aa, BK virus
CPCMLCQLRLR

SEQ ID NO: 16017 - protein, 11 aa, BK virus
PCMLCQLRLRH

SEQ ID NO: 16018 - protein, 11 aa, BK virus
CMLCQLRLRHL

SEQ ID NO: 16019 - protein, 11 aa, BK virus
MLCQLRLRHLN

SEQ ID NO: 16020 - protein, 11 aa, BK virus
LCQLRLRHLNR

SEQ ID NO: 16021 - protein, 11 aa, BK virus
CQLRLRHLNRK

SEQ ID NO: 16022 - protein, 11 aa, BK virus
QLRLRHLNRKF

SEQ ID NO: 16023 - protein, 11 aa, BK virus
LRLRHLNRKFL

SEQ ID NO: 16024 - protein, 11 aa, BK virus
RLRHLNRKFLR

SEQ ID NO: 16025 - protein, 11 aa, BK virus
LRHLNRKFLRK

SEQ ID NO: 16026 - protein, 11 aa, BK virus
RHLNRKFLRKE

SEQ ID NO: 16027 - protein, 11 aa, BK virus
HLNRKFLRKEP

SEQ ID NO: 16028 - protein, 11 aa, BK virus
LNRKFLRKEPL

SEQ ID NO: 16029 - protein, 11 aa, BK virus
NRKFLRKEPLV

SEQ ID NO: 16030 - protein, 11 aa, BK virus
RKFLRKEPLVW

SEQ ID NO: 16031 - protein, 11 aa, BK virus
KFLRKEPLVWI

SEQ ID NO: 16032 - protein, 11 aa, BK virus
FLRKEPLVWID

SEQ ID NO: 16033 - protein, 11 aa, BK virus
LRKEPLVWIDC

SEQ ID NO: 16034 - protein, 11 aa, BK virus
RKEPLVWIDCY

SEQ ID NO: 16035 - protein, 11 aa, BK virus
KEPLVWIDCYC

SEQ ID NO: 16036 - protein, 11 aa, BK virus
EPLVWIDCYCI

SEQ ID NO: 16037 - protein, 11 aa, BK virus
PLVWIDCYCID

SEQ ID NO: 16038 - protein, 11 aa, BK virus
LVWIDCYCIDC

SEQ ID NO: 16039 - protein, 11 aa, BK virus
VWIDCYCIDCF

SEQ ID NO: 16040 - protein, 11 aa, BK virus
WIDCYCIDCFT

SEQ ID NO: 16041 - protein, 11 aa, BK virus
IDCYCIDCFTQ

SEQ ID NO: 16042 - protein, 11 aa, BK virus
DCYCIDCFTQW

SEQ ID NO: 16043 - protein, 11 aa, BK virus
CYCIDCFTQWF

SEQ ID NO: 16044 - protein, 11 aa, BK virus
YCIDCFTQWFG

SEQ ID NO: 16045 - protein, 11 aa, BK virus
CIDCFTQWFGL

SEQ ID NO: 16046 - protein, 11 aa, BK virus
IDCFTQWFGLD

SEQ ID NO: 16047 - protein, 11 aa, BK virus
DCFTQWFGLDL

SEQ ID NO: 16048 - protein, 11 aa, BK virus
CFTQWFGLDLT

SEQ ID NO: 16049 - protein, 11 aa, BK virus
FTQWFGLDLTE

SEQ ID NO: 16050 - protein, 11 aa, BK virus
TQWFGLDLTEE

SEQ ID NO: 16051 - protein, 11 aa, BK virus
QWFGLDLTEET

SEQ ID NO: 16052 - protein, 11 aa, BK virus
WFGLDLTEETL

SEQ ID NO: 16053 - protein, 11 aa, BK virus
FGLDLTEETLQ

SEQ ID NO: 16054 - protein, 11 aa, BK virus
GLDLTEETLQW

SEQ ID NO: 16055 - protein, 11 aa, BK virus
LDLTEETLQWW

SEQ ID NO: 16056 - protein, 11 aa, BK virus
DLTEETLQWWV

SEQ ID NO: 16057 - protein, 11 aa, BK virus
LTEETLQWWVQ

SEQ ID NO: 16058 - protein, 11 aa, BK virus
TEETLQWWVQI

SEQ ID NO: 16059 - protein, 11 aa, BK virus
EETLQWWVQII

SEQ ID NO: 16060 - protein, 11 aa, BK virus
ETLQWWVQIIG

SEQ ID NO: 16061 - protein, 11 aa, BK virus
TLQWWVQIIGE

SEQ ID NO: 16062 - protein, 11 aa, BK virus
LQWWVQIIGET

SEQ ID NO: 16063 - protein, 11 aa, BK virus
QWWVQIIGETP

SEQ ID NO: 16064 - protein, 11 aa, BK virus
WWVQIIGETPF

SEQ ID NO: 16065 - protein, 11 aa, BK virus
WVQIIGETPFR

SEQ ID NO: 16066 - protein, 11 aa, BK virus
VQIIGETPFRD

SEQ ID NO: 16067 - protein, 11 aa, BK virus
QIIGETPFRDL

SEQ ID NO: 16068 - protein, 11 aa, BK virus
IIGETPFRDLK

SEQ ID NO: 16069 - protein, 11 aa, BK virus
IGETPFRDLKL

SEQ ID NO: 16070 - protein, 11 aa, BK virus
KALSNYFFYRC

SEQ ID NO: 16071 - protein, 11 aa, BK virus
ALSNYFFYRCQ

SEQ ID NO: 16072 - protein, 11 aa, BK virus
LSNYFFYRCQP

SEQ ID NO: 16073 - protein, 11 aa, BK virus
SNYFFYRCQPM

SEQ ID NO: 16074 - protein, 11 aa, BK virus
NYFFYRCQPME

SEQ ID NO: 16075 - protein, 11 aa, BK virus
YFFYRCQPMEQ

SEQ ID NO: 16076 - protein, 11 aa, BK virus
FFYRCQPMEQK

SEQ ID NO: 16077 - protein, 11 aa, BK virus
FYRCQPMEQKS

SEQ ID NO: 16078 - protein, 11 aa, BK virus
YRCQPMEQKSG

SEQ ID NO: 16079 - protein, 11 aa, BK virus
RCQPMEQKSGS

SEQ ID NO: 16080 - protein, 11 aa, BK virus
CQPMEQKSGSP

SEQ ID NO: 16081 - protein, 11 aa, BK virus
QPMEQKSGSPG

SEQ ID NO: 16082 - protein, 11 aa, BK virus
PMEQKSGSPGG

SEQ ID NO: 16083 - protein, 11 aa, BK virus
MEQKSGSPGGV

SEQ ID NO: 16084 - protein, 11 aa, BK virus
EQKSGSPGGVP

SEQ ID NO: 16085 - protein, 11 aa, BK virus
QKSGSPGGVPL

SEQ ID NO: 16086 - protein, 11 aa, BK virus
KSGSPGGVPLM

SEQ ID NO: 16087 - protein, 11 aa, BK virus
SGSPGGVPLMK

SEQ ID NO: 16088 - protein, 11 aa, BK virus
GSPGGVPLMKN

SEQ ID NO: 16089 - protein, 11 aa, BK virus
SPGGVPLMKNG

SEQ ID NO: 16090 - protein, 11 aa, BK virus
PGGVPLMKNGM

SEQ ID NO: 16091 - protein, 11 aa, BK virus
GGVPLMKNGMK

SEQ ID NO: 16092 - protein, 11 aa, BK virus
GVPLMKNGMKI

SEQ ID NO: 16093 - protein, 11 aa, BK virus
VPLMKNGMKIY

SEQ ID NO: 16094 - protein, 11 aa, BK virus
PLMKNGMKIYF

SEQ ID NO: 16095 - protein, 11 aa, BK virus
LMKNGMKIYFA

SEQ ID NO: 16096 - protein, 11 aa, BK virus
MKNGMKIYFAM

SEQ ID NO: 16097 - protein, 11 aa, BK virus
KNGMKIYFAMK

SEQ ID NO: 16098 - protein, 11 aa, BK virus
NGMKIYFAMKI

SEQ ID NO: 16099 - protein, 11 aa, BK virus
GMKIYFAMKIC

SEQ ID NO: 16100 - protein, 11 aa, BK virus
MKIYFAMKICL

SEQ ID NO: 16101 - protein, 11 aa, BK virus
KIYFAMKICLP

SEQ ID NO: 16102 - protein, 11 aa, BK virus
IYFAMKICLPV

SEQ ID NO: 16103 - protein, 11 aa, BK virus
YFAMKICLPVM

SEQ ID NO: 16104 - protein, 11 aa, BK virus
FAMKICLPVMK

SEQ ID NO: 16105 - protein, 11 aa, BK virus
AMKICLPVMKK

SEQ ID NO: 16106 - protein, 11 aa, BK virus
MKICLPVMKKQ

SEQ ID NO: 16107 - protein, 11 aa, BK virus
KICLPVMKKQQ

SEQ ID NO: 16108 - protein, 11 aa, BK virus
ICLPVMKKQQQ

SEQ ID NO: 16109 - protein, 11 aa, BK virus
CLPVMKKQQQI

SEQ ID NO: 16110 - protein, 11 aa, BK virus
LPVMKKQQQIL

SEQ ID NO: 16111 - protein, 11 aa, BK virus
PVMKKQQQILN

SEQ ID NO: 16112 - protein, 11 aa, BK virus
VMKKQQQILNT

SEQ ID NO: 16113 - protein, 11 aa, BK virus
MKKQQQILNTQ

SEQ ID NO: 16114 - protein, 11 aa, BK virus
KKQQQILNTQH

SEQ ID NO: 16115 - protein, 11 aa, BK virus
KQQQILNTQHH

SEQ ID NO: 16116 - protein, 11 aa, BK virus
QQQILNTQHHP

SEQ ID NO: 16117 - protein, 11 aa, BK virus
QQILNTQHHPK

SEQ ID NO: 16118 - protein, 11 aa, BK virus
QILNTQHHPKK

SEQ ID NO: 16119 - protein, 11 aa, BK virus
ILNTQHHPKKK

SEQ ID NO: 16120 - protein, 11 aa, BK virus
LNTQHHPKKKE

SEQ ID NO: 16121 - protein, 11 aa, BK virus
NTQHHPKKKER

SEQ ID NO: 16122 - protein, 11 aa, BK virus
KTLKTFPLIYT

SEQ ID NO: 16123 - protein, 11 aa, BK virus
TLKTFPLIYTS

SEQ ID NO: 16124 - protein, 11 aa, BK virus
LKTFPLIYTSF

SEQ ID NO: 16125 - protein, 11 aa, BK virus
KTFPLIYTSFL

SEQ ID NO: 16126 - protein, 11 aa, BK virus
TFPLIYTSFLV

SEQ ID NO: 16127 - protein, 11 aa, BK virus
FPLIYTSFLVK

SEQ ID NO: 16128 - protein, 11 aa, BK virus
PLIYTSFLVKL

SEQ ID NO: 16129 - protein, 11 aa, BK virus
LIYTSFLVKLY

SEQ ID NO: 16130 - protein, 11 aa, BK virus
IYTSFLVKLYL

SEQ ID NO: 16131 - protein, 11 aa, BK virus
YTSFLVKLYLV

SEQ ID NO: 16132 - protein, 11 aa, BK virus
TSFLVKLYLVI

SEQ ID NO: 16133 - protein, 11 aa, BK virus
SFLVKLYLVIE

SEQ ID NO: 16134 - protein, 11 aa, BK virus
FLVKLYLVIEP

SEQ ID NO: 16135 - protein, 11 aa, BK virus
LVKLYLVIEPL

SEQ ID NO: 16136 - protein, 11 aa, BK virus
VKLYLVIEPLP

SEQ ID NO: 16137 - protein, 11 aa, BK virus
KLYLVIEPLPA

SEQ ID NO: 16138 - protein, 11 aa, BK virus
LYLVIEPLPAL

SEQ ID NO: 16139 - protein, 11 aa, BK virus
YLVIEPLPALL

SEQ ID NO: 16140 - protein, 11 aa, BK virus
LVIEPLPALLC

SEQ ID NO: 16141 - protein, 11 aa, BK virus
VIEPLPALLCI

SEQ ID NO: 16142 - protein, 11 aa, BK virus
IEPLPALLCIL

SEQ ID NO: 16143 - protein, 11 aa, BK virus
EPLPALLCILL

SEQ ID NO: 16144 - protein, 11 aa, BK virus
PLPALLCILLK

SEQ ID NO: 16145 - protein, 11 aa, BK virus
LPALLCILLKK

SEQ ID NO: 16146 - protein, 11 aa, BK virus
PALLCILLKKK

SEQ ID NO: 16147 - protein, 11 aa, BK virus
ALLCILLKKKL

SEQ ID NO: 16148 - protein, 11 aa, BK virus
LLCILLKKKLK

SEQ ID NO: 16149 - protein, 11 aa, BK virus
LCILLKKKLKF

SEQ ID NO: 16150 - protein, 11 aa, BK virus
CILLKKKLKFC

SEQ ID NO: 16151 - protein, 11 aa, BK virus
ILLKKKLKFCI

SEQ ID NO: 16152 - protein, 11 aa, BK virus
LLKKKLKFCIK

SEQ ID NO: 16153 - protein, 11 aa, BK virus
LKKKLKFCIKN

SEQ ID NO: 16154 - protein, 11 aa, BK virus
KKKLKFCIKNL

SEQ ID NO: 16155 - protein, 11 aa, BK virus
KKLKFCIKNLW

SEQ ID NO: 16156 - protein, 11 aa, BK virus
KLKFCIKNLWK

SEQ ID NO: 16157 - protein, 11 aa, BK virus
LKFCIKNLWKN

SEQ ID NO: 16158 - protein, 11 aa, BK virus
KFCIKNLWKNI

SEQ ID NO: 16159 - protein, 11 aa, BK virus
FCIKNLWKNIL

SEQ ID NO: 16160 - protein, 11 aa, BK virus
LLLVDTCVLGI

SEQ ID NO: 16161 - protein, 11 aa, BK virus
LLVDTCVLGII

SEQ ID NO: 16162 - protein, 11 aa, BK virus
LVDTCVLGIIL

SEQ ID NO: 16163 - protein, 11 aa, BK virus
VDTCVLGIILY

SEQ ID NO: 16164 - protein, 11 aa, BK virus
DTCVLGIILYS

SEQ ID NO: 16165 - protein, 11 aa, BK virus
TCVLGIILYSF

SEQ ID NO: 16166 - protein, 11 aa, BK virus
LHIDIEFLQLI

SEQ ID NO: 16167 - protein, 11 aa, BK virus
HIDIEFLQLII

SEQ ID NO: 16168 - protein, 11 aa, BK virus
IDIEFLQLIIS

SEQ ID NO: 16169 - protein, 11 aa, BK virus
DIEFLQLIISV

SEQ ID NO: 16170 - protein, 11 aa, BK virus
IEFLQLIISVK

SEQ ID NO: 16171 - protein, 11 aa, BK virus
EFLQLIISVKS

SEQ ID NO: 16172 - protein, 11 aa, BK virus
FLQLIISVKSC

SEQ ID NO: 16173 - protein, 11 aa, BK virus
LQLIISVKSCV

SEQ ID NO: 16174 - protein, 11 aa, BK virus
QLIISVKSCVP

SEQ ID NO: 16175 - protein, 11 aa, BK virus
LIISVKSCVPL

SEQ ID NO: 16176 - protein, 11 aa, BK virus
IISVKSCVPLV

SEQ ID NO: 16177 - protein, 11 aa, BK virus
ISVKSCVPLVF

SEQ ID NO: 16178 - protein, 11 aa, BK virus
FVRVLIRNTYY

SEQ ID NO: 16179 - protein, 11 aa, BK virus
VRVLIRNTYYI

SEQ ID NO: 16180 - protein, 11 aa, BK virus
RVLIRNTYYIV

SEQ ID NO: 16181 - protein, 11 aa, BK virus
VLIRNTYYIVP

SEQ ID NO: 16182 - protein, 11 aa, BK virus
RSMILAQKSLK

SEQ ID NO: 16183 - protein, 11 aa, BK virus
SMILAQKSLKK

SEQ ID NO: 16184 - protein, 11 aa, BK virus
MILAQKSLKKQ

SEQ ID NO: 16185 - protein, 11 aa, BK virus
ILAQKSLKKQS

SEQ ID NO: 16186 - protein, 11 aa, BK virus
LAQKSLKKQSR

SEQ ID NO: 16187 - protein, 11 aa, BK virus
AQKSLKKQSRC

SEQ ID NO: 16188 - protein, 11 aa, BK virus
QKSLKKQSRCL

SEQ ID NO: 16189 - protein, 11 aa, BK virus
KSLKKQSRCLG

SEQ ID NO: 16190 - protein, 11 aa, BK virus
SLKKQSRCLGN

SEQ ID NO: 16191 - protein, 11 aa, BK virus
RSVKSVRKKTS

SEQ ID NO: 16192 - protein, 11 aa, BK virus
SVKSVRKKTSL

SEQ ID NO: 16193 - protein, 11 aa, BK virus
VKSVRKKTSLI

SEQ ID NO: 16194 - protein, 11 aa, BK virus
KSVRKKTSLIT

SEQ ID NO: 16195 - protein, 11 aa, BK virus
SVRKKTSLITL

SEQ ID NO: 16196 - protein, 11 aa, BK virus
VRKKTSLITLS

SEQ ID NO: 16197 - protein, 11 aa, BK virus
RKKTSLITLSI

SEQ ID NO: 16198 - protein, 11 aa, BK virus
KKTSLITLSIM

SEQ ID NO: 16199 - protein, 11 aa, BK virus
KTSLITLSIMK

SEQ ID NO: 16200 - protein, 11 aa, BK virus
TSLITLSIMKS

SEQ ID NO: 16201 - protein, 11 aa, BK virus
SLITLSIMKST

SEQ ID NO: 16202 - protein, 11 aa, BK virus
LITLSIMKSTL

SEQ ID NO: 16203 - protein, 11 aa, BK virus
ITLSIMKSTLQ

SEQ ID NO: 16204 - protein, 11 aa, BK virus
TLSIMKSTLQM

SEQ ID NO: 16205 - protein, 11 aa, BK virus
LSIMKSTLQML

SEQ ID NO: 16206 - protein, 11 aa, BK virus
SIMKSTLQMLL

SEQ ID NO: 16207 - protein, 11 aa, BK virus
IMKSTLQMLLF

SEQ ID NO: 16208 - protein, 11 aa, BK virus
MKSTLQMLLFL

SEQ ID NO: 16209 - protein, 11 aa, BK virus
KSTLQMLLFLQ

SEQ ID NO: 16210 - protein, 11 aa, BK virus
STLQMLLFLQK

SEQ ID NO: 16211 - protein, 11 aa, BK virus
TLQMLLFLQKV

SEQ ID NO: 16212 - protein, 11 aa, BK virus
LQMLLFLQKVK

SEQ ID NO: 16213 - protein, 11 aa, BK virus
QMLLFLQKVKI

SEQ ID NO: 16214 - protein, 11 aa, BK virus
MLLFLQKVKIK

SEQ ID NO: 16215 - protein, 11 aa, BK virus
LLFLQKVKIKK

SEQ ID NO: 16216 - protein, 11 aa, BK virus
LFLQKVKIKKV

SEQ ID NO: 16217 - protein, 11 aa, BK virus
FLQKVKIKKVF

SEQ ID NO: 16218 - protein, 11 aa, BK virus
LQKVKIKKVFV

SEQ ID NO: 16219 - protein, 11 aa, BK virus
QKVKIKKVFVS

SEQ ID NO: 16220 - protein, 11 aa, BK virus
KVKIKKVFVSK

SEQ ID NO: 16221 - protein, 11 aa, BK virus
VKIKKVFVSKQ

SEQ ID NO: 16222 - protein, 11 aa, BK virus
NNIWQVLLGCT

SEQ ID NO: 16223 - protein, 11 aa, BK virus
NIWQVLLGCTV

SEQ ID NO: 16224 - protein, 11 aa, BK virus
IWQVLLGCTVC

SEQ ID NO: 16225 - protein, 11 aa, BK virus
WQVLLGCTVCY

SEQ ID NO: 16226 - protein, 11 aa, BK virus
QVLLGCTVCYL

SEQ ID NO: 16227 - protein, 11 aa, BK virus
VLLGCTVCYLK

SEQ ID NO: 16228 - protein, 11 aa, BK virus
LLGCTVCYLKW

SEQ ID NO: 16229 - protein, 11 aa, BK virus
LGCTVCYLKWI

SEQ ID NO: 16230 - protein, 11 aa, BK virus
GCTVCYLKWIL

SEQ ID NO: 16231 - protein, 11 aa, BK virus
YLIFCTVLFSM

SEQ ID NO: 16232 - protein, 11 aa, BK virus
LIFCTVLFSMY

SEQ ID NO: 16233 - protein, 11 aa, BK virus
IFCTVLFSMYL

SEQ ID NO: 16234 - protein, 11 aa, BK virus
FCTVLFSMYLK

SEQ ID NO: 16235 - protein, 11 aa, BK virus
CTVLFSMYLKE

SEQ ID NO: 16236 - protein, 11 aa, BK virus
TVLFSMYLKED

SEQ ID NO: 16237 - protein, 11 aa, BK virus
VLFSMYLKEDT

SEQ ID NO: 16238 - protein, 11 aa, BK virus
LFSMYLKEDTG

SEQ ID NO: 16239 - protein, 11 aa, BK virus
FSMYLKEDTGY

SEQ ID NO: 16240 - protein, 11 aa, BK virus
SMYLKEDTGYL

SEQ ID NO: 16241 - protein, 11 aa, BK virus
MYLKEDTGYLK

SEQ ID NO: 16242 - protein, 11 aa, BK virus
YLKEDTGYLKV

SEQ ID NO: 16243 - protein, 11 aa, BK virus
LKEDTGYLKVP

SEQ ID NO: 16244 - protein, 11 aa, BK virus
KEDTGYLKVPL

SEQ ID NO: 16245 - protein, 11 aa, BK virus
EDTGYLKVPLI

SEQ ID NO: 16246 - protein, 11 aa, BK virus
DTGYLKVPLIV

SEQ ID NO: 16247 - protein, 11 aa, BK virus
TGYLKVPLIVE

SEQ ID NO: 16248 - protein, 11 aa, BK virus
GYLKVPLIVEK

SEQ ID NO: 16249 - protein, 11 aa, BK virus
YLKVPLIVEKQ

SEQ ID NO: 16250 - protein, 11 aa, BK virus
LKVPLIVEKQH

SEQ ID NO: 16251 - protein, 11 aa, BK virus
KGQELNQRICL

SEQ ID NO: 16252 - protein, 11 aa, BK virus
GQELNQRICLQ

SEQ ID NO: 16253 - protein, 11 aa, BK virus
QELNQRICLQD

SEQ ID NO: 16254 - protein, 11 aa, BK virus
ELNQRICLQDM

SEQ ID NO: 16255 - protein, 11 aa, BK virus
LNQRICLQDME

SEQ ID NO: 16256 - protein, 11 aa, BK virus
TKEPKYFHQAW

SEQ ID NO: 16257 - protein, 11 aa, BK virus
KEPKYFHQAWL

SEQ ID NO: 16258 - protein, 11 aa, BK virus
EPKYFHQAWLQ

SEQ ID NO: 16259 - protein, 11 aa, BK virus
MSILSLKPCKL

SEQ ID NO: 16260 - protein, 11 aa, BK virus
SILSLKPCKLD

SEQ ID NO: 16261 - protein, 11 aa, BK virus
ILSLKPCKLDL

SEQ ID NO: 16262 - protein, 11 aa, BK virus
ENPYKTQSSYL

SEQ ID NO: 16263 - protein, 11 aa, BK virus
NPYKTQSSYLK

SEQ ID NO: 16264 - protein, 11 aa, BK virus
PYKTQSSYLKK

SEQ ID NO: 16265 - protein, 11 aa, BK virus
YKTQSSYLKKE

SEQ ID NO: 16266 - protein, 11 aa, BK virus
KTQSSYLKKEF

SEQ ID NO: 16267 - protein, 11 aa, BK virus
TQSSYLKKEFY

SEQ ID NO: 16268 - protein, 11 aa, BK virus
QSSYLKKEFYK

SEQ ID NO: 16269 - protein, 11 aa, BK virus
SSYLKKEFYKV

SEQ ID NO: 16270 - protein, 11 aa, BK virus
SYLKKEFYKVE

SEQ ID NO: 16271 - protein, 11 aa, BK virus
LILQLIYNLEL

SEQ ID NO: 16272 - protein, 11 aa, BK virus
ILQLIYNLELL

SEQ ID NO: 16273 - protein, 11 aa, BK virus
LQLIYNLELLN

SEQ ID NO: 16274 - protein, 11 aa, BK virus
QLIYNLELLNG

SEQ ID NO: 16275 - protein, 11 aa, BK virus
LIYNLELLNGR

SEQ ID NO: 16276 - protein, 11 aa, BK virus
IYNLELLNGRK

SEQ ID NO: 16277 - protein, 11 aa, BK virus
YNLELLNGRKG

SEQ ID NO: 16278 - protein, 11 aa, BK virus
NLELLNGRKGW

SEQ ID NO: 16279 - protein, 11 aa, BK virus
LELLNGRKGWI

SEQ ID NO: 16280 - protein, 11 aa, BK virus
ELLNGRKGWIL

SEQ ID NO: 16281 - protein, 11 aa, BK virus
LLNGRKGWILR

SEQ ID NO: 16282 - protein, 11 aa, BK virus
NIIYAWGNVFL

SEQ ID NO: 16283 - protein, 11 aa, BK virus
IIYAWGNVFLI

SEQ ID NO: 16284 - protein, 11 aa, BK virus
IYAWGNVFLIL

SEQ ID NO: 16285 - protein, 11 aa, BK virus
YAWGNVFLILQ

SEQ ID NO: 16286 - protein, 11 aa, BK virus
AWGNVFLILQE

SEQ ID NO: 16287 - protein, 11 aa, BK virus
WGNVFLILQEK

SEQ ID NO: 16288 - protein, 11 aa, BK virus
GNVFLILQEKR

SEQ ID NO: 16289 - protein, 11 aa, BK virus
NVFLILQEKRI

SEQ ID NO: 16290 - protein, 11 aa, BK virus
VFLILQEKRIQ

SEQ ID NO: 16291 - protein, 11 aa, BK virus
FLILQEKRIQK

SEQ ID NO: 16292 - protein, 11 aa, BK virus
LILQEKRIQKL

SEQ ID NO: 16293 - protein, 11 aa, BK virus
ILQEKRIQKLK

SEQ ID NO: 16294 - protein, 11 aa, BK virus
LQEKRIQKLKT

SEQ ID NO: 16295 - protein, 11 aa, BK virus
QEKRIQKLKTL

SEQ ID NO: 16296 - protein, 11 aa, BK virus
EKRIQKLKTLD

SEQ ID NO: 16297 - protein, 11 aa, BK virus
KRIQKLKTLDM

SEQ ID NO: 16298 - protein, 11 aa, BK virus
RIQKLKTLDMD

SEQ ID NO: 16299 - protein, 11 aa, BK virus
IQKLKTLDMDQ

SEQ ID NO: 16300 - protein, 11 aa, BK virus
QKLKTLDMDQA

SEQ ID NO: 16301 - protein, 11 aa, BK virus
KLKTLDMDQAL

SEQ ID NO: 16302 - protein, 11 aa, BK virus
LKTLDMDQALN

SEQ ID NO: 16303 - protein, 11 aa, BK virus
KTLDMDQALNP

SEQ ID NO: 16304 - protein, 11 aa, BK virus
TLDMDQALNPN

SEQ ID NO: 16305 - protein, 11 aa, BK virus
LDMDQALNPNH

SEQ ID NO: 16306 - protein, 11 aa, BK virus
DMDQALNPNHN

SEQ ID NO: 16307 - protein, 11 aa, BK virus
MDQALNPNHNA

SEQ ID NO: 16308 - protein, 11 aa, BK virus
DQALNPNHNAL

SEQ ID NO: 16309 - protein, 11 aa, BK virus
QALNPNHNALP

SEQ ID NO: 16310 - protein, 11 aa, BK virus
ALNPNHNALPK

SEQ ID NO: 16311 - protein, 11 aa, BK virus
LNPNHNALPKS

SEQ ID NO: 16312 - protein, 11 aa, BK virus
NPNHNALPKSQ

SEQ ID NO: 16313 - protein, 11 aa, BK virus
PNHNALPKSQI

SEQ ID NO: 16314 - protein, 11 aa, BK virus
NHNALPKSQIL

SEQ ID NO: 16315 - protein, 11 aa, BK virus
HNALPKSQILQ

SEQ ID NO: 16316 - protein, 11 aa, BK virus
NALPKSQILQP

SEQ ID NO: 16317 - protein, 11 aa, BK virus
ALPKSQILQPL

SEQ ID NO: 16318 - protein, 11 aa, BK virus
LPKSQILQPLL

SEQ ID NO: 16319 - protein, 11 aa, BK virus
PKSQILQPLLK

SEQ ID NO: 16320 - protein, 11 aa, BK virus
KSQILQPLLKI

SEQ ID NO: 16321 - protein, 11 aa, BK virus
SQILQPLLKIP

SEQ ID NO: 16322 - protein, 11 aa, BK virus
QILQPLLKIPK

SEQ ID NO: 16323 - protein, 11 aa, BK virus
ILQPLLKIPKG

SEQ ID NO: 16324 - protein, 11 aa, BK virus
LQPLLKIPKGQ

SEQ ID NO: 16325 - protein, 11 aa, BK virus
QPLLKIPKGQT

SEQ ID NO: 16326 - protein, 11 aa, BK virus
PLLKIPKGQTP

SEQ ID NO: 16327 - protein, 11 aa, BK virus
LLKIPKGQTPI

SEQ ID NO: 16328 - protein, 11 aa, BK virus
LKIPKGQTPIV

SEQ ID NO: 16329 - protein, 11 aa, BK virus
KIPKGQTPIVK

SEQ ID NO: 16330 - protein, 11 aa, BK virus
IPKGQTPIVKS

SEQ ID NO: 16331 - protein, 11 aa, BK virus
PKGQTPIVKSC

SEQ ID NO: 16332 - protein, 11 aa, BK virus
KGQTPIVKSCI

SEQ ID NO: 16333 - protein, 11 aa, BK virus
GQTPIVKSCIC

SEQ ID NO: 16334 - protein, 11 aa, BK virus
QTPIVKSCICV

SEQ ID NO: 16335 - protein, 11 aa, BK virus
TPIVKSCICVK

SEQ ID NO: 16336 - protein, 11 aa, BK virus
PIVKSCICVKA

SEQ ID NO: 16337 - protein, 11 aa, BK virus
IVKSCICVKAF

SEQ ID NO: 16338 - protein, 11 aa, BK virus
VKSCICVKAFS

SEQ ID NO: 16339 - protein, 11 aa, BK virus
KSCICVKAFSV

SEQ ID NO: 16340 - protein, 11 aa, BK virus
SCICVKAFSVL

SEQ ID NO: 16341 - protein, 11 aa, BK virus
CICVKAFSVLK

SEQ ID NO: 16342 - protein, 11 aa, BK virus
ICVKAFSVLKG

SEQ ID NO: 16343 - protein, 11 aa, BK virus
CVKAFSVLKGL

SEQ ID NO: 16344 - protein, 11 aa, BK virus
VKAFSVLKGLK

SEQ ID NO: 16345 - protein, 11 aa, BK virus
KAFSVLKGLKH

SEQ ID NO: 16346 - protein, 11 aa, BK virus
AFSVLKGLKHH

SEQ ID NO: 16347 - protein, 11 aa, BK virus
FSVLKGLKHHP

SEQ ID NO: 16348 - protein, 11 aa, BK virus
SVLKGLKHHPQ

SEQ ID NO: 16349 - protein, 11 aa, BK virus
VLKGLKHHPQN

SEQ ID NO: 16350 - protein, 11 aa, BK virus
LKGLKHHPQNN

SEQ ID NO: 16351 - protein, 11 aa, BK virus
KGLKHHPQNNT

SEQ ID NO: 16352 - protein, 11 aa, BK virus
GLKHHPQNNTS

SEQ ID NO: 16353 - protein, 11 aa, BK virus
LKHHPQNNTSL

SEQ ID NO: 16354 - protein, 11 aa, BK virus
KHHPQNNTSLK

SEQ ID NO: 16355 - protein, 11 aa, BK virus
HHPQNNTSLKV

SEQ ID NO: 16356 - protein, 11 aa, BK virus
HPQNNTSLKVA

SEQ ID NO: 16357 - protein, 11 aa, BK virus
PQNNTSLKVAY

SEQ ID NO: 16358 - protein, 11 aa, BK virus
QNNTSLKVAYT

SEQ ID NO: 16359 - protein, 11 aa, BK virus
NNTSLKVAYTK

SEQ ID NO: 16360 - protein, 11 aa, BK virus
NTSLKVAYTKA

SEQ ID NO: 16361 - protein, 11 aa, BK virus
TSLKVAYTKAA

SEQ ID NO: 16362 - protein, 11 aa, BK virus
SLKVAYTKAAF

SEQ ID NO: 16363 - protein, 11 aa, BK virus
LKVAYTKAAFI

SEQ ID NO: 16364 - protein, 11 aa, BK virus
KVAYTKAAFIK

SEQ ID NO: 16365 - protein, 11 aa, BK virus
VAYTKAAFIKC

SEQ ID NO: 16366 - protein, 11 aa, BK virus
AYTKAAFIKCI

SEQ ID NO: 16367 - protein, 11 aa, BK virus
YTKAAFIKCIC

SEQ ID NO: 16368 - protein, 11 aa, BK virus
TKAAFIKCICT

SEQ ID NO: 16369 - protein, 11 aa, BK virus
KAAFIKCICTI

SEQ ID NO: 16370 - protein, 11 aa, BK virus
AAFIKCICTIK

SEQ ID NO: 16371 - protein, 11 aa, BK virus
AFIKCICTIKA

SEQ ID NO: 16372 - protein, 11 aa, BK virus
FIKCICTIKAP

SEQ ID NO: 16373 - protein, 11 aa, BK virus
IKCICTIKAPV

SEQ ID NO: 16374 - protein, 11 aa, BK virus
SILVCNCPCLS

SEQ ID NO: 16375 - protein, 11 aa, BK virus
ILVCNCPCLSI

SEQ ID NO: 16376 - protein, 11 aa, BK virus
LVCNCPCLSIY

SEQ ID NO: 16377 - protein, 11 aa, BK virus
VCNCPCLSIYL

SEQ ID NO: 16378 - protein, 11 aa, BK virus
CNCPCLSIYLI

SEQ ID NO: 16379 - protein, 11 aa, BK virus
NCPCLSIYLII

SEQ ID NO: 16380 - protein, 11 aa, BK virus
CPCLSIYLIIS

SEQ ID NO: 16381 - protein, 11 aa, BK virus
PCLSIYLIISG

SEQ ID NO: 16382 - protein, 11 aa, BK virus
CLSIYLIISGS

SEQ ID NO: 16383 - protein, 11 aa, BK virus
LSIYLIISGSP

SEQ ID NO: 16384 - protein, 11 aa, BK virus
SIYLIISGSPG

SEQ ID NO: 16385 - protein, 11 aa, BK virus
IYLIISGSPGS

SEQ ID NO: 16386 - protein, 11 aa, BK virus
YLIISGSPGSL

SEQ ID NO: 16387 - protein, 11 aa, BK virus
LIISGSPGSLS

SEQ ID NO: 16388 - protein, 11 aa, BK virus
IISGSPGSLSV

SEQ ID NO: 16389 - protein, 11 aa, BK virus
ISGSPGSLSVP

SEQ ID NO: 16390 - protein, 11 aa, BK virus
SGSPGSLSVPS

SEQ ID NO: 16391 - protein, 11 aa, BK virus
GSPGSLSVPSN

SEQ ID NO: 16392 - protein, 11 aa, BK virus
SPGSLSVPSNT

SEQ ID NO: 16393 - protein, 11 aa, BK virus
PGSLSVPSNTL

SEQ ID NO: 16394 - protein, 11 aa, BK virus
GSLSVPSNTLT

SEQ ID NO: 16395 - protein, 11 aa, BK virus
SLSVPSNTLTS

SEQ ID NO: 16396 - protein, 11 aa, BK virus
LSVPSNTLTSS

SEQ ID NO: 16397 - protein, 11 aa, BK virus
SVPSNTLTSST

SEQ ID NO: 16398 - protein, 11 aa, BK virus
VPSNTLTSSTW

SEQ ID NO: 16399 - protein, 11 aa, BK virus
PSNTLTSSTWD

SEQ ID NO: 16400 - protein, 11 aa, BK virus
SNTLTSSTWDS

SEQ ID NO: 16401 - protein, 11 aa, BK virus
NTLTSSTWDSI

SEQ ID NO: 16402 - protein, 11 aa, BK virus
TLTSSTWDSIP

SEQ ID NO: 16403 - protein, 11 aa, BK virus
LTSSTWDSIPY

SEQ ID NO: 16404 - protein, 11 aa, BK virus
TSSTWDSIPYI

SEQ ID NO: 16405 - protein, 11 aa, BK virus
SSTWDSIPYIG

SEQ ID NO: 16406 - protein, 11 aa, BK virus
STWDSIPYIGC

SEQ ID NO: 16407 - protein, 11 aa, BK virus
TWDSIPYIGCP

SEQ ID NO: 16408 - protein, 11 aa, BK virus
WDSIPYIGCPS

SEQ ID NO: 16409 - protein, 11 aa, BK virus
DSIPYIGCPST

SEQ ID NO: 16410 - protein, 11 aa, BK virus
SIPYIGCPSTL

SEQ ID NO: 16411 - protein, 11 aa, BK virus
IPYIGCPSTLW

SEQ ID NO: 16412 - protein, 11 aa, BK virus
PYIGCPSTLWV

SEQ ID NO: 16413 - protein, 11 aa, BK virus
YIGCPSTLWVL

SEQ ID NO: 16414 - protein, 11 aa, BK virus
IGCPSTLWVLL

SEQ ID NO: 16415 - protein, 11 aa, BK virus
GCPSTLWVLLF

SEQ ID NO: 16416 - protein, 11 aa, BK virus
CPSTLWVLLFI

SEQ ID NO: 16417 - protein, 11 aa, BK virus
PSTLWVLLFIR

SEQ ID NO: 16418 - protein, 11 aa, BK virus
STLWVLLFIRS

SEQ ID NO: 16419 - protein, 11 aa, BK virus
TLWVLLFIRSL

SEQ ID NO: 16420 - protein, 11 aa, BK virus
LWVLLFIRSLS

SEQ ID NO: 16421 - protein, 11 aa, BK virus
WVLLFIRSLSK

SEQ ID NO: 16422 - protein, 11 aa, BK virus
VLLFIRSLSKK

SEQ ID NO: 16423 - protein, 11 aa, BK virus
LLFIRSLSKKE

SEQ ID NO: 16424 - protein, 11 aa, BK virus
LFIRSLSKKEI

SEQ ID NO: 16425 - protein, 11 aa, BK virus
FIRSLSKKEIG

SEQ ID NO: 16426 - protein, 11 aa, BK virus
GFFTDLFLRRI

SEQ ID NO: 16427 - protein, 11 aa, BK virus
FFTDLFLRRIL

SEQ ID NO: 16428 - protein, 11 aa, BK virus
FTDLFLRRILK

SEQ ID NO: 16429 - protein, 11 aa, BK virus
TDLFLRRILKY

SEQ ID NO: 16430 - protein, 11 aa, BK virus
DLFLRRILKYL

SEQ ID NO: 16431 - protein, 11 aa, BK virus
LFLRRILKYLA

SEQ ID NO: 16432 - protein, 11 aa, BK virus
FLRRILKYLAR

SEQ ID NO: 16433 - protein, 11 aa, BK virus
LRRILKYLARP

SEQ ID NO: 16434 - protein, 11 aa, BK virus
RRILKYLARPL

SEQ ID NO: 16435 - protein, 11 aa, BK virus
RILKYLARPLH

SEQ ID NO: 16436 - protein, 11 aa, BK virus
ILKYLARPLHC

SEQ ID NO: 16437 - protein, 11 aa, BK virus
LKYLARPLHCC

SEQ ID NO: 16438 - protein, 11 aa, BK virus
KYLARPLHCCV

SEQ ID NO: 16439 - protein, 11 aa, BK virus
YLARPLHCCVP

SEQ ID NO: 16440 - protein, 11 aa, BK virus
LARPLHCCVPE

SEQ ID NO: 16441 - protein, 11 aa, BK virus
ARPLHCCVPEL

SEQ ID NO: 16442 - protein, 11 aa, BK virus
RPLHCCVPELL

SEQ ID NO: 16443 - protein, 11 aa, BK virus
PLHCCVPELLV

SEQ ID NO: 16444 - protein, 11 aa, BK virus
LHCCVPELLVN

SEQ ID NO: 16445 - protein, 11 aa, BK virus
HCCVPELLVNR

SEQ ID NO: 16446 - protein, 11 aa, BK virus
CCVPELLVNRP

SEQ ID NO: 16447 - protein, 11 aa, BK virus
CVPELLVNRPQ

SEQ ID NO: 16448 - protein, 11 aa, BK virus
VPELLVNRPQI

SEQ ID NO: 16449 - protein, 11 aa, BK virus
PELLVNRPQIS

SEQ ID NO: 16450 - protein, 11 aa, BK virus
ELLVNRPQISA

SEQ ID NO: 16451 - protein, 11 aa, BK virus
LLVNRPQISAA

SEQ ID NO: 16452 - protein, 11 aa, BK virus
LVNRPQISAAE

SEQ ID NO: 16453 - protein, 11 aa, BK virus
VNRPQISAAET

SEQ ID NO: 16454 - protein, 11 aa, BK virus
NRPQISAAETY

SEQ ID NO: 16455 - protein, 11 aa, BK virus
RPQISAAETYR

SEQ ID NO: 16456 - protein, 11 aa, BK virus
PQISAAETYRL

SEQ ID NO: 16457 - protein, 11 aa, BK virus
QISAAETYRLS

SEQ ID NO: 16458 - protein, 11 aa, BK virus
ISAAETYRLSA

SEQ ID NO: 16459 - protein, 11 aa, BK virus
SAAETYRLSAL

SEQ ID NO: 16460 - protein, 11 aa, BK virus
AAETYRLSALQ

SEQ ID NO: 16461 - protein, 11 aa, BK virus
AETYRLSALQR

SEQ ID NO: 16462 - protein, 11 aa, BK virus
ETYRLSALQRG

SEQ ID NO: 16463 - protein, 11 aa, BK virus
TYRLSALQRGP

SEQ ID NO: 16464 - protein, 11 aa, BK virus
YRLSALQRGPT

SEQ ID NO: 16465 - protein, 11 aa, BK virus
RLSALQRGPTP

SEQ ID NO: 16466 - protein, 11 aa, BK virus
LSALQRGPTPC

SEQ ID NO: 16467 - protein, 11 aa, BK virus
SALQRGPTPCS

SEQ ID NO: 16468 - protein, 11 aa, BK virus
ALQRGPTPCSS

SEQ ID NO: 16469 - protein, 11 aa, BK virus
LQRGPTPCSSS

SEQ ID NO: 16470 - protein, 11 aa, BK virus
QRGPTPCSSSN

SEQ ID NO: 16471 - protein, 11 aa, BK virus
RGPTPCSSSNT

SEQ ID NO: 16472 - protein, 11 aa, BK virus
GPTPCSSSNTV

SEQ ID NO: 16473 - protein, 11 aa, BK virus
PTPCSSSNTVV

SEQ ID NO: 16474 - protein, 11 aa, BK virus
TPCSSSNTVVA

SEQ ID NO: 16475 - protein, 11 aa, BK virus
PCSSSNTVVAV

SEQ ID NO: 16476 - protein, 11 aa, BK virus
CSSSNTVVAVL

SEQ ID NO: 16477 - protein, 11 aa, BK virus
SSSNTVVAVLV

SEQ ID NO: 16478 - protein, 11 aa, BK virus
SSNTVVAVLVT

SEQ ID NO: 16479 - protein, 11 aa, BK virus
STGGTFSPPVK

SEQ ID NO: 16480 - protein, 11 aa, BK virus
TGGTFSPPVKV

SEQ ID NO: 16481 - protein, 11 aa, BK virus
GGTFSPPVKVP

SEQ ID NO: 16482 - protein, 11 aa, BK virus
GTFSPPVKVPK

SEQ ID NO: 16483 - protein, 11 aa, BK virus
TFSPPVKVPKY

SEQ ID NO: 16484 - protein, 11 aa, BK virus
FSPPVKVPKYL

SEQ ID NO: 16485 - protein, 11 aa, BK virus
SPPVKVPKYLA

SEQ ID NO: 16486 - protein, 11 aa, BK virus
PPVKVPKYLAF

SEQ ID NO: 16487 - protein, 11 aa, BK virus
PVKVPKYLAFS

SEQ ID NO: 16488 - protein, 11 aa, BK virus
VKVPKYLAFSF

SEQ ID NO: 16489 - protein, 11 aa, BK virus
KVPKYLAFSFL

SEQ ID NO: 16490 - protein, 11 aa, BK virus
VPKYLAFSFLL

SEQ ID NO: 16491 - protein, 11 aa, BK virus
PKYLAFSFLLG

SEQ ID NO: 16492 - protein, 11 aa, BK virus
KYLAFSFLLGS

SEQ ID NO: 16493 - protein, 11 aa, BK virus
YLAFSFLLGSG

SEQ ID NO: 16494 - protein, 11 aa, BK virus
LAFSFLLGSGT

SEQ ID NO: 16495 - protein, 11 aa, BK virus
AFSFLLGSGTQ

SEQ ID NO: 16496 - protein, 11 aa, BK virus
FSFLLGSGTQH

SEQ ID NO: 16497 - protein, 11 aa, BK virus
SFLLGSGTQHS

SEQ ID NO: 16498 - protein, 11 aa, BK virus
FLLGSGTQHST

SEQ ID NO: 16499 - protein, 11 aa, BK virus
LLGSGTQHSTG

SEQ ID NO: 16500 - protein, 11 aa, BK virus
ALWSVFITWDW

SEQ ID NO: 16501 - protein, 11 aa, BK virus
LWSVFITWDWA

SEQ ID NO: 16502 - protein, 11 aa, BK virus
WSVFITWDWAV

SEQ ID NO: 16503 - protein, 11 aa, BK virus
SVFITWDWAVG

SEQ ID NO: 16504 - protein, 11 aa, BK virus
VFITWDWAVGF

SEQ ID NO: 16505 - protein, 11 aa, BK virus
FITWDWAVGFL

SEQ ID NO: 16506 - protein, 11 aa, BK virus
ITWDWAVGFLG

SEQ ID NO: 16507 - protein, 11 aa, BK virus
TWDWAVGFLGV

SEQ ID NO: 16508 - protein, 11 aa, BK virus
WDWAVGFLGVI

SEQ ID NO: 16509 - protein, 11 aa, BK virus
DWAVGFLGVIV

SEQ ID NO: 16510 - protein, 11 aa, BK virus
WAVGFLGVIVP

SEQ ID NO: 16511 - protein, 11 aa, BK virus
AVGFLGVIVPS

SEQ ID NO: 16512 - protein, 11 aa, BK virus
VGFLGVIVPSG

SEQ ID NO: 16513 - protein, 11 aa, BK virus
GFLGVIVPSGY

SEQ ID NO: 16514 - protein, 11 aa, BK virus
FLGVIVPSGYF

SEQ ID NO: 16515 - protein, 11 aa, BK virus
LGVIVPSGYFD

SEQ ID NO: 16516 - protein, 11 aa, BK virus
GVIVPSGYFDL

SEQ ID NO: 16517 - protein, 11 aa, BK virus
FISTPCISKGS

SEQ ID NO: 16518 - protein, 11 aa, BK virus
ISTPCISKGSP

SEQ ID NO: 16519 - protein, 11 aa, BK virus
STPCISKGSPP

SEQ ID NO: 16520 - protein, 11 aa, BK virus
TPCISKGSPPT

SEQ ID NO: 16521 - protein, 11 aa, BK virus
PCISKGSPPTA

SEQ ID NO: 16522 - protein, 11 aa, BK virus
CISKGSPPTAK

SEQ ID NO: 16523 - protein, 11 aa, BK virus
ISKGSPPTAKK

SEQ ID NO: 16524 - protein, 11 aa, BK virus
SKGSPPTAKKW

SEQ ID NO: 16525 - protein, 11 aa, BK virus
KGSPPTAKKWK

SEQ ID NO: 16526 - protein, 11 aa, BK virus
GSPPTAKKWKL

SEQ ID NO: 16527 - protein, 11 aa, BK virus
SPPTAKKWKLL

SEQ ID NO: 16528 - protein, 11 aa, BK virus
PPTAKKWKLLP

SEQ ID NO: 16529 - protein, 11 aa, BK virus
IGFPPPCSCTF

SEQ ID NO: 16530 - protein, 11 aa, BK virus
GFPPPCSCTFC

SEQ ID NO: 16531 - protein, 11 aa, BK virus
FPPPCSCTFCD

SEQ ID NO: 16532 - protein, 11 aa, BK virus
PPPCSCTFCDP

SEQ ID NO: 16533 - protein, 11 aa, BK virus
PPCSCTFCDPA

SEQ ID NO: 16534 - protein, 11 aa, BK virus
RLSMLVIPITS

SEQ ID NO: 16535 - protein, 11 aa, BK virus
LSMLVIPITSV

SEQ ID NO: 16536 - protein, 11 aa, BK virus
SMLVIPITSVC

SEQ ID NO: 16537 - protein, 11 aa, BK virus
MLVIPITSVCT

SEQ ID NO: 16538 - protein, 11 aa, BK virus
LVIPITSVCTV

SEQ ID NO: 16539 - protein, 11 aa, BK virus
VIPITSVCTVT

SEQ ID NO: 16540 - protein, 11 aa, BK virus
IPITSVCTVTA

SEQ ID NO: 16541 - protein, 11 aa, BK virus
PITSVCTVTAS

SEQ ID NO: 16542 - protein, 11 aa, BK virus
ITSVCTVTASH

SEQ ID NO: 16543 - protein, 11 aa, BK virus
TSVCTVTASHI

SEQ ID NO: 16544 - protein, 11 aa, BK virus
SVCTVTASHIS

SEQ ID NO: 16545 - protein, 11 aa, BK virus
VCTVTASHISR

SEQ ID NO: 16546 - protein, 11 aa, BK virus
CTVTASHISRF

SEQ ID NO: 16547 - protein, 11 aa, BK virus
TVTASHISRFP

SEQ ID NO: 16548 - protein, 11 aa, BK virus
VTASHISRFPQ

SEQ ID NO: 16549 - protein, 11 aa, BK virus
TASHISRFPQV

SEQ ID NO: 16550 - protein, 11 aa, BK virus
ASHISRFPQVR

SEQ ID NO: 16551 - protein, 11 aa, BK virus
SHISRFPQVRS

SEQ ID NO: 16552 - protein, 11 aa, BK virus
HISRFPQVRSS

SEQ ID NO: 16553 - protein, 11 aa, BK virus
ISRFPQVRSSF

SEQ ID NO: 16554 - protein, 11 aa, BK virus
SRFPQVRSSFK

SEQ ID NO: 16555 - protein, 11 aa, BK virus
RFPQVRSSFKL

SEQ ID NO: 16556 - protein, 11 aa, BK virus
FPQVRSSFKLG

SEQ ID NO: 16557 - protein, 11 aa, BK virus
PQVRSSFKLGR

SEQ ID NO: 16558 - protein, 11 aa, BK virus
QVRSSFKLGRG

SEQ ID NO: 16559 - protein, 11 aa, BK virus
VRSSFKLGRGI

SEQ ID NO: 16560 - protein, 11 aa, BK virus
RSSFKLGRGIL

SEQ ID NO: 16561 - protein, 11 aa, BK virus
SSFKLGRGILA

SEQ ID NO: 16562 - protein, 11 aa, BK virus
SFKLGRGILAV

SEQ ID NO: 16563 - protein, 11 aa, BK virus
FKLGRGILAVL

SEQ ID NO: 16564 - protein, 11 aa, BK virus
QGSIFLSGLSL

SEQ ID NO: 16565 - protein, 11 aa, BK virus
GSIFLSGLSLL

SEQ ID NO: 16566 - protein, 11 aa, BK virus
SIFLSGLSLLK

SEQ ID NO: 16567 - protein, 11 aa, BK virus
IFLSGLSLLKS

SEQ ID NO: 16568 - protein, 11 aa, BK virus
FLSGLSLLKSF

SEQ ID NO: 16569 - protein, 11 aa, BK virus
LSGLSLLKSFS

SEQ ID NO: 16570 - protein, 11 aa, BK virus
SGLSLLKSFSA

SEQ ID NO: 16571 - protein, 11 aa, BK virus
GLSLLKSFSAL

SEQ ID NO: 16572 - protein, 11 aa, BK virus
LSLLKSFSALS

SEQ ID NO: 16573 - protein, 11 aa, BK virus
SLLKSFSALSF

SEQ ID NO: 16574 - protein, 11 aa, BK virus
LLKSFSALSFR

SEQ ID NO: 16575 - protein, 11 aa, BK virus
LKSFSALSFRL

SEQ ID NO: 16576 - protein, 11 aa, BK virus
KSFSALSFRLK

SEQ ID NO: 16577 - protein, 11 aa, BK virus
SFSALSFRLKP

SEQ ID NO: 16578 - protein, 11 aa, BK virus
FSALSFRLKPL

SEQ ID NO: 16579 - protein, 11 aa, BK virus
SALSFRLKPLR

SEQ ID NO: 16580 - protein, 11 aa, BK virus
ALSFRLKPLRF

SEQ ID NO: 16581 - protein, 11 aa, BK virus
LSFRLKPLRFS

SEQ ID NO: 16582 - protein, 11 aa, BK virus
SFRLKPLRFSS

SEQ ID NO: 16583 - protein, 11 aa, BK virus
FRLKPLRFSSG

SEQ ID NO: 16584 - protein, 11 aa, BK virus
RLKPLRFSSGS

SEQ ID NO: 16585 - protein, 11 aa, BK virus
LKPLRFSSGSP

SEQ ID NO: 16586 - protein, 11 aa, BK virus
KPLRFSSGSPI

SEQ ID NO: 16587 - protein, 11 aa, BK virus
PLRFSSGSPIS

SEQ ID NO: 16588 - protein, 11 aa, BK virus
LRFSSGSPISG

SEQ ID NO: 16589 - protein, 11 aa, BK virus
RFSSGSPISGF

SEQ ID NO: 16590 - protein, 11 aa, BK virus
FSSGSPISGFR

SEQ ID NO: 16591 - protein, 11 aa, BK virus
SSGSPISGFRK

SEQ ID NO: 16592 - protein, 11 aa, BK virus
SGSPISGFRKH

SEQ ID NO: 16593 - protein, 11 aa, BK virus
GSPISGFRKHS

SEQ ID NO: 16594 - protein, 11 aa, BK virus
SPISGFRKHST

SEQ ID NO: 16595 - protein, 11 aa, BK virus
PISGFRKHSTS

SEQ ID NO: 16596 - protein, 11 aa, BK virus
ISGFRKHSTSV

SEQ ID NO: 16597 - protein, 11 aa, BK virus
SGFRKHSTSVI

SEQ ID NO: 16598 - protein, 11 aa, BK virus
GFRKHSTSVIA

SEQ ID NO: 16599 - protein, 11 aa, BK virus
FRKHSTSVIAS

SEQ ID NO: 16600 - protein, 11 aa, BK virus
RKHSTSVIAST

SEQ ID NO: 16601 - protein, 11 aa, BK virus
KHSTSVIASTP

SEQ ID NO: 16602 - protein, 11 aa, BK virus
HSTSVIASTPV

SEQ ID NO: 16603 - protein, 11 aa, BK virus
STSVIASTPVL

SEQ ID NO: 16604 - protein, 11 aa, BK virus
TSVIASTPVLT

SEQ ID NO: 16605 - protein, 11 aa, BK virus
SVIASTPVLTS

SEQ ID NO: 16606 - protein, 11 aa, BK virus
VIASTPVLTSR

SEQ ID NO: 16607 - protein, 11 aa, BK virus
IASTPVLTSRT

SEQ ID NO: 16608 - protein, 11 aa, BK virus
ASTPVLTSRTS

SEQ ID NO: 16609 - protein, 11 aa, BK virus
STPVLTSRTST

SEQ ID NO: 16610 - protein, 11 aa, BK virus
TPVLTSRTSTP

SEQ ID NO: 16611 - protein, 11 aa, BK virus
PVLTSRTSTPP

SEQ ID NO: 16612 - protein, 11 aa, BK virus
VLTSRTSTPPF

SEQ ID NO: 16613 - protein, 11 aa, BK virus
LTSRTSTPPFI

SEQ ID NO: 16614 - protein, 11 aa, BK virus
TSRTSTPPFIS

SEQ ID NO: 16615 - protein, 11 aa, BK virus
SRTSTPPFISS

SEQ ID NO: 16616 - protein, 11 aa, BK virus
RTSTPPFISSF

SEQ ID NO: 16617 - protein, 11 aa, BK virus
TSTPPFISSFG

SEQ ID NO: 16618 - protein, 11 aa, BK virus
STPPFISSFGT

SEQ ID NO: 16619 - protein, 11 aa, BK virus
TPPFISSFGTC

SEQ ID NO: 16620 - protein, 11 aa, BK virus
PPFISSFGTCT

SEQ ID NO: 16621 - protein, 11 aa, BK virus
PFISSFGTCTG

SEQ ID NO: 16622 - protein, 11 aa, BK virus
FISSFGTCTGS

SEQ ID NO: 16623 - protein, 11 aa, BK virus
ISSFGTCTGSF

SEQ ID NO: 16624 - protein, 11 aa, BK virus
SSFGTCTGSFG

SEQ ID NO: 16625 - protein, 11 aa, BK virus
SFGTCTGSFGF

SEQ ID NO: 16626 - protein, 11 aa, BK virus
FGTCTGSFGFL

SEQ ID NO: 16627 - protein, 11 aa, BK virus
GTCTGSFGFLG

SEQ ID NO: 16628 - protein, 11 aa, BK virus
TCTGSFGFLGA

SEQ ID NO: 16629 - protein, 11 aa, BK virus
CTGSFGFLGAA

SEQ ID NO: 16630 - protein, 11 aa, BK virus
TGSFGFLGAAP

SEQ ID NO: 16631 - protein, 11 aa, BK virus
GSFGFLGAAPG

SEQ ID NO: 16632 - protein, 11 aa, BK virus
SFGFLGAAPGH

SEQ ID NO: 16633 - protein, 11 aa, BK virus
FGFLGAAPGHS

SEQ ID NO: 16634 - protein, 11 aa, BK virus
GFLGAAPGHSP

SEQ ID NO: 16635 - protein, 11 aa, BK virus
FLGAAPGHSPF

SEQ ID NO: 16636 - protein, 11 aa, BK virus
LGAAPGHSPFL

SEQ ID NO: 16637 - protein, 11 aa, BK virus
GAAPGHSPFLL

SEQ ID NO: 16638 - protein, 11 aa, BK virus
AAPGHSPFLLV

SEQ ID NO: 16639 - protein, 11 aa, BK virus
APGHSPFLLVG

SEQ ID NO: 16640 - protein, 11 aa, BK virus
PGHSPFLLVGA

SEQ ID NO: 16641 - protein, 11 aa, BK virus
GHSPFLLVGAI

SEQ ID NO: 16642 - protein, 11 aa, BK virus
HSPFLLVGAIF

SEQ ID NO: 16643 - protein, 11 aa, BK virus
SPFLLVGAIFI

SEQ ID NO: 16644 - protein, 11 aa, BK virus
PFLLVGAIFIC

SEQ ID NO: 16645 - protein, 11 aa, BK virus
FLLVGAIFICF

SEQ ID NO: 16646 - protein, 11 aa, BK virus
LLVGAIFICFK

SEQ ID NO: 16647 - protein, 11 aa, BK virus
LVGAIFICFKS

SEQ ID NO: 16648 - protein, 11 aa, BK virus
VGAIFICFKSR

SEQ ID NO: 16649 - protein, 11 aa, BK virus
GAIFICFKSRC

SEQ ID NO: 16650 - protein, 11 aa, BK virus
AIFICFKSRCY

SEQ ID NO: 16651 - protein, 11 aa, BK virus
IFICFKSRCYS

SEQ ID NO: 16652 - protein, 11 aa, BK virus
FICFKSRCYSP

SEQ ID NO: 16653 - protein, 11 aa, BK virus
ICFKSRCYSPV

SEQ ID NO: 16654 - protein, 11 aa, BK virus
CFKSRCYSPVQ

SEQ ID NO: 16655 - protein, 11 aa, BK virus
FKSRCYSPVQA

SEQ ID NO: 16656 - protein, 11 aa, BK virus
RQHPLRSSSLI

SEQ ID NO: 16657 - protein, 11 aa, BK virus
QHPLRSSSLIS

SEQ ID NO: 16658 - protein, 11 aa, BK virus
HPLRSSSLIST

SEQ ID NO: 16659 - protein, 11 aa, BK virus
PLRSSSLISTS

SEQ ID NO: 16660 - protein, 11 aa, BK virus
LRSSSLISTSW

SEQ ID NO: 16661 - protein, 11 aa, BK virus
RSSSLISTSWG

SEQ ID NO: 16662 - protein, 11 aa, BK virus
SSSLISTSWGN

SEQ ID NO: 16663 - protein, 11 aa, BK virus
SSLISTSWGNS

SEQ ID NO: 16664 - protein, 11 aa, BK virus
SLISTSWGNSF

SEQ ID NO: 16665 - protein, 11 aa, BK virus
LISTSWGNSFF

SEQ ID NO: 16666 - protein, 11 aa, BK virus
ISTSWGNSFFY

SEQ ID NO: 16667 - protein, 11 aa, BK virus
STSWGNSFFYK

SEQ ID NO: 16668 - protein, 11 aa, BK virus
TSWGNSFFYKL

SEQ ID NO: 16669 - protein, 11 aa, BK virus
SWGNSFFYKLS

SEQ ID NO: 16670 - protein, 11 aa, BK virus
VHSLCNFFYTV

SEQ ID NO: 16671 - protein, 11 aa, BK virus
HSLCNFFYTVS

SEQ ID NO: 16672 - protein, 11 aa, BK virus
SLCNFFYTVSI

SEQ ID NO: 16673 - protein, 11 aa, BK virus
LCNFFYTVSII

SEQ ID NO: 16674 - protein, 11 aa, BK virus
CNFFYTVSIIY

SEQ ID NO: 16675 - protein, 11 aa, BK virus
NFFYTVSIIYT

SEQ ID NO: 16676 - protein, 11 aa, BK virus
FFYTVSIIYTI

SEQ ID NO: 16677 - protein, 11 aa, BK virus
FYTVSIIYTIS

SEQ ID NO: 16678 - protein, 11 aa, BK virus
YTVSIIYTISM

SEQ ID NO: 16679 - protein, 11 aa, BK virus
TVSIIYTISMA

SEQ ID NO: 16680 - protein, 11 aa, BK virus
VSIIYTISMAK

SEQ ID NO: 16681 - protein, 11 aa, BK virus
SIIYTISMAKM

SEQ ID NO: 16682 - protein, 11 aa, BK virus
IIYTISMAKMY

SEQ ID NO: 16683 - protein, 11 aa, BK virus
IYTISMAKMYT

SEQ ID NO: 16684 - protein, 11 aa, BK virus
YTISMAKMYTG

SEQ ID NO: 16685 - protein, 11 aa, BK virus
TISMAKMYTGT

SEQ ID NO: 16686 - protein, 11 aa, BK virus
ISMAKMYTGTF

SEQ ID NO: 16687 - protein, 11 aa, BK virus
SMAKMYTGTFP

SEQ ID NO: 16688 - protein, 11 aa, BK virus
MAKMYTGTFPF

SEQ ID NO: 16689 - protein, 11 aa, BK virus
AKMYTGTFPFS

SEQ ID NO: 16690 - protein, 11 aa, BK virus
KMYTGTFPFSY

SEQ ID NO: 16691 - protein, 11 aa, BK virus
MYTGTFPFSYL

SEQ ID NO: 16692 - protein, 11 aa, BK virus
YTGTFPFSYLS

SEQ ID NO: 16693 - protein, 11 aa, BK virus
TGTFPFSYLSN

SEQ ID NO: 16694 - protein, 11 aa, BK virus
GTFPFSYLSNH

SEQ ID NO: 16695 - protein, 11 aa, BK virus
GPNRGKIRIIL

SEQ ID NO: 16696 - protein, 11 aa, BK virus
PNRGKIRIILL

SEQ ID NO: 16697 - protein, 11 aa, BK virus
NRGKIRIILLN

SEQ ID NO: 16698 - protein, 11 aa, BK virus
RGKIRIILLNI

SEQ ID NO: 16699 - protein, 11 aa, BK virus
GKIRIILLNII

SEQ ID NO: 16700 - protein, 11 aa, BK virus
KIRIILLNIII

SEQ ID NO: 16701 - protein, 11 aa, BK virus
IRIILLNIIIK

SEQ ID NO: 16702 - protein, 11 aa, BK virus
RIILLNIIIKV

SEQ ID NO: 16703 - protein, 11 aa, BK virus
IILLNIIIKVY

SEQ ID NO: 16704 - protein, 11 aa, BK virus
ILLNIIIKVYR

SEQ ID NO: 16705 - protein, 11 aa, BK virus
LLNIIIKVYRG

SEQ ID NO: 16706 - protein, 11 aa, BK virus
LNIIIKVYRGI

SEQ ID NO: 16707 - protein, 11 aa, BK virus
NIIIKVYRGIY

SEQ ID NO: 16708 - protein, 11 aa, BK virus
IIIKVYRGIYN

SEQ ID NO: 16709 - protein, 11 aa, BK virus
IIKVYRGIYNC

SEQ ID NO: 16710 - protein, 11 aa, BK virus
IKVYRGIYNCP

SEQ ID NO: 16711 - protein, 11 aa, BK virus
KVYRGIYNCPG

SEQ ID NO: 16712 - protein, 11 aa, BK virus
VYRGIYNCPGS

SEQ ID NO: 16713 - protein, 11 aa, BK virus
YRGIYNCPGSF

SEQ ID NO: 16714 - protein, 11 aa, BK virus
RGIYNCPGSFL

SEQ ID NO: 16715 - protein, 11 aa, BK virus
GIYNCPGSFLQ

SEQ ID NO: 16716 - protein, 11 aa, BK virus
IYNCPGSFLQK

SEQ ID NO: 16717 - protein, 11 aa, BK virus
YNCPGSFLQKS

SEQ ID NO: 16718 - protein, 11 aa, BK virus
NCPGSFLQKSS

SEQ ID NO: 16719 - protein, 11 aa, BK virus
CPGSFLQKSSQ

SEQ ID NO: 16720 - protein, 11 aa, BK virus
PGSFLQKSSQG

SEQ ID NO: 16721 - protein, 11 aa, BK virus
GSFLQKSSQGV

SEQ ID NO: 16722 - protein, 11 aa, BK virus
SFLQKSSQGVS

SEQ ID NO: 16723 - protein, 11 aa, BK virus
FLQKSSQGVSK

SEQ ID NO: 16724 - protein, 11 aa, BK virus
LQKSSQGVSKK

SEQ ID NO: 16725 - protein, 11 aa, BK virus
QKSSQGVSKKS

SEQ ID NO: 16726 - protein, 11 aa, BK virus
KSSQGVSKKSF

SEQ ID NO: 16727 - protein, 11 aa, BK virus
SSQGVSKKSFC

SEQ ID NO: 16728 - protein, 11 aa, BK virus
SQGVSKKSFCS

SEQ ID NO: 16729 - protein, 11 aa, BK virus
QGVSKKSFCSS

SEQ ID NO: 16730 - protein, 11 aa, BK virus
GVSKKSFCSSL

SEQ ID NO: 16731 - protein, 11 aa, BK virus
VSKKSFCSSLQ

SEQ ID NO: 16732 - protein, 11 aa, BK virus
SKKSFCSSLQF

SEQ ID NO: 16733 - protein, 11 aa, BK virus
KKSFCSSLQFL

SEQ ID NO: 16734 - protein, 11 aa, BK virus
GYRRYIIPNNM

SEQ ID NO: 16735 - protein, 11 aa, BK virus
YRRYIIPNNMP

SEQ ID NO: 16736 - protein, 11 aa, BK virus
RRYIIPNNMPQ

SEQ ID NO: 16737 - protein, 11 aa, BK virus
RYIIPNNMPQS

SEQ ID NO: 16738 - protein, 11 aa, BK virus
YIIPNNMPQSL

SEQ ID NO: 16739 - protein, 11 aa, BK virus
IIPNNMPQSLG

SEQ ID NO: 16740 - protein, 11 aa, BK virus
IPNNMPQSLGN

SEQ ID NO: 16741 - protein, 11 aa, BK virus
PNNMPQSLGNS

SEQ ID NO: 16742 - protein, 11 aa, BK virus
NNMPQSLGNSS

SEQ ID NO: 16743 - protein, 11 aa, BK virus
NMPQSLGNSSK

SEQ ID NO: 16744 - protein, 11 aa, BK virus
MPQSLGNSSKQ

SEQ ID NO: 16745 - protein, 11 aa, BK virus
PQSLGNSSKQR

SEQ ID NO: 16746 - protein, 11 aa, BK virus
QSLGNSSKQRR

SEQ ID NO: 16747 - protein, 11 aa, BK virus
SLGNSSKQRRT

SEQ ID NO: 16748 - protein, 11 aa, BK virus
LGNSSKQRRTP

SEQ ID NO: 16749 - protein, 11 aa, BK virus
GNSSKQRRTPM

SEQ ID NO: 16750 - protein, 11 aa, BK virus
NSSKQRRTPMP

SEQ ID NO: 16751 - protein, 11 aa, BK virus
SSKQRRTPMPR

SEQ ID NO: 16752 - protein, 11 aa, BK virus
SKQRRTPMPRI

SEQ ID NO: 16753 - protein, 11 aa, BK virus
KQRRTPMPRIK

SEQ ID NO: 16754 - protein, 11 aa, BK virus
QRRTPMPRIKV

SEQ ID NO: 16755 - protein, 11 aa, BK virus
RRTPMPRIKVL

SEQ ID NO: 16756 - protein, 11 aa, BK virus
RTPMPRIKVLN

SEQ ID NO: 16757 - protein, 11 aa, BK virus
TPMPRIKVLNI

SEQ ID NO: 16758 - protein, 11 aa, BK virus
PMPRIKVLNII

SEQ ID NO: 16759 - protein, 11 aa, BK virus
MPRIKVLNIIN

SEQ ID NO: 16760 - protein, 11 aa, BK virus
PRIKVLNIINK

SEQ ID NO: 16761 - protein, 11 aa, BK virus
RIKVLNIINKS

SEQ ID NO: 16762 - protein, 11 aa, BK virus
IKVLNIINKSI

SEQ ID NO: 16763 - protein, 11 aa, BK virus
KVLNIINKSIY

SEQ ID NO: 16764 - protein, 11 aa, BK virus
VLNIINKSIYT

SEQ ID NO: 16765 - protein, 11 aa, BK virus
LNIINKSIYTR

SEQ ID NO: 16766 - protein, 11 aa, BK virus
NIINKSIYTRK

SEQ ID NO: 16767 - protein, 11 aa, BK virus
IINKSIYTRKQ

SEQ ID NO: 16768 - protein, 11 aa, BK virus
INKSIYTRKQN

SEQ ID NO: 16769 - protein, 11 aa, BK virus
NKSIYTRKQNI

SEQ ID NO: 16770 - protein, 11 aa, BK virus
KSIYTRKQNII

SEQ ID NO: 16771 - protein, 11 aa, BK virus
SIYTRKQNIIV

SEQ ID NO: 16772 - protein, 11 aa, BK virus
IYTRKQNIIVL

SEQ ID NO: 16773 - protein, 11 aa, BK virus
YTRKQNIIVLI

SEQ ID NO: 16774 - protein, 11 aa, BK virus
TRKQNIIVLIW

SEQ ID NO: 16775 - protein, 11 aa, BK virus
RKQNIIVLIWV

SEQ ID NO: 16776 - protein, 11 aa, BK virus
KQNIIVLIWVK

SEQ ID NO: 16777 - protein, 11 aa, BK virus
QNIIVLIWVKQ

SEQ ID NO: 16778 - protein, 11 aa, BK virus
NIIVLIWVKQF

SEQ ID NO: 16779 - protein, 11 aa, BK virus
IIVLIWVKQFQ

SEQ ID NO: 16780 - protein, 11 aa, BK virus
IVLIWVKQFQS

SEQ ID NO: 16781 - protein, 11 aa, BK virus
VLIWVKQFQSH

SEQ ID NO: 16782 - protein, 11 aa, BK virus
LIWVKQFQSHA

SEQ ID NO: 16783 - protein, 11 aa, BK virus
LLIEAYSGNFV

SEQ ID NO: 16784 - protein, 11 aa, BK virus
LIEAYSGNFVI

SEQ ID NO: 16785 - protein, 11 aa, BK virus
IEAYSGNFVIP

SEQ ID NO: 16786 - protein, 11 aa, BK virus
EAYSGNFVIPI

SEQ ID NO: 16787 - protein, 11 aa, BK virus
AYSGNFVIPII

SEQ ID NO: 16788 - protein, 11 aa, BK virus
YSGNFVIPIIK

SEQ ID NO: 16789 - protein, 11 aa, BK virus
SGNFVIPIIKE

SEQ ID NO: 16790 - protein, 11 aa, BK virus
GNFVIPIIKEL

SEQ ID NO: 16791 - protein, 11 aa, BK virus
NFVIPIIKELI

SEQ ID NO: 16792 - protein, 11 aa, BK virus
FVIPIIKELIP

SEQ ID NO: 16793 - protein, 11 aa, BK virus
VIPIIKELIPY

SEQ ID NO: 16794 - protein, 11 aa, BK virus
IPIIKELIPYL

SEQ ID NO: 16795 - protein, 11 aa, BK virus
PIIKELIPYLS

SEQ ID NO: 16796 - protein, 11 aa, BK virus
SSKPSNSPRST

SEQ ID NO: 16797 - protein, 11 aa, BK virus
SKPSNSPRSTS

SEQ ID NO: 16798 - protein, 11 aa, BK virus
KPSNSPRSTSN

SEQ ID NO: 16799 - protein, 11 aa, BK virus
PSNSPRSTSNY

SEQ ID NO: 16800 - protein, 11 aa, BK virus
SNSPRSTSNYS

SEQ ID NO: 16801 - protein, 11 aa, BK virus
NSPRSTSNYSI

SEQ ID NO: 16802 - protein, 11 aa, BK virus
SPRSTSNYSIC

SEQ ID NO: 16803 - protein, 11 aa, BK virus
PRSTSNYSICL

SEQ ID NO: 16804 - protein, 11 aa, BK virus
RSTSNYSICLR

SEQ ID NO: 16805 - protein, 11 aa, BK virus
STSNYSICLRS

SEQ ID NO: 16806 - protein, 11 aa, BK virus
GTCYALYSSKG

SEQ ID NO: 16807 - protein, 11 aa, BK virus
TCYALYSSKGC

SEQ ID NO: 16808 - protein, 11 aa, BK virus
CYALYSSKGCN

SEQ ID NO: 16809 - protein, 11 aa, BK virus
YALYSSKGCNL

SEQ ID NO: 16810 - protein, 11 aa, BK virus
ALYSSKGCNLN

SEQ ID NO: 16811 - protein, 11 aa, BK virus
LYSSKGCNLNF

SEQ ID NO: 16812 - protein, 11 aa, BK virus
YSSKGCNLNFY

SEQ ID NO: 16813 - protein, 11 aa, BK virus
SSKGCNLNFYS

SEQ ID NO: 16814 - protein, 11 aa, BK virus
SKGCNLNFYSS

SEQ ID NO: 16815 - protein, 11 aa, BK virus
KGCNLNFYSSS

SEQ ID NO: 16816 - protein, 11 aa, BK virus
GCNLNFYSSSS

SEQ ID NO: 16817 - protein, 11 aa, BK virus
CNLNFYSSSSL

SEQ ID NO: 16818 - protein, 11 aa, BK virus
NLNFYSSSSLP

SEQ ID NO: 16819 - protein, 11 aa, BK virus
LNFYSSSSLPS

SEQ ID NO: 16820 - protein, 11 aa, BK virus
NFYSSSSLPSS

SEQ ID NO: 16821 - protein, 11 aa, BK virus
FYSSSSLPSSN

SEQ ID NO: 16822 - protein, 11 aa, BK virus
YSSSSLPSSNF

SEQ ID NO: 16823 - protein, 11 aa, BK virus
SSSSLPSSNFS

SEQ ID NO: 16824 - protein, 11 aa, BK virus
SSSLPSSNFSH

SEQ ID NO: 16825 - protein, 11 aa, BK virus
KSCGSSSLRYT

SEQ ID NO: 16826 - protein, 11 aa, BK virus
SCGSSSLRYTG

SEQ ID NO: 16827 - protein, 11 aa, BK virus
CGSSSLRYTGN

SEQ ID NO: 16828 - protein, 11 aa, BK virus
SSTHEPGNTKK

SEQ ID NO: 16829 - protein, 11 aa, BK virus
STHEPGNTKKK

SEQ ID NO: 16830 - protein, 11 aa, BK virus
THEPGNTKKKG

SEQ ID NO: 16831 - protein, 11 aa, BK virus
HEPGNTKKKGL

SEQ ID NO: 16832 - protein, 11 aa, BK virus
EPGNTKKKGLL

SEQ ID NO: 16833 - protein, 11 aa, BK virus
PGNTKKKGLLT

SEQ ID NO: 16834 - protein, 11 aa, BK virus
ESFTESFTAGK

SEQ ID NO: 16835 - protein, 11 aa, BK virus
SFTESFTAGKA

SEQ ID NO: 16836 - protein, 11 aa, BK virus
FTESFTAGKAV

SEQ ID NO: 16837 - protein, 11 aa, BK virus
TESFTAGKAVV

SEQ ID NO: 16838 - protein, 11 aa, BK virus
ESFTAGKAVVL

SEQ ID NO: 16839 - protein, 11 aa, BK virus
SFTAGKAVVLL

SEQ ID NO: 16840 - protein, 11 aa, BK virus
FTAGKAVVLLF

SEQ ID NO: 16841 - protein, 11 aa, BK virus
TAGKAVVLLFF

SEQ ID NO: 16842 - protein, 11 aa, BK virus
AGKAVVLLFFP

SEQ ID NO: 16843 - protein, 11 aa, BK virus
GKAVVLLFFPS

SEQ ID NO: 16844 - protein, 11 aa, BK virus
KAVVLLFFPST

SEQ ID NO: 16845 - protein, 11 aa, BK virus
AVVLLFFPSTL

SEQ ID NO: 16846 - protein, 11 aa, BK virus
VVLLFFPSTLS

SEQ ID NO: 16847 - protein, 11 aa, BK virus
VLLFFPSTLSS

SEQ ID NO: 16848 - protein, 11 aa, BK virus
LLFFPSTLSSP

SEQ ID NO: 16849 - protein, 11 aa, BK virus
LFFPSTLSSPL

SEQ ID NO: 16850 - protein, 11 aa, BK virus
FFPSTLSSPLQ

SEQ ID NO: 16851 - protein, 11 aa, BK virus
FPSTLSSPLQN

SEQ ID NO: 16852 - protein, 11 aa, BK virus
PSTLSSPLQNS

SEQ ID NO: 16853 - protein, 11 aa, BK virus
STLSSPLQNSS

SEQ ID NO: 16854 - protein, 11 aa, BK virus
TLSSPLQNSSK

SEQ ID NO: 16855 - protein, 11 aa, BK virus
LSSPLQNSSKS

SEQ ID NO: 16856 - protein, 11 aa, BK virus
SSPLQNSSKSS

SEQ ID NO: 16857 - protein, 11 aa, BK virus
SPLQNSSKSSK

SEQ ID NO: 16858 - protein, 11 aa, BK virus
PLQNSSKSSKI

SEQ ID NO: 16859 - protein, 11 aa, BK virus
LQNSSKSSKIK

SEQ ID NO: 16860 - protein, 11 aa, BK virus
QNSSKSSKIKI

SEQ ID NO: 16861 - protein, 11 aa, BK virus
NSSKSSKIKIK

SEQ ID NO: 16862 - protein, 11 aa, BK virus
SSKSSKIKIKI

SEQ ID NO: 16863 - protein, 11 aa, BK virus
SKSSKIKIKIL

SEQ ID NO: 16864 - protein, 11 aa, BK virus
ALFFVPVQVLP

SEQ ID NO: 16865 - protein, 11 aa, BK virus
LFFVPVQVLPT

SEQ ID NO: 16866 - protein, 11 aa, BK virus
FFVPVQVLPTF

SEQ ID NO: 16867 - protein, 11 aa, BK virus
FVPVQVLPTFT

SEQ ID NO: 16868 - protein, 11 aa, BK virus
VPVQVLPTFTE

SEQ ID NO: 16869 - protein, 11 aa, BK virus
PVQVLPTFTEA

SEQ ID NO: 16870 - protein, 11 aa, BK virus
VQVLPTFTEAC

SEQ ID NO: 16871 - protein, 11 aa, BK virus
QVLPTFTEACR

SEQ ID NO: 16872 - protein, 11 aa, BK virus
VLPTFTEACRD

SEQ ID NO: 16873 - protein, 11 aa, BK virus
LPTFTEACRDS

SEQ ID NO: 16874 - protein, 11 aa, BK virus
PTFTEACRDSW

SEQ ID NO: 16875 - protein, 11 aa, BK virus
TFTEACRDSWR

SEQ ID NO: 16876 - protein, 11 aa, BK virus
FTEACRDSWRR

SEQ ID NO: 16877 - protein, 11 aa, BK virus
TEACRDSWRRT

SEQ ID NO: 16878 - protein, 11 aa, BK virus
EACRDSWRRTM

SEQ ID NO: 16879 - protein, 11 aa, BK virus
ACRDSWRRTMA

SEQ ID NO: 16880 - protein, 11 aa, BK virus
CRDSWRRTMAF

SEQ ID NO: 16881 - protein, 11 aa, BK virus
RDSWRRTMAFV

SEQ ID NO: 16882 - protein, 11 aa, BK virus
DSWRRTMAFVQ

SEQ ID NO: 16883 - protein, 11 aa, BK virus
SWRRTMAFVQF

SEQ ID NO: 16884 - protein, 11 aa, BK virus
WRRTMAFVQFN

SEQ ID NO: 16885 - protein, 11 aa, BK virus
RRTMAFVQFNW

SEQ ID NO: 16886 - protein, 11 aa, BK virus
RTMAFVQFNWG

SEQ ID NO: 16887 - protein, 11 aa, BK virus
TMAFVQFNWGQ

SEQ ID NO: 16888 - protein, 11 aa, BK virus
MAFVQFNWGQG

SEQ ID NO: 16889 - protein, 11 aa, BK virus
AFVQFNWGQGQ

SEQ ID NO: 16890 - protein, 11 aa, BK virus
FVQFNWGQGQD

SEQ ID NO: 16891 - protein, 11 aa, BK virus
VQFNWGQGQDS

SEQ ID NO: 16892 - protein, 11 aa, BK virus
ARKTCLSCTFL

SEQ ID NO: 16893 - protein, 11 aa, BK virus
RKTCLSCTFLP

SEQ ID NO: 16894 - protein, 11 aa, BK virus
KTCLSCTFLPE

SEQ ID NO: 16895 - protein, 11 aa, BK virus
TCLSCTFLPEV

SEQ ID NO: 16896 - protein, 11 aa, BK virus
CLSCTFLPEVM

SEQ ID NO: 16897 - protein, 11 aa, BK virus
LSCTFLPEVMV

SEQ ID NO: 16898 - protein, 11 aa, BK virus
SCTFLPEVMVW

SEQ ID NO: 16899 - protein, 11 aa, BK virus
CTFLPEVMVWL

SEQ ID NO: 16900 - protein, 11 aa, BK virus
TFLPEVMVWLH

SEQ ID NO: 16901 - protein, 11 aa, BK virus
FLPEVMVWLHS

SEQ ID NO: 16902 - protein, 11 aa, BK virus
LPEVMVWLHSM

SEQ ID NO: 16903 - protein, 11 aa, BK virus
PEVMVWLHSMG

SEQ ID NO: 16904 - protein, 11 aa, BK virus
EVMVWLHSMGK

SEQ ID NO: 16905 - protein, 11 aa, BK virus
VMVWLHSMGKQ

SEQ ID NO: 16906 - protein, 11 aa, BK virus
MVWLHSMGKQL

SEQ ID NO: 16907 - protein, 11 aa, BK virus
VWLHSMGKQLL

SEQ ID NO: 16908 - protein, 11 aa, BK virus
WLHSMGKQLLP

SEQ ID NO: 16909 - protein, 11 aa, BK virus
LHSMGKQLLPV

SEQ ID NO: 16910 - protein, 11 aa, BK virus
HSMGKQLLPVS

SEQ ID NO: 16911 - protein, 11 aa, BK virus
SMGKQLLPVSH

SEQ ID NO: 16912 - protein, 11 aa, BK virus
MGKQLLPVSHA

SEQ ID NO: 16913 - protein, 11 aa, BK virus
GKQLLPVSHAL

SEQ ID NO: 16914 - protein, 11 aa, BK virus
KQLLPVSHALS

SEQ ID NO: 16915 - protein, 11 aa, BK virus
QLLPVSHALSF

SEQ ID NO: 16916 - protein, 11 aa, BK virus
LLPVSHALSFL

SEQ ID NO: 16917 - protein, 11 aa, BK virus
LPVSHALSFLR

SEQ ID NO: 16918 - protein, 11 aa, BK virus
PVSHALSFLRS

SEQ ID NO: 16919 - protein, 11 aa, BK virus
VSHALSFLRSW

SEQ ID NO: 16920 - protein, 11 aa, BK virus
SHALSFLRSWF

SEQ ID NO: 16921 - protein, 11 aa, BK virus
HALSFLRSWFG

SEQ ID NO: 16922 - protein, 11 aa, BK virus
ALSFLRSWFGC

SEQ ID NO: 16923 - protein, 11 aa, BK virus
LSFLRSWFGCI

SEQ ID NO: 16924 - protein, 11 aa, BK virus
SFLRSWFGCIP

SEQ ID NO: 16925 - protein, 11 aa, BK virus
FLRSWFGCIPL

SEQ ID NO: 16926 - protein, 11 aa, BK virus
AAPPCGLFFYN

SEQ ID NO: 16927 - protein, 11 aa, BK virus
APPCGLFFYNI

SEQ ID NO: 16928 - protein, 11 aa, BK virus
EAEAASASTLS

SEQ ID NO: 16929 - protein, 11 aa, BK virus
AEAASASTLSL

SEQ ID NO: 16930 - protein, 11 aa, BK virus
EAASASTLSLK

SEQ ID NO: 16931 - protein, 11 aa, BK virus
GLAKLFGEIPI

SEQ ID NO: 16932 - protein, 11 aa, BK virus
LAKLFGEIPIL

SEQ ID NO: 16933 - protein, 11 aa, BK virus
AKLFGEIPILL

SEQ ID NO: 16934 - protein, 11 aa, BK virus
KLFGEIPILLQ

SEQ ID NO: 16935 - protein, 11 aa, BK virus
LFGEIPILLQF

SEQ ID NO: 16936 - protein, 11 aa, BK virus
FGEIPILLQFL

SEQ ID NO: 16937 - protein, 11 aa, BK virus
GEIPILLQFLQ

SEQ ID NO: 16938 - protein, 8 aa, BK virus
WIKFLTGK

SEQ ID NO: 16939 - protein, 8 aa, BK virus
IKFLTGKN

SEQ ID NO: 16940 - protein, 8 aa, BK virus
KFLTGKNP

SEQ ID NO: 16941 - protein, 8 aa, BK virus
FLTGKNPW

SEQ ID NO: 16942 - protein, 8 aa, BK virus
LTGKNPWS

SEQ ID NO: 16943 - protein, 8 aa, BK virus
TGKNPWSS

SEQ ID NO: 16944 - protein, 8 aa, BK virus
GKNPWSSW

SEQ ID NO: 16945 - protein, 8 aa, BK virus
KNPWSSWT

SEQ ID NO: 16946 - protein, 8 aa, BK virus
NPWSSWTF

SEQ ID NO: 16947 - protein, 8 aa, BK virus
ALKELPGE

SEQ ID NO: 16948 - protein, 8 aa, BK virus
LKELPGEI

SEQ ID NO: 16949 - protein, 8 aa, BK virus
KELPGEIF

SEQ ID NO: 16950 - protein, 8 aa, BK virus
ELPGEIFP

SEQ ID NO: 16951 - protein, 8 aa, BK virus
GSVRNFTL

SEQ ID NO: 16952 - protein, 8 aa, BK virus
SVRNFTLT

SEQ ID NO: 16953 - protein, 8 aa, BK virus
VRNFTLTK

SEQ ID NO: 16954 - protein, 8 aa, BK virus
RNFTLTKG

SEQ ID NO: 16955 - protein, 8 aa, BK virus
NFTLTKGA

SEQ ID NO: 16956 - protein, 8 aa, BK virus
FTLTKGAT

SEQ ID NO: 16957 - protein, 8 aa, BK virus
TLTKGATR

SEQ ID NO: 16958 - protein, 8 aa, BK virus
LTKGATRI

SEQ ID NO: 16959 - protein, 8 aa, BK virus
TKGATRIK

SEQ ID NO: 16960 - protein, 8 aa, BK virus
ILCIKKWS

SEQ ID NO: 16961 - protein, 8 aa, BK virus
LCIKKWSR

SEQ ID NO: 16962 - protein, 8 aa, BK virus
CIKKWSRM

SEQ ID NO: 16963 - protein, 8 aa, BK virus
LISLILEP

SEQ ID NO: 16964 - protein, 8 aa, BK virus
ISLILEPG

SEQ ID NO: 16965 - protein, 8 aa, BK virus
SLILEPGV

SEQ ID NO: 16966 - protein, 8 aa, BK virus
LILEPGVA

SEQ ID NO: 16967 - protein, 8 aa, BK virus
ILEPGVAQ

SEQ ID NO: 16968 - protein, 8 aa, BK virus
LEPGVAQR

SEQ ID NO: 16969 - protein, 8 aa, BK virus
EPGVAQRF

SEQ ID NO: 16970 - protein, 8 aa, BK virus
PGVAQRFV

SEQ ID NO: 16971 - protein, 8 aa, BK virus
GVAQRFVL

SEQ ID NO: 16972 - protein, 8 aa, BK virus
VAQRFVLI

SEQ ID NO: 16973 - protein, 8 aa, BK virus
AQRFVLIF

SEQ ID NO: 16974 - protein, 8 aa, BK virus
QRFVLIFL

SEQ ID NO: 16975 - protein, 8 aa, BK virus
RFVLIFLF

SEQ ID NO: 16976 - protein, 8 aa, BK virus
FVLIFLFA

SEQ ID NO: 16977 - protein, 8 aa, BK virus
VLIFLFAQ

SEQ ID NO: 16978 - protein, 8 aa, BK virus
LIFLFAQI

SEQ ID NO: 16979 - protein, 8 aa, BK virus
IFLFAQIP

SEQ ID NO: 16980 - protein, 8 aa, BK virus
FLFAQIPC

SEQ ID NO: 16981 - protein, 8 aa, BK virus
LFAQIPCT

SEQ ID NO: 16982 - protein, 8 aa, BK virus
FAQIPCTA

SEQ ID NO: 16983 - protein, 8 aa, BK virus
AQIPCTAR

SEQ ID NO: 16984 - protein, 8 aa, BK virus
QIPCTARN

SEQ ID NO: 16985 - protein, 8 aa, BK virus
IPCTARNG

SEQ ID NO: 16986 - protein, 8 aa, BK virus
PCTARNGL

SEQ ID NO: 16987 - protein, 8 aa, BK virus
CTARNGLF

SEQ ID NO: 16988 - protein, 8 aa, BK virus
TARNGLFV

SEQ ID NO: 16989 - protein, 8 aa, BK virus
ARNGLFVP

SEQ ID NO: 16990 - protein, 8 aa, BK virus
RNGLFVPK

SEQ ID NO: 16991 - protein, 8 aa, BK virus
NGLFVPKS

SEQ ID NO: 16992 - protein, 8 aa, BK virus
GLFVPKSL

SEQ ID NO: 16993 - protein, 8 aa, BK virus
LFVPKSLL

SEQ ID NO: 16994 - protein, 8 aa, BK virus
FVPKSLLC

SEQ ID NO: 16995 - protein, 8 aa, BK virus
VPKSLLCT

SEQ ID NO: 16996 - protein, 8 aa, BK virus
PKSLLCTA

SEQ ID NO: 16997 - protein, 8 aa, BK virus
KSLLCTAL

SEQ ID NO: 16998 - protein, 8 aa, BK virus
SLLCTALA

SEQ ID NO: 16999 - protein, 8 aa, BK virus
LLCTALAC

SEQ ID NO: 17000 - protein, 8 aa, BK virus
LCTALACY

SEQ ID NO: 17001 - protein, 8 aa, BK virus
CTALACYV

SEQ ID NO: 17002 - protein, 8 aa, BK virus
TALACYVS

SEQ ID NO: 17003 - protein, 8 aa, BK virus
ALACYVSL

SEQ ID NO: 17004 - protein, 8 aa, BK virus
LACYVSLD

SEQ ID NO: 17005 - protein, 8 aa, BK virus
IATALTAS

SEQ ID NO: 17006 - protein, 8 aa, BK virus
ATALTASH

SEQ ID NO: 17007 - protein, 8 aa, BK virus
TALTASHS

SEQ ID NO: 17008 - protein, 8 aa, BK virus
ALTASHSG

SEQ ID NO: 17009 - protein, 8 aa, BK virus
LTASHSGL

SEQ ID NO: 17010 - protein, 8 aa, BK virus
TASHSGLA

SEQ ID NO: 17011 - protein, 8 aa, BK virus
LKKLCNGG

SEQ ID NO: 17012 - protein, 8 aa, BK virus
KKLCNGGS

SEQ ID NO: 17013 - protein, 8 aa, BK virus
KLCNGGSK

SEQ ID NO: 17014 - protein, 8 aa, BK virus
LEKLPSEI

SEQ ID NO: 17015 - protein, 8 aa, BK virus
SFKVTNLY

SEQ ID NO: 17016 - protein, 8 aa, BK virus
FKVTNLYL

SEQ ID NO: 17017 - protein, 8 aa, BK virus
KVTNLYLD

SEQ ID NO: 17018 - protein, 8 aa, BK virus
VTNLYLDK

SEQ ID NO: 17019 - protein, 8 aa, BK virus
VIIFFIGA

SEQ ID NO: 17020 - protein, 8 aa, BK virus
IIFFIGAN

SEQ ID NO: 17021 - protein, 8 aa, BK virus
IFFIGANL

SEQ ID NO: 17022 - protein, 8 aa, BK virus
FFIGANLW

SEQ ID NO: 17023 - protein, 8 aa, BK virus
FIGANLWN

SEQ ID NO: 17024 - protein, 8 aa, BK virus
IGANLWNR

SEQ ID NO: 17025 - protein, 8 aa, BK virus
GANLWNRR

SEQ ID NO: 17026 - protein, 8 aa, BK virus
ANLWNRRV

SEQ ID NO: 17027 - protein, 8 aa, BK virus
NLWNRRVG

SEQ ID NO: 17028 - protein, 8 aa, BK virus
LWNRRVGV

SEQ ID NO: 17029 - protein, 8 aa, BK virus
WNRRVGVL

SEQ ID NO: 17030 - protein, 8 aa, BK virus
NRRVGVLV

SEQ ID NO: 17031 - protein, 8 aa, BK virus
RRVGVLVE

SEQ ID NO: 17032 - protein, 8 aa, BK virus
RVGVLVEF

SEQ ID NO: 17033 - protein, 8 aa, BK virus
VGVLVEFL

SEQ ID NO: 17034 - protein, 8 aa, BK virus
RSNSRFST

SEQ ID NO: 17035 - protein, 8 aa, BK virus
SNSRFSTL

SEQ ID NO: 17036 - protein, 8 aa, BK virus
NSRFSTLN

SEQ ID NO: 17037 - protein, 8 aa, BK virus
SRFSTLNT

SEQ ID NO: 17038 - protein, 8 aa, BK virus
RFSTLNTT

SEQ ID NO: 17039 - protein, 8 aa, BK virus
FSTLNTTQ

SEQ ID NO: 17040 - protein, 8 aa, BK virus
STLNTTQK

SEQ ID NO: 17041 - protein, 8 aa, BK virus
TLNTTQKK

SEQ ID NO: 17042 - protein, 8 aa, BK virus
LNTTQKKK

SEQ ID NO: 17043 - protein, 8 aa, BK virus
NTTQKKKK

SEQ ID NO: 17044 - protein, 8 aa, BK virus
TTQKKKKG

SEQ ID NO: 17045 - protein, 8 aa, BK virus
TQKKKKGR

SEQ ID NO: 17046 - protein, 8 aa, BK virus
QKKKKGRR

SEQ ID NO: 17047 - protein, 8 aa, BK virus
KKKKGRRP

SEQ ID NO: 17048 - protein, 8 aa, BK virus
NPCLLCCV

SEQ ID NO: 17049 - protein, 8 aa, BK virus
PCLLCCVY

SEQ ID NO: 17050 - protein, 8 aa, BK virus
CLLCCVYY

SEQ ID NO: 17051 - protein, 8 aa, BK virus
KTYGKIFC

SEQ ID NO: 17052 - protein, 8 aa, BK virus
TYGKIFCN

SEQ ID NO: 17053 - protein, 8 aa, BK virus
YGKIFCNF

SEQ ID NO: 17054 - protein, 8 aa, BK virus
GKIFCNFY

SEQ ID NO: 17055 - protein, 8 aa, BK virus
YYILFNST

SEQ ID NO: 17056 - protein, 8 aa, BK virus
FLSKAVYL

SEQ ID NO: 17057 - protein, 8 aa, BK virus
RSIPYYRR

SEQ ID NO: 17058 - protein, 8 aa, BK virus
SIPYYRRK

SEQ ID NO: 17059 - protein, 8 aa, BK virus
IPYYRRKH

SEQ ID NO: 17060 - protein, 8 aa, BK virus
PYYRRKHS

SEQ ID NO: 17061 - protein, 8 aa, BK virus
YYRRKHSR

SEQ ID NO: 17062 - protein, 8 aa, BK virus
YRRKHSRG

SEQ ID NO: 17063 - protein, 8 aa, BK virus
RRKHSRGL

SEQ ID NO: 17064 - protein, 8 aa, BK virus
RKHSRGLK

SEQ ID NO: 17065 - protein, 8 aa, BK virus
KHSRGLKG

SEQ ID NO: 17066 - protein, 8 aa, BK virus
HSRGLKGA

SEQ ID NO: 17067 - protein, 8 aa, BK virus
RNKAGVLE

SEQ ID NO: 17068 - protein, 8 aa, BK virus
NKAGVLEI

SEQ ID NO: 17069 - protein, 8 aa, BK virus
KAGVLEIN

SEQ ID NO: 17070 - protein, 8 aa, BK virus
AGVLEINY

SEQ ID NO: 17071 - protein, 8 aa, BK virus
GCVFIIRY

SEQ ID NO: 17072 - protein, 8 aa, BK virus
CVFIIRYV

SEQ ID NO: 17073 - protein, 8 aa, BK virus
VFIIRYVF

SEQ ID NO: 17074 - protein, 8 aa, BK virus
FIIRYVFR

SEQ ID NO: 17075 - protein, 8 aa, BK virus
IIRYVFRI

SEQ ID NO: 17076 - protein, 8 aa, BK virus
IRYVFRIS

SEQ ID NO: 17077 - protein, 8 aa, BK virus
RYVFRISI

SEQ ID NO: 17078 - protein, 8 aa, BK virus
YVFRISIQ

SEQ ID NO: 17079 - protein, 8 aa, BK virus
VFRISIQC

SEQ ID NO: 17080 - protein, 8 aa, BK virus
FRISIQCR

SEQ ID NO: 17081 - protein, 8 aa, BK virus
RISIQCRG

SEQ ID NO: 17082 - protein, 8 aa, BK virus
ISIQCRGV

SEQ ID NO: 17083 - protein, 8 aa, BK virus
KVSEKRPA

SEQ ID NO: 17084 - protein, 8 aa, BK virus
VSEKRPAL

SEQ ID NO: 17085 - protein, 8 aa, BK virus
SEKRPALS

SEQ ID NO: 17086 - protein, 8 aa, BK virus
EKRPALSL

SEQ ID NO: 17087 - protein, 8 aa, BK virus
KALCKCYY

SEQ ID NO: 17088 - protein, 8 aa, BK virus
ALCKCYYF

SEQ ID NO: 17089 - protein, 8 aa, BK virus
LCKCYYFC

SEQ ID NO: 17090 - protein, 8 aa, BK virus
CKCYYFCR

SEQ ID NO: 17091 - protein, 8 aa, BK virus
KCYYFCRK

SEQ ID NO: 17092 - protein, 8 aa, BK virus
KSKKYLSA

SEQ ID NO: 17093 - protein, 8 aa, BK virus
SKKYLSAS

SEQ ID NO: 17094 - protein, 8 aa, BK virus
KKYLSASS

SEQ ID NO: 17095 - protein, 8 aa, BK virus
KYLSASSR

SEQ ID NO: 17096 - protein, 8 aa, BK virus
YLSASSRY

SEQ ID NO: 17097 - protein, 8 aa, BK virus
LSASSRYS

SEQ ID NO: 17098 - protein, 8 aa, BK virus
SASSRYSF

SEQ ID NO: 17099 - protein, 8 aa, BK virus
ASSRYSFS

SEQ ID NO: 17100 - protein, 8 aa, BK virus
KKSRYPSY

SEQ ID NO: 17101 - protein, 8 aa, BK virus
KSRYPSYD

SEQ ID NO: 17102 - protein, 8 aa, BK virus
SRYPSYDQ

SEQ ID NO: 17103 - protein, 8 aa, BK virus
RYPSYDQG

SEQ ID NO: 17104 - protein, 8 aa, BK virus
YPSYDQGR

SEQ ID NO: 17105 - protein, 8 aa, BK virus
PSYDQGRN

SEQ ID NO: 17106 - protein, 8 aa, BK virus
SYDQGRNA

SEQ ID NO: 17107 - protein, 8 aa, BK virus
YDQGRNAN

SEQ ID NO: 17108 - protein, 8 aa, BK virus
DQGRNANR

SEQ ID NO: 17109 - protein, 8 aa, BK virus
QGRNANRK

SEQ ID NO: 17110 - protein, 8 aa, BK virus
GRNANRKI

SEQ ID NO: 17111 - protein, 8 aa, BK virus
RNANRKIQ

SEQ ID NO: 17112 - protein, 8 aa, BK virus
NANRKIQS

SEQ ID NO: 17113 - protein, 8 aa, BK virus
ANRKIQSY

SEQ ID NO: 17114 - protein, 8 aa, BK virus
NRKIQSYI

SEQ ID NO: 17115 - protein, 8 aa, BK virus
RKIQSYIR

SEQ ID NO: 17116 - protein, 8 aa, BK virus
NGFNIWSS

SEQ ID NO: 17117 - protein, 8 aa, BK virus
GFNIWSSW

SEQ ID NO: 17118 - protein, 8 aa, BK virus
FNIWSSWK

SEQ ID NO: 17119 - protein, 8 aa, BK virus
NIWSSWKC

SEQ ID NO: 17120 - protein, 8 aa, BK virus
IWSSWKCC

SEQ ID NO: 17121 - protein, 8 aa, BK virus
WSSWKCCT

SEQ ID NO: 17122 - protein, 8 aa, BK virus
SSWKCCTR

SEQ ID NO: 17123 - protein, 8 aa, BK virus
SWKCCTRT

SEQ ID NO: 17124 - protein, 8 aa, BK virus
WKCCTRTI

SEQ ID NO: 17125 - protein, 8 aa, BK virus
KCCTRTIY

SEQ ID NO: 17126 - protein, 8 aa, BK virus
CCTRTIYG

SEQ ID NO: 17127 - protein, 8 aa, BK virus
CTRTIYGR

SEQ ID NO: 17128 - protein, 8 aa, BK virus
TRTIYGRC

SEQ ID NO: 17129 - protein, 8 aa, BK virus
RTIYGRCC

SEQ ID NO: 17130 - protein, 8 aa, BK virus
TIYGRCCL

SEQ ID NO: 17131 - protein, 8 aa, BK virus
IYGRCCLA

SEQ ID NO: 17132 - protein, 8 aa, BK virus
YGRCCLAA

SEQ ID NO: 17133 - protein, 8 aa, BK virus
GRCCLAAL

SEQ ID NO: 17134 - protein, 8 aa, BK virus
RCCLAALF

SEQ ID NO: 17135 - protein, 8 aa, BK virus
CCLAALFA

SEQ ID NO: 17136 - protein, 8 aa, BK virus
CLAALFAT

SEQ ID NO: 17137 - protein, 8 aa, BK virus
FFALYCFQ

SEQ ID NO: 17138 - protein, 8 aa, BK virus
FALYCFQC

SEQ ID NO: 17139 - protein, 8 aa, BK virus
ALYCFQCT

SEQ ID NO: 17140 - protein, 8 aa, BK virus
WKNNTSCR

SEQ ID NO: 17141 - protein, 8 aa, BK virus
KNNTSCRV

SEQ ID NO: 17142 - protein, 8 aa, BK virus
NNTSCRVI

SEQ ID NO: 17143 - protein, 8 aa, BK virus
NTSCRVIR

SEQ ID NO: 17144 - protein, 8 aa, BK virus
TSCRVIRF

SEQ ID NO: 17145 - protein, 8 aa, BK virus
SCRVIRFV

SEQ ID NO: 17146 - protein, 8 aa, BK virus
CRVIRFVW

SEQ ID NO: 17147 - protein, 8 aa, BK virus
RVIRFVWW

SEQ ID NO: 17148 - protein, 8 aa, BK virus
SLKCKPTH

SEQ ID NO: 17149 - protein, 8 aa, BK virus
LKCKPTHG

SEQ ID NO: 17150 - protein, 8 aa, BK virus
KCKPTHGK

SEQ ID NO: 17151 - protein, 8 aa, BK virus
CKPTHGKA

SEQ ID NO: 17152 - protein, 8 aa, BK virus
KPTHGKAN

SEQ ID NO: 17153 - protein, 8 aa, BK virus
PTHGKANL

SEQ ID NO: 17154 - protein, 8 aa, BK virus
ARCSYRSV

SEQ ID NO: 17155 - protein, 8 aa, BK virus
RCSYRSVH

SEQ ID NO: 17156 - protein, 8 aa, BK virus
CSYRSVHG

SEQ ID NO: 17157 - protein, 8 aa, BK virus
SYRSVHGC

SEQ ID NO: 17158 - protein, 8 aa, BK virus
YRSVHGCF

SEQ ID NO: 17159 - protein, 8 aa, BK virus
IKGFAFRT

SEQ ID NO: 17160 - protein, 8 aa, BK virus
KGFAFRTW

SEQ ID NO: 17161 - protein, 8 aa, BK virus
GFAFRTWN

SEQ ID NO: 17162 - protein, 8 aa, BK virus
FAFRTWNK

SEQ ID NO: 17163 - protein, 8 aa, BK virus
AFRTWNKQ

SEQ ID NO: 17164 - protein, 8 aa, BK virus
FRTWNKQF

SEQ ID NO: 17165 - protein, 8 aa, BK virus
RTWNKQFR

SEQ ID NO: 17166 - protein, 8 aa, BK virus
TWNKQFRQ

SEQ ID NO: 17167 - protein, 8 aa, BK virus
WNKQFRQF

SEQ ID NO: 17168 - protein, 8 aa, BK virus
NKQFRQFE

SEQ ID NO: 17169 - protein, 8 aa, BK virus
KQFRQFER

SEQ ID NO: 17170 - protein, 8 aa, BK virus
QFRQFERL

SEQ ID NO: 17171 - protein, 8 aa, BK virus
FRQFERLF

SEQ ID NO: 17172 - protein, 8 aa, BK virus
RQFERLFR

SEQ ID NO: 17173 - protein, 8 aa, BK virus
QFERLFRW

SEQ ID NO: 17174 - protein, 8 aa, BK virus
FERLFRWK

SEQ ID NO: 17175 - protein, 8 aa, BK virus
ERLFRWKC

SEQ ID NO: 17176 - protein, 8 aa, BK virus
GKFRKETF

SEQ ID NO: 17177 - protein, 8 aa, BK virus
KFRKETFK

SEQ ID NO: 17178 - protein, 8 aa, BK virus
FRKETFKQ

SEQ ID NO: 17179 - protein, 8 aa, BK virus
RKETFKQK

SEQ ID NO: 17180 - protein, 8 aa, BK virus
KETFKQKN

SEQ ID NO: 17181 - protein, 8 aa, BK virus
ETFKQKNP

SEQ ID NO: 17182 - protein, 8 aa, BK virus
TFKQKNPN

SEQ ID NO: 17183 - protein, 8 aa, BK virus
FKQKNPNI

SEQ ID NO: 17184 - protein, 8 aa, BK virus
KQKNPNIS

SEQ ID NO: 17185 - protein, 8 aa, BK virus
QKNPNIST

SEQ ID NO: 17186 - protein, 8 aa, BK virus
KNPNISTR

SEQ ID NO: 17187 - protein, 8 aa, BK virus
NPNISTRL

SEQ ID NO: 17188 - protein, 8 aa, BK virus
PNISTRLG

SEQ ID NO: 17189 - protein, 8 aa, BK virus
NISTRLGY

SEQ ID NO: 17190 - protein, 8 aa, BK virus
ISTRLGYN

SEQ ID NO: 17191 - protein, 8 aa, BK virus
STRLGYNE

SEQ ID NO: 17192 - protein, 8 aa, BK virus
AQNIFKKI

SEQ ID NO: 17193 - protein, 8 aa, BK virus
QNIFKKIL

SEQ ID NO: 17194 - protein, 8 aa, BK virus
NIFKKILT

SEQ ID NO: 17195 - protein, 8 aa, BK virus
IFKKILTK

SEQ ID NO: 17196 - protein, 8 aa, BK virus
FKKILTKL

SEQ ID NO: 17197 - protein, 8 aa, BK virus
KKILTKLR

SEQ ID NO: 17198 - protein, 8 aa, BK virus
KILTKLRV

SEQ ID NO: 17199 - protein, 8 aa, BK virus
ILTKLRVL

SEQ ID NO: 17200 - protein, 8 aa, BK virus
LTKLRVLT

SEQ ID NO: 17201 - protein, 8 aa, BK virus
KKNFTKWN

SEQ ID NO: 17202 - protein, 8 aa, BK virus
KNFTKWND

SEQ ID NO: 17203 - protein, 8 aa, BK virus
NFTKWNDL

SEQ ID NO: 17204 - protein, 8 aa, BK virus
FTKWNDLV

SEQ ID NO: 17205 - protein, 8 aa, BK virus
TKWNDLVA

SEQ ID NO: 17206 - protein, 8 aa, BK virus
KWNDLVAT

SEQ ID NO: 17207 - protein, 8 aa, BK virus
WNDLVATA

SEQ ID NO: 17208 - protein, 8 aa, BK virus
NDLVATAN

SEQ ID NO: 17209 - protein, 8 aa, BK virus
DLVATANL

SEQ ID NO: 17210 - protein, 8 aa, BK virus
LVATANLV

SEQ ID NO: 17211 - protein, 8 aa, BK virus
DKYVYFFK

SEQ ID NO: 17212 - protein, 8 aa, BK virus
KYVYFFKD

SEQ ID NO: 17213 - protein, 8 aa, BK virus
YVYFFKDE

SEQ ID NO: 17214 - protein, 8 aa, BK virus
VYFFKDEI

SEQ ID NO: 17215 - protein, 8 aa, BK virus
YMHGEMYS

SEQ ID NO: 17216 - protein, 8 aa, BK virus
YYKRRGFR

SEQ ID NO: 17217 - protein, 8 aa, BK virus
YKRRGFRN

SEQ ID NO: 17218 - protein, 8 aa, BK virus
RLWTWIKH

SEQ ID NO: 17219 - protein, 8 aa, BK virus
IPITMLFP

SEQ ID NO: 17220 - protein, 8 aa, BK virus
PITMLFPS

SEQ ID NO: 17221 - protein, 8 aa, BK virus
ITMLFPSL

SEQ ID NO: 17222 - protein, 8 aa, BK virus
TMLFPSLR

SEQ ID NO: 17223 - protein, 8 aa, BK virus
MLFPSLRY

SEQ ID NO: 17224 - protein, 8 aa, BK virus
LFPSLRYF

SEQ ID NO: 17225 - protein, 8 aa, BK virus
FPSLRYFS

SEQ ID NO: 17226 - protein, 8 aa, BK virus
PSLRYFSP

SEQ ID NO: 17227 - protein, 8 aa, BK virus
SLRYFSPC

SEQ ID NO: 17228 - protein, 8 aa, BK virus
RFPKVRPP

SEQ ID NO: 17229 - protein, 8 aa, BK virus
NTTPKITQ

SEQ ID NO: 17230 - protein, 8 aa, BK virus
TTPKITQA

SEQ ID NO: 17231 - protein, 8 aa, BK virus
KWLIQKQH

SEQ ID NO: 17232 - protein, 8 aa, BK virus
WLIQKQHL

SEQ ID NO: 17233 - protein, 8 aa, BK virus
LIQKQHLL

SEQ ID NO: 17234 - protein, 8 aa, BK virus
IQKQHLLN

SEQ ID NO: 17235 - protein, 8 aa, BK virus
QKQHLLNV

SEQ ID NO: 17236 - protein, 8 aa, BK virus
KQHLLNVY

SEQ ID NO: 17237 - protein, 8 aa, BK virus
QHLLNVYV

SEQ ID NO: 17238 - protein, 8 aa, BK virus
HLLNVYVQ

SEQ ID NO: 17239 - protein, 8 aa, BK virus
KHLFKAFW

SEQ ID NO: 17240 - protein, 8 aa, BK virus
HLFKAFWF

SEQ ID NO: 17241 - protein, 8 aa, BK virus
LFKAFWFA

SEQ ID NO: 17242 - protein, 8 aa, BK virus
FKAFWFAI

SEQ ID NO: 17243 - protein, 8 aa, BK virus
KAFWFAIV

SEQ ID NO: 17244 - protein, 8 aa, BK virus
AFWFAIVP

SEQ ID NO: 17245 - protein, 8 aa, BK virus
FWFAIVPV

SEQ ID NO: 17246 - protein, 8 aa, BK virus
WFAIVPVC

SEQ ID NO: 17247 - protein, 8 aa, BK virus
FAIVPVCQ

SEQ ID NO: 17248 - protein, 8 aa, BK virus
AIVPVCQY

SEQ ID NO: 17249 - protein, 8 aa, BK virus
IVPVCQYI

SEQ ID NO: 17250 - protein, 8 aa, BK virus
VPVCQYIL

SEQ ID NO: 17251 - protein, 8 aa, BK virus
PVCQYILS

SEQ ID NO: 17252 - protein, 8 aa, BK virus
VCQYILSY

SEQ ID NO: 17253 - protein, 8 aa, BK virus
CQYILSYL

SEQ ID NO: 17254 - protein, 8 aa, BK virus
QYILSYLG

SEQ ID NO: 17255 - protein, 8 aa, BK virus
YILSYLGP

SEQ ID NO: 17256 - protein, 8 aa, BK virus
ILSYLGPL

SEQ ID NO: 17257 - protein, 8 aa, BK virus
LSYLGPLE

SEQ ID NO: 17258 - protein, 8 aa, BK virus
SYLGPLEV

SEQ ID NO: 17259 - protein, 8 aa, BK virus
YLGPLEVF

SEQ ID NO: 17260 - protein, 8 aa, BK virus
LGPLEVFL

SEQ ID NO: 17261 - protein, 8 aa, BK virus
GPLEVFLC

SEQ ID NO: 17262 - protein, 8 aa, BK virus
PLEVFLCH

SEQ ID NO: 17263 - protein, 8 aa, BK virus
LEVFLCHQ

SEQ ID NO: 17264 - protein, 8 aa, BK virus
EVFLCHQT

SEQ ID NO: 17265 - protein, 8 aa, BK virus
VFLCHQTP

SEQ ID NO: 17266 - protein, 8 aa, BK virus
PLLPGIPY

SEQ ID NO: 17267 - protein, 8 aa, BK virus
LLPGIPYH

SEQ ID NO: 17268 - protein, 8 aa, BK virus
LPGIPYHT

SEQ ID NO: 17269 - protein, 8 aa, BK virus
AAHPLSGF

SEQ ID NO: 17270 - protein, 8 aa, BK virus
AHPLSGFS

SEQ ID NO: 17271 - protein, 8 aa, BK virus
HPLSGFSC

SEQ ID NO: 17272 - protein, 8 aa, BK virus
PLSGFSCL

SEQ ID NO: 17273 - protein, 8 aa, BK virus
GHLAKRKL

SEQ ID NO: 17274 - protein, 8 aa, BK virus
HLAKRKLG

SEQ ID NO: 17275 - protein, 8 aa, BK virus
LAKRKLGK

SEQ ID NO: 17276 - protein, 8 aa, BK virus
AKRKLGKD

SEQ ID NO: 17277 - protein, 8 aa, BK virus
KRKLGKDS

SEQ ID NO: 17278 - protein, 8 aa, BK virus
RKLGKDSL

SEQ ID NO: 17279 - protein, 8 aa, BK virus
KLGKDSLQ

SEQ ID NO: 17280 - protein, 8 aa, BK virus
LGKDSLQI

SEQ ID NO: 17281 - protein, 8 aa, BK virus
GKDSLQIF

SEQ ID NO: 17282 - protein, 8 aa, BK virus
KDSLQIFF

SEQ ID NO: 17283 - protein, 8 aa, BK virus
DSLQIFFS

SEQ ID NO: 17284 - protein, 8 aa, BK virus
SLQIFFSG

SEQ ID NO: 17285 - protein, 8 aa, BK virus
LQIFFSGG

SEQ ID NO: 17286 - protein, 8 aa, BK virus
QIFFSGGS

SEQ ID NO: 17287 - protein, 8 aa, BK virus
NILQGLST

SEQ ID NO: 17288 - protein, 8 aa, BK virus
ILQGLSTV

SEQ ID NO: 17289 - protein, 8 aa, BK virus
LQGLSTVV

SEQ ID NO: 17290 - protein, 8 aa, BK virus
QGLSTVVF

SEQ ID NO: 17291 - protein, 8 aa, BK virus
GLSTVVFQ

SEQ ID NO: 17292 - protein, 8 aa, BK virus
LSTVVFQS

SEQ ID NO: 17293 - protein, 8 aa, BK virus
STVVFQSC

SEQ ID NO: 17294 - protein, 8 aa, BK virus
TGHKYQQL

SEQ ID NO: 17295 - protein, 8 aa, BK virus
GHKYQQLK

SEQ ID NO: 17296 - protein, 8 aa, BK virus
HKYQQLKH

SEQ ID NO: 17297 - protein, 8 aa, BK virus
KYQQLKHT

SEQ ID NO: 17298 - protein, 8 aa, BK virus
YQQLKHTG

SEQ ID NO: 17299 - protein, 8 aa, BK virus
QQLKHTGY

SEQ ID NO: 17300 - protein, 8 aa, BK virus
QLKHTGYQ

SEQ ID NO: 17301 - protein, 8 aa, BK virus
LKHTGYQL

SEQ ID NO: 17302 - protein, 8 aa, BK virus
KHTGYQLY

SEQ ID NO: 17303 - protein, 8 aa, BK virus
HTGYQLYK

SEQ ID NO: 17304 - protein, 8 aa, BK virus
TGYQLYKE

SEQ ID NO: 17305 - protein, 8 aa, BK virus
GYQLYKEA

SEQ ID NO: 17306 - protein, 8 aa, BK virus
YQLYKEAP

SEQ ID NO: 17307 - protein, 8 aa, BK virus
QLYKEAPH

SEQ ID NO: 17308 - protein, 8 aa, BK virus
LYKEAPHP

SEQ ID NO: 17309 - protein, 8 aa, BK virus
YKEAPHPV

SEQ ID NO: 17310 - protein, 8 aa, BK virus
KEAPHPVH

SEQ ID NO: 17311 - protein, 8 aa, BK virus
EAPHPVHL

SEQ ID NO: 17312 - protein, 8 aa, BK virus
APHPVHLA

SEQ ID NO: 17313 - protein, 8 aa, BK virus
PHPVHLAT

SEQ ID NO: 17314 - protein, 8 aa, BK virus
HPVHLATL

SEQ ID NO: 17315 - protein, 8 aa, BK virus
PVHLATLW

SEQ ID NO: 17316 - protein, 8 aa, BK virus
LCWSHEVL

SEQ ID NO: 17317 - protein, 8 aa, BK virus
CWSHEVLG

SEQ ID NO: 17318 - protein, 8 aa, BK virus
WSHEVLGE

SEQ ID NO: 17319 - protein, 8 aa, BK virus
SHEVLGEH

SEQ ID NO: 17320 - protein, 8 aa, BK virus
HEVLGEHF

SEQ ID NO: 17321 - protein, 8 aa, BK virus
EVLGEHFP

SEQ ID NO: 17322 - protein, 8 aa, BK virus
VLGEHFPL

SEQ ID NO: 17323 - protein, 8 aa, BK virus
LGEHFPLL

SEQ ID NO: 17324 - protein, 8 aa, BK virus
HFHFYWDQ

SEQ ID NO: 17325 - protein, 8 aa, BK virus
FHFYWDQV

SEQ ID NO: 17326 - protein, 8 aa, BK virus
HFYWDQVP

SEQ ID NO: 17327 - protein, 8 aa, BK virus
FYWDQVPS

SEQ ID NO: 17328 - protein, 8 aa, BK virus
YWDQVPST

SEQ ID NO: 17329 - protein, 8 aa, BK virus
WDQVPSTQ

SEQ ID NO: 17330 - protein, 8 aa, BK virus
DQVPSTQL

SEQ ID NO: 17331 - protein, 8 aa, BK virus
QVPSTQLD

SEQ ID NO: 17332 - protein, 8 aa, BK virus
VPSTQLDK

SEQ ID NO: 17333 - protein, 8 aa, BK virus
PSTQLDKH

SEQ ID NO: 17334 - protein, 8 aa, BK virus
STQLDKHC

SEQ ID NO: 17335 - protein, 8 aa, BK virus
TQLDKHCF

SEQ ID NO: 17336 - protein, 8 aa, BK virus
QLDKHCFC

SEQ ID NO: 17337 - protein, 8 aa, BK virus
LDKHCFCP

SEQ ID NO: 17338 - protein, 8 aa, BK virus
DKHCFCPN

SEQ ID NO: 17339 - protein, 8 aa, BK virus
KHCFCPNR

SEQ ID NO: 17340 - protein, 8 aa, BK virus
HCFCPNRP

SEQ ID NO: 17341 - protein, 8 aa, BK virus
CFCPNRPY

SEQ ID NO: 17342 - protein, 8 aa, BK virus
FCPNRPYG

SEQ ID NO: 17343 - protein, 8 aa, BK virus
CPNRPYGQ

SEQ ID NO: 17344 - protein, 8 aa, BK virus
PNRPYGQY

SEQ ID NO: 17345 - protein, 8 aa, BK virus
NRPYGQYS

SEQ ID NO: 17346 - protein, 8 aa, BK virus
RPYGQYSL

SEQ ID NO: 17347 - protein, 8 aa, BK virus
PYGQYSLP

SEQ ID NO: 17348 - protein, 8 aa, BK virus
YGQYSLPG

SEQ ID NO: 17349 - protein, 8 aa, BK virus
GQYSLPGT

SEQ ID NO: 17350 - protein, 8 aa, BK virus
QYSLPGTG

SEQ ID NO: 17351 - protein, 8 aa, BK virus
YSLPGTGL

SEQ ID NO: 17352 - protein, 8 aa, BK virus
SLPGTGLL

SEQ ID NO: 17353 - protein, 8 aa, BK virus
LPGTGLLG

SEQ ID NO: 17354 - protein, 8 aa, BK virus
PGTGLLGF

SEQ ID NO: 17355 - protein, 8 aa, BK virus
YHQGTLTC

SEQ ID NO: 17356 - protein, 8 aa, BK virus
HQGTLTCN

SEQ ID NO: 17357 - protein, 8 aa, BK virus
QGTLTCNS

SEQ ID NO: 17358 - protein, 8 aa, BK virus
GTLTCNSL

SEQ ID NO: 17359 - protein, 8 aa, BK virus
TLTCNSLA

SEQ ID NO: 17360 - protein, 8 aa, BK virus
LTCNSLAL

SEQ ID NO: 17361 - protein, 8 aa, BK virus
TCNSLALP

SEQ ID NO: 17362 - protein, 8 aa, BK virus
CNSLALPA

SEQ ID NO: 17363 - protein, 8 aa, BK virus
NSLALPAF

SEQ ID NO: 17364 - protein, 8 aa, BK virus
SLALPAFP

SEQ ID NO: 17365 - protein, 8 aa, BK virus
LALPAFPR

SEQ ID NO: 17366 - protein, 8 aa, BK virus
ALPAFPRV

SEQ ID NO: 17367 - protein, 8 aa, BK virus
LPAFPRVL

SEQ ID NO: 17368 - protein, 8 aa, BK virus
PAFPRVLH

SEQ ID NO: 17369 - protein, 8 aa, BK virus
AFPRVLHL

SEQ ID NO: 17370 - protein, 8 aa, BK virus
FPRVLHLQ

SEQ ID NO: 17371 - protein, 8 aa, BK virus
PRVLHLQQ

SEQ ID NO: 17372 - protein, 8 aa, BK virus
RVLHLQQR

SEQ ID NO: 17373 - protein, 8 aa, BK virus
VLHLQQRS

SEQ ID NO: 17374 - protein, 8 aa, BK virus
LHLQQRSG

SEQ ID NO: 17375 - protein, 8 aa, BK virus
HLQQRSGN

SEQ ID NO: 17376 - protein, 8 aa, BK virus
LQQRSGNY

SEQ ID NO: 17377 - protein, 8 aa, BK virus
QQRSGNYC

SEQ ID NO: 17378 - protein, 8 aa, BK virus
QRSGNYCL

SEQ ID NO: 17379 - protein, 8 aa, BK virus
RSGNYCLE

SEQ ID NO: 17380 - protein, 8 aa, BK virus
VFLHHAHA

SEQ ID NO: 17381 - protein, 8 aa, BK virus
FLHHAHAL

SEQ ID NO: 17382 - protein, 8 aa, BK virus
LHHAHALF

SEQ ID NO: 17383 - protein, 8 aa, BK virus
HHAHALFV

SEQ ID NO: 17384 - protein, 8 aa, BK virus
HAHALFVT

SEQ ID NO: 17385 - protein, 8 aa, BK virus
AHALFVTL

SEQ ID NO: 17386 - protein, 8 aa, BK virus
HALFVTLH

SEQ ID NO: 17387 - protein, 8 aa, BK virus
ALFVTLHE

SEQ ID NO: 17388 - protein, 8 aa, BK virus
LFVTLHEG

SEQ ID NO: 17389 - protein, 8 aa, BK virus
PLFVQLQP

SEQ ID NO: 17390 - protein, 8 aa, BK virus
LFVQLQPP

SEQ ID NO: 17391 - protein, 8 aa, BK virus
FVQLQPPT

SEQ ID NO: 17392 - protein, 8 aa, BK virus
VQLQPPTS

SEQ ID NO: 17393 - protein, 8 aa, BK virus
QLQPPTSV

SEQ ID NO: 17394 - protein, 8 aa, BK virus
LQPPTSVD

SEQ ID NO: 17395 - protein, 8 aa, BK virus
QPPTSVDF

SEQ ID NO: 17396 - protein, 8 aa, BK virus
PPTSVDFH

SEQ ID NO: 17397 - protein, 8 aa, BK virus
PTSVDFHR

SEQ ID NO: 17398 - protein, 8 aa, BK virus
TSVDFHRL

SEQ ID NO: 17399 - protein, 8 aa, BK virus
SVDFHRLG

SEQ ID NO: 17400 - protein, 8 aa, BK virus
VDFHRLGP

SEQ ID NO: 17401 - protein, 8 aa, BK virus
DFHRLGPH

SEQ ID NO: 17402 - protein, 8 aa, BK virus
FHRLGPHL

SEQ ID NO: 17403 - protein, 8 aa, BK virus
HRLGPHLN

SEQ ID NO: 17404 - protein, 8 aa, BK virus
RLGPHLNW

SEQ ID NO: 17405 - protein, 8 aa, BK virus
LGPHLNWG

SEQ ID NO: 17406 - protein, 8 aa, BK virus
GPHLNWGG

SEQ ID NO: 17407 - protein, 8 aa, BK virus
PHLNWGGE

SEQ ID NO: 17408 - protein, 8 aa, BK virus
HLNWGGEF

SEQ ID NO: 17409 - protein, 8 aa, BK virus
LNWGGEFL

SEQ ID NO: 17410 - protein, 8 aa, BK virus
NWGGEFLL

SEQ ID NO: 17411 - protein, 8 aa, BK virus
WGGEFLLC

SEQ ID NO: 17412 - protein, 8 aa, BK virus
GGEFLLCC

SEQ ID NO: 17413 - protein, 8 aa, BK virus
GEFLLCCN

SEQ ID NO: 17414 - protein, 8 aa, BK virus
EFLLCCNR

SEQ ID NO: 17415 - protein, 8 aa, BK virus
FLLCCNRE

SEQ ID NO: 17416 - protein, 8 aa, BK virus
LLCCNREA

SEQ ID NO: 17417 - protein, 8 aa, BK virus
LCCNREAF

SEQ ID NO: 17418 - protein, 8 aa, BK virus
CCNREAFF

SEQ ID NO: 17419 - protein, 8 aa, BK virus
CNREAFFS

SEQ ID NO: 17420 - protein, 8 aa, BK virus
NREAFFSL

SEQ ID NO: 17421 - protein, 8 aa, BK virus
REAFFSLG

SEQ ID NO: 17422 - protein, 8 aa, BK virus
EAFFSLGY

SEQ ID NO: 17423 - protein, 8 aa, BK virus
AFFSLGYH

SEQ ID NO: 17424 - protein, 8 aa, BK virus
FFSLGYHC

SEQ ID NO: 17425 - protein, 8 aa, BK virus
SHFQHLAL

SEQ ID NO: 17426 - protein, 8 aa, BK virus
HFQHLALD

SEQ ID NO: 17427 - protein, 8 aa, BK virus
GFHLDPPF

SEQ ID NO: 17428 - protein, 8 aa, BK virus
FHLDPPFL

SEQ ID NO: 17429 - protein, 8 aa, BK virus
HLDPPFLG

SEQ ID NO: 17430 - protein, 8 aa, BK virus
LDPPFLGL

SEQ ID NO: 17431 - protein, 8 aa, BK virus
DPPFLGLG

SEQ ID NO: 17432 - protein, 8 aa, BK virus
PPFLGLGS

SEQ ID NO: 17433 - protein, 8 aa, BK virus
PFLGLGSI

SEQ ID NO: 17434 - protein, 8 aa, BK virus
FLGLGSIL

SEQ ID NO: 17435 - protein, 8 aa, BK virus
LGLGSILP

SEQ ID NO: 17436 - protein, 8 aa, BK virus
GLGSILPL

SEQ ID NO: 17437 - protein, 8 aa, BK virus
LLELLLLL

SEQ ID NO: 17438 - protein, 8 aa, BK virus
LELLLLLL

SEQ ID NO: 17439 - protein, 8 aa, BK virus
ELLLLLLL

SEQ ID NO: 17440 - protein, 8 aa, BK virus
LLLLLLLV

SEQ ID NO: 17441 - protein, 8 aa, BK virus
LLLLLLVV

SEQ ID NO: 17442 - protein, 8 aa, BK virus
LLLLLVVL

SEQ ID NO: 17443 - protein, 8 aa, BK virus
LLLLVVLA

SEQ ID NO: 17444 - protein, 8 aa, BK virus
LLLVVLAL

SEQ ID NO: 17445 - protein, 8 aa, BK virus
LLVVLALA

SEQ ID NO: 17446 - protein, 8 aa, BK virus
LVVLALAR

SEQ ID NO: 17447 - protein, 8 aa, BK virus
VVLALARV

SEQ ID NO: 17448 - protein, 8 aa, BK virus
VLALARVP

SEQ ID NO: 17449 - protein, 8 aa, BK virus
LALARVPL

SEQ ID NO: 17450 - protein, 8 aa, BK virus
ALARVPLA

SEQ ID NO: 17451 - protein, 8 aa, BK virus
LARVPLAF

SEQ ID NO: 17452 - protein, 8 aa, BK virus
ARVPLAFW

SEQ ID NO: 17453 - protein, 8 aa, BK virus
RVPLAFWE

SEQ ID NO: 17454 - protein, 8 aa, BK virus
VPLAFWEL

SEQ ID NO: 17455 - protein, 8 aa, BK virus
PLAFWELP

SEQ ID NO: 17456 - protein, 8 aa, BK virus
LAFWELPL

SEQ ID NO: 17457 - protein, 8 aa, BK virus
AFWELPLD

SEQ ID NO: 17458 - protein, 8 aa, BK virus
FWELPLDT

SEQ ID NO: 17459 - protein, 8 aa, BK virus
WELPLDTL

SEQ ID NO: 17460 - protein, 8 aa, BK virus
ELPLDTLL

SEQ ID NO: 17461 - protein, 8 aa, BK virus
LPLDTLLF

SEQ ID NO: 17462 - protein, 8 aa, BK virus
PLDTLLFF

SEQ ID NO: 17463 - protein, 8 aa, BK virus
LDTLLFFW

SEQ ID NO: 17464 - protein, 8 aa, BK virus
DTLLFFWL

SEQ ID NO: 17465 - protein, 8 aa, BK virus
TLLFFWLG

SEQ ID NO: 17466 - protein, 8 aa, BK virus
LLFFWLGP

SEQ ID NO: 17467 - protein, 8 aa, BK virus
LFFWLGPS

SEQ ID NO: 17468 - protein, 8 aa, BK virus
FFWLGPSS

SEQ ID NO: 17469 - protein, 8 aa, BK virus
FWLGPSSY

SEQ ID NO: 17470 - protein, 8 aa, BK virus
WLGPSSYA

SEQ ID NO: 17471 - protein, 8 aa, BK virus
LGPSSYAS

SEQ ID NO: 17472 - protein, 8 aa, BK virus
GPSSYASR

SEQ ID NO: 17473 - protein, 8 aa, BK virus
PSSYASRA

SEQ ID NO: 17474 - protein, 8 aa, BK virus
SSYASRAG

SEQ ID NO: 17475 - protein, 8 aa, BK virus
SYASRAGV

SEQ ID NO: 17476 - protein, 8 aa, BK virus
YASRAGVT

SEQ ID NO: 17477 - protein, 8 aa, BK virus
ASRAGVTV

SEQ ID NO: 17478 - protein, 8 aa, BK virus
SRAGVTVP

SEQ ID NO: 17479 - protein, 8 aa, BK virus
RAGVTVPY

SEQ ID NO: 17480 - protein, 8 aa, BK virus
AGVTVPYR

SEQ ID NO: 17481 - protein, 8 aa, BK virus
GVTVPYRP

SEQ ID NO: 17482 - protein, 8 aa, BK virus
VTVPYRPR

SEQ ID NO: 17483 - protein, 8 aa, BK virus
TVPYRPRS

SEQ ID NO: 17484 - protein, 8 aa, BK virus
VPYRPRSK

SEQ ID NO: 17485 - protein, 8 aa, BK virus
PYRPRSKG

SEQ ID NO: 17486 - protein, 8 aa, BK virus
YRPRSKGN

SEQ ID NO: 17487 - protein, 8 aa, BK virus
RPRSKGNI

SEQ ID NO: 17488 - protein, 8 aa, BK virus
PRSKGNIH

SEQ ID NO: 17489 - protein, 8 aa, BK virus
LAPPGAIV

SEQ ID NO: 17490 - protein, 8 aa, BK virus
APPGAIVF

SEQ ID NO: 17491 - protein, 8 aa, BK virus
PPGAIVFS

SEQ ID NO: 17492 - protein, 8 aa, BK virus
PGAIVFSI

SEQ ID NO: 17493 - protein, 8 aa, BK virus
GAIVFSIN

SEQ ID NO: 17494 - protein, 8 aa, BK virus
AIVFSINS

SEQ ID NO: 17495 - protein, 8 aa, BK virus
IVFSINSP

SEQ ID NO: 17496 - protein, 8 aa, BK virus
VFSINSPE

SEQ ID NO: 17497 - protein, 8 aa, BK virus
FSINSPEC

SEQ ID NO: 17498 - protein, 8 aa, BK virus
SINSPECT

SEQ ID NO: 17499 - protein, 8 aa, BK virus
INSPECTL

SEQ ID NO: 17500 - protein, 8 aa, BK virus
NSPECTLC

SEQ ID NO: 17501 - protein, 8 aa, BK virus
FLKSILCV

SEQ ID NO: 17502 - protein, 8 aa, BK virus
LKSILCVT

SEQ ID NO: 17503 - protein, 8 aa, BK virus
KSILCVTS

SEQ ID NO: 17504 - protein, 8 aa, BK virus
SILCVTSS

SEQ ID NO: 17505 - protein, 8 aa, BK virus
ILCVTSSI

SEQ ID NO: 17506 - protein, 8 aa, BK virus
LCVTSSIL

SEQ ID NO: 17507 - protein, 8 aa, BK virus
CVTSSILS

SEQ ID NO: 17508 - protein, 8 aa, BK virus
VTSSILSA

SEQ ID NO: 17509 - protein, 8 aa, BK virus
TSSILSAS

SEQ ID NO: 17510 - protein, 8 aa, BK virus
SSILSASS

SEQ ID NO: 17511 - protein, 8 aa, BK virus
SILSASSI

SEQ ID NO: 17512 - protein, 8 aa, BK virus
ILSASSIL

SEQ ID NO: 17513 - protein, 8 aa, BK virus
VWPKCTRV

SEQ ID NO: 17514 - protein, 8 aa, BK virus
WPKCTRVP

SEQ ID NO: 17515 - protein, 8 aa, BK virus
PKCTRVPS

SEQ ID NO: 17516 - protein, 8 aa, BK virus
KCTRVPSL

SEQ ID NO: 17517 - protein, 8 aa, BK virus
CTRVPSLS

SEQ ID NO: 17518 - protein, 8 aa, BK virus
TRVPSLSA

SEQ ID NO: 17519 - protein, 8 aa, BK virus
RVPSLSAT

SEQ ID NO: 17520 - protein, 8 aa, BK virus
VPSLSATC

SEQ ID NO: 17521 - protein, 8 aa, BK virus
PSLSATCL

SEQ ID NO: 17522 - protein, 8 aa, BK virus
SLSATCLT

SEQ ID NO: 17523 - protein, 8 aa, BK virus
LSATCLTI

SEQ ID NO: 17524 - protein, 8 aa, BK virus
SATCLTIE

SEQ ID NO: 17525 - protein, 8 aa, BK virus
ATCLTIEG

SEQ ID NO: 17526 - protein, 8 aa, BK virus
TCLTIEGL

SEQ ID NO: 17527 - protein, 8 aa, BK virus
CLTIEGLI

SEQ ID NO: 17528 - protein, 8 aa, BK virus
LTIEGLIG

SEQ ID NO: 17529 - protein, 8 aa, BK virus
TIEGLIGE

SEQ ID NO: 17530 - protein, 8 aa, BK virus
IEGLIGER

SEQ ID NO: 17531 - protein, 8 aa, BK virus
EGLIGERS

SEQ ID NO: 17532 - protein, 8 aa, BK virus
GLIGERSE

SEQ ID NO: 17533 - protein, 8 aa, BK virus
KFIGAFTI

SEQ ID NO: 17534 - protein, 8 aa, BK virus
FIGAFTIV

SEQ ID NO: 17535 - protein, 8 aa, BK virus
IGAFTIVQ

SEQ ID NO: 17536 - protein, 8 aa, BK virus
GAFTIVQV

SEQ ID NO: 17537 - protein, 8 aa, BK virus
AFTIVQVV

SEQ ID NO: 17538 - protein, 8 aa, BK virus
FTIVQVVS

SEQ ID NO: 17539 - protein, 8 aa, BK virus
TIVQVVSS

SEQ ID NO: 17540 - protein, 8 aa, BK virus
IVQVVSSK

SEQ ID NO: 17541 - protein, 8 aa, BK virus
VQVVSSKN

SEQ ID NO: 17542 - protein, 8 aa, BK virus
QVVSSKNL

SEQ ID NO: 17543 - protein, 8 aa, BK virus
VVSSKNLA

SEQ ID NO: 17544 - protein, 8 aa, BK virus
VSSKNLAK

SEQ ID NO: 17545 - protein, 8 aa, BK virus
SSKNLAKE

SEQ ID NO: 17546 - protein, 8 aa, BK virus
SKNLAKES

SEQ ID NO: 17547 - protein, 8 aa, BK virus
KNLAKESL

SEQ ID NO: 17548 - protein, 8 aa, BK virus
NLAKESLK

SEQ ID NO: 17549 - protein, 8 aa, BK virus
LAKESLKN

SEQ ID NO: 17550 - protein, 8 aa, BK virus
AKESLKNL

SEQ ID NO: 17551 - protein, 8 aa, BK virus
KESLKNLS

SEQ ID NO: 17552 - protein, 8 aa, BK virus
ESLKNLSV

SEQ ID NO: 17553 - protein, 8 aa, BK virus
SLKNLSVL

SEQ ID NO: 17554 - protein, 8 aa, BK virus
LKNLSVLL

SEQ ID NO: 17555 - protein, 8 aa, BK virus
KNLSVLLC

SEQ ID NO: 17556 - protein, 8 aa, BK virus
NLSVLLCN

SEQ ID NO: 17557 - protein, 8 aa, BK virus
LSVLLCNS

SEQ ID NO: 17558 - protein, 8 aa, BK virus
SVLLCNSC

SEQ ID NO: 17559 - protein, 8 aa, BK virus
VLLCNSCE

SEQ ID NO: 17560 - protein, 8 aa, BK virus
LLCNSCEV

SEQ ID NO: 17561 - protein, 8 aa, BK virus
LCNSCEVI

SEQ ID NO: 17562 - protein, 8 aa, BK virus
CNSCEVIE

SEQ ID NO: 17563 - protein, 8 aa, BK virus
NSCEVIEG

SEQ ID NO: 17564 - protein, 8 aa, BK virus
SCEVIEGI

SEQ ID NO: 17565 - protein, 8 aa, BK virus
CEVIEGIS

SEQ ID NO: 17566 - protein, 8 aa, BK virus
EVIEGISS

SEQ ID NO: 17567 - protein, 8 aa, BK virus
VIEGISSL

SEQ ID NO: 17568 - protein, 8 aa, BK virus
IEGISSLI

SEQ ID NO: 17569 - protein, 8 aa, BK virus
EGISSLIT

SEQ ID NO: 17570 - protein, 8 aa, BK virus
GISSLITC

SEQ ID NO: 17571 - protein, 8 aa, BK virus
ISSLITCH

SEQ ID NO: 17572 - protein, 8 aa, BK virus
SSLITCHK

SEQ ID NO: 17573 - protein, 8 aa, BK virus
SLITCHKA

SEQ ID NO: 17574 - protein, 8 aa, BK virus
LITCHKAW

SEQ ID NO: 17575 - protein, 8 aa, BK virus
ITCHKAWE

SEQ ID NO: 17576 - protein, 8 aa, BK virus
TCHKAWEI

SEQ ID NO: 17577 - protein, 8 aa, BK virus
CHKAWEIV

SEQ ID NO: 17578 - protein, 8 aa, BK virus
HKAWEIVA

SEQ ID NO: 17579 - protein, 8 aa, BK virus
KAWEIVAN

SEQ ID NO: 17580 - protein, 8 aa, BK virus
AWEIVANK

SEQ ID NO: 17581 - protein, 8 aa, BK virus
WEIVANKE

SEQ ID NO: 17582 - protein, 8 aa, BK virus
EIVANKEG

SEQ ID NO: 17583 - protein, 8 aa, BK virus
IVANKEGP

SEQ ID NO: 17584 - protein, 8 aa, BK virus
VANKEGPQ

SEQ ID NO: 17585 - protein, 8 aa, BK virus
ANKEGPQC

SEQ ID NO: 17586 - protein, 8 aa, BK virus
NKEGPQCL

SEQ ID NO: 17587 - protein, 8 aa, BK virus
KEGPQCLG

SEQ ID NO: 17588 - protein, 8 aa, BK virus
EGPQCLGS

SEQ ID NO: 17589 - protein, 8 aa, BK virus
GPQCLGSR

SEQ ID NO: 17590 - protein, 8 aa, BK virus
PQCLGSRY

SEQ ID NO: 17591 - protein, 8 aa, BK virus
ILLTKVFT

SEQ ID NO: 17592 - protein, 8 aa, BK virus
LLTKVFTP

SEQ ID NO: 17593 - protein, 8 aa, BK virus
LTKVFTPG

SEQ ID NO: 17594 - protein, 8 aa, BK virus
TKVFTPGN

SEQ ID NO: 17595 - protein, 8 aa, BK virus
KVFTPGNR

SEQ ID NO: 17596 - protein, 8 aa, BK virus
VFTPGNRI

SEQ ID NO: 17597 - protein, 8 aa, BK virus
FTPGNRIS

SEQ ID NO: 17598 - protein, 8 aa, BK virus
YSSGLNNS

SEQ ID NO: 17599 - protein, 8 aa, BK virus
SSGLNNSK

SEQ ID NO: 17600 - protein, 8 aa, BK virus
SGLNNSKA

SEQ ID NO: 17601 - protein, 8 aa, BK virus
GLNNSKAM

SEQ ID NO: 17602 - protein, 8 aa, BK virus
LNNSKAMP

SEQ ID NO: 17603 - protein, 8 aa, BK virus
NNSKAMPD

SEQ ID NO: 17604 - protein, 8 aa, BK virus
NSKAMPDC

SEQ ID NO: 17605 - protein, 8 aa, BK virus
SQSSKNLY

SEQ ID NO: 17606 - protein, 8 aa, BK virus
QSSKNLYP

SEQ ID NO: 17607 - protein, 8 aa, BK virus
SSKNLYPT

SEQ ID NO: 17608 - protein, 8 aa, BK virus
AKELIPLT

SEQ ID NO: 17609 - protein, 8 aa, BK virus
KELIPLTV

SEQ ID NO: 17610 - protein, 8 aa, BK virus
IKAANPAI

SEQ ID NO: 17611 - protein, 8 aa, BK virus
KAANPAIA

SEQ ID NO: 17612 - protein, 8 aa, BK virus
AANPAIAP

SEQ ID NO: 17613 - protein, 8 aa, BK virus
ANPAIAPG

SEQ ID NO: 17614 - protein, 8 aa, BK virus
NPAIAPGA

SEQ ID NO: 17615 - protein, 8 aa, BK virus
PAIAPGAP

SEQ ID NO: 17616 - protein, 8 aa, BK virus
AIAPGAPA

SEQ ID NO: 17617 - protein, 8 aa, BK virus
IAPGAPAI

SEQ ID NO: 17618 - protein, 8 aa, BK virus
APGAPAIT

SEQ ID NO: 17619 - protein, 8 aa, BK virus
PGAPAITA

SEQ ID NO: 17620 - protein, 8 aa, BK virus
GAPAITAY

SEQ ID NO: 17621 - protein, 8 aa, BK virus
APAITAYV

SEQ ID NO: 17622 - protein, 8 aa, BK virus
GVRPIAAI

SEQ ID NO: 17623 - protein, 8 aa, BK virus
VRPIAAIA

SEQ ID NO: 17624 - protein, 8 aa, BK virus
RPIAAIAS

SEQ ID NO: 17625 - protein, 8 aa, BK virus
PIAAIASE

SEQ ID NO: 17626 - protein, 8 aa, BK virus
IAAIASEV

SEQ ID NO: 17627 - protein, 8 aa, BK virus
AAIASEVL

SEQ ID NO: 17628 - protein, 8 aa, BK virus
AIASEVLV

SEQ ID NO: 17629 - protein, 8 aa, BK virus
IASEVLVM

SEQ ID NO: 17630 - protein, 8 aa, BK virus
ASEVLVMP

SEQ ID NO: 17631 - protein, 8 aa, BK virus
SEVLVMPS

SEQ ID NO: 17632 - protein, 8 aa, BK virus
EVLVMPST

SEQ ID NO: 17633 - protein, 8 aa, BK virus
VLVMPSTV

SEQ ID NO: 17634 - protein, 8 aa, BK virus
LVMPSTVA

SEQ ID NO: 17635 - protein, 8 aa, BK virus
VMPSTVAR

SEQ ID NO: 17636 - protein, 8 aa, BK virus
MPSTVARD

SEQ ID NO: 17637 - protein, 8 aa, BK virus
PSTVARDA

SEQ ID NO: 17638 - protein, 8 aa, BK virus
STVARDAI

SEQ ID NO: 17639 - protein, 8 aa, BK virus
TSIAAAAS

SEQ ID NO: 17640 - protein, 8 aa, BK virus
SIAAAASP

SEQ ID NO: 17641 - protein, 8 aa, BK virus
IAAAASPA

SEQ ID NO: 17642 - protein, 8 aa, BK virus
AAAASPAA

SEQ ID NO: 17643 - protein, 8 aa, BK virus
AAASPAAI

SEQ ID NO: 17644 - protein, 8 aa, BK virus
AASPAAIS

SEQ ID NO: 17645 - protein, 8 aa, BK virus
ASPAAISA

SEQ ID NO: 17646 - protein, 8 aa, BK virus
SPAAISAT

SEQ ID NO: 17647 - protein, 8 aa, BK virus
PAAISATE

SEQ ID NO: 17648 - protein, 8 aa, BK virus
AAISATEN

SEQ ID NO: 17649 - protein, 8 aa, BK virus
AISATENP

SEQ ID NO: 17650 - protein, 8 aa, BK virus
ISATENPV

SEQ ID NO: 17651 - protein, 8 aa, BK virus
SATENPVA

SEQ ID NO: 17652 - protein, 8 aa, BK virus
ATENPVAA

SEQ ID NO: 17653 - protein, 8 aa, BK virus
TENPVAAA

SEQ ID NO: 17654 - protein, 8 aa, BK virus
ENPVAAAA

SEQ ID NO: 17655 - protein, 8 aa, BK virus
NPVAAAAS

SEQ ID NO: 17656 - protein, 8 aa, BK virus
PVAAAASD

SEQ ID NO: 17657 - protein, 8 aa, BK virus
VAAAASDT

SEQ ID NO: 17658 - protein, 8 aa, BK virus
AAAASDTL

SEQ ID NO: 17659 - protein, 8 aa, BK virus
AAASDTLA

SEQ ID NO: 17660 - protein, 8 aa, BK virus
AASDTLAT

SEQ ID NO: 17661 - protein, 8 aa, BK virus
ASDTLATR

SEQ ID NO: 17662 - protein, 8 aa, BK virus
SDTLATRS

SEQ ID NO: 17663 - protein, 8 aa, BK virus
DTLATRSP

SEQ ID NO: 17664 - protein, 8 aa, BK virus
TLATRSPK

SEQ ID NO: 17665 - protein, 8 aa, BK virus
LATRSPKS

SEQ ID NO: 17666 - protein, 8 aa, BK virus
ATRSPKSA

SEQ ID NO: 17667 - protein, 8 aa, BK virus
TRSPKSAR

SEQ ID NO: 17668 - protein, 8 aa, BK virus
RSPKSARA

SEQ ID NO: 17669 - protein, 8 aa, BK virus
SPKSARAA

SEQ ID NO: 17670 - protein, 8 aa, BK virus
PKSARAAP

SEQ ID NO: 17671 - protein, 8 aa, BK virus
KSARAAPM

SEQ ID NO: 17672 - protein, 8 aa, BK virus
SARAAPMN

SEQ ID NO: 17673 - protein, 8 aa, BK virus
ARAAPMNL

SEQ ID NO: 17674 - protein, 8 aa, BK virus
RAAPMNLE

SEQ ID NO: 17675 - protein, 8 aa, BK virus
AAPMNLEI

SEQ ID NO: 17676 - protein, 8 aa, BK virus
APMNLEIQ

SEQ ID NO: 17677 - protein, 8 aa, BK virus
PMNLEIQK

SEQ ID NO: 17678 - protein, 8 aa, BK virus
MNLEIQKK

SEQ ID NO: 17679 - protein, 8 aa, BK virus
NLEIQKKR

SEQ ID NO: 17680 - protein, 8 aa, BK virus
LEIQKKRD

SEQ ID NO: 17681 - protein, 8 aa, BK virus
EIQKKRDY

SEQ ID NO: 17682 - protein, 8 aa, BK virus
IQKKRDYL

SEQ ID NO: 17683 - protein, 8 aa, BK virus
QKKRDYLP

SEQ ID NO: 17684 - protein, 8 aa, BK virus
KKRDYLPR

SEQ ID NO: 17685 - protein, 8 aa, BK virus
KRDYLPRS

SEQ ID NO: 17686 - protein, 8 aa, BK virus
RDYLPRSL

SEQ ID NO: 17687 - protein, 8 aa, BK virus
DYLPRSLL

SEQ ID NO: 17688 - protein, 8 aa, BK virus
YLPRSLLQ

SEQ ID NO: 17689 - protein, 8 aa, BK virus
LPRSLLQS

SEQ ID NO: 17690 - protein, 8 aa, BK virus
PRSLLQSL

SEQ ID NO: 17691 - protein, 8 aa, BK virus
RSLLQSLL

SEQ ID NO: 17692 - protein, 8 aa, BK virus
SLLQSLLQ

SEQ ID NO: 17693 - protein, 8 aa, BK virus
LLQSLLQQ

SEQ ID NO: 17694 - protein, 8 aa, BK virus
LQSLLQQV

SEQ ID NO: 17695 - protein, 8 aa, BK virus
QSLLQQVK

SEQ ID NO: 17696 - protein, 8 aa, BK virus
SLLQQVKQ

SEQ ID NO: 17697 - protein, 8 aa, BK virus
LLQQVKQW

SEQ ID NO: 17698 - protein, 8 aa, BK virus
LQQVKQWY

SEQ ID NO: 17699 - protein, 8 aa, BK virus
QQVKQWYF

SEQ ID NO: 17700 - protein, 8 aa, BK virus
QVKQWYFC

SEQ ID NO: 17701 - protein, 8 aa, BK virus
VKQWYFCF

SEQ ID NO: 17702 - protein, 8 aa, BK virus
KQWYFCFS

SEQ ID NO: 17703 - protein, 8 aa, BK virus
QWYFCFSR

SEQ ID NO: 17704 - protein, 8 aa, BK virus
WYFCFSRL

SEQ ID NO: 17705 - protein, 8 aa, BK virus
YFCFSRLH

SEQ ID NO: 17706 - protein, 8 aa, BK virus
FCFSRLHC

SEQ ID NO: 17707 - protein, 8 aa, BK virus
CFSRLHCL

SEQ ID NO: 17708 - protein, 8 aa, BK virus
FSRLHCLH

SEQ ID NO: 17709 - protein, 8 aa, BK virus
SRLHCLHL

SEQ ID NO: 17710 - protein, 8 aa, BK virus
RLHCLHLY

SEQ ID NO: 17711 - protein, 8 aa, BK virus
LHCLHLYK

SEQ ID NO: 17712 - protein, 8 aa, BK virus
HCLHLYKI

SEQ ID NO: 17713 - protein, 8 aa, BK virus
CLHLYKIP

SEQ ID NO: 17714 - protein, 8 aa, BK virus
LHLYKIPA

SEQ ID NO: 17715 - protein, 8 aa, BK virus
HLYKIPAK

SEQ ID NO: 17716 - protein, 8 aa, BK virus
LYKIPAKA

SEQ ID NO: 17717 - protein, 8 aa, BK virus
YKIPAKAL

SEQ ID NO: 17718 - protein, 8 aa, BK virus
KIPAKALK

SEQ ID NO: 17719 - protein, 8 aa, BK virus
KSSELFFL

SEQ ID NO: 17720 - protein, 8 aa, BK virus
SSELFFLF

SEQ ID NO: 17721 - protein, 8 aa, BK virus
SELFFLFQ

SEQ ID NO: 17722 - protein, 8 aa, BK virus
ELFFLFQS

SEQ ID NO: 17723 - protein, 8 aa, BK virus
LFFLFQSR

SEQ ID NO: 17724 - protein, 8 aa, BK virus
FFLFQSRF

SEQ ID NO: 17725 - protein, 8 aa, BK virus
FLFQSRFY

SEQ ID NO: 17726 - protein, 8 aa, BK virus
LFQSRFYQ

SEQ ID NO: 17727 - protein, 8 aa, BK virus
FQSRFYQL

SEQ ID NO: 17728 - protein, 8 aa, BK virus
QSRFYQLS

SEQ ID NO: 17729 - protein, 8 aa, BK virus
SRFYQLSL

SEQ ID NO: 17730 - protein, 8 aa, BK virus
RFYQLSLK

SEQ ID NO: 17731 - protein, 8 aa, BK virus
FYQLSLKL

SEQ ID NO: 17732 - protein, 8 aa, BK virus
YQLSLKLV

SEQ ID NO: 17733 - protein, 8 aa, BK virus
QLSLKLVV

SEQ ID NO: 17734 - protein, 8 aa, BK virus
LSLKLVVT

SEQ ID NO: 17735 - protein, 8 aa, BK virus
SLKLVVTA

SEQ ID NO: 17736 - protein, 8 aa, BK virus
LKLVVTAG

SEQ ID NO: 17737 - protein, 8 aa, BK virus
KLVVTAGA

SEQ ID NO: 17738 - protein, 8 aa, BK virus
LVVTAGAE

SEQ ID NO: 17739 - protein, 8 aa, BK virus
VVTAGAEP

SEQ ID NO: 17740 - protein, 8 aa, BK virus
VTAGAEPW

SEQ ID NO: 17741 - protein, 8 aa, BK virus
TAGAEPWP

SEQ ID NO: 17742 - protein, 8 aa, BK virus
AGAEPWPL

SEQ ID NO: 17743 - protein, 8 aa, BK virus
GAEPWPLS

SEQ ID NO: 17744 - protein, 8 aa, BK virus
AEPWPLSS

SEQ ID NO: 17745 - protein, 8 aa, BK virus
EPWPLSSL

SEQ ID NO: 17746 - protein, 8 aa, BK virus
PWPLSSLT

SEQ ID NO: 17747 - protein, 8 aa, BK virus
WPLSSLTG

SEQ ID NO: 17748 - protein, 8 aa, BK virus
PLSSLTGD

SEQ ID NO: 17749 - protein, 8 aa, BK virus
LSSLTGDK

SEQ ID NO: 17750 - protein, 8 aa, BK virus
SSLTGDKA

SEQ ID NO: 17751 - protein, 8 aa, BK virus
SLTGDKAK

SEQ ID NO: 17752 - protein, 8 aa, BK virus
LTGDKAKI

SEQ ID NO: 17753 - protein, 8 aa, BK virus
TGDKAKIP

SEQ ID NO: 17754 - protein, 8 aa, BK virus
GDKAKIPR

SEQ ID NO: 17755 - protein, 8 aa, BK virus
DKAKIPRL

SEQ ID NO: 17756 - protein, 8 aa, BK virus
KAKIPRLA

SEQ ID NO: 17757 - protein, 8 aa, BK virus
AKIPRLAK

SEQ ID NO: 17758 - protein, 8 aa, BK virus
KIPRLAKH

SEQ ID NO: 17759 - protein, 8 aa, BK virus
IPRLAKHV

SEQ ID NO: 17760 - protein, 8 aa, BK virus
PRLAKHVC

SEQ ID NO: 17761 - protein, 8 aa, BK virus
RLAKHVCH

SEQ ID NO: 17762 - protein, 8 aa, BK virus
LAKHVCHA

SEQ ID NO: 17763 - protein, 8 aa, BK virus
AKHVCHAL

SEQ ID NO: 17764 - protein, 8 aa, BK virus
KHVCHALS

SEQ ID NO: 17765 - protein, 8 aa, BK virus
HVCHALSF

SEQ ID NO: 17766 - protein, 8 aa, BK virus
VCHALSFL

SEQ ID NO: 17767 - protein, 8 aa, BK virus
CHALSFLR

SEQ ID NO: 17768 - protein, 8 aa, BK virus
HALSFLRS

SEQ ID NO: 17769 - protein, 8 aa, BK virus
ALSFLRSW

SEQ ID NO: 17770 - protein, 8 aa, BK virus
LSFLRSWF

SEQ ID NO: 17771 - protein, 8 aa, BK virus
SFLRSWFG

SEQ ID NO: 17772 - protein, 8 aa, BK virus
FLRSWFGC

SEQ ID NO: 17773 - protein, 8 aa, BK virus
LRSWFGCI

SEQ ID NO: 17774 - protein, 8 aa, BK virus
RSWFGCIP

SEQ ID NO: 17775 - protein, 8 aa, BK virus
SWFGCIPW

SEQ ID NO: 17776 - protein, 8 aa, BK virus
WFGCIPWV

SEQ ID NO: 17777 - protein, 8 aa, BK virus
FGCIPWVS

SEQ ID NO: 17778 - protein, 8 aa, BK virus
GCIPWVSS

SEQ ID NO: 17779 - protein, 8 aa, BK virus
CIPWVSSS

SEQ ID NO: 17780 - protein, 8 aa, BK virus
IPWVSSSS

SEQ ID NO: 17781 - protein, 8 aa, BK virus
PWVSSSSL

SEQ ID NO: 17782 - protein, 8 aa, BK virus
GHGLAAFP

SEQ ID NO: 17783 - protein, 8 aa, BK virus
HGLAAFPC

SEQ ID NO: 17784 - protein, 8 aa, BK virus
GLAAFPCE

SEQ ID NO: 17785 - protein, 8 aa, BK virus
LAAFPCES

SEQ ID NO: 17786 - protein, 8 aa, BK virus
AAFPCESC

SEQ ID NO: 17787 - protein, 8 aa, BK virus
AFPCESCT

SEQ ID NO: 17788 - protein, 8 aa, BK virus
FPCESCTF

SEQ ID NO: 17789 - protein, 8 aa, BK virus
PCESCTFL

SEQ ID NO: 17790 - protein, 8 aa, BK virus
CESCTFLP

SEQ ID NO: 17791 - protein, 8 aa, BK virus
ESCTFLPE

SEQ ID NO: 17792 - protein, 8 aa, BK virus
SCTFLPEV

SEQ ID NO: 17793 - protein, 8 aa, BK virus
CTFLPEVM

SEQ ID NO: 17794 - protein, 8 aa, BK virus
TFLPEVMV

SEQ ID NO: 17795 - protein, 8 aa, BK virus
FLPEVMVW

SEQ ID NO: 17796 - protein, 8 aa, BK virus
LPEVMVWL

SEQ ID NO: 17797 - protein, 8 aa, BK virus
PEVMVWLH

SEQ ID NO: 17798 - protein, 8 aa, BK virus
EVMVWLHS

SEQ ID NO: 17799 - protein, 8 aa, BK virus
VMVWLHSM

SEQ ID NO: 17800 - protein, 8 aa, BK virus
MVWLHSMG

SEQ ID NO: 17801 - protein, 8 aa, BK virus
VWLHSMGK

SEQ ID NO: 17802 - protein, 8 aa, BK virus
WLHSMGKQ

SEQ ID NO: 17803 - protein, 8 aa, BK virus
LHSMGKQL

SEQ ID NO: 17804 - protein, 8 aa, BK virus
HSMGKQLL

SEQ ID NO: 17805 - protein, 8 aa, BK virus
SMGKQLLP

SEQ ID NO: 17806 - protein, 8 aa, BK virus
MGKQLLPV

SEQ ID NO: 17807 - protein, 8 aa, BK virus
GKQLLPVA

SEQ ID NO: 17808 - protein, 8 aa, BK virus
KQLLPVAF

SEQ ID NO: 17809 - protein, 8 aa, BK virus
QLLPVAFF

SEQ ID NO: 17810 - protein, 8 aa, BK virus
LLPVAFFF

SEQ ID NO: 17811 - protein, 8 aa, BK virus
LPVAFFFI

SEQ ID NO: 17812 - protein, 8 aa, BK virus
PVAFFFII

SEQ ID NO: 17813 - protein, 8 aa, BK virus
VAFFFIIY

SEQ ID NO: 17814 - protein, 8 aa, BK virus
AFFFIIYK

SEQ ID NO: 17815 - protein, 8 aa, BK virus
FFFIIYKR

SEQ ID NO: 17816 - protein, 8 aa, BK virus
FFIIYKRP

SEQ ID NO: 17817 - protein, 8 aa, BK virus
FIIYKRPR

SEQ ID NO: 17818 - protein, 8 aa, BK virus
IIYKRPRP

SEQ ID NO: 17819 - protein, 8 aa, BK virus
IYKRPRPP

SEQ ID NO: 17820 - protein, 8 aa, BK virus
YKRPRPPL

SEQ ID NO: 17821 - protein, 8 aa, BK virus
KRPRPPLP

SEQ ID NO: 17822 - protein, 8 aa, BK virus
RPRPPLPP

SEQ ID NO: 17823 - protein, 8 aa, BK virus
PRPPLPPP

SEQ ID NO: 17824 - protein, 8 aa, BK virus
RPPLPPPF

SEQ ID NO: 17825 - protein, 8 aa, BK virus
PPLPPPFL

SEQ ID NO: 17826 - protein, 8 aa, BK virus
PLPPPFLS

SEQ ID NO: 17827 - protein, 8 aa, BK virus
LPPPFLSS

SEQ ID NO: 17828 - protein, 8 aa, BK virus
PPPFLSSS

SEQ ID NO: 17829 - protein, 8 aa, BK virus
PPFLSSSK

SEQ ID NO: 17830 - protein, 8 aa, BK virus
PFLSSSKG

SEQ ID NO: 17831 - protein, 8 aa, BK virus
FLSSSKGV

SEQ ID NO: 17832 - protein, 8 aa, BK virus
LSSSKGVE

SEQ ID NO: 17833 - protein, 8 aa, BK virus
SSSKGVEA

SEQ ID NO: 17834 - protein, 8 aa, BK virus
SSKGVEAF

SEQ ID NO: 17835 - protein, 8 aa, BK virus
SKGVEAFS

SEQ ID NO: 17836 - protein, 8 aa, BK virus
KGVEAFSE

SEQ ID NO: 17837 - protein, 8 aa, BK virus
GVEAFSEA

SEQ ID NO: 17838 - protein, 8 aa, BK virus
QNYLGKSL

SEQ ID NO: 17839 - protein, 8 aa, BK virus
NYLGKSLF

SEQ ID NO: 17840 - protein, 8 aa, BK virus
YLGKSLFF

SEQ ID NO: 17841 - protein, 8 aa, BK virus
LGKSLFFC

SEQ ID NO: 17842 - protein, 8 aa, BK virus
GKSLFFCN

SEQ ID NO: 17843 - protein, 8 aa, BK virus
KSLFFCNF

SEQ ID NO: 17844 - protein, 8 aa, BK virus
SLFFCNFC

SEQ ID NO: 17845 - protein, 8 aa, BK virus
LFFCNFCK

SEQ ID NO: 17846 - protein, 9 aa, BK virus
WIKFLTGKN

SEQ ID NO: 17847 - protein, 9 aa, BK virus
IKFLTGKNP

SEQ ID NO: 17848 - protein, 9 aa, BK virus
KFLTGKNPW

SEQ ID NO: 17849 - protein, 9 aa, BK virus
FLTGKNPWS

SEQ ID NO: 17850 - protein, 9 aa, BK virus
LTGKNPWSS

SEQ ID NO: 17851 - protein, 9 aa, BK virus
TGKNPWSSW

SEQ ID NO: 17852 - protein, 9 aa, BK virus
GKNPWSSWT

SEQ ID NO: 17853 - protein, 9 aa, BK virus
KNPWSSWTF

SEQ ID NO: 17854 - protein, 9 aa, BK virus
ALKELPGEI

SEQ ID NO: 17855 - protein, 9 aa, BK virus
LKELPGEIF

SEQ ID NO: 17856 - protein, 9 aa, BK virus
KELPGEIFP

SEQ ID NO: 17857 - protein, 9 aa, BK virus
GSVRNFTLT

SEQ ID NO: 17858 - protein, 9 aa, BK virus
SVRNFTLTK

SEQ ID NO: 17859 - protein, 9 aa, BK virus
VRNFTLTKG

SEQ ID NO: 17860 - protein, 9 aa, BK virus
RNFTLTKGA

SEQ ID NO: 17861 - protein, 9 aa, BK virus
NFTLTKGAT

SEQ ID NO: 17862 - protein, 9 aa, BK virus
FTLTKGATR

SEQ ID NO: 17863 - protein, 9 aa, BK virus
TLTKGATRI

SEQ ID NO: 17864 - protein, 9 aa, BK virus
LTKGATRIK

SEQ ID NO: 17865 - protein, 9 aa, BK virus
ILCIKKWSR

SEQ ID NO: 17866 - protein, 9 aa, BK virus
LCIKKWSRM

SEQ ID NO: 17867 - protein, 9 aa, BK virus
LISLILEPG

SEQ ID NO: 17868 - protein, 9 aa, BK virus
ISLILEPGV

SEQ ID NO: 17869 - protein, 9 aa, BK virus
SLILEPGVA

SEQ ID NO: 17870 - protein, 9 aa, BK virus
LILEPGVAQ

SEQ ID NO: 17871 - protein, 9 aa, BK virus
ILEPGVAQR

SEQ ID NO: 17872 - protein, 9 aa, BK virus
LEPGVAQRF

SEQ ID NO: 17873 - protein, 9 aa, BK virus
EPGVAQRFV

SEQ ID NO: 17874 - protein, 9 aa, BK virus
PGVAQRFVL

SEQ ID NO: 17875 - protein, 9 aa, BK virus
GVAQRFVLI

SEQ ID NO: 17876 - protein, 9 aa, BK virus
VAQRFVLIF

SEQ ID NO: 17877 - protein, 9 aa, BK virus
AQRFVLIFL

SEQ ID NO: 17878 - protein, 9 aa, BK virus
QRFVLIFLF

SEQ ID NO: 17879 - protein, 9 aa, BK virus
RFVLIFLFA

SEQ ID NO: 17880 - protein, 9 aa, BK virus
FVLIFLFAQ

SEQ ID NO: 17881 - protein, 9 aa, BK virus
VLIFLFAQI

SEQ ID NO: 17882 - protein, 9 aa, BK virus
LIFLFAQIP

SEQ ID NO: 17883 - protein, 9 aa, BK virus
IFLFAQIPC

SEQ ID NO: 17884 - protein, 9 aa, BK virus
FLFAQIPCT

SEQ ID NO: 17885 - protein, 9 aa, BK virus
LFAQIPCTA

SEQ ID NO: 17886 - protein, 9 aa, BK virus
FAQIPCTAR

SEQ ID NO: 17887 - protein, 9 aa, BK virus
AQIPCTARN

SEQ ID NO: 17888 - protein, 9 aa, BK virus
QIPCTARNG

SEQ ID NO: 17889 - protein, 9 aa, BK virus
IPCTARNGL

SEQ ID NO: 17890 - protein, 9 aa, BK virus
PCTARNGLF

SEQ ID NO: 17891 - protein, 9 aa, BK virus
CTARNGLFV

SEQ ID NO: 17892 - protein, 9 aa, BK virus
TARNGLFVP

SEQ ID NO: 17893 - protein, 9 aa, BK virus
ARNGLFVPK

SEQ ID NO: 17894 - protein, 9 aa, BK virus
RNGLFVPKS

SEQ ID NO: 17895 - protein, 9 aa, BK virus
NGLFVPKSL

SEQ ID NO: 17896 - protein, 9 aa, BK virus
GLFVPKSLL

SEQ ID NO: 17897 - protein, 9 aa, BK virus
LFVPKSLLC

SEQ ID NO: 17898 - protein, 9 aa, BK virus
FVPKSLLCT

SEQ ID NO: 17899 - protein, 9 aa, BK virus
VPKSLLCTA

SEQ ID NO: 17900 - protein, 9 aa, BK virus
PKSLLCTAL

SEQ ID NO: 17901 - protein, 9 aa, BK virus
KSLLCTALA

SEQ ID NO: 17902 - protein, 9 aa, BK virus
SLLCTALAC

SEQ ID NO: 17903 - protein, 9 aa, BK virus
LLCTALACY

SEQ ID NO: 17904 - protein, 9 aa, BK virus
LCTALACYV

SEQ ID NO: 17905 - protein, 9 aa, BK virus
CTALACYVS

SEQ ID NO: 17906 - protein, 9 aa, BK virus
TALACYVSL

SEQ ID NO: 17907 - protein, 9 aa, BK virus
ALACYVSLD

SEQ ID NO: 17908 - protein, 9 aa, BK virus
IATALTASH

SEQ ID NO: 17909 - protein, 9 aa, BK virus
ATALTASHS

SEQ ID NO: 17910 - protein, 9 aa, BK virus
TALTASHSG

SEQ ID NO: 17911 - protein, 9 aa, BK virus
ALTASHSGL

SEQ ID NO: 17912 - protein, 9 aa, BK virus
LTASHSGLA

SEQ ID NO: 17913 - protein, 9 aa, BK virus
LKKLCNGGS

SEQ ID NO: 17914 - protein, 9 aa, BK virus
KKLCNGGSK

SEQ ID NO: 17915 - protein, 9 aa, BK virus
SFKVTNLYL

SEQ ID NO: 17916 - protein, 9 aa, BK virus
FKVTNLYLD

SEQ ID NO: 17917 - protein, 9 aa, BK virus
KVTNLYLDK

SEQ ID NO: 17918 - protein, 9 aa, BK virus
VIIFFIGAN

SEQ ID NO: 17919 - protein, 9 aa, BK virus
IIFFIGANL

SEQ ID NO: 17920 - protein, 9 aa, BK virus
IFFIGANLW

SEQ ID NO: 17921 - protein, 9 aa, BK virus
FFIGANLWN

SEQ ID NO: 17922 - protein, 9 aa, BK virus
FIGANLWNR

SEQ ID NO: 17923 - protein, 9 aa, BK virus
IGANLWNRR

SEQ ID NO: 17924 - protein, 9 aa, BK virus
GANLWNRRV

SEQ ID NO: 17925 - protein, 9 aa, BK virus
ANLWNRRVG

SEQ ID NO: 17926 - protein, 9 aa, BK virus
NLWNRRVGV

SEQ ID NO: 17927 - protein, 9 aa, BK virus
LWNRRVGVL

SEQ ID NO: 17928 - protein, 9 aa, BK virus
WNRRVGVLV

SEQ ID NO: 17929 - protein, 9 aa, BK virus
NRRVGVLVE

SEQ ID NO: 17930 - protein, 9 aa, BK virus
RRVGVLVEF

SEQ ID NO: 17931 - protein, 9 aa, BK virus
RVGVLVEFL

SEQ ID NO: 17932 - protein, 9 aa, BK virus
RSNSRFSTL

SEQ ID NO: 17933 - protein, 9 aa, BK virus
SNSRFSTLN

SEQ ID NO: 17934 - protein, 9 aa, BK virus
NSRFSTLNT

SEQ ID NO: 17935 - protein, 9 aa, BK virus
SRFSTLNTT

SEQ ID NO: 17936 - protein, 9 aa, BK virus
RFSTLNTTQ

SEQ ID NO: 17937 - protein, 9 aa, BK virus
FSTLNTTQK

SEQ ID NO: 17938 - protein, 9 aa, BK virus
STLNTTQKK

SEQ ID NO: 17939 - protein, 9 aa, BK virus
TLNTTQKKK

SEQ ID NO: 17940 - protein, 9 aa, BK virus
LNTTQKKKK

SEQ ID NO: 17941 - protein, 9 aa, BK virus
NTTQKKKKG

SEQ ID NO: 17942 - protein, 9 aa, BK virus
TTQKKKKGR

SEQ ID NO: 17943 - protein, 9 aa, BK virus
TQKKKKGRR

SEQ ID NO: 17944 - protein, 9 aa, BK virus
QKKKKGRRP

SEQ ID NO: 17945 - protein, 9 aa, BK virus
NPCLLCCVY

SEQ ID NO: 17946 - protein, 9 aa, BK virus
PCLLCCVYY

SEQ ID NO: 17947 - protein, 9 aa, BK virus
KTYGKIFCN

SEQ ID NO: 17948 - protein, 9 aa, BK virus
TYGKIFCNF

SEQ ID NO: 17949 - protein, 9 aa, BK virus
YGKIFCNFY

SEQ ID NO: 17950 - protein, 9 aa, BK virus
RSIPYYRRK

SEQ ID NO: 17951 - protein, 9 aa, BK virus
SIPYYRRKH

SEQ ID NO: 17952 - protein, 9 aa, BK virus
IPYYRRKHS

SEQ ID NO: 17953 - protein, 9 aa, BK virus
PYYRRKHSR

SEQ ID NO: 17954 - protein, 9 aa, BK virus
YYRRKHSRG

SEQ ID NO: 17955 - protein, 9 aa, BK virus
YRRKHSRGL

SEQ ID NO: 17956 - protein, 9 aa, BK virus
RRKHSRGLK

SEQ ID NO: 17957 - protein, 9 aa, BK virus
RKHSRGLKG

SEQ ID NO: 17958 - protein, 9 aa, BK virus
KHSRGLKGA

SEQ ID NO: 17959 - protein, 9 aa, BK virus
RNKAGVLEI

SEQ ID NO: 17960 - protein, 9 aa, BK virus
NKAGVLEIN

SEQ ID NO: 17961 - protein, 9 aa, BK virus
KAGVLEINY

SEQ ID NO: 17962 - protein, 9 aa, BK virus
GCVFIIRYV

SEQ ID NO: 17963 - protein, 9 aa, BK virus
CVFIIRYVF

SEQ ID NO: 17964 - protein, 9 aa, BK virus
VFIIRYVFR

SEQ ID NO: 17965 - protein, 9 aa, BK virus
FIIRYVFRI

SEQ ID NO: 17966 - protein, 9 aa, BK virus
IIRYVFRIS

SEQ ID NO: 17967 - protein, 9 aa, BK virus
IRYVFRISI

SEQ ID NO: 17968 - protein, 9 aa, BK virus
RYVFRISIQ

SEQ ID NO: 17969 - protein, 9 aa, BK virus
YVFRISIQC

SEQ ID NO: 17970 - protein, 9 aa, BK virus
VFRISIQCR

SEQ ID NO: 17971 - protein, 9 aa, BK virus
FRISIQCRG

SEQ ID NO: 17972 - protein, 9 aa, BK virus
RISIQCRGV

SEQ ID NO: 17973 - protein, 9 aa, BK virus
KVSEKRPAL

SEQ ID NO: 17974 - protein, 9 aa, BK virus
VSEKRPALS

SEQ ID NO: 17975 - protein, 9 aa, BK virus
SEKRPALSL

SEQ ID NO: 17976 - protein, 9 aa, BK virus
KALCKCYYF

SEQ ID NO: 17977 - protein, 9 aa, BK virus
ALCKCYYFC

SEQ ID NO: 17978 - protein, 9 aa, BK virus
LCKCYYFCR

SEQ ID NO: 17979 - protein, 9 aa, BK virus
CKCYYFCRK

SEQ ID NO: 17980 - protein, 9 aa, BK virus
KSKKYLSAS

SEQ ID NO: 17981 - protein, 9 aa, BK virus
SKKYLSASS

SEQ ID NO: 17982 - protein, 9 aa, BK virus
KKYLSASSR

SEQ ID NO: 17983 - protein, 9 aa, BK virus
KYLSASSRY

SEQ ID NO: 17984 - protein, 9 aa, BK virus
YLSASSRYS

SEQ ID NO: 17985 - protein, 9 aa, BK virus
LSASSRYSF

SEQ ID NO: 17986 - protein, 9 aa, BK virus
SASSRYSFS

SEQ ID NO: 17987 - protein, 9 aa, BK virus
KKSRYPSYD

SEQ ID NO: 17988 - protein, 9 aa, BK virus
KSRYPSYDQ

SEQ ID NO: 17989 - protein, 9 aa, BK virus
SRYPSYDQG

SEQ ID NO: 17990 - protein, 9 aa, BK virus
RYPSYDQGR

SEQ ID NO: 17991 - protein, 9 aa, BK virus
YPSYDQGRN

SEQ ID NO: 17992 - protein, 9 aa, BK virus
PSYDQGRNA

SEQ ID NO: 17993 - protein, 9 aa, BK virus
SYDQGRNAN

SEQ ID NO: 17994 - protein, 9 aa, BK virus
YDQGRNANR

SEQ ID NO: 17995 - protein, 9 aa, BK virus
DQGRNANRK

SEQ ID NO: 17996 - protein, 9 aa, BK virus
QGRNANRKI

SEQ ID NO: 17997 - protein, 9 aa, BK virus
GRNANRKIQ

SEQ ID NO: 17998 - protein, 9 aa, BK virus
RNANRKIQS

SEQ ID NO: 17999 - protein, 9 aa, BK virus
NANRKIQSY

SEQ ID NO: 18000 - protein, 9 aa, BK virus
ANRKIQSYI

SEQ ID NO: 18001 - protein, 9 aa, BK virus
NRKIQSYIR

SEQ ID NO: 18002 - protein, 9 aa, BK virus
NGFNIWSSW

SEQ ID NO: 18003 - protein, 9 aa, BK virus
GFNIWSSWK

SEQ ID NO: 18004 - protein, 9 aa, BK virus
FNIWSSWKC

SEQ ID NO: 18005 - protein, 9 aa, BK virus
NIWSSWKCC

SEQ ID NO: 18006 - protein, 9 aa, BK virus
IWSSWKCCT

SEQ ID NO: 18007 - protein, 9 aa, BK virus
WSSWKCCTR

SEQ ID NO: 18008 - protein, 9 aa, BK virus
SSWKCCTRT

SEQ ID NO: 18009 - protein, 9 aa, BK virus
SWKCCTRTI

SEQ ID NO: 18010 - protein, 9 aa, BK virus
WKCCTRTIY

SEQ ID NO: 18011 - protein, 9 aa, BK virus
KCCTRTIYG

SEQ ID NO: 18012 - protein, 9 aa, BK virus
CCTRTIYGR

SEQ ID NO: 18013 - protein, 9 aa, BK virus
CTRTIYGRC

SEQ ID NO: 18014 - protein, 9 aa, BK virus
TRTIYGRCC

SEQ ID NO: 18015 - protein, 9 aa, BK virus
RTIYGRCCL

SEQ ID NO: 18016 - protein, 9 aa, BK virus
TIYGRCCLA

SEQ ID NO: 18017 - protein, 9 aa, BK virus
IYGRCCLAA

SEQ ID NO: 18018 - protein, 9 aa, BK virus
YGRCCLAAL

SEQ ID NO: 18019 - protein, 9 aa, BK virus
GRCCLAALF

SEQ ID NO: 18020 - protein, 9 aa, BK virus
RCCLAALFA

SEQ ID NO: 18021 - protein, 9 aa, BK virus
CCLAALFAT

SEQ ID NO: 18022 - protein, 9 aa, BK virus
FFALYCFQC

SEQ ID NO: 18023 - protein, 9 aa, BK virus
FALYCFQCT

SEQ ID NO: 18024 - protein, 9 aa, BK virus
WKNNTSCRV

SEQ ID NO: 18025 - protein, 9 aa, BK virus
KNNTSCRVI

SEQ ID NO: 18026 - protein, 9 aa, BK virus
NNTSCRVIR

SEQ ID NO: 18027 - protein, 9 aa, BK virus
NTSCRVIRF

SEQ ID NO: 18028 - protein, 9 aa, BK virus
TSCRVIRFV

SEQ ID NO: 18029 - protein, 9 aa, BK virus
SCRVIRFVW

SEQ ID NO: 18030 - protein, 9 aa, BK virus
CRVIRFVWW

SEQ ID NO: 18031 - protein, 9 aa, BK virus
SLKCKPTHG

SEQ ID NO: 18032 - protein, 9 aa, BK virus
LKCKPTHGK

SEQ ID NO: 18033 - protein, 9 aa, BK virus
KCKPTHGKA

SEQ ID NO: 18034 - protein, 9 aa, BK virus
CKPTHGKAN

SEQ ID NO: 18035 - protein, 9 aa, BK virus
KPTHGKANL

SEQ ID NO: 18036 - protein, 9 aa, BK virus
ARCSYRSVH

SEQ ID NO: 18037 - protein, 9 aa, BK virus
RCSYRSVHG

SEQ ID NO: 18038 - protein, 9 aa, BK virus
CSYRSVHGC

SEQ ID NO: 18039 - protein, 9 aa, BK virus
SYRSVHGCF

SEQ ID NO: 18040 - protein, 9 aa, BK virus
IKGFAFRTW

SEQ ID NO: 18041 - protein, 9 aa, BK virus
KGFAFRTWN

SEQ ID NO: 18042 - protein, 9 aa, BK virus
GFAFRTWNK

SEQ ID NO: 18043 - protein, 9 aa, BK virus
FAFRTWNKQ

SEQ ID NO: 18044 - protein, 9 aa, BK virus
AFRTWNKQF

SEQ ID NO: 18045 - protein, 9 aa, BK virus
FRTWNKQFR

SEQ ID NO: 18046 - protein, 9 aa, BK virus
RTWNKQFRQ

SEQ ID NO: 18047 - protein, 9 aa, BK virus
TWNKQFRQF

SEQ ID NO: 18048 - protein, 9 aa, BK virus
WNKQFRQFE

SEQ ID NO: 18049 - protein, 9 aa, BK virus
NKQFRQFER

SEQ ID NO: 18050 - protein, 9 aa, BK virus
KQFRQFERL

SEQ ID NO: 18051 - protein, 9 aa, BK virus
QFRQFERLF

SEQ ID NO: 18052 - protein, 9 aa, BK virus
FRQFERLFR

SEQ ID NO: 18053 - protein, 9 aa, BK virus
RQFERLFRW

SEQ ID NO: 18054 - protein, 9 aa, BK virus
QFERLFRWK

SEQ ID NO: 18055 - protein, 9 aa, BK virus
FERLFRWKC

SEQ ID NO: 18056 - protein, 9 aa, BK virus
GKFRKETFK

SEQ ID NO: 18057 - protein, 9 aa, BK virus
KFRKETFKQ

SEQ ID NO: 18058 - protein, 9 aa, BK virus
FRKETFKQK

SEQ ID NO: 18059 - protein, 9 aa, BK virus
RKETFKQKN

SEQ ID NO: 18060 - protein, 9 aa, BK virus
KETFKQKNP

SEQ ID NO: 18061 - protein, 9 aa, BK virus
ETFKQKNPN

SEQ ID NO: 18062 - protein, 9 aa, BK virus
TFKQKNPNI

SEQ ID NO: 18063 - protein, 9 aa, BK virus
FKQKNPNIS

SEQ ID NO: 18064 - protein, 9 aa, BK virus
KQKNPNIST

SEQ ID NO: 18065 - protein, 9 aa, BK virus
QKNPNISTR

SEQ ID NO: 18066 - protein, 9 aa, BK virus
KNPNISTRL

SEQ ID NO: 18067 - protein, 9 aa, BK virus
NPNISTRLG

SEQ ID NO: 18068 - protein, 9 aa, BK virus
PNISTRLGY

SEQ ID NO: 18069 - protein, 9 aa, BK virus
NISTRLGYN

SEQ ID NO: 18070 - protein, 9 aa, BK virus
ISTRLGYNE

SEQ ID NO: 18071 - protein, 9 aa, BK virus
AQNIFKKIL

SEQ ID NO: 18072 - protein, 9 aa, BK virus
QNIFKKILT

SEQ ID NO: 18073 - protein, 9 aa, BK virus
NIFKKILTK

SEQ ID NO: 18074 - protein, 9 aa, BK virus
IFKKILTKL

SEQ ID NO: 18075 - protein, 9 aa, BK virus
FKKILTKLR

SEQ ID NO: 18076 - protein, 9 aa, BK virus
KKILTKLRV

SEQ ID NO: 18077 - protein, 9 aa, BK virus
KILTKLRVL

SEQ ID NO: 18078 - protein, 9 aa, BK virus
ILTKLRVLT

SEQ ID NO: 18079 - protein, 9 aa, BK virus
KKNFTKWND

SEQ ID NO: 18080 - protein, 9 aa, BK virus
KNFTKWNDL

SEQ ID NO: 18081 - protein, 9 aa, BK virus
NFTKWNDLV

SEQ ID NO: 18082 - protein, 9 aa, BK virus
FTKWNDLVA

SEQ ID NO: 18083 - protein, 9 aa, BK virus
TKWNDLVAT

SEQ ID NO: 18084 - protein, 9 aa, BK virus
KWNDLVATA

SEQ ID NO: 18085 - protein, 9 aa, BK virus
WNDLVATAN

SEQ ID NO: 18086 - protein, 9 aa, BK virus
NDLVATANL

SEQ ID NO: 18087 - protein, 9 aa, BK virus
DLVATANLV

SEQ ID NO: 18088 - protein, 9 aa, BK virus
DKYVYFFKD

SEQ ID NO: 18089 - protein, 9 aa, BK virus
KYVYFFKDE

SEQ ID NO: 18090 - protein, 9 aa, BK virus
YVYFFKDEI

SEQ ID NO: 18091 - protein, 9 aa, BK virus
YYKRRGFRN

SEQ ID NO: 18092 - protein, 9 aa, BK virus
IPITMLFPS

SEQ ID NO: 18093 - protein, 9 aa, BK virus
PITMLFPSL

SEQ ID NO: 18094 - protein, 9 aa, BK virus
ITMLFPSLR

SEQ ID NO: 18095 - protein, 9 aa, BK virus
TMLFPSLRY

SEQ ID NO: 18096 - protein, 9 aa, BK virus
MLFPSLRYF

SEQ ID NO: 18097 - protein, 9 aa, BK virus
LFPSLRYFS

SEQ ID NO: 18098 - protein, 9 aa, BK virus
FPSLRYFSP

SEQ ID NO: 18099 - protein, 9 aa, BK virus
PSLRYFSPC

SEQ ID NO: 18100 - protein, 9 aa, BK virus
NTTPKITQA

SEQ ID NO: 18101 - protein, 9 aa, BK virus
KWLIQKQHL

SEQ ID NO: 18102 - protein, 9 aa, BK virus
WLIQKQHLL

SEQ ID NO: 18103 - protein, 9 aa, BK virus
LIQKQHLLN

SEQ ID NO: 18104 - protein, 9 aa, BK virus
IQKQHLLNV

SEQ ID NO: 18105 - protein, 9 aa, BK virus
QKQHLLNVY

SEQ ID NO: 18106 - protein, 9 aa, BK virus
KQHLLNVYV

SEQ ID NO: 18107 - protein, 9 aa, BK virus
QHLLNVYVQ

SEQ ID NO: 18108 - protein, 9 aa, BK virus
KHLFKAFWF

SEQ ID NO: 18109 - protein, 9 aa, BK virus
HLFKAFWFA

SEQ ID NO: 18110 - protein, 9 aa, BK virus
LFKAFWFAI

SEQ ID NO: 18111 - protein, 9 aa, BK virus
FKAFWFAIV

SEQ ID NO: 18112 - protein, 9 aa, BK virus
KAFWFAIVP

SEQ ID NO: 18113 - protein, 9 aa, BK virus
AFWFAIVPV

SEQ ID NO: 18114 - protein, 9 aa, BK virus
FWFAIVPVC

SEQ ID NO: 18115 - protein, 9 aa, BK virus
WFAIVPVCQ

SEQ ID NO: 18116 - protein, 9 aa, BK virus
FAIVPVCQY

SEQ ID NO: 18117 - protein, 9 aa, BK virus
AIVPVCQYI

SEQ ID NO: 18118 - protein, 9 aa, BK virus
IVPVCQYIL

SEQ ID NO: 18119 - protein, 9 aa, BK virus
VPVCQYILS

SEQ ID NO: 18120 - protein, 9 aa, BK virus
PVCQYILSY

SEQ ID NO: 18121 - protein, 9 aa, BK virus
VCQYILSYL

SEQ ID NO: 18122 - protein, 9 aa, BK virus
CQYILSYLG

SEQ ID NO: 18123 - protein, 9 aa, BK virus
QYILSYLGP

SEQ ID NO: 18124 - protein, 9 aa, BK virus
YILSYLGPL

SEQ ID NO: 18125 - protein, 9 aa, BK virus
ILSYLGPLE

SEQ ID NO: 18126 - protein, 9 aa, BK virus
LSYLGPLEV

SEQ ID NO: 18127 - protein, 9 aa, BK virus
SYLGPLEVF

SEQ ID NO: 18128 - protein, 9 aa, BK virus
YLGPLEVFL

SEQ ID NO: 18129 - protein, 9 aa, BK virus
LGPLEVFLC

SEQ ID NO: 18130 - protein, 9 aa, BK virus
GPLEVFLCH

SEQ ID NO: 18131 - protein, 9 aa, BK virus
PLEVFLCHQ

SEQ ID NO: 18132 - protein, 9 aa, BK virus
LEVFLCHQT

SEQ ID NO: 18133 - protein, 9 aa, BK virus
EVFLCHQTP

SEQ ID NO: 18134 - protein, 9 aa, BK virus
PLLPGIPYH

SEQ ID NO: 18135 - protein, 9 aa, BK virus
LLPGIPYHT

SEQ ID NO: 18136 - protein, 9 aa, BK virus
AAHPLSGFS

SEQ ID NO: 18137 - protein, 9 aa, BK virus
AHPLSGFSC

SEQ ID NO: 18138 - protein, 9 aa, BK virus
HPLSGFSCL

SEQ ID NO: 18139 - protein, 9 aa, BK virus
GHLAKRKLG

SEQ ID NO: 18140 - protein, 9 aa, BK virus
HLAKRKLGK

SEQ ID NO: 18141 - protein, 9 aa, BK virus
LAKRKLGKD

SEQ ID NO: 18142 - protein, 9 aa, BK virus
AKRKLGKDS

SEQ ID NO: 18143 - protein, 9 aa, BK virus
KRKLGKDSL

SEQ ID NO: 18144 - protein, 9 aa, BK virus
RKLGKDSLQ

SEQ ID NO: 18145 - protein, 9 aa, BK virus
KLGKDSLQI

SEQ ID NO: 18146 - protein, 9 aa, BK virus
LGKDSLQIF

SEQ ID NO: 18147 - protein, 9 aa, BK virus
GKDSLQIFF

SEQ ID NO: 18148 - protein, 9 aa, BK virus
KDSLQIFFS

SEQ ID NO: 18149 - protein, 9 aa, BK virus
DSLQIFFSG

SEQ ID NO: 18150 - protein, 9 aa, BK virus
SLQIFFSGG

SEQ ID NO: 18151 - protein, 9 aa, BK virus
LQIFFSGGS

SEQ ID NO: 18152 - protein, 9 aa, BK virus
NILQGLSTV

SEQ ID NO: 18153 - protein, 9 aa, BK virus
ILQGLSTVV

SEQ ID NO: 18154 - protein, 9 aa, BK virus
LQGLSTVVF

SEQ ID NO: 18155 - protein, 9 aa, BK virus
QGLSTVVFQ

SEQ ID NO: 18156 - protein, 9 aa, BK virus
GLSTVVFQS

SEQ ID NO: 18157 - protein, 9 aa, BK virus
LSTVVFQSC

SEQ ID NO: 18158 - protein, 9 aa, BK virus
TGHKYQQLK

SEQ ID NO: 18159 - protein, 9 aa, BK virus
GHKYQQLKH

SEQ ID NO: 18160 - protein, 9 aa, BK virus
HKYQQLKHT

SEQ ID NO: 18161 - protein, 9 aa, BK virus
KYQQLKHTG

SEQ ID NO: 18162 - protein, 9 aa, BK virus
YQQLKHTGY

SEQ ID NO: 18163 - protein, 9 aa, BK virus
QQLKHTGYQ

SEQ ID NO: 18164 - protein, 9 aa, BK virus
QLKHTGYQL

SEQ ID NO: 18165 - protein, 9 aa, BK virus
LKHTGYQLY

SEQ ID NO: 18166 - protein, 9 aa, BK virus
KHTGYQLYK

SEQ ID NO: 18167 - protein, 9 aa, BK virus
HTGYQLYKE

SEQ ID NO: 18168 - protein, 9 aa, BK virus
TGYQLYKEA

SEQ ID NO: 18169 - protein, 9 aa, BK virus
GYQLYKEAP

SEQ ID NO: 18170 - protein, 9 aa, BK virus
YQLYKEAPH

SEQ ID NO: 18171 - protein, 9 aa, BK virus
QLYKEAPHP

SEQ ID NO: 18172 - protein, 9 aa, BK virus
LYKEAPHPV

SEQ ID NO: 18173 - protein, 9 aa, BK virus
YKEAPHPVH

SEQ ID NO: 18174 - protein, 9 aa, BK virus
KEAPHPVHL

SEQ ID NO: 18175 - protein, 9 aa, BK virus
EAPHPVHLA

SEQ ID NO: 18176 - protein, 9 aa, BK virus
APHPVHLAT

SEQ ID NO: 18177 - protein, 9 aa, BK virus
PHPVHLATL

SEQ ID NO: 18178 - protein, 9 aa, BK virus
HPVHLATLW

SEQ ID NO: 18179 - protein, 9 aa, BK virus
LCWSHEVLG

SEQ ID NO: 18180 - protein, 9 aa, BK virus
CWSHEVLGE

SEQ ID NO: 18181 - protein, 9 aa, BK virus
WSHEVLGEH

SEQ ID NO: 18182 - protein, 9 aa, BK virus
SHEVLGEHF

SEQ ID NO: 18183 - protein, 9 aa, BK virus
HEVLGEHFP

SEQ ID NO: 18184 - protein, 9 aa, BK virus
EVLGEHFPL

SEQ ID NO: 18185 - protein, 9 aa, BK virus
VLGEHFPLL

SEQ ID NO: 18186 - protein, 9 aa, BK virus
HFHFYWDQV

SEQ ID NO: 18187 - protein, 9 aa, BK virus
FHFYWDQVP

SEQ ID NO: 18188 - protein, 9 aa, BK virus
HFYWDQVPS

SEQ ID NO: 18189 - protein, 9 aa, BK virus
FYWDQVPST

SEQ ID NO: 18190 - protein, 9 aa, BK virus
YWDQVPSTQ

SEQ ID NO: 18191 - protein, 9 aa, BK virus
WDQVPSTQL

SEQ ID NO: 18192 - protein, 9 aa, BK virus
DQVPSTQLD

SEQ ID NO: 18193 - protein, 9 aa, BK virus
QVPSTQLDK

SEQ ID NO: 18194 - protein, 9 aa, BK virus
VPSTQLDKH

SEQ ID NO: 18195 - protein, 9 aa, BK virus
PSTQLDKHC

SEQ ID NO: 18196 - protein, 9 aa, BK virus
STQLDKHCF

SEQ ID NO: 18197 - protein, 9 aa, BK virus
TQLDKHCFC

SEQ ID NO: 18198 - protein, 9 aa, BK virus
QLDKHCFCP

SEQ ID NO: 18199 - protein, 9 aa, BK virus
LDKHCFCPN

SEQ ID NO: 18200 - protein, 9 aa, BK virus
DKHCFCPNR

SEQ ID NO: 18201 - protein, 9 aa, BK virus
KHCFCPNRP

SEQ ID NO: 18202 - protein, 9 aa, BK virus
HCFCPNRPY

SEQ ID NO: 18203 - protein, 9 aa, BK virus
CFCPNRPYG

SEQ ID NO: 18204 - protein, 9 aa, BK virus
FCPNRPYGQ

SEQ ID NO: 18205 - protein, 9 aa, BK virus
CPNRPYGQY

SEQ ID NO: 18206 - protein, 9 aa, BK virus
PNRPYGQYS

SEQ ID NO: 18207 - protein, 9 aa, BK virus
NRPYGQYSL

SEQ ID NO: 18208 - protein, 9 aa, BK virus
RPYGQYSLP

SEQ ID NO: 18209 - protein, 9 aa, BK virus
PYGQYSLPG

SEQ ID NO: 18210 - protein, 9 aa, BK virus
YGQYSLPGT

SEQ ID NO: 18211 - protein, 9 aa, BK virus
GQYSLPGTG

SEQ ID NO: 18212 - protein, 9 aa, BK virus
QYSLPGTGL

SEQ ID NO: 18213 - protein, 9 aa, BK virus
YSLPGTGLL

SEQ ID NO: 18214 - protein, 9 aa, BK virus
SLPGTGLLG

SEQ ID NO: 18215 - protein, 9 aa, BK virus
LPGTGLLGF

SEQ ID NO: 18216 - protein, 9 aa, BK virus
YHQGTLTCN

SEQ ID NO: 18217 - protein, 9 aa, BK virus
HQGTLTCNS

SEQ ID NO: 18218 - protein, 9 aa, BK virus
QGTLTCNSL

SEQ ID NO: 18219 - protein, 9 aa, BK virus
GTLTCNSLA

SEQ ID NO: 18220 - protein, 9 aa, BK virus
TLTCNSLAL

SEQ ID NO: 18221 - protein, 9 aa, BK virus
LTCNSLALP

SEQ ID NO: 18222 - protein, 9 aa, BK virus
TCNSLALPA

SEQ ID NO: 18223 - protein, 9 aa, BK virus
CNSLALPAF

SEQ ID NO: 18224 - protein, 9 aa, BK virus
NSLALPAFP

SEQ ID NO: 18225 - protein, 9 aa, BK virus
SLALPAFPR

SEQ ID NO: 18226 - protein, 9 aa, BK virus
LALPAFPRV

SEQ ID NO: 18227 - protein, 9 aa, BK virus
ALPAFPRVL

SEQ ID NO: 18228 - protein, 9 aa, BK virus
LPAFPRVLH

SEQ ID NO: 18229 - protein, 9 aa, BK virus
PAFPRVLHL

SEQ ID NO: 18230 - protein, 9 aa, BK virus
AFPRVLHLQ

SEQ ID NO: 18231 - protein, 9 aa, BK virus
FPRVLHLQQ

SEQ ID NO: 18232 - protein, 9 aa, BK virus
PRVLHLQQR

SEQ ID NO: 18233 - protein, 9 aa, BK virus
RVLHLQQRS

SEQ ID NO: 18234 - protein, 9 aa, BK virus
VLHLQQRSG

SEQ ID NO: 18235 - protein, 9 aa, BK virus
LHLQQRSGN

SEQ ID NO: 18236 - protein, 9 aa, BK virus
HLQQRSGNY

SEQ ID NO: 18237 - protein, 9 aa, BK virus
LQQRSGNYC

SEQ ID NO: 18238 - protein, 9 aa, BK virus
QQRSGNYCL

SEQ ID NO: 18239 - protein, 9 aa, BK virus
QRSGNYCLE

SEQ ID NO: 18240 - protein, 9 aa, BK virus
VFLHHAHAL

SEQ ID NO: 18241 - protein, 9 aa, BK virus
FLHHAHALF

SEQ ID NO: 18242 - protein, 9 aa, BK virus
LHHAHALFV

SEQ ID NO: 18243 - protein, 9 aa, BK virus
HHAHALFVT

SEQ ID NO: 18244 - protein, 9 aa, BK virus
HAHALFVTL

SEQ ID NO: 18245 - protein, 9 aa, BK virus
AHALFVTLH

SEQ ID NO: 18246 - protein, 9 aa, BK virus
HALFVTLHE

SEQ ID NO: 18247 - protein, 9 aa, BK virus
ALFVTLHEG

SEQ ID NO: 18248 - protein, 9 aa, BK virus
PLFVQLQPP

SEQ ID NO: 18249 - protein, 9 aa, BK virus
LFVQLQPPT

SEQ ID NO: 18250 - protein, 9 aa, BK virus
FVQLQPPTS

SEQ ID NO: 18251 - protein, 9 aa, BK virus
VQLQPPTSV

SEQ ID NO: 18252 - protein, 9 aa, BK virus
QLQPPTSVD

SEQ ID NO: 18253 - protein, 9 aa, BK virus
LQPPTSVDF

SEQ ID NO: 18254 - protein, 9 aa, BK virus
QPPTSVDFH

SEQ ID NO: 18255 - protein, 9 aa, BK virus
PPTSVDFHR

SEQ ID NO: 18256 - protein, 9 aa, BK virus
PTSVDFHRL

SEQ ID NO: 18257 - protein, 9 aa, BK virus
TSVDFHRLG

SEQ ID NO: 18258 - protein, 9 aa, BK virus
SVDFHRLGP

SEQ ID NO: 18259 - protein, 9 aa, BK virus
VDFHRLGPH

SEQ ID NO: 18260 - protein, 9 aa, BK virus
DFHRLGPHL

SEQ ID NO: 18261 - protein, 9 aa, BK virus
FHRLGPHLN

SEQ ID NO: 18262 - protein, 9 aa, BK virus
HRLGPHLNW

SEQ ID NO: 18263 - protein, 9 aa, BK virus
RLGPHLNWG

SEQ ID NO: 18264 - protein, 9 aa, BK virus
LGPHLNWGG

SEQ ID NO: 18265 - protein, 9 aa, BK virus
GPHLNWGGE

SEQ ID NO: 18266 - protein, 9 aa, BK virus
PHLNWGGEF

SEQ ID NO: 18267 - protein, 9 aa, BK virus
HLNWGGEFL

SEQ ID NO: 18268 - protein, 9 aa, BK virus
LNWGGEFLL

SEQ ID NO: 18269 - protein, 9 aa, BK virus
NWGGEFLLC

SEQ ID NO: 18270 - protein, 9 aa, BK virus
WGGEFLLCC

SEQ ID NO: 18271 - protein, 9 aa, BK virus
GGEFLLCCN

SEQ ID NO: 18272 - protein, 9 aa, BK virus
GEFLLCCNR

SEQ ID NO: 18273 - protein, 9 aa, BK virus
EFLLCCNRE

SEQ ID NO: 18274 - protein, 9 aa, BK virus
FLLCCNREA

SEQ ID NO: 18275 - protein, 9 aa, BK virus
LLCCNREAF

SEQ ID NO: 18276 - protein, 9 aa, BK virus
LCCNREAFF

SEQ ID NO: 18277 - protein, 9 aa, BK virus
CCNREAFFS

SEQ ID NO: 18278 - protein, 9 aa, BK virus
CNREAFFSL

SEQ ID NO: 18279 - protein, 9 aa, BK virus
NREAFFSLG

SEQ ID NO: 18280 - protein, 9 aa, BK virus
REAFFSLGY

SEQ ID NO: 18281 - protein, 9 aa, BK virus
EAFFSLGYH

SEQ ID NO: 18282 - protein, 9 aa, BK virus
AFFSLGYHC

SEQ ID NO: 18283 - protein, 9 aa, BK virus
SHFQHLALD

SEQ ID NO: 18284 - protein, 9 aa, BK virus
GFHLDPPFL

SEQ ID NO: 18285 - protein, 9 aa, BK virus
FHLDPPFLG

SEQ ID NO: 18286 - protein, 9 aa, BK virus
HLDPPFLGL

SEQ ID NO: 18287 - protein, 9 aa, BK virus
LDPPFLGLG

SEQ ID NO: 18288 - protein, 9 aa, BK virus
DPPFLGLGS

SEQ ID NO: 18289 - protein, 9 aa, BK virus
PPFLGLGSI

SEQ ID NO: 18290 - protein, 9 aa, BK virus
PFLGLGSIL

SEQ ID NO: 18291 - protein, 9 aa, BK virus
FLGLGSILP

SEQ ID NO: 18292 - protein, 9 aa, BK virus
LGLGSILPL

SEQ ID NO: 18293 - protein, 9 aa, BK virus
LLELLLLLL

SEQ ID NO: 18294 - protein, 9 aa, BK virus
LELLLLLLL

SEQ ID NO: 18295 - protein, 9 aa, BK virus
ELLLLLLLV

SEQ ID NO: 18296 - protein, 9 aa, BK virus
LLLLLLLVV

SEQ ID NO: 18297 - protein, 9 aa, BK virus
LLLLLLVVL

SEQ ID NO: 18298 - protein, 9 aa, BK virus
LLLLLVVLA

SEQ ID NO: 18299 - protein, 9 aa, BK virus
LLLLVVLAL

SEQ ID NO: 18300 - protein, 9 aa, BK virus
LLLVVLALA

SEQ ID NO: 18301 - protein, 9 aa, BK virus
LLVVLALAR

SEQ ID NO: 18302 - protein, 9 aa, BK virus
LVVLALARV

SEQ ID NO: 18303 - protein, 9 aa, BK virus
VVLALARVP

SEQ ID NO: 18304 - protein, 9 aa, BK virus
VLALARVPL

SEQ ID NO: 18305 - protein, 9 aa, BK virus
LALARVPLA

SEQ ID NO: 18306 - protein, 9 aa, BK virus
ALARVPLAF

SEQ ID NO: 18307 - protein, 9 aa, BK virus
LARVPLAFW

SEQ ID NO: 18308 - protein, 9 aa, BK virus
ARVPLAFWE

SEQ ID NO: 18309 - protein, 9 aa, BK virus
RVPLAFWEL

SEQ ID NO: 18310 - protein, 9 aa, BK virus
VPLAFWELP

SEQ ID NO: 18311 - protein, 9 aa, BK virus
PLAFWELPL

SEQ ID NO: 18312 - protein, 9 aa, BK virus
LAFWELPLD

SEQ ID NO: 18313 - protein, 9 aa, BK virus
AFWELPLDT

SEQ ID NO: 18314 - protein, 9 aa, BK virus
FWELPLDTL

SEQ ID NO: 18315 - protein, 9 aa, BK virus
WELPLDTLL

SEQ ID NO: 18316 - protein, 9 aa, BK virus
ELPLDTLLF

SEQ ID NO: 18317 - protein, 9 aa, BK virus
LPLDTLLFF

SEQ ID NO: 18318 - protein, 9 aa, BK virus
PLDTLLFFW

SEQ ID NO: 18319 - protein, 9 aa, BK virus
LDTLLFFWL

SEQ ID NO: 18320 - protein, 9 aa, BK virus
DTLLFFWLG

SEQ ID NO: 18321 - protein, 9 aa, BK virus
TLLFFWLGP

SEQ ID NO: 18322 - protein, 9 aa, BK virus
LLFFWLGPS

SEQ ID NO: 18323 - protein, 9 aa, BK virus
LFFWLGPSS

SEQ ID NO: 18324 - protein, 9 aa, BK virus
FFWLGPSSY

SEQ ID NO: 18325 - protein, 9 aa, BK virus
FWLGPSSYA

SEQ ID NO: 18326 - protein, 9 aa, BK virus
WLGPSSYAS

SEQ ID NO: 18327 - protein, 9 aa, BK virus
LGPSSYASR

SEQ ID NO: 18328 - protein, 9 aa, BK virus
GPSSYASRA

SEQ ID NO: 18329 - protein, 9 aa, BK virus
PSSYASRAG

SEQ ID NO: 18330 - protein, 9 aa, BK virus
SSYASRAGV

SEQ ID NO: 18331 - protein, 9 aa, BK virus
SYASRAGVT

SEQ ID NO: 18332 - protein, 9 aa, BK virus
YASRAGVTV

SEQ ID NO: 18333 - protein, 9 aa, BK virus
ASRAGVTVP

SEQ ID NO: 18334 - protein, 9 aa, BK virus
SRAGVTVPY

SEQ ID NO: 18335 - protein, 9 aa, BK virus
RAGVTVPYR

SEQ ID NO: 18336 - protein, 9 aa, BK virus
AGVTVPYRP

SEQ ID NO: 18337 - protein, 9 aa, BK virus
GVTVPYRPR

SEQ ID NO: 18338 - protein, 9 aa, BK virus
VTVPYRPRS

SEQ ID NO: 18339 - protein, 9 aa, BK virus
TVPYRPRSK

SEQ ID NO: 18340 - protein, 9 aa, BK virus
VPYRPRSKG

SEQ ID NO: 18341 - protein, 9 aa, BK virus
PYRPRSKGN

SEQ ID NO: 18342 - protein, 9 aa, BK virus
YRPRSKGNI

SEQ ID NO: 18343 - protein, 9 aa, BK virus
RPRSKGNIH

SEQ ID NO: 18344 - protein, 9 aa, BK virus
LAPPGAIVF

SEQ ID NO: 18345 - protein, 9 aa, BK virus
APPGAIVFS

SEQ ID NO: 18346 - protein, 9 aa, BK virus
PPGAIVFSI

SEQ ID NO: 18347 - protein, 9 aa, BK virus
PGAIVFSIN

SEQ ID NO: 18348 - protein, 9 aa, BK virus
GAIVFSINS

SEQ ID NO: 18349 - protein, 9 aa, BK virus
AIVFSINSP

SEQ ID NO: 18350 - protein, 9 aa, BK virus
IVFSINSPE

SEQ ID NO: 18351 - protein, 9 aa, BK virus
VFSINSPEC

SEQ ID NO: 18352 - protein, 9 aa, BK virus
FSINSPECT

SEQ ID NO: 18353 - protein, 9 aa, BK virus
SINSPECTL

SEQ ID NO: 18354 - protein, 9 aa, BK virus
INSPECTLC

SEQ ID NO: 18355 - protein, 9 aa, BK virus
FLKSILCVT

SEQ ID NO: 18356 - protein, 9 aa, BK virus
LKSILCVTS

SEQ ID NO: 18357 - protein, 9 aa, BK virus
KSILCVTSS

SEQ ID NO: 18358 - protein, 9 aa, BK virus
SILCVTSSI

SEQ ID NO: 18359 - protein, 9 aa, BK virus
ILCVTSSIL

SEQ ID NO: 18360 - protein, 9 aa, BK virus
LCVTSSILS

SEQ ID NO: 18361 - protein, 9 aa, BK virus
CVTSSILSA

SEQ ID NO: 18362 - protein, 9 aa, BK virus
VTSSILSAS

SEQ ID NO: 18363 - protein, 9 aa, BK virus
TSSILSASS

SEQ ID NO: 18364 - protein, 9 aa, BK virus
SSILSASSI

SEQ ID NO: 18365 - protein, 9 aa, BK virus
SILSASSIL

SEQ ID NO: 18366 - protein, 9 aa, BK virus
VWPKCTRVP

SEQ ID NO: 18367 - protein, 9 aa, BK virus
WPKCTRVPS

SEQ ID NO: 18368 - protein, 9 aa, BK virus
PKCTRVPSL

SEQ ID NO: 18369 - protein, 9 aa, BK virus
KCTRVPSLS

SEQ ID NO: 18370 - protein, 9 aa, BK virus
CTRVPSLSA

SEQ ID NO: 18371 - protein, 9 aa, BK virus
TRVPSLSAT

SEQ ID NO: 18372 - protein, 9 aa, BK virus
RVPSLSATC

SEQ ID NO: 18373 - protein, 9 aa, BK virus
VPSLSATCL

SEQ ID NO: 18374 - protein, 9 aa, BK virus
PSLSATCLT

SEQ ID NO: 18375 - protein, 9 aa, BK virus
SLSATCLTI

SEQ ID NO: 18376 - protein, 9 aa, BK virus
LSATCLTIE

SEQ ID NO: 18377 - protein, 9 aa, BK virus
SATCLTIEG

SEQ ID NO: 18378 - protein, 9 aa, BK virus
ATCLTIEGL

SEQ ID NO: 18379 - protein, 9 aa, BK virus
TCLTIEGLI

SEQ ID NO: 18380 - protein, 9 aa, BK virus
CLTIEGLIG

SEQ ID NO: 18381 - protein, 9 aa, BK virus
LTIEGLIGE

SEQ ID NO: 18382 - protein, 9 aa, BK virus
TIEGLIGER

SEQ ID NO: 18383 - protein, 9 aa, BK virus
IEGLIGERS

SEQ ID NO: 18384 - protein, 9 aa, BK virus
EGLIGERSE

SEQ ID NO: 18385 - protein, 9 aa, BK virus
KFIGAFTIV

SEQ ID NO: 18386 - protein, 9 aa, BK virus
FIGAFTIVQ

SEQ ID NO: 18387 - protein, 9 aa, BK virus
IGAFTIVQV

SEQ ID NO: 18388 - protein, 9 aa, BK virus
GAFTIVQVV

SEQ ID NO: 18389 - protein, 9 aa, BK virus
AFTIVQVVS

SEQ ID NO: 18390 - protein, 9 aa, BK virus
FTIVQVVSS

SEQ ID NO: 18391 - protein, 9 aa, BK virus
TIVQVVSSK

SEQ ID NO: 18392 - protein, 9 aa, BK virus
IVQVVSSKN

SEQ ID NO: 18393 - protein, 9 aa, BK virus
VQVVSSKNL

SEQ ID NO: 18394 - protein, 9 aa, BK virus
QVVSSKNLA

SEQ ID NO: 18395 - protein, 9 aa, BK virus
VVSSKNLAK

SEQ ID NO: 18396 - protein, 9 aa, BK virus
VSSKNLAKE

SEQ ID NO: 18397 - protein, 9 aa, BK virus
SSKNLAKES

SEQ ID NO: 18398 - protein, 9 aa, BK virus
SKNLAKESL

SEQ ID NO: 18399 - protein, 9 aa, BK virus
KNLAKESLK

SEQ ID NO: 18400 - protein, 9 aa, BK virus
NLAKESLKN

SEQ ID NO: 18401 - protein, 9 aa, BK virus
LAKESLKNL

SEQ ID NO: 18402 - protein, 9 aa, BK virus
AKESLKNLS

SEQ ID NO: 18403 - protein, 9 aa, BK virus
KESLKNLSV

SEQ ID NO: 18404 - protein, 9 aa, BK virus
ESLKNLSVL

SEQ ID NO: 18405 - protein, 9 aa, BK virus
SLKNLSVLL

SEQ ID NO: 18406 - protein, 9 aa, BK virus
LKNLSVLLC

SEQ ID NO: 18407 - protein, 9 aa, BK virus
KNLSVLLCN

SEQ ID NO: 18408 - protein, 9 aa, BK virus
NLSVLLCNS

SEQ ID NO: 18409 - protein, 9 aa, BK virus
LSVLLCNSC

SEQ ID NO: 18410 - protein, 9 aa, BK virus
SVLLCNSCE

SEQ ID NO: 18411 - protein, 9 aa, BK virus
VLLCNSCEV

SEQ ID NO: 18412 - protein, 9 aa, BK virus
LLCNSCEVI

SEQ ID NO: 18413 - protein, 9 aa, BK virus
LCNSCEVIE

SEQ ID NO: 18414 - protein, 9 aa, BK virus
CNSCEVIEG

SEQ ID NO: 18415 - protein, 9 aa, BK virus
NSCEVIEGI

SEQ ID NO: 18416 - protein, 9 aa, BK virus
SCEVIEGIS

SEQ ID NO: 18417 - protein, 9 aa, BK virus
CEVIEGISS

SEQ ID NO: 18418 - protein, 9 aa, BK virus
EVIEGISSL

SEQ ID NO: 18419 - protein, 9 aa, BK virus
VIEGISSLI

SEQ ID NO: 18420 - protein, 9 aa, BK virus
IEGISSLIT

SEQ ID NO: 18421 - protein, 9 aa, BK virus
EGISSLITC

SEQ ID NO: 18422 - protein, 9 aa, BK virus
GISSLITCH

SEQ ID NO: 18423 - protein, 9 aa, BK virus
ISSLITCHK

SEQ ID NO: 18424 - protein, 9 aa, BK virus
SSLITCHKA

SEQ ID NO: 18425 - protein, 9 aa, BK virus
SLITCHKAW

SEQ ID NO: 18426 - protein, 9 aa, BK virus
LITCHKAWE

SEQ ID NO: 18427 - protein, 9 aa, BK virus
ITCHKAWEI

SEQ ID NO: 18428 - protein, 9 aa, BK virus
TCHKAWEIV

SEQ ID NO: 18429 - protein, 9 aa, BK virus
CHKAWEIVA

SEQ ID NO: 18430 - protein, 9 aa, BK virus
HKAWEIVAN

SEQ ID NO: 18431 - protein, 9 aa, BK virus
KAWEIVANK

SEQ ID NO: 18432 - protein, 9 aa, BK virus
AWEIVANKE

SEQ ID NO: 18433 - protein, 9 aa, BK virus
WEIVANKEG

SEQ ID NO: 18434 - protein, 9 aa, BK virus
EIVANKEGP

SEQ ID NO: 18435 - protein, 9 aa, BK virus
IVANKEGPQ

SEQ ID NO: 18436 - protein, 9 aa, BK virus
VANKEGPQC

SEQ ID NO: 18437 - protein, 9 aa, BK virus
ANKEGPQCL

SEQ ID NO: 18438 - protein, 9 aa, BK virus
NKEGPQCLG

SEQ ID NO: 18439 - protein, 9 aa, BK virus
KEGPQCLGS

SEQ ID NO: 18440 - protein, 9 aa, BK virus
EGPQCLGSR

SEQ ID NO: 18441 - protein, 9 aa, BK virus
GPQCLGSRY

SEQ ID NO: 18442 - protein, 9 aa, BK virus
ILLTKVFTP

SEQ ID NO: 18443 - protein, 9 aa, BK virus
LLTKVFTPG

SEQ ID NO: 18444 - protein, 9 aa, BK virus
LTKVFTPGN

SEQ ID NO: 18445 - protein, 9 aa, BK virus
TKVFTPGNR

SEQ ID NO: 18446 - protein, 9 aa, BK virus
KVFTPGNRI

SEQ ID NO: 18447 - protein, 9 aa, BK virus
VFTPGNRIS

SEQ ID NO: 18448 - protein, 9 aa, BK virus
YSSGLNNSK

SEQ ID NO: 18449 - protein, 9 aa, BK virus
SSGLNNSKA

SEQ ID NO: 18450 - protein, 9 aa, BK virus
SGLNNSKAM

SEQ ID NO: 18451 - protein, 9 aa, BK virus
GLNNSKAMP

SEQ ID NO: 18452 - protein, 9 aa, BK virus
LNNSKAMPD

SEQ ID NO: 18453 - protein, 9 aa, BK virus
NNSKAMPDC

SEQ ID NO: 18454 - protein, 9 aa, BK virus
SQSSKNLYP

SEQ ID NO: 18455 - protein, 9 aa, BK virus
QSSKNLYPT

SEQ ID NO: 18456 - protein, 9 aa, BK virus
AKELIPLTV

SEQ ID NO: 18457 - protein, 9 aa, BK virus
IKAANPAIA

SEQ ID NO: 18458 - protein, 9 aa, BK virus
KAANPAIAP

SEQ ID NO: 18459 - protein, 9 aa, BK virus
AANPAIAPG

SEQ ID NO: 18460 - protein, 9 aa, BK virus
ANPAIAPGA

SEQ ID NO: 18461 - protein, 9 aa, BK virus
NPAIAPGAP

SEQ ID NO: 18462 - protein, 9 aa, BK virus
PAIAPGAPA

SEQ ID NO: 18463 - protein, 9 aa, BK virus
AIAPGAPAI

SEQ ID NO: 18464 - protein, 9 aa, BK virus
IAPGAPAIT

SEQ ID NO: 18465 - protein, 9 aa, BK virus
APGAPAITA

SEQ ID NO: 18466 - protein, 9 aa, BK virus
PGAPAITAY

SEQ ID NO: 18467 - protein, 9 aa, BK virus
GAPAITAYV

SEQ ID NO: 18468 - protein, 9 aa, BK virus
GVRPIAAIA

SEQ ID NO: 18469 - protein, 9 aa, BK virus
VRPIAAIAS

SEQ ID NO: 18470 - protein, 9 aa, BK virus
RPIAAIASE

SEQ ID NO: 18471 - protein, 9 aa, BK virus
PIAAIASEV

SEQ ID NO: 18472 - protein, 9 aa, BK virus
IAAIASEVL

SEQ ID NO: 18473 - protein, 9 aa, BK virus
AAIASEVLV

SEQ ID NO: 18474 - protein, 9 aa, BK virus
AIASEVLVM

SEQ ID NO: 18475 - protein, 9 aa, BK virus
IASEVLVMP

SEQ ID NO: 18476 - protein, 9 aa, BK virus
ASEVLVMPS

SEQ ID NO: 18477 - protein, 9 aa, BK virus
SEVLVMPST

SEQ ID NO: 18478 - protein, 9 aa, BK virus
EVLVMPSTV

SEQ ID NO: 18479 - protein, 9 aa, BK virus
VLVMPSTVA

SEQ ID NO: 18480 - protein, 9 aa, BK virus
LVMPSTVAR

SEQ ID NO: 18481 - protein, 9 aa, BK virus
VMPSTVARD

SEQ ID NO: 18482 - protein, 9 aa, BK virus
MPSTVARDA

SEQ ID NO: 18483 - protein, 9 aa, BK virus
PSTVARDAI

SEQ ID NO: 18484 - protein, 9 aa, BK virus
TSIAAAASP

SEQ ID NO: 18485 - protein, 9 aa, BK virus
SIAAAASPA

SEQ ID NO: 18486 - protein, 9 aa, BK virus
IAAAASPAA

SEQ ID NO: 18487 - protein, 9 aa, BK virus
AAAASPAAI

SEQ ID NO: 18488 - protein, 9 aa, BK virus
AAASPAAIS

SEQ ID NO: 18489 - protein, 9 aa, BK virus
AASPAAISA

SEQ ID NO: 18490 - protein, 9 aa, BK virus
ASPAAISAT

SEQ ID NO: 18491 - protein, 9 aa, BK virus
SPAAISATE

SEQ ID NO: 18492 - protein, 9 aa, BK virus
PAAISATEN

SEQ ID NO: 18493 - protein, 9 aa, BK virus
AAISATENP

SEQ ID NO: 18494 - protein, 9 aa, BK virus
AISATENPV

SEQ ID NO: 18495 - protein, 9 aa, BK virus
ISATENPVA

SEQ ID NO: 18496 - protein, 9 aa, BK virus
SATENPVAA

SEQ ID NO: 18497 - protein, 9 aa, BK virus
ATENPVAAA

SEQ ID NO: 18498 - protein, 9 aa, BK virus
TENPVAAAA

SEQ ID NO: 18499 - protein, 9 aa, BK virus
ENPVAAAAS

SEQ ID NO: 18500 - protein, 9 aa, BK virus
NPVAAAASD

SEQ ID NO: 18501 - protein, 9 aa, BK virus
PVAAAASDT

SEQ ID NO: 18502 - protein, 9 aa, BK virus
VAAAASDTL

SEQ ID NO: 18503 - protein, 9 aa, BK virus
AAAASDTLA

SEQ ID NO: 18504 - protein, 9 aa, BK virus
AAASDTLAT

SEQ ID NO: 18505 - protein, 9 aa, BK virus
AASDTLATR

SEQ ID NO: 18506 - protein, 9 aa, BK virus
ASDTLATRS

SEQ ID NO: 18507 - protein, 9 aa, BK virus
SDTLATRSP

SEQ ID NO: 18508 - protein, 9 aa, BK virus
DTLATRSPK

SEQ ID NO: 18509 - protein, 9 aa, BK virus
TLATRSPKS

SEQ ID NO: 18510 - protein, 9 aa, BK virus
LATRSPKSA

SEQ ID NO: 18511 - protein, 9 aa, BK virus
ATRSPKSAR

SEQ ID NO: 18512 - protein, 9 aa, BK virus
TRSPKSARA

SEQ ID NO: 18513 - protein, 9 aa, BK virus
RSPKSARAA

SEQ ID NO: 18514 - protein, 9 aa, BK virus
SPKSARAAP

SEQ ID NO: 18515 - protein, 9 aa, BK virus
PKSARAAPM

SEQ ID NO: 18516 - protein, 9 aa, BK virus
KSARAAPMN

SEQ ID NO: 18517 - protein, 9 aa, BK virus
SARAAPMNL

SEQ ID NO: 18518 - protein, 9 aa, BK virus
ARAAPMNLE

SEQ ID NO: 18519 - protein, 9 aa, BK virus
RAAPMNLEI

SEQ ID NO: 18520 - protein, 9 aa, BK virus
AAPMNLEIQ

SEQ ID NO: 18521 - protein, 9 aa, BK virus
APMNLEIQK

SEQ ID NO: 18522 - protein, 9 aa, BK virus
PMNLEIQKK

SEQ ID NO: 18523 - protein, 9 aa, BK virus
MNLEIQKKR

SEQ ID NO: 18524 - protein, 9 aa, BK virus
NLEIQKKRD

SEQ ID NO: 18525 - protein, 9 aa, BK virus
LEIQKKRDY

SEQ ID NO: 18526 - protein, 9 aa, BK virus
EIQKKRDYL

SEQ ID NO: 18527 - protein, 9 aa, BK virus
IQKKRDYLP

SEQ ID NO: 18528 - protein, 9 aa, BK virus
QKKRDYLPR

SEQ ID NO: 18529 - protein, 9 aa, BK virus
KKRDYLPRS

SEQ ID NO: 18530 - protein, 9 aa, BK virus
KRDYLPRSL

SEQ ID NO: 18531 - protein, 9 aa, BK virus
RDYLPRSLL

SEQ ID NO: 18532 - protein, 9 aa, BK virus
DYLPRSLLQ

SEQ ID NO: 18533 - protein, 9 aa, BK virus
YLPRSLLQS

SEQ ID NO: 18534 - protein, 9 aa, BK virus
LPRSLLQSL

SEQ ID NO: 18535 - protein, 9 aa, BK virus
PRSLLQSLL

SEQ ID NO: 18536 - protein, 9 aa, BK virus
RSLLQSLLQ

SEQ ID NO: 18537 - protein, 9 aa, BK virus
SLLQSLLQQ

SEQ ID NO: 18538 - protein, 9 aa, BK virus
LLQSLLQQV

SEQ ID NO: 18539 - protein, 9 aa, BK virus
LQSLLQQVK

SEQ ID NO: 18540 - protein, 9 aa, BK virus
QSLLQQVKQ

SEQ ID NO: 18541 - protein, 9 aa, BK virus
SLLQQVKQW

SEQ ID NO: 18542 - protein, 9 aa, BK virus
LLQQVKQWY

SEQ ID NO: 18543 - protein, 9 aa, BK virus
LQQVKQWYF

SEQ ID NO: 18544 - protein, 9 aa, BK virus
QQVKQWYFC

SEQ ID NO: 18545 - protein, 9 aa, BK virus
QVKQWYFCF

SEQ ID NO: 18546 - protein, 9 aa, BK virus
VKQWYFCFS

SEQ ID NO: 18547 - protein, 9 aa, BK virus
KQWYFCFSR

SEQ ID NO: 18548 - protein, 9 aa, BK virus
QWYFCFSRL

SEQ ID NO: 18549 - protein, 9 aa, BK virus
WYFCFSRLH

SEQ ID NO: 18550 - protein, 9 aa, BK virus
YFCFSRLHC

SEQ ID NO: 18551 - protein, 9 aa, BK virus
FCFSRLHCL

SEQ ID NO: 18552 - protein, 9 aa, BK virus
CFSRLHCLH

SEQ ID NO: 18553 - protein, 9 aa, BK virus
FSRLHCLHL

SEQ ID NO: 18554 - protein, 9 aa, BK virus
SRLHCLHLY

SEQ ID NO: 18555 - protein, 9 aa, BK virus
RLHCLHLYK

SEQ ID NO: 18556 - protein, 9 aa, BK virus
LHCLHLYKI

SEQ ID NO: 18557 - protein, 9 aa, BK virus
HCLHLYKIP

SEQ ID NO: 18558 - protein, 9 aa, BK virus
CLHLYKIPA

SEQ ID NO: 18559 - protein, 9 aa, BK virus
LHLYKIPAK

SEQ ID NO: 18560 - protein, 9 aa, BK virus
HLYKIPAKA

SEQ ID NO: 18561 - protein, 9 aa, BK virus
LYKIPAKAL

SEQ ID NO: 18562 - protein, 9 aa, BK virus
YKIPAKALK

SEQ ID NO: 18563 - protein, 9 aa, BK virus
KSSELFFLF

SEQ ID NO: 18564 - protein, 9 aa, BK virus
SSELFFLFQ

SEQ ID NO: 18565 - protein, 9 aa, BK virus
SELFFLFQS

SEQ ID NO: 18566 - protein, 9 aa, BK virus
ELFFLFQSR

SEQ ID NO: 18567 - protein, 9 aa, BK virus
LFFLFQSRF

SEQ ID NO: 18568 - protein, 9 aa, BK virus
FFLFQSRFY

SEQ ID NO: 18569 - protein, 9 aa, BK virus
FLFQSRFYQ

SEQ ID NO: 18570 - protein, 9 aa, BK virus
LFQSRFYQL

SEQ ID NO: 18571 - protein, 9 aa, BK virus
FQSRFYQLS

SEQ ID NO: 18572 - protein, 9 aa, BK virus
QSRFYQLSL

SEQ ID NO: 18573 - protein, 9 aa, BK virus
SRFYQLSLK

SEQ ID NO: 18574 - protein, 9 aa, BK virus
RFYQLSLKL

SEQ ID NO: 18575 - protein, 9 aa, BK virus
FYQLSLKLV

SEQ ID NO: 18576 - protein, 9 aa, BK virus
YQLSLKLVV

SEQ ID NO: 18577 - protein, 9 aa, BK virus
QLSLKLVVT

SEQ ID NO: 18578 - protein, 9 aa, BK virus
LSLKLVVTA

SEQ ID NO: 18579 - protein, 9 aa, BK virus
SLKLVVTAG

SEQ ID NO: 18580 - protein, 9 aa, BK virus
LKLVVTAGA

SEQ ID NO: 18581 - protein, 9 aa, BK virus
KLVVTAGAE

SEQ ID NO: 18582 - protein, 9 aa, BK virus
LVVTAGAEP

SEQ ID NO: 18583 - protein, 9 aa, BK virus
VVTAGAEPW

SEQ ID NO: 18584 - protein, 9 aa, BK virus
VTAGAEPWP

SEQ ID NO: 18585 - protein, 9 aa, BK virus
TAGAEPWPL

SEQ ID NO: 18586 - protein, 9 aa, BK virus
AGAEPWPLS

SEQ ID NO: 18587 - protein, 9 aa, BK virus
GAEPWPLSS

SEQ ID NO: 18588 - protein, 9 aa, BK virus
AEPWPLSSL

SEQ ID NO: 18589 - protein, 9 aa, BK virus
EPWPLSSLT

SEQ ID NO: 18590 - protein, 9 aa, BK virus
PWPLSSLTG

SEQ ID NO: 18591 - protein, 9 aa, BK virus
WPLSSLTGD

SEQ ID NO: 18592 - protein, 9 aa, BK virus
PLSSLTGDK

SEQ ID NO: 18593 - protein, 9 aa, BK virus
LSSLTGDKA

SEQ ID NO: 18594 - protein, 9 aa, BK virus
SSLTGDKAK

SEQ ID NO: 18595 - protein, 9 aa, BK virus
SLTGDKAKI

SEQ ID NO: 18596 - protein, 9 aa, BK virus
LTGDKAKIP

SEQ ID NO: 18597 - protein, 9 aa, BK virus
TGDKAKIPR

SEQ ID NO: 18598 - protein, 9 aa, BK virus
GDKAKIPRL

SEQ ID NO: 18599 - protein, 9 aa, BK virus
DKAKIPRLA

SEQ ID NO: 18600 - protein, 9 aa, BK virus
KAKIPRLAK

SEQ ID NO: 18601 - protein, 9 aa, BK virus
AKIPRLAKH

SEQ ID NO: 18602 - protein, 9 aa, BK virus
KIPRLAKHV

SEQ ID NO: 18603 - protein, 9 aa, BK virus
IPRLAKHVC

SEQ ID NO: 18604 - protein, 9 aa, BK virus
PRLAKHVCH

SEQ ID NO: 18605 - protein, 9 aa, BK virus
RLAKHVCHA

SEQ ID NO: 18606 - protein, 9 aa, BK virus
LAKHVCHAL

SEQ ID NO: 18607 - protein, 9 aa, BK virus
AKHVCHALS

SEQ ID NO: 18608 - protein, 9 aa, BK virus
KHVCHALSF

SEQ ID NO: 18609 - protein, 9 aa, BK virus
HVCHALSFL

SEQ ID NO: 18610 - protein, 9 aa, BK virus
VCHALSFLR

SEQ ID NO: 18611 - protein, 9 aa, BK virus
CHALSFLRS

SEQ ID NO: 18612 - protein, 9 aa, BK virus
HALSFLRSW

SEQ ID NO: 18613 - protein, 9 aa, BK virus
ALSFLRSWF

SEQ ID NO: 18614 - protein, 9 aa, BK virus
LSFLRSWFG

SEQ ID NO: 18615 - protein, 9 aa, BK virus
SFLRSWFGC

SEQ ID NO: 18616 - protein, 9 aa, BK virus
FLRSWFGCI

SEQ ID NO: 18617 - protein, 9 aa, BK virus
LRSWFGCIP

SEQ ID NO: 18618 - protein, 9 aa, BK virus
RSWFGCIPW

SEQ ID NO: 18619 - protein, 9 aa, BK virus
SWFGCIPWV

SEQ ID NO: 18620 - protein, 9 aa, BK virus
WFGCIPWVS

SEQ ID NO: 18621 - protein, 9 aa, BK virus
FGCIPWVSS

SEQ ID NO: 18622 - protein, 9 aa, BK virus
GCIPWVSSS

SEQ ID NO: 18623 - protein, 9 aa, BK virus
CIPWVSSSS

SEQ ID NO: 18624 - protein, 9 aa, BK virus
IPWVSSSSL

SEQ ID NO: 18625 - protein, 9 aa, BK virus
GHGLAAFPC

SEQ ID NO: 18626 - protein, 9 aa, BK virus
HGLAAFPCE

SEQ ID NO: 18627 - protein, 9 aa, BK virus
GLAAFPCES

SEQ ID NO: 18628 - protein, 9 aa, BK virus
LAAFPCESC

SEQ ID NO: 18629 - protein, 9 aa, BK virus
AAFPCESCT

SEQ ID NO: 18630 - protein, 9 aa, BK virus
AFPCESCTF

SEQ ID NO: 18631 - protein, 9 aa, BK virus
FPCESCTFL

SEQ ID NO: 18632 - protein, 9 aa, BK virus
PCESCTFLP

SEQ ID NO: 18633 - protein, 9 aa, BK virus
CESCTFLPE

SEQ ID NO: 18634 - protein, 9 aa, BK virus
ESCTFLPEV

SEQ ID NO: 18635 - protein, 9 aa, BK virus
SCTFLPEVM

SEQ ID NO: 18636 - protein, 9 aa, BK virus
CTFLPEVMV

SEQ ID NO: 18637 - protein, 9 aa, BK virus
TFLPEVMVW

SEQ ID NO: 18638 - protein, 9 aa, BK virus
FLPEVMVWL

SEQ ID NO: 18639 - protein, 9 aa, BK virus
LPEVMVWLH

SEQ ID NO: 18640 - protein, 9 aa, BK virus
PEVMVWLHS

SEQ ID NO: 18641 - protein, 9 aa, BK virus
EVMVWLHSM

SEQ ID NO: 18642 - protein, 9 aa, BK virus
VMVWLHSMG

SEQ ID NO: 18643 - protein, 9 aa, BK virus
MVWLHSMGK

SEQ ID NO: 18644 - protein, 9 aa, BK virus
VWLHSMGKQ

SEQ ID NO: 18645 - protein, 9 aa, BK virus
WLHSMGKQL

SEQ ID NO: 18646 - protein, 9 aa, BK virus
LHSMGKQLL

SEQ ID NO: 18647 - protein, 9 aa, BK virus
HSMGKQLLP

SEQ ID NO: 18648 - protein, 9 aa, BK virus
SMGKQLLPV

SEQ ID NO: 18649 - protein, 9 aa, BK virus
MGKQLLPVA

SEQ ID NO: 18650 - protein, 9 aa, BK virus
GKQLLPVAF

SEQ ID NO: 18651 - protein, 9 aa, BK virus
KQLLPVAFF

SEQ ID NO: 18652 - protein, 9 aa, BK virus
QLLPVAFFF

SEQ ID NO: 18653 - protein, 9 aa, BK virus
LLPVAFFFI

SEQ ID NO: 18654 - protein, 9 aa, BK virus
LPVAFFFII

SEQ ID NO: 18655 - protein, 9 aa, BK virus
PVAFFFIIY

SEQ ID NO: 18656 - protein, 9 aa, BK virus
VAFFFIIYK

SEQ ID NO: 18657 - protein, 9 aa, BK virus
AFFFIIYKR

SEQ ID NO: 18658 - protein, 9 aa, BK virus
FFFIIYKRP

SEQ ID NO: 18659 - protein, 9 aa, BK virus
FFIIYKRPR

SEQ ID NO: 18660 - protein, 9 aa, BK virus
FIIYKRPRP

SEQ ID NO: 18661 - protein, 9 aa, BK virus
IIYKRPRPP

SEQ ID NO: 18662 - protein, 9 aa, BK virus
IYKRPRPPL

SEQ ID NO: 18663 - protein, 9 aa, BK virus
YKRPRPPLP

SEQ ID NO: 18664 - protein, 9 aa, BK virus
KRPRPPLPP

SEQ ID NO: 18665 - protein, 9 aa, BK virus
RPRPPLPPP

SEQ ID NO: 18666 - protein, 9 aa, BK virus
PRPPLPPPF

SEQ ID NO: 18667 - protein, 9 aa, BK virus
RPPLPPPFL

SEQ ID NO: 18668 - protein, 9 aa, BK virus
PPLPPPFLS

SEQ ID NO: 18669 - protein, 9 aa, BK virus
PLPPPFLSS

SEQ ID NO: 18670 - protein, 9 aa, BK virus
LPPPFLSSS

SEQ ID NO: 18671 - protein, 9 aa, BK virus
PPPFLSSSK

SEQ ID NO: 18672 - protein, 9 aa, BK virus
PPFLSSSKG

SEQ ID NO: 18673 - protein, 9 aa, BK virus
PFLSSSKGV

SEQ ID NO: 18674 - protein, 9 aa, BK virus
FLSSSKGVE

SEQ ID NO: 18675 - protein, 9 aa, BK virus
LSSSKGVEA

SEQ ID NO: 18676 - protein, 9 aa, BK virus
SSSKGVEAF

SEQ ID NO: 18677 - protein, 9 aa, BK virus
SSKGVEAFS

SEQ ID NO: 18678 - protein, 9 aa, BK virus
SKGVEAFSE

SEQ ID NO: 18679 - protein, 9 aa, BK virus
KGVEAFSEA

SEQ ID NO: 18680 - protein, 9 aa, BK virus
QNYLGKSLF

SEQ ID NO: 18681 - protein, 9 aa, BK virus
NYLGKSLFF

SEQ ID NO: 18682 - protein, 9 aa, BK virus
YLGKSLFFC

SEQ ID NO: 18683 - protein, 9 aa, BK virus
LGKSLFFCN

SEQ ID NO: 18684 - protein, 9 aa, BK virus
GKSLFFCNF

SEQ ID NO: 18685 - protein, 9 aa, BK virus
KSLFFCNFC

SEQ ID NO: 18686 - protein, 9 aa, BK virus
SLFFCNFCK

SEQ ID NO: 18687 - protein, 10 aa, BK virus
WIKFLTGKNP

SEQ ID NO: 18688 - protein, 10 aa, BK virus
IKFLTGKNPW

SEQ ID NO: 18689 - protein, 10 aa, BK virus
KFLTGKNPWS

SEQ ID NO: 18690 - protein, 10 aa, BK virus
FLTGKNPWSS

SEQ ID NO: 18691 - protein, 10 aa, BK virus
LTGKNPWSSW

SEQ ID NO: 18692 - protein, 10 aa, BK virus
TGKNPWSSWT

SEQ ID NO: 18693 - protein, 10 aa, BK virus
GKNPWSSWTF

SEQ ID NO: 18694 - protein, 10 aa, BK virus
ALKELPGEIF

SEQ ID NO: 18695 - protein, 10 aa, BK virus
LKELPGEIFP

SEQ ID NO: 18696 - protein, 10 aa, BK virus
GSVRNFTLTK

SEQ ID NO: 18697 - protein, 10 aa, BK virus
SVRNFTLTKG

SEQ ID NO: 18698 - protein, 10 aa, BK virus
VRNFTLTKGA

SEQ ID NO: 18699 - protein, 10 aa, BK virus
RNFTLTKGAT

SEQ ID NO: 18700 - protein, 10 aa, BK virus
NFTLTKGATR

SEQ ID NO: 18701 - protein, 10 aa, BK virus
FTLTKGATRI

SEQ ID NO: 18702 - protein, 10 aa, BK virus
TLTKGATRIK

SEQ ID NO: 18703 - protein, 10 aa, BK virus
ILCIKKWSRM

SEQ ID NO: 18704 - protein, 10 aa, BK virus
LISLILEPGV

SEQ ID NO: 18705 - protein, 10 aa, BK virus
ISLILEPGVA

SEQ ID NO: 18706 - protein, 10 aa, BK virus
SLILEPGVAQ

SEQ ID NO: 18707 - protein, 10 aa, BK virus
LILEPGVAQR

SEQ ID NO: 18708 - protein, 10 aa, BK virus
ILEPGVAQRF

SEQ ID NO: 18709 - protein, 10 aa, BK virus
LEPGVAQRFV

SEQ ID NO: 18710 - protein, 10 aa, BK virus
EPGVAQRFVL

SEQ ID NO: 18711 - protein, 10 aa, BK virus
PGVAQRFVLI

SEQ ID NO: 18712 - protein, 10 aa, BK virus
GVAQRFVLIF

SEQ ID NO: 18713 - protein, 10 aa, BK virus
VAQRFVLIFL

SEQ ID NO: 18714 - protein, 10 aa, BK virus
AQRFVLIFLF

SEQ ID NO: 18715 - protein, 10 aa, BK virus
QRFVLIFLFA

SEQ ID NO: 18716 - protein, 10 aa, BK virus
RFVLIFLFAQ

SEQ ID NO: 18717 - protein, 10 aa, BK virus
FVLIFLFAQI

SEQ ID NO: 18718 - protein, 10 aa, BK virus
VLIFLFAQIP

SEQ ID NO: 18719 - protein, 10 aa, BK virus
LIFLFAQIPC

SEQ ID NO: 18720 - protein, 10 aa, BK virus
IFLFAQIPCT

SEQ ID NO: 18721 - protein, 10 aa, BK virus
FLFAQIPCTA

SEQ ID NO: 18722 - protein, 10 aa, BK virus
LFAQIPCTAR

SEQ ID NO: 18723 - protein, 10 aa, BK virus
FAQIPCTARN

SEQ ID NO: 18724 - protein, 10 aa, BK virus
AQIPCTARNG

SEQ ID NO: 18725 - protein, 10 aa, BK virus
QIPCTARNGL

SEQ ID NO: 18726 - protein, 10 aa, BK virus
IPCTARNGLF

SEQ ID NO: 18727 - protein, 10 aa, BK virus
PCTARNGLFV

SEQ ID NO: 18728 - protein, 10 aa, BK virus
CTARNGLFVP

SEQ ID NO: 18729 - protein, 10 aa, BK virus
TARNGLFVPK

SEQ ID NO: 18730 - protein, 10 aa, BK virus
ARNGLFVPKS

SEQ ID NO: 18731 - protein, 10 aa, BK virus
RNGLFVPKSL

SEQ ID NO: 18732 - protein, 10 aa, BK virus
NGLFVPKSLL

SEQ ID NO: 18733 - protein, 10 aa, BK virus
GLFVPKSLLC

SEQ ID NO: 18734 - protein, 10 aa, BK virus
LFVPKSLLCT

SEQ ID NO: 18735 - protein, 10 aa, BK virus
FVPKSLLCTA

SEQ ID NO: 18736 - protein, 10 aa, BK virus
VPKSLLCTAL

SEQ ID NO: 18737 - protein, 10 aa, BK virus
PKSLLCTALA

SEQ ID NO: 18738 - protein, 10 aa, BK virus
KSLLCTALAC

SEQ ID NO: 18739 - protein, 10 aa, BK virus
SLLCTALACY

SEQ ID NO: 18740 - protein, 10 aa, BK virus
LLCTALACYV

SEQ ID NO: 18741 - protein, 10 aa, BK virus
LCTALACYVS

SEQ ID NO: 18742 - protein, 10 aa, BK virus
CTALACYVSL

SEQ ID NO: 18743 - protein, 10 aa, BK virus
TALACYVSLD

SEQ ID NO: 18744 - protein, 10 aa, BK virus
IATALTASHS

SEQ ID NO: 18745 - protein, 10 aa, BK virus
ATALTASHSG

SEQ ID NO: 18746 - protein, 10 aa, BK virus
TALTASHSGL

SEQ ID NO: 18747 - protein, 10 aa, BK virus
ALTASHSGLA

SEQ ID NO: 18748 - protein, 10 aa, BK virus
LKKLCNGGSK

SEQ ID NO: 18749 - protein, 10 aa, BK virus
SFKVTNLYLD

SEQ ID NO: 18750 - protein, 10 aa, BK virus
FKVTNLYLDK

SEQ ID NO: 18751 - protein, 10 aa, BK virus
VIIFFIGANL

SEQ ID NO: 18752 - protein, 10 aa, BK virus
IIFFIGANLW

SEQ ID NO: 18753 - protein, 10 aa, BK virus
IFFIGANLWN

SEQ ID NO: 18754 - protein, 10 aa, BK virus
FFIGANLWNR

SEQ ID NO: 18755 - protein, 10 aa, BK virus
FIGANLWNRR

SEQ ID NO: 18756 - protein, 10 aa, BK virus
IGANLWNRRV

SEQ ID NO: 18757 - protein, 10 aa, BK virus
GANLWNRRVG

SEQ ID NO: 18758 - protein, 10 aa, BK virus
ANLWNRRVGV

SEQ ID NO: 18759 - protein, 10 aa, BK virus
NLWNRRVGVL

SEQ ID NO: 18760 - protein, 10 aa, BK virus
LWNRRVGVLV

SEQ ID NO: 18761 - protein, 10 aa, BK virus
WNRRVGVLVE

SEQ ID NO: 18762 - protein, 10 aa, BK virus
NRRVGVLVEF

SEQ ID NO: 18763 - protein, 10 aa, BK virus
RRVGVLVEFL

SEQ ID NO: 18764 - protein, 10 aa, BK virus
RSNSRFSTLN

SEQ ID NO: 18765 - protein, 10 aa, BK virus
SNSRFSTLNT

SEQ ID NO: 18766 - protein, 10 aa, BK virus
NSRFSTLNTT

SEQ ID NO: 18767 - protein, 10 aa, BK virus
SRFSTLNTTQ

SEQ ID NO: 18768 - protein, 10 aa, BK virus
RFSTLNTTQK

SEQ ID NO: 18769 - protein, 10 aa, BK virus
FSTLNTTQKK

SEQ ID NO: 18770 - protein, 10 aa, BK virus
STLNTTQKKK

SEQ ID NO: 18771 - protein, 10 aa, BK virus
TLNTTQKKKK

SEQ ID NO: 18772 - protein, 10 aa, BK virus
LNTTQKKKKG

SEQ ID NO: 18773 - protein, 10 aa, BK virus
NTTQKKKKGR

SEQ ID NO: 18774 - protein, 10 aa, BK virus
TTQKKKKGRR

SEQ ID NO: 18775 - protein, 10 aa, BK virus
TQKKKKGRRP

SEQ ID NO: 18776 - protein, 10 aa, BK virus
NPCLLCCVYY

SEQ ID NO: 18777 - protein, 10 aa, BK virus
KTYGKIFCNF

SEQ ID NO: 18778 - protein, 10 aa, BK virus
TYGKIFCNFY

SEQ ID NO: 18779 - protein, 10 aa, BK virus
RSIPYYRRKH

SEQ ID NO: 18780 - protein, 10 aa, BK virus
SIPYYRRKHS

SEQ ID NO: 18781 - protein, 10 aa, BK virus
IPYYRRKHSR

SEQ ID NO: 18782 - protein, 10 aa, BK virus
PYYRRKHSRG

SEQ ID NO: 18783 - protein, 10 aa, BK virus
YYRRKHSRGL

SEQ ID NO: 18784 - protein, 10 aa, BK virus
YRRKHSRGLK

SEQ ID NO: 18785 - protein, 10 aa, BK virus
RRKHSRGLKG

SEQ ID NO: 18786 - protein, 10 aa, BK virus
RKHSRGLKGA

SEQ ID NO: 18787 - protein, 10 aa, BK virus
RNKAGVLEIN

SEQ ID NO: 18788 - protein, 10 aa, BK virus
NKAGVLEINY

SEQ ID NO: 18789 - protein, 10 aa, BK virus
GCVFIIRYVF

SEQ ID NO: 18790 - protein, 10 aa, BK virus
CVFIIRYVFR

SEQ ID NO: 18791 - protein, 10 aa, BK virus
VFIIRYVFRI

SEQ ID NO: 18792 - protein, 10 aa, BK virus
FIIRYVFRIS

SEQ ID NO: 18793 - protein, 10 aa, BK virus
IIRYVFRISI

SEQ ID NO: 18794 - protein, 10 aa, BK virus
IRYVFRISIQ

SEQ ID NO: 18795 - protein, 10 aa, BK virus
RYVFRISIQC

SEQ ID NO: 18796 - protein, 10 aa, BK virus
YVFRISIQCR

SEQ ID NO: 18797 - protein, 10 aa, BK virus
VFRISIQCRG

SEQ ID NO: 18798 - protein, 10 aa, BK virus
FRISIQCRGV

SEQ ID NO: 18799 - protein, 10 aa, BK virus
KVSEKRPALS

SEQ ID NO: 18800 - protein, 10 aa, BK virus
VSEKRPALSL

SEQ ID NO: 18801 - protein, 10 aa, BK virus
KALCKCYYFC

SEQ ID NO: 18802 - protein, 10 aa, BK virus
ALCKCYYFCR

SEQ ID NO: 18803 - protein, 10 aa, BK virus
LCKCYYFCRK

SEQ ID NO: 18804 - protein, 10 aa, BK virus
KSKKYLSASS

SEQ ID NO: 18805 - protein, 10 aa, BK virus
SKKYLSASSR

SEQ ID NO: 18806 - protein, 10 aa, BK virus
KKYLSASSRY

SEQ ID NO: 18807 - protein, 10 aa, BK virus
KYLSASSRYS

SEQ ID NO: 18808 - protein, 10 aa, BK virus
YLSASSRYSF

SEQ ID NO: 18809 - protein, 10 aa, BK virus
LSASSRYSFS

SEQ ID NO: 18810 - protein, 10 aa, BK virus
KKSRYPSYDQ

SEQ ID NO: 18811 - protein, 10 aa, BK virus
KSRYPSYDQG

SEQ ID NO: 18812 - protein, 10 aa, BK virus
SRYPSYDQGR

SEQ ID NO: 18813 - protein, 10 aa, BK virus
RYPSYDQGRN

SEQ ID NO: 18814 - protein, 10 aa, BK virus
YPSYDQGRNA

SEQ ID NO: 18815 - protein, 10 aa, BK virus
PSYDQGRNAN

SEQ ID NO: 18816 - protein, 10 aa, BK virus
SYDQGRNANR

SEQ ID NO: 18817 - protein, 10 aa, BK virus
YDQGRNANRK

SEQ ID NO: 18818 - protein, 10 aa, BK virus
DQGRNANRKI

SEQ ID NO: 18819 - protein, 10 aa, BK virus
QGRNANRKIQ

SEQ ID NO: 18820 - protein, 10 aa, BK virus
GRNANRKIQS

SEQ ID NO: 18821 - protein, 10 aa, BK virus
RNANRKIQSY

SEQ ID NO: 18822 - protein, 10 aa, BK virus
NANRKIQSYI

SEQ ID NO: 18823 - protein, 10 aa, BK virus
ANRKIQSYIR

SEQ ID NO: 18824 - protein, 10 aa, BK virus
NGFNIWSSWK

SEQ ID NO: 18825 - protein, 10 aa, BK virus
GFNIWSSWKC

SEQ ID NO: 18826 - protein, 10 aa, BK virus
FNIWSSWKCC

SEQ ID NO: 18827 - protein, 10 aa, BK virus
NIWSSWKCCT

SEQ ID NO: 18828 - protein, 10 aa, BK virus
IWSSWKCCTR

SEQ ID NO: 18829 - protein, 10 aa, BK virus
WSSWKCCTRT

SEQ ID NO: 18830 - protein, 10 aa, BK virus
SSWKCCTRTI

SEQ ID NO: 18831 - protein, 10 aa, BK virus
SWKCCTRTIY

SEQ ID NO: 18832 - protein, 10 aa, BK virus
WKCCTRTIYG

SEQ ID NO: 18833 - protein, 10 aa, BK virus
KCCTRTIYGR

SEQ ID NO: 18834 - protein, 10 aa, BK virus
CCTRTIYGRC

SEQ ID NO: 18835 - protein, 10 aa, BK virus
CTRTIYGRCC

SEQ ID NO: 18836 - protein, 10 aa, BK virus
TRTIYGRCCL

SEQ ID NO: 18837 - protein, 10 aa, BK virus
RTIYGRCCLA

SEQ ID NO: 18838 - protein, 10 aa, BK virus
TIYGRCCLAA

SEQ ID NO: 18839 - protein, 10 aa, BK virus
IYGRCCLAAL

SEQ ID NO: 18840 - protein, 10 aa, BK virus
YGRCCLAALF

SEQ ID NO: 18841 - protein, 10 aa, BK virus
GRCCLAALFA

SEQ ID NO: 18842 - protein, 10 aa, BK virus
RCCLAALFAT

SEQ ID NO: 18843 - protein, 10 aa, BK virus
FFALYCFQCT

SEQ ID NO: 18844 - protein, 10 aa, BK virus
WKNNTSCRVI

SEQ ID NO: 18845 - protein, 10 aa, BK virus
KNNTSCRVIR

SEQ ID NO: 18846 - protein, 10 aa, BK virus
NNTSCRVIRF

SEQ ID NO: 18847 - protein, 10 aa, BK virus
NTSCRVIRFV

SEQ ID NO: 18848 - protein, 10 aa, BK virus
TSCRVIRFVW

SEQ ID NO: 18849 - protein, 10 aa, BK virus
SCRVIRFVWW

SEQ ID NO: 18850 - protein, 10 aa, BK virus
SLKCKPTHGK

SEQ ID NO: 18851 - protein, 10 aa, BK virus
LKCKPTHGKA

SEQ ID NO: 18852 - protein, 10 aa, BK virus
KCKPTHGKAN

SEQ ID NO: 18853 - protein, 10 aa, BK virus
CKPTHGKANL

SEQ ID NO: 18854 - protein, 10 aa, BK virus
ARCSYRSVHG

SEQ ID NO: 18855 - protein, 10 aa, BK virus
RCSYRSVHGC

SEQ ID NO: 18856 - protein, 10 aa, BK virus
CSYRSVHGCF

SEQ ID NO: 18857 - protein, 10 aa, BK virus
IKGFAFRTWN

SEQ ID NO: 18858 - protein, 10 aa, BK virus
KGFAFRTWNK

SEQ ID NO: 18859 - protein, 10 aa, BK virus
GFAFRTWNKQ

SEQ ID NO: 18860 - protein, 10 aa, BK virus
FAFRTWNKQF

SEQ ID NO: 18861 - protein, 10 aa, BK virus
AFRTWNKQFR

SEQ ID NO: 18862 - protein, 10 aa, BK virus
FRTWNKQFRQ

SEQ ID NO: 18863 - protein, 10 aa, BK virus
RTWNKQFRQF

SEQ ID NO: 18864 - protein, 10 aa, BK virus
TWNKQFRQFE

SEQ ID NO: 18865 - protein, 10 aa, BK virus
WNKQFRQFER

SEQ ID NO: 18866 - protein, 10 aa, BK virus
NKQFRQFERL

SEQ ID NO: 18867 - protein, 10 aa, BK virus
KQFRQFERLF

SEQ ID NO: 18868 - protein, 10 aa, BK virus
QFRQFERLFR

SEQ ID NO: 18869 - protein, 10 aa, BK virus
FRQFERLFRW

SEQ ID NO: 18870 - protein, 10 aa, BK virus
RQFERLFRWK

SEQ ID NO: 18871 - protein, 10 aa, BK virus
QFERLFRWKC

SEQ ID NO: 18872 - protein, 10 aa, BK virus
GKFRKETFKQ

SEQ ID NO: 18873 - protein, 10 aa, BK virus
KFRKETFKQK

SEQ ID NO: 18874 - protein, 10 aa, BK virus
FRKETFKQKN

SEQ ID NO: 18875 - protein, 10 aa, BK virus
RKETFKQKNP

SEQ ID NO: 18876 - protein, 10 aa, BK virus
KETFKQKNPN

SEQ ID NO: 18877 - protein, 10 aa, BK virus
ETFKQKNPNI

SEQ ID NO: 18878 - protein, 10 aa, BK virus
TFKQKNPNIS

SEQ ID NO: 18879 - protein, 10 aa, BK virus
FKQKNPNIST

SEQ ID NO: 18880 - protein, 10 aa, BK virus
KQKNPNISTR

SEQ ID NO: 18881 - protein, 10 aa, BK virus
QKNPNISTRL

SEQ ID NO: 18882 - protein, 10 aa, BK virus
KNPNISTRLG

SEQ ID NO: 18883 - protein, 10 aa, BK virus
NPNISTRLGY

SEQ ID NO: 18884 - protein, 10 aa, BK virus
PNISTRLGYN

SEQ ID NO: 18885 - protein, 10 aa, BK virus
NISTRLGYNE

SEQ ID NO: 18886 - protein, 10 aa, BK virus
AQNIFKKILT

SEQ ID NO: 18887 - protein, 10 aa, BK virus
QNIFKKILTK

SEQ ID NO: 18888 - protein, 10 aa, BK virus
NIFKKILTKL

SEQ ID NO: 18889 - protein, 10 aa, BK virus
IFKKILTKLR

SEQ ID NO: 18890 - protein, 10 aa, BK virus
FKKILTKLRV

SEQ ID NO: 18891 - protein, 10 aa, BK virus
KKILTKLRVL

SEQ ID NO: 18892 - protein, 10 aa, BK virus
KILTKLRVLT

SEQ ID NO: 18893 - protein, 10 aa, BK virus
KKNFTKWNDL

SEQ ID NO: 18894 - protein, 10 aa, BK virus
KNFTKWNDLV

SEQ ID NO: 18895 - protein, 10 aa, BK virus
NFTKWNDLVA

SEQ ID NO: 18896 - protein, 10 aa, BK virus
FTKWNDLVAT

SEQ ID NO: 18897 - protein, 10 aa, BK virus
TKWNDLVATA

SEQ ID NO: 18898 - protein, 10 aa, BK virus
KWNDLVATAN

SEQ ID NO: 18899 - protein, 10 aa, BK virus
WNDLVATANL

SEQ ID NO: 18900 - protein, 10 aa, BK virus
NDLVATANLV

SEQ ID NO: 18901 - protein, 10 aa, BK virus
DKYVYFFKDE

SEQ ID NO: 18902 - protein, 10 aa, BK virus
KYVYFFKDEI

SEQ ID NO: 18903 - protein, 10 aa, BK virus
IPITMLFPSL

SEQ ID NO: 18904 - protein, 10 aa, BK virus
PITMLFPSLR

SEQ ID NO: 18905 - protein, 10 aa, BK virus
ITMLFPSLRY

SEQ ID NO: 18906 - protein, 10 aa, BK virus
TMLFPSLRYF

SEQ ID NO: 18907 - protein, 10 aa, BK virus
MLFPSLRYFS

SEQ ID NO: 18908 - protein, 10 aa, BK virus
LFPSLRYFSP

SEQ ID NO: 18909 - protein, 10 aa, BK virus
FPSLRYFSPC

SEQ ID NO: 18910 - protein, 10 aa, BK virus
KWLIQKQHLL

SEQ ID NO: 18911 - protein, 10 aa, BK virus
WLIQKQHLLN

SEQ ID NO: 18912 - protein, 10 aa, BK virus
LIQKQHLLNV

SEQ ID NO: 18913 - protein, 10 aa, BK virus
IQKQHLLNVY

SEQ ID NO: 18914 - protein, 10 aa, BK virus
QKQHLLNVYV

SEQ ID NO: 18915 - protein, 10 aa, BK virus
KQHLLNVYVQ

SEQ ID NO: 18916 - protein, 10 aa, BK virus
KHLFKAFWFA

SEQ ID NO: 18917 - protein, 10 aa, BK virus
HLFKAFWFAI

SEQ ID NO: 18918 - protein, 10 aa, BK virus
LFKAFWFAIV

SEQ ID NO: 18919 - protein, 10 aa, BK virus
FKAFWFAIVP

SEQ ID NO: 18920 - protein, 10 aa, BK virus
KAFWFAIVPV

SEQ ID NO: 18921 - protein, 10 aa, BK virus
AFWFAIVPVC

SEQ ID NO: 18922 - protein, 10 aa, BK virus
FWFAIVPVCQ

SEQ ID NO: 18923 - protein, 10 aa, BK virus
WFAIVPVCQY

SEQ ID NO: 18924 - protein, 10 aa, BK virus
FAIVPVCQYI

SEQ ID NO: 18925 - protein, 10 aa, BK virus
AIVPVCQYIL

SEQ ID NO: 18926 - protein, 10 aa, BK virus
IVPVCQYILS

SEQ ID NO: 18927 - protein, 10 aa, BK virus
VPVCQYILSY

SEQ ID NO: 18928 - protein, 10 aa, BK virus
PVCQYILSYL

SEQ ID NO: 18929 - protein, 10 aa, BK virus
VCQYILSYLG

SEQ ID NO: 18930 - protein, 10 aa, BK virus
CQYILSYLGP

SEQ ID NO: 18931 - protein, 10 aa, BK virus
QYILSYLGPL

SEQ ID NO: 18932 - protein, 10 aa, BK virus
YILSYLGPLE

SEQ ID NO: 18933 - protein, 10 aa, BK virus
ILSYLGPLEV

SEQ ID NO: 18934 - protein, 10 aa, BK virus
LSYLGPLEVF

SEQ ID NO: 18935 - protein, 10 aa, BK virus
SYLGPLEVFL

SEQ ID NO: 18936 - protein, 10 aa, BK virus
YLGPLEVFLC

SEQ ID NO: 18937 - protein, 10 aa, BK virus
LGPLEVFLCH

SEQ ID NO: 18938 - protein, 10 aa, BK virus
GPLEVFLCHQ

SEQ ID NO: 18939 - protein, 10 aa, BK virus
PLEVFLCHQT

SEQ ID NO: 18940 - protein, 10 aa, BK virus
LEVFLCHQTP

SEQ ID NO: 18941 - protein, 10 aa, BK virus
PLLPGIPYHT

SEQ ID NO: 18942 - protein, 10 aa, BK virus
AAHPLSGFSC

SEQ ID NO: 18943 - protein, 10 aa, BK virus
AHPLSGFSCL

SEQ ID NO: 18944 - protein, 10 aa, BK virus
GHLAKRKLGK

SEQ ID NO: 18945 - protein, 10 aa, BK virus
HLAKRKLGKD

SEQ ID NO: 18946 - protein, 10 aa, BK virus
LAKRKLGKDS

SEQ ID NO: 18947 - protein, 10 aa, BK virus
AKRKLGKDSL

SEQ ID NO: 18948 - protein, 10 aa, BK virus
KRKLGKDSLQ

SEQ ID NO: 18949 - protein, 10 aa, BK virus
RKLGKDSLQI

SEQ ID NO: 18950 - protein, 10 aa, BK virus
KLGKDSLQIF

SEQ ID NO: 18951 - protein, 10 aa, BK virus
LGKDSLQIFF

SEQ ID NO: 18952 - protein, 10 aa, BK virus
GKDSLQIFFS

SEQ ID NO: 18953 - protein, 10 aa, BK virus
KDSLQIFFSG

SEQ ID NO: 18954 - protein, 10 aa, BK virus
DSLQIFFSGG

SEQ ID NO: 18955 - protein, 10 aa, BK virus
SLQIFFSGGS

SEQ ID NO: 18956 - protein, 10 aa, BK virus
NILQGLSTVV

SEQ ID NO: 18957 - protein, 10 aa, BK virus
ILQGLSTVVF

SEQ ID NO: 18958 - protein, 10 aa, BK virus
LQGLSTVVFQ

SEQ ID NO: 18959 - protein, 10 aa, BK virus
QGLSTVVFQS

SEQ ID NO: 18960 - protein, 10 aa, BK virus
GLSTVVFQSC

SEQ ID NO: 18961 - protein, 10 aa, BK virus
TGHKYQQLKH

SEQ ID NO: 18962 - protein, 10 aa, BK virus
GHKYQQLKHT

SEQ ID NO: 18963 - protein, 10 aa, BK virus
HKYQQLKHTG

SEQ ID NO: 18964 - protein, 10 aa, BK virus
KYQQLKHTGY

SEQ ID NO: 18965 - protein, 10 aa, BK virus
YQQLKHTGYQ

SEQ ID NO: 18966 - protein, 10 aa, BK virus
QQLKHTGYQL

SEQ ID NO: 18967 - protein, 10 aa, BK virus
QLKHTGYQLY

SEQ ID NO: 18968 - protein, 10 aa, BK virus
LKHTGYQLYK

SEQ ID NO: 18969 - protein, 10 aa, BK virus
KHTGYQLYKE

SEQ ID NO: 18970 - protein, 10 aa, BK virus
HTGYQLYKEA

SEQ ID NO: 18971 - protein, 10 aa, BK virus
TGYQLYKEAP

SEQ ID NO: 18972 - protein, 10 aa, BK virus
GYQLYKEAPH

SEQ ID NO: 18973 - protein, 10 aa, BK virus
YQLYKEAPHP

SEQ ID NO: 18974 - protein, 10 aa, BK virus
QLYKEAPHPV

SEQ ID NO: 18975 - protein, 10 aa, BK virus
LYKEAPHPVH

SEQ ID NO: 18976 - protein, 10 aa, BK virus
YKEAPHPVHL

SEQ ID NO: 18977 - protein, 10 aa, BK virus
KEAPHPVHLA

SEQ ID NO: 18978 - protein, 10 aa, BK virus
EAPHPVHLAT

SEQ ID NO: 18979 - protein, 10 aa, BK virus
APHPVHLATL

SEQ ID NO: 18980 - protein, 10 aa, BK virus
PHPVHLATLW

SEQ ID NO: 18981 - protein, 10 aa, BK virus
LCWSHEVLGE

SEQ ID NO: 18982 - protein, 10 aa, BK virus
CWSHEVLGEH

SEQ ID NO: 18983 - protein, 10 aa, BK virus
WSHEVLGEHF

SEQ ID NO: 18984 - protein, 10 aa, BK virus
SHEVLGEHFP

SEQ ID NO: 18985 - protein, 10 aa, BK virus
HEVLGEHFPL

SEQ ID NO: 18986 - protein, 10 aa, BK virus
EVLGEHFPLL

SEQ ID NO: 18987 - protein, 10 aa, BK virus
HFHFYWDQVP

SEQ ID NO: 18988 - protein, 10 aa, BK virus
FHFYWDQVPS

SEQ ID NO: 18989 - protein, 10 aa, BK virus
HFYWDQVPST

SEQ ID NO: 18990 - protein, 10 aa, BK virus
FYWDQVPSTQ

SEQ ID NO: 18991 - protein, 10 aa, BK virus
YWDQVPSTQL

SEQ ID NO: 18992 - protein, 10 aa, BK virus
WDQVPSTQLD

SEQ ID NO: 18993 - protein, 10 aa, BK virus
DQVPSTQLDK

SEQ ID NO: 18994 - protein, 10 aa, BK virus
QVPSTQLDKH

SEQ ID NO: 18995 - protein, 10 aa, BK virus
VPSTQLDKHC

SEQ ID NO: 18996 - protein, 10 aa, BK virus
PSTQLDKHCF

SEQ ID NO: 18997 - protein, 10 aa, BK virus
STQLDKHCFC

SEQ ID NO: 18998 - protein, 10 aa, BK virus
TQLDKHCFCP

SEQ ID NO: 18999 - protein, 10 aa, BK virus
QLDKHCFCPN

SEQ ID NO: 19000 - protein, 10 aa, BK virus
LDKHCFCPNR

SEQ ID NO: 19001 - protein, 10 aa, BK virus
DKHCFCPNRP

SEQ ID NO: 19002 - protein, 10 aa, BK virus
KHCFCPNRPY

SEQ ID NO: 19003 - protein, 10 aa, BK virus
HCFCPNRPYG

SEQ ID NO: 19004 - protein, 10 aa, BK virus
CFCPNRPYGQ

SEQ ID NO: 19005 - protein, 10 aa, BK virus
FCPNRPYGQY

SEQ ID NO: 19006 - protein, 10 aa, BK virus
CPNRPYGQYS

SEQ ID NO: 19007 - protein, 10 aa, BK virus
PNRPYGQYSL

SEQ ID NO: 19008 - protein, 10 aa, BK virus
NRPYGQYSLP

SEQ ID NO: 19009 - protein, 10 aa, BK virus
RPYGQYSLPG

SEQ ID NO: 19010 - protein, 10 aa, BK virus
PYGQYSLPGT

SEQ ID NO: 19011 - protein, 10 aa, BK virus
YGQYSLPGTG

SEQ ID NO: 19012 - protein, 10 aa, BK virus
GQYSLPGTGL

SEQ ID NO: 19013 - protein, 10 aa, BK virus
QYSLPGTGLL

SEQ ID NO: 19014 - protein, 10 aa, BK virus
YSLPGTGLLG

SEQ ID NO: 19015 - protein, 10 aa, BK virus
SLPGTGLLGF

SEQ ID NO: 19016 - protein, 10 aa, BK virus
YHQGTLTCNS

SEQ ID NO: 19017 - protein, 10 aa, BK virus
HQGTLTCNSL

SEQ ID NO: 19018 - protein, 10 aa, BK virus
QGTLTCNSLA

SEQ ID NO: 19019 - protein, 10 aa, BK virus
GTLTCNSLAL

SEQ ID NO: 19020 - protein, 10 aa, BK virus
TLTCNSLALP

SEQ ID NO: 19021 - protein, 10 aa, BK virus
LTCNSLALPA

SEQ ID NO: 19022 - protein, 10 aa, BK virus
TCNSLALPAF

SEQ ID NO: 19023 - protein, 10 aa, BK virus
CNSLALPAFP

SEQ ID NO: 19024 - protein, 10 aa, BK virus
NSLALPAFPR

SEQ ID NO: 19025 - protein, 10 aa, BK virus
SLALPAFPRV

SEQ ID NO: 19026 - protein, 10 aa, BK virus
LALPAFPRVL

SEQ ID NO: 19027 - protein, 10 aa, BK virus
ALPAFPRVLH

SEQ ID NO: 19028 - protein, 10 aa, BK virus
LPAFPRVLHL

SEQ ID NO: 19029 - protein, 10 aa, BK virus
PAFPRVLHLQ

SEQ ID NO: 19030 - protein, 10 aa, BK virus
AFPRVLHLQQ

SEQ ID NO: 19031 - protein, 10 aa, BK virus
FPRVLHLQQR

SEQ ID NO: 19032 - protein, 10 aa, BK virus
PRVLHLQQRS

SEQ ID NO: 19033 - protein, 10 aa, BK virus
RVLHLQQRSG

SEQ ID NO: 19034 - protein, 10 aa, BK virus
VLHLQQRSGN

SEQ ID NO: 19035 - protein, 10 aa, BK virus
LHLQQRSGNY

SEQ ID NO: 19036 - protein, 10 aa, BK virus
HLQQRSGNYC

SEQ ID NO: 19037 - protein, 10 aa, BK virus
LQQRSGNYCL

SEQ ID NO: 19038 - protein, 10 aa, BK virus
QQRSGNYCLE

SEQ ID NO: 19039 - protein, 10 aa, BK virus
VFLHHAHALF

SEQ ID NO: 19040 - protein, 10 aa, BK virus
FLHHAHALFV

SEQ ID NO: 19041 - protein, 10 aa, BK virus
LHHAHALFVT

SEQ ID NO: 19042 - protein, 10 aa, BK virus
HHAHALFVTL

SEQ ID NO: 19043 - protein, 10 aa, BK virus
HAHALFVTLH

SEQ ID NO: 19044 - protein, 10 aa, BK virus
AHALFVTLHE

SEQ ID NO: 19045 - protein, 10 aa, BK virus
HALFVTLHEG

SEQ ID NO: 19046 - protein, 10 aa, BK virus
PLFVQLQPPT

SEQ ID NO: 19047 - protein, 10 aa, BK virus
LFVQLQPPTS

SEQ ID NO: 19048 - protein, 10 aa, BK virus
FVQLQPPTSV

SEQ ID NO: 19049 - protein, 10 aa, BK virus
VQLQPPTSVD

SEQ ID NO: 19050 - protein, 10 aa, BK virus
QLQPPTSVDF

SEQ ID NO: 19051 - protein, 10 aa, BK virus
LQPPTSVDFH

SEQ ID NO: 19052 - protein, 10 aa, BK virus
QPPTSVDFHR

SEQ ID NO: 19053 - protein, 10 aa, BK virus
PPTSVDFHRL

SEQ ID NO: 19054 - protein, 10 aa, BK virus
PTSVDFHRLG

SEQ ID NO: 19055 - protein, 10 aa, BK virus
TSVDFHRLGP

SEQ ID NO: 19056 - protein, 10 aa, BK virus
SVDFHRLGPH

SEQ ID NO: 19057 - protein, 10 aa, BK virus
VDFHRLGPHL

SEQ ID NO: 19058 - protein, 10 aa, BK virus
DFHRLGPHLN

SEQ ID NO: 19059 - protein, 10 aa, BK virus
FHRLGPHLNW

SEQ ID NO: 19060 - protein, 10 aa, BK virus
HRLGPHLNWG

SEQ ID NO: 19061 - protein, 10 aa, BK virus
RLGPHLNWGG

SEQ ID NO: 19062 - protein, 10 aa, BK virus
LGPHLNWGGE

SEQ ID NO: 19063 - protein, 10 aa, BK virus
GPHLNWGGEF

SEQ ID NO: 19064 - protein, 10 aa, BK virus
PHLNWGGEFL

SEQ ID NO: 19065 - protein, 10 aa, BK virus
HLNWGGEFLL

SEQ ID NO: 19066 - protein, 10 aa, BK virus
LNWGGEFLLC

SEQ ID NO: 19067 - protein, 10 aa, BK virus
NWGGEFLLCC

SEQ ID NO: 19068 - protein, 10 aa, BK virus
WGGEFLLCCN

SEQ ID NO: 19069 - protein, 10 aa, BK virus
GGEFLLCCNR

SEQ ID NO: 19070 - protein, 10 aa, BK virus
GEFLLCCNRE

SEQ ID NO: 19071 - protein, 10 aa, BK virus
EFLLCCNREA

SEQ ID NO: 19072 - protein, 10 aa, BK virus
FLLCCNREAF

SEQ ID NO: 19073 - protein, 10 aa, BK virus
LLCCNREAFF

SEQ ID NO: 19074 - protein, 10 aa, BK virus
LCCNREAFFS

SEQ ID NO: 19075 - protein, 10 aa, BK virus
CCNREAFFSL

SEQ ID NO: 19076 - protein, 10 aa, BK virus
CNREAFFSLG

SEQ ID NO: 19077 - protein, 10 aa, BK virus
NREAFFSLGY

SEQ ID NO: 19078 - protein, 10 aa, BK virus
REAFFSLGYH

SEQ ID NO: 19079 - protein, 10 aa, BK virus
EAFFSLGYHC

SEQ ID NO: 19080 - protein, 10 aa, BK virus
GFHLDPPFLG

SEQ ID NO: 19081 - protein, 10 aa, BK virus
FHLDPPFLGL

SEQ ID NO: 19082 - protein, 10 aa, BK virus
HLDPPFLGLG

SEQ ID NO: 19083 - protein, 10 aa, BK virus
LDPPFLGLGS

SEQ ID NO: 19084 - protein, 10 aa, BK virus
DPPFLGLGSI

SEQ ID NO: 19085 - protein, 10 aa, BK virus
PPFLGLGSIL

SEQ ID NO: 19086 - protein, 10 aa, BK virus
PFLGLGSILP

SEQ ID NO: 19087 - protein, 10 aa, BK virus
FLGLGSILPL

SEQ ID NO: 19088 - protein, 10 aa, BK virus
LLELLLLLLL

SEQ ID NO: 19089 - protein, 10 aa, BK virus
LELLLLLLLV

SEQ ID NO: 19090 - protein, 10 aa, BK virus
ELLLLLLLVV

SEQ ID NO: 19091 - protein, 10 aa, BK virus
LLLLLLLVVL

SEQ ID NO: 19092 - protein, 10 aa, BK virus
LLLLLLVVLA

SEQ ID NO: 19093 - protein, 10 aa, BK virus
LLLLLVVLAL

SEQ ID NO: 19094 - protein, 10 aa, BK virus
LLLLVVLALA

SEQ ID NO: 19095 - protein, 10 aa, BK virus
LLLVVLALAR

SEQ ID NO: 19096 - protein, 10 aa, BK virus
LLVVLALARV

SEQ ID NO: 19097 - protein, 10 aa, BK virus
LVVLALARVP

SEQ ID NO: 19098 - protein, 10 aa, BK virus
VVLALARVPL

SEQ ID NO: 19099 - protein, 10 aa, BK virus
VLALARVPLA

SEQ ID NO: 19100 - protein, 10 aa, BK virus
LALARVPLAF

SEQ ID NO: 19101 - protein, 10 aa, BK virus
ALARVPLAFW

SEQ ID NO: 19102 - protein, 10 aa, BK virus
LARVPLAFWE

SEQ ID NO: 19103 - protein, 10 aa, BK virus
ARVPLAFWEL

SEQ ID NO: 19104 - protein, 10 aa, BK virus
RVPLAFWELP

SEQ ID NO: 19105 - protein, 10 aa, BK virus
VPLAFWELPL

SEQ ID NO: 19106 - protein, 10 aa, BK virus
PLAFWELPLD

SEQ ID NO: 19107 - protein, 10 aa, BK virus
LAFWELPLDT

SEQ ID NO: 19108 - protein, 10 aa, BK virus
AFWELPLDTL

SEQ ID NO: 19109 - protein, 10 aa, BK virus
FWELPLDTLL

SEQ ID NO: 19110 - protein, 10 aa, BK virus
WELPLDTLLF

SEQ ID NO: 19111 - protein, 10 aa, BK virus
ELPLDTLLFF

SEQ ID NO: 19112 - protein, 10 aa, BK virus
LPLDTLLFFW

SEQ ID NO: 19113 - protein, 10 aa, BK virus
PLDTLLFFWL

SEQ ID NO: 19114 - protein, 10 aa, BK virus
LDTLLFFWLG

SEQ ID NO: 19115 - protein, 10 aa, BK virus
DTLLFFWLGP

SEQ ID NO: 19116 - protein, 10 aa, BK virus
TLLFFWLGPS

SEQ ID NO: 19117 - protein, 10 aa, BK virus
LLFFWLGPSS

SEQ ID NO: 19118 - protein, 10 aa, BK virus
LFFWLGPSSY

SEQ ID NO: 19119 - protein, 10 aa, BK virus
FFWLGPSSYA

SEQ ID NO: 19120 - protein, 10 aa, BK virus
FWLGPSSYAS

SEQ ID NO: 19121 - protein, 10 aa, BK virus
WLGPSSYASR

SEQ ID NO: 19122 - protein, 10 aa, BK virus
LGPSSYASRA

SEQ ID NO: 19123 - protein, 10 aa, BK virus
GPSSYASRAG

SEQ ID NO: 19124 - protein, 10 aa, BK virus
PSSYASRAGV

SEQ ID NO: 19125 - protein, 10 aa, BK virus
SSYASRAGVT

SEQ ID NO: 19126 - protein, 10 aa, BK virus
SYASRAGVTV

SEQ ID NO: 19127 - protein, 10 aa, BK virus
YASRAGVTVP

SEQ ID NO: 19128 - protein, 10 aa, BK virus
ASRAGVTVPY

SEQ ID NO: 19129 - protein, 10 aa, BK virus
SRAGVTVPYR

SEQ ID NO: 19130 - protein, 10 aa, BK virus
RAGVTVPYRP

SEQ ID NO: 19131 - protein, 10 aa, BK virus
AGVTVPYRPR

SEQ ID NO: 19132 - protein, 10 aa, BK virus
GVTVPYRPRS

SEQ ID NO: 19133 - protein, 10 aa, BK virus
VTVPYRPRSK

SEQ ID NO: 19134 - protein, 10 aa, BK virus
TVPYRPRSKG

SEQ ID NO: 19135 - protein, 10 aa, BK virus
VPYRPRSKGN

SEQ ID NO: 19136 - protein, 10 aa, BK virus
PYRPRSKGNI

SEQ ID NO: 19137 - protein, 10 aa, BK virus
YRPRSKGNIH

SEQ ID NO: 19138 - protein, 10 aa, BK virus
LAPPGAIVFS

SEQ ID NO: 19139 - protein, 10 aa, BK virus
APPGAIVFSI

SEQ ID NO: 19140 - protein, 10 aa, BK virus
PPGAIVFSIN

SEQ ID NO: 19141 - protein, 10 aa, BK virus
PGAIVFSINS

SEQ ID NO: 19142 - protein, 10 aa, BK virus
GAIVFSINSP

SEQ ID NO: 19143 - protein, 10 aa, BK virus
AIVFSINSPE

SEQ ID NO: 19144 - protein, 10 aa, BK virus
IVFSINSPEC

SEQ ID NO: 19145 - protein, 10 aa, BK virus
VFSINSPECT

SEQ ID NO: 19146 - protein, 10 aa, BK virus
FSINSPECTL

SEQ ID NO: 19147 - protein, 10 aa, BK virus
SINSPECTLC

SEQ ID NO: 19148 - protein, 10 aa, BK virus
FLKSILCVTS

SEQ ID NO: 19149 - protein, 10 aa, BK virus
LKSILCVTSS

SEQ ID NO: 19150 - protein, 10 aa, BK virus
KSILCVTSSI

SEQ ID NO: 19151 - protein, 10 aa, BK virus
SILCVTSSIL

SEQ ID NO: 19152 - protein, 10 aa, BK virus
ILCVTSSILS

SEQ ID NO: 19153 - protein, 10 aa, BK virus
LCVTSSILSA

SEQ ID NO: 19154 - protein, 10 aa, BK virus
CVTSSILSAS

SEQ ID NO: 19155 - protein, 10 aa, BK virus
VTSSILSASS

SEQ ID NO: 19156 - protein, 10 aa, BK virus
TSSILSASSI

SEQ ID NO: 19157 - protein, 10 aa, BK virus
SSILSASSIL

SEQ ID NO: 19158 - protein, 10 aa, BK virus
VWPKCTRVPS

SEQ ID NO: 19159 - protein, 10 aa, BK virus
WPKCTRVPSL

SEQ ID NO: 19160 - protein, 10 aa, BK virus
PKCTRVPSLS

SEQ ID NO: 19161 - protein, 10 aa, BK virus
KCTRVPSLSA

SEQ ID NO: 19162 - protein, 10 aa, BK virus
CTRVPSLSAT

SEQ ID NO: 19163 - protein, 10 aa, BK virus
TRVPSLSATC

SEQ ID NO: 19164 - protein, 10 aa, BK virus
RVPSLSATCL

SEQ ID NO: 19165 - protein, 10 aa, BK virus
VPSLSATCLT

SEQ ID NO: 19166 - protein, 10 aa, BK virus
PSLSATCLTI

SEQ ID NO: 19167 - protein, 10 aa, BK virus
SLSATCLTIE

SEQ ID NO: 19168 - protein, 10 aa, BK virus
LSATCLTIEG

SEQ ID NO: 19169 - protein, 10 aa, BK virus
SATCLTIEGL

SEQ ID NO: 19170 - protein, 10 aa, BK virus
ATCLTIEGLI

SEQ ID NO: 19171 - protein, 10 aa, BK virus
TCLTIEGLIG

SEQ ID NO: 19172 - protein, 10 aa, BK virus
CLTIEGLIGE

SEQ ID NO: 19173 - protein, 10 aa, BK virus
LTIEGLIGER

SEQ ID NO: 19174 - protein, 10 aa, BK virus
TIEGLIGERS

SEQ ID NO: 19175 - protein, 10 aa, BK virus
IEGLIGERSE

SEQ ID NO: 19176 - protein, 10 aa, BK virus
KFIGAFTIVQ

SEQ ID NO: 19177 - protein, 10 aa, BK virus
FIGAFTIVQV

SEQ ID NO: 19178 - protein, 10 aa, BK virus
IGAFTIVQVV

SEQ ID NO: 19179 - protein, 10 aa, BK virus
GAFTIVQVVS

SEQ ID NO: 19180 - protein, 10 aa, BK virus
AFTIVQVVSS

SEQ ID NO: 19181 - protein, 10 aa, BK virus
FTIVQVVSSK

SEQ ID NO: 19182 - protein, 10 aa, BK virus
TIVQVVSSKN

SEQ ID NO: 19183 - protein, 10 aa, BK virus
IVQVVSSKNL

SEQ ID NO: 19184 - protein, 10 aa, BK virus
VQVVSSKNLA

SEQ ID NO: 19185 - protein, 10 aa, BK virus
QVVSSKNLAK

SEQ ID NO: 19186 - protein, 10 aa, BK virus
VVSSKNLAKE

SEQ ID NO: 19187 - protein, 10 aa, BK virus
VSSKNLAKES

SEQ ID NO: 19188 - protein, 10 aa, BK virus
SSKNLAKESL

SEQ ID NO: 19189 - protein, 10 aa, BK virus
SKNLAKESLK

SEQ ID NO: 19190 - protein, 10 aa, BK virus
KNLAKESLKN

SEQ ID NO: 19191 - protein, 10 aa, BK virus
NLAKESLKNL

SEQ ID NO: 19192 - protein, 10 aa, BK virus
LAKESLKNLS

SEQ ID NO: 19193 - protein, 10 aa, BK virus
AKESLKNLSV

SEQ ID NO: 19194 - protein, 10 aa, BK virus
KESLKNLSVL

SEQ ID NO: 19195 - protein, 10 aa, BK virus
ESLKNLSVLL

SEQ ID NO: 19196 - protein, 10 aa, BK virus
SLKNLSVLLC

SEQ ID NO: 19197 - protein, 10 aa, BK virus
LKNLSVLLCN

SEQ ID NO: 19198 - protein, 10 aa, BK virus
KNLSVLLCNS

SEQ ID NO: 19199 - protein, 10 aa, BK virus
NLSVLLCNSC

SEQ ID NO: 19200 - protein, 10 aa, BK virus
LSVLLCNSCE

SEQ ID NO: 19201 - protein, 10 aa, BK virus
SVLLCNSCEV

SEQ ID NO: 19202 - protein, 10 aa, BK virus
VLLCNSCEVI

SEQ ID NO: 19203 - protein, 10 aa, BK virus
LLCNSCEVIE

SEQ ID NO: 19204 - protein, 10 aa, BK virus
LCNSCEVIEG

SEQ ID NO: 19205 - protein, 10 aa, BK virus
CNSCEVIEGI

SEQ ID NO: 19206 - protein, 10 aa, BK virus
NSCEVIEGIS

SEQ ID NO: 19207 - protein, 10 aa, BK virus
SCEVIEGISS

SEQ ID NO: 19208 - protein, 10 aa, BK virus
CEVIEGISSL

SEQ ID NO: 19209 - protein, 10 aa, BK virus
EVIEGISSLI

SEQ ID NO: 19210 - protein, 10 aa, BK virus
VIEGISSLIT

SEQ ID NO: 19211 - protein, 10 aa, BK virus
IEGISSLITC

SEQ ID NO: 19212 - protein, 10 aa, BK virus
EGISSLITCH

SEQ ID NO: 19213 - protein, 10 aa, BK virus
GISSLITCHK

SEQ ID NO: 19214 - protein, 10 aa, BK virus
ISSLITCHKA

SEQ ID NO: 19215 - protein, 10 aa, BK virus
SSLITCHKAW

SEQ ID NO: 19216 - protein, 10 aa, BK virus
SLITCHKAWE

SEQ ID NO: 19217 - protein, 10 aa, BK virus
LITCHKAWEI

SEQ ID NO: 19218 - protein, 10 aa, BK virus
ITCHKAWEIV

SEQ ID NO: 19219 - protein, 10 aa, BK virus
TCHKAWEIVA

SEQ ID NO: 19220 - protein, 10 aa, BK virus
CHKAWEIVAN

SEQ ID NO: 19221 - protein, 10 aa, BK virus
HKAWEIVANK

SEQ ID NO: 19222 - protein, 10 aa, BK virus
KAWEIVANKE

SEQ ID NO: 19223 - protein, 10 aa, BK virus
AWEIVANKEG

SEQ ID NO: 19224 - protein, 10 aa, BK virus
WEIVANKEGP

SEQ ID NO: 19225 - protein, 10 aa, BK virus
EIVANKEGPQ

SEQ ID NO: 19226 - protein, 10 aa, BK virus
IVANKEGPQC

SEQ ID NO: 19227 - protein, 10 aa, BK virus
VANKEGPQCL

SEQ ID NO: 19228 - protein, 10 aa, BK virus
ANKEGPQCLG

SEQ ID NO: 19229 - protein, 10 aa, BK virus
NKEGPQCLGS

SEQ ID NO: 19230 - protein, 10 aa, BK virus
KEGPQCLGSR

SEQ ID NO: 19231 - protein, 10 aa, BK virus
EGPQCLGSRY

SEQ ID NO: 19232 - protein, 10 aa, BK virus
ILLTKVFTPG

SEQ ID NO: 19233 - protein, 10 aa, BK virus
LLTKVFTPGN

SEQ ID NO: 19234 - protein, 10 aa, BK virus
LTKVFTPGNR

SEQ ID NO: 19235 - protein, 10 aa, BK virus
TKVFTPGNRI

SEQ ID NO: 19236 - protein, 10 aa, BK virus
KVFTPGNRIS

SEQ ID NO: 19237 - protein, 10 aa, BK virus
YSSGLNNSKA

SEQ ID NO: 19238 - protein, 10 aa, BK virus
SSGLNNSKAM

SEQ ID NO: 19239 - protein, 10 aa, BK virus
SGLNNSKAMP

SEQ ID NO: 19240 - protein, 10 aa, BK virus
GLNNSKAMPD

SEQ ID NO: 19241 - protein, 10 aa, BK virus
LNNSKAMPDC

SEQ ID NO: 19242 - protein, 10 aa, BK virus
SQSSKNLYPT

SEQ ID NO: 19243 - protein, 10 aa, BK virus
IKAANPAIAP

SEQ ID NO: 19244 - protein, 10 aa, BK virus
KAANPAIAPG

SEQ ID NO: 19245 - protein, 10 aa, BK virus
AANPAIAPGA

SEQ ID NO: 19246 - protein, 10 aa, BK virus
ANPAIAPGAP

SEQ ID NO: 19247 - protein, 10 aa, BK virus
NPAIAPGAPA

SEQ ID NO: 19248 - protein, 10 aa, BK virus
PAIAPGAPAI

SEQ ID NO: 19249 - protein, 10 aa, BK virus
AIAPGAPAIT

SEQ ID NO: 19250 - protein, 10 aa, BK virus
IAPGAPAITA

SEQ ID NO: 19251 - protein, 10 aa, BK virus
APGAPAITAY

SEQ ID NO: 19252 - protein, 10 aa, BK virus
PGAPAITAYV

SEQ ID NO: 19253 - protein, 10 aa, BK virus
GVRPIAAIAS

SEQ ID NO: 19254 - protein, 10 aa, BK virus
VRPIAAIASE

SEQ ID NO: 19255 - protein, 10 aa, BK virus
RPIAAIASEV

SEQ ID NO: 19256 - protein, 10 aa, BK virus
PIAAIASEVL

SEQ ID NO: 19257 - protein, 10 aa, BK virus
IAAIASEVLV

SEQ ID NO: 19258 - protein, 10 aa, BK virus
AAIASEVLVM

SEQ ID NO: 19259 - protein, 10 aa, BK virus
AIASEVLVMP

SEQ ID NO: 19260 - protein, 10 aa, BK virus
IASEVLVMPS

SEQ ID NO: 19261 - protein, 10 aa, BK virus
ASEVLVMPST

SEQ ID NO: 19262 - protein, 10 aa, BK virus
SEVLVMPSTV

SEQ ID NO: 19263 - protein, 10 aa, BK virus
EVLVMPSTVA

SEQ ID NO: 19264 - protein, 10 aa, BK virus
VLVMPSTVAR

SEQ ID NO: 19265 - protein, 10 aa, BK virus
LVMPSTVARD

SEQ ID NO: 19266 - protein, 10 aa, BK virus
VMPSTVARDA

SEQ ID NO: 19267 - protein, 10 aa, BK virus
MPSTVARDAI

SEQ ID NO: 19268 - protein, 10 aa, BK virus
TSIAAAASPA

SEQ ID NO: 19269 - protein, 10 aa, BK virus
SIAAAASPAA

SEQ ID NO: 19270 - protein, 10 aa, BK virus
IAAAASPAAI

SEQ ID NO: 19271 - protein, 10 aa, BK virus
AAAASPAAIS

SEQ ID NO: 19272 - protein, 10 aa, BK virus
AAASPAAISA

SEQ ID NO: 19273 - protein, 10 aa, BK virus
AASPAAISAT

SEQ ID NO: 19274 - protein, 10 aa, BK virus
ASPAAISATE

SEQ ID NO: 19275 - protein, 10 aa, BK virus
SPAAISATEN

SEQ ID NO: 19276 - protein, 10 aa, BK virus
PAAISATENP

SEQ ID NO: 19277 - protein, 10 aa, BK virus
AAISATENPV

SEQ ID NO: 19278 - protein, 10 aa, BK virus
AISATENPVA

SEQ ID NO: 19279 - protein, 10 aa, BK virus
ISATENPVAA

SEQ ID NO: 19280 - protein, 10 aa, BK virus
SATENPVAAA

SEQ ID NO: 19281 - protein, 10 aa, BK virus
ATENPVAAAA

SEQ ID NO: 19282 - protein, 10 aa, BK virus
TENPVAAAAS

SEQ ID NO: 19283 - protein, 10 aa, BK virus
ENPVAAAASD

SEQ ID NO: 19284 - protein, 10 aa, BK virus
NPVAAAASDT

SEQ ID NO: 19285 - protein, 10 aa, BK virus
PVAAAASDTL

SEQ ID NO: 19286 - protein, 10 aa, BK virus
VAAAASDTLA

SEQ ID NO: 19287 - protein, 10 aa, BK virus
AAAASDTLAT

SEQ ID NO: 19288 - protein, 10 aa, BK virus
AAASDTLATR

SEQ ID NO: 19289 - protein, 10 aa, BK virus
AASDTLATRS

SEQ ID NO: 19290 - protein, 10 aa, BK virus
ASDTLATRSP

SEQ ID NO: 19291 - protein, 10 aa, BK virus
SDTLATRSPK

SEQ ID NO: 19292 - protein, 10 aa, BK virus
DTLATRSPKS

SEQ ID NO: 19293 - protein, 10 aa, BK virus
TLATRSPKSA

SEQ ID NO: 19294 - protein, 10 aa, BK virus
LATRSPKSAR

SEQ ID NO: 19295 - protein, 10 aa, BK virus
ATRSPKSARA

SEQ ID NO: 19296 - protein, 10 aa, BK virus
TRSPKSARAA

SEQ ID NO: 19297 - protein, 10 aa, BK virus
RSPKSARAAP

SEQ ID NO: 19298 - protein, 10 aa, BK virus
SPKSARAAPM

SEQ ID NO: 19299 - protein, 10 aa, BK virus
PKSARAAPMN

SEQ ID NO: 19300 - protein, 10 aa, BK virus
KSARAAPMNL

SEQ ID NO: 19301 - protein, 10 aa, BK virus
SARAAPMNLE

SEQ ID NO: 19302 - protein, 10 aa, BK virus
ARAAPMNLEI

SEQ ID NO: 19303 - protein, 10 aa, BK virus
RAAPMNLEIQ

SEQ ID NO: 19304 - protein, 10 aa, BK virus
AAPMNLEIQK

SEQ ID NO: 19305 - protein, 10 aa, BK virus
APMNLEIQKK

SEQ ID NO: 19306 - protein, 10 aa, BK virus
PMNLEIQKKR

SEQ ID NO: 19307 - protein, 10 aa, BK virus
MNLEIQKKRD

SEQ ID NO: 19308 - protein, 10 aa, BK virus
NLEIQKKRDY

SEQ ID NO: 19309 - protein, 10 aa, BK virus
LEIQKKRDYL

SEQ ID NO: 19310 - protein, 10 aa, BK virus
EIQKKRDYLP

SEQ ID NO: 19311 - protein, 10 aa, BK virus
IQKKRDYLPR

SEQ ID NO: 19312 - protein, 10 aa, BK virus
QKKRDYLPRS

SEQ ID NO: 19313 - protein, 10 aa, BK virus
KKRDYLPRSL

SEQ ID NO: 19314 - protein, 10 aa, BK virus
KRDYLPRSLL

SEQ ID NO: 19315 - protein, 10 aa, BK virus
RDYLPRSLLQ

SEQ ID NO: 19316 - protein, 10 aa, BK virus
DYLPRSLLQS

SEQ ID NO: 19317 - protein, 10 aa, BK virus
YLPRSLLQSL

SEQ ID NO: 19318 - protein, 10 aa, BK virus
LPRSLLQSLL

SEQ ID NO: 19319 - protein, 10 aa, BK virus
PRSLLQSLLQ

SEQ ID NO: 19320 - protein, 10 aa, BK virus
RSLLQSLLQQ

SEQ ID NO: 19321 - protein, 10 aa, BK virus
SLLQSLLQQV

SEQ ID NO: 19322 - protein, 10 aa, BK virus
LLQSLLQQVK

SEQ ID NO: 19323 - protein, 10 aa, BK virus
LQSLLQQVKQ

SEQ ID NO: 19324 - protein, 10 aa, BK virus
QSLLQQVKQW

SEQ ID NO: 19325 - protein, 10 aa, BK virus
SLLQQVKQWY

SEQ ID NO: 19326 - protein, 10 aa, BK virus
LLQQVKQWYF

SEQ ID NO: 19327 - protein, 10 aa, BK virus
LQQVKQWYFC

SEQ ID NO: 19328 - protein, 10 aa, BK virus
QQVKQWYFCF

SEQ ID NO: 19329 - protein, 10 aa, BK virus
QVKQWYFCFS

SEQ ID NO: 19330 - protein, 10 aa, BK virus
VKQWYFCFSR

SEQ ID NO: 19331 - protein, 10 aa, BK virus
KQWYFCFSRL

SEQ ID NO: 19332 - protein, 10 aa, BK virus
QWYFCFSRLH

SEQ ID NO: 19333 - protein, 10 aa, BK virus
WYFCFSRLHC

SEQ ID NO: 19334 - protein, 10 aa, BK virus
YFCFSRLHCL

SEQ ID NO: 19335 - protein, 10 aa, BK virus
FCFSRLHCLH

SEQ ID NO: 19336 - protein, 10 aa, BK virus
CFSRLHCLHL

SEQ ID NO: 19337 - protein, 10 aa, BK virus
FSRLHCLHLY

SEQ ID NO: 19338 - protein, 10 aa, BK virus
SRLHCLHLYK

SEQ ID NO: 19339 - protein, 10 aa, BK virus
RLHCLHLYKI

SEQ ID NO: 19340 - protein, 10 aa, BK virus
LHCLHLYKIP

SEQ ID NO: 19341 - protein, 10 aa, BK virus
HCLHLYKIPA

SEQ ID NO: 19342 - protein, 10 aa, BK virus
CLHLYKIPAK

SEQ ID NO: 19343 - protein, 10 aa, BK virus
LHLYKIPAKA

SEQ ID NO: 19344 - protein, 10 aa, BK virus
HLYKIPAKAL

SEQ ID NO: 19345 - protein, 10 aa, BK virus
LYKIPAKALK

SEQ ID NO: 19346 - protein, 10 aa, BK virus
KSSELFFLFQ

SEQ ID NO: 19347 - protein, 10 aa, BK virus
SSELFFLFQS

SEQ ID NO: 19348 - protein, 10 aa, BK virus
SELFFLFQSR

SEQ ID NO: 19349 - protein, 10 aa, BK virus
ELFFLFQSRF

SEQ ID NO: 19350 - protein, 10 aa, BK virus
LFFLFQSRFY

SEQ ID NO: 19351 - protein, 10 aa, BK virus
FFLFQSRFYQ

SEQ ID NO: 19352 - protein, 10 aa, BK virus
FLFQSRFYQL

SEQ ID NO: 19353 - protein, 10 aa, BK virus
LFQSRFYQLS

SEQ ID NO: 19354 - protein, 10 aa, BK virus
FQSRFYQLSL

SEQ ID NO: 19355 - protein, 10 aa, BK virus
QSRFYQLSLK

SEQ ID NO: 19356 - protein, 10 aa, BK virus
SRFYQLSLKL

SEQ ID NO: 19357 - protein, 10 aa, BK virus
RFYQLSLKLV

SEQ ID NO: 19358 - protein, 10 aa, BK virus
FYQLSLKLVV

SEQ ID NO: 19359 - protein, 10 aa, BK virus
YQLSLKLVVT

SEQ ID NO: 19360 - protein, 10 aa, BK virus
QLSLKLVVTA

SEQ ID NO: 19361 - protein, 10 aa, BK virus
LSLKLVVTAG

SEQ ID NO: 19362 - protein, 10 aa, BK virus
SLKLVVTAGA

SEQ ID NO: 19363 - protein, 10 aa, BK virus
LKLVVTAGAE

SEQ ID NO: 19364 - protein, 10 aa, BK virus
KLVVTAGAEP

SEQ ID NO: 19365 - protein, 10 aa, BK virus
LVVTAGAEPW

SEQ ID NO: 19366 - protein, 10 aa, BK virus
VVTAGAEPWP

SEQ ID NO: 19367 - protein, 10 aa, BK virus
VTAGAEPWPL

SEQ ID NO: 19368 - protein, 10 aa, BK virus
TAGAEPWPLS

SEQ ID NO: 19369 - protein, 10 aa, BK virus
AGAEPWPLSS

SEQ ID NO: 19370 - protein, 10 aa, BK virus
GAEPWPLSSL

SEQ ID NO: 19371 - protein, 10 aa, BK virus
AEPWPLSSLT

SEQ ID NO: 19372 - protein, 10 aa, BK virus
EPWPLSSLTG

SEQ ID NO: 19373 - protein, 10 aa, BK virus
PWPLSSLTGD

SEQ ID NO: 19374 - protein, 10 aa, BK virus
WPLSSLTGDK

SEQ ID NO: 19375 - protein, 10 aa, BK virus
PLSSLTGDKA

SEQ ID NO: 19376 - protein, 10 aa, BK virus
LSSLTGDKAK

SEQ ID NO: 19377 - protein, 10 aa, BK virus
SSLTGDKAKI

SEQ ID NO: 19378 - protein, 10 aa, BK virus
SLTGDKAKIP

SEQ ID NO: 19379 - protein, 10 aa, BK virus
LTGDKAKIPR

SEQ ID NO: 19380 - protein, 10 aa, BK virus
TGDKAKIPRL

SEQ ID NO: 19381 - protein, 10 aa, BK virus
GDKAKIPRLA

SEQ ID NO: 19382 - protein, 10 aa, BK virus
DKAKIPRLAK

SEQ ID NO: 19383 - protein, 10 aa, BK virus
KAKIPRLAKH

SEQ ID NO: 19384 - protein, 10 aa, BK virus
AKIPRLAKHV

SEQ ID NO: 19385 - protein, 10 aa, BK virus
KIPRLAKHVC

SEQ ID NO: 19386 - protein, 10 aa, BK virus
IPRLAKHVCH

SEQ ID NO: 19387 - protein, 10 aa, BK virus
PRLAKHVCHA

SEQ ID NO: 19388 - protein, 10 aa, BK virus
RLAKHVCHAL

SEQ ID NO: 19389 - protein, 10 aa, BK virus
LAKHVCHALS

SEQ ID NO: 19390 - protein, 10 aa, BK virus
AKHVCHALSF

SEQ ID NO: 19391 - protein, 10 aa, BK virus
KHVCHALSFL

SEQ ID NO: 19392 - protein, 10 aa, BK virus
HVCHALSFLR

SEQ ID NO: 19393 - protein, 10 aa, BK virus
VCHALSFLRS

SEQ ID NO: 19394 - protein, 10 aa, BK virus
CHALSFLRSW

SEQ ID NO: 19395 - protein, 10 aa, BK virus
HALSFLRSWF

SEQ ID NO: 19396 - protein, 10 aa, BK virus
ALSFLRSWFG

SEQ ID NO: 19397 - protein, 10 aa, BK virus
LSFLRSWFGC

SEQ ID NO: 19398 - protein, 10 aa, BK virus
SFLRSWFGCI

SEQ ID NO: 19399 - protein, 10 aa, BK virus
FLRSWFGCIP

SEQ ID NO: 19400 - protein, 10 aa, BK virus
LRSWFGCIPW

SEQ ID NO: 19401 - protein, 10 aa, BK virus
RSWFGCIPWV

SEQ ID NO: 19402 - protein, 10 aa, BK virus
SWFGCIPWVS

SEQ ID NO: 19403 - protein, 10 aa, BK virus
WFGCIPWVSS

SEQ ID NO: 19404 - protein, 10 aa, BK virus
FGCIPWVSSS

SEQ ID NO: 19405 - protein, 10 aa, BK virus
GCIPWVSSSS

SEQ ID NO: 19406 - protein, 10 aa, BK virus
CIPWVSSSSL

SEQ ID NO: 19407 - protein, 10 aa, BK virus
GHGLAAFPCE

SEQ ID NO: 19408 - protein, 10 aa, BK virus
HGLAAFPCES

SEQ ID NO: 19409 - protein, 10 aa, BK virus
GLAAFPCESC

SEQ ID NO: 19410 - protein, 10 aa, BK virus
LAAFPCESCT

SEQ ID NO: 19411 - protein, 10 aa, BK virus
AAFPCESCTF

SEQ ID NO: 19412 - protein, 10 aa, BK virus
AFPCESCTFL

SEQ ID NO: 19413 - protein, 10 aa, BK virus
FPCESCTFLP

SEQ ID NO: 19414 - protein, 10 aa, BK virus
PCESCTFLPE

SEQ ID NO: 19415 - protein, 10 aa, BK virus
CESCTFLPEV

SEQ ID NO: 19416 - protein, 10 aa, BK virus
ESCTFLPEVM

SEQ ID NO: 19417 - protein, 10 aa, BK virus
SCTFLPEVMV

SEQ ID NO: 19418 - protein, 10 aa, BK virus
CTFLPEVMVW

SEQ ID NO: 19419 - protein, 10 aa, BK virus
TFLPEVMVWL

SEQ ID NO: 19420 - protein, 10 aa, BK virus
FLPEVMVWLH

SEQ ID NO: 19421 - protein, 10 aa, BK virus
LPEVMVWLHS

SEQ ID NO: 19422 - protein, 10 aa, BK virus
PEVMVWLHSM

SEQ ID NO: 19423 - protein, 10 aa, BK virus
EVMVWLHSMG

SEQ ID NO: 19424 - protein, 10 aa, BK virus
VMVWLHSMGK

SEQ ID NO: 19425 - protein, 10 aa, BK virus
MVWLHSMGKQ

SEQ ID NO: 19426 - protein, 10 aa, BK virus
VWLHSMGKQL

SEQ ID NO: 19427 - protein, 10 aa, BK virus
WLHSMGKQLL

SEQ ID NO: 19428 - protein, 10 aa, BK virus
LHSMGKQLLP

SEQ ID NO: 19429 - protein, 10 aa, BK virus
HSMGKQLLPV

SEQ ID NO: 19430 - protein, 10 aa, BK virus
SMGKQLLPVA

SEQ ID NO: 19431 - protein, 10 aa, BK virus
MGKQLLPVAF

SEQ ID NO: 19432 - protein, 10 aa, BK virus
GKQLLPVAFF

SEQ ID NO: 19433 - protein, 10 aa, BK virus
KQLLPVAFFF

SEQ ID NO: 19434 - protein, 10 aa, BK virus
QLLPVAFFFI

SEQ ID NO: 19435 - protein, 10 aa, BK virus
LLPVAFFFII

SEQ ID NO: 19436 - protein, 10 aa, BK virus
LPVAFFFIIY

SEQ ID NO: 19437 - protein, 10 aa, BK virus
PVAFFFIIYK

SEQ ID NO: 19438 - protein, 10 aa, BK virus
VAFFFIIYKR

SEQ ID NO: 19439 - protein, 10 aa, BK virus
AFFFIIYKRP

SEQ ID NO: 19440 - protein, 10 aa, BK virus
FFFIIYKRPR

SEQ ID NO: 19441 - protein, 10 aa, BK virus
FFIIYKRPRP

SEQ ID NO: 19442 - protein, 10 aa, BK virus
FIIYKRPRPP

SEQ ID NO: 19443 - protein, 10 aa, BK virus
IIYKRPRPPL

SEQ ID NO: 19444 - protein, 10 aa, BK virus
IYKRPRPPLP

SEQ ID NO: 19445 - protein, 10 aa, BK virus
YKRPRPPLPP

SEQ ID NO: 19446 - protein, 10 aa, BK virus
KRPRPPLPPP

SEQ ID NO: 19447 - protein, 10 aa, BK virus
RPRPPLPPPF

SEQ ID NO: 19448 - protein, 10 aa, BK virus
PRPPLPPPFL

SEQ ID NO: 19449 - protein, 10 aa, BK virus
RPPLPPPFLS

SEQ ID NO: 19450 - protein, 10 aa, BK virus
PPLPPPFLSS

SEQ ID NO: 19451 - protein, 10 aa, BK virus
PLPPPFLSSS

SEQ ID NO: 19452 - protein, 10 aa, BK virus
LPPPFLSSSK

SEQ ID NO: 19453 - protein, 10 aa, BK virus
PPPFLSSSKG

SEQ ID NO: 19454 - protein, 10 aa, BK virus
PPFLSSSKGV

SEQ ID NO: 19455 - protein, 10 aa, BK virus
PFLSSSKGVE

SEQ ID NO: 19456 - protein, 10 aa, BK virus
FLSSSKGVEA

SEQ ID NO: 19457 - protein, 10 aa, BK virus
LSSSKGVEAF

SEQ ID NO: 19458 - protein, 10 aa, BK virus
SSSKGVEAFS

SEQ ID NO: 19459 - protein, 10 aa, BK virus
SSKGVEAFSE

SEQ ID NO: 19460 - protein, 10 aa, BK virus
SKGVEAFSEA

SEQ ID NO: 19461 - protein, 10 aa, BK virus
QNYLGKSLFF

SEQ ID NO: 19462 - protein, 10 aa, BK virus
NYLGKSLFFC

SEQ ID NO: 19463 - protein, 10 aa, BK virus
YLGKSLFFCN

SEQ ID NO: 19464 - protein, 10 aa, BK virus
LGKSLFFCNF

SEQ ID NO: 19465 - protein, 10 aa, BK virus
GKSLFFCNFC

SEQ ID NO: 19466 - protein, 10 aa, BK virus
KSLFFCNFCK

SEQ ID NO: 19467 - protein, 11 aa, BK virus
WIKFLTGKNPW

SEQ ID NO: 19468 - protein, 11 aa, BK virus
IKFLTGKNPWS

SEQ ID NO: 19469 - protein, 11 aa, BK virus
KFLTGKNPWSS

SEQ ID NO: 19470 - protein, 11 aa, BK virus
FLTGKNPWSSW

SEQ ID NO: 19471 - protein, 11 aa, BK virus
LTGKNPWSSWT

SEQ ID NO: 19472 - protein, 11 aa, BK virus
TGKNPWSSWTF

SEQ ID NO: 19473 - protein, 11 aa, BK virus
ALKELPGEIFP

SEQ ID NO: 19474 - protein, 11 aa, BK virus
GSVRNFTLTKG

SEQ ID NO: 19475 - protein, 11 aa, BK virus
SVRNFTLTKGA

SEQ ID NO: 19476 - protein, 11 aa, BK virus
VRNFTLTKGAT

SEQ ID NO: 19477 - protein, 11 aa, BK virus
RNFTLTKGATR

SEQ ID NO: 19478 - protein, 11 aa, BK virus
NFTLTKGATRI

SEQ ID NO: 19479 - protein, 11 aa, BK virus
FTLTKGATRIK

SEQ ID NO: 19480 - protein, 11 aa, BK virus
LISLILEPGVA

SEQ ID NO: 19481 - protein, 11 aa, BK virus
ISLILEPGVAQ

SEQ ID NO: 19482 - protein, 11 aa, BK virus
SLILEPGVAQR

SEQ ID NO: 19483 - protein, 11 aa, BK virus
LILEPGVAQRF

SEQ ID NO: 19484 - protein, 11 aa, BK virus
ILEPGVAQRFV

SEQ ID NO: 19485 - protein, 11 aa, BK virus
LEPGVAQRFVL

SEQ ID NO: 19486 - protein, 11 aa, BK virus
EPGVAQRFVLI

SEQ ID NO: 19487 - protein, 11 aa, BK virus
PGVAQRFVLIF

SEQ ID NO: 19488 - protein, 11 aa, BK virus
GVAQRFVLIFL

SEQ ID NO: 19489 - protein, 11 aa, BK virus
VAQRFVLIFLF

SEQ ID NO: 19490 - protein, 11 aa, BK virus
AQRFVLIFLFA

SEQ ID NO: 19491 - protein, 11 aa, BK virus
QRFVLIFLFAQ

SEQ ID NO: 19492 - protein, 11 aa, BK virus
RFVLIFLFAQI

SEQ ID NO: 19493 - protein, 11 aa, BK virus
FVLIFLFAQIP

SEQ ID NO: 19494 - protein, 11 aa, BK virus
VLIFLFAQIPC

SEQ ID NO: 19495 - protein, 11 aa, BK virus
LIFLFAQIPCT

SEQ ID NO: 19496 - protein, 11 aa, BK virus
IFLFAQIPCTA

SEQ ID NO: 19497 - protein, 11 aa, BK virus
FLFAQIPCTAR

SEQ ID NO: 19498 - protein, 11 aa, BK virus
LFAQIPCTARN

SEQ ID NO: 19499 - protein, 11 aa, BK virus
FAQIPCTARNG

SEQ ID NO: 19500 - protein, 11 aa, BK virus
AQIPCTARNGL

SEQ ID NO: 19501 - protein, 11 aa, BK virus
QIPCTARNGLF

SEQ ID NO: 19502 - protein, 11 aa, BK virus
IPCTARNGLFV

SEQ ID NO: 19503 - protein, 11 aa, BK virus
PCTARNGLFVP

SEQ ID NO: 19504 - protein, 11 aa, BK virus
CTARNGLFVPK

SEQ ID NO: 19505 - protein, 11 aa, BK virus
TARNGLFVPKS

SEQ ID NO: 19506 - protein, 11 aa, BK virus
ARNGLFVPKSL

SEQ ID NO: 19507 - protein, 11 aa, BK virus
RNGLFVPKSLL

SEQ ID NO: 19508 - protein, 11 aa, BK virus
NGLFVPKSLLC

SEQ ID NO: 19509 - protein, 11 aa, BK virus
GLFVPKSLLCT

SEQ ID NO: 19510 - protein, 11 aa, BK virus
LFVPKSLLCTA

SEQ ID NO: 19511 - protein, 11 aa, BK virus
FVPKSLLCTAL

SEQ ID NO: 19512 - protein, 11 aa, BK virus
VPKSLLCTALA

SEQ ID NO: 19513 - protein, 11 aa, BK virus
PKSLLCTALAC

SEQ ID NO: 19514 - protein, 11 aa, BK virus
KSLLCTALACY

SEQ ID NO: 19515 - protein, 11 aa, BK virus
SLLCTALACYV

SEQ ID NO: 19516 - protein, 11 aa, BK virus
LLCTALACYVS

SEQ ID NO: 19517 - protein, 11 aa, BK virus
LCTALACYVSL

SEQ ID NO: 19518 - protein, 11 aa, BK virus
CTALACYVSLD

SEQ ID NO: 19519 - protein, 11 aa, BK virus
IATALTASHSG

SEQ ID NO: 19520 - protein, 11 aa, BK virus
ATALTASHSGL

SEQ ID NO: 19521 - protein, 11 aa, BK virus
TALTASHSGLA

SEQ ID NO: 19522 - protein, 11 aa, BK virus
SFKVTNLYLDK

SEQ ID NO: 19523 - protein, 11 aa, BK virus
VIIFFIGANLW

SEQ ID NO: 19524 - protein, 11 aa, BK virus
IIFFIGANLWN

SEQ ID NO: 19525 - protein, 11 aa, BK virus
IFFIGANLWNR

SEQ ID NO: 19526 - protein, 11 aa, BK virus
FFIGANLWNRR

SEQ ID NO: 19527 - protein, 11 aa, BK virus
FIGANLWNRRV

SEQ ID NO: 19528 - protein, 11 aa, BK virus
IGANLWNRRVG

SEQ ID NO: 19529 - protein, 11 aa, BK virus
GANLWNRRVGV

SEQ ID NO: 19530 - protein, 11 aa, BK virus
ANLWNRRVGVL

SEQ ID NO: 19531 - protein, 11 aa, BK virus
NLWNRRVGVLV

SEQ ID NO: 19532 - protein, 11 aa, BK virus
LWNRRVGVLVE

SEQ ID NO: 19533 - protein, 11 aa, BK virus
WNRRVGVLVEF

SEQ ID NO: 19534 - protein, 11 aa, BK virus
NRRVGVLVEFL

SEQ ID NO: 19535 - protein, 11 aa, BK virus
RSNSRFSTLNT

SEQ ID NO: 19536 - protein, 11 aa, BK virus
SNSRFSTLNTT

SEQ ID NO: 19537 - protein, 11 aa, BK virus
NSRFSTLNTTQ

SEQ ID NO: 19538 - protein, 11 aa, BK virus
SRFSTLNTTQK

SEQ ID NO: 19539 - protein, 11 aa, BK virus
RFSTLNTTQKK

SEQ ID NO: 19540 - protein, 11 aa, BK virus
FSTLNTTQKKK

SEQ ID NO: 19541 - protein, 11 aa, BK virus
STLNTTQKKKK

SEQ ID NO: 19542 - protein, 11 aa, BK virus
TLNTTQKKKKG

SEQ ID NO: 19543 - protein, 11 aa, BK virus
LNTTQKKKKGR

SEQ ID NO: 19544 - protein, 11 aa, BK virus
NTTQKKKKGRR

SEQ ID NO: 19545 - protein, 11 aa, BK virus
TTQKKKKGRRP

SEQ ID NO: 19546 - protein, 11 aa, BK virus
KTYGKIFCNFY

SEQ ID NO: 19547 - protein, 11 aa, BK virus
RSIPYYRRKHS

SEQ ID NO: 19548 - protein, 11 aa, BK virus
SIPYYRRKHSR

SEQ ID NO: 19549 - protein, 11 aa, BK virus
IPYYRRKHSRG

SEQ ID NO: 19550 - protein, 11 aa, BK virus
PYYRRKHSRGL

SEQ ID NO: 19551 - protein, 11 aa, BK virus
YYRRKHSRGLK

SEQ ID NO: 19552 - protein, 11 aa, BK virus
YRRKHSRGLKG

SEQ ID NO: 19553 - protein, 11 aa, BK virus
RRKHSRGLKGA

SEQ ID NO: 19554 - protein, 11 aa, BK virus
RNKAGVLEINY

SEQ ID NO: 19555 - protein, 11 aa, BK virus
GCVFIIRYVFR

SEQ ID NO: 19556 - protein, 11 aa, BK virus
CVFIIRYVFRI

SEQ ID NO: 19557 - protein, 11 aa, BK virus
VFIIRYVFRIS

SEQ ID NO: 19558 - protein, 11 aa, BK virus
FIIRYVFRISI

SEQ ID NO: 19559 - protein, 11 aa, BK virus
IIRYVFRISIQ

SEQ ID NO: 19560 - protein, 11 aa, BK virus
IRYVFRISIQC

SEQ ID NO: 19561 - protein, 11 aa, BK virus
RYVFRISIQCR

SEQ ID NO: 19562 - protein, 11 aa, BK virus
YVFRISIQCRG

SEQ ID NO: 19563 - protein, 11 aa, BK virus
VFRISIQCRGV

SEQ ID NO: 19564 - protein, 11 aa, BK virus
KVSEKRPALSL

SEQ ID NO: 19565 - protein, 11 aa, BK virus
KALCKCYYFCR

SEQ ID NO: 19566 - protein, 11 aa, BK virus
ALCKCYYFCRK

SEQ ID NO: 19567 - protein, 11 aa, BK virus
KSKKYLSASSR

SEQ ID NO: 19568 - protein, 11 aa, BK virus
SKKYLSASSRY

SEQ ID NO: 19569 - protein, 11 aa, BK virus
KKYLSASSRYS

SEQ ID NO: 19570 - protein, 11 aa, BK virus
KYLSASSRYSF

SEQ ID NO: 19571 - protein, 11 aa, BK virus
YLSASSRYSFS

SEQ ID NO: 19572 - protein, 11 aa, BK virus
KKSRYPSYDQG

SEQ ID NO: 19573 - protein, 11 aa, BK virus
KSRYPSYDQGR

SEQ ID NO: 19574 - protein, 11 aa, BK virus
SRYPSYDQGRN

SEQ ID NO: 19575 - protein, 11 aa, BK virus
RYPSYDQGRNA

SEQ ID NO: 19576 - protein, 11 aa, BK virus
YPSYDQGRNAN

SEQ ID NO: 19577 - protein, 11 aa, BK virus
PSYDQGRNANR

SEQ ID NO: 19578 - protein, 11 aa, BK virus
SYDQGRNANRK

SEQ ID NO: 19579 - protein, 11 aa, BK virus
YDQGRNANRKI

SEQ ID NO: 19580 - protein, 11 aa, BK virus
DQGRNANRKIQ

SEQ ID NO: 19581 - protein, 11 aa, BK virus
QGRNANRKIQS

SEQ ID NO: 19582 - protein, 11 aa, BK virus
GRNANRKIQSY

SEQ ID NO: 19583 - protein, 11 aa, BK virus
RNANRKIQSYI

SEQ ID NO: 19584 - protein, 11 aa, BK virus
NANRKIQSYIR

SEQ ID NO: 19585 - protein, 11 aa, BK virus
NGFNIWSSWKC

SEQ ID NO: 19586 - protein, 11 aa, BK virus
GFNIWSSWKCC

SEQ ID NO: 19587 - protein, 11 aa, BK virus
FNIWSSWKCCT

SEQ ID NO: 19588 - protein, 11 aa, BK virus
NIWSSWKCCTR

SEQ ID NO: 19589 - protein, 11 aa, BK virus
IWSSWKCCTRT

SEQ ID NO: 19590 - protein, 11 aa, BK virus
WSSWKCCTRTI

SEQ ID NO: 19591 - protein, 11 aa, BK virus
SSWKCCTRTIY

SEQ ID NO: 19592 - protein, 11 aa, BK virus
SWKCCTRTIYG

SEQ ID NO: 19593 - protein, 11 aa, BK virus
WKCCTRTIYGR

SEQ ID NO: 19594 - protein, 11 aa, BK virus
KCCTRTIYGRC

SEQ ID NO: 19595 - protein, 11 aa, BK virus
CCTRTIYGRCC

SEQ ID NO: 19596 - protein, 11 aa, BK virus
CTRTIYGRCCL

SEQ ID NO: 19597 - protein, 11 aa, BK virus
TRTIYGRCCLA

SEQ ID NO: 19598 - protein, 11 aa, BK virus
RTIYGRCCLAA

SEQ ID NO: 19599 - protein, 11 aa, BK virus
TIYGRCCLAAL

SEQ ID NO: 19600 - protein, 11 aa, BK virus
IYGRCCLAALF

SEQ ID NO: 19601 - protein, 11 aa, BK virus
YGRCCLAALFA

SEQ ID NO: 19602 - protein, 11 aa, BK virus
GRCCLAALFAT

SEQ ID NO: 19603 - protein, 11 aa, BK virus
WKNNTSCRVIR

SEQ ID NO: 19604 - protein, 11 aa, BK virus
KNNTSCRVIRF

SEQ ID NO: 19605 - protein, 11 aa, BK virus
NNTSCRVIRFV

SEQ ID NO: 19606 - protein, 11 aa, BK virus
NTSCRVIRFVW

SEQ ID NO: 19607 - protein, 11 aa, BK virus
TSCRVIRFVWW

SEQ ID NO: 19608 - protein, 11 aa, BK virus
SLKCKPTHGKA

SEQ ID NO: 19609 - protein, 11 aa, BK virus
LKCKPTHGKAN

SEQ ID NO: 19610 - protein, 11 aa, BK virus
KCKPTHGKANL

SEQ ID NO: 19611 - protein, 11 aa, BK virus
ARCSYRSVHGC

SEQ ID NO: 19612 - protein, 11 aa, BK virus
RCSYRSVHGCF

SEQ ID NO: 19613 - protein, 11 aa, BK virus
IKGFAFRTWNK

SEQ ID NO: 19614 - protein, 11 aa, BK virus
KGFAFRTWNKQ

SEQ ID NO: 19615 - protein, 11 aa, BK virus
GFAFRTWNKQF

SEQ ID NO: 19616 - protein, 11 aa, BK virus
FAFRTWNKQFR

SEQ ID NO: 19617 - protein, 11 aa, BK virus
AFRTWNKQFRQ

SEQ ID NO: 19618 - protein, 11 aa, BK virus
FRTWNKQFRQF

SEQ ID NO: 19619 - protein, 11 aa, BK virus
RTWNKQFRQFE

SEQ ID NO: 19620 - protein, 11 aa, BK virus
TWNKQFRQFER

SEQ ID NO: 19621 - protein, 11 aa, BK virus
WNKQFRQFERL

SEQ ID NO: 19622 - protein, 11 aa, BK virus
NKQFRQFERLF

SEQ ID NO: 19623 - protein, 11 aa, BK virus
KQFRQFERLFR

SEQ ID NO: 19624 - protein, 11 aa, BK virus
QFRQFERLFRW

SEQ ID NO: 19625 - protein, 11 aa, BK virus
FRQFERLFRWK

SEQ ID NO: 19626 - protein, 11 aa, BK virus
RQFERLFRWKC

SEQ ID NO: 19627 - protein, 11 aa, BK virus
GKFRKETFKQK

SEQ ID NO: 19628 - protein, 11 aa, BK virus
KFRKETFKQKN

SEQ ID NO: 19629 - protein, 11 aa, BK virus
FRKETFKQKNP

SEQ ID NO: 19630 - protein, 11 aa, BK virus
RKETFKQKNPN

SEQ ID NO: 19631 - protein, 11 aa, BK virus
KETFKQKNPNI

SEQ ID NO: 19632 - protein, 11 aa, BK virus
ETFKQKNPNIS

SEQ ID NO: 19633 - protein, 11 aa, BK virus
TFKQKNPNIST

SEQ ID NO: 19634 - protein, 11 aa, BK virus
FKQKNPNISTR

SEQ ID NO: 19635 - protein, 11 aa, BK virus
KQKNPNISTRL

SEQ ID NO: 19636 - protein, 11 aa, BK virus
QKNPNISTRLG

SEQ ID NO: 19637 - protein, 11 aa, BK virus
KNPNISTRLGY

SEQ ID NO: 19638 - protein, 11 aa, BK virus
NPNISTRLGYN

SEQ ID NO: 19639 - protein, 11 aa, BK virus
PNISTRLGYNE

SEQ ID NO: 19640 - protein, 11 aa, BK virus
AQNIFKKILTK

SEQ ID NO: 19641 - protein, 11 aa, BK virus
QNIFKKILTKL

SEQ ID NO: 19642 - protein, 11 aa, BK virus
NIFKKILTKLR

SEQ ID NO: 19643 - protein, 11 aa, BK virus
IFKKILTKLRV

SEQ ID NO: 19644 - protein, 11 aa, BK virus
FKKILTKLRVL

SEQ ID NO: 19645 - protein, 11 aa, BK virus
KKILTKLRVLT

SEQ ID NO: 19646 - protein, 11 aa, BK virus
KKNFTKWNDLV

SEQ ID NO: 19647 - protein, 11 aa, BK virus
KNFTKWNDLVA

SEQ ID NO: 19648 - protein, 11 aa, BK virus
NFTKWNDLVAT

SEQ ID NO: 19649 - protein, 11 aa, BK virus
FTKWNDLVATA

SEQ ID NO: 19650 - protein, 11 aa, BK virus
TKWNDLVATAN

SEQ ID NO: 19651 - protein, 11 aa, BK virus
KWNDLVATANL

SEQ ID NO: 19652 - protein, 11 aa, BK virus
WNDLVATANLV

SEQ ID NO: 19653 - protein, 11 aa, BK virus
DKYVYFFKDEI

SEQ ID NO: 19654 - protein, 11 aa, BK virus
IPITMLFPSLR

SEQ ID NO: 19655 - protein, 11 aa, BK virus
PITMLFPSLRY

SEQ ID NO: 19656 - protein, 11 aa, BK virus
ITMLFPSLRYF

SEQ ID NO: 19657 - protein, 11 aa, BK virus
TMLFPSLRYFS

SEQ ID NO: 19658 - protein, 11 aa, BK virus
MLFPSLRYFSP

SEQ ID NO: 19659 - protein, 11 aa, BK virus
LFPSLRYFSPC

SEQ ID NO: 19660 - protein, 11 aa, BK virus
KWLIQKQHLLN

SEQ ID NO: 19661 - protein, 11 aa, BK virus
WLIQKQHLLNV

SEQ ID NO: 19662 - protein, 11 aa, BK virus
LIQKQHLLNVY

SEQ ID NO: 19663 - protein, 11 aa, BK virus
IQKQHLLNVYV

SEQ ID NO: 19664 - protein, 11 aa, BK virus
QKQHLLNVYVQ

SEQ ID NO: 19665 - protein, 11 aa, BK virus
KHLFKAFWFAI

SEQ ID NO: 19666 - protein, 11 aa, BK virus
HLFKAFWFAIV

SEQ ID NO: 19667 - protein, 11 aa, BK virus
LFKAFWFAIVP

SEQ ID NO: 19668 - protein, 11 aa, BK virus
FKAFWFAIVPV

SEQ ID NO: 19669 - protein, 11 aa, BK virus
KAFWFAIVPVC

SEQ ID NO: 19670 - protein, 11 aa, BK virus
AFWFAIVPVCQ

SEQ ID NO: 19671 - protein, 11 aa, BK virus
FWFAIVPVCQY

SEQ ID NO: 19672 - protein, 11 aa, BK virus
WFAIVPVCQYI

SEQ ID NO: 19673 - protein, 11 aa, BK virus
FAIVPVCQYIL

SEQ ID NO: 19674 - protein, 11 aa, BK virus
AIVPVCQYILS

SEQ ID NO: 19675 - protein, 11 aa, BK virus
IVPVCQYILSY

SEQ ID NO: 19676 - protein, 11 aa, BK virus
VPVCQYILSYL

SEQ ID NO: 19677 - protein, 11 aa, BK virus
PVCQYILSYLG

SEQ ID NO: 19678 - protein, 11 aa, BK virus
VCQYILSYLGP

SEQ ID NO: 19679 - protein, 11 aa, BK virus
CQYILSYLGPL

SEQ ID NO: 19680 - protein, 11 aa, BK virus
QYILSYLGPLE

SEQ ID NO: 19681 - protein, 11 aa, BK virus
YILSYLGPLEV

SEQ ID NO: 19682 - protein, 11 aa, BK virus
ILSYLGPLEVF

SEQ ID NO: 19683 - protein, 11 aa, BK virus
LSYLGPLEVFL

SEQ ID NO: 19684 - protein, 11 aa, BK virus
SYLGPLEVFLC

SEQ ID NO: 19685 - protein, 11 aa, BK virus
YLGPLEVFLCH

SEQ ID NO: 19686 - protein, 11 aa, BK virus
LGPLEVFLCHQ

SEQ ID NO: 19687 - protein, 11 aa, BK virus
GPLEVFLCHQT

SEQ ID NO: 19688 - protein, 11 aa, BK virus
PLEVFLCHQTP

SEQ ID NO: 19689 - protein, 11 aa, BK virus
AAHPLSGFSCL

SEQ ID NO: 19690 - protein, 11 aa, BK virus
GHLAKRKLGKD

SEQ ID NO: 19691 - protein, 11 aa, BK virus
HLAKRKLGKDS

SEQ ID NO: 19692 - protein, 11 aa, BK virus
LAKRKLGKDSL

SEQ ID NO: 19693 - protein, 11 aa, BK virus
AKRKLGKDSLQ

SEQ ID NO: 19694 - protein, 11 aa, BK virus
KRKLGKDSLQI

SEQ ID NO: 19695 - protein, 11 aa, BK virus
RKLGKDSLQIF

SEQ ID NO: 19696 - protein, 11 aa, BK virus
KLGKDSLQIFF

SEQ ID NO: 19697 - protein, 11 aa, BK virus
LGKDSLQIFFS

SEQ ID NO: 19698 - protein, 11 aa, BK virus
GKDSLQIFFSG

SEQ ID NO: 19699 - protein, 11 aa, BK virus
KDSLQIFFSGG

SEQ ID NO: 19700 - protein, 11 aa, BK virus
DSLQIFFSGGS

SEQ ID NO: 19701 - protein, 11 aa, BK virus
NILQGLSTVVF

SEQ ID NO: 19702 - protein, 11 aa, BK virus
ILQGLSTVVFQ

SEQ ID NO: 19703 - protein, 11 aa, BK virus
LQGLSTVVFQS

SEQ ID NO: 19704 - protein, 11 aa, BK virus
QGLSTVVFQSC

SEQ ID NO: 19705 - protein, 11 aa, BK virus
TGHKYQQLKHT

SEQ ID NO: 19706 - protein, 11 aa, BK virus
GHKYQQLKHTG

SEQ ID NO: 19707 - protein, 11 aa, BK virus
HKYQQLKHTGY

SEQ ID NO: 19708 - protein, 11 aa, BK virus
KYQQLKHTGYQ

SEQ ID NO: 19709 - protein, 11 aa, BK virus
YQQLKHTGYQL

SEQ ID NO: 19710 - protein, 11 aa, BK virus
QQLKHTGYQLY

SEQ ID NO: 19711 - protein, 11 aa, BK virus
QLKHTGYQLYK

SEQ ID NO: 19712 - protein, 11 aa, BK virus
LKHTGYQLYKE

SEQ ID NO: 19713 - protein, 11 aa, BK virus
KHTGYQLYKEA

SEQ ID NO: 19714 - protein, 11 aa, BK virus
HTGYQLYKEAP

SEQ ID NO: 19715 - protein, 11 aa, BK virus
TGYQLYKEAPH

SEQ ID NO: 19716 - protein, 11 aa, BK virus
GYQLYKEAPHP

SEQ ID NO: 19717 - protein, 11 aa, BK virus
YQLYKEAPHPV

SEQ ID NO: 19718 - protein, 11 aa, BK virus
QLYKEAPHPVH

SEQ ID NO: 19719 - protein, 11 aa, BK virus
LYKEAPHPVHL

SEQ ID NO: 19720 - protein, 11 aa, BK virus
YKEAPHPVHLA

SEQ ID NO: 19721 - protein, 11 aa, BK virus
KEAPHPVHLAT

SEQ ID NO: 19722 - protein, 11 aa, BK virus
EAPHPVHLATL

SEQ ID NO: 19723 - protein, 11 aa, BK virus
APHPVHLATLW

SEQ ID NO: 19724 - protein, 11 aa, BK virus
LCWSHEVLGEH

SEQ ID NO: 19725 - protein, 11 aa, BK virus
CWSHEVLGEHF

SEQ ID NO: 19726 - protein, 11 aa, BK virus
WSHEVLGEHFP

SEQ ID NO: 19727 - protein, 11 aa, BK virus
SHEVLGEHFPL

SEQ ID NO: 19728 - protein, 11 aa, BK virus
HEVLGEHFPLL

SEQ ID NO: 19729 - protein, 11 aa, BK virus
HFHFYWDQVPS

SEQ ID NO: 19730 - protein, 11 aa, BK virus
FHFYWDQVPST

SEQ ID NO: 19731 - protein, 11 aa, BK virus
HFYWDQVPSTQ

SEQ ID NO: 19732 - protein, 11 aa, BK virus
FYWDQVPSTQL

SEQ ID NO: 19733 - protein, 11 aa, BK virus
YWDQVPSTQLD

SEQ ID NO: 19734 - protein, 11 aa, BK virus
WDQVPSTQLDK

SEQ ID NO: 19735 - protein, 11 aa, BK virus
DQVPSTQLDKH

SEQ ID NO: 19736 - protein, 11 aa, BK virus
QVPSTQLDKHC

SEQ ID NO: 19737 - protein, 11 aa, BK virus
VPSTQLDKHCF

SEQ ID NO: 19738 - protein, 11 aa, BK virus
PSTQLDKHCFC

SEQ ID NO: 19739 - protein, 11 aa, BK virus
STQLDKHCFCP

SEQ ID NO: 19740 - protein, 11 aa, BK virus
TQLDKHCFCPN

SEQ ID NO: 19741 - protein, 11 aa, BK virus
QLDKHCFCPNR

SEQ ID NO: 19742 - protein, 11 aa, BK virus
LDKHCFCPNRP

SEQ ID NO: 19743 - protein, 11 aa, BK virus
DKHCFCPNRPY

SEQ ID NO: 19744 - protein, 11 aa, BK virus
KHCFCPNRPYG

SEQ ID NO: 19745 - protein, 11 aa, BK virus
HCFCPNRPYGQ

SEQ ID NO: 19746 - protein, 11 aa, BK virus
CFCPNRPYGQY

SEQ ID NO: 19747 - protein, 11 aa, BK virus
FCPNRPYGQYS

SEQ ID NO: 19748 - protein, 11 aa, BK virus
CPNRPYGQYSL

SEQ ID NO: 19749 - protein, 11 aa, BK virus
PNRPYGQYSLP

SEQ ID NO: 19750 - protein, 11 aa, BK virus
NRPYGQYSLPG

SEQ ID NO: 19751 - protein, 11 aa, BK virus
RPYGQYSLPGT

SEQ ID NO: 19752 - protein, 11 aa, BK virus
PYGQYSLPGTG

SEQ ID NO: 19753 - protein, 11 aa, BK virus
YGQYSLPGTGL

SEQ ID NO: 19754 - protein, 11 aa, BK virus
GQYSLPGTGLL

SEQ ID NO: 19755 - protein, 11 aa, BK virus
QYSLPGTGLLG

SEQ ID NO: 19756 - protein, 11 aa, BK virus
YSLPGTGLLGF

SEQ ID NO: 19757 - protein, 11 aa, BK virus
YHQGTLTCNSL

SEQ ID NO: 19758 - protein, 11 aa, BK virus
HQGTLTCNSLA

SEQ ID NO: 19759 - protein, 11 aa, BK virus
QGTLTCNSLAL

SEQ ID NO: 19760 - protein, 11 aa, BK virus
GTLTCNSLALP

SEQ ID NO: 19761 - protein, 11 aa, BK virus
TLTCNSLALPA

SEQ ID NO: 19762 - protein, 11 aa, BK virus
LTCNSLALPAF

SEQ ID NO: 19763 - protein, 11 aa, BK virus
TCNSLALPAFP

SEQ ID NO: 19764 - protein, 11 aa, BK virus
CNSLALPAFPR

SEQ ID NO: 19765 - protein, 11 aa, BK virus
NSLALPAFPRV

SEQ ID NO: 19766 - protein, 11 aa, BK virus
SLALPAFPRVL

SEQ ID NO: 19767 - protein, 11 aa, BK virus
LALPAFPRVLH

SEQ ID NO: 19768 - protein, 11 aa, BK virus
ALPAFPRVLHL

SEQ ID NO: 19769 - protein, 11 aa, BK virus
LPAFPRVLHLQ

SEQ ID NO: 19770 - protein, 11 aa, BK virus
PAFPRVLHLQQ

SEQ ID NO: 19771 - protein, 11 aa, BK virus
AFPRVLHLQQR

SEQ ID NO: 19772 - protein, 11 aa, BK virus
FPRVLHLQQRS

SEQ ID NO: 19773 - protein, 11 aa, BK virus
PRVLHLQQRSG

SEQ ID NO: 19774 - protein, 11 aa, BK virus
RVLHLQQRSGN

SEQ ID NO: 19775 - protein, 11 aa, BK virus
VLHLQQRSGNY

SEQ ID NO: 19776 - protein, 11 aa, BK virus
LHLQQRSGNYC

SEQ ID NO: 19777 - protein, 11 aa, BK virus
HLQQRSGNYCL

SEQ ID NO: 19778 - protein, 11 aa, BK virus
LQQRSGNYCLE

SEQ ID NO: 19779 - protein, 11 aa, BK virus
VFLHHAHALFV

SEQ ID NO: 19780 - protein, 11 aa, BK virus
FLHHAHALFVT

SEQ ID NO: 19781 - protein, 11 aa, BK virus
LHHAHALFVTL

SEQ ID NO: 19782 - protein, 11 aa, BK virus
HHAHALFVTLH

SEQ ID NO: 19783 - protein, 11 aa, BK virus
HAHALFVTLHE

SEQ ID NO: 19784 - protein, 11 aa, BK virus
AHALFVTLHEG

SEQ ID NO: 19785 - protein, 11 aa, BK virus
PLFVQLQPPTS

SEQ ID NO: 19786 - protein, 11 aa, BK virus
LFVQLQPPTSV

SEQ ID NO: 19787 - protein, 11 aa, BK virus
FVQLQPPTSVD

SEQ ID NO: 19788 - protein, 11 aa, BK virus
VQLQPPTSVDF

SEQ ID NO: 19789 - protein, 11 aa, BK virus
QLQPPTSVDFH

SEQ ID NO: 19790 - protein, 11 aa, BK virus
LQPPTSVDFHR

SEQ ID NO: 19791 - protein, 11 aa, BK virus
QPPTSVDFHRL

SEQ ID NO: 19792 - protein, 11 aa, BK virus
PPTSVDFHRLG

SEQ ID NO: 19793 - protein, 11 aa, BK virus
PTSVDFHRLGP

SEQ ID NO: 19794 - protein, 11 aa, BK virus
TSVDFHRLGPH

SEQ ID NO: 19795 - protein, 11 aa, BK virus
SVDFHRLGPHL

SEQ ID NO: 19796 - protein, 11 aa, BK virus
VDFHRLGPHLN

SEQ ID NO: 19797 - protein, 11 aa, BK virus
DFHRLGPHLNW

SEQ ID NO: 19798 - protein, 11 aa, BK virus
FHRLGPHLNWG

SEQ ID NO: 19799 - protein, 11 aa, BK virus
HRLGPHLNWGG

SEQ ID NO: 19800 - protein, 11 aa, BK virus
RLGPHLNWGGE

SEQ ID NO: 19801 - protein, 11 aa, BK virus
LGPHLNWGGEF

SEQ ID NO: 19802 - protein, 11 aa, BK virus
GPHLNWGGEFL

SEQ ID NO: 19803 - protein, 11 aa, BK virus
PHLNWGGEFLL

SEQ ID NO: 19804 - protein, 11 aa, BK virus
HLNWGGEFLLC

SEQ ID NO: 19805 - protein, 11 aa, BK virus
LNWGGEFLLCC

SEQ ID NO: 19806 - protein, 11 aa, BK virus
NWGGEFLLCCN

SEQ ID NO: 19807 - protein, 11 aa, BK virus
WGGEFLLCCNR

SEQ ID NO: 19808 - protein, 11 aa, BK virus
GGEFLLCCNRE

SEQ ID NO: 19809 - protein, 11 aa, BK virus
GEFLLCCNREA

SEQ ID NO: 19810 - protein, 11 aa, BK virus
EFLLCCNREAF

SEQ ID NO: 19811 - protein, 11 aa, BK virus
FLLCCNREAFF

SEQ ID NO: 19812 - protein, 11 aa, BK virus
LLCCNREAFFS

SEQ ID NO: 19813 - protein, 11 aa, BK virus
LCCNREAFFSL

SEQ ID NO: 19814 - protein, 11 aa, BK virus
CCNREAFFSLG

SEQ ID NO: 19815 - protein, 11 aa, BK virus
CNREAFFSLGY

SEQ ID NO: 19816 - protein, 11 aa, BK virus
NREAFFSLGYH

SEQ ID NO: 19817 - protein, 11 aa, BK virus
REAFFSLGYHC

SEQ ID NO: 19818 - protein, 11 aa, BK virus
GFHLDPPFLGL

SEQ ID NO: 19819 - protein, 11 aa, BK virus
FHLDPPFLGLG

SEQ ID NO: 19820 - protein, 11 aa, BK virus
HLDPPFLGLGS

SEQ ID NO: 19821 - protein, 11 aa, BK virus
LDPPFLGLGSI

SEQ ID NO: 19822 - protein, 11 aa, BK virus
DPPFLGLGSIL

SEQ ID NO: 19823 - protein, 11 aa, BK virus
PPFLGLGSILP

SEQ ID NO: 19824 - protein, 11 aa, BK virus
PFLGLGSILPL

SEQ ID NO: 19825 - protein, 11 aa, BK virus
LLELLLLLLLV

SEQ ID NO: 19826 - protein, 11 aa, BK virus
LELLLLLLLVV

SEQ ID NO: 19827 - protein, 11 aa, BK virus
ELLLLLLLVVL

SEQ ID NO: 19828 - protein, 11 aa, BK virus
LLLLLLLVVLA

SEQ ID NO: 19829 - protein, 11 aa, BK virus
LLLLLLVVLAL

SEQ ID NO: 19830 - protein, 11 aa, BK virus
LLLLLVVLALA

SEQ ID NO: 19831 - protein, 11 aa, BK virus
LLLLVVLALAR

SEQ ID NO: 19832 - protein, 11 aa, BK virus
LLLVVLALARV

SEQ ID NO: 19833 - protein, 11 aa, BK virus
LLVVLALARVP

SEQ ID NO: 19834 - protein, 11 aa, BK virus
LVVLALARVPL

SEQ ID NO: 19835 - protein, 11 aa, BK virus
VVLALARVPLA

SEQ ID NO: 19836 - protein, 11 aa, BK virus
VLALARVPLAF

SEQ ID NO: 19837 - protein, 11 aa, BK virus
LALARVPLAFW

SEQ ID NO: 19838 - protein, 11 aa, BK virus
ALARVPLAFWE

SEQ ID NO: 19839 - protein, 11 aa, BK virus
LARVPLAFWEL

SEQ ID NO: 19840 - protein, 11 aa, BK virus
ARVPLAFWELP

SEQ ID NO: 19841 - protein, 11 aa, BK virus
RVPLAFWELPL

SEQ ID NO: 19842 - protein, 11 aa, BK virus
VPLAFWELPLD

SEQ ID NO: 19843 - protein, 11 aa, BK virus
PLAFWELPLDT

SEQ ID NO: 19844 - protein, 11 aa, BK virus
LAFWELPLDTL

SEQ ID NO: 19845 - protein, 11 aa, BK virus
AFWELPLDTLL

SEQ ID NO: 19846 - protein, 11 aa, BK virus
FWELPLDTLLF

SEQ ID NO: 19847 - protein, 11 aa, BK virus
WELPLDTLLFF

SEQ ID NO: 19848 - protein, 11 aa, BK virus
ELPLDTLLFFW

SEQ ID NO: 19849 - protein, 11 aa, BK virus
LPLDTLLFFWL

SEQ ID NO: 19850 - protein, 11 aa, BK virus
PLDTLLFFWLG

SEQ ID NO: 19851 - protein, 11 aa, BK virus
LDTLLFFWLGP

SEQ ID NO: 19852 - protein, 11 aa, BK virus
DTLLFFWLGPS

SEQ ID NO: 19853 - protein, 11 aa, BK virus
TLLFFWLGPSS

SEQ ID NO: 19854 - protein, 11 aa, BK virus
LLFFWLGPSSY

SEQ ID NO: 19855 - protein, 11 aa, BK virus
LFFWLGPSSYA

SEQ ID NO: 19856 - protein, 11 aa, BK virus
FFWLGPSSYAS

SEQ ID NO: 19857 - protein, 11 aa, BK virus
FWLGPSSYASR

SEQ ID NO: 19858 - protein, 11 aa, BK virus
WLGPSSYASRA

SEQ ID NO: 19859 - protein, 11 aa, BK virus
LGPSSYASRAG

SEQ ID NO: 19860 - protein, 11 aa, BK virus
GPSSYASRAGV

SEQ ID NO: 19861 - protein, 11 aa, BK virus
PSSYASRAGVT

SEQ ID NO: 19862 - protein, 11 aa, BK virus
SSYASRAGVTV

SEQ ID NO: 19863 - protein, 11 aa, BK virus
SYASRAGVTVP

SEQ ID NO: 19864 - protein, 11 aa, BK virus
YASRAGVTVPY

SEQ ID NO: 19865 - protein, 11 aa, BK virus
ASRAGVTVPYR

SEQ ID NO: 19866 - protein, 11 aa, BK virus
SRAGVTVPYRP

SEQ ID NO: 19867 - protein, 11 aa, BK virus
RAGVTVPYRPR

SEQ ID NO: 19868 - protein, 11 aa, BK virus
AGVTVPYRPRS

SEQ ID NO: 19869 - protein, 11 aa, BK virus
GVTVPYRPRSK

SEQ ID NO: 19870 - protein, 11 aa, BK virus
VTVPYRPRSKG

SEQ ID NO: 19871 - protein, 11 aa, BK virus
TVPYRPRSKGN

SEQ ID NO: 19872 - protein, 11 aa, BK virus
VPYRPRSKGNI

SEQ ID NO: 19873 - protein, 11 aa, BK virus
PYRPRSKGNIH

SEQ ID NO: 19874 - protein, 11 aa, BK virus
LAPPGAIVFSI

SEQ ID NO: 19875 - protein, 11 aa, BK virus
APPGAIVFSIN

SEQ ID NO: 19876 - protein, 11 aa, BK virus
PPGAIVFSINS

SEQ ID NO: 19877 - protein, 11 aa, BK virus
PGAIVFSINSP

SEQ ID NO: 19878 - protein, 11 aa, BK virus
GAIVFSINSPE

SEQ ID NO: 19879 - protein, 11 aa, BK virus
AIVFSINSPEC

SEQ ID NO: 19880 - protein, 11 aa, BK virus
IVFSINSPECT

SEQ ID NO: 19881 - protein, 11 aa, BK virus
VFSINSPECTL

SEQ ID NO: 19882 - protein, 11 aa, BK virus
FSINSPECTLC

SEQ ID NO: 19883 - protein, 11 aa, BK virus
FLKSILCVTSS

SEQ ID NO: 19884 - protein, 11 aa, BK virus
LKSILCVTSSI

SEQ ID NO: 19885 - protein, 11 aa, BK virus
KSILCVTSSIL

SEQ ID NO: 19886 - protein, 11 aa, BK virus
SILCVTSSILS

SEQ ID NO: 19887 - protein, 11 aa, BK virus
ILCVTSSILSA

SEQ ID NO: 19888 - protein, 11 aa, BK virus
LCVTSSILSAS

SEQ ID NO: 19889 - protein, 11 aa, BK virus
CVTSSILSASS

SEQ ID NO: 19890 - protein, 11 aa, BK virus
VTSSILSASSI

SEQ ID NO: 19891 - protein, 11 aa, BK virus
TSSILSASSIL

SEQ ID NO: 19892 - protein, 11 aa, BK virus
VWPKCTRVPSL

SEQ ID NO: 19893 - protein, 11 aa, BK virus
WPKCTRVPSLS

SEQ ID NO: 19894 - protein, 11 aa, BK virus
PKCTRVPSLSA

SEQ ID NO: 19895 - protein, 11 aa, BK virus
KCTRVPSLSAT

SEQ ID NO: 19896 - protein, 11 aa, BK virus
CTRVPSLSATC

SEQ ID NO: 19897 - protein, 11 aa, BK virus
TRVPSLSATCL

SEQ ID NO: 19898 - protein, 11 aa, BK virus
RVPSLSATCLT

SEQ ID NO: 19899 - protein, 11 aa, BK virus
VPSLSATCLTI

SEQ ID NO: 19900 - protein, 11 aa, BK virus
PSLSATCLTIE

SEQ ID NO: 19901 - protein, 11 aa, BK virus
SLSATCLTIEG

SEQ ID NO: 19902 - protein, 11 aa, BK virus
LSATCLTIEGL

SEQ ID NO: 19903 - protein, 11 aa, BK virus
SATCLTIEGLI

SEQ ID NO: 19904 - protein, 11 aa, BK virus
ATCLTIEGLIG

SEQ ID NO: 19905 - protein, 11 aa, BK virus
TCLTIEGLIGE

SEQ ID NO: 19906 - protein, 11 aa, BK virus
CLTIEGLIGER

SEQ ID NO: 19907 - protein, 11 aa, BK virus
LTIEGLIGERS

SEQ ID NO: 19908 - protein, 11 aa, BK virus
TIEGLIGERSE

SEQ ID NO: 19909 - protein, 11 aa, BK virus
KFIGAFTIVQV

SEQ ID NO: 19910 - protein, 11 aa, BK virus
FIGAFTIVQVV

SEQ ID NO: 19911 - protein, 11 aa, BK virus
IGAFTIVQVVS

SEQ ID NO: 19912 - protein, 11 aa, BK virus
GAFTIVQVVSS

SEQ ID NO: 19913 - protein, 11 aa, BK virus
AFTIVQVVSSK

SEQ ID NO: 19914 - protein, 11 aa, BK virus
FTIVQVVSSKN

SEQ ID NO: 19915 - protein, 11 aa, BK virus
TIVQVVSSKNL

SEQ ID NO: 19916 - protein, 11 aa, BK virus
IVQVVSSKNLA

SEQ ID NO: 19917 - protein, 11 aa, BK virus
VQVVSSKNLAK

SEQ ID NO: 19918 - protein, 11 aa, BK virus
QVVSSKNLAKE

SEQ ID NO: 19919 - protein, 11 aa, BK virus
VVSSKNLAKES

SEQ ID NO: 19920 - protein, 11 aa, BK virus
VSSKNLAKESL

SEQ ID NO: 19921 - protein, 11 aa, BK virus
SSKNLAKESLK

SEQ ID NO: 19922 - protein, 11 aa, BK virus
SKNLAKESLKN

SEQ ID NO: 19923 - protein, 11 aa, BK virus
KNLAKESLKNL

SEQ ID NO: 19924 - protein, 11 aa, BK virus
NLAKESLKNLS

SEQ ID NO: 19925 - protein, 11 aa, BK virus
LAKESLKNLSV

SEQ ID NO: 19926 - protein, 11 aa, BK virus
AKESLKNLSVL

SEQ ID NO: 19927 - protein, 11 aa, BK virus
KESLKNLSVLL

SEQ ID NO: 19928 - protein, 11 aa, BK virus
ESLKNLSVLLC

SEQ ID NO: 19929 - protein, 11 aa, BK virus
SLKNLSVLLCN

SEQ ID NO: 19930 - protein, 11 aa, BK virus
LKNLSVLLCNS

SEQ ID NO: 19931 - protein, 11 aa, BK virus
KNLSVLLCNSC

SEQ ID NO: 19932 - protein, 11 aa, BK virus
NLSVLLCNSCE

SEQ ID NO: 19933 - protein, 11 aa, BK virus
LSVLLCNSCEV

SEQ ID NO: 19934 - protein, 11 aa, BK virus
SVLLCNSCEVI

SEQ ID NO: 19935 - protein, 11 aa, BK virus
VLLCNSCEVIE

SEQ ID NO: 19936 - protein, 11 aa, BK virus
LLCNSCEVIEG

SEQ ID NO: 19937 - protein, 11 aa, BK virus
LCNSCEVIEGI

SEQ ID NO: 19938 - protein, 11 aa, BK virus
CNSCEVIEGIS

SEQ ID NO: 19939 - protein, 11 aa, BK virus
NSCEVIEGISS

SEQ ID NO: 19940 - protein, 11 aa, BK virus
SCEVIEGISSL

SEQ ID NO: 19941 - protein, 11 aa, BK virus
CEVIEGISSLI

SEQ ID NO: 19942 - protein, 11 aa, BK virus
EVIEGISSLIT

SEQ ID NO: 19943 - protein, 11 aa, BK virus
VIEGISSLITC

SEQ ID NO: 19944 - protein, 11 aa, BK virus
IEGISSLITCH

SEQ ID NO: 19945 - protein, 11 aa, BK virus
EGISSLITCHK

SEQ ID NO: 19946 - protein, 11 aa, BK virus
GISSLITCHKA

SEQ ID NO: 19947 - protein, 11 aa, BK virus
ISSLITCHKAW

SEQ ID NO: 19948 - protein, 11 aa, BK virus
SSLITCHKAWE

SEQ ID NO: 19949 - protein, 11 aa, BK virus
SLITCHKAWEI

SEQ ID NO: 19950 - protein, 11 aa, BK virus
LITCHKAWEIV

SEQ ID NO: 19951 - protein, 11 aa, BK virus
ITCHKAWEIVA

SEQ ID NO: 19952 - protein, 11 aa, BK virus
TCHKAWEIVAN

SEQ ID NO: 19953 - protein, 11 aa, BK virus
CHKAWEIVANK

SEQ ID NO: 19954 - protein, 11 aa, BK virus
HKAWEIVANKE

SEQ ID NO: 19955 - protein, 11 aa, BK virus
KAWEIVANKEG

SEQ ID NO: 19956 - protein, 11 aa, BK virus
AWEIVANKEGP

SEQ ID NO: 19957 - protein, 11 aa, BK virus
WEIVANKEGPQ

SEQ ID NO: 19958 - protein, 11 aa, BK virus
EIVANKEGPQC

SEQ ID NO: 19959 - protein, 11 aa, BK virus
IVANKEGPQCL

SEQ ID NO: 19960 - protein, 11 aa, BK virus
VANKEGPQCLG

SEQ ID NO: 19961 - protein, 11 aa, BK virus
ANKEGPQCLGS

SEQ ID NO: 19962 - protein, 11 aa, BK virus
NKEGPQCLGSR

SEQ ID NO: 19963 - protein, 11 aa, BK virus
KEGPQCLGSRY

SEQ ID NO: 19964 - protein, 11 aa, BK virus
ILLTKVFTPGN

SEQ ID NO: 19965 - protein, 11 aa, BK virus
LLTKVFTPGNR

SEQ ID NO: 19966 - protein, 11 aa, BK virus
LTKVFTPGNRI

SEQ ID NO: 19967 - protein, 11 aa, BK virus
TKVFTPGNRIS

SEQ ID NO: 19968 - protein, 11 aa, BK virus
YSSGLNNSKAM

SEQ ID NO: 19969 - protein, 11 aa, BK virus
SSGLNNSKAMP

SEQ ID NO: 19970 - protein, 11 aa, BK virus
SGLNNSKAMPD

SEQ ID NO: 19971 - protein, 11 aa, BK virus
GLNNSKAMPDC

SEQ ID NO: 19972 - protein, 11 aa, BK virus
IKAANPAIAPG

SEQ ID NO: 19973 - protein, 11 aa, BK virus
KAANPAIAPGA

SEQ ID NO: 19974 - protein, 11 aa, BK virus
AANPAIAPGAP

SEQ ID NO: 19975 - protein, 11 aa, BK virus
ANPAIAPGAPA

SEQ ID NO: 19976 - protein, 11 aa, BK virus
NPAIAPGAPAI

SEQ ID NO: 19977 - protein, 11 aa, BK virus
PAIAPGAPAIT

SEQ ID NO: 19978 - protein, 11 aa, BK virus
AIAPGAPAITA

SEQ ID NO: 19979 - protein, 11 aa, BK virus
IAPGAPAITAY

SEQ ID NO: 19980 - protein, 11 aa, BK virus
APGAPAITAYV

SEQ ID NO: 19981 - protein, 11 aa, BK virus
GVRPIAAIASE

SEQ ID NO: 19982 - protein, 11 aa, BK virus
VRPIAAIASEV

SEQ ID NO: 19983 - protein, 11 aa, BK virus
RPIAAIASEVL

SEQ ID NO: 19984 - protein, 11 aa, BK virus
PIAAIASEVLV

SEQ ID NO: 19985 - protein, 11 aa, BK virus
IAAIASEVLVM

SEQ ID NO: 19986 - protein, 11 aa, BK virus
AAIASEVLVMP

SEQ ID NO: 19987 - protein, 11 aa, BK virus
AIASEVLVMPS

SEQ ID NO: 19988 - protein, 11 aa, BK virus
IASEVLVMPST

SEQ ID NO: 19989 - protein, 11 aa, BK virus
ASEVLVMPSTV

SEQ ID NO: 19990 - protein, 11 aa, BK virus
SEVLVMPSTVA

SEQ ID NO: 19991 - protein, 11 aa, BK virus
EVLVMPSTVAR

SEQ ID NO: 19992 - protein, 11 aa, BK virus
VLVMPSTVARD

SEQ ID NO: 19993 - protein, 11 aa, BK virus
LVMPSTVARDA

SEQ ID NO: 19994 - protein, 11 aa, BK virus
VMPSTVARDAI

SEQ ID NO: 19995 - protein, 11 aa, BK virus
TSIAAAASPAA

SEQ ID NO: 19996 - protein, 11 aa, BK virus
SIAAAASPAAI

SEQ ID NO: 19997 - protein, 11 aa, BK virus
IAAAASPAAIS

SEQ ID NO: 19998 - protein, 11 aa, BK virus
AAAASPAAISA

SEQ ID NO: 19999 - protein, 11 aa, BK virus
AAASPAAISAT

SEQ ID NO: 20000 - protein, 11 aa, BK virus
AASPAAISATE

SEQ ID NO: 20001 - protein, 11 aa, BK virus
ASPAAISATEN

SEQ ID NO: 20002 - protein, 11 aa, BK virus
SPAAISATENP

SEQ ID NO: 20003 - protein, 11 aa, BK virus
PAAISATENPV

SEQ ID NO: 20004 - protein, 11 aa, BK virus
AAISATENPVA

SEQ ID NO: 20005 - protein, 11 aa, BK virus
AISATENPVAA

SEQ ID NO: 20006 - protein, 11 aa, BK virus
ISATENPVAAA

SEQ ID NO: 20007 - protein, 11 aa, BK virus
SATENPVAAAA

SEQ ID NO: 20008 - protein, 11 aa, BK virus
ATENPVAAAAS

SEQ ID NO: 20009 - protein, 11 aa, BK virus
TENPVAAAASD

SEQ ID NO: 20010 - protein, 11 aa, BK virus
ENPVAAAASDT

SEQ ID NO: 20011 - protein, 11 aa, BK virus
NPVAAAASDTL

SEQ ID NO: 20012 - protein, 11 aa, BK virus
PVAAAASDTLA

SEQ ID NO: 20013 - protein, 11 aa, BK virus
VAAAASDTLAT

SEQ ID NO: 20014 - protein, 11 aa, BK virus
AAAASDTLATR

SEQ ID NO: 20015 - protein, 11 aa, BK virus
AAASDTLATRS

SEQ ID NO: 20016 - protein, 11 aa, BK virus
AASDTLATRSP

SEQ ID NO: 20017 - protein, 11 aa, BK virus
ASDTLATRSPK

SEQ ID NO: 20018 - protein, 11 aa, BK virus
SDTLATRSPKS

SEQ ID NO: 20019 - protein, 11 aa, BK virus
DTLATRSPKSA

SEQ ID NO: 20020 - protein, 11 aa, BK virus
TLATRSPKSAR

SEQ ID NO: 20021 - protein, 11 aa, BK virus
LATRSPKSARA

SEQ ID NO: 20022 - protein, 11 aa, BK virus
ATRSPKSARAA

SEQ ID NO: 20023 - protein, 11 aa, BK virus
TRSPKSARAAP

SEQ ID NO: 20024 - protein, 11 aa, BK virus
RSPKSARAAPM

SEQ ID NO: 20025 - protein, 11 aa, BK virus
SPKSARAAPMN

SEQ ID NO: 20026 - protein, 11 aa, BK virus
PKSARAAPMNL

SEQ ID NO: 20027 - protein, 11 aa, BK virus
KSARAAPMNLE

SEQ ID NO: 20028 - protein, 11 aa, BK virus
SARAAPMNLEI

SEQ ID NO: 20029 - protein, 11 aa, BK virus
ARAAPMNLEIQ

SEQ ID NO: 20030 - protein, 11 aa, BK virus
RAAPMNLEIQK

SEQ ID NO: 20031 - protein, 11 aa, BK virus
AAPMNLEIQKK

SEQ ID NO: 20032 - protein, 11 aa, BK virus
APMNLEIQKKR

SEQ ID NO: 20033 - protein, 11 aa, BK virus
PMNLEIQKKRD

SEQ ID NO: 20034 - protein, 11 aa, BK virus
MNLEIQKKRDY

SEQ ID NO: 20035 - protein, 11 aa, BK virus
NLEIQKKRDYL

SEQ ID NO: 20036 - protein, 11 aa, BK virus
LEIQKKRDYLP

SEQ ID NO: 20037 - protein, 11 aa, BK virus
EIQKKRDYLPR

SEQ ID NO: 20038 - protein, 11 aa, BK virus
IQKKRDYLPRS

SEQ ID NO: 20039 - protein, 11 aa, BK virus
QKKRDYLPRSL

SEQ ID NO: 20040 - protein, 11 aa, BK virus
KKRDYLPRSLL

SEQ ID NO: 20041 - protein, 11 aa, BK virus
KRDYLPRSLLQ

SEQ ID NO: 20042 - protein, 11 aa, BK virus
RDYLPRSLLQS

SEQ ID NO: 20043 - protein, 11 aa, BK virus
DYLPRSLLQSL

SEQ ID NO: 20044 - protein, 11 aa, BK virus
YLPRSLLQSLL

SEQ ID NO: 20045 - protein, 11 aa, BK virus
LPRSLLQSLLQ

SEQ ID NO: 20046 - protein, 11 aa, BK virus
PRSLLQSLLQQ

SEQ ID NO: 20047 - protein, 11 aa, BK virus
RSLLQSLLQQV

SEQ ID NO: 20048 - protein, 11 aa, BK virus
SLLQSLLQQVK

SEQ ID NO: 20049 - protein, 11 aa, BK virus
LLQSLLQQVKQ

SEQ ID NO: 20050 - protein, 11 aa, BK virus
LQSLLQQVKQW

SEQ ID NO: 20051 - protein, 11 aa, BK virus
QSLLQQVKQWY

SEQ ID NO: 20052 - protein, 11 aa, BK virus
SLLQQVKQWYF

SEQ ID NO: 20053 - protein, 11 aa, BK virus
LLQQVKQWYFC

SEQ ID NO: 20054 - protein, 11 aa, BK virus
LQQVKQWYFCF

SEQ ID NO: 20055 - protein, 11 aa, BK virus
QQVKQWYFCFS

SEQ ID NO: 20056 - protein, 11 aa, BK virus
QVKQWYFCFSR

SEQ ID NO: 20057 - protein, 11 aa, BK virus
VKQWYFCFSRL

SEQ ID NO: 20058 - protein, 11 aa, BK virus
KQWYFCFSRLH

SEQ ID NO: 20059 - protein, 11 aa, BK virus
QWYFCFSRLHC

SEQ ID NO: 20060 - protein, 11 aa, BK virus
WYFCFSRLHCL

SEQ ID NO: 20061 - protein, 11 aa, BK virus
YFCFSRLHCLH

SEQ ID NO: 20062 - protein, 11 aa, BK virus
FCFSRLHCLHL

SEQ ID NO: 20063 - protein, 11 aa, BK virus
CFSRLHCLHLY

SEQ ID NO: 20064 - protein, 11 aa, BK virus
FSRLHCLHLYK

SEQ ID NO: 20065 - protein, 11 aa, BK virus
SRLHCLHLYKI

SEQ ID NO: 20066 - protein, 11 aa, BK virus
RLHCLHLYKIP

SEQ ID NO: 20067 - protein, 11 aa, BK virus
LHCLHLYKIPA

SEQ ID NO: 20068 - protein, 11 aa, BK virus
HCLHLYKIPAK

SEQ ID NO: 20069 - protein, 11 aa, BK virus
CLHLYKIPAKA

SEQ ID NO: 20070 - protein, 11 aa, BK virus
LHLYKIPAKAL

SEQ ID NO: 20071 - protein, 11 aa, BK virus
HLYKIPAKALK

SEQ ID NO: 20072 - protein, 11 aa, BK virus
KSSELFFLFQS

SEQ ID NO: 20073 - protein, 11 aa, BK virus
SSELFFLFQSR

SEQ ID NO: 20074 - protein, 11 aa, BK virus
SELFFLFQSRF

SEQ ID NO: 20075 - protein, 11 aa, BK virus
ELFFLFQSRFY

SEQ ID NO: 20076 - protein, 11 aa, BK virus
LFFLFQSRFYQ

SEQ ID NO: 20077 - protein, 11 aa, BK virus
FFLFQSRFYQL

SEQ ID NO: 20078 - protein, 11 aa, BK virus
FLFQSRFYQLS

SEQ ID NO: 20079 - protein, 11 aa, BK virus
LFQSRFYQLSL

SEQ ID NO: 20080 - protein, 11 aa, BK virus
FQSRFYQLSLK

SEQ ID NO: 20081 - protein, 11 aa, BK virus
QSRFYQLSLKL

SEQ ID NO: 20082 - protein, 11 aa, BK virus
SRFYQLSLKLV

SEQ ID NO: 20083 - protein, 11 aa, BK virus
RFYQLSLKLVV

SEQ ID NO: 20084 - protein, 11 aa, BK virus
FYQLSLKLVVT

SEQ ID NO: 20085 - protein, 11 aa, BK virus
YQLSLKLVVTA

SEQ ID NO: 20086 - protein, 11 aa, BK virus
QLSLKLVVTAG

SEQ ID NO: 20087 - protein, 11 aa, BK virus
LSLKLVVTAGA

SEQ ID NO: 20088 - protein, 11 aa, BK virus
SLKLVVTAGAE

SEQ ID NO: 20089 - protein, 11 aa, BK virus
LKLVVTAGAEP

SEQ ID NO: 20090 - protein, 11 aa, BK virus
KLVVTAGAEPW

SEQ ID NO: 20091 - protein, 11 aa, BK virus
LVVTAGAEPWP

SEQ ID NO: 20092 - protein, 11 aa, BK virus
VVTAGAEPWPL

SEQ ID NO: 20093 - protein, 11 aa, BK virus
VTAGAEPWPLS

SEQ ID NO: 20094 - protein, 11 aa, BK virus
TAGAEPWPLSS

SEQ ID NO: 20095 - protein, 11 aa, BK virus
AGAEPWPLSSL

SEQ ID NO: 20096 - protein, 11 aa, BK virus
GAEPWPLSSLT

SEQ ID NO: 20097 - protein, 11 aa, BK virus
AEPWPLSSLTG

SEQ ID NO: 20098 - protein, 11 aa, BK virus
EPWPLSSLTGD

SEQ ID NO: 20099 - protein, 11 aa, BK virus
PWPLSSLTGDK

SEQ ID NO: 20100 - protein, 11 aa, BK virus
WPLSSLTGDKA

SEQ ID NO: 20101 - protein, 11 aa, BK virus
PLSSLTGDKAK

SEQ ID NO: 20102 - protein, 11 aa, BK virus
LSSLTGDKAKI

SEQ ID NO: 20103 - protein, 11 aa, BK virus
SSLTGDKAKIP

SEQ ID NO: 20104 - protein, 11 aa, BK virus
SLTGDKAKIPR

SEQ ID NO: 20105 - protein, 11 aa, BK virus
LTGDKAKIPRL

SEQ ID NO: 20106 - protein, 11 aa, BK virus
TGDKAKIPRLA

SEQ ID NO: 20107 - protein, 11 aa, BK virus
GDKAKIPRLAK

SEQ ID NO: 20108 - protein, 11 aa, BK virus
DKAKIPRLAKH

SEQ ID NO: 20109 - protein, 11 aa, BK virus
KAKIPRLAKHV

SEQ ID NO: 20110 - protein, 11 aa, BK virus
AKIPRLAKHVC

SEQ ID NO: 20111 - protein, 11 aa, BK virus
KIPRLAKHVCH

SEQ ID NO: 20112 - protein, 11 aa, BK virus
IPRLAKHVCHA

SEQ ID NO: 20113 - protein, 11 aa, BK virus
PRLAKHVCHAL

SEQ ID NO: 20114 - protein, 11 aa, BK virus
RLAKHVCHALS

SEQ ID NO: 20115 - protein, 11 aa, BK virus
LAKHVCHALSF

SEQ ID NO: 20116 - protein, 11 aa, BK virus
AKHVCHALSFL

SEQ ID NO: 20117 - protein, 11 aa, BK virus
KHVCHALSFLR

SEQ ID NO: 20118 - protein, 11 aa, BK virus
HVCHALSFLRS

SEQ ID NO: 20119 - protein, 11 aa, BK virus
VCHALSFLRSW

SEQ ID NO: 20120 - protein, 11 aa, BK virus
CHALSFLRSWF

SEQ ID NO: 20121 - protein, 11 aa, BK virus
HALSFLRSWFG

SEQ ID NO: 20122 - protein, 11 aa, BK virus
ALSFLRSWFGC

SEQ ID NO: 20123 - protein, 11 aa, BK virus
LSFLRSWFGCI

SEQ ID NO: 20124 - protein, 11 aa, BK virus
SFLRSWFGCIP

SEQ ID NO: 20125 - protein, 11 aa, BK virus
FLRSWFGCIPW

SEQ ID NO: 20126 - protein, 11 aa, BK virus
LRSWFGCIPWV

SEQ ID NO: 20127 - protein, 11 aa, BK virus
RSWFGCIPWVS

SEQ ID NO: 20128 - protein, 11 aa, BK virus
SWFGCIPWVSS

SEQ ID NO: 20129 - protein, 11 aa, BK virus
WFGCIPWVSSS

SEQ ID NO: 20130 - protein, 11 aa, BK virus
FGCIPWVSSSS

SEQ ID NO: 20131 - protein, 11 aa, BK virus
GCIPWVSSSSL

SEQ ID NO: 20132 - protein, 11 aa, BK virus
GHGLAAFPCES

SEQ ID NO: 20133 - protein, 11 aa, BK virus
HGLAAFPCESC

SEQ ID NO: 20134 - protein, 11 aa, BK virus
GLAAFPCESCT

SEQ ID NO: 20135 - protein, 11 aa, BK virus
LAAFPCESCTF

SEQ ID NO: 20136 - protein, 11 aa, BK virus
AAFPCESCTFL

SEQ ID NO: 20137 - protein, 11 aa, BK virus
AFPCESCTFLP

SEQ ID NO: 20138 - protein, 11 aa, BK virus
FPCESCTFLPE

SEQ ID NO: 20139 - protein, 11 aa, BK virus
PCESCTFLPEV

SEQ ID NO: 20140 - protein, 11 aa, BK virus
CESCTFLPEVM

SEQ ID NO: 20141 - protein, 11 aa, BK virus
ESCTFLPEVMV

SEQ ID NO: 20142 - protein, 11 aa, BK virus
SCTFLPEVMVW

SEQ ID NO: 20143 - protein, 11 aa, BK virus
CTFLPEVMVWL

SEQ ID NO: 20144 - protein, 11 aa, BK virus
TFLPEVMVWLH

SEQ ID NO: 20145 - protein, 11 aa, BK virus
FLPEVMVWLHS

SEQ ID NO: 20146 - protein, 11 aa, BK virus
LPEVMVWLHSM

SEQ ID NO: 20147 - protein, 11 aa, BK virus
PEVMVWLHSMG

SEQ ID NO: 20148 - protein, 11 aa, BK virus
EVMVWLHSMGK

SEQ ID NO: 20149 - protein, 11 aa, BK virus
VMVWLHSMGKQ

SEQ ID NO: 20150 - protein, 11 aa, BK virus
MVWLHSMGKQL

SEQ ID NO: 20151 - protein, 11 aa, BK virus
VWLHSMGKQLL

SEQ ID NO: 20152 - protein, 11 aa, BK virus
WLHSMGKQLLP

SEQ ID NO: 20153 - protein, 11 aa, BK virus
LHSMGKQLLPV

SEQ ID NO: 20154 - protein, 11 aa, BK virus
HSMGKQLLPVA

SEQ ID NO: 20155 - protein, 11 aa, BK virus
SMGKQLLPVAF

SEQ ID NO: 20156 - protein, 11 aa, BK virus
MGKQLLPVAFF

SEQ ID NO: 20157 - protein, 11 aa, BK virus
GKQLLPVAFFF

SEQ ID NO: 20158 - protein, 11 aa, BK virus
KQLLPVAFFFI

SEQ ID NO: 20159 - protein, 11 aa, BK virus
QLLPVAFFFII

SEQ ID NO: 20160 - protein, 11 aa, BK virus
LLPVAFFFIIY

SEQ ID NO: 20161 - protein, 11 aa, BK virus
LPVAFFFIIYK

SEQ ID NO: 20162 - protein, 11 aa, BK virus
PVAFFFIIYKR

SEQ ID NO: 20163 - protein, 11 aa, BK virus
VAFFFIIYKRP

SEQ ID NO: 20164 - protein, 11 aa, BK virus
AFFFIIYKRPR

SEQ ID NO: 20165 - protein, 11 aa, BK virus
FFFIIYKRPRP

SEQ ID NO: 20166 - protein, 11 aa, BK virus
FFIIYKRPRPP

SEQ ID NO: 20167 - protein, 11 aa, BK virus
FIIYKRPRPPL

SEQ ID NO: 20168 - protein, 11 aa, BK virus
IIYKRPRPPLP

SEQ ID NO: 20169 - protein, 11 aa, BK virus
IYKRPRPPLPP

SEQ ID NO: 20170 - protein, 11 aa, BK virus
YKRPRPPLPPP

SEQ ID NO: 20171 - protein, 11 aa, BK virus
KRPRPPLPPPF

SEQ ID NO: 20172 - protein, 11 aa, BK virus
RPRPPLPPPFL

SEQ ID NO: 20173 - protein, 11 aa, BK virus
PRPPLPPPFLS

SEQ ID NO: 20174 - protein, 11 aa, BK virus
RPPLPPPFLSS

SEQ ID NO: 20175 - protein, 11 aa, BK virus
PPLPPPFLSSS

SEQ ID NO: 20176 - protein, 11 aa, BK virus
PLPPPFLSSSK

SEQ ID NO: 20177 - protein, 11 aa, BK virus
LPPPFLSSSKG

SEQ ID NO: 20178 - protein, 11 aa, BK virus
PPPFLSSSKGV

SEQ ID NO: 20179 - protein, 11 aa, BK virus
PPFLSSSKGVE

SEQ ID NO: 20180 - protein, 11 aa, BK virus
PFLSSSKGVEA

SEQ ID NO: 20181 - protein, 11 aa, BK virus
FLSSSKGVEAF

SEQ ID NO: 20182 - protein, 11 aa, BK virus
LSSSKGVEAFS

SEQ ID NO: 20183 - protein, 11 aa, BK virus
SSSKGVEAFSE

SEQ ID NO: 20184 - protein, 11 aa, BK virus
SSKGVEAFSEA

SEQ ID NO: 20185 - protein, 11 aa, BK virus
QNYLGKSLFFC

SEQ ID NO: 20186 - protein, 11 aa, BK virus
NYLGKSLFFCN

SEQ ID NO: 20187 - protein, 11 aa, BK virus
YLGKSLFFCNF

SEQ ID NO: 20188 - protein, 11 aa, BK virus
LGKSLFFCNFC

SEQ ID NO: 20189 - protein, 11 aa, BK virus
GKSLFFCNFCK

SEQ ID NO: 20190 - protein, 8 aa, BK virus
QGRIHGAH

SEQ ID NO: 20191 - protein, 8 aa, BK virus
GRIHGAHG

SEQ ID NO: 20192 - protein, 8 aa, BK virus
RIHGAHGP

SEQ ID NO: 20193 - protein, 8 aa, BK virus
IHGAHGPF

SEQ ID NO: 20194 - protein, 8 aa, BK virus
HGAHGPFR

SEQ ID NO: 20195 - protein, 8 aa, BK virus
GAHGPFRP

SEQ ID NO: 20196 - protein, 8 aa, BK virus
KSCLGKSS

SEQ ID NO: 20197 - protein, 8 aa, BK virus
SCLGKSSL

SEQ ID NO: 20198 - protein, 8 aa, BK virus
CLGKSSLN

SEQ ID NO: 20199 - protein, 8 aa, BK virus
LGKSSLNE

SEQ ID NO: 20200 - protein, 8 aa, BK virus
GKSSLNEK

SEQ ID NO: 20201 - protein, 8 aa, BK virus
KSSLNEKS

SEQ ID NO: 20202 - protein, 8 aa, BK virus
SSLNEKSL

SEQ ID NO: 20203 - protein, 8 aa, BK virus
SLNEKSLF

SEQ ID NO: 20204 - protein, 8 aa, BK virus
LNEKSLFK

SEQ ID NO: 20205 - protein, 8 aa, BK virus
NEKSLFKE

SEQ ID NO: 20206 - protein, 8 aa, BK virus
EKSLFKEV

SEQ ID NO: 20207 - protein, 8 aa, BK virus
NEENEYFV

SEQ ID NO: 20208 - protein, 8 aa, BK virus
KNGAGCKG

SEQ ID NO: 20209 - protein, 8 aa, BK virus
NGAGCKGS

SEQ ID NO: 20210 - protein, 8 aa, BK virus
GAGCKGSS

SEQ ID NO: 20211 - protein, 8 aa, BK virus
AGCKGSSS

SEQ ID NO: 20212 - protein, 8 aa, BK virus
GCKGSSSA

SEQ ID NO: 20213 - protein, 8 aa, BK virus
FSSLPRYP

SEQ ID NO: 20214 - protein, 8 aa, BK virus
SSLPRYPV

SEQ ID NO: 20215 - protein, 8 aa, BK virus
SLPRYPVL

SEQ ID NO: 20216 - protein, 8 aa, BK virus
LPRYPVLQ

SEQ ID NO: 20217 - protein, 8 aa, BK virus
PRYPVLQG

SEQ ID NO: 20218 - protein, 8 aa, BK virus
RYPVLQGM

SEQ ID NO: 20219 - protein, 8 aa, BK virus
YPVLQGMA

SEQ ID NO: 20220 - protein, 8 aa, BK virus
PVLQGMAY

SEQ ID NO: 20221 - protein, 8 aa, BK virus
VLQGMAYL

SEQ ID NO: 20222 - protein, 8 aa, BK virus
LQGMAYLF

SEQ ID NO: 20223 - protein, 8 aa, BK virus
QGMAYLFQ

SEQ ID NO: 20224 - protein, 8 aa, BK virus
GMAYLFQK

SEQ ID NO: 20225 - protein, 8 aa, BK virus
MAYLFQKA

SEQ ID NO: 20226 - protein, 8 aa, BK virus
AYLFQKAF

SEQ ID NO: 20227 - protein, 8 aa, BK virus
YLFQKAFC

SEQ ID NO: 20228 - protein, 8 aa, BK virus
LFQKAFCA

SEQ ID NO: 20229 - protein, 8 aa, BK virus
FQKAFCAL

SEQ ID NO: 20230 - protein, 8 aa, BK virus
QKAFCALP

SEQ ID NO: 20231 - protein, 8 aa, BK virus
KAFCALPL

SEQ ID NO: 20232 - protein, 8 aa, BK virus
AFCALPLH

SEQ ID NO: 20233 - protein, 8 aa, BK virus
FCALPLHA

SEQ ID NO: 20234 - protein, 8 aa, BK virus
CALPLHAM

SEQ ID NO: 20235 - protein, 8 aa, BK virus
ALPLHAMS

SEQ ID NO: 20236 - protein, 8 aa, BK virus
LPLHAMSA

SEQ ID NO: 20237 - protein, 8 aa, BK virus
KIFKKRAL

SEQ ID NO: 20238 - protein, 8 aa, BK virus
IFKKRALG

SEQ ID NO: 20239 - protein, 8 aa, BK virus
FKKRALGL

SEQ ID NO: 20240 - protein, 8 aa, BK virus
KKRALGLD

SEQ ID NO: 20241 - protein, 8 aa, BK virus
KRALGLDR

SEQ ID NO: 20242 - protein, 8 aa, BK virus
RALGLDRL

SEQ ID NO: 20243 - protein, 8 aa, BK virus
ALGLDRLL

SEQ ID NO: 20244 - protein, 8 aa, BK virus
LGLDRLLL

SEQ ID NO: 20245 - protein, 8 aa, BK virus
GLDRLLLH

SEQ ID NO: 20246 - protein, 8 aa, BK virus
LLHTVVWL

SEQ ID NO: 20247 - protein, 8 aa, BK virus
LHTVVWLR

SEQ ID NO: 20248 - protein, 8 aa, BK virus
HTVVWLRP

SEQ ID NO: 20249 - protein, 8 aa, BK virus
TVVWLRPN

SEQ ID NO: 20250 - protein, 8 aa, BK virus
RNSAMVGP

SEQ ID NO: 20251 - protein, 8 aa, BK virus
NSAMVGPN

SEQ ID NO: 20252 - protein, 8 aa, BK virus
SAMVGPNN

SEQ ID NO: 20253 - protein, 8 aa, BK virus
AMVGPNNW

SEQ ID NO: 20254 - protein, 8 aa, BK virus
MVGPNNWR

SEQ ID NO: 20255 - protein, 8 aa, BK virus
VGPNNWRN

SEQ ID NO: 20256 - protein, 8 aa, BK virus
GPNNWRNS

SEQ ID NO: 20257 - protein, 8 aa, BK virus
PNNWRNSL

SEQ ID NO: 20258 - protein, 8 aa, BK virus
NNWRNSLQ

SEQ ID NO: 20259 - protein, 8 aa, BK virus
NWRNSLQR

SEQ ID NO: 20260 - protein, 8 aa, BK virus
WRNSLQRS

SEQ ID NO: 20261 - protein, 8 aa, BK virus
RNSLQRSK

SEQ ID NO: 20262 - protein, 8 aa, BK virus
NSLQRSKA

SEQ ID NO: 20263 - protein, 8 aa, BK virus
SLQRSKAL

SEQ ID NO: 20264 - protein, 8 aa, BK virus
LQRSKALR

SEQ ID NO: 20265 - protein, 8 aa, BK virus
INNKILKG

SEQ ID NO: 20266 - protein, 8 aa, BK virus
NNKILKGP

SEQ ID NO: 20267 - protein, 8 aa, BK virus
NKILKGPK

SEQ ID NO: 20268 - protein, 8 aa, BK virus
VPTYGTEE

SEQ ID NO: 20269 - protein, 8 aa, BK virus
PTYGTEEW

SEQ ID NO: 20270 - protein, 8 aa, BK virus
TYGTEEWE

SEQ ID NO: 20271 - protein, 8 aa, BK virus
YGTEEWES

SEQ ID NO: 20272 - protein, 8 aa, BK virus
GTEEWESW

SEQ ID NO: 20273 - protein, 8 aa, BK virus
TEEWESWW

SEQ ID NO: 20274 - protein, 8 aa, BK virus
EEWESWWS

SEQ ID NO: 20275 - protein, 8 aa, BK virus
EWESWWSS

SEQ ID NO: 20276 - protein, 8 aa, BK virus
WESWWSSF

SEQ ID NO: 20277 - protein, 8 aa, BK virus
ESWWSSFN

SEQ ID NO: 20278 - protein, 8 aa, BK virus
SWWSSFNE

SEQ ID NO: 20279 - protein, 8 aa, BK virus
WWSSFNEK

SEQ ID NO: 20280 - protein, 8 aa, BK virus
WSSFNEKW

SEQ ID NO: 20281 - protein, 8 aa, BK virus
SSFNEKWD

SEQ ID NO: 20282 - protein, 8 aa, BK virus
SFNEKWDE

SEQ ID NO: 20283 - protein, 8 aa, BK virus
FNEKWDED

SEQ ID NO: 20284 - protein, 8 aa, BK virus
NEKWDEDL

SEQ ID NO: 20285 - protein, 8 aa, BK virus
EKWDEDLF

SEQ ID NO: 20286 - protein, 8 aa, BK virus
KWDEDLFC

SEQ ID NO: 20287 - protein, 8 aa, BK virus
WDEDLFCH

SEQ ID NO: 20288 - protein, 8 aa, BK virus
DEDLFCHE

SEQ ID NO: 20289 - protein, 8 aa, BK virus
EDLFCHED

SEQ ID NO: 20290 - protein, 8 aa, BK virus
DLFCHEDM

SEQ ID NO: 20291 - protein, 8 aa, BK virus
LFCHEDMF

SEQ ID NO: 20292 - protein, 8 aa, BK virus
FCHEDMFA

SEQ ID NO: 20293 - protein, 8 aa, BK virus
CHEDMFAS

SEQ ID NO: 20294 - protein, 8 aa, BK virus
HEDMFASD

SEQ ID NO: 20295 - protein, 8 aa, BK virus
EDMFASDE

SEQ ID NO: 20296 - protein, 8 aa, BK virus
DMFASDEE

SEQ ID NO: 20297 - protein, 8 aa, BK virus
MFASDEEA

SEQ ID NO: 20298 - protein, 8 aa, BK virus
FASDEEAT

SEQ ID NO: 20299 - protein, 8 aa, BK virus
ASDEEATA

SEQ ID NO: 20300 - protein, 8 aa, BK virus
SDEEATAD

SEQ ID NO: 20301 - protein, 8 aa, BK virus
DEEATADS

SEQ ID NO: 20302 - protein, 8 aa, BK virus
EEATADSQ

SEQ ID NO: 20303 - protein, 8 aa, BK virus
EATADSQH

SEQ ID NO: 20304 - protein, 8 aa, BK virus
ATADSQHS

SEQ ID NO: 20305 - protein, 8 aa, BK virus
TADSQHST

SEQ ID NO: 20306 - protein, 8 aa, BK virus
ADSQHSTP

SEQ ID NO: 20307 - protein, 8 aa, BK virus
DSQHSTPP

SEQ ID NO: 20308 - protein, 8 aa, BK virus
SQHSTPPK

SEQ ID NO: 20309 - protein, 8 aa, BK virus
QHSTPPKK

SEQ ID NO: 20310 - protein, 8 aa, BK virus
HSTPPKKK

SEQ ID NO: 20311 - protein, 8 aa, BK virus
STPPKKKR

SEQ ID NO: 20312 - protein, 8 aa, BK virus
TPPKKKRK

SEQ ID NO: 20313 - protein, 8 aa, BK virus
PPKKKRKV

SEQ ID NO: 20314 - protein, 8 aa, BK virus
PKKKRKVE

SEQ ID NO: 20315 - protein, 8 aa, BK virus
KKKRKVED

SEQ ID NO: 20316 - protein, 8 aa, BK virus
KKRKVEDP

SEQ ID NO: 20317 - protein, 8 aa, BK virus
KRKVEDPK

SEQ ID NO: 20318 - protein, 8 aa, BK virus
RKVEDPKD

SEQ ID NO: 20319 - protein, 8 aa, BK virus
KVEDPKDF

SEQ ID NO: 20320 - protein, 8 aa, BK virus
VEDPKDFP

SEQ ID NO: 20321 - protein, 8 aa, BK virus
EDPKDFPS

SEQ ID NO: 20322 - protein, 8 aa, BK virus
DPKDFPSD

SEQ ID NO: 20323 - protein, 8 aa, BK virus
PKDFPSDL

SEQ ID NO: 20324 - protein, 8 aa, BK virus
KDFPSDLH

SEQ ID NO: 20325 - protein, 8 aa, BK virus
DFPSDLHQ

SEQ ID NO: 20326 - protein, 8 aa, BK virus
FPSDLHQF

SEQ ID NO: 20327 - protein, 8 aa, BK virus
PSDLHQFL

SEQ ID NO: 20328 - protein, 8 aa, BK virus
SDLHQFLS

SEQ ID NO: 20329 - protein, 8 aa, BK virus
DLHQFLSQ

SEQ ID NO: 20330 - protein, 8 aa, BK virus
LHQFLSQA

SEQ ID NO: 20331 - protein, 8 aa, BK virus
HQFLSQAV

SEQ ID NO: 20332 - protein, 8 aa, BK virus
QFLSQAVF

SEQ ID NO: 20333 - protein, 8 aa, BK virus
FLSQAVFS

SEQ ID NO: 20334 - protein, 8 aa, BK virus
LSQAVFSN

SEQ ID NO: 20335 - protein, 8 aa, BK virus
SQAVFSNR

SEQ ID NO: 20336 - protein, 8 aa, BK virus
QAVFSNRT

SEQ ID NO: 20337 - protein, 8 aa, BK virus
AVFSNRTL

SEQ ID NO: 20338 - protein, 8 aa, BK virus
VFSNRTLA

SEQ ID NO: 20339 - protein, 8 aa, BK virus
FSNRTLAC

SEQ ID NO: 20340 - protein, 8 aa, BK virus
SNRTLACF

SEQ ID NO: 20341 - protein, 8 aa, BK virus
NRTLACFA

SEQ ID NO: 20342 - protein, 8 aa, BK virus
RTLACFAV

SEQ ID NO: 20343 - protein, 8 aa, BK virus
TLACFAVY

SEQ ID NO: 20344 - protein, 8 aa, BK virus
LACFAVYT

SEQ ID NO: 20345 - protein, 8 aa, BK virus
ACFAVYTT

SEQ ID NO: 20346 - protein, 8 aa, BK virus
CFAVYTTK

SEQ ID NO: 20347 - protein, 8 aa, BK virus
FAVYTTKE

SEQ ID NO: 20348 - protein, 8 aa, BK virus
AVYTTKEK

SEQ ID NO: 20349 - protein, 8 aa, BK virus
VYTTKEKA

SEQ ID NO: 20350 - protein, 8 aa, BK virus
YTTKEKAQ

SEQ ID NO: 20351 - protein, 8 aa, BK virus
TTKEKAQI

SEQ ID NO: 20352 - protein, 8 aa, BK virus
TKEKAQIL

SEQ ID NO: 20353 - protein, 8 aa, BK virus
KEKAQILY

SEQ ID NO: 20354 - protein, 8 aa, BK virus
EKAQILYK

SEQ ID NO: 20355 - protein, 8 aa, BK virus
KAQILYKK

SEQ ID NO: 20356 - protein, 8 aa, BK virus
AQILYKKL

SEQ ID NO: 20357 - protein, 8 aa, BK virus
QILYKKLM

SEQ ID NO: 20358 - protein, 8 aa, BK virus
ILYKKLME

SEQ ID NO: 20359 - protein, 8 aa, BK virus
LYKKLMEK

SEQ ID NO: 20360 - protein, 8 aa, BK virus
YKKLMEKY

SEQ ID NO: 20361 - protein, 8 aa, BK virus
KKLMEKYS

SEQ ID NO: 20362 - protein, 8 aa, BK virus
KLMEKYSV

SEQ ID NO: 20363 - protein, 8 aa, BK virus
LMEKYSVT

SEQ ID NO: 20364 - protein, 8 aa, BK virus
MEKYSVTF

SEQ ID NO: 20365 - protein, 8 aa, BK virus
EKYSVTFI

SEQ ID NO: 20366 - protein, 8 aa, BK virus
KYSVTFIS

SEQ ID NO: 20367 - protein, 8 aa, BK virus
YSVTFISR

SEQ ID NO: 20368 - protein, 8 aa, BK virus
SVTFISRH

SEQ ID NO: 20369 - protein, 8 aa, BK virus
VTFISRHM

SEQ ID NO: 20370 - protein, 8 aa, BK virus
TFISRHMC

SEQ ID NO: 20371 - protein, 8 aa, BK virus
FISRHMCA

SEQ ID NO: 20372 - protein, 8 aa, BK virus
ISRHMCAG

SEQ ID NO: 20373 - protein, 8 aa, BK virus
SRHMCAGH

SEQ ID NO: 20374 - protein, 8 aa, BK virus
RHMCAGHN

SEQ ID NO: 20375 - protein, 8 aa, BK virus
HMCAGHNI

SEQ ID NO: 20376 - protein, 8 aa, BK virus
MCAGHNII

SEQ ID NO: 20377 - protein, 8 aa, BK virus
CAGHNIIF

SEQ ID NO: 20378 - protein, 8 aa, BK virus
AGHNIIFF

SEQ ID NO: 20379 - protein, 8 aa, BK virus
GHNIIFFL

SEQ ID NO: 20380 - protein, 8 aa, BK virus
HNIIFFLT

SEQ ID NO: 20381 - protein, 8 aa, BK virus
NIIFFLTP

SEQ ID NO: 20382 - protein, 8 aa, BK virus
IIFFLTPH

SEQ ID NO: 20383 - protein, 8 aa, BK virus
IFFLTPHR

SEQ ID NO: 20384 - protein, 8 aa, BK virus
FFLTPHRH

SEQ ID NO: 20385 - protein, 8 aa, BK virus
FLTPHRHR

SEQ ID NO: 20386 - protein, 8 aa, BK virus
LTPHRHRV

SEQ ID NO: 20387 - protein, 8 aa, BK virus
TPHRHRVS

SEQ ID NO: 20388 - protein, 8 aa, BK virus
PHRHRVSA

SEQ ID NO: 20389 - protein, 8 aa, BK virus
HRHRVSAI

SEQ ID NO: 20390 - protein, 8 aa, BK virus
RHRVSAIN

SEQ ID NO: 20391 - protein, 8 aa, BK virus
HRVSAINN

SEQ ID NO: 20392 - protein, 8 aa, BK virus
RVSAINNF

SEQ ID NO: 20393 - protein, 8 aa, BK virus
VSAINNFC

SEQ ID NO: 20394 - protein, 8 aa, BK virus
SAINNFCQ

SEQ ID NO: 20395 - protein, 8 aa, BK virus
AINNFCQK

SEQ ID NO: 20396 - protein, 8 aa, BK virus
INNFCQKL

SEQ ID NO: 20397 - protein, 8 aa, BK virus
NNFCQKLC

SEQ ID NO: 20398 - protein, 8 aa, BK virus
NFCQKLCT

SEQ ID NO: 20399 - protein, 8 aa, BK virus
FCQKLCTF

SEQ ID NO: 20400 - protein, 8 aa, BK virus
CQKLCTFS

SEQ ID NO: 20401 - protein, 8 aa, BK virus
QKLCTFSF

SEQ ID NO: 20402 - protein, 8 aa, BK virus
KLCTFSFL

SEQ ID NO: 20403 - protein, 8 aa, BK virus
LCTFSFLI

SEQ ID NO: 20404 - protein, 8 aa, BK virus
CTFSFLIC

SEQ ID NO: 20405 - protein, 8 aa, BK virus
TFSFLICK

SEQ ID NO: 20406 - protein, 8 aa, BK virus
FSFLICKG

SEQ ID NO: 20407 - protein, 8 aa, BK virus
SFLICKGV

SEQ ID NO: 20408 - protein, 8 aa, BK virus
FLICKGVN

SEQ ID NO: 20409 - protein, 8 aa, BK virus
LICKGVNK

SEQ ID NO: 20410 - protein, 8 aa, BK virus
ICKGVNKE

SEQ ID NO: 20411 - protein, 8 aa, BK virus
CKGVNKEY

SEQ ID NO: 20412 - protein, 8 aa, BK virus
KGVNKEYL

SEQ ID NO: 20413 - protein, 8 aa, BK virus
GVNKEYLL

SEQ ID NO: 20414 - protein, 8 aa, BK virus
VNKEYLLY

SEQ ID NO: 20415 - protein, 8 aa, BK virus
NKEYLLYS

SEQ ID NO: 20416 - protein, 8 aa, BK virus
KEYLLYSA

SEQ ID NO: 20417 - protein, 8 aa, BK virus
EYLLYSAL

SEQ ID NO: 20418 - protein, 8 aa, BK virus
YLLYSALT

SEQ ID NO: 20419 - protein, 8 aa, BK virus
LLYSALTR

SEQ ID NO: 20420 - protein, 8 aa, BK virus
LYSALTRD

SEQ ID NO: 20421 - protein, 8 aa, BK virus
YSALTRDP

SEQ ID NO: 20422 - protein, 8 aa, BK virus
SALTRDPY

SEQ ID NO: 20423 - protein, 8 aa, BK virus
ALTRDPYH

SEQ ID NO: 20424 - protein, 8 aa, BK virus
LTRDPYHT

SEQ ID NO: 20425 - protein, 8 aa, BK virus
TRDPYHTI

SEQ ID NO: 20426 - protein, 8 aa, BK virus
RDPYHTIE

SEQ ID NO: 20427 - protein, 8 aa, BK virus
DPYHTIEE

SEQ ID NO: 20428 - protein, 8 aa, BK virus
PYHTIEES

SEQ ID NO: 20429 - protein, 8 aa, BK virus
YHTIEESI

SEQ ID NO: 20430 - protein, 8 aa, BK virus
HTIEESIQ

SEQ ID NO: 20431 - protein, 8 aa, BK virus
TIEESIQG

SEQ ID NO: 20432 - protein, 8 aa, BK virus
IEESIQGG

SEQ ID NO: 20433 - protein, 8 aa, BK virus
EESIQGGL

SEQ ID NO: 20434 - protein, 8 aa, BK virus
ESIQGGLK

SEQ ID NO: 20435 - protein, 8 aa, BK virus
SIQGGLKE

SEQ ID NO: 20436 - protein, 8 aa, BK virus
IQGGLKEH

SEQ ID NO: 20437 - protein, 8 aa, BK virus
QGGLKEHD

SEQ ID NO: 20438 - protein, 8 aa, BK virus
GGLKEHDF

SEQ ID NO: 20439 - protein, 8 aa, BK virus
GLKEHDFS

SEQ ID NO: 20440 - protein, 8 aa, BK virus
LKEHDFSP

SEQ ID NO: 20441 - protein, 8 aa, BK virus
KEHDFSPE

SEQ ID NO: 20442 - protein, 8 aa, BK virus
EHDFSPEE

SEQ ID NO: 20443 - protein, 8 aa, BK virus
HDFSPEEP

SEQ ID NO: 20444 - protein, 8 aa, BK virus
DFSPEEPE

SEQ ID NO: 20445 - protein, 8 aa, BK virus
FSPEEPEE

SEQ ID NO: 20446 - protein, 8 aa, BK virus
SPEEPEET

SEQ ID NO: 20447 - protein, 8 aa, BK virus
PEEPEETK

SEQ ID NO: 20448 - protein, 8 aa, BK virus
EEPEETKQ

SEQ ID NO: 20449 - protein, 8 aa, BK virus
EPEETKQV

SEQ ID NO: 20450 - protein, 8 aa, BK virus
PEETKQVS

SEQ ID NO: 20451 - protein, 8 aa, BK virus
EETKQVSW

SEQ ID NO: 20452 - protein, 8 aa, BK virus
ETKQVSWK

SEQ ID NO: 20453 - protein, 8 aa, BK virus
TKQVSWKL

SEQ ID NO: 20454 - protein, 8 aa, BK virus
KQVSWKLI

SEQ ID NO: 20455 - protein, 8 aa, BK virus
QVSWKLIT

SEQ ID NO: 20456 - protein, 8 aa, BK virus
VSWKLITE

SEQ ID NO: 20457 - protein, 8 aa, BK virus
SWKLITEY

SEQ ID NO: 20458 - protein, 8 aa, BK virus
WKLITEYA

SEQ ID NO: 20459 - protein, 8 aa, BK virus
KLITEYAV

SEQ ID NO: 20460 - protein, 8 aa, BK virus
LITEYAVE

SEQ ID NO: 20461 - protein, 8 aa, BK virus
ITEYAVET

SEQ ID NO: 20462 - protein, 8 aa, BK virus
TEYAVETK

SEQ ID NO: 20463 - protein, 8 aa, BK virus
EYAVETKC

SEQ ID NO: 20464 - protein, 8 aa, BK virus
YAVETKCE

SEQ ID NO: 20465 - protein, 8 aa, BK virus
AVETKCED

SEQ ID NO: 20466 - protein, 8 aa, BK virus
VETKCEDV

SEQ ID NO: 20467 - protein, 8 aa, BK virus
ETKCEDVF

SEQ ID NO: 20468 - protein, 8 aa, BK virus
TKCEDVFL

SEQ ID NO: 20469 - protein, 8 aa, BK virus
KCEDVFLL

SEQ ID NO: 20470 - protein, 8 aa, BK virus
CEDVFLLL

SEQ ID NO: 20471 - protein, 8 aa, BK virus
EDVFLLLG

SEQ ID NO: 20472 - protein, 8 aa, BK virus
DVFLLLGM

SEQ ID NO: 20473 - protein, 8 aa, BK virus
VFLLLGMY

SEQ ID NO: 20474 - protein, 8 aa, BK virus
FLLLGMYL

SEQ ID NO: 20475 - protein, 8 aa, BK virus
LLLGMYLE

SEQ ID NO: 20476 - protein, 8 aa, BK virus
LLGMYLEF

SEQ ID NO: 20477 - protein, 8 aa, BK virus
LGMYLEFQ

SEQ ID NO: 20478 - protein, 8 aa, BK virus
GMYLEFQY

SEQ ID NO: 20479 - protein, 8 aa, BK virus
MYLEFQYN

SEQ ID NO: 20480 - protein, 8 aa, BK virus
YLEFQYNV

SEQ ID NO: 20481 - protein, 8 aa, BK virus
LEFQYNVE

SEQ ID NO: 20482 - protein, 8 aa, BK virus
EFQYNVEE

SEQ ID NO: 20483 - protein, 8 aa, BK virus
FQYNVEEC

SEQ ID NO: 20484 - protein, 8 aa, BK virus
QYNVEECK

SEQ ID NO: 20485 - protein, 8 aa, BK virus
YNVEECKK

SEQ ID NO: 20486 - protein, 8 aa, BK virus
NVEECKKC

SEQ ID NO: 20487 - protein, 8 aa, BK virus
VEECKKCQ

SEQ ID NO: 20488 - protein, 8 aa, BK virus
EECKKCQK

SEQ ID NO: 20489 - protein, 8 aa, BK virus
ECKKCQKK

SEQ ID NO: 20490 - protein, 8 aa, BK virus
CKKCQKKD

SEQ ID NO: 20491 - protein, 8 aa, BK virus
KKCQKKDQ

SEQ ID NO: 20492 - protein, 8 aa, BK virus
KCQKKDQP

SEQ ID NO: 20493 - protein, 8 aa, BK virus
CQKKDQPY

SEQ ID NO: 20494 - protein, 8 aa, BK virus
QKKDQPYH

SEQ ID NO: 20495 - protein, 8 aa, BK virus
KKDQPYHF

SEQ ID NO: 20496 - protein, 8 aa, BK virus
KDQPYHFK

SEQ ID NO: 20497 - protein, 8 aa, BK virus
DQPYHFKY

SEQ ID NO: 20498 - protein, 8 aa, BK virus
QPYHFKYH

SEQ ID NO: 20499 - protein, 8 aa, BK virus
PYHFKYHE

SEQ ID NO: 20500 - protein, 8 aa, BK virus
YHFKYHEK

SEQ ID NO: 20501 - protein, 8 aa, BK virus
HFKYHEKH

SEQ ID NO: 20502 - protein, 8 aa, BK virus
FKYHEKHF

SEQ ID NO: 20503 - protein, 8 aa, BK virus
KYHEKHFA

SEQ ID NO: 20504 - protein, 8 aa, BK virus
YHEKHFAN

SEQ ID NO: 20505 - protein, 8 aa, BK virus
HEKHFANA

SEQ ID NO: 20506 - protein, 8 aa, BK virus
EKHFANAI

SEQ ID NO: 20507 - protein, 8 aa, BK virus
KHFANAII

SEQ ID NO: 20508 - protein, 8 aa, BK virus
HFANAIIF

SEQ ID NO: 20509 - protein, 8 aa, BK virus
FANAIIFA

SEQ ID NO: 20510 - protein, 8 aa, BK virus
ANAIIFAE

SEQ ID NO: 20511 - protein, 8 aa, BK virus
NAIIFAES

SEQ ID NO: 20512 - protein, 8 aa, BK virus
AIIFAESK

SEQ ID NO: 20513 - protein, 8 aa, BK virus
IIFAESKN

SEQ ID NO: 20514 - protein, 8 aa, BK virus
IFAESKNQ

SEQ ID NO: 20515 - protein, 8 aa, BK virus
FAESKNQK

SEQ ID NO: 20516 - protein, 8 aa, BK virus
AESKNQKS

SEQ ID NO: 20517 - protein, 8 aa, BK virus
ESKNQKSI

SEQ ID NO: 20518 - protein, 8 aa, BK virus
SKNQKSIC

SEQ ID NO: 20519 - protein, 8 aa, BK virus
KNQKSICQ

SEQ ID NO: 20520 - protein, 8 aa, BK virus
NQKSICQQ

SEQ ID NO: 20521 - protein, 8 aa, BK virus
QKSICQQA

SEQ ID NO: 20522 - protein, 8 aa, BK virus
KSICQQAV

SEQ ID NO: 20523 - protein, 8 aa, BK virus
SICQQAVD

SEQ ID NO: 20524 - protein, 8 aa, BK virus
ICQQAVDT

SEQ ID NO: 20525 - protein, 8 aa, BK virus
CQQAVDTV

SEQ ID NO: 20526 - protein, 8 aa, BK virus
QQAVDTVL

SEQ ID NO: 20527 - protein, 8 aa, BK virus
QAVDTVLA

SEQ ID NO: 20528 - protein, 8 aa, BK virus
AVDTVLAK

SEQ ID NO: 20529 - protein, 8 aa, BK virus
VDTVLAKK

SEQ ID NO: 20530 - protein, 8 aa, BK virus
DTVLAKKR

SEQ ID NO: 20531 - protein, 8 aa, BK virus
TVLAKKRV

SEQ ID NO: 20532 - protein, 8 aa, BK virus
VLAKKRVD

SEQ ID NO: 20533 - protein, 8 aa, BK virus
LAKKRVDT

SEQ ID NO: 20534 - protein, 8 aa, BK virus
AKKRVDTL

SEQ ID NO: 20535 - protein, 8 aa, BK virus
KKRVDTLH

SEQ ID NO: 20536 - protein, 8 aa, BK virus
KRVDTLHM

SEQ ID NO: 20537 - protein, 8 aa, BK virus
RVDTLHMT

SEQ ID NO: 20538 - protein, 8 aa, BK virus
VDTLHMTR

SEQ ID NO: 20539 - protein, 8 aa, BK virus
DTLHMTRE

SEQ ID NO: 20540 - protein, 8 aa, BK virus
TLHMTREE

SEQ ID NO: 20541 - protein, 8 aa, BK virus
LHMTREEM

SEQ ID NO: 20542 - protein, 8 aa, BK virus
HMTREEML

SEQ ID NO: 20543 - protein, 8 aa, BK virus
MTREEMLT

SEQ ID NO: 20544 - protein, 8 aa, BK virus
TREEMLTE

SEQ ID NO: 20545 - protein, 8 aa, BK virus
REEMLTER

SEQ ID NO: 20546 - protein, 8 aa, BK virus
EEMLTERF

SEQ ID NO: 20547 - protein, 8 aa, BK virus
EMLTERFN

SEQ ID NO: 20548 - protein, 8 aa, BK virus
MLTERFNH

SEQ ID NO: 20549 - protein, 8 aa, BK virus
LTERFNHI

SEQ ID NO: 20550 - protein, 8 aa, BK virus
TERFNHIL

SEQ ID NO: 20551 - protein, 8 aa, BK virus
ERFNHILD

SEQ ID NO: 20552 - protein, 8 aa, BK virus
RFNHILDK

SEQ ID NO: 20553 - protein, 8 aa, BK virus
FNHILDKM

SEQ ID NO: 20554 - protein, 8 aa, BK virus
NHILDKMD

SEQ ID NO: 20555 - protein, 8 aa, BK virus
HILDKMDL

SEQ ID NO: 20556 - protein, 8 aa, BK virus
ILDKMDLI

SEQ ID NO: 20557 - protein, 8 aa, BK virus
LDKMDLIF

SEQ ID NO: 20558 - protein, 8 aa, BK virus
DKMDLIFG

SEQ ID NO: 20559 - protein, 8 aa, BK virus
KMDLIFGA

SEQ ID NO: 20560 - protein, 8 aa, BK virus
MDLIFGAH

SEQ ID NO: 20561 - protein, 8 aa, BK virus
DLIFGAHG

SEQ ID NO: 20562 - protein, 8 aa, BK virus
LIFGAHGN

SEQ ID NO: 20563 - protein, 8 aa, BK virus
IFGAHGNA

SEQ ID NO: 20564 - protein, 8 aa, BK virus
FGAHGNAV

SEQ ID NO: 20565 - protein, 8 aa, BK virus
GAHGNAVL

SEQ ID NO: 20566 - protein, 8 aa, BK virus
AHGNAVLE

SEQ ID NO: 20567 - protein, 8 aa, BK virus
HGNAVLEQ

SEQ ID NO: 20568 - protein, 8 aa, BK virus
GNAVLEQY

SEQ ID NO: 20569 - protein, 8 aa, BK virus
NAVLEQYM

SEQ ID NO: 20570 - protein, 8 aa, BK virus
AVLEQYMA

SEQ ID NO: 20571 - protein, 8 aa, BK virus
VLEQYMAG

SEQ ID NO: 20572 - protein, 8 aa, BK virus
LEQYMAGV

SEQ ID NO: 20573 - protein, 8 aa, BK virus
EQYMAGVA

SEQ ID NO: 20574 - protein, 8 aa, BK virus
QYMAGVAW

SEQ ID NO: 20575 - protein, 8 aa, BK virus
YMAGVAWL

SEQ ID NO: 20576 - protein, 8 aa, BK virus
MAGVAWLH

SEQ ID NO: 20577 - protein, 8 aa, BK virus
AGVAWLHC

SEQ ID NO: 20578 - protein, 8 aa, BK virus
GVAWLHCL

SEQ ID NO: 20579 - protein, 8 aa, BK virus
VAWLHCLL

SEQ ID NO: 20580 - protein, 8 aa, BK virus
AWLHCLLP

SEQ ID NO: 20581 - protein, 8 aa, BK virus
WLHCLLPK

SEQ ID NO: 20582 - protein, 8 aa, BK virus
LHCLLPKM

SEQ ID NO: 20583 - protein, 8 aa, BK virus
HCLLPKMD

SEQ ID NO: 20584 - protein, 8 aa, BK virus
CLLPKMDS

SEQ ID NO: 20585 - protein, 8 aa, BK virus
LLPKMDSV

SEQ ID NO: 20586 - protein, 8 aa, BK virus
LPKMDSVI

SEQ ID NO: 20587 - protein, 8 aa, BK virus
PKMDSVIF

SEQ ID NO: 20588 - protein, 8 aa, BK virus
KMDSVIFD

SEQ ID NO: 20589 - protein, 8 aa, BK virus
MDSVIFDF

SEQ ID NO: 20590 - protein, 8 aa, BK virus
DSVIFDFL

SEQ ID NO: 20591 - protein, 8 aa, BK virus
SVIFDFLH

SEQ ID NO: 20592 - protein, 8 aa, BK virus
VIFDFLHC

SEQ ID NO: 20593 - protein, 8 aa, BK virus
IFDFLHCI

SEQ ID NO: 20594 - protein, 8 aa, BK virus
FDFLHCIV

SEQ ID NO: 20595 - protein, 8 aa, BK virus
DFLHCIVF

SEQ ID NO: 20596 - protein, 8 aa, BK virus
FLHCIVFN

SEQ ID NO: 20597 - protein, 8 aa, BK virus
LHCIVFNV

SEQ ID NO: 20598 - protein, 8 aa, BK virus
HCIVFNVP

SEQ ID NO: 20599 - protein, 8 aa, BK virus
CIVFNVPK

SEQ ID NO: 20600 - protein, 8 aa, BK virus
IVFNVPKR

SEQ ID NO: 20601 - protein, 8 aa, BK virus
VFNVPKRR

SEQ ID NO: 20602 - protein, 8 aa, BK virus
FNVPKRRY

SEQ ID NO: 20603 - protein, 8 aa, BK virus
NVPKRRYW

SEQ ID NO: 20604 - protein, 8 aa, BK virus
VPKRRYWL

SEQ ID NO: 20605 - protein, 8 aa, BK virus
PKRRYWLF

SEQ ID NO: 20606 - protein, 8 aa, BK virus
KRRYWLFK

SEQ ID NO: 20607 - protein, 8 aa, BK virus
RRYWLFKG

SEQ ID NO: 20608 - protein, 8 aa, BK virus
RYWLFKGP

SEQ ID NO: 20609 - protein, 8 aa, BK virus
YWLFKGPI

SEQ ID NO: 20610 - protein, 8 aa, BK virus
WLFKGPID

SEQ ID NO: 20611 - protein, 8 aa, BK virus
LFKGPIDS

SEQ ID NO: 20612 - protein, 8 aa, BK virus
FKGPIDSG

SEQ ID NO: 20613 - protein, 8 aa, BK virus
KGPIDSGK

SEQ ID NO: 20614 - protein, 8 aa, BK virus
GPIDSGKT

SEQ ID NO: 20615 - protein, 8 aa, BK virus
PIDSGKTT

SEQ ID NO: 20616 - protein, 8 aa, BK virus
IDSGKTTL

SEQ ID NO: 20617 - protein, 8 aa, BK virus
DSGKTTLA

SEQ ID NO: 20618 - protein, 8 aa, BK virus
SGKTTLAA

SEQ ID NO: 20619 - protein, 8 aa, BK virus
GKTTLAAG

SEQ ID NO: 20620 - protein, 8 aa, BK virus
KTTLAAGL

SEQ ID NO: 20621 - protein, 8 aa, BK virus
TTLAAGLL

SEQ ID NO: 20622 - protein, 8 aa, BK virus
TLAAGLLD

SEQ ID NO: 20623 - protein, 8 aa, BK virus
LAAGLLDL

SEQ ID NO: 20624 - protein, 8 aa, BK virus
AAGLLDLC

SEQ ID NO: 20625 - protein, 8 aa, BK virus
AGLLDLCG

SEQ ID NO: 20626 - protein, 8 aa, BK virus
GLLDLCGG

SEQ ID NO: 20627 - protein, 8 aa, BK virus
LLDLCGGK

SEQ ID NO: 20628 - protein, 8 aa, BK virus
LDLCGGKA

SEQ ID NO: 20629 - protein, 8 aa, BK virus
DLCGGKAL

SEQ ID NO: 20630 - protein, 8 aa, BK virus
LCGGKALN

SEQ ID NO: 20631 - protein, 8 aa, BK virus
CGGKALNV

SEQ ID NO: 20632 - protein, 8 aa, BK virus
GGKALNVN

SEQ ID NO: 20633 - protein, 8 aa, BK virus
GKALNVNL

SEQ ID NO: 20634 - protein, 8 aa, BK virus
KALNVNLP

SEQ ID NO: 20635 - protein, 8 aa, BK virus
ALNVNLPM

SEQ ID NO: 20636 - protein, 8 aa, BK virus
LNVNLPME

SEQ ID NO: 20637 - protein, 8 aa, BK virus
NVNLPMER

SEQ ID NO: 20638 - protein, 8 aa, BK virus
VNLPMERL

SEQ ID NO: 20639 - protein, 8 aa, BK virus
NLPMERLT

SEQ ID NO: 20640 - protein, 8 aa, BK virus
LPMERLTF

SEQ ID NO: 20641 - protein, 8 aa, BK virus
PMERLTFE

SEQ ID NO: 20642 - protein, 8 aa, BK virus
MERLTFEL

SEQ ID NO: 20643 - protein, 8 aa, BK virus
ERLTFELG

SEQ ID NO: 20644 - protein, 8 aa, BK virus
RLTFELGV

SEQ ID NO: 20645 - protein, 8 aa, BK virus
LTFELGVA

SEQ ID NO: 20646 - protein, 8 aa, BK virus
TFELGVAI

SEQ ID NO: 20647 - protein, 8 aa, BK virus
FELGVAID

SEQ ID NO: 20648 - protein, 8 aa, BK virus
ELGVAIDQ

SEQ ID NO: 20649 - protein, 8 aa, BK virus
LGVAIDQY

SEQ ID NO: 20650 - protein, 8 aa, BK virus
GVAIDQYM

SEQ ID NO: 20651 - protein, 8 aa, BK virus
VAIDQYMV

SEQ ID NO: 20652 - protein, 8 aa, BK virus
AIDQYMVV

SEQ ID NO: 20653 - protein, 8 aa, BK virus
IDQYMVVF

SEQ ID NO: 20654 - protein, 8 aa, BK virus
DQYMVVFE

SEQ ID NO: 20655 - protein, 8 aa, BK virus
QYMVVFED

SEQ ID NO: 20656 - protein, 8 aa, BK virus
YMVVFEDV

SEQ ID NO: 20657 - protein, 8 aa, BK virus
MVVFEDVK

SEQ ID NO: 20658 - protein, 8 aa, BK virus
VVFEDVKG

SEQ ID NO: 20659 - protein, 8 aa, BK virus
VFEDVKGT

SEQ ID NO: 20660 - protein, 8 aa, BK virus
FEDVKGTG

SEQ ID NO: 20661 - protein, 8 aa, BK virus
EDVKGTGA

SEQ ID NO: 20662 - protein, 8 aa, BK virus
DVKGTGAE

SEQ ID NO: 20663 - protein, 8 aa, BK virus
VKGTGAES

SEQ ID NO: 20664 - protein, 8 aa, BK virus
KGTGAESK

SEQ ID NO: 20665 - protein, 8 aa, BK virus
GTGAESKD

SEQ ID NO: 20666 - protein, 8 aa, BK virus
TGAESKDL

SEQ ID NO: 20667 - protein, 8 aa, BK virus
GAESKDLP

SEQ ID NO: 20668 - protein, 8 aa, BK virus
AESKDLPS

SEQ ID NO: 20669 - protein, 8 aa, BK virus
ESKDLPSG

SEQ ID NO: 20670 - protein, 8 aa, BK virus
SKDLPSGH

SEQ ID NO: 20671 - protein, 8 aa, BK virus
KDLPSGHG

SEQ ID NO: 20672 - protein, 8 aa, BK virus
DLPSGHGI

SEQ ID NO: 20673 - protein, 8 aa, BK virus
LPSGHGIN

SEQ ID NO: 20674 - protein, 8 aa, BK virus
PSGHGINN

SEQ ID NO: 20675 - protein, 8 aa, BK virus
SGHGINNL

SEQ ID NO: 20676 - protein, 8 aa, BK virus
GHGINNLD

SEQ ID NO: 20677 - protein, 8 aa, BK virus
HGINNLDS

SEQ ID NO: 20678 - protein, 8 aa, BK virus
GINNLDSL

SEQ ID NO: 20679 - protein, 8 aa, BK virus
INNLDSLR

SEQ ID NO: 20680 - protein, 8 aa, BK virus
NNLDSLRD

SEQ ID NO: 20681 - protein, 8 aa, BK virus
NLDSLRDY

SEQ ID NO: 20682 - protein, 8 aa, BK virus
LDSLRDYL

SEQ ID NO: 20683 - protein, 8 aa, BK virus
DSLRDYLD

SEQ ID NO: 20684 - protein, 8 aa, BK virus
SLRDYLDG

SEQ ID NO: 20685 - protein, 8 aa, BK virus
LRDYLDGS

SEQ ID NO: 20686 - protein, 8 aa, BK virus
RDYLDGSV

SEQ ID NO: 20687 - protein, 8 aa, BK virus
DYLDGSVK

SEQ ID NO: 20688 - protein, 8 aa, BK virus
YLDGSVKV

SEQ ID NO: 20689 - protein, 8 aa, BK virus
LDGSVKVN

SEQ ID NO: 20690 - protein, 8 aa, BK virus
DGSVKVNL

SEQ ID NO: 20691 - protein, 8 aa, BK virus
GSVKVNLE

SEQ ID NO: 20692 - protein, 8 aa, BK virus
SVKVNLEK

SEQ ID NO: 20693 - protein, 8 aa, BK virus
VKVNLEKK

SEQ ID NO: 20694 - protein, 8 aa, BK virus
KVNLEKKH

SEQ ID NO: 20695 - protein, 8 aa, BK virus
VNLEKKHL

SEQ ID NO: 20696 - protein, 8 aa, BK virus
NLEKKHLN

SEQ ID NO: 20697 - protein, 8 aa, BK virus
LEKKHLNK

SEQ ID NO: 20698 - protein, 8 aa, BK virus
EKKHLNKR

SEQ ID NO: 20699 - protein, 8 aa, BK virus
KKHLNKRT

SEQ ID NO: 20700 - protein, 8 aa, BK virus
KHLNKRTQ

SEQ ID NO: 20701 - protein, 8 aa, BK virus
HLNKRTQI

SEQ ID NO: 20702 - protein, 8 aa, BK virus
LNKRTQIF

SEQ ID NO: 20703 - protein, 8 aa, BK virus
NKRTQIFP

SEQ ID NO: 20704 - protein, 8 aa, BK virus
KRTQIFPP

SEQ ID NO: 20705 - protein, 8 aa, BK virus
RTQIFPPG

SEQ ID NO: 20706 - protein, 8 aa, BK virus
TQIFPPGL

SEQ ID NO: 20707 - protein, 8 aa, BK virus
QIFPPGLV

SEQ ID NO: 20708 - protein, 8 aa, BK virus
IFPPGLVT

SEQ ID NO: 20709 - protein, 8 aa, BK virus
FPPGLVTM

SEQ ID NO: 20710 - protein, 8 aa, BK virus
PPGLVTMN

SEQ ID NO: 20711 - protein, 8 aa, BK virus
PGLVTMNE

SEQ ID NO: 20712 - protein, 8 aa, BK virus
GLVTMNEY

SEQ ID NO: 20713 - protein, 8 aa, BK virus
LVTMNEYP

SEQ ID NO: 20714 - protein, 8 aa, BK virus
VTMNEYPV

SEQ ID NO: 20715 - protein, 8 aa, BK virus
TMNEYPVP

SEQ ID NO: 20716 - protein, 8 aa, BK virus
MNEYPVPK

SEQ ID NO: 20717 - protein, 8 aa, BK virus
NEYPVPKT

SEQ ID NO: 20718 - protein, 8 aa, BK virus
EYPVPKTL

SEQ ID NO: 20719 - protein, 8 aa, BK virus
YPVPKTLQ

SEQ ID NO: 20720 - protein, 8 aa, BK virus
PVPKTLQA

SEQ ID NO: 20721 - protein, 8 aa, BK virus
VPKTLQAR

SEQ ID NO: 20722 - protein, 8 aa, BK virus
PKTLQARF

SEQ ID NO: 20723 - protein, 8 aa, BK virus
KTLQARFV

SEQ ID NO: 20724 - protein, 8 aa, BK virus
TLQARFVR

SEQ ID NO: 20725 - protein, 8 aa, BK virus
LQARFVRQ

SEQ ID NO: 20726 - protein, 8 aa, BK virus
QARFVRQI

SEQ ID NO: 20727 - protein, 8 aa, BK virus
ARFVRQID

SEQ ID NO: 20728 - protein, 8 aa, BK virus
RFVRQIDF

SEQ ID NO: 20729 - protein, 8 aa, BK virus
FVRQIDFR

SEQ ID NO: 20730 - protein, 8 aa, BK virus
VRQIDFRP

SEQ ID NO: 20731 - protein, 8 aa, BK virus
RQIDFRPK

SEQ ID NO: 20732 - protein, 8 aa, BK virus
QIDFRPKI

SEQ ID NO: 20733 - protein, 8 aa, BK virus
IDFRPKIY

SEQ ID NO: 20734 - protein, 8 aa, BK virus
DFRPKIYL

SEQ ID NO: 20735 - protein, 8 aa, BK virus
FRPKIYLR

SEQ ID NO: 20736 - protein, 8 aa, BK virus
RPKIYLRK

SEQ ID NO: 20737 - protein, 8 aa, BK virus
PKIYLRKS

SEQ ID NO: 20738 - protein, 8 aa, BK virus
KIYLRKSL

SEQ ID NO: 20739 - protein, 8 aa, BK virus
IYLRKSLQ

SEQ ID NO: 20740 - protein, 8 aa, BK virus
YLRKSLQN

SEQ ID NO: 20741 - protein, 8 aa, BK virus
LRKSLQNS

SEQ ID NO: 20742 - protein, 8 aa, BK virus
RKSLQNSE

SEQ ID NO: 20743 - protein, 8 aa, BK virus
KSLQNSEF

SEQ ID NO: 20744 - protein, 8 aa, BK virus
SLQNSEFL

SEQ ID NO: 20745 - protein, 8 aa, BK virus
LQNSEFLL

SEQ ID NO: 20746 - protein, 8 aa, BK virus
QNSEFLLE

SEQ ID NO: 20747 - protein, 8 aa, BK virus
NSEFLLEK

SEQ ID NO: 20748 - protein, 8 aa, BK virus
SEFLLEKR

SEQ ID NO: 20749 - protein, 8 aa, BK virus
EFLLEKRI

SEQ ID NO: 20750 - protein, 8 aa, BK virus
FLLEKRIL

SEQ ID NO: 20751 - protein, 8 aa, BK virus
LLEKRILQ

SEQ ID NO: 20752 - protein, 8 aa, BK virus
LEKRILQS

SEQ ID NO: 20753 - protein, 8 aa, BK virus
EKRILQSG

SEQ ID NO: 20754 - protein, 8 aa, BK virus
KRILQSGM

SEQ ID NO: 20755 - protein, 8 aa, BK virus
RILQSGMT

SEQ ID NO: 20756 - protein, 8 aa, BK virus
ILQSGMTL

SEQ ID NO: 20757 - protein, 8 aa, BK virus
LQSGMTLL

SEQ ID NO: 20758 - protein, 8 aa, BK virus
QSGMTLLL

SEQ ID NO: 20759 - protein, 8 aa, BK virus
SGMTLLLL

SEQ ID NO: 20760 - protein, 8 aa, BK virus
GMTLLLLL

SEQ ID NO: 20761 - protein, 8 aa, BK virus
MTLLLLLI

SEQ ID NO: 20762 - protein, 8 aa, BK virus
TLLLLLIW

SEQ ID NO: 20763 - protein, 8 aa, BK virus
LLLLLIWF

SEQ ID NO: 20764 - protein, 8 aa, BK virus
LLLLIWFR

SEQ ID NO: 20765 - protein, 8 aa, BK virus
LLLIWFRP

SEQ ID NO: 20766 - protein, 8 aa, BK virus
LLIWFRPV

SEQ ID NO: 20767 - protein, 8 aa, BK virus
LIWFRPVA

SEQ ID NO: 20768 - protein, 8 aa, BK virus
IWFRPVAD

SEQ ID NO: 20769 - protein, 8 aa, BK virus
WFRPVADF

SEQ ID NO: 20770 - protein, 8 aa, BK virus
FRPVADFA

SEQ ID NO: 20771 - protein, 8 aa, BK virus
RPVADFAT

SEQ ID NO: 20772 - protein, 8 aa, BK virus
PVADFATD

SEQ ID NO: 20773 - protein, 8 aa, BK virus
VADFATDI

SEQ ID NO: 20774 - protein, 8 aa, BK virus
ADFATDIQ

SEQ ID NO: 20775 - protein, 8 aa, BK virus
DFATDIQS

SEQ ID NO: 20776 - protein, 8 aa, BK virus
FATDIQSR

SEQ ID NO: 20777 - protein, 8 aa, BK virus
ATDIQSRI

SEQ ID NO: 20778 - protein, 8 aa, BK virus
TDIQSRIV

SEQ ID NO: 20779 - protein, 8 aa, BK virus
DIQSRIVE

SEQ ID NO: 20780 - protein, 8 aa, BK virus
IQSRIVEW

SEQ ID NO: 20781 - protein, 8 aa, BK virus
QSRIVEWK

SEQ ID NO: 20782 - protein, 8 aa, BK virus
SRIVEWKE

SEQ ID NO: 20783 - protein, 8 aa, BK virus
RIVEWKER

SEQ ID NO: 20784 - protein, 8 aa, BK virus
IVEWKERL

SEQ ID NO: 20785 - protein, 8 aa, BK virus
VEWKERLD

SEQ ID NO: 20786 - protein, 8 aa, BK virus
EWKERLDS

SEQ ID NO: 20787 - protein, 8 aa, BK virus
WKERLDSE

SEQ ID NO: 20788 - protein, 8 aa, BK virus
KERLDSEI

SEQ ID NO: 20789 - protein, 8 aa, BK virus
ERLDSEIS

SEQ ID NO: 20790 - protein, 8 aa, BK virus
RLDSEISM

SEQ ID NO: 20791 - protein, 8 aa, BK virus
LDSEISMY

SEQ ID NO: 20792 - protein, 8 aa, BK virus
DSEISMYT

SEQ ID NO: 20793 - protein, 8 aa, BK virus
SEISMYTF

SEQ ID NO: 20794 - protein, 8 aa, BK virus
EISMYTFS

SEQ ID NO: 20795 - protein, 8 aa, BK virus
ISMYTFSR

SEQ ID NO: 20796 - protein, 8 aa, BK virus
SMYTFSRM

SEQ ID NO: 20797 - protein, 8 aa, BK virus
MYTFSRMK

SEQ ID NO: 20798 - protein, 8 aa, BK virus
YTFSRMKY

SEQ ID NO: 20799 - protein, 8 aa, BK virus
TFSRMKYN

SEQ ID NO: 20800 - protein, 8 aa, BK virus
FSRMKYNI

SEQ ID NO: 20801 - protein, 8 aa, BK virus
SRMKYNIC

SEQ ID NO: 20802 - protein, 8 aa, BK virus
RMKYNICM

SEQ ID NO: 20803 - protein, 8 aa, BK virus
MKYNICMG

SEQ ID NO: 20804 - protein, 8 aa, BK virus
KYNICMGK

SEQ ID NO: 20805 - protein, 8 aa, BK virus
YNICMGKC

SEQ ID NO: 20806 - protein, 8 aa, BK virus
NICMGKCI

SEQ ID NO: 20807 - protein, 8 aa, BK virus
ICMGKCIL

SEQ ID NO: 20808 - protein, 8 aa, BK virus
CMGKCILD

SEQ ID NO: 20809 - protein, 8 aa, BK virus
MGKCILDI

SEQ ID NO: 20810 - protein, 8 aa, BK virus
GKCILDIT

SEQ ID NO: 20811 - protein, 8 aa, BK virus
KCILDITR

SEQ ID NO: 20812 - protein, 8 aa, BK virus
CILDITRE

SEQ ID NO: 20813 - protein, 8 aa, BK virus
ILDITREE

SEQ ID NO: 20814 - protein, 8 aa, BK virus
LDITREED

SEQ ID NO: 20815 - protein, 8 aa, BK virus
DITREEDS

SEQ ID NO: 20816 - protein, 8 aa, BK virus
ITREEDSE

SEQ ID NO: 20817 - protein, 8 aa, BK virus
TREEDSET

SEQ ID NO: 20818 - protein, 8 aa, BK virus
REEDSETE

SEQ ID NO: 20819 - protein, 8 aa, BK virus
EEDSETED

SEQ ID NO: 20820 - protein, 8 aa, BK virus
EDSETEDS

SEQ ID NO: 20821 - protein, 8 aa, BK virus
DSETEDSG

SEQ ID NO: 20822 - protein, 8 aa, BK virus
SETEDSGH

SEQ ID NO: 20823 - protein, 8 aa, BK virus
ETEDSGHG

SEQ ID NO: 20824 - protein, 8 aa, BK virus
TEDSGHGS

SEQ ID NO: 20825 - protein, 8 aa, BK virus
EDSGHGSS

SEQ ID NO: 20826 - protein, 8 aa, BK virus
DSGHGSST

SEQ ID NO: 20827 - protein, 8 aa, BK virus
SGHGSSTE

SEQ ID NO: 20828 - protein, 8 aa, BK virus
GHGSSTES

SEQ ID NO: 20829 - protein, 8 aa, BK virus
HGSSTESQ

SEQ ID NO: 20830 - protein, 8 aa, BK virus
GSSTESQS

SEQ ID NO: 20831 - protein, 8 aa, BK virus
SSTESQSQ

SEQ ID NO: 20832 - protein, 8 aa, BK virus
STESQSQC

SEQ ID NO: 20833 - protein, 8 aa, BK virus
TESQSQCS

SEQ ID NO: 20834 - protein, 8 aa, BK virus
ESQSQCSS

SEQ ID NO: 20835 - protein, 8 aa, BK virus
SQSQCSSQ

SEQ ID NO: 20836 - protein, 8 aa, BK virus
QSQCSSQV

SEQ ID NO: 20837 - protein, 8 aa, BK virus
SQCSSQVS

SEQ ID NO: 20838 - protein, 8 aa, BK virus
QCSSQVSD

SEQ ID NO: 20839 - protein, 8 aa, BK virus
CSSQVSDT

SEQ ID NO: 20840 - protein, 8 aa, BK virus
SSQVSDTS

SEQ ID NO: 20841 - protein, 8 aa, BK virus
SQVSDTSA

SEQ ID NO: 20842 - protein, 8 aa, BK virus
QVSDTSAP

SEQ ID NO: 20843 - protein, 8 aa, BK virus
VSDTSAPA

SEQ ID NO: 20844 - protein, 8 aa, BK virus
SDTSAPAE

SEQ ID NO: 20845 - protein, 8 aa, BK virus
DTSAPAED

SEQ ID NO: 20846 - protein, 8 aa, BK virus
TSAPAEDS

SEQ ID NO: 20847 - protein, 8 aa, BK virus
SAPAEDSQ

SEQ ID NO: 20848 - protein, 8 aa, BK virus
APAEDSQR

SEQ ID NO: 20849 - protein, 8 aa, BK virus
PAEDSQRS

SEQ ID NO: 20850 - protein, 8 aa, BK virus
AEDSQRSD

SEQ ID NO: 20851 - protein, 8 aa, BK virus
EDSQRSDP

SEQ ID NO: 20852 - protein, 8 aa, BK virus
DSQRSDPH

SEQ ID NO: 20853 - protein, 8 aa, BK virus
SQRSDPHS

SEQ ID NO: 20854 - protein, 8 aa, BK virus
QRSDPHSQ

SEQ ID NO: 20855 - protein, 8 aa, BK virus
RSDPHSQE

SEQ ID NO: 20856 - protein, 8 aa, BK virus
SDPHSQEL

SEQ ID NO: 20857 - protein, 8 aa, BK virus
DPHSQELH

SEQ ID NO: 20858 - protein, 8 aa, BK virus
PHSQELHL

SEQ ID NO: 20859 - protein, 8 aa, BK virus
HSQELHLC

SEQ ID NO: 20860 - protein, 8 aa, BK virus
SQELHLCK

SEQ ID NO: 20861 - protein, 8 aa, BK virus
QELHLCKG

SEQ ID NO: 20862 - protein, 8 aa, BK virus
ELHLCKGF

SEQ ID NO: 20863 - protein, 8 aa, BK virus
LHLCKGFQ

SEQ ID NO: 20864 - protein, 8 aa, BK virus
HLCKGFQC

SEQ ID NO: 20865 - protein, 8 aa, BK virus
LCKGFQCF

SEQ ID NO: 20866 - protein, 8 aa, BK virus
CKGFQCFK

SEQ ID NO: 20867 - protein, 8 aa, BK virus
KGFQCFKR

SEQ ID NO: 20868 - protein, 8 aa, BK virus
GFQCFKRP

SEQ ID NO: 20869 - protein, 8 aa, BK virus
FQCFKRPK

SEQ ID NO: 20870 - protein, 8 aa, BK virus
QCFKRPKT

SEQ ID NO: 20871 - protein, 8 aa, BK virus
CFKRPKTP

SEQ ID NO: 20872 - protein, 8 aa, BK virus
FKRPKTPP

SEQ ID NO: 20873 - protein, 8 aa, BK virus
KRPKTPPP

SEQ ID NO: 20874 - protein, 8 aa, BK virus
RPKTPPPK

SEQ ID NO: 20875 - protein, 8 aa, BK virus
HKLKSGLY

SEQ ID NO: 20876 - protein, 8 aa, BK virus
KLKSGLYK

SEQ ID NO: 20877 - protein, 8 aa, BK virus
LKSGLYKS

SEQ ID NO: 20878 - protein, 8 aa, BK virus
KSGLYKSS

SEQ ID NO: 20879 - protein, 8 aa, BK virus
SGLYKSSI

SEQ ID NO: 20880 - protein, 8 aa, BK virus
GLYKSSIY

SEQ ID NO: 20881 - protein, 8 aa, BK virus
MYMYNKST

SEQ ID NO: 20882 - protein, 8 aa, BK virus
YMYNKSTC

SEQ ID NO: 20883 - protein, 8 aa, BK virus
MYNKSTCL

SEQ ID NO: 20884 - protein, 8 aa, BK virus
YNKSTCLK

SEQ ID NO: 20885 - protein, 8 aa, BK virus
NKSTCLKH

SEQ ID NO: 20886 - protein, 8 aa, BK virus
KSTCLKHF

SEQ ID NO: 20887 - protein, 8 aa, BK virus
STCLKHFG

SEQ ID NO: 20888 - protein, 8 aa, BK virus
TCLKHFGL

SEQ ID NO: 20889 - protein, 8 aa, BK virus
CLKHFGLQ

SEQ ID NO: 20890 - protein, 8 aa, BK virus
LKHFGLQL

SEQ ID NO: 20891 - protein, 8 aa, BK virus
KHFGLQLS

SEQ ID NO: 20892 - protein, 8 aa, BK virus
HFGLQLSL

SEQ ID NO: 20893 - protein, 8 aa, BK virus
FGLQLSLF

SEQ ID NO: 20894 - protein, 8 aa, BK virus
GLQLSLFV

SEQ ID NO: 20895 - protein, 8 aa, BK virus
LQLSLFVN

SEQ ID NO: 20896 - protein, 8 aa, BK virus
QLSLFVNI

SEQ ID NO: 20897 - protein, 8 aa, BK virus
LSLFVNIS

SEQ ID NO: 20898 - protein, 8 aa, BK virus
SLFVNISY

SEQ ID NO: 20899 - protein, 8 aa, BK virus
LFVNISYH

SEQ ID NO: 20900 - protein, 8 aa, BK virus
FVNISYHI

SEQ ID NO: 20901 - protein, 8 aa, BK virus
VNISYHIW

SEQ ID NO: 20902 - protein, 8 aa, BK virus
NISYHIWV

SEQ ID NO: 20903 - protein, 8 aa, BK virus
ISYHIWVP

SEQ ID NO: 20904 - protein, 8 aa, BK virus
SYHIWVPW

SEQ ID NO: 20905 - protein, 8 aa, BK virus
YHIWVPWK

SEQ ID NO: 20906 - protein, 8 aa, BK virus
HIWVPWKS

SEQ ID NO: 20907 - protein, 8 aa, BK virus
IWVPWKSF

SEQ ID NO: 20908 - protein, 8 aa, BK virus
WVPWKSFC

SEQ ID NO: 20909 - protein, 8 aa, BK virus
VPWKSFCA

SEQ ID NO: 20910 - protein, 8 aa, BK virus
PWKSFCAI

SEQ ID NO: 20911 - protein, 8 aa, BK virus
WKSFCAIK

SEQ ID NO: 20912 - protein, 8 aa, BK virus
KSFCAIKH

SEQ ID NO: 20913 - protein, 8 aa, BK virus
SFCAIKHP

SEQ ID NO: 20914 - protein, 8 aa, BK virus
FCAIKHPN

SEQ ID NO: 20915 - protein, 8 aa, BK virus
CAIKHPNL

SEQ ID NO: 20916 - protein, 8 aa, BK virus
AIKHPNLF

SEQ ID NO: 20917 - protein, 8 aa, BK virus
IKHPNLFY

SEQ ID NO: 20918 - protein, 8 aa, BK virus
KHPNLFYL

SEQ ID NO: 20919 - protein, 8 aa, BK virus
HPNLFYLG

SEQ ID NO: 20920 - protein, 8 aa, BK virus
PNLFYLGF

SEQ ID NO: 20921 - protein, 8 aa, BK virus
NLFYLGFH

SEQ ID NO: 20922 - protein, 8 aa, BK virus
LFYLGFHT

SEQ ID NO: 20923 - protein, 8 aa, BK virus
FYLGFHTI

SEQ ID NO: 20924 - protein, 8 aa, BK virus
YLGFHTIH

SEQ ID NO: 20925 - protein, 8 aa, BK virus
LGFHTIHR

SEQ ID NO: 20926 - protein, 8 aa, BK virus
GFHTIHRL

SEQ ID NO: 20927 - protein, 8 aa, BK virus
FHTIHRLP

SEQ ID NO: 20928 - protein, 8 aa, BK virus
HTIHRLPI

SEQ ID NO: 20929 - protein, 8 aa, BK virus
TIHRLPIH

SEQ ID NO: 20930 - protein, 8 aa, BK virus
IHRLPIHS

SEQ ID NO: 20931 - protein, 8 aa, BK virus
HRLPIHSL

SEQ ID NO: 20932 - protein, 8 aa, BK virus
RLPIHSLG

SEQ ID NO: 20933 - protein, 8 aa, BK virus
LPIHSLGS

SEQ ID NO: 20934 - protein, 8 aa, BK virus
PIHSLGSP

SEQ ID NO: 20935 - protein, 8 aa, BK virus
IHSLGSPV

SEQ ID NO: 20936 - protein, 8 aa, BK virus
HSLGSPVY

SEQ ID NO: 20937 - protein, 8 aa, BK virus
SLGSPVYK

SEQ ID NO: 20938 - protein, 8 aa, BK virus
LGSPVYKV

SEQ ID NO: 20939 - protein, 8 aa, BK virus
GSPVYKVT

SEQ ID NO: 20940 - protein, 8 aa, BK virus
QKGNWVRI

SEQ ID NO: 20941 - protein, 8 aa, BK virus
KGNWVRIL

SEQ ID NO: 20942 - protein, 8 aa, BK virus
GNWVRILY

SEQ ID NO: 20943 - protein, 8 aa, BK virus
NWVRILYR

SEQ ID NO: 20944 - protein, 8 aa, BK virus
WVRILYRS

SEQ ID NO: 20945 - protein, 8 aa, BK virus
VRILYRSF

SEQ ID NO: 20946 - protein, 8 aa, BK virus
RILYRSFS

SEQ ID NO: 20947 - protein, 8 aa, BK virus
ILYRSFSQ

SEQ ID NO: 20948 - protein, 8 aa, BK virus
LYRSFSQA

SEQ ID NO: 20949 - protein, 8 aa, BK virus
YRSFSQAD

SEQ ID NO: 20950 - protein, 8 aa, BK virus
RSFSQADL

SEQ ID NO: 20951 - protein, 8 aa, BK virus
SFSQADLK

SEQ ID NO: 20952 - protein, 8 aa, BK virus
FSQADLKI

SEQ ID NO: 20953 - protein, 8 aa, BK virus
SQADLKIS

SEQ ID NO: 20954 - protein, 8 aa, BK virus
QADLKISC

SEQ ID NO: 20955 - protein, 8 aa, BK virus
ADLKISCK

SEQ ID NO: 20956 - protein, 8 aa, BK virus
DLKISCKA

SEQ ID NO: 20957 - protein, 8 aa, BK virus
LKISCKAS

SEQ ID NO: 20958 - protein, 8 aa, BK virus
KISCKASP

SEQ ID NO: 20959 - protein, 8 aa, BK virus
ISCKASPL

SEQ ID NO: 20960 - protein, 8 aa, BK virus
SCKASPLL

SEQ ID NO: 20961 - protein, 8 aa, BK virus
CKASPLLC

SEQ ID NO: 20962 - protein, 8 aa, BK virus
KASPLLCS

SEQ ID NO: 20963 - protein, 8 aa, BK virus
ASPLLCSR

SEQ ID NO: 20964 - protein, 8 aa, BK virus
SPLLCSRA

SEQ ID NO: 20965 - protein, 8 aa, BK virus
PLLCSRAV

SEQ ID NO: 20966 - protein, 8 aa, BK virus
LLCSRAVS

SEQ ID NO: 20967 - protein, 8 aa, BK virus
LCSRAVSK

SEQ ID NO: 20968 - protein, 8 aa, BK virus
CSRAVSKQ

SEQ ID NO: 20969 - protein, 8 aa, BK virus
SRAVSKQA

SEQ ID NO: 20970 - protein, 8 aa, BK virus
RAVSKQAT

SEQ ID NO: 20971 - protein, 8 aa, BK virus
AVSKQATN

SEQ ID NO: 20972 - protein, 8 aa, BK virus
VSKQATNI

SEQ ID NO: 20973 - protein, 8 aa, BK virus
SKQATNIS

SEQ ID NO: 20974 - protein, 8 aa, BK virus
KQATNISS

SEQ ID NO: 20975 - protein, 8 aa, BK virus
NIQAISFT

SEQ ID NO: 20976 - protein, 8 aa, BK virus
IQAISFTK

SEQ ID NO: 20977 - protein, 8 aa, BK virus
QAISFTKR

SEQ ID NO: 20978 - protein, 8 aa, BK virus
AISFTKRP

SEQ ID NO: 20979 - protein, 8 aa, BK virus
ISFTKRPH

SEQ ID NO: 20980 - protein, 8 aa, BK virus
SFTKRPHT

SEQ ID NO: 20981 - protein, 8 aa, BK virus
FTKRPHTL

SEQ ID NO: 20982 - protein, 8 aa, BK virus
TKRPHTLF

SEQ ID NO: 20983 - protein, 8 aa, BK virus
KRPHTLFI

SEQ ID NO: 20984 - protein, 8 aa, BK virus
QHCGSCVG

SEQ ID NO: 20985 - protein, 8 aa, BK virus
HCGSCVGH

SEQ ID NO: 20986 - protein, 8 aa, BK virus
CGSCVGHM

SEQ ID NO: 20987 - protein, 8 aa, BK virus
GSCVGHMK

SEQ ID NO: 20988 - protein, 8 aa, BK virus
SCVGHMKY

SEQ ID NO: 20989 - protein, 8 aa, BK virus
CVGHMKYW

SEQ ID NO: 20990 - protein, 8 aa, BK virus
VGHMKYWG

SEQ ID NO: 20991 - protein, 8 aa, BK virus
GHMKYWGN

SEQ ID NO: 20992 - protein, 8 aa, BK virus
HMKYWGNI

SEQ ID NO: 20993 - protein, 8 aa, BK virus
MKYWGNIF

SEQ ID NO: 20994 - protein, 8 aa, BK virus
KYWGNIFP

SEQ ID NO: 20995 - protein, 8 aa, BK virus
YWGNIFPS

SEQ ID NO: 20996 - protein, 8 aa, BK virus
WGNIFPSC

SEQ ID NO: 20997 - protein, 8 aa, BK virus
GNIFPSCE

SEQ ID NO: 20998 - protein, 8 aa, BK virus
NIFPSCES

SEQ ID NO: 20999 - protein, 8 aa, BK virus
IFPSCESP

SEQ ID NO: 21000 - protein, 8 aa, BK virus
FPSCESPK

SEQ ID NO: 21001 - protein, 8 aa, BK virus
PSCESPKI

SEQ ID NO: 21002 - protein, 8 aa, BK virus
SCESPKIP

SEQ ID NO: 21003 - protein, 8 aa, BK virus
CESPKIPS

SEQ ID NO: 21004 - protein, 8 aa, BK virus
ESPKIPSI

SEQ ID NO: 21005 - protein, 8 aa, BK virus
SPKIPSIF

SEQ ID NO: 21006 - protein, 8 aa, BK virus
PKIPSIFI

SEQ ID NO: 21007 - protein, 8 aa, BK virus
KIPSIFIS

SEQ ID NO: 21008 - protein, 8 aa, BK virus
IPSIFIST

SEQ ID NO: 21009 - protein, 8 aa, BK virus
PSIFISTG

SEQ ID NO: 21010 - protein, 8 aa, BK virus
SIFISTGI

SEQ ID NO: 21011 - protein, 8 aa, BK virus
IFISTGIR

SEQ ID NO: 21012 - protein, 8 aa, BK virus
FISTGIRY

SEQ ID NO: 21013 - protein, 8 aa, BK virus
ISTGIRYP

SEQ ID NO: 21014 - protein, 8 aa, BK virus
STGIRYPA

SEQ ID NO: 21015 - protein, 8 aa, BK virus
TGIRYPAL

SEQ ID NO: 21016 - protein, 8 aa, BK virus
GIRYPALN

SEQ ID NO: 21017 - protein, 8 aa, BK virus
IRYPALNW

SEQ ID NO: 21018 - protein, 8 aa, BK virus
RYPALNWI

SEQ ID NO: 21019 - protein, 8 aa, BK virus
YPALNWIS

SEQ ID NO: 21020 - protein, 8 aa, BK virus
PALNWISI

SEQ ID NO: 21021 - protein, 8 aa, BK virus
ALNWISIV

SEQ ID NO: 21022 - protein, 8 aa, BK virus
LNWISIVF

SEQ ID NO: 21023 - protein, 8 aa, BK virus
NWISIVFV

SEQ ID NO: 21024 - protein, 8 aa, BK virus
WISIVFVQ

SEQ ID NO: 21025 - protein, 8 aa, BK virus
ISIVFVQI

SEQ ID NO: 21026 - protein, 8 aa, BK virus
SIVFVQIG

SEQ ID NO: 21027 - protein, 8 aa, BK virus
IVFVQIGL

SEQ ID NO: 21028 - protein, 8 aa, BK virus
VFVQIGLM

SEQ ID NO: 21029 - protein, 8 aa, BK virus
FVQIGLMV

SEQ ID NO: 21030 - protein, 8 aa, BK virus
VQIGLMVS

SEQ ID NO: 21031 - protein, 8 aa, BK virus
QIGLMVSI

SEQ ID NO: 21032 - protein, 8 aa, BK virus
IGLMVSIH

SEQ ID NO: 21033 - protein, 8 aa, BK virus
GLMVSIHY

SEQ ID NO: 21034 - protein, 8 aa, BK virus
LMVSIHYL

SEQ ID NO: 21035 - protein, 8 aa, BK virus
MVSIHYLG

SEQ ID NO: 21036 - protein, 8 aa, BK virus
VSIHYLGL

SEQ ID NO: 21037 - protein, 8 aa, BK virus
SIHYLGLG

SEQ ID NO: 21038 - protein, 8 aa, BK virus
IHYLGLGC

SEQ ID NO: 21039 - protein, 8 aa, BK virus
HYLGLGCW

SEQ ID NO: 21040 - protein, 8 aa, BK virus
YLGLGCWV

SEQ ID NO: 21041 - protein, 8 aa, BK virus
LGLGCWVF

SEQ ID NO: 21042 - protein, 8 aa, BK virus
GLGCWVFR

SEQ ID NO: 21043 - protein, 8 aa, BK virus
LGCWVFRG

SEQ ID NO: 21044 - protein, 8 aa, BK virus
GCWVFRGY

SEQ ID NO: 21045 - protein, 8 aa, BK virus
CWVFRGYS

SEQ ID NO: 21046 - protein, 8 aa, BK virus
WVFRGYST

SEQ ID NO: 21047 - protein, 8 aa, BK virus
VFRGYSTI

SEQ ID NO: 21048 - protein, 8 aa, BK virus
FRGYSTIR

SEQ ID NO: 21049 - protein, 8 aa, BK virus
RGYSTIRV

SEQ ID NO: 21050 - protein, 8 aa, BK virus
GYSTIRVL

SEQ ID NO: 21051 - protein, 8 aa, BK virus
HSLHFQGF

SEQ ID NO: 21052 - protein, 8 aa, BK virus
SLHFQGFS

SEQ ID NO: 21053 - protein, 8 aa, BK virus
LHFQGFST

SEQ ID NO: 21054 - protein, 8 aa, BK virus
HFQGFSTY

SEQ ID NO: 21055 - protein, 8 aa, BK virus
FQGFSTYS

SEQ ID NO: 21056 - protein, 8 aa, BK virus
QGFSTYSK

SEQ ID NO: 21057 - protein, 8 aa, BK virus
GFSTYSKE

SEQ ID NO: 21058 - protein, 8 aa, BK virus
FSTYSKEV

SEQ ID NO: 21059 - protein, 8 aa, BK virus
STYSKEVE

SEQ ID NO: 21060 - protein, 8 aa, BK virus
TYSKEVEI

SEQ ID NO: 21061 - protein, 8 aa, BK virus
YSKEVEIT

SEQ ID NO: 21062 - protein, 8 aa, BK virus
SKEVEITA

SEQ ID NO: 21063 - protein, 8 aa, BK virus
KEVEITAL

SEQ ID NO: 21064 - protein, 8 aa, BK virus
EVEITALN

SEQ ID NO: 21065 - protein, 8 aa, BK virus
VEITALNR

SEQ ID NO: 21066 - protein, 8 aa, BK virus
EITALNRF

SEQ ID NO: 21067 - protein, 8 aa, BK virus
ITALNRFS

SEQ ID NO: 21068 - protein, 8 aa, BK virus
TALNRFSS

SEQ ID NO: 21069 - protein, 8 aa, BK virus
ALNRFSST

SEQ ID NO: 21070 - protein, 8 aa, BK virus
LNRFSSTM

SEQ ID NO: 21071 - protein, 8 aa, BK virus
NRFSSTML

SEQ ID NO: 21072 - protein, 8 aa, BK virus
RFSSTMLM

SEQ ID NO: 21073 - protein, 8 aa, BK virus
FSSTMLMH

SEQ ID NO: 21074 - protein, 8 aa, BK virus
SSTMLMHF

SEQ ID NO: 21075 - protein, 8 aa, BK virus
STMLMHFL

SEQ ID NO: 21076 - protein, 8 aa, BK virus
PCMKVKHA

SEQ ID NO: 21077 - protein, 8 aa, BK virus
CMKVKHAS

SEQ ID NO: 21078 - protein, 8 aa, BK virus
MKVKHASY

SEQ ID NO: 21079 - protein, 8 aa, BK virus
KVKHASYS

SEQ ID NO: 21080 - protein, 8 aa, BK virus
VKHASYSN

SEQ ID NO: 21081 - protein, 8 aa, BK virus
KHASYSNN

SEQ ID NO: 21082 - protein, 8 aa, BK virus
HASYSNNL

SEQ ID NO: 21083 - protein, 8 aa, BK virus
ASYSNNLC

SEQ ID NO: 21084 - protein, 8 aa, BK virus
SYSNNLCL

SEQ ID NO: 21085 - protein, 8 aa, BK virus
YSNNLCLY

SEQ ID NO: 21086 - protein, 8 aa, BK virus
SNNLCLYS

SEQ ID NO: 21087 - protein, 8 aa, BK virus
NNLCLYSY

SEQ ID NO: 21088 - protein, 8 aa, BK virus
NLCLYSYS

SEQ ID NO: 21089 - protein, 8 aa, BK virus
LCLYSYSL

SEQ ID NO: 21090 - protein, 8 aa, BK virus
CLYSYSLP

SEQ ID NO: 21091 - protein, 8 aa, BK virus
LYSYSLPH

SEQ ID NO: 21092 - protein, 8 aa, BK virus
YSYSLPHQ

SEQ ID NO: 21093 - protein, 8 aa, BK virus
IGEGNSCC

SEQ ID NO: 21094 - protein, 8 aa, BK virus
GEGNSCCA

SEQ ID NO: 21095 - protein, 8 aa, BK virus
EGNSCCAV

SEQ ID NO: 21096 - protein, 8 aa, BK virus
GNSCCAVT

SEQ ID NO: 21097 - protein, 8 aa, BK virus
NSCCAVTG

SEQ ID NO: 21098 - protein, 8 aa, BK virus
SCCAVTGK

SEQ ID NO: 21099 - protein, 8 aa, BK virus
CCAVTGKH

SEQ ID NO: 21100 - protein, 8 aa, BK virus
CAVTGKHF

SEQ ID NO: 21101 - protein, 8 aa, BK virus
AVTGKHFS

SEQ ID NO: 21102 - protein, 8 aa, BK virus
VTGKHFSL

SEQ ID NO: 21103 - protein, 8 aa, BK virus
TGKHFSLW

SEQ ID NO: 21104 - protein, 8 aa, BK virus
GKHFSLWA

SEQ ID NO: 21105 - protein, 8 aa, BK virus
KHFSLWAI

SEQ ID NO: 21106 - protein, 8 aa, BK virus
HFSLWAIT

SEQ ID NO: 21107 - protein, 8 aa, BK virus
FSLWAITA

SEQ ID NO: 21108 - protein, 8 aa, BK virus
SLWAITAK

SEQ ID NO: 21109 - protein, 8 aa, BK virus
LWAITAKV

SEQ ID NO: 21110 - protein, 8 aa, BK virus
WAITAKVI

SEQ ID NO: 21111 - protein, 8 aa, BK virus
AITAKVIF

SEQ ID NO: 21112 - protein, 8 aa, BK virus
ITAKVIFS

SEQ ID NO: 21113 - protein, 8 aa, BK virus
TAKVIFST

SEQ ID NO: 21114 - protein, 8 aa, BK virus
TKAPKVFI

SEQ ID NO: 21115 - protein, 8 aa, BK virus
KAPKVFIW

SEQ ID NO: 21116 - protein, 8 aa, BK virus
APKVFIWI

SEQ ID NO: 21117 - protein, 8 aa, BK virus
PKVFIWIP

SEQ ID NO: 21118 - protein, 8 aa, BK virus
KVFIWIPH

SEQ ID NO: 21119 - protein, 8 aa, BK virus
VFIWIPHF

SEQ ID NO: 21120 - protein, 8 aa, BK virus
FIWIPHFW

SEQ ID NO: 21121 - protein, 8 aa, BK virus
IWIPHFWV

SEQ ID NO: 21122 - protein, 8 aa, BK virus
EAFYLCNS

SEQ ID NO: 21123 - protein, 8 aa, BK virus
AFYLCNSI

SEQ ID NO: 21124 - protein, 8 aa, BK virus
FYLCNSIY

SEQ ID NO: 21125 - protein, 8 aa, BK virus
YLCNSIYP

SEQ ID NO: 21126 - protein, 8 aa, BK virus
LCNSIYPS

SEQ ID NO: 21127 - protein, 8 aa, BK virus
CNSIYPSF

SEQ ID NO: 21128 - protein, 8 aa, BK virus
NSIYPSFN

SEQ ID NO: 21129 - protein, 8 aa, BK virus
SIYPSFNF

SEQ ID NO: 21130 - protein, 8 aa, BK virus
FWHLHGFL

SEQ ID NO: 21131 - protein, 8 aa, BK virus
WHLHGFLW

SEQ ID NO: 21132 - protein, 8 aa, BK virus
HLHGFLWL

SEQ ID NO: 21133 - protein, 8 aa, BK virus
LHGFLWLF

SEQ ID NO: 21134 - protein, 8 aa, BK virus
HGFLWLFG

SEQ ID NO: 21135 - protein, 8 aa, BK virus
GFLWLFGS

SEQ ID NO: 21136 - protein, 8 aa, BK virus
FLWLFGSC

SEQ ID NO: 21137 - protein, 8 aa, BK virus
LWLFGSCP

SEQ ID NO: 21138 - protein, 8 aa, BK virus
WLFGSCPW

SEQ ID NO: 21139 - protein, 8 aa, BK virus
LFGSCPWT

SEQ ID NO: 21140 - protein, 8 aa, BK virus
FGSCPWTL

SEQ ID NO: 21141 - protein, 8 aa, BK virus
GSCPWTLS

SEQ ID NO: 21142 - protein, 8 aa, BK virus
SCPWTLSF

SEQ ID NO: 21143 - protein, 8 aa, BK virus
CPWTLSFS

SEQ ID NO: 21144 - protein, 8 aa, BK virus
PWTLSFSF

SEQ ID NO: 21145 - protein, 8 aa, BK virus
WTLSFSFG

SEQ ID NO: 21146 - protein, 8 aa, BK virus
TLSFSFGW

SEQ ID NO: 21147 - protein, 8 aa, BK virus
LSFSFGWG

SEQ ID NO: 21148 - protein, 8 aa, BK virus
SFSFGWGH

SEQ ID NO: 21149 - protein, 8 aa, BK virus
FSFGWGHL

SEQ ID NO: 21150 - protein, 8 aa, BK virus
SFGWGHLH

SEQ ID NO: 21151 - protein, 8 aa, BK virus
FGWGHLHM

SEQ ID NO: 21152 - protein, 8 aa, BK virus
GWGHLHML

SEQ ID NO: 21153 - protein, 8 aa, BK virus
WGHLHMLQ

SEQ ID NO: 21154 - protein, 8 aa, BK virus
GHLHMLQE

SEQ ID NO: 21155 - protein, 8 aa, BK virus
HLHMLQEQ

SEQ ID NO: 21156 - protein, 8 aa, BK virus
LHMLQEQV

SEQ ID NO: 21157 - protein, 8 aa, BK virus
HMLQEQVL

SEQ ID NO: 21158 - protein, 8 aa, BK virus
MLQEQVLQ

SEQ ID NO: 21159 - protein, 8 aa, BK virus
LQEQVLQS

SEQ ID NO: 21160 - protein, 8 aa, BK virus
QEQVLQSR

SEQ ID NO: 21161 - protein, 8 aa, BK virus
EQVLQSRT

SEQ ID NO: 21162 - protein, 8 aa, BK virus
QVLQSRTG

SEQ ID NO: 21163 - protein, 8 aa, BK virus
VLQSRTGL

SEQ ID NO: 21164 - protein, 8 aa, BK virus
LQSRTGLE

SEQ ID NO: 21165 - protein, 8 aa, BK virus
QSRTGLEV

SEQ ID NO: 21166 - protein, 8 aa, BK virus
SRTGLEVK

SEQ ID NO: 21167 - protein, 8 aa, BK virus
RTGLEVKA

SEQ ID NO: 21168 - protein, 8 aa, BK virus
TGLEVKAT

SEQ ID NO: 21169 - protein, 8 aa, BK virus
GLEVKATS

SEQ ID NO: 21170 - protein, 8 aa, BK virus
LEVKATSI

SEQ ID NO: 21171 - protein, 8 aa, BK virus
EVKATSIE

SEQ ID NO: 21172 - protein, 8 aa, BK virus
VKATSIEE

SEQ ID NO: 21173 - protein, 8 aa, BK virus
KATSIEEQ

SEQ ID NO: 21174 - protein, 8 aa, BK virus
ATSIEEQF

SEQ ID NO: 21175 - protein, 8 aa, BK virus
TSIEEQFF

SEQ ID NO: 21176 - protein, 8 aa, BK virus
SIEEQFFD

SEQ ID NO: 21177 - protein, 8 aa, BK virus
TLLNVHFV

SEQ ID NO: 21178 - protein, 8 aa, BK virus
LLNVHFVD

SEQ ID NO: 21179 - protein, 8 aa, BK virus
LNVHFVDF

SEQ ID NO: 21180 - protein, 8 aa, BK virus
NVHFVDFL

SEQ ID NO: 21181 - protein, 8 aa, BK virus
VHFVDFLS

SEQ ID NO: 21182 - protein, 8 aa, BK virus
HFVDFLSP

SEQ ID NO: 21183 - protein, 8 aa, BK virus
FVDFLSPF

SEQ ID NO: 21184 - protein, 8 aa, BK virus
VDFLSPFF

SEQ ID NO: 21185 - protein, 8 aa, BK virus
DFLSPFFV

SEQ ID NO: 21186 - protein, 8 aa, BK virus
LLLYCQHH

SEQ ID NO: 21187 - protein, 8 aa, BK virus
LLYCQHHL

SEQ ID NO: 21188 - protein, 8 aa, BK virus
LYCQHHLY

SEQ ID NO: 21189 - protein, 8 aa, BK virus
YCQHHLYY

SEQ ID NO: 21190 - protein, 8 aa, BK virus
CQHHLYYK

SEQ ID NO: 21191 - protein, 8 aa, BK virus
QHHLYYKY

SEQ ID NO: 21192 - protein, 8 aa, BK virus
HHLYYKYG

SEQ ID NO: 21193 - protein, 8 aa, BK virus
HLYYKYGQ

SEQ ID NO: 21194 - protein, 8 aa, BK virus
LYYKYGQN

SEQ ID NO: 21195 - protein, 8 aa, BK virus
YYKYGQNV

SEQ ID NO: 21196 - protein, 8 aa, BK virus
YKYGQNVH

SEQ ID NO: 21197 - protein, 8 aa, BK virus
KYGQNVHG

SEQ ID NO: 21198 - protein, 8 aa, BK virus
YGQNVHGY

SEQ ID NO: 21199 - protein, 8 aa, BK virus
GQNVHGYL

SEQ ID NO: 21200 - protein, 8 aa, BK virus
QNVHGYLP

SEQ ID NO: 21201 - protein, 8 aa, BK virus
NVHGYLPF

SEQ ID NO: 21202 - protein, 8 aa, BK virus
VHGYLPFQ

SEQ ID NO: 21203 - protein, 8 aa, BK virus
HGYLPFQL

SEQ ID NO: 21204 - protein, 8 aa, BK virus
GYLPFQLL

SEQ ID NO: 21205 - protein, 8 aa, BK virus
YLPFQLLV

SEQ ID NO: 21206 - protein, 8 aa, BK virus
GKDQNNIV

SEQ ID NO: 21207 - protein, 8 aa, BK virus
KDQNNIVE

SEQ ID NO: 21208 - protein, 8 aa, BK virus
DQNNIVEY

SEQ ID NO: 21209 - protein, 8 aa, BK virus
QNNIVEYN

SEQ ID NO: 21210 - protein, 8 aa, BK virus
NNIVEYNY

SEQ ID NO: 21211 - protein, 8 aa, BK virus
NIVEYNYK

SEQ ID NO: 21212 - protein, 8 aa, BK virus
IVEYNYKS

SEQ ID NO: 21213 - protein, 8 aa, BK virus
VEYNYKSL

SEQ ID NO: 21214 - protein, 8 aa, BK virus
KIFLFFSA

SEQ ID NO: 21215 - protein, 8 aa, BK virus
IFLFFSAI

SEQ ID NO: 21216 - protein, 8 aa, BK virus
FLFFSAIP

SEQ ID NO: 21217 - protein, 8 aa, BK virus
LFFSAIPV

SEQ ID NO: 21218 - protein, 8 aa, BK virus
FFSAIPVR

SEQ ID NO: 21219 - protein, 8 aa, BK virus
FSAIPVRL

SEQ ID NO: 21220 - protein, 8 aa, BK virus
QTKKDPNA

SEQ ID NO: 21221 - protein, 8 aa, BK virus
QKYLHQET

SEQ ID NO: 21222 - protein, 8 aa, BK virus
KYLHQETE

SEQ ID NO: 21223 - protein, 8 aa, BK virus
YLHQETEY

SEQ ID NO: 21224 - protein, 8 aa, BK virus
LHQETEYH

SEQ ID NO: 21225 - protein, 8 aa, BK virus
HQETEYHS

SEQ ID NO: 21226 - protein, 8 aa, BK virus
QETEYHST

SEQ ID NO: 21227 - protein, 8 aa, BK virus
ETEYHSTH

SEQ ID NO: 21228 - protein, 8 aa, BK virus
TEYHSTHL

SEQ ID NO: 21229 - protein, 8 aa, BK virus
EYHSTHLG

SEQ ID NO: 21230 - protein, 8 aa, BK virus
TIPKPCLI

SEQ ID NO: 21231 - protein, 8 aa, BK virus
IPKPCLIA

SEQ ID NO: 21232 - protein, 8 aa, BK virus
PKPCLIAD

SEQ ID NO: 21233 - protein, 8 aa, BK virus
KPCLIADR

SEQ ID NO: 21234 - protein, 8 aa, BK virus
PCLIADRG

SEQ ID NO: 21235 - protein, 8 aa, BK virus
CLIADRGL

SEQ ID NO: 21236 - protein, 8 aa, BK virus
LIADRGLQ

SEQ ID NO: 21237 - protein, 8 aa, BK virus
IADRGLQW

SEQ ID NO: 21238 - protein, 8 aa, BK virus
ADRGLQWK

SEQ ID NO: 21239 - protein, 8 aa, BK virus
DRGLQWKL

SEQ ID NO: 21240 - protein, 8 aa, BK virus
RGLQWKLC

SEQ ID NO: 21241 - protein, 8 aa, BK virus
GLQWKLCD

SEQ ID NO: 21242 - protein, 8 aa, BK virus
LQWKLCDP

SEQ ID NO: 21243 - protein, 8 aa, BK virus
QWKLCDPN

SEQ ID NO: 21244 - protein, 8 aa, BK virus
WKLCDPNH

SEQ ID NO: 21245 - protein, 8 aa, BK virus
KLCDPNHQ

SEQ ID NO: 21246 - protein, 8 aa, BK virus
LCDPNHQR

SEQ ID NO: 21247 - protein, 8 aa, BK virus
CDPNHQRT

SEQ ID NO: 21248 - protein, 8 aa, BK virus
DPNHQRTY

SEQ ID NO: 21249 - protein, 8 aa, BK virus
PNHQRTYT

SEQ ID NO: 21250 - protein, 8 aa, BK virus
NHQRTYTL

SEQ ID NO: 21251 - protein, 8 aa, BK virus
HQRTYTLL

SEQ ID NO: 21252 - protein, 8 aa, BK virus
QRTYTLLE

SEQ ID NO: 21253 - protein, 8 aa, BK virus
RTYTLLEL

SEQ ID NO: 21254 - protein, 8 aa, BK virus
TYTLLELR

SEQ ID NO: 21255 - protein, 8 aa, BK virus
YTLLELRN

SEQ ID NO: 21256 - protein, 8 aa, BK virus
QFELKQQT

SEQ ID NO: 21257 - protein, 8 aa, BK virus
FELKQQTQ

SEQ ID NO: 21258 - protein, 8 aa, BK virus
ELKQQTQQ

SEQ ID NO: 21259 - protein, 8 aa, BK virus
PQEHQQLQ

SEQ ID NO: 21260 - protein, 8 aa, BK virus
QEHQQLQH

SEQ ID NO: 21261 - protein, 8 aa, BK virus
EHQQLQHM

SEQ ID NO: 21262 - protein, 8 aa, BK virus
HQQLQHMF

SEQ ID NO: 21263 - protein, 8 aa, BK virus
QQLQHMFE

SEQ ID NO: 21264 - protein, 8 aa, BK virus
QLQHMFEE

SEQ ID NO: 21265 - protein, 8 aa, BK virus
LQHMFEEL

SEQ ID NO: 21266 - protein, 8 aa, BK virus
QHMFEELG

SEQ ID NO: 21267 - protein, 8 aa, BK virus
HMFEELGL

SEQ ID NO: 21268 - protein, 8 aa, BK virus
PLRYLLCP

SEQ ID NO: 21269 - protein, 8 aa, BK virus
LRYLLCPL

SEQ ID NO: 21270 - protein, 8 aa, BK virus
RYLLCPLQ

SEQ ID NO: 21271 - protein, 8 aa, BK virus
QGMQFELL

SEQ ID NO: 21272 - protein, 8 aa, BK virus
QQQPPQQQ

SEQ ID NO: 21273 - protein, 8 aa, BK virus
QQPPQQQF

SEQ ID NO: 21274 - protein, 8 aa, BK virus
QPPQQQFQ

SEQ ID NO: 21275 - protein, 8 aa, BK virus
PPQQQFQP

SEQ ID NO: 21276 - protein, 8 aa, BK virus
PQQQFQPL

SEQ ID NO: 21277 - protein, 8 aa, BK virus
QQQFQPLK

SEQ ID NO: 21278 - protein, 8 aa, BK virus
QQFQPLKI

SEQ ID NO: 21279 - protein, 8 aa, BK virus
QFQPLKIL

SEQ ID NO: 21280 - protein, 8 aa, BK virus
FQPLKILW

SEQ ID NO: 21281 - protein, 8 aa, BK virus
QPLKILWQ

SEQ ID NO: 21282 - protein, 8 aa, BK virus
PLKILWQQ

SEQ ID NO: 21283 - protein, 8 aa, BK virus
LKILWQQQ

SEQ ID NO: 21284 - protein, 8 aa, BK virus
KILWQQQP

SEQ ID NO: 21285 - protein, 8 aa, BK virus
ILWQQQPQ

SEQ ID NO: 21286 - protein, 8 aa, BK virus
LWQQQPQI

SEQ ID NO: 21287 - protein, 8 aa, BK virus
WQQQPQIH

SEQ ID NO: 21288 - protein, 8 aa, BK virus
QQQPQIHW

SEQ ID NO: 21289 - protein, 8 aa, BK virus
QQPQIHWQ

SEQ ID NO: 21290 - protein, 8 aa, BK virus
QPQIHWQL

SEQ ID NO: 21291 - protein, 8 aa, BK virus
PQIHWQLG

SEQ ID NO: 21292 - protein, 8 aa, BK virus
QIHWQLGP

SEQ ID NO: 21293 - protein, 8 aa, BK virus
IHWQLGPP

SEQ ID NO: 21294 - protein, 8 aa, BK virus
HWQLGPPK

SEQ ID NO: 21295 - protein, 8 aa, BK virus
WQLGPPKV

SEQ ID NO: 21296 - protein, 8 aa, BK virus
QLGPPKVL

SEQ ID NO: 21297 - protein, 8 aa, BK virus
LGPPKVLE

SEQ ID NO: 21298 - protein, 8 aa, BK virus
GPPKVLEQ

SEQ ID NO: 21299 - protein, 8 aa, BK virus
PPKVLEQH

SEQ ID NO: 21300 - protein, 8 aa, BK virus
PKVLEQHP

SEQ ID NO: 21301 - protein, 8 aa, BK virus
TWKYKKKG

SEQ ID NO: 21302 - protein, 8 aa, BK virus
WKYKKKGI

SEQ ID NO: 21303 - protein, 8 aa, BK virus
KYKKKGIT

SEQ ID NO: 21304 - protein, 8 aa, BK virus
YKKKGITY

SEQ ID NO: 21305 - protein, 8 aa, BK virus
KKKGITYL

SEQ ID NO: 21306 - protein, 8 aa, BK virus
KKGITYLG

SEQ ID NO: 21307 - protein, 8 aa, BK virus
KGITYLGV

SEQ ID NO: 21308 - protein, 8 aa, BK virus
GITYLGVF

SEQ ID NO: 21309 - protein, 8 aa, BK virus
ITYLGVFY

SEQ ID NO: 21310 - protein, 8 aa, BK virus
TYLGVFYR

SEQ ID NO: 21311 - protein, 8 aa, BK virus
YLGVFYRV

SEQ ID NO: 21312 - protein, 8 aa, BK virus
LGVFYRVF

SEQ ID NO: 21313 - protein, 8 aa, BK virus
GVFYRVFY

SEQ ID NO: 21314 - protein, 8 aa, BK virus
VFYRVFYS

SEQ ID NO: 21315 - protein, 8 aa, BK virus
FYRVFYSR

SEQ ID NO: 21316 - protein, 8 aa, BK virus
SSGTFVFP

SEQ ID NO: 21317 - protein, 8 aa, BK virus
SGTFVFPV

SEQ ID NO: 21318 - protein, 8 aa, BK virus
GTFVFPVY

SEQ ID NO: 21319 - protein, 8 aa, BK virus
TFVFPVYT

SEQ ID NO: 21320 - protein, 8 aa, BK virus
FVFPVYTV

SEQ ID NO: 21321 - protein, 8 aa, BK virus
VFPVYTVF

SEQ ID NO: 21322 - protein, 8 aa, BK virus
FPVYTVFT

SEQ ID NO: 21323 - protein, 8 aa, BK virus
PVYTVFTS

SEQ ID NO: 21324 - protein, 8 aa, BK virus
VYTVFTST

SEQ ID NO: 21325 - protein, 8 aa, BK virus
YTVFTSTK

SEQ ID NO: 21326 - protein, 8 aa, BK virus
TVFTSTKF

SEQ ID NO: 21327 - protein, 8 aa, BK virus
VFTSTKFQ

SEQ ID NO: 21328 - protein, 8 aa, BK virus
FTSTKFQQ

SEQ ID NO: 21329 - protein, 8 aa, BK virus
TSTKFQQK

SEQ ID NO: 21330 - protein, 8 aa, BK virus
STKFQQKL

SEQ ID NO: 21331 - protein, 8 aa, BK virus
NKNKNPLS

SEQ ID NO: 21332 - protein, 8 aa, BK virus
KNKNPLSS

SEQ ID NO: 21333 - protein, 8 aa, BK virus
NKNPLSSF

SEQ ID NO: 21334 - protein, 8 aa, BK virus
KNPLSSFF

SEQ ID NO: 21335 - protein, 8 aa, BK virus
NPLSSFFC

SEQ ID NO: 21336 - protein, 8 aa, BK virus
PLSSFFCS

SEQ ID NO: 21337 - protein, 8 aa, BK virus
LSSFFCSS

SEQ ID NO: 21338 - protein, 8 aa, BK virus
SSFFCSSP

SEQ ID NO: 21339 - protein, 8 aa, BK virus
SFFCSSPG

SEQ ID NO: 21340 - protein, 8 aa, BK virus
FFCSSPGF

SEQ ID NO: 21341 - protein, 8 aa, BK virus
FCSSPGFT

SEQ ID NO: 21342 - protein, 8 aa, BK virus
CSSPGFTN

SEQ ID NO: 21343 - protein, 8 aa, BK virus
SSPGFTNF

SEQ ID NO: 21344 - protein, 8 aa, BK virus
SPGFTNFH

SEQ ID NO: 21345 - protein, 8 aa, BK virus
QLAQNHGL

SEQ ID NO: 21346 - protein, 8 aa, BK virus
LAQNHGLC

SEQ ID NO: 21347 - protein, 8 aa, BK virus
AQNHGLCP

SEQ ID NO: 21348 - protein, 8 aa, BK virus
QNHGLCPV

SEQ ID NO: 21349 - protein, 8 aa, BK virus
LGTRPRFL

SEQ ID NO: 21350 - protein, 8 aa, BK virus
GTRPRFLG

SEQ ID NO: 21351 - protein, 8 aa, BK virus
TRPRFLGS

SEQ ID NO: 21352 - protein, 8 aa, BK virus
RPRFLGSQ

SEQ ID NO: 21353 - protein, 8 aa, BK virus
PRFLGSQN

SEQ ID NO: 21354 - protein, 8 aa, BK virus
RFLGSQNM

SEQ ID NO: 21355 - protein, 8 aa, BK virus
FLGSQNMS

SEQ ID NO: 21356 - protein, 8 aa, BK virus
LGSQNMSV

SEQ ID NO: 21357 - protein, 8 aa, BK virus
GSQNMSVM

SEQ ID NO: 21358 - protein, 8 aa, BK virus
SQNMSVMH

SEQ ID NO: 21359 - protein, 8 aa, BK virus
QNMSVMHF

SEQ ID NO: 21360 - protein, 8 aa, BK virus
NMSVMHFP

SEQ ID NO: 21361 - protein, 8 aa, BK virus
MSVMHFPS

SEQ ID NO: 21362 - protein, 8 aa, BK virus
GHGLAAFH

SEQ ID NO: 21363 - protein, 8 aa, BK virus
HGLAAFHG

SEQ ID NO: 21364 - protein, 8 aa, BK virus
AAPPCESC

SEQ ID NO: 21365 - protein, 8 aa, BK virus
APPCESCT

SEQ ID NO: 21366 - protein, 8 aa, BK virus
PPCESCTF

SEQ ID NO: 21367 - protein, 8 aa, BK virus
PCESCTFL

SEQ ID NO: 21368 - protein, 8 aa, BK virus
CESCTFLP

SEQ ID NO: 21369 - protein, 8 aa, BK virus
ESCTFLPE

SEQ ID NO: 21370 - protein, 8 aa, BK virus
SCTFLPEV

SEQ ID NO: 21371 - protein, 8 aa, BK virus
CTFLPEVM

SEQ ID NO: 21372 - protein, 8 aa, BK virus
TFLPEVMV

SEQ ID NO: 21373 - protein, 8 aa, BK virus
FLPEVMVW

SEQ ID NO: 21374 - protein, 8 aa, BK virus
LPEVMVWL

SEQ ID NO: 21375 - protein, 8 aa, BK virus
PEVMVWLH

SEQ ID NO: 21376 - protein, 8 aa, BK virus
EVMVWLHS

SEQ ID NO: 21377 - protein, 8 aa, BK virus
VMVWLHSP

SEQ ID NO: 21378 - protein, 8 aa, BK virus
MVWLHSPV

SEQ ID NO: 21379 - protein, 8 aa, BK virus
VWLHSPVS

SEQ ID NO: 21380 - protein, 8 aa, BK virus
WLHSPVSH

SEQ ID NO: 21381 - protein, 8 aa, BK virus
LHSPVSHA

SEQ ID NO: 21382 - protein, 8 aa, BK virus
HSPVSHAL

SEQ ID NO: 21383 - protein, 8 aa, BK virus
SPVSHALS

SEQ ID NO: 21384 - protein, 8 aa, BK virus
PVSHALSF

SEQ ID NO: 21385 - protein, 8 aa, BK virus
VSHALSFL

SEQ ID NO: 21386 - protein, 8 aa, BK virus
SHALSFLR

SEQ ID NO: 21387 - protein, 8 aa, BK virus
HALSFLRS

SEQ ID NO: 21388 - protein, 8 aa, BK virus
ALSFLRSW

SEQ ID NO: 21389 - protein, 8 aa, BK virus
LSFLRSWF

SEQ ID NO: 21390 - protein, 8 aa, BK virus
SFLRSWFG

SEQ ID NO: 21391 - protein, 8 aa, BK virus
FLRSWFGC

SEQ ID NO: 21392 - protein, 8 aa, BK virus
LRSWFGCI

SEQ ID NO: 21393 - protein, 8 aa, BK virus
RSWFGCIP

SEQ ID NO: 21394 - protein, 8 aa, BK virus
SWFGCIPW

SEQ ID NO: 21395 - protein, 8 aa, BK virus
WFGCIPWV

SEQ ID NO: 21396 - protein, 8 aa, BK virus
FGCIPWVS

SEQ ID NO: 21397 - protein, 8 aa, BK virus
GCIPWVSS

SEQ ID NO: 21398 - protein, 8 aa, BK virus
CIPWVSSS

SEQ ID NO: 21399 - protein, 8 aa, BK virus
IPWVSSSS

SEQ ID NO: 21400 - protein, 8 aa, BK virus
PWVSSSSL

SEQ ID NO: 21401 - protein, 8 aa, BK virus
WVSSSSLW

SEQ ID NO: 21402 - protein, 8 aa, BK virus
VSSSSLWP

SEQ ID NO: 21403 - protein, 8 aa, BK virus
SSSSLWPF

SEQ ID NO: 21404 - protein, 8 aa, BK virus
SSSLWPFF

SEQ ID NO: 21405 - protein, 8 aa, BK virus
SSLWPFFL

SEQ ID NO: 21406 - protein, 8 aa, BK virus
YIRGRGRL

SEQ ID NO: 21407 - protein, 8 aa, BK virus
IRGRGRLC

SEQ ID NO: 21408 - protein, 8 aa, BK virus
RGRGRLCL

SEQ ID NO: 21409 - protein, 8 aa, BK virus
GRGRLCLH

SEQ ID NO: 21410 - protein, 8 aa, BK virus
RGRLCLHP

SEQ ID NO: 21411 - protein, 8 aa, BK virus
GRLCLHPF

SEQ ID NO: 21412 - protein, 8 aa, BK virus
RLCLHPFS

SEQ ID NO: 21413 - protein, 8 aa, BK virus
LCLHPFSQ

SEQ ID NO: 21414 - protein, 8 aa, BK virus
CLHPFSQV

SEQ ID NO: 21415 - protein, 8 aa, BK virus
LHPFSQVV

SEQ ID NO: 21416 - protein, 8 aa, BK virus
HPFSQVVR

SEQ ID NO: 21417 - protein, 8 aa, BK virus
PFSQVVRV

SEQ ID NO: 21418 - protein, 8 aa, BK virus
FSQVVRVW

SEQ ID NO: 21419 - protein, 8 aa, BK virus
SQVVRVWR

SEQ ID NO: 21420 - protein, 8 aa, BK virus
QVVRVWRL

SEQ ID NO: 21421 - protein, 8 aa, BK virus
VVRVWRLF

SEQ ID NO: 21422 - protein, 8 aa, BK virus
VRVWRLFL

SEQ ID NO: 21423 - protein, 8 aa, BK virus
RVWRLFLR

SEQ ID NO: 21424 - protein, 8 aa, BK virus
VWRLFLRP

SEQ ID NO: 21425 - protein, 8 aa, BK virus
WRLFLRPS

SEQ ID NO: 21426 - protein, 8 aa, BK virus
RLFLRPSK

SEQ ID NO: 21427 - protein, 8 aa, BK virus
LFLRPSKT

SEQ ID NO: 21428 - protein, 8 aa, BK virus
FLRPSKTI

SEQ ID NO: 21429 - protein, 8 aa, BK virus
LRPSKTIW

SEQ ID NO: 21430 - protein, 8 aa, BK virus
RPSKTIWG

SEQ ID NO: 21431 - protein, 8 aa, BK virus
PSKTIWGN

SEQ ID NO: 21432 - protein, 8 aa, BK virus
SKTIWGNP

SEQ ID NO: 21433 - protein, 8 aa, BK virus
KTIWGNPY

SEQ ID NO: 21434 - protein, 8 aa, BK virus
TIWGNPYS

SEQ ID NO: 21435 - protein, 8 aa, BK virus
IWGNPYSF

SEQ ID NO: 21436 - protein, 8 aa, BK virus
WGNPYSFA

SEQ ID NO: 21437 - protein, 8 aa, BK virus
GNPYSFAI

SEQ ID NO: 21438 - protein, 8 aa, BK virus
NPYSFAIF

SEQ ID NO: 21439 - protein, 8 aa, BK virus
PYSFAIFA

SEQ ID NO: 21440 - protein, 8 aa, BK virus
YSFAIFAK

SEQ ID NO: 21441 - protein, 9 aa, BK virus
QGRIHGAHG

SEQ ID NO: 21442 - protein, 9 aa, BK virus
GRIHGAHGP

SEQ ID NO: 21443 - protein, 9 aa, BK virus
RIHGAHGPF

SEQ ID NO: 21444 - protein, 9 aa, BK virus
IHGAHGPFR

SEQ ID NO: 21445 - protein, 9 aa, BK virus
HGAHGPFRP

SEQ ID NO: 21446 - protein, 9 aa, BK virus
KSCLGKSSL

SEQ ID NO: 21447 - protein, 9 aa, BK virus
SCLGKSSLN

SEQ ID NO: 21448 - protein, 9 aa, BK virus
CLGKSSLNE

SEQ ID NO: 21449 - protein, 9 aa, BK virus
LGKSSLNEK

SEQ ID NO: 21450 - protein, 9 aa, BK virus
GKSSLNEKS

SEQ ID NO: 21451 - protein, 9 aa, BK virus
KSSLNEKSL

SEQ ID NO: 21452 - protein, 9 aa, BK virus
SSLNEKSLF

SEQ ID NO: 21453 - protein, 9 aa, BK virus
SLNEKSLFK

SEQ ID NO: 21454 - protein, 9 aa, BK virus
LNEKSLFKE

SEQ ID NO: 21455 - protein, 9 aa, BK virus
NEKSLFKEV

SEQ ID NO: 21456 - protein, 9 aa, BK virus
KNGAGCKGS

SEQ ID NO: 21457 - protein, 9 aa, BK virus
NGAGCKGSS

SEQ ID NO: 21458 - protein, 9 aa, BK virus
GAGCKGSSS

SEQ ID NO: 21459 - protein, 9 aa, BK virus
AGCKGSSSA

SEQ ID NO: 21460 - protein, 9 aa, BK virus
FSSLPRYPV

SEQ ID NO: 21461 - protein, 9 aa, BK virus
SSLPRYPVL

SEQ ID NO: 21462 - protein, 9 aa, BK virus
SLPRYPVLQ

SEQ ID NO: 21463 - protein, 9 aa, BK virus
LPRYPVLQG

SEQ ID NO: 21464 - protein, 9 aa, BK virus
PRYPVLQGM

SEQ ID NO: 21465 - protein, 9 aa, BK virus
RYPVLQGMA

SEQ ID NO: 21466 - protein, 9 aa, BK virus
YPVLQGMAY

SEQ ID NO: 21467 - protein, 9 aa, BK virus
PVLQGMAYL

SEQ ID NO: 21468 - protein, 9 aa, BK virus
VLQGMAYLF

SEQ ID NO: 21469 - protein, 9 aa, BK virus
LQGMAYLFQ

SEQ ID NO: 21470 - protein, 9 aa, BK virus
QGMAYLFQK

SEQ ID NO: 21471 - protein, 9 aa, BK virus
GMAYLFQKA

SEQ ID NO: 21472 - protein, 9 aa, BK virus
MAYLFQKAF

SEQ ID NO: 21473 - protein, 9 aa, BK virus
AYLFQKAFC

SEQ ID NO: 21474 - protein, 9 aa, BK virus
YLFQKAFCA

SEQ ID NO: 21475 - protein, 9 aa, BK virus
LFQKAFCAL

SEQ ID NO: 21476 - protein, 9 aa, BK virus
FQKAFCALP

SEQ ID NO: 21477 - protein, 9 aa, BK virus
QKAFCALPL

SEQ ID NO: 21478 - protein, 9 aa, BK virus
KAFCALPLH

SEQ ID NO: 21479 - protein, 9 aa, BK virus
AFCALPLHA

SEQ ID NO: 21480 - protein, 9 aa, BK virus
FCALPLHAM

SEQ ID NO: 21481 - protein, 9 aa, BK virus
CALPLHAMS

SEQ ID NO: 21482 - protein, 9 aa, BK virus
ALPLHAMSA

SEQ ID NO: 21483 - protein, 9 aa, BK virus
KIFKKRALG

SEQ ID NO: 21484 - protein, 9 aa, BK virus
IFKKRALGL

SEQ ID NO: 21485 - protein, 9 aa, BK virus
FKKRALGLD

SEQ ID NO: 21486 - protein, 9 aa, BK virus
KKRALGLDR

SEQ ID NO: 21487 - protein, 9 aa, BK virus
KRALGLDRL

SEQ ID NO: 21488 - protein, 9 aa, BK virus
RALGLDRLL

SEQ ID NO: 21489 - protein, 9 aa, BK virus
ALGLDRLLL

SEQ ID NO: 21490 - protein, 9 aa, BK virus
LGLDRLLLH

SEQ ID NO: 21491 - protein, 9 aa, BK virus
LLHTVVWLR

SEQ ID NO: 21492 - protein, 9 aa, BK virus
LHTVVWLRP

SEQ ID NO: 21493 - protein, 9 aa, BK virus
HTVVWLRPN

SEQ ID NO: 21494 - protein, 9 aa, BK virus
RNSAMVGPN

SEQ ID NO: 21495 - protein, 9 aa, BK virus
NSAMVGPNN

SEQ ID NO: 21496 - protein, 9 aa, BK virus
SAMVGPNNW

SEQ ID NO: 21497 - protein, 9 aa, BK virus
AMVGPNNWR

SEQ ID NO: 21498 - protein, 9 aa, BK virus
MVGPNNWRN

SEQ ID NO: 21499 - protein, 9 aa, BK virus
VGPNNWRNS

SEQ ID NO: 21500 - protein, 9 aa, BK virus
GPNNWRNSL

SEQ ID NO: 21501 - protein, 9 aa, BK virus
PNNWRNSLQ

SEQ ID NO: 21502 - protein, 9 aa, BK virus
NNWRNSLQR

SEQ ID NO: 21503 - protein, 9 aa, BK virus
NWRNSLQRS

SEQ ID NO: 21504 - protein, 9 aa, BK virus
WRNSLQRSK

SEQ ID NO: 21505 - protein, 9 aa, BK virus
RNSLQRSKA

SEQ ID NO: 21506 - protein, 9 aa, BK virus
NSLQRSKAL

SEQ ID NO: 21507 - protein, 9 aa, BK virus
SLQRSKALR

SEQ ID NO: 21508 - protein, 9 aa, BK virus
INNKILKGP

SEQ ID NO: 21509 - protein, 9 aa, BK virus
NNKILKGPK

SEQ ID NO: 21510 - protein, 9 aa, BK virus
VPTYGTEEW

SEQ ID NO: 21511 - protein, 9 aa, BK virus
PTYGTEEWE

SEQ ID NO: 21512 - protein, 9 aa, BK virus
TYGTEEWES

SEQ ID NO: 21513 - protein, 9 aa, BK virus
YGTEEWESW

SEQ ID NO: 21514 - protein, 9 aa, BK virus
GTEEWESWW

SEQ ID NO: 21515 - protein, 9 aa, BK virus
TEEWESWWS

SEQ ID NO: 21516 - protein, 9 aa, BK virus
EEWESWWSS

SEQ ID NO: 21517 - protein, 9 aa, BK virus
EWESWWSSF

SEQ ID NO: 21518 - protein, 9 aa, BK virus
WESWWSSFN

SEQ ID NO: 21519 - protein, 9 aa, BK virus
ESWWSSFNE

SEQ ID NO: 21520 - protein, 9 aa, BK virus
SWWSSFNEK

SEQ ID NO: 21521 - protein, 9 aa, BK virus
WWSSFNEKW

SEQ ID NO: 21522 - protein, 9 aa, BK virus
WSSFNEKWD

SEQ ID NO: 21523 - protein, 9 aa, BK virus
SSFNEKWDE

SEQ ID NO: 21524 - protein, 9 aa, BK virus
SFNEKWDED

SEQ ID NO: 21525 - protein, 9 aa, BK virus
FNEKWDEDL

SEQ ID NO: 21526 - protein, 9 aa, BK virus
NEKWDEDLF

SEQ ID NO: 21527 - protein, 9 aa, BK virus
EKWDEDLFC

SEQ ID NO: 21528 - protein, 9 aa, BK virus
KWDEDLFCH

SEQ ID NO: 21529 - protein, 9 aa, BK virus
WDEDLFCHE

SEQ ID NO: 21530 - protein, 9 aa, BK virus
DEDLFCHED

SEQ ID NO: 21531 - protein, 9 aa, BK virus
EDLFCHEDM

SEQ ID NO: 21532 - protein, 9 aa, BK virus
DLFCHEDMF

SEQ ID NO: 21533 - protein, 9 aa, BK virus
LFCHEDMFA

SEQ ID NO: 21534 - protein, 9 aa, BK virus
FCHEDMFAS

SEQ ID NO: 21535 - protein, 9 aa, BK virus
CHEDMFASD

SEQ ID NO: 21536 - protein, 9 aa, BK virus
HEDMFASDE

SEQ ID NO: 21537 - protein, 9 aa, BK virus
EDMFASDEE

SEQ ID NO: 21538 - protein, 9 aa, BK virus
DMFASDEEA

SEQ ID NO: 21539 - protein, 9 aa, BK virus
MFASDEEAT

SEQ ID NO: 21540 - protein, 9 aa, BK virus
FASDEEATA

SEQ ID NO: 21541 - protein, 9 aa, BK virus
ASDEEATAD

SEQ ID NO: 21542 - protein, 9 aa, BK virus
SDEEATADS

SEQ ID NO: 21543 - protein, 9 aa, BK virus
DEEATADSQ

SEQ ID NO: 21544 - protein, 9 aa, BK virus
EEATADSQH

SEQ ID NO: 21545 - protein, 9 aa, BK virus
EATADSQHS

SEQ ID NO: 21546 - protein, 9 aa, BK virus
ATADSQHST

SEQ ID NO: 21547 - protein, 9 aa, BK virus
TADSQHSTP

SEQ ID NO: 21548 - protein, 9 aa, BK virus
ADSQHSTPP

SEQ ID NO: 21549 - protein, 9 aa, BK virus
DSQHSTPPK

SEQ ID NO: 21550 - protein, 9 aa, BK virus
SQHSTPPKK

SEQ ID NO: 21551 - protein, 9 aa, BK virus
QHSTPPKKK

SEQ ID NO: 21552 - protein, 9 aa, BK virus
HSTPPKKKR

SEQ ID NO: 21553 - protein, 9 aa, BK virus
STPPKKKRK

SEQ ID NO: 21554 - protein, 9 aa, BK virus
TPPKKKRKV

SEQ ID NO: 21555 - protein, 9 aa, BK virus
PPKKKRKVE

SEQ ID NO: 21556 - protein, 9 aa, BK virus
PKKKRKVED

SEQ ID NO: 21557 - protein, 9 aa, BK virus
KKKRKVEDP

SEQ ID NO: 21558 - protein, 9 aa, BK virus
KKRKVEDPK

SEQ ID NO: 21559 - protein, 9 aa, BK virus
KRKVEDPKD

SEQ ID NO: 21560 - protein, 9 aa, BK virus
RKVEDPKDF

SEQ ID NO: 21561 - protein, 9 aa, BK virus
KVEDPKDFP

SEQ ID NO: 21562 - protein, 9 aa, BK virus
VEDPKDFPS

SEQ ID NO: 21563 - protein, 9 aa, BK virus
EDPKDFPSD

SEQ ID NO: 21564 - protein, 9 aa, BK virus
DPKDFPSDL

SEQ ID NO: 21565 - protein, 9 aa, BK virus
PKDFPSDLH

SEQ ID NO: 21566 - protein, 9 aa, BK virus
KDFPSDLHQ

SEQ ID NO: 21567 - protein, 9 aa, BK virus
DFPSDLHQF

SEQ ID NO: 21568 - protein, 9 aa, BK virus
FPSDLHQFL

SEQ ID NO: 21569 - protein, 9 aa, BK virus
PSDLHQFLS

SEQ ID NO: 21570 - protein, 9 aa, BK virus
SDLHQFLSQ

SEQ ID NO: 21571 - protein, 9 aa, BK virus
DLHQFLSQA

SEQ ID NO: 21572 - protein, 9 aa, BK virus
LHQFLSQAV

SEQ ID NO: 21573 - protein, 9 aa, BK virus
HQFLSQAVF

SEQ ID NO: 21574 - protein, 9 aa, BK virus
QFLSQAVFS

SEQ ID NO: 21575 - protein, 9 aa, BK virus
FLSQAVFSN

SEQ ID NO: 21576 - protein, 9 aa, BK virus
LSQAVFSNR

SEQ ID NO: 21577 - protein, 9 aa, BK virus
SQAVFSNRT

SEQ ID NO: 21578 - protein, 9 aa, BK virus
QAVFSNRTL

SEQ ID NO: 21579 - protein, 9 aa, BK virus
AVFSNRTLA

SEQ ID NO: 21580 - protein, 9 aa, BK virus
VFSNRTLAC

SEQ ID NO: 21581 - protein, 9 aa, BK virus
FSNRTLACF

SEQ ID NO: 21582 - protein, 9 aa, BK virus
SNRTLACFA

SEQ ID NO: 21583 - protein, 9 aa, BK virus
NRTLACFAV

SEQ ID NO: 21584 - protein, 9 aa, BK virus
RTLACFAVY

SEQ ID NO: 21585 - protein, 9 aa, BK virus
TLACFAVYT

SEQ ID NO: 21586 - protein, 9 aa, BK virus
LACFAVYTT

SEQ ID NO: 21587 - protein, 9 aa, BK virus
ACFAVYTTK

SEQ ID NO: 21588 - protein, 9 aa, BK virus
CFAVYTTKE

SEQ ID NO: 21589 - protein, 9 aa, BK virus
FAVYTTKEK

SEQ ID NO: 21590 - protein, 9 aa, BK virus
AVYTTKEKA

SEQ ID NO: 21591 - protein, 9 aa, BK virus
VYTTKEKAQ

SEQ ID NO: 21592 - protein, 9 aa, BK virus
YTTKEKAQI

SEQ ID NO: 21593 - protein, 9 aa, BK virus
TTKEKAQIL

SEQ ID NO: 21594 - protein, 9 aa, BK virus
TKEKAQILY

SEQ ID NO: 21595 - protein, 9 aa, BK virus
KEKAQILYK

SEQ ID NO: 21596 - protein, 9 aa, BK virus
EKAQILYKK

SEQ ID NO: 21597 - protein, 9 aa, BK virus
KAQILYKKL

SEQ ID NO: 21598 - protein, 9 aa, BK virus
AQILYKKLM

SEQ ID NO: 21599 - protein, 9 aa, BK virus
QILYKKLME

SEQ ID NO: 21600 - protein, 9 aa, BK virus
ILYKKLMEK

SEQ ID NO: 21601 - protein, 9 aa, BK virus
LYKKLMEKY

SEQ ID NO: 21602 - protein, 9 aa, BK virus
YKKLMEKYS

SEQ ID NO: 21603 - protein, 9 aa, BK virus
KKLMEKYSV

SEQ ID NO: 21604 - protein, 9 aa, BK virus
KLMEKYSVT

SEQ ID NO: 21605 - protein, 9 aa, BK virus
LMEKYSVTF

SEQ ID NO: 21606 - protein, 9 aa, BK virus
MEKYSVTFI

SEQ ID NO: 21607 - protein, 9 aa, BK virus
EKYSVTFIS

SEQ ID NO: 21608 - protein, 9 aa, BK virus
KYSVTFISR

SEQ ID NO: 21609 - protein, 9 aa, BK virus
YSVTFISRH

SEQ ID NO: 21610 - protein, 9 aa, BK virus
SVTFISRHM

SEQ ID NO: 21611 - protein, 9 aa, BK virus
VTFISRHMC

SEQ ID NO: 21612 - protein, 9 aa, BK virus
TFISRHMCA

SEQ ID NO: 21613 - protein, 9 aa, BK virus
FISRHMCAG

SEQ ID NO: 21614 - protein, 9 aa, BK virus
ISRHMCAGH

SEQ ID NO: 21615 - protein, 9 aa, BK virus
SRHMCAGHN

SEQ ID NO: 21616 - protein, 9 aa, BK virus
RHMCAGHNI

SEQ ID NO: 21617 - protein, 9 aa, BK virus
HMCAGHNII

SEQ ID NO: 21618 - protein, 9 aa, BK virus
MCAGHNIIF

SEQ ID NO: 21619 - protein, 9 aa, BK virus
CAGHNIIFF

SEQ ID NO: 21620 - protein, 9 aa, BK virus
AGHNIIFFL

SEQ ID NO: 21621 - protein, 9 aa, BK virus
GHNIIFFLT

SEQ ID NO: 21622 - protein, 9 aa, BK virus
HNIIFFLTP

SEQ ID NO: 21623 - protein, 9 aa, BK virus
NIIFFLTPH

SEQ ID NO: 21624 - protein, 9 aa, BK virus
IIFFLTPHR

SEQ ID NO: 21625 - protein, 9 aa, BK virus
IFFLTPHRH

SEQ ID NO: 21626 - protein, 9 aa, BK virus
FFLTPHRHR

SEQ ID NO: 21627 - protein, 9 aa, BK virus
FLTPHRHRV

SEQ ID NO: 21628 - protein, 9 aa, BK virus
LTPHRHRVS

SEQ ID NO: 21629 - protein, 9 aa, BK virus
TPHRHRVSA

SEQ ID NO: 21630 - protein, 9 aa, BK virus
PHRHRVSAI

SEQ ID NO: 21631 - protein, 9 aa, BK virus
HRHRVSAIN

SEQ ID NO: 21632 - protein, 9 aa, BK virus
RHRVSAINN

SEQ ID NO: 21633 - protein, 9 aa, BK virus
HRVSAINNF

SEQ ID NO: 21634 - protein, 9 aa, BK virus
RVSAINNFC

SEQ ID NO: 21635 - protein, 9 aa, BK virus
VSAINNFCQ

SEQ ID NO: 21636 - protein, 9 aa, BK virus
SAINNFCQK

SEQ ID NO: 21637 - protein, 9 aa, BK virus
AINNFCQKL

SEQ ID NO: 21638 - protein, 9 aa, BK virus
INNFCQKLC

SEQ ID NO: 21639 - protein, 9 aa, BK virus
NNFCQKLCT

SEQ ID NO: 21640 - protein, 9 aa, BK virus
NFCQKLCTF

SEQ ID NO: 21641 - protein, 9 aa, BK virus
FCQKLCTFS

SEQ ID NO: 21642 - protein, 9 aa, BK virus
CQKLCTFSF

SEQ ID NO: 21643 - protein, 9 aa, BK virus
QKLCTFSFL

SEQ ID NO: 21644 - protein, 9 aa, BK virus
KLCTFSFLI

SEQ ID NO: 21645 - protein, 9 aa, BK virus
LCTFSFLIC

SEQ ID NO: 21646 - protein, 9 aa, BK virus
CTFSFLICK

SEQ ID NO: 21647 - protein, 9 aa, BK virus
TFSFLICKG

SEQ ID NO: 21648 - protein, 9 aa, BK virus
FSFLICKGV

SEQ ID NO: 21649 - protein, 9 aa, BK virus
SFLICKGVN

SEQ ID NO: 21650 - protein, 9 aa, BK virus
FLICKGVNK

SEQ ID NO: 21651 - protein, 9 aa, BK virus
LICKGVNKE

SEQ ID NO: 21652 - protein, 9 aa, BK virus
ICKGVNKEY

SEQ ID NO: 21653 - protein, 9 aa, BK virus
CKGVNKEYL

SEQ ID NO: 21654 - protein, 9 aa, BK virus
KGVNKEYLL

SEQ ID NO: 21655 - protein, 9 aa, BK virus
GVNKEYLLY

SEQ ID NO: 21656 - protein, 9 aa, BK virus
VNKEYLLYS

SEQ ID NO: 21657 - protein, 9 aa, BK virus
NKEYLLYSA

SEQ ID NO: 21658 - protein, 9 aa, BK virus
KEYLLYSAL

SEQ ID NO: 21659 - protein, 9 aa, BK virus
EYLLYSALT

SEQ ID NO: 21660 - protein, 9 aa, BK virus
YLLYSALTR

SEQ ID NO: 21661 - protein, 9 aa, BK virus
LLYSALTRD

SEQ ID NO: 21662 - protein, 9 aa, BK virus
LYSALTRDP

SEQ ID NO: 21663 - protein, 9 aa, BK virus
YSALTRDPY

SEQ ID NO: 21664 - protein, 9 aa, BK virus
SALTRDPYH

SEQ ID NO: 21665 - protein, 9 aa, BK virus
ALTRDPYHT

SEQ ID NO: 21666 - protein, 9 aa, BK virus
LTRDPYHTI

SEQ ID NO: 21667 - protein, 9 aa, BK virus
TRDPYHTIE

SEQ ID NO: 21668 - protein, 9 aa, BK virus
RDPYHTIEE

SEQ ID NO: 21669 - protein, 9 aa, BK virus
DPYHTIEES

SEQ ID NO: 21670 - protein, 9 aa, BK virus
PYHTIEESI

SEQ ID NO: 21671 - protein, 9 aa, BK virus
YHTIEESIQ

SEQ ID NO: 21672 - protein, 9 aa, BK virus
HTIEESIQG

SEQ ID NO: 21673 - protein, 9 aa, BK virus
TIEESIQGG

SEQ ID NO: 21674 - protein, 9 aa, BK virus
IEESIQGGL

SEQ ID NO: 21675 - protein, 9 aa, BK virus
EESIQGGLK

SEQ ID NO: 21676 - protein, 9 aa, BK virus
ESIQGGLKE

SEQ ID NO: 21677 - protein, 9 aa, BK virus
SIQGGLKEH

SEQ ID NO: 21678 - protein, 9 aa, BK virus
IQGGLKEHD

SEQ ID NO: 21679 - protein, 9 aa, BK virus
QGGLKEHDF

SEQ ID NO: 21680 - protein, 9 aa, BK virus
GGLKEHDFS

SEQ ID NO: 21681 - protein, 9 aa, BK virus
GLKEHDFSP

SEQ ID NO: 21682 - protein, 9 aa, BK virus
LKEHDFSPE

SEQ ID NO: 21683 - protein, 9 aa, BK virus
KEHDFSPEE

SEQ ID NO: 21684 - protein, 9 aa, BK virus
EHDFSPEEP

SEQ ID NO: 21685 - protein, 9 aa, BK virus
HDFSPEEPE

SEQ ID NO: 21686 - protein, 9 aa, BK virus
DFSPEEPEE

SEQ ID NO: 21687 - protein, 9 aa, BK virus
FSPEEPEET

SEQ ID NO: 21688 - protein, 9 aa, BK virus
SPEEPEETK

SEQ ID NO: 21689 - protein, 9 aa, BK virus
PEEPEETKQ

SEQ ID NO: 21690 - protein, 9 aa, BK virus
EEPEETKQV

SEQ ID NO: 21691 - protein, 9 aa, BK virus
EPEETKQVS

SEQ ID NO: 21692 - protein, 9 aa, BK virus
PEETKQVSW

SEQ ID NO: 21693 - protein, 9 aa, BK virus
EETKQVSWK

SEQ ID NO: 21694 - protein, 9 aa, BK virus
ETKQVSWKL

SEQ ID NO: 21695 - protein, 9 aa, BK virus
TKQVSWKLI

SEQ ID NO: 21696 - protein, 9 aa, BK virus
KQVSWKLIT

SEQ ID NO: 21697 - protein, 9 aa, BK virus
QVSWKLITE

SEQ ID NO: 21698 - protein, 9 aa, BK virus
VSWKLITEY

SEQ ID NO: 21699 - protein, 9 aa, BK virus
SWKLITEYA

SEQ ID NO: 21700 - protein, 9 aa, BK virus
WKLITEYAV

SEQ ID NO: 21701 - protein, 9 aa, BK virus
KLITEYAVE

SEQ ID NO: 21702 - protein, 9 aa, BK virus
LITEYAVET

SEQ ID NO: 21703 - protein, 9 aa, BK virus
ITEYAVETK

SEQ ID NO: 21704 - protein, 9 aa, BK virus
TEYAVETKC

SEQ ID NO: 21705 - protein, 9 aa, BK virus
EYAVETKCE

SEQ ID NO: 21706 - protein, 9 aa, BK virus
YAVETKCED

SEQ ID NO: 21707 - protein, 9 aa, BK virus
AVETKCEDV

SEQ ID NO: 21708 - protein, 9 aa, BK virus
VETKCEDVF

SEQ ID NO: 21709 - protein, 9 aa, BK virus
ETKCEDVFL

SEQ ID NO: 21710 - protein, 9 aa, BK virus
TKCEDVFLL

SEQ ID NO: 21711 - protein, 9 aa, BK virus
KCEDVFLLL

SEQ ID NO: 21712 - protein, 9 aa, BK virus
CEDVFLLLG

SEQ ID NO: 21713 - protein, 9 aa, BK virus
EDVFLLLGM

SEQ ID NO: 21714 - protein, 9 aa, BK virus
DVFLLLGMY

SEQ ID NO: 21715 - protein, 9 aa, BK virus
VFLLLGMYL

SEQ ID NO: 21716 - protein, 9 aa, BK virus
FLLLGMYLE

SEQ ID NO: 21717 - protein, 9 aa, BK virus
LLLGMYLEF

SEQ ID NO: 21718 - protein, 9 aa, BK virus
LLGMYLEFQ

SEQ ID NO: 21719 - protein, 9 aa, BK virus
LGMYLEFQY

SEQ ID NO: 21720 - protein, 9 aa, BK virus
GMYLEFQYN

SEQ ID NO: 21721 - protein, 9 aa, BK virus
MYLEFQYNV

SEQ ID NO: 21722 - protein, 9 aa, BK virus
YLEFQYNVE

SEQ ID NO: 21723 - protein, 9 aa, BK virus
LEFQYNVEE

SEQ ID NO: 21724 - protein, 9 aa, BK virus
EFQYNVEEC

SEQ ID NO: 21725 - protein, 9 aa, BK virus
FQYNVEECK

SEQ ID NO: 21726 - protein, 9 aa, BK virus
QYNVEECKK

SEQ ID NO: 21727 - protein, 9 aa, BK virus
YNVEECKKC

SEQ ID NO: 21728 - protein, 9 aa, BK virus
NVEECKKCQ

SEQ ID NO: 21729 - protein, 9 aa, BK virus
VEECKKCQK

SEQ ID NO: 21730 - protein, 9 aa, BK virus
EECKKCQKK

SEQ ID NO: 21731 - protein, 9 aa, BK virus
ECKKCQKKD

SEQ ID NO: 21732 - protein, 9 aa, BK virus
CKKCQKKDQ

SEQ ID NO: 21733 - protein, 9 aa, BK virus
KKCQKKDQP

SEQ ID NO: 21734 - protein, 9 aa, BK virus
KCQKKDQPY

SEQ ID NO: 21735 - protein, 9 aa, BK virus
CQKKDQPYH

SEQ ID NO: 21736 - protein, 9 aa, BK virus
QKKDQPYHF

SEQ ID NO: 21737 - protein, 9 aa, BK virus
KKDQPYHFK

SEQ ID NO: 21738 - protein, 9 aa, BK virus
KDQPYHFKY

SEQ ID NO: 21739 - protein, 9 aa, BK virus
DQPYHFKYH

SEQ ID NO: 21740 - protein, 9 aa, BK virus
QPYHFKYHE

SEQ ID NO: 21741 - protein, 9 aa, BK virus
PYHFKYHEK

SEQ ID NO: 21742 - protein, 9 aa, BK virus
YHFKYHEKH

SEQ ID NO: 21743 - protein, 9 aa, BK virus
HFKYHEKHF

SEQ ID NO: 21744 - protein, 9 aa, BK virus
FKYHEKHFA

SEQ ID NO: 21745 - protein, 9 aa, BK virus
KYHEKHFAN

SEQ ID NO: 21746 - protein, 9 aa, BK virus
YHEKHFANA

SEQ ID NO: 21747 - protein, 9 aa, BK virus
HEKHFANAI

SEQ ID NO: 21748 - protein, 9 aa, BK virus
EKHFANAII

SEQ ID NO: 21749 - protein, 9 aa, BK virus
KHFANAIIF

SEQ ID NO: 21750 - protein, 9 aa, BK virus
HFANAIIFA

SEQ ID NO: 21751 - protein, 9 aa, BK virus
FANAIIFAE

SEQ ID NO: 21752 - protein, 9 aa, BK virus
ANAIIFAES

SEQ ID NO: 21753 - protein, 9 aa, BK virus
NAIIFAESK

SEQ ID NO: 21754 - protein, 9 aa, BK virus
AIIFAESKN

SEQ ID NO: 21755 - protein, 9 aa, BK virus
IIFAESKNQ

SEQ ID NO: 21756 - protein, 9 aa, BK virus
IFAESKNQK

SEQ ID NO: 21757 - protein, 9 aa, BK virus
FAESKNQKS

SEQ ID NO: 21758 - protein, 9 aa, BK virus
AESKNQKSI

SEQ ID NO: 21759 - protein, 9 aa, BK virus
ESKNQKSIC

SEQ ID NO: 21760 - protein, 9 aa, BK virus
SKNQKSICQ

SEQ ID NO: 21761 - protein, 9 aa, BK virus
KNQKSICQQ

SEQ ID NO: 21762 - protein, 9 aa, BK virus
NQKSICQQA

SEQ ID NO: 21763 - protein, 9 aa, BK virus
QKSICQQAV

SEQ ID NO: 21764 - protein, 9 aa, BK virus
KSICQQAVD

SEQ ID NO: 21765 - protein, 9 aa, BK virus
SICQQAVDT

SEQ ID NO: 21766 - protein, 9 aa, BK virus
ICQQAVDTV

SEQ ID NO: 21767 - protein, 9 aa, BK virus
CQQAVDTVL

SEQ ID NO: 21768 - protein, 9 aa, BK virus
QQAVDTVLA

SEQ ID NO: 21769 - protein, 9 aa, BK virus
QAVDTVLAK

SEQ ID NO: 21770 - protein, 9 aa, BK virus
AVDTVLAKK

SEQ ID NO: 21771 - protein, 9 aa, BK virus
VDTVLAKKR

SEQ ID NO: 21772 - protein, 9 aa, BK virus
DTVLAKKRV

SEQ ID NO: 21773 - protein, 9 aa, BK virus
TVLAKKRVD

SEQ ID NO: 21774 - protein, 9 aa, BK virus
VLAKKRVDT

SEQ ID NO: 21775 - protein, 9 aa, BK virus
LAKKRVDTL

SEQ ID NO: 21776 - protein, 9 aa, BK virus
AKKRVDTLH

SEQ ID NO: 21777 - protein, 9 aa, BK virus
KKRVDTLHM

SEQ ID NO: 21778 - protein, 9 aa, BK virus
KRVDTLHMT

SEQ ID NO: 21779 - protein, 9 aa, BK virus
RVDTLHMTR

SEQ ID NO: 21780 - protein, 9 aa, BK virus
VDTLHMTRE

SEQ ID NO: 21781 - protein, 9 aa, BK virus
DTLHMTREE

SEQ ID NO: 21782 - protein, 9 aa, BK virus
TLHMTREEM

SEQ ID NO: 21783 - protein, 9 aa, BK virus
LHMTREEML

SEQ ID NO: 21784 - protein, 9 aa, BK virus
HMTREEMLT

SEQ ID NO: 21785 - protein, 9 aa, BK virus
MTREEMLTE

SEQ ID NO: 21786 - protein, 9 aa, BK virus
TREEMLTER

SEQ ID NO: 21787 - protein, 9 aa, BK virus
REEMLTERF

SEQ ID NO: 21788 - protein, 9 aa, BK virus
EEMLTERFN

SEQ ID NO: 21789 - protein, 9 aa, BK virus
EMLTERFNH

SEQ ID NO: 21790 - protein, 9 aa, BK virus
MLTERFNHI

SEQ ID NO: 21791 - protein, 9 aa, BK virus
LTERFNHIL

SEQ ID NO: 21792 - protein, 9 aa, BK virus
TERFNHILD

SEQ ID NO: 21793 - protein, 9 aa, BK virus
ERFNHILDK

SEQ ID NO: 21794 - protein, 9 aa, BK virus
RFNHILDKM

SEQ ID NO: 21795 - protein, 9 aa, BK virus
FNHILDKMD

SEQ ID NO: 21796 - protein, 9 aa, BK virus
NHILDKMDL

SEQ ID NO: 21797 - protein, 9 aa, BK virus
HILDKMDLI

SEQ ID NO: 21798 - protein, 9 aa, BK virus
ILDKMDLIF

SEQ ID NO: 21799 - protein, 9 aa, BK virus
LDKMDLIFG

SEQ ID NO: 21800 - protein, 9 aa, BK virus
DKMDLIFGA

SEQ ID NO: 21801 - protein, 9 aa, BK virus
KMDLIFGAH

SEQ ID NO: 21802 - protein, 9 aa, BK virus
MDLIFGAHG

SEQ ID NO: 21803 - protein, 9 aa, BK virus
DLIFGAHGN

SEQ ID NO: 21804 - protein, 9 aa, BK virus
LIFGAHGNA

SEQ ID NO: 21805 - protein, 9 aa, BK virus
IFGAHGNAV

SEQ ID NO: 21806 - protein, 9 aa, BK virus
FGAHGNAVL

SEQ ID NO: 21807 - protein, 9 aa, BK virus
GAHGNAVLE

SEQ ID NO: 21808 - protein, 9 aa, BK virus
AHGNAVLEQ

SEQ ID NO: 21809 - protein, 9 aa, BK virus
HGNAVLEQY

SEQ ID NO: 21810 - protein, 9 aa, BK virus
GNAVLEQYM

SEQ ID NO: 21811 - protein, 9 aa, BK virus
NAVLEQYMA

SEQ ID NO: 21812 - protein, 9 aa, BK virus
AVLEQYMAG

SEQ ID NO: 21813 - protein, 9 aa, BK virus
VLEQYMAGV

SEQ ID NO: 21814 - protein, 9 aa, BK virus
LEQYMAGVA

SEQ ID NO: 21815 - protein, 9 aa, BK virus
EQYMAGVAW

SEQ ID NO: 21816 - protein, 9 aa, BK virus
QYMAGVAWL

SEQ ID NO: 21817 - protein, 9 aa, BK virus
YMAGVAWLH

SEQ ID NO: 21818 - protein, 9 aa, BK virus
MAGVAWLHC

SEQ ID NO: 21819 - protein, 9 aa, BK virus
AGVAWLHCL

SEQ ID NO: 21820 - protein, 9 aa, BK virus
GVAWLHCLL

SEQ ID NO: 21821 - protein, 9 aa, BK virus
VAWLHCLLP

SEQ ID NO: 21822 - protein, 9 aa, BK virus
AWLHCLLPK

SEQ ID NO: 21823 - protein, 9 aa, BK virus
WLHCLLPKM

SEQ ID NO: 21824 - protein, 9 aa, BK virus
LHCLLPKMD

SEQ ID NO: 21825 - protein, 9 aa, BK virus
HCLLPKMDS

SEQ ID NO: 21826 - protein, 9 aa, BK virus
CLLPKMDSV

SEQ ID NO: 21827 - protein, 9 aa, BK virus
LLPKMDSVI

SEQ ID NO: 21828 - protein, 9 aa, BK virus
LPKMDSVIF

SEQ ID NO: 21829 - protein, 9 aa, BK virus
PKMDSVIFD

SEQ ID NO: 21830 - protein, 9 aa, BK virus
KMDSVIFDF

SEQ ID NO: 21831 - protein, 9 aa, BK virus
MDSVIFDFL

SEQ ID NO: 21832 - protein, 9 aa, BK virus
DSVIFDFLH

SEQ ID NO: 21833 - protein, 9 aa, BK virus
SVIFDFLHC

SEQ ID NO: 21834 - protein, 9 aa, BK virus
VIFDFLHCI

SEQ ID NO: 21835 - protein, 9 aa, BK virus
IFDFLHCIV

SEQ ID NO: 21836 - protein, 9 aa, BK virus
FDFLHCIVF

SEQ ID NO: 21837 - protein, 9 aa, BK virus
DFLHCIVFN

SEQ ID NO: 21838 - protein, 9 aa, BK virus
FLHCIVFNV

SEQ ID NO: 21839 - protein, 9 aa, BK virus
LHCIVFNVP

SEQ ID NO: 21840 - protein, 9 aa, BK virus
HCIVFNVPK

SEQ ID NO: 21841 - protein, 9 aa, BK virus
CIVFNVPKR

SEQ ID NO: 21842 - protein, 9 aa, BK virus
IVFNVPKRR

SEQ ID NO: 21843 - protein, 9 aa, BK virus
VFNVPKRRY

SEQ ID NO: 21844 - protein, 9 aa, BK virus
FNVPKRRYW

SEQ ID NO: 21845 - protein, 9 aa, BK virus
NVPKRRYWL

SEQ ID NO: 21846 - protein, 9 aa, BK virus
VPKRRYWLF

SEQ ID NO: 21847 - protein, 9 aa, BK virus
PKRRYWLFK

SEQ ID NO: 21848 - protein, 9 aa, BK virus
KRRYWLFKG

SEQ ID NO: 21849 - protein, 9 aa, BK virus
RRYWLFKGP

SEQ ID NO: 21850 - protein, 9 aa, BK virus
RYWLFKGPI

SEQ ID NO: 21851 - protein, 9 aa, BK virus
YWLFKGPID

SEQ ID NO: 21852 - protein, 9 aa, BK virus
WLFKGPIDS

SEQ ID NO: 21853 - protein, 9 aa, BK virus
LFKGPIDSG

SEQ ID NO: 21854 - protein, 9 aa, BK virus
FKGPIDSGK

SEQ ID NO: 21855 - protein, 9 aa, BK virus
KGPIDSGKT

SEQ ID NO: 21856 - protein, 9 aa, BK virus
GPIDSGKTT

SEQ ID NO: 21857 - protein, 9 aa, BK virus
PIDSGKTTL

SEQ ID NO: 21858 - protein, 9 aa, BK virus
IDSGKTTLA

SEQ ID NO: 21859 - protein, 9 aa, BK virus
DSGKTTLAA

SEQ ID NO: 21860 - protein, 9 aa, BK virus
SGKTTLAAG

SEQ ID NO: 21861 - protein, 9 aa, BK virus
GKTTLAAGL

SEQ ID NO: 21862 - protein, 9 aa, BK virus
KTTLAAGLL

SEQ ID NO: 21863 - protein, 9 aa, BK virus
TTLAAGLLD

SEQ ID NO: 21864 - protein, 9 aa, BK virus
TLAAGLLDL

SEQ ID NO: 21865 - protein, 9 aa, BK virus
LAAGLLDLC

SEQ ID NO: 21866 - protein, 9 aa, BK virus
AAGLLDLCG

SEQ ID NO: 21867 - protein, 9 aa, BK virus
AGLLDLCGG

SEQ ID NO: 21868 - protein, 9 aa, BK virus
GLLDLCGGK

SEQ ID NO: 21869 - protein, 9 aa, BK virus
LLDLCGGKA

SEQ ID NO: 21870 - protein, 9 aa, BK virus
LDLCGGKAL

SEQ ID NO: 21871 - protein, 9 aa, BK virus
DLCGGKALN

SEQ ID NO: 21872 - protein, 9 aa, BK virus
LCGGKALNV

SEQ ID NO: 21873 - protein, 9 aa, BK virus
CGGKALNVN

SEQ ID NO: 21874 - protein, 9 aa, BK virus
GGKALNVNL

SEQ ID NO: 21875 - protein, 9 aa, BK virus
GKALNVNLP

SEQ ID NO: 21876 - protein, 9 aa, BK virus
KALNVNLPM

SEQ ID NO: 21877 - protein, 9 aa, BK virus
ALNVNLPME

SEQ ID NO: 21878 - protein, 9 aa, BK virus
LNVNLPMER

SEQ ID NO: 21879 - protein, 9 aa, BK virus
NVNLPMERL

SEQ ID NO: 21880 - protein, 9 aa, BK virus
VNLPMERLT

SEQ ID NO: 21881 - protein, 9 aa, BK virus
NLPMERLTF

SEQ ID NO: 21882 - protein, 9 aa, BK virus
LPMERLTFE

SEQ ID NO: 21883 - protein, 9 aa, BK virus
PMERLTFEL

SEQ ID NO: 21884 - protein, 9 aa, BK virus
MERLTFELG

SEQ ID NO: 21885 - protein, 9 aa, BK virus
ERLTFELGV

SEQ ID NO: 21886 - protein, 9 aa, BK virus
RLTFELGVA

SEQ ID NO: 21887 - protein, 9 aa, BK virus
LTFELGVAI

SEQ ID NO: 21888 - protein, 9 aa, BK virus
TFELGVAID

SEQ ID NO: 21889 - protein, 9 aa, BK virus
FELGVAIDQ

SEQ ID NO: 21890 - protein, 9 aa, BK virus
ELGVAIDQY

SEQ ID NO: 21891 - protein, 9 aa, BK virus
LGVAIDQYM

SEQ ID NO: 21892 - protein, 9 aa, BK virus
GVAIDQYMV

SEQ ID NO: 21893 - protein, 9 aa, BK virus
VAIDQYMVV

SEQ ID NO: 21894 - protein, 9 aa, BK virus
AIDQYMVVF

SEQ ID NO: 21895 - protein, 9 aa, BK virus
IDQYMVVFE

SEQ ID NO: 21896 - protein, 9 aa, BK virus
DQYMVVFED

SEQ ID NO: 21897 - protein, 9 aa, BK virus
QYMVVFEDV

SEQ ID NO: 21898 - protein, 9 aa, BK virus
YMVVFEDVK

SEQ ID NO: 21899 - protein, 9 aa, BK virus
MVVFEDVKG

SEQ ID NO: 21900 - protein, 9 aa, BK virus
VVFEDVKGT

SEQ ID NO: 21901 - protein, 9 aa, BK virus
VFEDVKGTG

SEQ ID NO: 21902 - protein, 9 aa, BK virus
FEDVKGTGA

SEQ ID NO: 21903 - protein, 9 aa, BK virus
EDVKGTGAE

SEQ ID NO: 21904 - protein, 9 aa, BK virus
DVKGTGAES

SEQ ID NO: 21905 - protein, 9 aa, BK virus
VKGTGAESK

SEQ ID NO: 21906 - protein, 9 aa, BK virus
KGTGAESKD

SEQ ID NO: 21907 - protein, 9 aa, BK virus
GTGAESKDL

SEQ ID NO: 21908 - protein, 9 aa, BK virus
TGAESKDLP

SEQ ID NO: 21909 - protein, 9 aa, BK virus
GAESKDLPS

SEQ ID NO: 21910 - protein, 9 aa, BK virus
AESKDLPSG

SEQ ID NO: 21911 - protein, 9 aa, BK virus
ESKDLPSGH

SEQ ID NO: 21912 - protein, 9 aa, BK virus
SKDLPSGHG

SEQ ID NO: 21913 - protein, 9 aa, BK virus
KDLPSGHGI

SEQ ID NO: 21914 - protein, 9 aa, BK virus
DLPSGHGIN

SEQ ID NO: 21915 - protein, 9 aa, BK virus
LPSGHGINN

SEQ ID NO: 21916 - protein, 9 aa, BK virus
PSGHGINNL

SEQ ID NO: 21917 - protein, 9 aa, BK virus
SGHGINNLD

SEQ ID NO: 21918 - protein, 9 aa, BK virus
GHGINNLDS

SEQ ID NO: 21919 - protein, 9 aa, BK virus
HGINNLDSL

SEQ ID NO: 21920 - protein, 9 aa, BK virus
GINNLDSLR

SEQ ID NO: 21921 - protein, 9 aa, BK virus
INNLDSLRD

SEQ ID NO: 21922 - protein, 9 aa, BK virus
NNLDSLRDY

SEQ ID NO: 21923 - protein, 9 aa, BK virus
NLDSLRDYL

SEQ ID NO: 21924 - protein, 9 aa, BK virus
LDSLRDYLD

SEQ ID NO: 21925 - protein, 9 aa, BK virus
DSLRDYLDG

SEQ ID NO: 21926 - protein, 9 aa, BK virus
SLRDYLDGS

SEQ ID NO: 21927 - protein, 9 aa, BK virus
LRDYLDGSV

SEQ ID NO: 21928 - protein, 9 aa, BK virus
RDYLDGSVK

SEQ ID NO: 21929 - protein, 9 aa, BK virus
DYLDGSVKV

SEQ ID NO: 21930 - protein, 9 aa, BK virus
YLDGSVKVN

SEQ ID NO: 21931 - protein, 9 aa, BK virus
LDGSVKVNL

SEQ ID NO: 21932 - protein, 9 aa, BK virus
DGSVKVNLE

SEQ ID NO: 21933 - protein, 9 aa, BK virus
GSVKVNLEK

SEQ ID NO: 21934 - protein, 9 aa, BK virus
SVKVNLEKK

SEQ ID NO: 21935 - protein, 9 aa, BK virus
VKVNLEKKH

SEQ ID NO: 21936 - protein, 9 aa, BK virus
KVNLEKKHL

SEQ ID NO: 21937 - protein, 9 aa, BK virus
VNLEKKHLN

SEQ ID NO: 21938 - protein, 9 aa, BK virus
NLEKKHLNK

SEQ ID NO: 21939 - protein, 9 aa, BK virus
LEKKHLNKR

SEQ ID NO: 21940 - protein, 9 aa, BK virus
EKKHLNKRT

SEQ ID NO: 21941 - protein, 9 aa, BK virus
KKHLNKRTQ

SEQ ID NO: 21942 - protein, 9 aa, BK virus
KHLNKRTQI

SEQ ID NO: 21943 - protein, 9 aa, BK virus
HLNKRTQIF

SEQ ID NO: 21944 - protein, 9 aa, BK virus
LNKRTQIFP

SEQ ID NO: 21945 - protein, 9 aa, BK virus
NKRTQIFPP

SEQ ID NO: 21946 - protein, 9 aa, BK virus
KRTQIFPPG

SEQ ID NO: 21947 - protein, 9 aa, BK virus
RTQIFPPGL

SEQ ID NO: 21948 - protein, 9 aa, BK virus
TQIFPPGLV

SEQ ID NO: 21949 - protein, 9 aa, BK virus
QIFPPGLVT

SEQ ID NO: 21950 - protein, 9 aa, BK virus
IFPPGLVTM

SEQ ID NO: 21951 - protein, 9 aa, BK virus
FPPGLVTMN

SEQ ID NO: 21952 - protein, 9 aa, BK virus
PPGLVTMNE

SEQ ID NO: 21953 - protein, 9 aa, BK virus
PGLVTMNEY

SEQ ID NO: 21954 - protein, 9 aa, BK virus
GLVTMNEYP

SEQ ID NO: 21955 - protein, 9 aa, BK virus
LVTMNEYPV

SEQ ID NO: 21956 - protein, 9 aa, BK virus
VTMNEYPVP

SEQ ID NO: 21957 - protein, 9 aa, BK virus
TMNEYPVPK

SEQ ID NO: 21958 - protein, 9 aa, BK virus
MNEYPVPKT

SEQ ID NO: 21959 - protein, 9 aa, BK virus
NEYPVPKTL

SEQ ID NO: 21960 - protein, 9 aa, BK virus
EYPVPKTLQ

SEQ ID NO: 21961 - protein, 9 aa, BK virus
YPVPKTLQA

SEQ ID NO: 21962 - protein, 9 aa, BK virus
PVPKTLQAR

SEQ ID NO: 21963 - protein, 9 aa, BK virus
VPKTLQARF

SEQ ID NO: 21964 - protein, 9 aa, BK virus
PKTLQARFV

SEQ ID NO: 21965 - protein, 9 aa, BK virus
KTLQARFVR

SEQ ID NO: 21966 - protein, 9 aa, BK virus
TLQARFVRQ

SEQ ID NO: 21967 - protein, 9 aa, BK virus
LQARFVRQI

SEQ ID NO: 21968 - protein, 9 aa, BK virus
QARFVRQID

SEQ ID NO: 21969 - protein, 9 aa, BK virus
ARFVRQIDF

SEQ ID NO: 21970 - protein, 9 aa, BK virus
RFVRQIDFR

SEQ ID NO: 21971 - protein, 9 aa, BK virus
FVRQIDFRP

SEQ ID NO: 21972 - protein, 9 aa, BK virus
VRQIDFRPK

SEQ ID NO: 21973 - protein, 9 aa, BK virus
RQIDFRPKI

SEQ ID NO: 21974 - protein, 9 aa, BK virus
QIDFRPKIY

SEQ ID NO: 21975 - protein, 9 aa, BK virus
IDFRPKIYL

SEQ ID NO: 21976 - protein, 9 aa, BK virus
DFRPKIYLR

SEQ ID NO: 21977 - protein, 9 aa, BK virus
FRPKIYLRK

SEQ ID NO: 21978 - protein, 9 aa, BK virus
RPKIYLRKS

SEQ ID NO: 21979 - protein, 9 aa, BK virus
PKIYLRKSL

SEQ ID NO: 21980 - protein, 9 aa, BK virus
KIYLRKSLQ

SEQ ID NO: 21981 - protein, 9 aa, BK virus
IYLRKSLQN

SEQ ID NO: 21982 - protein, 9 aa, BK virus
YLRKSLQNS

SEQ ID NO: 21983 - protein, 9 aa, BK virus
LRKSLQNSE

SEQ ID NO: 21984 - protein, 9 aa, BK virus
RKSLQNSEF

SEQ ID NO: 21985 - protein, 9 aa, BK virus
KSLQNSEFL

SEQ ID NO: 21986 - protein, 9 aa, BK virus
SLQNSEFLL

SEQ ID NO: 21987 - protein, 9 aa, BK virus
LQNSEFLLE

SEQ ID NO: 21988 - protein, 9 aa, BK virus
QNSEFLLEK

SEQ ID NO: 21989 - protein, 9 aa, BK virus
NSEFLLEKR

SEQ ID NO: 21990 - protein, 9 aa, BK virus
SEFLLEKRI

SEQ ID NO: 21991 - protein, 9 aa, BK virus
EFLLEKRIL

SEQ ID NO: 21992 - protein, 9 aa, BK virus
FLLEKRILQ

SEQ ID NO: 21993 - protein, 9 aa, BK virus
LLEKRILQS

SEQ ID NO: 21994 - protein, 9 aa, BK virus
LEKRILQSG

SEQ ID NO: 21995 - protein, 9 aa, BK virus
EKRILQSGM

SEQ ID NO: 21996 - protein, 9 aa, BK virus
KRILQSGMT

SEQ ID NO: 21997 - protein, 9 aa, BK virus
RILQSGMTL

SEQ ID NO: 21998 - protein, 9 aa, BK virus
ILQSGMTLL

SEQ ID NO: 21999 - protein, 9 aa, BK virus
LQSGMTLLL

SEQ ID NO: 22000 - protein, 9 aa, BK virus
QSGMTLLLL

SEQ ID NO: 22001 - protein, 9 aa, BK virus
SGMTLLLLL

SEQ ID NO: 22002 - protein, 9 aa, BK virus
GMTLLLLLI

SEQ ID NO: 22003 - protein, 9 aa, BK virus
MTLLLLLIW

SEQ ID NO: 22004 - protein, 9 aa, BK virus
TLLLLLIWF

SEQ ID NO: 22005 - protein, 9 aa, BK virus
LLLLLIWFR

SEQ ID NO: 22006 - protein, 9 aa, BK virus
LLLLIWFRP

SEQ ID NO: 22007 - protein, 9 aa, BK virus
LLLIWFRPV

SEQ ID NO: 22008 - protein, 9 aa, BK virus
LLIWFRPVA

SEQ ID NO: 22009 - protein, 9 aa, BK virus
LIWFRPVAD

SEQ ID NO: 22010 - protein, 9 aa, BK virus
IWFRPVADF

SEQ ID NO: 22011 - protein, 9 aa, BK virus
WFRPVADFA

SEQ ID NO: 22012 - protein, 9 aa, BK virus
FRPVADFAT

SEQ ID NO: 22013 - protein, 9 aa, BK virus
RPVADFATD

SEQ ID NO: 22014 - protein, 9 aa, BK virus
PVADFATDI

SEQ ID NO: 22015 - protein, 9 aa, BK virus
VADFATDIQ

SEQ ID NO: 22016 - protein, 9 aa, BK virus
ADFATDIQS

SEQ ID NO: 22017 - protein, 9 aa, BK virus
DFATDIQSR

SEQ ID NO: 22018 - protein, 9 aa, BK virus
FATDIQSRI

SEQ ID NO: 22019 - protein, 9 aa, BK virus
ATDIQSRIV

SEQ ID NO: 22020 - protein, 9 aa, BK virus
TDIQSRIVE

SEQ ID NO: 22021 - protein, 9 aa, BK virus
DIQSRIVEW

SEQ ID NO: 22022 - protein, 9 aa, BK virus
IQSRIVEWK

SEQ ID NO: 22023 - protein, 9 aa, BK virus
QSRIVEWKE

SEQ ID NO: 22024 - protein, 9 aa, BK virus
SRIVEWKER

SEQ ID NO: 22025 - protein, 9 aa, BK virus
RIVEWKERL

SEQ ID NO: 22026 - protein, 9 aa, BK virus
IVEWKERLD

SEQ ID NO: 22027 - protein, 9 aa, BK virus
VEWKERLDS

SEQ ID NO: 22028 - protein, 9 aa, BK virus
EWKERLDSE

SEQ ID NO: 22029 - protein, 9 aa, BK virus
WKERLDSEI

SEQ ID NO: 22030 - protein, 9 aa, BK virus
KERLDSEIS

SEQ ID NO: 22031 - protein, 9 aa, BK virus
ERLDSEISM

SEQ ID NO: 22032 - protein, 9 aa, BK virus
RLDSEISMY

SEQ ID NO: 22033 - protein, 9 aa, BK virus
LDSEISMYT

SEQ ID NO: 22034 - protein, 9 aa, BK virus
DSEISMYTF

SEQ ID NO: 22035 - protein, 9 aa, BK virus
SEISMYTFS

SEQ ID NO: 22036 - protein, 9 aa, BK virus
EISMYTFSR

SEQ ID NO: 22037 - protein, 9 aa, BK virus
ISMYTFSRM

SEQ ID NO: 22038 - protein, 9 aa, BK virus
SMYTFSRMK

SEQ ID NO: 22039 - protein, 9 aa, BK virus
MYTFSRMKY

SEQ ID NO: 22040 - protein, 9 aa, BK virus
YTFSRMKYN

SEQ ID NO: 22041 - protein, 9 aa, BK virus
TFSRMKYNI

SEQ ID NO: 22042 - protein, 9 aa, BK virus
FSRMKYNIC

SEQ ID NO: 22043 - protein, 9 aa, BK virus
SRMKYNICM

SEQ ID NO: 22044 - protein, 9 aa, BK virus
RMKYNICMG

SEQ ID NO: 22045 - protein, 9 aa, BK virus
MKYNICMGK

SEQ ID NO: 22046 - protein, 9 aa, BK virus
KYNICMGKC

SEQ ID NO: 22047 - protein, 9 aa, BK virus
YNICMGKCI

SEQ ID NO: 22048 - protein, 9 aa, BK virus
NICMGKCIL

SEQ ID NO: 22049 - protein, 9 aa, BK virus
ICMGKCILD

SEQ ID NO: 22050 - protein, 9 aa, BK virus
CMGKCILDI

SEQ ID NO: 22051 - protein, 9 aa, BK virus
MGKCILDIT

SEQ ID NO: 22052 - protein, 9 aa, BK virus
GKCILDITR

SEQ ID NO: 22053 - protein, 9 aa, BK virus
KCILDITRE

SEQ ID NO: 22054 - protein, 9 aa, BK virus
CILDITREE

SEQ ID NO: 22055 - protein, 9 aa, BK virus
ILDITREED

SEQ ID NO: 22056 - protein, 9 aa, BK virus
LDITREEDS

SEQ ID NO: 22057 - protein, 9 aa, BK virus
DITREEDSE

SEQ ID NO: 22058 - protein, 9 aa, BK virus
ITREEDSET

SEQ ID NO: 22059 - protein, 9 aa, BK virus
TREEDSETE

SEQ ID NO: 22060 - protein, 9 aa, BK virus
REEDSETED

SEQ ID NO: 22061 - protein, 9 aa, BK virus
EEDSETEDS

SEQ ID NO: 22062 - protein, 9 aa, BK virus
EDSETEDSG

SEQ ID NO: 22063 - protein, 9 aa, BK virus
DSETEDSGH

SEQ ID NO: 22064 - protein, 9 aa, BK virus
SETEDSGHG

SEQ ID NO: 22065 - protein, 9 aa, BK virus
ETEDSGHGS

SEQ ID NO: 22066 - protein, 9 aa, BK virus
TEDSGHGSS

SEQ ID NO: 22067 - protein, 9 aa, BK virus
EDSGHGSST

SEQ ID NO: 22068 - protein, 9 aa, BK virus
DSGHGSSTE

SEQ ID NO: 22069 - protein, 9 aa, BK virus
SGHGSSTES

SEQ ID NO: 22070 - protein, 9 aa, BK virus
GHGSSTESQ

SEQ ID NO: 22071 - protein, 9 aa, BK virus
HGSSTESQS

SEQ ID NO: 22072 - protein, 9 aa, BK virus
GSSTESQSQ

SEQ ID NO: 22073 - protein, 9 aa, BK virus
SSTESQSQC

SEQ ID NO: 22074 - protein, 9 aa, BK virus
STESQSQCS

SEQ ID NO: 22075 - protein, 9 aa, BK virus
TESQSQCSS

SEQ ID NO: 22076 - protein, 9 aa, BK virus
ESQSQCSSQ

SEQ ID NO: 22077 - protein, 9 aa, BK virus
SQSQCSSQV

SEQ ID NO: 22078 - protein, 9 aa, BK virus
QSQCSSQVS

SEQ ID NO: 22079 - protein, 9 aa, BK virus
SQCSSQVSD

SEQ ID NO: 22080 - protein, 9 aa, BK virus
QCSSQVSDT

SEQ ID NO: 22081 - protein, 9 aa, BK virus
CSSQVSDTS

SEQ ID NO: 22082 - protein, 9 aa, BK virus
SSQVSDTSA

SEQ ID NO: 22083 - protein, 9 aa, BK virus
SQVSDTSAP

SEQ ID NO: 22084 - protein, 9 aa, BK virus
QVSDTSAPA

SEQ ID NO: 22085 - protein, 9 aa, BK virus
VSDTSAPAE

SEQ ID NO: 22086 - protein, 9 aa, BK virus
SDTSAPAED

SEQ ID NO: 22087 - protein, 9 aa, BK virus
DTSAPAEDS

SEQ ID NO: 22088 - protein, 9 aa, BK virus
TSAPAEDSQ

SEQ ID NO: 22089 - protein, 9 aa, BK virus
SAPAEDSQR

SEQ ID NO: 22090 - protein, 9 aa, BK virus
APAEDSQRS

SEQ ID NO: 22091 - protein, 9 aa, BK virus
PAEDSQRSD

SEQ ID NO: 22092 - protein, 9 aa, BK virus
AEDSQRSDP

SEQ ID NO: 22093 - protein, 9 aa, BK virus
EDSQRSDPH

SEQ ID NO: 22094 - protein, 9 aa, BK virus
DSQRSDPHS

SEQ ID NO: 22095 - protein, 9 aa, BK virus
SQRSDPHSQ

SEQ ID NO: 22096 - protein, 9 aa, BK virus
QRSDPHSQE

SEQ ID NO: 22097 - protein, 9 aa, BK virus
RSDPHSQEL

SEQ ID NO: 22098 - protein, 9 aa, BK virus
SDPHSQELH

SEQ ID NO: 22099 - protein, 9 aa, BK virus
DPHSQELHL

SEQ ID NO: 22100 - protein, 9 aa, BK virus
PHSQELHLC

SEQ ID NO: 22101 - protein, 9 aa, BK virus
HSQELHLCK

SEQ ID NO: 22102 - protein, 9 aa, BK virus
SQELHLCKG

SEQ ID NO: 22103 - protein, 9 aa, BK virus
QELHLCKGF

SEQ ID NO: 22104 - protein, 9 aa, BK virus
ELHLCKGFQ

SEQ ID NO: 22105 - protein, 9 aa, BK virus
LHLCKGFQC

SEQ ID NO: 22106 - protein, 9 aa, BK virus
HLCKGFQCF

SEQ ID NO: 22107 - protein, 9 aa, BK virus
LCKGFQCFK

SEQ ID NO: 22108 - protein, 9 aa, BK virus
CKGFQCFKR

SEQ ID NO: 22109 - protein, 9 aa, BK virus
KGFQCFKRP

SEQ ID NO: 22110 - protein, 9 aa, BK virus
GFQCFKRPK

SEQ ID NO: 22111 - protein, 9 aa, BK virus
FQCFKRPKT

SEQ ID NO: 22112 - protein, 9 aa, BK virus
QCFKRPKTP

SEQ ID NO: 22113 - protein, 9 aa, BK virus
CFKRPKTPP

SEQ ID NO: 22114 - protein, 9 aa, BK virus
FKRPKTPPP

SEQ ID NO: 22115 - protein, 9 aa, BK virus
KRPKTPPPK

SEQ ID NO: 22116 - protein, 9 aa, BK virus
HKLKSGLYK

SEQ ID NO: 22117 - protein, 9 aa, BK virus
KLKSGLYKS

SEQ ID NO: 22118 - protein, 9 aa, BK virus
LKSGLYKSS

SEQ ID NO: 22119 - protein, 9 aa, BK virus
KSGLYKSSI

SEQ ID NO: 22120 - protein, 9 aa, BK virus
SGLYKSSIY

SEQ ID NO: 22121 - protein, 9 aa, BK virus
MYMYNKSTC

SEQ ID NO: 22122 - protein, 9 aa, BK virus
YMYNKSTCL

SEQ ID NO: 22123 - protein, 9 aa, BK virus
MYNKSTCLK

SEQ ID NO: 22124 - protein, 9 aa, BK virus
YNKSTCLKH

SEQ ID NO: 22125 - protein, 9 aa, BK virus
NKSTCLKHF

SEQ ID NO: 22126 - protein, 9 aa, BK virus
KSTCLKHFG

SEQ ID NO: 22127 - protein, 9 aa, BK virus
STCLKHFGL

SEQ ID NO: 22128 - protein, 9 aa, BK virus
TCLKHFGLQ

SEQ ID NO: 22129 - protein, 9 aa, BK virus
CLKHFGLQL

SEQ ID NO: 22130 - protein, 9 aa, BK virus
LKHFGLQLS

SEQ ID NO: 22131 - protein, 9 aa, BK virus
KHFGLQLSL

SEQ ID NO: 22132 - protein, 9 aa, BK virus
HFGLQLSLF

SEQ ID NO: 22133 - protein, 9 aa, BK virus
FGLQLSLFV

SEQ ID NO: 22134 - protein, 9 aa, BK virus
GLQLSLFVN

SEQ ID NO: 22135 - protein, 9 aa, BK virus
LQLSLFVNI

SEQ ID NO: 22136 - protein, 9 aa, BK virus
QLSLFVNIS

SEQ ID NO: 22137 - protein, 9 aa, BK virus
LSLFVNISY

SEQ ID NO: 22138 - protein, 9 aa, BK virus
SLFVNISYH

SEQ ID NO: 22139 - protein, 9 aa, BK virus
LFVNISYHI

SEQ ID NO: 22140 - protein, 9 aa, BK virus
FVNISYHIW

SEQ ID NO: 22141 - protein, 9 aa, BK virus
VNISYHIWV

SEQ ID NO: 22142 - protein, 9 aa, BK virus
NISYHIWVP

SEQ ID NO: 22143 - protein, 9 aa, BK virus
ISYHIWVPW

SEQ ID NO: 22144 - protein, 9 aa, BK virus
SYHIWVPWK

SEQ ID NO: 22145 - protein, 9 aa, BK virus
YHIWVPWKS

SEQ ID NO: 22146 - protein, 9 aa, BK virus
HIWVPWKSF

SEQ ID NO: 22147 - protein, 9 aa, BK virus
IWVPWKSFC

SEQ ID NO: 22148 - protein, 9 aa, BK virus
WVPWKSFCA

SEQ ID NO: 22149 - protein, 9 aa, BK virus
VPWKSFCAI

SEQ ID NO: 22150 - protein, 9 aa, BK virus
PWKSFCAIK

SEQ ID NO: 22151 - protein, 9 aa, BK virus
WKSFCAIKH

SEQ ID NO: 22152 - protein, 9 aa, BK virus
KSFCAIKHP

SEQ ID NO: 22153 - protein, 9 aa, BK virus
SFCAIKHPN

SEQ ID NO: 22154 - protein, 9 aa, BK virus
FCAIKHPNL

SEQ ID NO: 22155 - protein, 9 aa, BK virus
CAIKHPNLF

SEQ ID NO: 22156 - protein, 9 aa, BK virus
AIKHPNLFY

SEQ ID NO: 22157 - protein, 9 aa, BK virus
IKHPNLFYL

SEQ ID NO: 22158 - protein, 9 aa, BK virus
KHPNLFYLG

SEQ ID NO: 22159 - protein, 9 aa, BK virus
HPNLFYLGF

SEQ ID NO: 22160 - protein, 9 aa, BK virus
PNLFYLGFH

SEQ ID NO: 22161 - protein, 9 aa, BK virus
NLFYLGFHT

SEQ ID NO: 22162 - protein, 9 aa, BK virus
LFYLGFHTI

SEQ ID NO: 22163 - protein, 9 aa, BK virus
FYLGFHTIH

SEQ ID NO: 22164 - protein, 9 aa, BK virus
YLGFHTIHR

SEQ ID NO: 22165 - protein, 9 aa, BK virus
LGFHTIHRL

SEQ ID NO: 22166 - protein, 9 aa, BK virus
GFHTIHRLP

SEQ ID NO: 22167 - protein, 9 aa, BK virus
FHTIHRLPI

SEQ ID NO: 22168 - protein, 9 aa, BK virus
HTIHRLPIH

SEQ ID NO: 22169 - protein, 9 aa, BK virus
TIHRLPIHS

SEQ ID NO: 22170 - protein, 9 aa, BK virus
IHRLPIHSL

SEQ ID NO: 22171 - protein, 9 aa, BK virus
HRLPIHSLG

SEQ ID NO: 22172 - protein, 9 aa, BK virus
RLPIHSLGS

SEQ ID NO: 22173 - protein, 9 aa, BK virus
LPIHSLGSP

SEQ ID NO: 22174 - protein, 9 aa, BK virus
PIHSLGSPV

SEQ ID NO: 22175 - protein, 9 aa, BK virus
IHSLGSPVY

SEQ ID NO: 22176 - protein, 9 aa, BK virus
HSLGSPVYK

SEQ ID NO: 22177 - protein, 9 aa, BK virus
SLGSPVYKV

SEQ ID NO: 22178 - protein, 9 aa, BK virus
LGSPVYKVT

SEQ ID NO: 22179 - protein, 9 aa, BK virus
QKGNWVRIL

SEQ ID NO: 22180 - protein, 9 aa, BK virus
KGNWVRILY

SEQ ID NO: 22181 - protein, 9 aa, BK virus
GNWVRILYR

SEQ ID NO: 22182 - protein, 9 aa, BK virus
NWVRILYRS

SEQ ID NO: 22183 - protein, 9 aa, BK virus
WVRILYRSF

SEQ ID NO: 22184 - protein, 9 aa, BK virus
VRILYRSFS

SEQ ID NO: 22185 - protein, 9 aa, BK virus
RILYRSFSQ

SEQ ID NO: 22186 - protein, 9 aa, BK virus
ILYRSFSQA

SEQ ID NO: 22187 - protein, 9 aa, BK virus
LYRSFSQAD

SEQ ID NO: 22188 - protein, 9 aa, BK virus
YRSFSQADL

SEQ ID NO: 22189 - protein, 9 aa, BK virus
RSFSQADLK

SEQ ID NO: 22190 - protein, 9 aa, BK virus
SFSQADLKI

SEQ ID NO: 22191 - protein, 9 aa, BK virus
FSQADLKIS

SEQ ID NO: 22192 - protein, 9 aa, BK virus
SQADLKISC

SEQ ID NO: 22193 - protein, 9 aa, BK virus
QADLKISCK

SEQ ID NO: 22194 - protein, 9 aa, BK virus
ADLKISCKA

SEQ ID NO: 22195 - protein, 9 aa, BK virus
DLKISCKAS

SEQ ID NO: 22196 - protein, 9 aa, BK virus
LKISCKASP

SEQ ID NO: 22197 - protein, 9 aa, BK virus
KISCKASPL

SEQ ID NO: 22198 - protein, 9 aa, BK virus
ISCKASPLL

SEQ ID NO: 22199 - protein, 9 aa, BK virus
SCKASPLLC

SEQ ID NO: 22200 - protein, 9 aa, BK virus
CKASPLLCS

SEQ ID NO: 22201 - protein, 9 aa, BK virus
KASPLLCSR

SEQ ID NO: 22202 - protein, 9 aa, BK virus
ASPLLCSRA

SEQ ID NO: 22203 - protein, 9 aa, BK virus
SPLLCSRAV

SEQ ID NO: 22204 - protein, 9 aa, BK virus
PLLCSRAVS

SEQ ID NO: 22205 - protein, 9 aa, BK virus
LLCSRAVSK

SEQ ID NO: 22206 - protein, 9 aa, BK virus
LCSRAVSKQ

SEQ ID NO: 22207 - protein, 9 aa, BK virus
CSRAVSKQA

SEQ ID NO: 22208 - protein, 9 aa, BK virus
SRAVSKQAT

SEQ ID NO: 22209 - protein, 9 aa, BK virus
RAVSKQATN

SEQ ID NO: 22210 - protein, 9 aa, BK virus
AVSKQATNI

SEQ ID NO: 22211 - protein, 9 aa, BK virus
VSKQATNIS

SEQ ID NO: 22212 - protein, 9 aa, BK virus
SKQATNISS

SEQ ID NO: 22213 - protein, 9 aa, BK virus
NIQAISFTK

SEQ ID NO: 22214 - protein, 9 aa, BK virus
IQAISFTKR

SEQ ID NO: 22215 - protein, 9 aa, BK virus
QAISFTKRP

SEQ ID NO: 22216 - protein, 9 aa, BK virus
AISFTKRPH

SEQ ID NO: 22217 - protein, 9 aa, BK virus
ISFTKRPHT

SEQ ID NO: 22218 - protein, 9 aa, BK virus
SFTKRPHTL

SEQ ID NO: 22219 - protein, 9 aa, BK virus
FTKRPHTLF

SEQ ID NO: 22220 - protein, 9 aa, BK virus
TKRPHTLFI

SEQ ID NO: 22221 - protein, 9 aa, BK virus
QHCGSCVGH

SEQ ID NO: 22222 - protein, 9 aa, BK virus
HCGSCVGHM

SEQ ID NO: 22223 - protein, 9 aa, BK virus
CGSCVGHMK

SEQ ID NO: 22224 - protein, 9 aa, BK virus
GSCVGHMKY

SEQ ID NO: 22225 - protein, 9 aa, BK virus
SCVGHMKYW

SEQ ID NO: 22226 - protein, 9 aa, BK virus
CVGHMKYWG

SEQ ID NO: 22227 - protein, 9 aa, BK virus
VGHMKYWGN

SEQ ID NO: 22228 - protein, 9 aa, BK virus
GHMKYWGNI

SEQ ID NO: 22229 - protein, 9 aa, BK virus
HMKYWGNIF

SEQ ID NO: 22230 - protein, 9 aa, BK virus
MKYWGNIFP

SEQ ID NO: 22231 - protein, 9 aa, BK virus
KYWGNIFPS

SEQ ID NO: 22232 - protein, 9 aa, BK virus
YWGNIFPSC

SEQ ID NO: 22233 - protein, 9 aa, BK virus
WGNIFPSCE

SEQ ID NO: 22234 - protein, 9 aa, BK virus
GNIFPSCES

SEQ ID NO: 22235 - protein, 9 aa, BK virus
NIFPSCESP

SEQ ID NO: 22236 - protein, 9 aa, BK virus
IFPSCESPK

SEQ ID NO: 22237 - protein, 9 aa, BK virus
FPSCESPKI

SEQ ID NO: 22238 - protein, 9 aa, BK virus
PSCESPKIP

SEQ ID NO: 22239 - protein, 9 aa, BK virus
SCESPKIPS

SEQ ID NO: 22240 - protein, 9 aa, BK virus
CESPKIPSI

SEQ ID NO: 22241 - protein, 9 aa, BK virus
ESPKIPSIF

SEQ ID NO: 22242 - protein, 9 aa, BK virus
SPKIPSIFI

SEQ ID NO: 22243 - protein, 9 aa, BK virus
PKIPSIFIS

SEQ ID NO: 22244 - protein, 9 aa, BK virus
KIPSIFIST

SEQ ID NO: 22245 - protein, 9 aa, BK virus
IPSIFISTG

SEQ ID NO: 22246 - protein, 9 aa, BK virus
PSIFISTGI

SEQ ID NO: 22247 - protein, 9 aa, BK virus
SIFISTGIR

SEQ ID NO: 22248 - protein, 9 aa, BK virus
IFISTGIRY

SEQ ID NO: 22249 - protein, 9 aa, BK virus
FISTGIRYP

SEQ ID NO: 22250 - protein, 9 aa, BK virus
ISTGIRYPA

SEQ ID NO: 22251 - protein, 9 aa, BK virus
STGIRYPAL

SEQ ID NO: 22252 - protein, 9 aa, BK virus
TGIRYPALN

SEQ ID NO: 22253 - protein, 9 aa, BK virus
GIRYPALNW

SEQ ID NO: 22254 - protein, 9 aa, BK virus
IRYPALNWI

SEQ ID NO: 22255 - protein, 9 aa, BK virus
RYPALNWIS

SEQ ID NO: 22256 - protein, 9 aa, BK virus
YPALNWISI

SEQ ID NO: 22257 - protein, 9 aa, BK virus
PALNWISIV

SEQ ID NO: 22258 - protein, 9 aa, BK virus
ALNWISIVF

SEQ ID NO: 22259 - protein, 9 aa, BK virus
LNWISIVFV

SEQ ID NO: 22260 - protein, 9 aa, BK virus
NWISIVFVQ

SEQ ID NO: 22261 - protein, 9 aa, BK virus
WISIVFVQI

SEQ ID NO: 22262 - protein, 9 aa, BK virus
ISIVFVQIG

SEQ ID NO: 22263 - protein, 9 aa, BK virus
SIVFVQIGL

SEQ ID NO: 22264 - protein, 9 aa, BK virus
IVFVQIGLM

SEQ ID NO: 22265 - protein, 9 aa, BK virus
VFVQIGLMV

SEQ ID NO: 22266 - protein, 9 aa, BK virus
FVQIGLMVS

SEQ ID NO: 22267 - protein, 9 aa, BK virus
VQIGLMVSI

SEQ ID NO: 22268 - protein, 9 aa, BK virus
QIGLMVSIH

SEQ ID NO: 22269 - protein, 9 aa, BK virus
IGLMVSIHY

SEQ ID NO: 22270 - protein, 9 aa, BK virus
GLMVSIHYL

SEQ ID NO: 22271 - protein, 9 aa, BK virus
LMVSIHYLG

SEQ ID NO: 22272 - protein, 9 aa, BK virus
MVSIHYLGL

SEQ ID NO: 22273 - protein, 9 aa, BK virus
VSIHYLGLG

SEQ ID NO: 22274 - protein, 9 aa, BK virus
SIHYLGLGC

SEQ ID NO: 22275 - protein, 9 aa, BK virus
IHYLGLGCW

SEQ ID NO: 22276 - protein, 9 aa, BK virus
HYLGLGCWV

SEQ ID NO: 22277 - protein, 9 aa, BK virus
YLGLGCWVF

SEQ ID NO: 22278 - protein, 9 aa, BK virus
LGLGCWVFR

SEQ ID NO: 22279 - protein, 9 aa, BK virus
GLGCWVFRG

SEQ ID NO: 22280 - protein, 9 aa, BK virus
LGCWVFRGY

SEQ ID NO: 22281 - protein, 9 aa, BK virus
GCWVFRGYS

SEQ ID NO: 22282 - protein, 9 aa, BK virus
CWVFRGYST

SEQ ID NO: 22283 - protein, 9 aa, BK virus
WVFRGYSTI

SEQ ID NO: 22284 - protein, 9 aa, BK virus
VFRGYSTIR

SEQ ID NO: 22285 - protein, 9 aa, BK virus
FRGYSTIRV

SEQ ID NO: 22286 - protein, 9 aa, BK virus
RGYSTIRVL

SEQ ID NO: 22287 - protein, 9 aa, BK virus
HSLHFQGFS

SEQ ID NO: 22288 - protein, 9 aa, BK virus
SLHFQGFST

SEQ ID NO: 22289 - protein, 9 aa, BK virus
LHFQGFSTY

SEQ ID NO: 22290 - protein, 9 aa, BK virus
HFQGFSTYS

SEQ ID NO: 22291 - protein, 9 aa, BK virus
FQGFSTYSK

SEQ ID NO: 22292 - protein, 9 aa, BK virus
QGFSTYSKE

SEQ ID NO: 22293 - protein, 9 aa, BK virus
GFSTYSKEV

SEQ ID NO: 22294 - protein, 9 aa, BK virus
FSTYSKEVE

SEQ ID NO: 22295 - protein, 9 aa, BK virus
STYSKEVEI

SEQ ID NO: 22296 - protein, 9 aa, BK virus
TYSKEVEIT

SEQ ID NO: 22297 - protein, 9 aa, BK virus
YSKEVEITA

SEQ ID NO: 22298 - protein, 9 aa, BK virus
SKEVEITAL

SEQ ID NO: 22299 - protein, 9 aa, BK virus
KEVEITALN

SEQ ID NO: 22300 - protein, 9 aa, BK virus
EVEITALNR

SEQ ID NO: 22301 - protein, 9 aa, BK virus
VEITALNRF

SEQ ID NO: 22302 - protein, 9 aa, BK virus
EITALNRFS

SEQ ID NO: 22303 - protein, 9 aa, BK virus
ITALNRFSS

SEQ ID NO: 22304 - protein, 9 aa, BK virus
TALNRFSST

SEQ ID NO: 22305 - protein, 9 aa, BK virus
ALNRFSSTM

SEQ ID NO: 22306 - protein, 9 aa, BK virus
LNRFSSTML

SEQ ID NO: 22307 - protein, 9 aa, BK virus
NRFSSTMLM

SEQ ID NO: 22308 - protein, 9 aa, BK virus
RFSSTMLMH

SEQ ID NO: 22309 - protein, 9 aa, BK virus
FSSTMLMHF

SEQ ID NO: 22310 - protein, 9 aa, BK virus
SSTMLMHFL

SEQ ID NO: 22311 - protein, 9 aa, BK virus
PCMKVKHAS

SEQ ID NO: 22312 - protein, 9 aa, BK virus
CMKVKHASY

SEQ ID NO: 22313 - protein, 9 aa, BK virus
MKVKHASYS

SEQ ID NO: 22314 - protein, 9 aa, BK virus
KVKHASYSN

SEQ ID NO: 22315 - protein, 9 aa, BK virus
VKHASYSNN

SEQ ID NO: 22316 - protein, 9 aa, BK virus
KHASYSNNL

SEQ ID NO: 22317 - protein, 9 aa, BK virus
HASYSNNLC

SEQ ID NO: 22318 - protein, 9 aa, BK virus
ASYSNNLCL

SEQ ID NO: 22319 - protein, 9 aa, BK virus
SYSNNLCLY

SEQ ID NO: 22320 - protein, 9 aa, BK virus
YSNNLCLYS

SEQ ID NO: 22321 - protein, 9 aa, BK virus
SNNLCLYSY

SEQ ID NO: 22322 - protein, 9 aa, BK virus
NNLCLYSYS

SEQ ID NO: 22323 - protein, 9 aa, BK virus
NLCLYSYSL

SEQ ID NO: 22324 - protein, 9 aa, BK virus
LCLYSYSLP

SEQ ID NO: 22325 - protein, 9 aa, BK virus
CLYSYSLPH

SEQ ID NO: 22326 - protein, 9 aa, BK virus
LYSYSLPHQ

SEQ ID NO: 22327 - protein, 9 aa, BK virus
IGEGNSCCA

SEQ ID NO: 22328 - protein, 9 aa, BK virus
GEGNSCCAV

SEQ ID NO: 22329 - protein, 9 aa, BK virus
EGNSCCAVT

SEQ ID NO: 22330 - protein, 9 aa, BK virus
GNSCCAVTG

SEQ ID NO: 22331 - protein, 9 aa, BK virus
NSCCAVTGK

SEQ ID NO: 22332 - protein, 9 aa, BK virus
SCCAVTGKH

SEQ ID NO: 22333 - protein, 9 aa, BK virus
CCAVTGKHF

SEQ ID NO: 22334 - protein, 9 aa, BK virus
CAVTGKHFS

SEQ ID NO: 22335 - protein, 9 aa, BK virus
AVTGKHFSL

SEQ ID NO: 22336 - protein, 9 aa, BK virus
VTGKHFSLW

SEQ ID NO: 22337 - protein, 9 aa, BK virus
TGKHFSLWA

SEQ ID NO: 22338 - protein, 9 aa, BK virus
GKHFSLWAI

SEQ ID NO: 22339 - protein, 9 aa, BK virus
KHFSLWAIT

SEQ ID NO: 22340 - protein, 9 aa, BK virus
HFSLWAITA

SEQ ID NO: 22341 - protein, 9 aa, BK virus
FSLWAITAK

SEQ ID NO: 22342 - protein, 9 aa, BK virus
SLWAITAKV

SEQ ID NO: 22343 - protein, 9 aa, BK virus
LWAITAKVI

SEQ ID NO: 22344 - protein, 9 aa, BK virus
WAITAKVIF

SEQ ID NO: 22345 - protein, 9 aa, BK virus
AITAKVIFS

SEQ ID NO: 22346 - protein, 9 aa, BK virus
ITAKVIFST

SEQ ID NO: 22347 - protein, 9 aa, BK virus
TKAPKVFIW

SEQ ID NO: 22348 - protein, 9 aa, BK virus
KAPKVFIWI

SEQ ID NO: 22349 - protein, 9 aa, BK virus
APKVFIWIP

SEQ ID NO: 22350 - protein, 9 aa, BK virus
PKVFIWIPH

SEQ ID NO: 22351 - protein, 9 aa, BK virus
KVFIWIPHF

SEQ ID NO: 22352 - protein, 9 aa, BK virus
VFIWIPHFW

SEQ ID NO: 22353 - protein, 9 aa, BK virus
FIWIPHFWV

SEQ ID NO: 22354 - protein, 9 aa, BK virus
EAFYLCNSI

SEQ ID NO: 22355 - protein, 9 aa, BK virus
AFYLCNSIY

SEQ ID NO: 22356 - protein, 9 aa, BK virus
FYLCNSIYP

SEQ ID NO: 22357 - protein, 9 aa, BK virus
YLCNSIYPS

SEQ ID NO: 22358 - protein, 9 aa, BK virus
LCNSIYPSF

SEQ ID NO: 22359 - protein, 9 aa, BK virus
CNSIYPSFN

SEQ ID NO: 22360 - protein, 9 aa, BK virus
NSIYPSFNF

SEQ ID NO: 22361 - protein, 9 aa, BK virus
FWHLHGFLW

SEQ ID NO: 22362 - protein, 9 aa, BK virus
WHLHGFLWL

SEQ ID NO: 22363 - protein, 9 aa, BK virus
HLHGFLWLF

SEQ ID NO: 22364 - protein, 9 aa, BK virus
LHGFLWLFG

SEQ ID NO: 22365 - protein, 9 aa, BK virus
HGFLWLFGS

SEQ ID NO: 22366 - protein, 9 aa, BK virus
GFLWLFGSC

SEQ ID NO: 22367 - protein, 9 aa, BK virus
FLWLFGSCP

SEQ ID NO: 22368 - protein, 9 aa, BK virus
LWLFGSCPW

SEQ ID NO: 22369 - protein, 9 aa, BK virus
WLFGSCPWT

SEQ ID NO: 22370 - protein, 9 aa, BK virus
LFGSCPWTL

SEQ ID NO: 22371 - protein, 9 aa, BK virus
FGSCPWTLS

SEQ ID NO: 22372 - protein, 9 aa, BK virus
GSCPWTLSF

SEQ ID NO: 22373 - protein, 9 aa, BK virus
SCPWTLSFS

SEQ ID NO: 22374 - protein, 9 aa, BK virus
CPWTLSFSF

SEQ ID NO: 22375 - protein, 9 aa, BK virus
PWTLSFSFG

SEQ ID NO: 22376 - protein, 9 aa, BK virus
WTLSFSFGW

SEQ ID NO: 22377 - protein, 9 aa, BK virus
TLSFSFGWG

SEQ ID NO: 22378 - protein, 9 aa, BK virus
LSFSFGWGH

SEQ ID NO: 22379 - protein, 9 aa, BK virus
SFSFGWGHL

SEQ ID NO: 22380 - protein, 9 aa, BK virus
FSFGWGHLH

SEQ ID NO: 22381 - protein, 9 aa, BK virus
SFGWGHLHM

SEQ ID NO: 22382 - protein, 9 aa, BK virus
FGWGHLHML

SEQ ID NO: 22383 - protein, 9 aa, BK virus
GWGHLHMLQ

SEQ ID NO: 22384 - protein, 9 aa, BK virus
WGHLHMLQE

SEQ ID NO: 22385 - protein, 9 aa, BK virus
GHLHMLQEQ

SEQ ID NO: 22386 - protein, 9 aa, BK virus
HLHMLQEQV

SEQ ID NO: 22387 - protein, 9 aa, BK virus
LHMLQEQVL

SEQ ID NO: 22388 - protein, 9 aa, BK virus
HMLQEQVLQ

SEQ ID NO: 22389 - protein, 9 aa, BK virus
MLQEQVLQS

SEQ ID NO: 22390 - protein, 9 aa, BK virus
LQEQVLQSR

SEQ ID NO: 22391 - protein, 9 aa, BK virus
QEQVLQSRT

SEQ ID NO: 22392 - protein, 9 aa, BK virus
EQVLQSRTG

SEQ ID NO: 22393 - protein, 9 aa, BK virus
QVLQSRTGL

SEQ ID NO: 22394 - protein, 9 aa, BK virus
VLQSRTGLE

SEQ ID NO: 22395 - protein, 9 aa, BK virus
LQSRTGLEV

SEQ ID NO: 22396 - protein, 9 aa, BK virus
QSRTGLEVK

SEQ ID NO: 22397 - protein, 9 aa, BK virus
SRTGLEVKA

SEQ ID NO: 22398 - protein, 9 aa, BK virus
RTGLEVKAT

SEQ ID NO: 22399 - protein, 9 aa, BK virus
TGLEVKATS

SEQ ID NO: 22400 - protein, 9 aa, BK virus
GLEVKATSI

SEQ ID NO: 22401 - protein, 9 aa, BK virus
LEVKATSIE

SEQ ID NO: 22402 - protein, 9 aa, BK virus
EVKATSIEE

SEQ ID NO: 22403 - protein, 9 aa, BK virus
VKATSIEEQ

SEQ ID NO: 22404 - protein, 9 aa, BK virus
KATSIEEQF

SEQ ID NO: 22405 - protein, 9 aa, BK virus
ATSIEEQFF

SEQ ID NO: 22406 - protein, 9 aa, BK virus
TSIEEQFFD

SEQ ID NO: 22407 - protein, 9 aa, BK virus
TLLNVHFVD

SEQ ID NO: 22408 - protein, 9 aa, BK virus
LLNVHFVDF

SEQ ID NO: 22409 - protein, 9 aa, BK virus
LNVHFVDFL

SEQ ID NO: 22410 - protein, 9 aa, BK virus
NVHFVDFLS

SEQ ID NO: 22411 - protein, 9 aa, BK virus
VHFVDFLSP

SEQ ID NO: 22412 - protein, 9 aa, BK virus
HFVDFLSPF

SEQ ID NO: 22413 - protein, 9 aa, BK virus
FVDFLSPFF

SEQ ID NO: 22414 - protein, 9 aa, BK virus
VDFLSPFFV

SEQ ID NO: 22415 - protein, 9 aa, BK virus
LLLYCQHHL

SEQ ID NO: 22416 - protein, 9 aa, BK virus
LLYCQHHLY

SEQ ID NO: 22417 - protein, 9 aa, BK virus
LYCQHHLYY

SEQ ID NO: 22418 - protein, 9 aa, BK virus
YCQHHLYYK

SEQ ID NO: 22419 - protein, 9 aa, BK virus
CQHHLYYKY

SEQ ID NO: 22420 - protein, 9 aa, BK virus
QHHLYYKYG

SEQ ID NO: 22421 - protein, 9 aa, BK virus
HHLYYKYGQ

SEQ ID NO: 22422 - protein, 9 aa, BK virus
HLYYKYGQN

SEQ ID NO: 22423 - protein, 9 aa, BK virus
LYYKYGQNV

SEQ ID NO: 22424 - protein, 9 aa, BK virus
YYKYGQNVH

SEQ ID NO: 22425 - protein, 9 aa, BK virus
YKYGQNVHG

SEQ ID NO: 22426 - protein, 9 aa, BK virus
KYGQNVHGY

SEQ ID NO: 22427 - protein, 9 aa, BK virus
YGQNVHGYL

SEQ ID NO: 22428 - protein, 9 aa, BK virus
GQNVHGYLP

SEQ ID NO: 22429 - protein, 9 aa, BK virus
QNVHGYLPF

SEQ ID NO: 22430 - protein, 9 aa, BK virus
NVHGYLPFQ

SEQ ID NO: 22431 - protein, 9 aa, BK virus
VHGYLPFQL

SEQ ID NO: 22432 - protein, 9 aa, BK virus
HGYLPFQLL

SEQ ID NO: 22433 - protein, 9 aa, BK virus
GYLPFQLLV

SEQ ID NO: 22434 - protein, 9 aa, BK virus
GKDQNNIVE

SEQ ID NO: 22435 - protein, 9 aa, BK virus
KDQNNIVEY

SEQ ID NO: 22436 - protein, 9 aa, BK virus
DQNNIVEYN

SEQ ID NO: 22437 - protein, 9 aa, BK virus
QNNIVEYNY

SEQ ID NO: 22438 - protein, 9 aa, BK virus
NNIVEYNYK

SEQ ID NO: 22439 - protein, 9 aa, BK virus
NIVEYNYKS

SEQ ID NO: 22440 - protein, 9 aa, BK virus
IVEYNYKSL

SEQ ID NO: 22441 - protein, 9 aa, BK virus
KIFLFFSAI

SEQ ID NO: 22442 - protein, 9 aa, BK virus
IFLFFSAIP

SEQ ID NO: 22443 - protein, 9 aa, BK virus
FLFFSAIPV

SEQ ID NO: 22444 - protein, 9 aa, BK virus
LFFSAIPVR

SEQ ID NO: 22445 - protein, 9 aa, BK virus
FFSAIPVRL

SEQ ID NO: 22446 - protein, 9 aa, BK virus
QKYLHQETE

SEQ ID NO: 22447 - protein, 9 aa, BK virus
KYLHQETEY

SEQ ID NO: 22448 - protein, 9 aa, BK virus
YLHQETEYH

SEQ ID NO: 22449 - protein, 9 aa, BK virus
LHQETEYHS

SEQ ID NO: 22450 - protein, 9 aa, BK virus
HQETEYHST

SEQ ID NO: 22451 - protein, 9 aa, BK virus
QETEYHSTH

SEQ ID NO: 22452 - protein, 9 aa, BK virus
ETEYHSTHL

SEQ ID NO: 22453 - protein, 9 aa, BK virus
TEYHSTHLG

SEQ ID NO: 22454 - protein, 9 aa, BK virus
TIPKPCLIA

SEQ ID NO: 22455 - protein, 9 aa, BK virus
IPKPCLIAD

SEQ ID NO: 22456 - protein, 9 aa, BK virus
PKPCLIADR

SEQ ID NO: 22457 - protein, 9 aa, BK virus
KPCLIADRG

SEQ ID NO: 22458 - protein, 9 aa, BK virus
PCLIADRGL

SEQ ID NO: 22459 - protein, 9 aa, BK virus
CLIADRGLQ

SEQ ID NO: 22460 - protein, 9 aa, BK virus
LIADRGLQW

SEQ ID NO: 22461 - protein, 9 aa, BK virus
IADRGLQWK

SEQ ID NO: 22462 - protein, 9 aa, BK virus
ADRGLQWKL

SEQ ID NO: 22463 - protein, 9 aa, BK virus
DRGLQWKLC

SEQ ID NO: 22464 - protein, 9 aa, BK virus
RGLQWKLCD

SEQ ID NO: 22465 - protein, 9 aa, BK virus
GLQWKLCDP

SEQ ID NO: 22466 - protein, 9 aa, BK virus
LQWKLCDPN

SEQ ID NO: 22467 - protein, 9 aa, BK virus
QWKLCDPNH

SEQ ID NO: 22468 - protein, 9 aa, BK virus
WKLCDPNHQ

SEQ ID NO: 22469 - protein, 9 aa, BK virus
KLCDPNHQR

SEQ ID NO: 22470 - protein, 9 aa, BK virus
LCDPNHQRT

SEQ ID NO: 22471 - protein, 9 aa, BK virus
CDPNHQRTY

SEQ ID NO: 22472 - protein, 9 aa, BK virus
DPNHQRTYT

SEQ ID NO: 22473 - protein, 9 aa, BK virus
PNHQRTYTL

SEQ ID NO: 22474 - protein, 9 aa, BK virus
NHQRTYTLL

SEQ ID NO: 22475 - protein, 9 aa, BK virus
HQRTYTLLE

SEQ ID NO: 22476 - protein, 9 aa, BK virus
QRTYTLLEL

SEQ ID NO: 22477 - protein, 9 aa, BK virus
RTYTLLELR

SEQ ID NO: 22478 - protein, 9 aa, BK virus
TYTLLELRN

SEQ ID NO: 22479 - protein, 9 aa, BK virus
QFELKQQTQ

SEQ ID NO: 22480 - protein, 9 aa, BK virus
FELKQQTQQ

SEQ ID NO: 22481 - protein, 9 aa, BK virus
PQEHQQLQH

SEQ ID NO: 22482 - protein, 9 aa, BK virus
QEHQQLQHM

SEQ ID NO: 22483 - protein, 9 aa, BK virus
EHQQLQHMF

SEQ ID NO: 22484 - protein, 9 aa, BK virus
HQQLQHMFE

SEQ ID NO: 22485 - protein, 9 aa, BK virus
QQLQHMFEE

SEQ ID NO: 22486 - protein, 9 aa, BK virus
QLQHMFEEL

SEQ ID NO: 22487 - protein, 9 aa, BK virus
LQHMFEELG

SEQ ID NO: 22488 - protein, 9 aa, BK virus
QHMFEELGL

SEQ ID NO: 22489 - protein, 9 aa, BK virus
PLRYLLCPL

SEQ ID NO: 22490 - protein, 9 aa, BK virus
LRYLLCPLQ

SEQ ID NO: 22491 - protein, 9 aa, BK virus
QQQPPQQQF

SEQ ID NO: 22492 - protein, 9 aa, BK virus
QQPPQQQFQ

SEQ ID NO: 22493 - protein, 9 aa, BK virus
QPPQQQFQP

SEQ ID NO: 22494 - protein, 9 aa, BK virus
PPQQQFQPL

SEQ ID NO: 22495 - protein, 9 aa, BK virus
PQQQFQPLK

SEQ ID NO: 22496 - protein, 9 aa, BK virus
QQQFQPLKI

SEQ ID NO: 22497 - protein, 9 aa, BK virus
QQFQPLKIL

SEQ ID NO: 22498 - protein, 9 aa, BK virus
QFQPLKILW

SEQ ID NO: 22499 - protein, 9 aa, BK virus
FQPLKILWQ

SEQ ID NO: 22500 - protein, 9 aa, BK virus
QPLKILWQQ

SEQ ID NO: 22501 - protein, 9 aa, BK virus
PLKILWQQQ

SEQ ID NO: 22502 - protein, 9 aa, BK virus
LKILWQQQP

SEQ ID NO: 22503 - protein, 9 aa, BK virus
KILWQQQPQ

SEQ ID NO: 22504 - protein, 9 aa, BK virus
ILWQQQPQI

SEQ ID NO: 22505 - protein, 9 aa, BK virus
LWQQQPQIH

SEQ ID NO: 22506 - protein, 9 aa, BK virus
WQQQPQIHW

SEQ ID NO: 22507 - protein, 9 aa, BK virus
QQQPQIHWQ

SEQ ID NO: 22508 - protein, 9 aa, BK virus
QQPQIHWQL

SEQ ID NO: 22509 - protein, 9 aa, BK virus
QPQIHWQLG

SEQ ID NO: 22510 - protein, 9 aa, BK virus
PQIHWQLGP

SEQ ID NO: 22511 - protein, 9 aa, BK virus
QIHWQLGPP

SEQ ID NO: 22512 - protein, 9 aa, BK virus
IHWQLGPPK

SEQ ID NO: 22513 - protein, 9 aa, BK virus
HWQLGPPKV

SEQ ID NO: 22514 - protein, 9 aa, BK virus
WQLGPPKVL

SEQ ID NO: 22515 - protein, 9 aa, BK virus
QLGPPKVLE

SEQ ID NO: 22516 - protein, 9 aa, BK virus
LGPPKVLEQ

SEQ ID NO: 22517 - protein, 9 aa, BK virus
GPPKVLEQH

SEQ ID NO: 22518 - protein, 9 aa, BK virus
PPKVLEQHP

SEQ ID NO: 22519 - protein, 9 aa, BK virus
TWKYKKKGI

SEQ ID NO: 22520 - protein, 9 aa, BK virus
WKYKKKGIT

SEQ ID NO: 22521 - protein, 9 aa, BK virus
KYKKKGITY

SEQ ID NO: 22522 - protein, 9 aa, BK virus
YKKKGITYL

SEQ ID NO: 22523 - protein, 9 aa, BK virus
KKKGITYLG

SEQ ID NO: 22524 - protein, 9 aa, BK virus
KKGITYLGV

SEQ ID NO: 22525 - protein, 9 aa, BK virus
KGITYLGVF

SEQ ID NO: 22526 - protein, 9 aa, BK virus
GITYLGVFY

SEQ ID NO: 22527 - protein, 9 aa, BK virus
ITYLGVFYR

SEQ ID NO: 22528 - protein, 9 aa, BK virus
TYLGVFYRV

SEQ ID NO: 22529 - protein, 9 aa, BK virus
YLGVFYRVF

SEQ ID NO: 22530 - protein, 9 aa, BK virus
LGVFYRVFY

SEQ ID NO: 22531 - protein, 9 aa, BK virus
GVFYRVFYS

SEQ ID NO: 22532 - protein, 9 aa, BK virus
VFYRVFYSR

SEQ ID NO: 22533 - protein, 9 aa, BK virus
SSGTFVFPV

SEQ ID NO: 22534 - protein, 9 aa, BK virus
SGTFVFPVY

SEQ ID NO: 22535 - protein, 9 aa, BK virus
GTFVFPVYT

SEQ ID NO: 22536 - protein, 9 aa, BK virus
TFVFPVYTV

SEQ ID NO: 22537 - protein, 9 aa, BK virus
FVFPVYTVF

SEQ ID NO: 22538 - protein, 9 aa, BK virus
VFPVYTVFT

SEQ ID NO: 22539 - protein, 9 aa, BK virus
FPVYTVFTS

SEQ ID NO: 22540 - protein, 9 aa, BK virus
PVYTVFTST

SEQ ID NO: 22541 - protein, 9 aa, BK virus
VYTVFTSTK

SEQ ID NO: 22542 - protein, 9 aa, BK virus
YTVFTSTKF

SEQ ID NO: 22543 - protein, 9 aa, BK virus
TVFTSTKFQ

SEQ ID NO: 22544 - protein, 9 aa, BK virus
VFTSTKFQQ

SEQ ID NO: 22545 - protein, 9 aa, BK virus
FTSTKFQQK

SEQ ID NO: 22546 - protein, 9 aa, BK virus
TSTKFQQKL

SEQ ID NO: 22547 - protein, 9 aa, BK virus
NKNKNPLSS

SEQ ID NO: 22548 - protein, 9 aa, BK virus
KNKNPLSSF

SEQ ID NO: 22549 - protein, 9 aa, BK virus
NKNPLSSFF

SEQ ID NO: 22550 - protein, 9 aa, BK virus
KNPLSSFFC

SEQ ID NO: 22551 - protein, 9 aa, BK virus
NPLSSFFCS

SEQ ID NO: 22552 - protein, 9 aa, BK virus
PLSSFFCSS

SEQ ID NO: 22553 - protein, 9 aa, BK virus
LSSFFCSSP

SEQ ID NO: 22554 - protein, 9 aa, BK virus
SSFFCSSPG

SEQ ID NO: 22555 - protein, 9 aa, BK virus
SFFCSSPGF

SEQ ID NO: 22556 - protein, 9 aa, BK virus
FFCSSPGFT

SEQ ID NO: 22557 - protein, 9 aa, BK virus
FCSSPGFTN

SEQ ID NO: 22558 - protein, 9 aa, BK virus
CSSPGFTNF

SEQ ID NO: 22559 - protein, 9 aa, BK virus
SSPGFTNFH

SEQ ID NO: 22560 - protein, 9 aa, BK virus
QLAQNHGLC

SEQ ID NO: 22561 - protein, 9 aa, BK virus
LAQNHGLCP

SEQ ID NO: 22562 - protein, 9 aa, BK virus
AQNHGLCPV

SEQ ID NO: 22563 - protein, 9 aa, BK virus
LGTRPRFLG

SEQ ID NO: 22564 - protein, 9 aa, BK virus
GTRPRFLGS

SEQ ID NO: 22565 - protein, 9 aa, BK virus
TRPRFLGSQ

SEQ ID NO: 22566 - protein, 9 aa, BK virus
RPRFLGSQN

SEQ ID NO: 22567 - protein, 9 aa, BK virus
PRFLGSQNM

SEQ ID NO: 22568 - protein, 9 aa, BK virus
RFLGSQNMS

SEQ ID NO: 22569 - protein, 9 aa, BK virus
FLGSQNMSV

SEQ ID NO: 22570 - protein, 9 aa, BK virus
LGSQNMSVM

SEQ ID NO: 22571 - protein, 9 aa, BK virus
GSQNMSVMH

SEQ ID NO: 22572 - protein, 9 aa, BK virus
SQNMSVMHF

SEQ ID NO: 22573 - protein, 9 aa, BK virus
QNMSVMHFP

SEQ ID NO: 22574 - protein, 9 aa, BK virus
NMSVMHFPS

SEQ ID NO: 22575 - protein, 9 aa, BK virus
GHGLAAFHG

SEQ ID NO: 22576 - protein, 9 aa, BK virus
AAPPCESCT

SEQ ID NO: 22577 - protein, 9 aa, BK virus
APPCESCTF

SEQ ID NO: 22578 - protein, 9 aa, BK virus
PPCESCTFL

SEQ ID NO: 22579 - protein, 9 aa, BK virus
PCESCTFLP

SEQ ID NO: 22580 - protein, 9 aa, BK virus
CESCTFLPE

SEQ ID NO: 22581 - protein, 9 aa, BK virus
ESCTFLPEV

SEQ ID NO: 22582 - protein, 9 aa, BK virus
SCTFLPEVM

SEQ ID NO: 22583 - protein, 9 aa, BK virus
CTFLPEVMV

SEQ ID NO: 22584 - protein, 9 aa, BK virus
TFLPEVMVW

SEQ ID NO: 22585 - protein, 9 aa, BK virus
FLPEVMVWL

SEQ ID NO: 22586 - protein, 9 aa, BK virus
LPEVMVWLH

SEQ ID NO: 22587 - protein, 9 aa, BK virus
PEVMVWLHS

SEQ ID NO: 22588 - protein, 9 aa, BK virus
EVMVWLHSP

SEQ ID NO: 22589 - protein, 9 aa, BK virus
VMVWLHSPV

SEQ ID NO: 22590 - protein, 9 aa, BK virus
MVWLHSPVS

SEQ ID NO: 22591 - protein, 9 aa, BK virus
VWLHSPVSH

SEQ ID NO: 22592 - protein, 9 aa, BK virus
WLHSPVSHA

SEQ ID NO: 22593 - protein, 9 aa, BK virus
LHSPVSHAL

SEQ ID NO: 22594 - protein, 9 aa, BK virus
HSPVSHALS

SEQ ID NO: 22595 - protein, 9 aa, BK virus
SPVSHALSF

SEQ ID NO: 22596 - protein, 9 aa, BK virus
PVSHALSFL

SEQ ID NO: 22597 - protein, 9 aa, BK virus
VSHALSFLR

SEQ ID NO: 22598 - protein, 9 aa, BK virus
SHALSFLRS

SEQ ID NO: 22599 - protein, 9 aa, BK virus
HALSFLRSW

SEQ ID NO: 22600 - protein, 9 aa, BK virus
ALSFLRSWF

SEQ ID NO: 22601 - protein, 9 aa, BK virus
LSFLRSWFG

SEQ ID NO: 22602 - protein, 9 aa, BK virus
SFLRSWFGC

SEQ ID NO: 22603 - protein, 9 aa, BK virus
FLRSWFGCI

SEQ ID NO: 22604 - protein, 9 aa, BK virus
LRSWFGCIP

SEQ ID NO: 22605 - protein, 9 aa, BK virus
RSWFGCIPW

SEQ ID NO: 22606 - protein, 9 aa, BK virus
SWFGCIPWV

SEQ ID NO: 22607 - protein, 9 aa, BK virus
WFGCIPWVS

SEQ ID NO: 22608 - protein, 9 aa, BK virus
FGCIPWVSS

SEQ ID NO: 22609 - protein, 9 aa, BK virus
GCIPWVSSS

SEQ ID NO: 22610 - protein, 9 aa, BK virus
CIPWVSSSS

SEQ ID NO: 22611 - protein, 9 aa, BK virus
IPWVSSSSL

SEQ ID NO: 22612 - protein, 9 aa, BK virus
PWVSSSSLW

SEQ ID NO: 22613 - protein, 9 aa, BK virus
WVSSSSLWP

SEQ ID NO: 22614 - protein, 9 aa, BK virus
VSSSSLWPF

SEQ ID NO: 22615 - protein, 9 aa, BK virus
SSSSLWPFF

SEQ ID NO: 22616 - protein, 9 aa, BK virus
SSSLWPFFL

SEQ ID NO: 22617 - protein, 9 aa, BK virus
YIRGRGRLC

SEQ ID NO: 22618 - protein, 9 aa, BK virus
IRGRGRLCL

SEQ ID NO: 22619 - protein, 9 aa, BK virus
RGRGRLCLH

SEQ ID NO: 22620 - protein, 9 aa, BK virus
GRGRLCLHP

SEQ ID NO: 22621 - protein, 9 aa, BK virus
RGRLCLHPF

SEQ ID NO: 22622 - protein, 9 aa, BK virus
GRLCLHPFS

SEQ ID NO: 22623 - protein, 9 aa, BK virus
RLCLHPFSQ

SEQ ID NO: 22624 - protein, 9 aa, BK virus
LCLHPFSQV

SEQ ID NO: 22625 - protein, 9 aa, BK virus
CLHPFSQVV

SEQ ID NO: 22626 - protein, 9 aa, BK virus
LHPFSQVVR

SEQ ID NO: 22627 - protein, 9 aa, BK virus
HPFSQVVRV

SEQ ID NO: 22628 - protein, 9 aa, BK virus
PFSQVVRVW

SEQ ID NO: 22629 - protein, 9 aa, BK virus
FSQVVRVWR

SEQ ID NO: 22630 - protein, 9 aa, BK virus
SQVVRVWRL

SEQ ID NO: 22631 - protein, 9 aa, BK virus
QVVRVWRLF

SEQ ID NO: 22632 - protein, 9 aa, BK virus
VVRVWRLFL

SEQ ID NO: 22633 - protein, 9 aa, BK virus
VRVWRLFLR

SEQ ID NO: 22634 - protein, 9 aa, BK virus
RVWRLFLRP

SEQ ID NO: 22635 - protein, 9 aa, BK virus
VWRLFLRPS

SEQ ID NO: 22636 - protein, 9 aa, BK virus
WRLFLRPSK

SEQ ID NO: 22637 - protein, 9 aa, BK virus
RLFLRPSKT

SEQ ID NO: 22638 - protein, 9 aa, BK virus
LFLRPSKTI

SEQ ID NO: 22639 - protein, 9 aa, BK virus
FLRPSKTIW

SEQ ID NO: 22640 - protein, 9 aa, BK virus
LRPSKTIWG

SEQ ID NO: 22641 - protein, 9 aa, BK virus
RPSKTIWGN

SEQ ID NO: 22642 - protein, 9 aa, BK virus
PSKTIWGNP

SEQ ID NO: 22643 - protein, 9 aa, BK virus
SKTIWGNPY

SEQ ID NO: 22644 - protein, 9 aa, BK virus
KTIWGNPYS

SEQ ID NO: 22645 - protein, 9 aa, BK virus
TIWGNPYSF

SEQ ID NO: 22646 - protein, 9 aa, BK virus
IWGNPYSFA

SEQ ID NO: 22647 - protein, 9 aa, BK virus
WGNPYSFAI

SEQ ID NO: 22648 - protein, 9 aa, BK virus
GNPYSFAIF

SEQ ID NO: 22649 - protein, 9 aa, BK virus
NPYSFAIFA

SEQ ID NO: 22650 - protein, 9 aa, BK virus
PYSFAIFAK

SEQ ID NO: 22651 - protein, 10 aa, BK virus
QGRIHGAHGP

SEQ ID NO: 22652 - protein, 10 aa, BK virus
GRIHGAHGPF

SEQ ID NO: 22653 - protein, 10 aa, BK virus
RIHGAHGPFR

SEQ ID NO: 22654 - protein, 10 aa, BK virus
IHGAHGPFRP

SEQ ID NO: 22655 - protein, 10 aa, BK virus
KSCLGKSSLN

SEQ ID NO: 22656 - protein, 10 aa, BK virus
SCLGKSSLNE

SEQ ID NO: 22657 - protein, 10 aa, BK virus
CLGKSSLNEK

SEQ ID NO: 22658 - protein, 10 aa, BK virus
LGKSSLNEKS

SEQ ID NO: 22659 - protein, 10 aa, BK virus
GKSSLNEKSL

SEQ ID NO: 22660 - protein, 10 aa, BK virus
KSSLNEKSLF

SEQ ID NO: 22661 - protein, 10 aa, BK virus
SSLNEKSLFK

SEQ ID NO: 22662 - protein, 10 aa, BK virus
SLNEKSLFKE

SEQ ID NO: 22663 - protein, 10 aa, BK virus
LNEKSLFKEV

SEQ ID NO: 22664 - protein, 10 aa, BK virus
KNGAGCKGSS

SEQ ID NO: 22665 - protein, 10 aa, BK virus
NGAGCKGSSS

SEQ ID NO: 22666 - protein, 10 aa, BK virus
GAGCKGSSSA

SEQ ID NO: 22667 - protein, 10 aa, BK virus
FSSLPRYPVL

SEQ ID NO: 22668 - protein, 10 aa, BK virus
SSLPRYPVLQ

SEQ ID NO: 22669 - protein, 10 aa, BK virus
SLPRYPVLQG

SEQ ID NO: 22670 - protein, 10 aa, BK virus
LPRYPVLQGM

SEQ ID NO: 22671 - protein, 10 aa, BK virus
PRYPVLQGMA

SEQ ID NO: 22672 - protein, 10 aa, BK virus
RYPVLQGMAY

SEQ ID NO: 22673 - protein, 10 aa, BK virus
YPVLQGMAYL

SEQ ID NO: 22674 - protein, 10 aa, BK virus
PVLQGMAYLF

SEQ ID NO: 22675 - protein, 10 aa, BK virus
VLQGMAYLFQ

SEQ ID NO: 22676 - protein, 10 aa, BK virus
LQGMAYLFQK

SEQ ID NO: 22677 - protein, 10 aa, BK virus
QGMAYLFQKA

SEQ ID NO: 22678 - protein, 10 aa, BK virus
GMAYLFQKAF

SEQ ID NO: 22679 - protein, 10 aa, BK virus
MAYLFQKAFC

SEQ ID NO: 22680 - protein, 10 aa, BK virus
AYLFQKAFCA

SEQ ID NO: 22681 - protein, 10 aa, BK virus
YLFQKAFCAL

SEQ ID NO: 22682 - protein, 10 aa, BK virus
LFQKAFCALP

SEQ ID NO: 22683 - protein, 10 aa, BK virus
FQKAFCALPL

SEQ ID NO: 22684 - protein, 10 aa, BK virus
QKAFCALPLH

SEQ ID NO: 22685 - protein, 10 aa, BK virus
KAFCALPLHA

SEQ ID NO: 22686 - protein, 10 aa, BK virus
AFCALPLHAM

SEQ ID NO: 22687 - protein, 10 aa, BK virus
FCALPLHAMS

SEQ ID NO: 22688 - protein, 10 aa, BK virus
CALPLHAMSA

SEQ ID NO: 22689 - protein, 10 aa, BK virus
KIFKKRALGL

SEQ ID NO: 22690 - protein, 10 aa, BK virus
IFKKRALGLD

SEQ ID NO: 22691 - protein, 10 aa, BK virus
FKKRALGLDR

SEQ ID NO: 22692 - protein, 10 aa, BK virus
KKRALGLDRL

SEQ ID NO: 22693 - protein, 10 aa, BK virus
KRALGLDRLL

SEQ ID NO: 22694 - protein, 10 aa, BK virus
RALGLDRLLL

SEQ ID NO: 22695 - protein, 10 aa, BK virus
ALGLDRLLLH

SEQ ID NO: 22696 - protein, 10 aa, BK virus
LLHTVVWLRP

SEQ ID NO: 22697 - protein, 10 aa, BK virus
LHTVVWLRPN

SEQ ID NO: 22698 - protein, 10 aa, BK virus
RNSAMVGPNN

SEQ ID NO: 22699 - protein, 10 aa, BK virus
NSAMVGPNNW

SEQ ID NO: 22700 - protein, 10 aa, BK virus
SAMVGPNNWR

SEQ ID NO: 22701 - protein, 10 aa, BK virus
AMVGPNNWRN

SEQ ID NO: 22702 - protein, 10 aa, BK virus
MVGPNNWRNS

SEQ ID NO: 22703 - protein, 10 aa, BK virus
VGPNNWRNSL

SEQ ID NO: 22704 - protein, 10 aa, BK virus
GPNNWRNSLQ

SEQ ID NO: 22705 - protein, 10 aa, BK virus
PNNWRNSLQR

SEQ ID NO: 22706 - protein, 10 aa, BK virus
NNWRNSLQRS

SEQ ID NO: 22707 - protein, 10 aa, BK virus
NWRNSLQRSK

SEQ ID NO: 22708 - protein, 10 aa, BK virus
WRNSLQRSKA

SEQ ID NO: 22709 - protein, 10 aa, BK virus
RNSLQRSKAL

SEQ ID NO: 22710 - protein, 10 aa, BK virus
NSLQRSKALR

SEQ ID NO: 22711 - protein, 10 aa, BK virus
INNKILKGPK

SEQ ID NO: 22712 - protein, 10 aa, BK virus
VPTYGTEEWE

SEQ ID NO: 22713 - protein, 10 aa, BK virus
PTYGTEEWES

SEQ ID NO: 22714 - protein, 10 aa, BK virus
TYGTEEWESW

SEQ ID NO: 22715 - protein, 10 aa, BK virus
YGTEEWESWW

SEQ ID NO: 22716 - protein, 10 aa, BK virus
GTEEWESWWS

SEQ ID NO: 22717 - protein, 10 aa, BK virus
TEEWESWWSS

SEQ ID NO: 22718 - protein, 10 aa, BK virus
EEWESWWSSF

SEQ ID NO: 22719 - protein, 10 aa, BK virus
EWESWWSSFN

SEQ ID NO: 22720 - protein, 10 aa, BK virus
WESWWSSFNE

SEQ ID NO: 22721 - protein, 10 aa, BK virus
ESWWSSFNEK

SEQ ID NO: 22722 - protein, 10 aa, BK virus
SWWSSFNEKW

SEQ ID NO: 22723 - protein, 10 aa, BK virus
WWSSFNEKWD

SEQ ID NO: 22724 - protein, 10 aa, BK virus
WSSFNEKWDE

SEQ ID NO: 22725 - protein, 10 aa, BK virus
SSFNEKWDED

SEQ ID NO: 22726 - protein, 10 aa, BK virus
SFNEKWDEDL

SEQ ID NO: 22727 - protein, 10 aa, BK virus
FNEKWDEDLF

SEQ ID NO: 22728 - protein, 10 aa, BK virus
NEKWDEDLFC

SEQ ID NO: 22729 - protein, 10 aa, BK virus
EKWDEDLFCH

SEQ ID NO: 22730 - protein, 10 aa, BK virus
KWDEDLFCHE

SEQ ID NO: 22731 - protein, 10 aa, BK virus
WDEDLFCHED

SEQ ID NO: 22732 - protein, 10 aa, BK virus
DEDLFCHEDM

SEQ ID NO: 22733 - protein, 10 aa, BK virus
EDLFCHEDMF

SEQ ID NO: 22734 - protein, 10 aa, BK virus
DLFCHEDMFA

SEQ ID NO: 22735 - protein, 10 aa, BK virus
LFCHEDMFAS

SEQ ID NO: 22736 - protein, 10 aa, BK virus
FCHEDMFASD

SEQ ID NO: 22737 - protein, 10 aa, BK virus
CHEDMFASDE

SEQ ID NO: 22738 - protein, 10 aa, BK virus
HEDMFASDEE

SEQ ID NO: 22739 - protein, 10 aa, BK virus
EDMFASDEEA

SEQ ID NO: 22740 - protein, 10 aa, BK virus
DMFASDEEAT

SEQ ID NO: 22741 - protein, 10 aa, BK virus
MFASDEEATA

SEQ ID NO: 22742 - protein, 10 aa, BK virus
FASDEEATAD

SEQ ID NO: 22743 - protein, 10 aa, BK virus
ASDEEATADS

SEQ ID NO: 22744 - protein, 10 aa, BK virus
SDEEATADSQ

SEQ ID NO: 22745 - protein, 10 aa, BK virus
DEEATADSQH

SEQ ID NO: 22746 - protein, 10 aa, BK virus
EEATADSQHS

SEQ ID NO: 22747 - protein, 10 aa, BK virus
EATADSQHST

SEQ ID NO: 22748 - protein, 10 aa, BK virus
ATADSQHSTP

SEQ ID NO: 22749 - protein, 10 aa, BK virus
TADSQHSTPP

SEQ ID NO: 22750 - protein, 10 aa, BK virus
ADSQHSTPPK

SEQ ID NO: 22751 - protein, 10 aa, BK virus
DSQHSTPPKK

SEQ ID NO: 22752 - protein, 10 aa, BK virus
SQHSTPPKKK

SEQ ID NO: 22753 - protein, 10 aa, BK virus
QHSTPPKKKR

SEQ ID NO: 22754 - protein, 10 aa, BK virus
HSTPPKKKRK

SEQ ID NO: 22755 - protein, 10 aa, BK virus
STPPKKKRKV

SEQ ID NO: 22756 - protein, 10 aa, BK virus
TPPKKKRKVE

SEQ ID NO: 22757 - protein, 10 aa, BK virus
PPKKKRKVED

SEQ ID NO: 22758 - protein, 10 aa, BK virus
PKKKRKVEDP

SEQ ID NO: 22759 - protein, 10 aa, BK virus
KKKRKVEDPK

SEQ ID NO: 22760 - protein, 10 aa, BK virus
KKRKVEDPKD

SEQ ID NO: 22761 - protein, 10 aa, BK virus
KRKVEDPKDF

SEQ ID NO: 22762 - protein, 10 aa, BK virus
RKVEDPKDFP

SEQ ID NO: 22763 - protein, 10 aa, BK virus
KVEDPKDFPS

SEQ ID NO: 22764 - protein, 10 aa, BK virus
VEDPKDFPSD

SEQ ID NO: 22765 - protein, 10 aa, BK virus
EDPKDFPSDL

SEQ ID NO: 22766 - protein, 10 aa, BK virus
DPKDFPSDLH

SEQ ID NO: 22767 - protein, 10 aa, BK virus
PKDFPSDLHQ

SEQ ID NO: 22768 - protein, 10 aa, BK virus
KDFPSDLHQF

SEQ ID NO: 22769 - protein, 10 aa, BK virus
DFPSDLHQFL

SEQ ID NO: 22770 - protein, 10 aa, BK virus
FPSDLHQFLS

SEQ ID NO: 22771 - protein, 10 aa, BK virus
PSDLHQFLSQ

SEQ ID NO: 22772 - protein, 10 aa, BK virus
SDLHQFLSQA

SEQ ID NO: 22773 - protein, 10 aa, BK virus
DLHQFLSQAV

SEQ ID NO: 22774 - protein, 10 aa, BK virus
LHQFLSQAVF

SEQ ID NO: 22775 - protein, 10 aa, BK virus
HQFLSQAVFS

SEQ ID NO: 22776 - protein, 10 aa, BK virus
QFLSQAVFSN

SEQ ID NO: 22777 - protein, 10 aa, BK virus
FLSQAVFSNR

SEQ ID NO: 22778 - protein, 10 aa, BK virus
LSQAVFSNRT

SEQ ID NO: 22779 - protein, 10 aa, BK virus
SQAVFSNRTL

SEQ ID NO: 22780 - protein, 10 aa, BK virus
QAVFSNRTLA

SEQ ID NO: 22781 - protein, 10 aa, BK virus
AVFSNRTLAC

SEQ ID NO: 22782 - protein, 10 aa, BK virus
VFSNRTLACF

SEQ ID NO: 22783 - protein, 10 aa, BK virus
FSNRTLACFA

SEQ ID NO: 22784 - protein, 10 aa, BK virus
SNRTLACFAV

SEQ ID NO: 22785 - protein, 10 aa, BK virus
NRTLACFAVY

SEQ ID NO: 22786 - protein, 10 aa, BK virus
RTLACFAVYT

SEQ ID NO: 22787 - protein, 10 aa, BK virus
TLACFAVYTT

SEQ ID NO: 22788 - protein, 10 aa, BK virus
LACFAVYTTK

SEQ ID NO: 22789 - protein, 10 aa, BK virus
ACFAVYTTKE

SEQ ID NO: 22790 - protein, 10 aa, BK virus
CFAVYTTKEK

SEQ ID NO: 22791 - protein, 10 aa, BK virus
FAVYTTKEKA

SEQ ID NO: 22792 - protein, 10 aa, BK virus
AVYTTKEKAQ

SEQ ID NO: 22793 - protein, 10 aa, BK virus
VYTTKEKAQI

SEQ ID NO: 22794 - protein, 10 aa, BK virus
YTTKEKAQIL

SEQ ID NO: 22795 - protein, 10 aa, BK virus
TTKEKAQILY

SEQ ID NO: 22796 - protein, 10 aa, BK virus
TKEKAQILYK

SEQ ID NO: 22797 - protein, 10 aa, BK virus
KEKAQILYKK

SEQ ID NO: 22798 - protein, 10 aa, BK virus
EKAQILYKKL

SEQ ID NO: 22799 - protein, 10 aa, BK virus
KAQILYKKLM

SEQ ID NO: 22800 - protein, 10 aa, BK virus
AQILYKKLME

SEQ ID NO: 22801 - protein, 10 aa, BK virus
QILYKKLMEK

SEQ ID NO: 22802 - protein, 10 aa, BK virus
ILYKKLMEKY

SEQ ID NO: 22803 - protein, 10 aa, BK virus
LYKKLMEKYS

SEQ ID NO: 22804 - protein, 10 aa, BK virus
YKKLMEKYSV

SEQ ID NO: 22805 - protein, 10 aa, BK virus
KKLMEKYSVT

SEQ ID NO: 22806 - protein, 10 aa, BK virus
KLMEKYSVTF

SEQ ID NO: 22807 - protein, 10 aa, BK virus
LMEKYSVTFI

SEQ ID NO: 22808 - protein, 10 aa, BK virus
MEKYSVTFIS

SEQ ID NO: 22809 - protein, 10 aa, BK virus
EKYSVTFISR

SEQ ID NO: 22810 - protein, 10 aa, BK virus
KYSVTFISRH

SEQ ID NO: 22811 - protein, 10 aa, BK virus
YSVTFISRHM

SEQ ID NO: 22812 - protein, 10 aa, BK virus
SVTFISRHMC

SEQ ID NO: 22813 - protein, 10 aa, BK virus
VTFISRHMCA

SEQ ID NO: 22814 - protein, 10 aa, BK virus
TFISRHMCAG

SEQ ID NO: 22815 - protein, 10 aa, BK virus
FISRHMCAGH

SEQ ID NO: 22816 - protein, 10 aa, BK virus
ISRHMCAGHN

SEQ ID NO: 22817 - protein, 10 aa, BK virus
SRHMCAGHNI

SEQ ID NO: 22818 - protein, 10 aa, BK virus
RHMCAGHNII

SEQ ID NO: 22819 - protein, 10 aa, BK virus
HMCAGHNIIF

SEQ ID NO: 22820 - protein, 10 aa, BK virus
MCAGHNIIFF

SEQ ID NO: 22821 - protein, 10 aa, BK virus
CAGHNIIFFL

SEQ ID NO: 22822 - protein, 10 aa, BK virus
AGHNIIFFLT

SEQ ID NO: 22823 - protein, 10 aa, BK virus
GHNIIFFLTP

SEQ ID NO: 22824 - protein, 10 aa, BK virus
HNIIFFLTPH

SEQ ID NO: 22825 - protein, 10 aa, BK virus
NIIFFLTPHR

SEQ ID NO: 22826 - protein, 10 aa, BK virus
IIFFLTPHRH

SEQ ID NO: 22827 - protein, 10 aa, BK virus
IFFLTPHRHR

SEQ ID NO: 22828 - protein, 10 aa, BK virus
FFLTPHRHRV

SEQ ID NO: 22829 - protein, 10 aa, BK virus
FLTPHRHRVS

SEQ ID NO: 22830 - protein, 10 aa, BK virus
LTPHRHRVSA

SEQ ID NO: 22831 - protein, 10 aa, BK virus
TPHRHRVSAI

SEQ ID NO: 22832 - protein, 10 aa, BK virus
PHRHRVSAIN

SEQ ID NO: 22833 - protein, 10 aa, BK virus
HRHRVSAINN

SEQ ID NO: 22834 - protein, 10 aa, BK virus
RHRVSAINNF

SEQ ID NO: 22835 - protein, 10 aa, BK virus
HRVSAINNFC

SEQ ID NO: 22836 - protein, 10 aa, BK virus
RVSAINNFCQ

SEQ ID NO: 22837 - protein, 10 aa, BK virus
VSAINNFCQK

SEQ ID NO: 22838 - protein, 10 aa, BK virus
SAINNFCQKL

SEQ ID NO: 22839 - protein, 10 aa, BK virus
AINNFCQKLC

SEQ ID NO: 22840 - protein, 10 aa, BK virus
INNFCQKLCT

SEQ ID NO: 22841 - protein, 10 aa, BK virus
NNFCQKLCTF

SEQ ID NO: 22842 - protein, 10 aa, BK virus
NFCQKLCTFS

SEQ ID NO: 22843 - protein, 10 aa, BK virus
FCQKLCTFSF

SEQ ID NO: 22844 - protein, 10 aa, BK virus
CQKLCTFSFL

SEQ ID NO: 22845 - protein, 10 aa, BK virus
QKLCTFSFLI

SEQ ID NO: 22846 - protein, 10 aa, BK virus
KLCTFSFLIC

SEQ ID NO: 22847 - protein, 10 aa, BK virus
LCTFSFLICK

SEQ ID NO: 22848 - protein, 10 aa, BK virus
CTFSFLICKG

SEQ ID NO: 22849 - protein, 10 aa, BK virus
TFSFLICKGV

SEQ ID NO: 22850 - protein, 10 aa, BK virus
FSFLICKGVN

SEQ ID NO: 22851 - protein, 10 aa, BK virus
SFLICKGVNK

SEQ ID NO: 22852 - protein, 10 aa, BK virus
FLICKGVNKE

SEQ ID NO: 22853 - protein, 10 aa, BK virus
LICKGVNKEY

SEQ ID NO: 22854 - protein, 10 aa, BK virus
ICKGVNKEYL

SEQ ID NO: 22855 - protein, 10 aa, BK virus
CKGVNKEYLL

SEQ ID NO: 22856 - protein, 10 aa, BK virus
KGVNKEYLLY

SEQ ID NO: 22857 - protein, 10 aa, BK virus
GVNKEYLLYS

SEQ ID NO: 22858 - protein, 10 aa, BK virus
VNKEYLLYSA

SEQ ID NO: 22859 - protein, 10 aa, BK virus
NKEYLLYSAL

SEQ ID NO: 22860 - protein, 10 aa, BK virus
KEYLLYSALT

SEQ ID NO: 22861 - protein, 10 aa, BK virus
EYLLYSALTR

SEQ ID NO: 22862 - protein, 10 aa, BK virus
YLLYSALTRD

SEQ ID NO: 22863 - protein, 10 aa, BK virus
LLYSALTRDP

SEQ ID NO: 22864 - protein, 10 aa, BK virus
LYSALTRDPY

SEQ ID NO: 22865 - protein, 10 aa, BK virus
YSALTRDPYH

SEQ ID NO: 22866 - protein, 10 aa, BK virus
SALTRDPYHT

SEQ ID NO: 22867 - protein, 10 aa, BK virus
ALTRDPYHTI

SEQ ID NO: 22868 - protein, 10 aa, BK virus
LTRDPYHTIE

SEQ ID NO: 22869 - protein, 10 aa, BK virus
TRDPYHTIEE

SEQ ID NO: 22870 - protein, 10 aa, BK virus
RDPYHTIEES

SEQ ID NO: 22871 - protein, 10 aa, BK virus
DPYHTIEESI

SEQ ID NO: 22872 - protein, 10 aa, BK virus
PYHTIEESIQ

SEQ ID NO: 22873 - protein, 10 aa, BK virus
YHTIEESIQG

SEQ ID NO: 22874 - protein, 10 aa, BK virus
HTIEESIQGG

SEQ ID NO: 22875 - protein, 10 aa, BK virus
TIEESIQGGL

SEQ ID NO: 22876 - protein, 10 aa, BK virus
IEESIQGGLK

SEQ ID NO: 22877 - protein, 10 aa, BK virus
EESIQGGLKE

SEQ ID NO: 22878 - protein, 10 aa, BK virus
ESIQGGLKEH

SEQ ID NO: 22879 - protein, 10 aa, BK virus
SIQGGLKEHD

SEQ ID NO: 22880 - protein, 10 aa, BK virus
IQGGLKEHDF

SEQ ID NO: 22881 - protein, 10 aa, BK virus
QGGLKEHDFS

SEQ ID NO: 22882 - protein, 10 aa, BK virus
GGLKEHDFSP

SEQ ID NO: 22883 - protein, 10 aa, BK virus
GLKEHDFSPE

SEQ ID NO: 22884 - protein, 10 aa, BK virus
LKEHDFSPEE

SEQ ID NO: 22885 - protein, 10 aa, BK virus
KEHDFSPEEP

SEQ ID NO: 22886 - protein, 10 aa, BK virus
EHDFSPEEPE

SEQ ID NO: 22887 - protein, 10 aa, BK virus
HDFSPEEPEE

SEQ ID NO: 22888 - protein, 10 aa, BK virus
DFSPEEPEET

SEQ ID NO: 22889 - protein, 10 aa, BK virus
FSPEEPEETK

SEQ ID NO: 22890 - protein, 10 aa, BK virus
SPEEPEETKQ

SEQ ID NO: 22891 - protein, 10 aa, BK virus
PEEPEETKQV

SEQ ID NO: 22892 - protein, 10 aa, BK virus
EEPEETKQVS

SEQ ID NO: 22893 - protein, 10 aa, BK virus
EPEETKQVSW

SEQ ID NO: 22894 - protein, 10 aa, BK virus
PEETKQVSWK

SEQ ID NO: 22895 - protein, 10 aa, BK virus
EETKQVSWKL

SEQ ID NO: 22896 - protein, 10 aa, BK virus
ETKQVSWKLI

SEQ ID NO: 22897 - protein, 10 aa, BK virus
TKQVSWKLIT

SEQ ID NO: 22898 - protein, 10 aa, BK virus
KQVSWKLITE

SEQ ID NO: 22899 - protein, 10 aa, BK virus
QVSWKLITEY

SEQ ID NO: 22900 - protein, 10 aa, BK virus
VSWKLITEYA

SEQ ID NO: 22901 - protein, 10 aa, BK virus
SWKLITEYAV

SEQ ID NO: 22902 - protein, 10 aa, BK virus
WKLITEYAVE

SEQ ID NO: 22903 - protein, 10 aa, BK virus
KLITEYAVET

SEQ ID NO: 22904 - protein, 10 aa, BK virus
LITEYAVETK

SEQ ID NO: 22905 - protein, 10 aa, BK virus
ITEYAVETKC

SEQ ID NO: 22906 - protein, 10 aa, BK virus
TEYAVETKCE

SEQ ID NO: 22907 - protein, 10 aa, BK virus
EYAVETKCED

SEQ ID NO: 22908 - protein, 10 aa, BK virus
YAVETKCEDV

SEQ ID NO: 22909 - protein, 10 aa, BK virus
AVETKCEDVF

SEQ ID NO: 22910 - protein, 10 aa, BK virus
VETKCEDVFL

SEQ ID NO: 22911 - protein, 10 aa, BK virus
ETKCEDVFLL

SEQ ID NO: 22912 - protein, 10 aa, BK virus
TKCEDVFLLL

SEQ ID NO: 22913 - protein, 10 aa, BK virus
KCEDVFLLLG

SEQ ID NO: 22914 - protein, 10 aa, BK virus
CEDVFLLLGM

SEQ ID NO: 22915 - protein, 10 aa, BK virus
EDVFLLLGMY

SEQ ID NO: 22916 - protein, 10 aa, BK virus
DVFLLLGMYL

SEQ ID NO: 22917 - protein, 10 aa, BK virus
VFLLLGMYLE

SEQ ID NO: 22918 - protein, 10 aa, BK virus
FLLLGMYLEF

SEQ ID NO: 22919 - protein, 10 aa, BK virus
LLLGMYLEFQ

SEQ ID NO: 22920 - protein, 10 aa, BK virus
LLGMYLEFQY

SEQ ID NO: 22921 - protein, 10 aa, BK virus
LGMYLEFQYN

SEQ ID NO: 22922 - protein, 10 aa, BK virus
GMYLEFQYNV

SEQ ID NO: 22923 - protein, 10 aa, BK virus
MYLEFQYNVE

SEQ ID NO: 22924 - protein, 10 aa, BK virus
YLEFQYNVEE

SEQ ID NO: 22925 - protein, 10 aa, BK virus
LEFQYNVEEC

SEQ ID NO: 22926 - protein, 10 aa, BK virus
EFQYNVEECK

SEQ ID NO: 22927 - protein, 10 aa, BK virus
FQYNVEECKK

SEQ ID NO: 22928 - protein, 10 aa, BK virus
QYNVEECKKC

SEQ ID NO: 22929 - protein, 10 aa, BK virus
YNVEECKKCQ

SEQ ID NO: 22930 - protein, 10 aa, BK virus
NVEECKKCQK

SEQ ID NO: 22931 - protein, 10 aa, BK virus
VEECKKCQKK

SEQ ID NO: 22932 - protein, 10 aa, BK virus
EECKKCQKKD

SEQ ID NO: 22933 - protein, 10 aa, BK virus
ECKKCQKKDQ

SEQ ID NO: 22934 - protein, 10 aa, BK virus
CKKCQKKDQP

SEQ ID NO: 22935 - protein, 10 aa, BK virus
KKCQKKDQPY

SEQ ID NO: 22936 - protein, 10 aa, BK virus
KCQKKDQPYH

SEQ ID NO: 22937 - protein, 10 aa, BK virus
CQKKDQPYHF

SEQ ID NO: 22938 - protein, 10 aa, BK virus
QKKDQPYHFK

SEQ ID NO: 22939 - protein, 10 aa, BK virus
KKDQPYHFKY

SEQ ID NO: 22940 - protein, 10 aa, BK virus
KDQPYHFKYH

SEQ ID NO: 22941 - protein, 10 aa, BK virus
DQPYHFKYHE

SEQ ID NO: 22942 - protein, 10 aa, BK virus
QPYHFKYHEK

SEQ ID NO: 22943 - protein, 10 aa, BK virus
PYHFKYHEKH

SEQ ID NO: 22944 - protein, 10 aa, BK virus
YHFKYHEKHF

SEQ ID NO: 22945 - protein, 10 aa, BK virus
HFKYHEKHFA

SEQ ID NO: 22946 - protein, 10 aa, BK virus
FKYHEKHFAN

SEQ ID NO: 22947 - protein, 10 aa, BK virus
KYHEKHFANA

SEQ ID NO: 22948 - protein, 10 aa, BK virus
YHEKHFANAI

SEQ ID NO: 22949 - protein, 10 aa, BK virus
HEKHFANAII

SEQ ID NO: 22950 - protein, 10 aa, BK virus
EKHFANAIIF

SEQ ID NO: 22951 - protein, 10 aa, BK virus
KHFANAIIFA

SEQ ID NO: 22952 - protein, 10 aa, BK virus
HFANAIIFAE

SEQ ID NO: 22953 - protein, 10 aa, BK virus
FANAIIFAES

SEQ ID NO: 22954 - protein, 10 aa, BK virus
ANAIIFAESK

SEQ ID NO: 22955 - protein, 10 aa, BK virus
NAIIFAESKN

SEQ ID NO: 22956 - protein, 10 aa, BK virus
AIIFAESKNQ

SEQ ID NO: 22957 - protein, 10 aa, BK virus
IIFAESKNQK

SEQ ID NO: 22958 - protein, 10 aa, BK virus
IFAESKNQKS

SEQ ID NO: 22959 - protein, 10 aa, BK virus
FAESKNQKSI

SEQ ID NO: 22960 - protein, 10 aa, BK virus
AESKNQKSIC

SEQ ID NO: 22961 - protein, 10 aa, BK virus
ESKNQKSICQ

SEQ ID NO: 22962 - protein, 10 aa, BK virus
SKNQKSICQQ

SEQ ID NO: 22963 - protein, 10 aa, BK virus
KNQKSICQQA

SEQ ID NO: 22964 - protein, 10 aa, BK virus
NQKSICQQAV

SEQ ID NO: 22965 - protein, 10 aa, BK virus
QKSICQQAVD

SEQ ID NO: 22966 - protein, 10 aa, BK virus
KSICQQAVDT

SEQ ID NO: 22967 - protein, 10 aa, BK virus
SICQQAVDTV

SEQ ID NO: 22968 - protein, 10 aa, BK virus
ICQQAVDTVL

SEQ ID NO: 22969 - protein, 10 aa, BK virus
CQQAVDTVLA

SEQ ID NO: 22970 - protein, 10 aa, BK virus
QQAVDTVLAK

SEQ ID NO: 22971 - protein, 10 aa, BK virus
QAVDTVLAKK

SEQ ID NO: 22972 - protein, 10 aa, BK virus
AVDTVLAKKR

SEQ ID NO: 22973 - protein, 10 aa, BK virus
VDTVLAKKRV

SEQ ID NO: 22974 - protein, 10 aa, BK virus
DTVLAKKRVD

SEQ ID NO: 22975 - protein, 10 aa, BK virus
TVLAKKRVDT

SEQ ID NO: 22976 - protein, 10 aa, BK virus
VLAKKRVDTL

SEQ ID NO: 22977 - protein, 10 aa, BK virus
LAKKRVDTLH

SEQ ID NO: 22978 - protein, 10 aa, BK virus
AKKRVDTLHM

SEQ ID NO: 22979 - protein, 10 aa, BK virus
KKRVDTLHMT

SEQ ID NO: 22980 - protein, 10 aa, BK virus
KRVDTLHMTR

SEQ ID NO: 22981 - protein, 10 aa, BK virus
RVDTLHMTRE

SEQ ID NO: 22982 - protein, 10 aa, BK virus
VDTLHMTREE

SEQ ID NO: 22983 - protein, 10 aa, BK virus
DTLHMTREEM

SEQ ID NO: 22984 - protein, 10 aa, BK virus
TLHMTREEML

SEQ ID NO: 22985 - protein, 10 aa, BK virus
LHMTREEMLT

SEQ ID NO: 22986 - protein, 10 aa, BK virus
HMTREEMLTE

SEQ ID NO: 22987 - protein, 10 aa, BK virus
MTREEMLTER

SEQ ID NO: 22988 - protein, 10 aa, BK virus
TREEMLTERF

SEQ ID NO: 22989 - protein, 10 aa, BK virus
REEMLTERFN

SEQ ID NO: 22990 - protein, 10 aa, BK virus
EEMLTERFNH

SEQ ID NO: 22991 - protein, 10 aa, BK virus
EMLTERFNHI

SEQ ID NO: 22992 - protein, 10 aa, BK virus
MLTERFNHIL

SEQ ID NO: 22993 - protein, 10 aa, BK virus
LTERFNHILD

SEQ ID NO: 22994 - protein, 10 aa, BK virus
TERFNHILDK

SEQ ID NO: 22995 - protein, 10 aa, BK virus
ERFNHILDKM

SEQ ID NO: 22996 - protein, 10 aa, BK virus
RFNHILDKMD

SEQ ID NO: 22997 - protein, 10 aa, BK virus
FNHILDKMDL

SEQ ID NO: 22998 - protein, 10 aa, BK virus
NHILDKMDLI

SEQ ID NO: 22999 - protein, 10 aa, BK virus
HILDKMDLIF

SEQ ID NO: 23000 - protein, 10 aa, BK virus
ILDKMDLIFG

SEQ ID NO: 23001 - protein, 10 aa, BK virus
LDKMDLIFGA

SEQ ID NO: 23002 - protein, 10 aa, BK virus
DKMDLIFGAH

SEQ ID NO: 23003 - protein, 10 aa, BK virus
KMDLIFGAHG

SEQ ID NO: 23004 - protein, 10 aa, BK virus
MDLIFGAHGN

SEQ ID NO: 23005 - protein, 10 aa, BK virus
DLIFGAHGNA

SEQ ID NO: 23006 - protein, 10 aa, BK virus
LIFGAHGNAV

SEQ ID NO: 23007 - protein, 10 aa, BK virus
IFGAHGNAVL

SEQ ID NO: 23008 - protein, 10 aa, BK virus
FGAHGNAVLE

SEQ ID NO: 23009 - protein, 10 aa, BK virus
GAHGNAVLEQ

SEQ ID NO: 23010 - protein, 10 aa, BK virus
AHGNAVLEQY

SEQ ID NO: 23011 - protein, 10 aa, BK virus
HGNAVLEQYM

SEQ ID NO: 23012 - protein, 10 aa, BK virus
GNAVLEQYMA

SEQ ID NO: 23013 - protein, 10 aa, BK virus
NAVLEQYMAG

SEQ ID NO: 23014 - protein, 10 aa, BK virus
AVLEQYMAGV

SEQ ID NO: 23015 - protein, 10 aa, BK virus
VLEQYMAGVA

SEQ ID NO: 23016 - protein, 10 aa, BK virus
LEQYMAGVAW

SEQ ID NO: 23017 - protein, 10 aa, BK virus
EQYMAGVAWL

SEQ ID NO: 23018 - protein, 10 aa, BK virus
QYMAGVAWLH

SEQ ID NO: 23019 - protein, 10 aa, BK virus
YMAGVAWLHC

SEQ ID NO: 23020 - protein, 10 aa, BK virus
MAGVAWLHCL

SEQ ID NO: 23021 - protein, 10 aa, BK virus
AGVAWLHCLL

SEQ ID NO: 23022 - protein, 10 aa, BK virus
GVAWLHCLLP

SEQ ID NO: 23023 - protein, 10 aa, BK virus
VAWLHCLLPK

SEQ ID NO: 23024 - protein, 10 aa, BK virus
AWLHCLLPKM

SEQ ID NO: 23025 - protein, 10 aa, BK virus
WLHCLLPKMD

SEQ ID NO: 23026 - protein, 10 aa, BK virus
LHCLLPKMDS

SEQ ID NO: 23027 - protein, 10 aa, BK virus
HCLLPKMDSV

SEQ ID NO: 23028 - protein, 10 aa, BK virus
CLLPKMDSVI

SEQ ID NO: 23029 - protein, 10 aa, BK virus
LLPKMDSVIF

SEQ ID NO: 23030 - protein, 10 aa, BK virus
LPKMDSVIFD

SEQ ID NO: 23031 - protein, 10 aa, BK virus
PKMDSVIFDF

SEQ ID NO: 23032 - protein, 10 aa, BK virus
KMDSVIFDFL

SEQ ID NO: 23033 - protein, 10 aa, BK virus
MDSVIFDFLH

SEQ ID NO: 23034 - protein, 10 aa, BK virus
DSVIFDFLHC

SEQ ID NO: 23035 - protein, 10 aa, BK virus
SVIFDFLHCI

SEQ ID NO: 23036 - protein, 10 aa, BK virus
VIFDFLHCIV

SEQ ID NO: 23037 - protein, 10 aa, BK virus
IFDFLHCIVF

SEQ ID NO: 23038 - protein, 10 aa, BK virus
FDFLHCIVFN

SEQ ID NO: 23039 - protein, 10 aa, BK virus
DFLHCIVFNV

SEQ ID NO: 23040 - protein, 10 aa, BK virus
FLHCIVFNVP

SEQ ID NO: 23041 - protein, 10 aa, BK virus
LHCIVFNVPK

SEQ ID NO: 23042 - protein, 10 aa, BK virus
HCIVFNVPKR

SEQ ID NO: 23043 - protein, 10 aa, BK virus
CIVFNVPKRR

SEQ ID NO: 23044 - protein, 10 aa, BK virus
IVFNVPKRRY

SEQ ID NO: 23045 - protein, 10 aa, BK virus
VFNVPKRRYW

SEQ ID NO: 23046 - protein, 10 aa, BK virus
FNVPKRRYWL

SEQ ID NO: 23047 - protein, 10 aa, BK virus
NVPKRRYWLF

SEQ ID NO: 23048 - protein, 10 aa, BK virus
VPKRRYWLFK

SEQ ID NO: 23049 - protein, 10 aa, BK virus
PKRRYWLFKG

SEQ ID NO: 23050 - protein, 10 aa, BK virus
KRRYWLFKGP

SEQ ID NO: 23051 - protein, 10 aa, BK virus
RRYWLFKGPI

SEQ ID NO: 23052 - protein, 10 aa, BK virus
RYWLFKGPID

SEQ ID NO: 23053 - protein, 10 aa, BK virus
YWLFKGPIDS

SEQ ID NO: 23054 - protein, 10 aa, BK virus
WLFKGPIDSG

SEQ ID NO: 23055 - protein, 10 aa, BK virus
LFKGPIDSGK

SEQ ID NO: 23056 - protein, 10 aa, BK virus
FKGPIDSGKT

SEQ ID NO: 23057 - protein, 10 aa, BK virus
KGPIDSGKTT

SEQ ID NO: 23058 - protein, 10 aa, BK virus
GPIDSGKTTL

SEQ ID NO: 23059 - protein, 10 aa, BK virus
PIDSGKTTLA

SEQ ID NO: 23060 - protein, 10 aa, BK virus
IDSGKTTLAA

SEQ ID NO: 23061 - protein, 10 aa, BK virus
DSGKTTLAAG

SEQ ID NO: 23062 - protein, 10 aa, BK virus
SGKTTLAAGL

SEQ ID NO: 23063 - protein, 10 aa, BK virus
GKTTLAAGLL

SEQ ID NO: 23064 - protein, 10 aa, BK virus
KTTLAAGLLD

SEQ ID NO: 23065 - protein, 10 aa, BK virus
TTLAAGLLDL

SEQ ID NO: 23066 - protein, 10 aa, BK virus
TLAAGLLDLC

SEQ ID NO: 23067 - protein, 10 aa, BK virus
LAAGLLDLCG

SEQ ID NO: 23068 - protein, 10 aa, BK virus
AAGLLDLCGG

SEQ ID NO: 23069 - protein, 10 aa, BK virus
AGLLDLCGGK

SEQ ID NO: 23070 - protein, 10 aa, BK virus
GLLDLCGGKA

SEQ ID NO: 23071 - protein, 10 aa, BK virus
LLDLCGGKAL

SEQ ID NO: 23072 - protein, 10 aa, BK virus
LDLCGGKALN

SEQ ID NO: 23073 - protein, 10 aa, BK virus
DLCGGKALNV

SEQ ID NO: 23074 - protein, 10 aa, BK virus
LCGGKALNVN

SEQ ID NO: 23075 - protein, 10 aa, BK virus
CGGKALNVNL

SEQ ID NO: 23076 - protein, 10 aa, BK virus
GGKALNVNLP

SEQ ID NO: 23077 - protein, 10 aa, BK virus
GKALNVNLPM

SEQ ID NO: 23078 - protein, 10 aa, BK virus
KALNVNLPME

SEQ ID NO: 23079 - protein, 10 aa, BK virus
ALNVNLPMER

SEQ ID NO: 23080 - protein, 10 aa, BK virus
LNVNLPMERL

SEQ ID NO: 23081 - protein, 10 aa, BK virus
NVNLPMERLT

SEQ ID NO: 23082 - protein, 10 aa, BK virus
VNLPMERLTF

SEQ ID NO: 23083 - protein, 10 aa, BK virus
NLPMERLTFE

SEQ ID NO: 23084 - protein, 10 aa, BK virus
LPMERLTFEL

SEQ ID NO: 23085 - protein, 10 aa, BK virus
PMERLTFELG

SEQ ID NO: 23086 - protein, 10 aa, BK virus
MERLTFELGV

SEQ ID NO: 23087 - protein, 10 aa, BK virus
ERLTFELGVA

SEQ ID NO: 23088 - protein, 10 aa, BK virus
RLTFELGVAI

SEQ ID NO: 23089 - protein, 10 aa, BK virus
LTFELGVAID

SEQ ID NO: 23090 - protein, 10 aa, BK virus
TFELGVAIDQ

SEQ ID NO: 23091 - protein, 10 aa, BK virus
FELGVAIDQY

SEQ ID NO: 23092 - protein, 10 aa, BK virus
ELGVAIDQYM

SEQ ID NO: 23093 - protein, 10 aa, BK virus
LGVAIDQYMV

SEQ ID NO: 23094 - protein, 10 aa, BK virus
GVAIDQYMVV

SEQ ID NO: 23095 - protein, 10 aa, BK virus
VAIDQYMVVF

SEQ ID NO: 23096 - protein, 10 aa, BK virus
AIDQYMVVFE

SEQ ID NO: 23097 - protein, 10 aa, BK virus
IDQYMVVFED

SEQ ID NO: 23098 - protein, 10 aa, BK virus
DQYMVVFEDV

SEQ ID NO: 23099 - protein, 10 aa, BK virus
QYMVVFEDVK

SEQ ID NO: 23100 - protein, 10 aa, BK virus
YMVVFEDVKG

SEQ ID NO: 23101 - protein, 10 aa, BK virus
MVVFEDVKGT

SEQ ID NO: 23102 - protein, 10 aa, BK virus
VVFEDVKGTG

SEQ ID NO: 23103 - protein, 10 aa, BK virus
VFEDVKGTGA

SEQ ID NO: 23104 - protein, 10 aa, BK virus
FEDVKGTGAE

SEQ ID NO: 23105 - protein, 10 aa, BK virus
EDVKGTGAES

SEQ ID NO: 23106 - protein, 10 aa, BK virus
DVKGTGAESK

SEQ ID NO: 23107 - protein, 10 aa, BK virus
VKGTGAESKD

SEQ ID NO: 23108 - protein, 10 aa, BK virus
KGTGAESKDL

SEQ ID NO: 23109 - protein, 10 aa, BK virus
GTGAESKDLP

SEQ ID NO: 23110 - protein, 10 aa, BK virus
TGAESKDLPS

SEQ ID NO: 23111 - protein, 10 aa, BK virus
GAESKDLPSG

SEQ ID NO: 23112 - protein, 10 aa, BK virus
AESKDLPSGH

SEQ ID NO: 23113 - protein, 10 aa, BK virus
ESKDLPSGHG

SEQ ID NO: 23114 - protein, 10 aa, BK virus
SKDLPSGHGI

SEQ ID NO: 23115 - protein, 10 aa, BK virus
KDLPSGHGIN

SEQ ID NO: 23116 - protein, 10 aa, BK virus
DLPSGHGINN

SEQ ID NO: 23117 - protein, 10 aa, BK virus
LPSGHGINNL

SEQ ID NO: 23118 - protein, 10 aa, BK virus
PSGHGINNLD

SEQ ID NO: 23119 - protein, 10 aa, BK virus
SGHGINNLDS

SEQ ID NO: 23120 - protein, 10 aa, BK virus
GHGINNLDSL

SEQ ID NO: 23121 - protein, 10 aa, BK virus
HGINNLDSLR

SEQ ID NO: 23122 - protein, 10 aa, BK virus
GINNLDSLRD

SEQ ID NO: 23123 - protein, 10 aa, BK virus
INNLDSLRDY

SEQ ID NO: 23124 - protein, 10 aa, BK virus
NNLDSLRDYL

SEQ ID NO: 23125 - protein, 10 aa, BK virus
NLDSLRDYLD

SEQ ID NO: 23126 - protein, 10 aa, BK virus
LDSLRDYLDG

SEQ ID NO: 23127 - protein, 10 aa, BK virus
DSLRDYLDGS

SEQ ID NO: 23128 - protein, 10 aa, BK virus
SLRDYLDGSV

SEQ ID NO: 23129 - protein, 10 aa, BK virus
LRDYLDGSVK

SEQ ID NO: 23130 - protein, 10 aa, BK virus
RDYLDGSVKV

SEQ ID NO: 23131 - protein, 10 aa, BK virus
DYLDGSVKVN

SEQ ID NO: 23132 - protein, 10 aa, BK virus
YLDGSVKVNL

SEQ ID NO: 23133 - protein, 10 aa, BK virus
LDGSVKVNLE

SEQ ID NO: 23134 - protein, 10 aa, BK virus
DGSVKVNLEK

SEQ ID NO: 23135 - protein, 10 aa, BK virus
GSVKVNLEKK

SEQ ID NO: 23136 - protein, 10 aa, BK virus
SVKVNLEKKH

SEQ ID NO: 23137 - protein, 10 aa, BK virus
VKVNLEKKHL

SEQ ID NO: 23138 - protein, 10 aa, BK virus
KVNLEKKHLN

SEQ ID NO: 23139 - protein, 10 aa, BK virus
VNLEKKHLNK

SEQ ID NO: 23140 - protein, 10 aa, BK virus
NLEKKHLNKR

SEQ ID NO: 23141 - protein, 10 aa, BK virus
LEKKHLNKRT

SEQ ID NO: 23142 - protein, 10 aa, BK virus
EKKHLNKRTQ

SEQ ID NO: 23143 - protein, 10 aa, BK virus
KKHLNKRTQI

SEQ ID NO: 23144 - protein, 10 aa, BK virus
KHLNKRTQIF

SEQ ID NO: 23145 - protein, 10 aa, BK virus
HLNKRTQIFP

SEQ ID NO: 23146 - protein, 10 aa, BK virus
LNKRTQIFPP

SEQ ID NO: 23147 - protein, 10 aa, BK virus
NKRTQIFPPG

SEQ ID NO: 23148 - protein, 10 aa, BK virus
KRTQIFPPGL

SEQ ID NO: 23149 - protein, 10 aa, BK virus
RTQIFPPGLV

SEQ ID NO: 23150 - protein, 10 aa, BK virus
TQIFPPGLVT

SEQ ID NO: 23151 - protein, 10 aa, BK virus
QIFPPGLVTM

SEQ ID NO: 23152 - protein, 10 aa, BK virus
IFPPGLVTMN

SEQ ID NO: 23153 - protein, 10 aa, BK virus
FPPGLVTMNE

SEQ ID NO: 23154 - protein, 10 aa, BK virus
PPGLVTMNEY

SEQ ID NO: 23155 - protein, 10 aa, BK virus
PGLVTMNEYP

SEQ ID NO: 23156 - protein, 10 aa, BK virus
GLVTMNEYPV

SEQ ID NO: 23157 - protein, 10 aa, BK virus
LVTMNEYPVP

SEQ ID NO: 23158 - protein, 10 aa, BK virus
VTMNEYPVPK

SEQ ID NO: 23159 - protein, 10 aa, BK virus
TMNEYPVPKT

SEQ ID NO: 23160 - protein, 10 aa, BK virus
MNEYPVPKTL

SEQ ID NO: 23161 - protein, 10 aa, BK virus
NEYPVPKTLQ

SEQ ID NO: 23162 - protein, 10 aa, BK virus
EYPVPKTLQA

SEQ ID NO: 23163 - protein, 10 aa, BK virus
YPVPKTLQAR

SEQ ID NO: 23164 - protein, 10 aa, BK virus
PVPKTLQARF

SEQ ID NO: 23165 - protein, 10 aa, BK virus
VPKTLQARFV

SEQ ID NO: 23166 - protein, 10 aa, BK virus
PKTLQARFVR

SEQ ID NO: 23167 - protein, 10 aa, BK virus
KTLQARFVRQ

SEQ ID NO: 23168 - protein, 10 aa, BK virus
TLQARFVRQI

SEQ ID NO: 23169 - protein, 10 aa, BK virus
LQARFVRQID

SEQ ID NO: 23170 - protein, 10 aa, BK virus
QARFVRQIDF

SEQ ID NO: 23171 - protein, 10 aa, BK virus
ARFVRQIDFR

SEQ ID NO: 23172 - protein, 10 aa, BK virus
RFVRQIDFRP

SEQ ID NO: 23173 - protein, 10 aa, BK virus
FVRQIDFRPK

SEQ ID NO: 23174 - protein, 10 aa, BK virus
VRQIDFRPKI

SEQ ID NO: 23175 - protein, 10 aa, BK virus
RQIDFRPKIY

SEQ ID NO: 23176 - protein, 10 aa, BK virus
QIDFRPKIYL

SEQ ID NO: 23177 - protein, 10 aa, BK virus
IDFRPKIYLR

SEQ ID NO: 23178 - protein, 10 aa, BK virus
DFRPKIYLRK

SEQ ID NO: 23179 - protein, 10 aa, BK virus
FRPKIYLRKS

SEQ ID NO: 23180 - protein, 10 aa, BK virus
RPKIYLRKSL

SEQ ID NO: 23181 - protein, 10 aa, BK virus
PKIYLRKSLQ

SEQ ID NO: 23182 - protein, 10 aa, BK virus
KIYLRKSLQN

SEQ ID NO: 23183 - protein, 10 aa, BK virus
IYLRKSLQNS

SEQ ID NO: 23184 - protein, 10 aa, BK virus
YLRKSLQNSE

SEQ ID NO: 23185 - protein, 10 aa, BK virus
LRKSLQNSEF

SEQ ID NO: 23186 - protein, 10 aa, BK virus
RKSLQNSEFL

SEQ ID NO: 23187 - protein, 10 aa, BK virus
KSLQNSEFLL

SEQ ID NO: 23188 - protein, 10 aa, BK virus
SLQNSEFLLE

SEQ ID NO: 23189 - protein, 10 aa, BK virus
LQNSEFLLEK

SEQ ID NO: 23190 - protein, 10 aa, BK virus
QNSEFLLEKR

SEQ ID NO: 23191 - protein, 10 aa, BK virus
NSEFLLEKRI

SEQ ID NO: 23192 - protein, 10 aa, BK virus
SEFLLEKRIL

SEQ ID NO: 23193 - protein, 10 aa, BK virus
EFLLEKRILQ

SEQ ID NO: 23194 - protein, 10 aa, BK virus
FLLEKRILQS

SEQ ID NO: 23195 - protein, 10 aa, BK virus
LLEKRILQSG

SEQ ID NO: 23196 - protein, 10 aa, BK virus
LEKRILQSGM

SEQ ID NO: 23197 - protein, 10 aa, BK virus
EKRILQSGMT

SEQ ID NO: 23198 - protein, 10 aa, BK virus
KRILQSGMTL

SEQ ID NO: 23199 - protein, 10 aa, BK virus
RILQSGMTLL

SEQ ID NO: 23200 - protein, 10 aa, BK virus
ILQSGMTLLL

SEQ ID NO: 23201 - protein, 10 aa, BK virus
LQSGMTLLLL

SEQ ID NO: 23202 - protein, 10 aa, BK virus
QSGMTLLLLL

SEQ ID NO: 23203 - protein, 10 aa, BK virus
SGMTLLLLLI

SEQ ID NO: 23204 - protein, 10 aa, BK virus
GMTLLLLLIW

SEQ ID NO: 23205 - protein, 10 aa, BK virus
MTLLLLLIWF

SEQ ID NO: 23206 - protein, 10 aa, BK virus
TLLLLLIWFR

SEQ ID NO: 23207 - protein, 10 aa, BK virus
LLLLLIWFRP

SEQ ID NO: 23208 - protein, 10 aa, BK virus
LLLLIWFRPV

SEQ ID NO: 23209 - protein, 10 aa, BK virus
LLLIWFRPVA

SEQ ID NO: 23210 - protein, 10 aa, BK virus
LLIWFRPVAD

SEQ ID NO: 23211 - protein, 10 aa, BK virus
LIWFRPVADF

SEQ ID NO: 23212 - protein, 10 aa, BK virus
IWFRPVADFA

SEQ ID NO: 23213 - protein, 10 aa, BK virus
WFRPVADFAT

SEQ ID NO: 23214 - protein, 10 aa, BK virus
FRPVADFATD

SEQ ID NO: 23215 - protein, 10 aa, BK virus
RPVADFATDI

SEQ ID NO: 23216 - protein, 10 aa, BK virus
PVADFATDIQ

SEQ ID NO: 23217 - protein, 10 aa, BK virus
VADFATDIQS

SEQ ID NO: 23218 - protein, 10 aa, BK virus
ADFATDIQSR

SEQ ID NO: 23219 - protein, 10 aa, BK virus
DFATDIQSRI

SEQ ID NO: 23220 - protein, 10 aa, BK virus
FATDIQSRIV

SEQ ID NO: 23221 - protein, 10 aa, BK virus
ATDIQSRIVE

SEQ ID NO: 23222 - protein, 10 aa, BK virus
TDIQSRIVEW

SEQ ID NO: 23223 - protein, 10 aa, BK virus
DIQSRIVEWK

SEQ ID NO: 23224 - protein, 10 aa, BK virus
IQSRIVEWKE

SEQ ID NO: 23225 - protein, 10 aa, BK virus
QSRIVEWKER

SEQ ID NO: 23226 - protein, 10 aa, BK virus
SRIVEWKERL

SEQ ID NO: 23227 - protein, 10 aa, BK virus
RIVEWKERLD

SEQ ID NO: 23228 - protein, 10 aa, BK virus
IVEWKERLDS

SEQ ID NO: 23229 - protein, 10 aa, BK virus
VEWKERLDSE

SEQ ID NO: 23230 - protein, 10 aa, BK virus
EWKERLDSEI

SEQ ID NO: 23231 - protein, 10 aa, BK virus
WKERLDSEIS

SEQ ID NO: 23232 - protein, 10 aa, BK virus
KERLDSEISM

SEQ ID NO: 23233 - protein, 10 aa, BK virus
ERLDSEISMY

SEQ ID NO: 23234 - protein, 10 aa, BK virus
RLDSEISMYT

SEQ ID NO: 23235 - protein, 10 aa, BK virus
LDSEISMYTF

SEQ ID NO: 23236 - protein, 10 aa, BK virus
DSEISMYTFS

SEQ ID NO: 23237 - protein, 10 aa, BK virus
SEISMYTFSR

SEQ ID NO: 23238 - protein, 10 aa, BK virus
EISMYTFSRM

SEQ ID NO: 23239 - protein, 10 aa, BK virus
ISMYTFSRMK

SEQ ID NO: 23240 - protein, 10 aa, BK virus
SMYTFSRMKY

SEQ ID NO: 23241 - protein, 10 aa, BK virus
MYTFSRMKYN

SEQ ID NO: 23242 - protein, 10 aa, BK virus
YTFSRMKYNI

SEQ ID NO: 23243 - protein, 10 aa, BK virus
TFSRMKYNIC

SEQ ID NO: 23244 - protein, 10 aa, BK virus
FSRMKYNICM

SEQ ID NO: 23245 - protein, 10 aa, BK virus
SRMKYNICMG

SEQ ID NO: 23246 - protein, 10 aa, BK virus
RMKYNICMGK

SEQ ID NO: 23247 - protein, 10 aa, BK virus
MKYNICMGKC

SEQ ID NO: 23248 - protein, 10 aa, BK virus
KYNICMGKCI

SEQ ID NO: 23249 - protein, 10 aa, BK virus
YNICMGKCIL

SEQ ID NO: 23250 - protein, 10 aa, BK virus
NICMGKCILD

SEQ ID NO: 23251 - protein, 10 aa, BK virus
ICMGKCILDI

SEQ ID NO: 23252 - protein, 10 aa, BK virus
CMGKCILDIT

SEQ ID NO: 23253 - protein, 10 aa, BK virus
MGKCILDITR

SEQ ID NO: 23254 - protein, 10 aa, BK virus
GKCILDITRE

SEQ ID NO: 23255 - protein, 10 aa, BK virus
KCILDITREE

SEQ ID NO: 23256 - protein, 10 aa, BK virus
CILDITREED

SEQ ID NO: 23257 - protein, 10 aa, BK virus
ILDITREEDS

SEQ ID NO: 23258 - protein, 10 aa, BK virus
LDITREEDSE

SEQ ID NO: 23259 - protein, 10 aa, BK virus
DITREEDSET

SEQ ID NO: 23260 - protein, 10 aa, BK virus
ITREEDSETE

SEQ ID NO: 23261 - protein, 10 aa, BK virus
TREEDSETED

SEQ ID NO: 23262 - protein, 10 aa, BK virus
REEDSETEDS

SEQ ID NO: 23263 - protein, 10 aa, BK virus
EEDSETEDSG

SEQ ID NO: 23264 - protein, 10 aa, BK virus
EDSETEDSGH

SEQ ID NO: 23265 - protein, 10 aa, BK virus
DSETEDSGHG

SEQ ID NO: 23266 - protein, 10 aa, BK virus
SETEDSGHGS

SEQ ID NO: 23267 - protein, 10 aa, BK virus
ETEDSGHGSS

SEQ ID NO: 23268 - protein, 10 aa, BK virus
TEDSGHGSST

SEQ ID NO: 23269 - protein, 10 aa, BK virus
EDSGHGSSTE

SEQ ID NO: 23270 - protein, 10 aa, BK virus
DSGHGSSTES

SEQ ID NO: 23271 - protein, 10 aa, BK virus
SGHGSSTESQ

SEQ ID NO: 23272 - protein, 10 aa, BK virus
GHGSSTESQS

SEQ ID NO: 23273 - protein, 10 aa, BK virus
HGSSTESQSQ

SEQ ID NO: 23274 - protein, 10 aa, BK virus
GSSTESQSQC

SEQ ID NO: 23275 - protein, 10 aa, BK virus
SSTESQSQCS

SEQ ID NO: 23276 - protein, 10 aa, BK virus
STESQSQCSS

SEQ ID NO: 23277 - protein, 10 aa, BK virus
TESQSQCSSQ

SEQ ID NO: 23278 - protein, 10 aa, BK virus
ESQSQCSSQV

SEQ ID NO: 23279 - protein, 10 aa, BK virus
SQSQCSSQVS

SEQ ID NO: 23280 - protein, 10 aa, BK virus
QSQCSSQVSD

SEQ ID NO: 23281 - protein, 10 aa, BK virus
SQCSSQVSDT

SEQ ID NO: 23282 - protein, 10 aa, BK virus
QCSSQVSDTS

SEQ ID NO: 23283 - protein, 10 aa, BK virus
CSSQVSDTSA

SEQ ID NO: 23284 - protein, 10 aa, BK virus
SSQVSDTSAP

SEQ ID NO: 23285 - protein, 10 aa, BK virus
SQVSDTSAPA

SEQ ID NO: 23286 - protein, 10 aa, BK virus
QVSDTSAPAE

SEQ ID NO: 23287 - protein, 10 aa, BK virus
VSDTSAPAED

SEQ ID NO: 23288 - protein, 10 aa, BK virus
SDTSAPAEDS

SEQ ID NO: 23289 - protein, 10 aa, BK virus
DTSAPAEDSQ

SEQ ID NO: 23290 - protein, 10 aa, BK virus
TSAPAEDSQR

SEQ ID NO: 23291 - protein, 10 aa, BK virus
SAPAEDSQRS

SEQ ID NO: 23292 - protein, 10 aa, BK virus
APAEDSQRSD

SEQ ID NO: 23293 - protein, 10 aa, BK virus
PAEDSQRSDP

SEQ ID NO: 23294 - protein, 10 aa, BK virus
AEDSQRSDPH

SEQ ID NO: 23295 - protein, 10 aa, BK virus
EDSQRSDPHS

SEQ ID NO: 23296 - protein, 10 aa, BK virus
DSQRSDPHSQ

SEQ ID NO: 23297 - protein, 10 aa, BK virus
SQRSDPHSQE

SEQ ID NO: 23298 - protein, 10 aa, BK virus
QRSDPHSQEL

SEQ ID NO: 23299 - protein, 10 aa, BK virus
RSDPHSQELH

SEQ ID NO: 23300 - protein, 10 aa, BK virus
SDPHSQELHL

SEQ ID NO: 23301 - protein, 10 aa, BK virus
DPHSQELHLC

SEQ ID NO: 23302 - protein, 10 aa, BK virus
PHSQELHLCK

SEQ ID NO: 23303 - protein, 10 aa, BK virus
HSQELHLCKG

SEQ ID NO: 23304 - protein, 10 aa, BK virus
SQELHLCKGF

SEQ ID NO: 23305 - protein, 10 aa, BK virus
QELHLCKGFQ

SEQ ID NO: 23306 - protein, 10 aa, BK virus
ELHLCKGFQC

SEQ ID NO: 23307 - protein, 10 aa, BK virus
LHLCKGFQCF

SEQ ID NO: 23308 - protein, 10 aa, BK virus
HLCKGFQCFK

SEQ ID NO: 23309 - protein, 10 aa, BK virus
LCKGFQCFKR

SEQ ID NO: 23310 - protein, 10 aa, BK virus
CKGFQCFKRP

SEQ ID NO: 23311 - protein, 10 aa, BK virus
KGFQCFKRPK

SEQ ID NO: 23312 - protein, 10 aa, BK virus
GFQCFKRPKT

SEQ ID NO: 23313 - protein, 10 aa, BK virus
FQCFKRPKTP

SEQ ID NO: 23314 - protein, 10 aa, BK virus
QCFKRPKTPP

SEQ ID NO: 23315 - protein, 10 aa, BK virus
CFKRPKTPPP

SEQ ID NO: 23316 - protein, 10 aa, BK virus
FKRPKTPPPK

SEQ ID NO: 23317 - protein, 10 aa, BK virus
HKLKSGLYKS

SEQ ID NO: 23318 - protein, 10 aa, BK virus
KLKSGLYKSS

SEQ ID NO: 23319 - protein, 10 aa, BK virus
LKSGLYKSSI

SEQ ID NO: 23320 - protein, 10 aa, BK virus
KSGLYKSSIY

SEQ ID NO: 23321 - protein, 10 aa, BK virus
MYMYNKSTCL

SEQ ID NO: 23322 - protein, 10 aa, BK virus
YMYNKSTCLK

SEQ ID NO: 23323 - protein, 10 aa, BK virus
MYNKSTCLKH

SEQ ID NO: 23324 - protein, 10 aa, BK virus
YNKSTCLKHF

SEQ ID NO: 23325 - protein, 10 aa, BK virus
NKSTCLKHFG

SEQ ID NO: 23326 - protein, 10 aa, BK virus
KSTCLKHFGL

SEQ ID NO: 23327 - protein, 10 aa, BK virus
STCLKHFGLQ

SEQ ID NO: 23328 - protein, 10 aa, BK virus
TCLKHFGLQL

SEQ ID NO: 23329 - protein, 10 aa, BK virus
CLKHFGLQLS

SEQ ID NO: 23330 - protein, 10 aa, BK virus
LKHFGLQLSL

SEQ ID NO: 23331 - protein, 10 aa, BK virus
KHFGLQLSLF

SEQ ID NO: 23332 - protein, 10 aa, BK virus
HFGLQLSLFV

SEQ ID NO: 23333 - protein, 10 aa, BK virus
FGLQLSLFVN

SEQ ID NO: 23334 - protein, 10 aa, BK virus
GLQLSLFVNI

SEQ ID NO: 23335 - protein, 10 aa, BK virus
LQLSLFVNIS

SEQ ID NO: 23336 - protein, 10 aa, BK virus
QLSLFVNISY

SEQ ID NO: 23337 - protein, 10 aa, BK virus
LSLFVNISYH

SEQ ID NO: 23338 - protein, 10 aa, BK virus
SLFVNISYHI

SEQ ID NO: 23339 - protein, 10 aa, BK virus
LFVNISYHIW

SEQ ID NO: 23340 - protein, 10 aa, BK virus
FVNISYHIWV

SEQ ID NO: 23341 - protein, 10 aa, BK virus
VNISYHIWVP

SEQ ID NO: 23342 - protein, 10 aa, BK virus
NISYHIWVPW

SEQ ID NO: 23343 - protein, 10 aa, BK virus
ISYHIWVPWK

SEQ ID NO: 23344 - protein, 10 aa, BK virus
SYHIWVPWKS

SEQ ID NO: 23345 - protein, 10 aa, BK virus
YHIWVPWKSF

SEQ ID NO: 23346 - protein, 10 aa, BK virus
HIWVPWKSFC

SEQ ID NO: 23347 - protein, 10 aa, BK virus
IWVPWKSFCA

SEQ ID NO: 23348 - protein, 10 aa, BK virus
WVPWKSFCAI

SEQ ID NO: 23349 - protein, 10 aa, BK virus
VPWKSFCAIK

SEQ ID NO: 23350 - protein, 10 aa, BK virus
PWKSFCAIKH

SEQ ID NO: 23351 - protein, 10 aa, BK virus
WKSFCAIKHP

SEQ ID NO: 23352 - protein, 10 aa, BK virus
KSFCAIKHPN

SEQ ID NO: 23353 - protein, 10 aa, BK virus
SFCAIKHPNL

SEQ ID NO: 23354 - protein, 10 aa, BK virus
FCAIKHPNLF

SEQ ID NO: 23355 - protein, 10 aa, BK virus
CAIKHPNLFY

SEQ ID NO: 23356 - protein, 10 aa, BK virus
AIKHPNLFYL

SEQ ID NO: 23357 - protein, 10 aa, BK virus
IKHPNLFYLG

SEQ ID NO: 23358 - protein, 10 aa, BK virus
KHPNLFYLGF

SEQ ID NO: 23359 - protein, 10 aa, BK virus
HPNLFYLGFH

SEQ ID NO: 23360 - protein, 10 aa, BK virus
PNLFYLGFHT

SEQ ID NO: 23361 - protein, 10 aa, BK virus
NLFYLGFHTI

SEQ ID NO: 23362 - protein, 10 aa, BK virus
LFYLGFHTIH

SEQ ID NO: 23363 - protein, 10 aa, BK virus
FYLGFHTIHR

SEQ ID NO: 23364 - protein, 10 aa, BK virus
YLGFHTIHRL

SEQ ID NO: 23365 - protein, 10 aa, BK virus
LGFHTIHRLP

SEQ ID NO: 23366 - protein, 10 aa, BK virus
GFHTIHRLPI

SEQ ID NO: 23367 - protein, 10 aa, BK virus
FHTIHRLPIH

SEQ ID NO: 23368 - protein, 10 aa, BK virus
HTIHRLPIHS

SEQ ID NO: 23369 - protein, 10 aa, BK virus
TIHRLPIHSL

SEQ ID NO: 23370 - protein, 10 aa, BK virus
IHRLPIHSLG

SEQ ID NO: 23371 - protein, 10 aa, BK virus
HRLPIHSLGS

SEQ ID NO: 23372 - protein, 10 aa, BK virus
RLPIHSLGSP

SEQ ID NO: 23373 - protein, 10 aa, BK virus
LPIHSLGSPV

SEQ ID NO: 23374 - protein, 10 aa, BK virus
PIHSLGSPVY

SEQ ID NO: 23375 - protein, 10 aa, BK virus
IHSLGSPVYK

SEQ ID NO: 23376 - protein, 10 aa, BK virus
HSLGSPVYKV

SEQ ID NO: 23377 - protein, 10 aa, BK virus
SLGSPVYKVT

SEQ ID NO: 23378 - protein, 10 aa, BK virus
QKGNWVRILY

SEQ ID NO: 23379 - protein, 10 aa, BK virus
KGNWVRILYR

SEQ ID NO: 23380 - protein, 10 aa, BK virus
GNWVRILYRS

SEQ ID NO: 23381 - protein, 10 aa, BK virus
NWVRILYRSF

SEQ ID NO: 23382 - protein, 10 aa, BK virus
WVRILYRSFS

SEQ ID NO: 23383 - protein, 10 aa, BK virus
VRILYRSFSQ

SEQ ID NO: 23384 - protein, 10 aa, BK virus
RILYRSFSQA

SEQ ID NO: 23385 - protein, 10 aa, BK virus
ILYRSFSQAD

SEQ ID NO: 23386 - protein, 10 aa, BK virus
LYRSFSQADL

SEQ ID NO: 23387 - protein, 10 aa, BK virus
YRSFSQADLK

SEQ ID NO: 23388 - protein, 10 aa, BK virus
RSFSQADLKI

SEQ ID NO: 23389 - protein, 10 aa, BK virus
SFSQADLKIS

SEQ ID NO: 23390 - protein, 10 aa, BK virus
FSQADLKISC

SEQ ID NO: 23391 - protein, 10 aa, BK virus
SQADLKISCK

SEQ ID NO: 23392 - protein, 10 aa, BK virus
QADLKISCKA

SEQ ID NO: 23393 - protein, 10 aa, BK virus
ADLKISCKAS

SEQ ID NO: 23394 - protein, 10 aa, BK virus
DLKISCKASP

SEQ ID NO: 23395 - protein, 10 aa, BK virus
LKISCKASPL

SEQ ID NO: 23396 - protein, 10 aa, BK virus
KISCKASPLL

SEQ ID NO: 23397 - protein, 10 aa, BK virus
ISCKASPLLC

SEQ ID NO: 23398 - protein, 10 aa, BK virus
SCKASPLLCS

SEQ ID NO: 23399 - protein, 10 aa, BK virus
CKASPLLCSR

SEQ ID NO: 23400 - protein, 10 aa, BK virus
KASPLLCSRA

SEQ ID NO: 23401 - protein, 10 aa, BK virus
ASPLLCSRAV

SEQ ID NO: 23402 - protein, 10 aa, BK virus
SPLLCSRAVS

SEQ ID NO: 23403 - protein, 10 aa, BK virus
PLLCSRAVSK

SEQ ID NO: 23404 - protein, 10 aa, BK virus
LLCSRAVSKQ

SEQ ID NO: 23405 - protein, 10 aa, BK virus
LCSRAVSKQA

SEQ ID NO: 23406 - protein, 10 aa, BK virus
CSRAVSKQAT

SEQ ID NO: 23407 - protein, 10 aa, BK virus
SRAVSKQATN

SEQ ID NO: 23408 - protein, 10 aa, BK virus
RAVSKQATNI

SEQ ID NO: 23409 - protein, 10 aa, BK virus
AVSKQATNIS

SEQ ID NO: 23410 - protein, 10 aa, BK virus
VSKQATNISS

SEQ ID NO: 23411 - protein, 10 aa, BK virus
NIQAISFTKR

SEQ ID NO: 23412 - protein, 10 aa, BK virus
IQAISFTKRP

SEQ ID NO: 23413 - protein, 10 aa, BK virus
QAISFTKRPH

SEQ ID NO: 23414 - protein, 10 aa, BK virus
AISFTKRPHT

SEQ ID NO: 23415 - protein, 10 aa, BK virus
ISFTKRPHTL

SEQ ID NO: 23416 - protein, 10 aa, BK virus
SFTKRPHTLF

SEQ ID NO: 23417 - protein, 10 aa, BK virus
FTKRPHTLFI

SEQ ID NO: 23418 - protein, 10 aa, BK virus
QHCGSCVGHM

SEQ ID NO: 23419 - protein, 10 aa, BK virus
HCGSCVGHMK

SEQ ID NO: 23420 - protein, 10 aa, BK virus
CGSCVGHMKY

SEQ ID NO: 23421 - protein, 10 aa, BK virus
GSCVGHMKYW

SEQ ID NO: 23422 - protein, 10 aa, BK virus
SCVGHMKYWG

SEQ ID NO: 23423 - protein, 10 aa, BK virus
CVGHMKYWGN

SEQ ID NO: 23424 - protein, 10 aa, BK virus
VGHMKYWGNI

SEQ ID NO: 23425 - protein, 10 aa, BK virus
GHMKYWGNIF

SEQ ID NO: 23426 - protein, 10 aa, BK virus
HMKYWGNIFP

SEQ ID NO: 23427 - protein, 10 aa, BK virus
MKYWGNIFPS

SEQ ID NO: 23428 - protein, 10 aa, BK virus
KYWGNIFPSC

SEQ ID NO: 23429 - protein, 10 aa, BK virus
YWGNIFPSCE

SEQ ID NO: 23430 - protein, 10 aa, BK virus
WGNIFPSCES

SEQ ID NO: 23431 - protein, 10 aa, BK virus
GNIFPSCESP

SEQ ID NO: 23432 - protein, 10 aa, BK virus
NIFPSCESPK

SEQ ID NO: 23433 - protein, 10 aa, BK virus
IFPSCESPKI

SEQ ID NO: 23434 - protein, 10 aa, BK virus
FPSCESPKIP

SEQ ID NO: 23435 - protein, 10 aa, BK virus
PSCESPKIPS

SEQ ID NO: 23436 - protein, 10 aa, BK virus
SCESPKIPSI

SEQ ID NO: 23437 - protein, 10 aa, BK virus
CESPKIPSIF

SEQ ID NO: 23438 - protein, 10 aa, BK virus
ESPKIPSIFI

SEQ ID NO: 23439 - protein, 10 aa, BK virus
SPKIPSIFIS

SEQ ID NO: 23440 - protein, 10 aa, BK virus
PKIPSIFIST

SEQ ID NO: 23441 - protein, 10 aa, BK virus
KIPSIFISTG

SEQ ID NO: 23442 - protein, 10 aa, BK virus
IPSIFISTGI

SEQ ID NO: 23443 - protein, 10 aa, BK virus
PSIFISTGIR

SEQ ID NO: 23444 - protein, 10 aa, BK virus
SIFISTGIRY

SEQ ID NO: 23445 - protein, 10 aa, BK virus
IFISTGIRYP

SEQ ID NO: 23446 - protein, 10 aa, BK virus
FISTGIRYPA

SEQ ID NO: 23447 - protein, 10 aa, BK virus
ISTGIRYPAL

SEQ ID NO: 23448 - protein, 10 aa, BK virus
STGIRYPALN

SEQ ID NO: 23449 - protein, 10 aa, BK virus
TGIRYPALNW

SEQ ID NO: 23450 - protein, 10 aa, BK virus
GIRYPALNWI

SEQ ID NO: 23451 - protein, 10 aa, BK virus
IRYPALNWIS

SEQ ID NO: 23452 - protein, 10 aa, BK virus
RYPALNWISI

SEQ ID NO: 23453 - protein, 10 aa, BK virus
YPALNWISIV

SEQ ID NO: 23454 - protein, 10 aa, BK virus
PALNWISIVF

SEQ ID NO: 23455 - protein, 10 aa, BK virus
ALNWISIVFV

SEQ ID NO: 23456 - protein, 10 aa, BK virus
LNWISIVFVQ

SEQ ID NO: 23457 - protein, 10 aa, BK virus
NWISIVFVQI

SEQ ID NO: 23458 - protein, 10 aa, BK virus
WISIVFVQIG

SEQ ID NO: 23459 - protein, 10 aa, BK virus
ISIVFVQIGL

SEQ ID NO: 23460 - protein, 10 aa, BK virus
SIVFVQIGLM

SEQ ID NO: 23461 - protein, 10 aa, BK virus
IVFVQIGLMV

SEQ ID NO: 23462 - protein, 10 aa, BK virus
VFVQIGLMVS

SEQ ID NO: 23463 - protein, 10 aa, BK virus
FVQIGLMVSI

SEQ ID NO: 23464 - protein, 10 aa, BK virus
VQIGLMVSIH

SEQ ID NO: 23465 - protein, 10 aa, BK virus
QIGLMVSIHY

SEQ ID NO: 23466 - protein, 10 aa, BK virus
IGLMVSIHYL

SEQ ID NO: 23467 - protein, 10 aa, BK virus
GLMVSIHYLG

SEQ ID NO: 23468 - protein, 10 aa, BK virus
LMVSIHYLGL

SEQ ID NO: 23469 - protein, 10 aa, BK virus
MVSIHYLGLG

SEQ ID NO: 23470 - protein, 10 aa, BK virus
VSIHYLGLGC

SEQ ID NO: 23471 - protein, 10 aa, BK virus
SIHYLGLGCW

SEQ ID NO: 23472 - protein, 10 aa, BK virus
IHYLGLGCWV

SEQ ID NO: 23473 - protein, 10 aa, BK virus
HYLGLGCWVF

SEQ ID NO: 23474 - protein, 10 aa, BK virus
YLGLGCWVFR

SEQ ID NO: 23475 - protein, 10 aa, BK virus
LGLGCWVFRG

SEQ ID NO: 23476 - protein, 10 aa, BK virus
GLGCWVFRGY

SEQ ID NO: 23477 - protein, 10 aa, BK virus
LGCWVFRGYS

SEQ ID NO: 23478 - protein, 10 aa, BK virus
GCWVFRGYST

SEQ ID NO: 23479 - protein, 10 aa, BK virus
CWVFRGYSTI

SEQ ID NO: 23480 - protein, 10 aa, BK virus
WVFRGYSTIR

SEQ ID NO: 23481 - protein, 10 aa, BK virus
VFRGYSTIRV

SEQ ID NO: 23482 - protein, 10 aa, BK virus
FRGYSTIRVL

SEQ ID NO: 23483 - protein, 10 aa, BK virus
HSLHFQGFST

SEQ ID NO: 23484 - protein, 10 aa, BK virus
SLHFQGFSTY

SEQ ID NO: 23485 - protein, 10 aa, BK virus
LHFQGFSTYS

SEQ ID NO: 23486 - protein, 10 aa, BK virus
HFQGFSTYSK

SEQ ID NO: 23487 - protein, 10 aa, BK virus
FQGFSTYSKE

SEQ ID NO: 23488 - protein, 10 aa, BK virus
QGFSTYSKEV

SEQ ID NO: 23489 - protein, 10 aa, BK virus
GFSTYSKEVE

SEQ ID NO: 23490 - protein, 10 aa, BK virus
FSTYSKEVEI

SEQ ID NO: 23491 - protein, 10 aa, BK virus
STYSKEVEIT

SEQ ID NO: 23492 - protein, 10 aa, BK virus
TYSKEVEITA

SEQ ID NO: 23493 - protein, 10 aa, BK virus
YSKEVEITAL

SEQ ID NO: 23494 - protein, 10 aa, BK virus
SKEVEITALN

SEQ ID NO: 23495 - protein, 10 aa, BK virus
KEVEITALNR

SEQ ID NO: 23496 - protein, 10 aa, BK virus
EVEITALNRF

SEQ ID NO: 23497 - protein, 10 aa, BK virus
VEITALNRFS

SEQ ID NO: 23498 - protein, 10 aa, BK virus
EITALNRFSS

SEQ ID NO: 23499 - protein, 10 aa, BK virus
ITALNRFSST

SEQ ID NO: 23500 - protein, 10 aa, BK virus
TALNRFSSTM

SEQ ID NO: 23501 - protein, 10 aa, BK virus
ALNRFSSTML

SEQ ID NO: 23502 - protein, 10 aa, BK virus
LNRFSSTMLM

SEQ ID NO: 23503 - protein, 10 aa, BK virus
NRFSSTMLMH

SEQ ID NO: 23504 - protein, 10 aa, BK virus
RFSSTMLMHF

SEQ ID NO: 23505 - protein, 10 aa, BK virus
FSSTMLMHFL

SEQ ID NO: 23506 - protein, 10 aa, BK virus
PCMKVKHASY

SEQ ID NO: 23507 - protein, 10 aa, BK virus
CMKVKHASYS

SEQ ID NO: 23508 - protein, 10 aa, BK virus
MKVKHASYSN

SEQ ID NO: 23509 - protein, 10 aa, BK virus
KVKHASYSNN

SEQ ID NO: 23510 - protein, 10 aa, BK virus
VKHASYSNNL

SEQ ID NO: 23511 - protein, 10 aa, BK virus
KHASYSNNLC

SEQ ID NO: 23512 - protein, 10 aa, BK virus
HASYSNNLCL

SEQ ID NO: 23513 - protein, 10 aa, BK virus
ASYSNNLCLY

SEQ ID NO: 23514 - protein, 10 aa, BK virus
SYSNNLCLYS

SEQ ID NO: 23515 - protein, 10 aa, BK virus
YSNNLCLYSY

SEQ ID NO: 23516 - protein, 10 aa, BK virus
SNNLCLYSYS

SEQ ID NO: 23517 - protein, 10 aa, BK virus
NNLCLYSYSL

SEQ ID NO: 23518 - protein, 10 aa, BK virus
NLCLYSYSLP

SEQ ID NO: 23519 - protein, 10 aa, BK virus
LCLYSYSLPH

SEQ ID NO: 23520 - protein, 10 aa, BK virus
CLYSYSLPHQ

SEQ ID NO: 23521 - protein, 10 aa, BK virus
IGEGNSCCAV

SEQ ID NO: 23522 - protein, 10 aa, BK virus
GEGNSCCAVT

SEQ ID NO: 23523 - protein, 10 aa, BK virus
EGNSCCAVTG

SEQ ID NO: 23524 - protein, 10 aa, BK virus
GNSCCAVTGK

SEQ ID NO: 23525 - protein, 10 aa, BK virus
NSCCAVTGKH

SEQ ID NO: 23526 - protein, 10 aa, BK virus
SCCAVTGKHF

SEQ ID NO: 23527 - protein, 10 aa, BK virus
CCAVTGKHFS

SEQ ID NO: 23528 - protein, 10 aa, BK virus
CAVTGKHFSL

SEQ ID NO: 23529 - protein, 10 aa, BK virus
AVTGKHFSLW

SEQ ID NO: 23530 - protein, 10 aa, BK virus
VTGKHFSLWA

SEQ ID NO: 23531 - protein, 10 aa, BK virus
TGKHFSLWAI

SEQ ID NO: 23532 - protein, 10 aa, BK virus
GKHFSLWAIT

SEQ ID NO: 23533 - protein, 10 aa, BK virus
KHFSLWAITA

SEQ ID NO: 23534 - protein, 10 aa, BK virus
HFSLWAITAK

SEQ ID NO: 23535 - protein, 10 aa, BK virus
FSLWAITAKV

SEQ ID NO: 23536 - protein, 10 aa, BK virus
SLWAITAKVI

SEQ ID NO: 23537 - protein, 10 aa, BK virus
LWAITAKVIF

SEQ ID NO: 23538 - protein, 10 aa, BK virus
WAITAKVIFS

SEQ ID NO: 23539 - protein, 10 aa, BK virus
AITAKVIFST

SEQ ID NO: 23540 - protein, 10 aa, BK virus
TKAPKVFIWI

SEQ ID NO: 23541 - protein, 10 aa, BK virus
KAPKVFIWIP

SEQ ID NO: 23542 - protein, 10 aa, BK virus
APKVFIWIPH

SEQ ID NO: 23543 - protein, 10 aa, BK virus
PKVFIWIPHF

SEQ ID NO: 23544 - protein, 10 aa, BK virus
KVFIWIPHFW

SEQ ID NO: 23545 - protein, 10 aa, BK virus
VFIWIPHFWV

SEQ ID NO: 23546 - protein, 10 aa, BK virus
EAFYLCNSIY

SEQ ID NO: 23547 - protein, 10 aa, BK virus
AFYLCNSIYP

SEQ ID NO: 23548 - protein, 10 aa, BK virus
FYLCNSIYPS

SEQ ID NO: 23549 - protein, 10 aa, BK virus
YLCNSIYPSF

SEQ ID NO: 23550 - protein, 10 aa, BK virus
LCNSIYPSFN

SEQ ID NO: 23551 - protein, 10 aa, BK virus
CNSIYPSFNF

SEQ ID NO: 23552 - protein, 10 aa, BK virus
FWHLHGFLWL

SEQ ID NO: 23553 - protein, 10 aa, BK virus
WHLHGFLWLF

SEQ ID NO: 23554 - protein, 10 aa, BK virus
HLHGFLWLFG

SEQ ID NO: 23555 - protein, 10 aa, BK virus
LHGFLWLFGS

SEQ ID NO: 23556 - protein, 10 aa, BK virus
HGFLWLFGSC

SEQ ID NO: 23557 - protein, 10 aa, BK virus
GFLWLFGSCP

SEQ ID NO: 23558 - protein, 10 aa, BK virus
FLWLFGSCPW

SEQ ID NO: 23559 - protein, 10 aa, BK virus
LWLFGSCPWT

SEQ ID NO: 23560 - protein, 10 aa, BK virus
WLFGSCPWTL

SEQ ID NO: 23561 - protein, 10 aa, BK virus
LFGSCPWTLS

SEQ ID NO: 23562 - protein, 10 aa, BK virus
FGSCPWTLSF

SEQ ID NO: 23563 - protein, 10 aa, BK virus
GSCPWTLSFS

SEQ ID NO: 23564 - protein, 10 aa, BK virus
SCPWTLSFSF

SEQ ID NO: 23565 - protein, 10 aa, BK virus
CPWTLSFSFG

SEQ ID NO: 23566 - protein, 10 aa, BK virus
PWTLSFSFGW

SEQ ID NO: 23567 - protein, 10 aa, BK virus
WTLSFSFGWG

SEQ ID NO: 23568 - protein, 10 aa, BK virus
TLSFSFGWGH

SEQ ID NO: 23569 - protein, 10 aa, BK virus
LSFSFGWGHL

SEQ ID NO: 23570 - protein, 10 aa, BK virus
SFSFGWGHLH

SEQ ID NO: 23571 - protein, 10 aa, BK virus
FSFGWGHLHM

SEQ ID NO: 23572 - protein, 10 aa, BK virus
SFGWGHLHML

SEQ ID NO: 23573 - protein, 10 aa, BK virus
FGWGHLHMLQ

SEQ ID NO: 23574 - protein, 10 aa, BK virus
GWGHLHMLQE

SEQ ID NO: 23575 - protein, 10 aa, BK virus
WGHLHMLQEQ

SEQ ID NO: 23576 - protein, 10 aa, BK virus
GHLHMLQEQV

SEQ ID NO: 23577 - protein, 10 aa, BK virus
HLHMLQEQVL

SEQ ID NO: 23578 - protein, 10 aa, BK virus
LHMLQEQVLQ

SEQ ID NO: 23579 - protein, 10 aa, BK virus
HMLQEQVLQS

SEQ ID NO: 23580 - protein, 10 aa, BK virus
MLQEQVLQSR

SEQ ID NO: 23581 - protein, 10 aa, BK virus
LQEQVLQSRT

SEQ ID NO: 23582 - protein, 10 aa, BK virus
QEQVLQSRTG

SEQ ID NO: 23583 - protein, 10 aa, BK virus
EQVLQSRTGL

SEQ ID NO: 23584 - protein, 10 aa, BK virus
QVLQSRTGLE

SEQ ID NO: 23585 - protein, 10 aa, BK virus
VLQSRTGLEV

SEQ ID NO: 23586 - protein, 10 aa, BK virus
LQSRTGLEVK

SEQ ID NO: 23587 - protein, 10 aa, BK virus
QSRTGLEVKA

SEQ ID NO: 23588 - protein, 10 aa, BK virus
SRTGLEVKAT

SEQ ID NO: 23589 - protein, 10 aa, BK virus
RTGLEVKATS

SEQ ID NO: 23590 - protein, 10 aa, BK virus
TGLEVKATSI

SEQ ID NO: 23591 - protein, 10 aa, BK virus
GLEVKATSIE

SEQ ID NO: 23592 - protein, 10 aa, BK virus
LEVKATSIEE

SEQ ID NO: 23593 - protein, 10 aa, BK virus
EVKATSIEEQ

SEQ ID NO: 23594 - protein, 10 aa, BK virus
VKATSIEEQF

SEQ ID NO: 23595 - protein, 10 aa, BK virus
KATSIEEQFF

SEQ ID NO: 23596 - protein, 10 aa, BK virus
ATSIEEQFFD

SEQ ID NO: 23597 - protein, 10 aa, BK virus
TLLNVHFVDF

SEQ ID NO: 23598 - protein, 10 aa, BK virus
LLNVHFVDFL

SEQ ID NO: 23599 - protein, 10 aa, BK virus
LNVHFVDFLS

SEQ ID NO: 23600 - protein, 10 aa, BK virus
NVHFVDFLSP

SEQ ID NO: 23601 - protein, 10 aa, BK virus
VHFVDFLSPF

SEQ ID NO: 23602 - protein, 10 aa, BK virus
HFVDFLSPFF

SEQ ID NO: 23603 - protein, 10 aa, BK virus
FVDFLSPFFV

SEQ ID NO: 23604 - protein, 10 aa, BK virus
LLLYCQHHLY

SEQ ID NO: 23605 - protein, 10 aa, BK virus
LLYCQHHLYY

SEQ ID NO: 23606 - protein, 10 aa, BK virus
LYCQHHLYYK

SEQ ID NO: 23607 - protein, 10 aa, BK virus
YCQHHLYYKY

SEQ ID NO: 23608 - protein, 10 aa, BK virus
CQHHLYYKYG

SEQ ID NO: 23609 - protein, 10 aa, BK virus
QHHLYYKYGQ

SEQ ID NO: 23610 - protein, 10 aa, BK virus
HHLYYKYGQN

SEQ ID NO: 23611 - protein, 10 aa, BK virus
HLYYKYGQNV

SEQ ID NO: 23612 - protein, 10 aa, BK virus
LYYKYGQNVH

SEQ ID NO: 23613 - protein, 10 aa, BK virus
YYKYGQNVHG

SEQ ID NO: 23614 - protein, 10 aa, BK virus
YKYGQNVHGY

SEQ ID NO: 23615 - protein, 10 aa, BK virus
KYGQNVHGYL

SEQ ID NO: 23616 - protein, 10 aa, BK virus
YGQNVHGYLP

SEQ ID NO: 23617 - protein, 10 aa, BK virus
GQNVHGYLPF

SEQ ID NO: 23618 - protein, 10 aa, BK virus
QNVHGYLPFQ

SEQ ID NO: 23619 - protein, 10 aa, BK virus
NVHGYLPFQL

SEQ ID NO: 23620 - protein, 10 aa, BK virus
VHGYLPFQLL

SEQ ID NO: 23621 - protein, 10 aa, BK virus
HGYLPFQLLV

SEQ ID NO: 23622 - protein, 10 aa, BK virus
GKDQNNIVEY

SEQ ID NO: 23623 - protein, 10 aa, BK virus
KDQNNIVEYN

SEQ ID NO: 23624 - protein, 10 aa, BK virus
DQNNIVEYNY

SEQ ID NO: 23625 - protein, 10 aa, BK virus
QNNIVEYNYK

SEQ ID NO: 23626 - protein, 10 aa, BK virus
NNIVEYNYKS

SEQ ID NO: 23627 - protein, 10 aa, BK virus
NIVEYNYKSL

SEQ ID NO: 23628 - protein, 10 aa, BK virus
KIFLFFSAIP

SEQ ID NO: 23629 - protein, 10 aa, BK virus
IFLFFSAIPV

SEQ ID NO: 23630 - protein, 10 aa, BK virus
FLFFSAIPVR

SEQ ID NO: 23631 - protein, 10 aa, BK virus
LFFSAIPVRL

SEQ ID NO: 23632 - protein, 10 aa, BK virus
QKYLHQETEY

SEQ ID NO: 23633 - protein, 10 aa, BK virus
KYLHQETEYH

SEQ ID NO: 23634 - protein, 10 aa, BK virus
YLHQETEYHS

SEQ ID NO: 23635 - protein, 10 aa, BK virus
LHQETEYHST

SEQ ID NO: 23636 - protein, 10 aa, BK virus
HQETEYHSTH

SEQ ID NO: 23637 - protein, 10 aa, BK virus
QETEYHSTHL

SEQ ID NO: 23638 - protein, 10 aa, BK virus
ETEYHSTHLG

SEQ ID NO: 23639 - protein, 10 aa, BK virus
TIPKPCLIAD

SEQ ID NO: 23640 - protein, 10 aa, BK virus
IPKPCLIADR

SEQ ID NO: 23641 - protein, 10 aa, BK virus
PKPCLIADRG

SEQ ID NO: 23642 - protein, 10 aa, BK virus
KPCLIADRGL

SEQ ID NO: 23643 - protein, 10 aa, BK virus
PCLIADRGLQ

SEQ ID NO: 23644 - protein, 10 aa, BK virus
CLIADRGLQW

SEQ ID NO: 23645 - protein, 10 aa, BK virus
LIADRGLQWK

SEQ ID NO: 23646 - protein, 10 aa, BK virus
IADRGLQWKL

SEQ ID NO: 23647 - protein, 10 aa, BK virus
ADRGLQWKLC

SEQ ID NO: 23648 - protein, 10 aa, BK virus
DRGLQWKLCD

SEQ ID NO: 23649 - protein, 10 aa, BK virus
RGLQWKLCDP

SEQ ID NO: 23650 - protein, 10 aa, BK virus
GLQWKLCDPN

SEQ ID NO: 23651 - protein, 10 aa, BK virus
LQWKLCDPNH

SEQ ID NO: 23652 - protein, 10 aa, BK virus
QWKLCDPNHQ

SEQ ID NO: 23653 - protein, 10 aa, BK virus
WKLCDPNHQR

SEQ ID NO: 23654 - protein, 10 aa, BK virus
KLCDPNHQRT

SEQ ID NO: 23655 - protein, 10 aa, BK virus
LCDPNHQRTY

SEQ ID NO: 23656 - protein, 10 aa, BK virus
CDPNHQRTYT

SEQ ID NO: 23657 - protein, 10 aa, BK virus
DPNHQRTYTL

SEQ ID NO: 23658 - protein, 10 aa, BK virus
PNHQRTYTLL

SEQ ID NO: 23659 - protein, 10 aa, BK virus
NHQRTYTLLE

SEQ ID NO: 23660 - protein, 10 aa, BK virus
HQRTYTLLEL

SEQ ID NO: 23661 - protein, 10 aa, BK virus
QRTYTLLELR

SEQ ID NO: 23662 - protein, 10 aa, BK virus
RTYTLLELRN

SEQ ID NO: 23663 - protein, 10 aa, BK virus
QFELKQQTQQ

SEQ ID NO: 23664 - protein, 10 aa, BK virus
PQEHQQLQHM

SEQ ID NO: 23665 - protein, 10 aa, BK virus
QEHQQLQHMF

SEQ ID NO: 23666 - protein, 10 aa, BK virus
EHQQLQHMFE

SEQ ID NO: 23667 - protein, 10 aa, BK virus
HQQLQHMFEE

SEQ ID NO: 23668 - protein, 10 aa, BK virus
QQLQHMFEEL

SEQ ID NO: 23669 - protein, 10 aa, BK virus
QLQHMFEELG

SEQ ID NO: 23670 - protein, 10 aa, BK virus
LQHMFEELGL

SEQ ID NO: 23671 - protein, 10 aa, BK virus
PLRYLLCPLQ

SEQ ID NO: 23672 - protein, 10 aa, BK virus
QQQPPQQQFQ

SEQ ID NO: 23673 - protein, 10 aa, BK virus
QQPPQQQFQP

SEQ ID NO: 23674 - protein, 10 aa, BK virus
QPPQQQFQPL

SEQ ID NO: 23675 - protein, 10 aa, BK virus
PPQQQFQPLK

SEQ ID NO: 23676 - protein, 10 aa, BK virus
PQQQFQPLKI

SEQ ID NO: 23677 - protein, 10 aa, BK virus
QQQFQPLKIL

SEQ ID NO: 23678 - protein, 10 aa, BK virus
QQFQPLKILW

SEQ ID NO: 23679 - protein, 10 aa, BK virus
QFQPLKILWQ

SEQ ID NO: 23680 - protein, 10 aa, BK virus
FQPLKILWQQ

SEQ ID NO: 23681 - protein, 10 aa, BK virus
QPLKILWQQQ

SEQ ID NO: 23682 - protein, 10 aa, BK virus
PLKILWQQQP

SEQ ID NO: 23683 - protein, 10 aa, BK virus
LKILWQQQPQ

SEQ ID NO: 23684 - protein, 10 aa, BK virus
KILWQQQPQI

SEQ ID NO: 23685 - protein, 10 aa, BK virus
ILWQQQPQIH

SEQ ID NO: 23686 - protein, 10 aa, BK virus
LWQQQPQIHW

SEQ ID NO: 23687 - protein, 10 aa, BK virus
WQQQPQIHWQ

SEQ ID NO: 23688 - protein, 10 aa, BK virus
QQQPQIHWQL

SEQ ID NO: 23689 - protein, 10 aa, BK virus
QQPQIHWQLG

SEQ ID NO: 23690 - protein, 10 aa, BK virus
QPQIHWQLGP

SEQ ID NO: 23691 - protein, 10 aa, BK virus
PQIHWQLGPP

SEQ ID NO: 23692 - protein, 10 aa, BK virus
QIHWQLGPPK

SEQ ID NO: 23693 - protein, 10 aa, BK virus
IHWQLGPPKV

SEQ ID NO: 23694 - protein, 10 aa, BK virus
HWQLGPPKVL

SEQ ID NO: 23695 - protein, 10 aa, BK virus
WQLGPPKVLE

SEQ ID NO: 23696 - protein, 10 aa, BK virus
QLGPPKVLEQ

SEQ ID NO: 23697 - protein, 10 aa, BK virus
LGPPKVLEQH

SEQ ID NO: 23698 - protein, 10 aa, BK virus
GPPKVLEQHP

SEQ ID NO: 23699 - protein, 10 aa, BK virus
TWKYKKKGIT

SEQ ID NO: 23700 - protein, 10 aa, BK virus
WKYKKKGITY

SEQ ID NO: 23701 - protein, 10 aa, BK virus
KYKKKGITYL

SEQ ID NO: 23702 - protein, 10 aa, BK virus
YKKKGITYLG

SEQ ID NO: 23703 - protein, 10 aa, BK virus
KKKGITYLGV

SEQ ID NO: 23704 - protein, 10 aa, BK virus
KKGITYLGVF

SEQ ID NO: 23705 - protein, 10 aa, BK virus
KGITYLGVFY

SEQ ID NO: 23706 - protein, 10 aa, BK virus
GITYLGVFYR

SEQ ID NO: 23707 - protein, 10 aa, BK virus
ITYLGVFYRV

SEQ ID NO: 23708 - protein, 10 aa, BK virus
TYLGVFYRVF

SEQ ID NO: 23709 - protein, 10 aa, BK virus
YLGVFYRVFY

SEQ ID NO: 23710 - protein, 10 aa, BK virus
LGVFYRVFYS

SEQ ID NO: 23711 - protein, 10 aa, BK virus
GVFYRVFYSR

SEQ ID NO: 23712 - protein, 10 aa, BK virus
SSGTFVFPVY

SEQ ID NO: 23713 - protein, 10 aa, BK virus
SGTFVFPVYT

SEQ ID NO: 23714 - protein, 10 aa, BK virus
GTFVFPVYTV

SEQ ID NO: 23715 - protein, 10 aa, BK virus
TFVFPVYTVF

SEQ ID NO: 23716 - protein, 10 aa, BK virus
FVFPVYTVFT

SEQ ID NO: 23717 - protein, 10 aa, BK virus
VFPVYTVFTS

SEQ ID NO: 23718 - protein, 10 aa, BK virus
FPVYTVFTST

SEQ ID NO: 23719 - protein, 10 aa, BK virus
PVYTVFTSTK

SEQ ID NO: 23720 - protein, 10 aa, BK virus
VYTVFTSTKF

SEQ ID NO: 23721 - protein, 10 aa, BK virus
YTVFTSTKFQ

SEQ ID NO: 23722 - protein, 10 aa, BK virus
TVFTSTKFQQ

SEQ ID NO: 23723 - protein, 10 aa, BK virus
VFTSTKFQQK

SEQ ID NO: 23724 - protein, 10 aa, BK virus
FTSTKFQQKL

SEQ ID NO: 23725 - protein, 10 aa, BK virus
NKNKNPLSSF

SEQ ID NO: 23726 - protein, 10 aa, BK virus
KNKNPLSSFF

SEQ ID NO: 23727 - protein, 10 aa, BK virus
NKNPLSSFFC

SEQ ID NO: 23728 - protein, 10 aa, BK virus
KNPLSSFFCS

SEQ ID NO: 23729 - protein, 10 aa, BK virus
NPLSSFFCSS

SEQ ID NO: 23730 - protein, 10 aa, BK virus
PLSSFFCSSP

SEQ ID NO: 23731 - protein, 10 aa, BK virus
LSSFFCSSPG

SEQ ID NO: 23732 - protein, 10 aa, BK virus
SSFFCSSPGF

SEQ ID NO: 23733 - protein, 10 aa, BK virus
SFFCSSPGFT

SEQ ID NO: 23734 - protein, 10 aa, BK virus
FFCSSPGFTN

SEQ ID NO: 23735 - protein, 10 aa, BK virus
FCSSPGFTNF

SEQ ID NO: 23736 - protein, 10 aa, BK virus
CSSPGFTNFH

SEQ ID NO: 23737 - protein, 10 aa, BK virus
QLAQNHGLCP

SEQ ID NO: 23738 - protein, 10 aa, BK virus
LAQNHGLCPV

SEQ ID NO: 23739 - protein, 10 aa, BK virus
LGTRPRFLGS

SEQ ID NO: 23740 - protein, 10 aa, BK virus
GTRPRFLGSQ

SEQ ID NO: 23741 - protein, 10 aa, BK virus
TRPRFLGSQN

SEQ ID NO: 23742 - protein, 10 aa, BK virus
RPRFLGSQNM

SEQ ID NO: 23743 - protein, 10 aa, BK virus
PRFLGSQNMS

SEQ ID NO: 23744 - protein, 10 aa, BK virus
RFLGSQNMSV

SEQ ID NO: 23745 - protein, 10 aa, BK virus
FLGSQNMSVM

SEQ ID NO: 23746 - protein, 10 aa, BK virus
LGSQNMSVMH

SEQ ID NO: 23747 - protein, 10 aa, BK virus
GSQNMSVMHF

SEQ ID NO: 23748 - protein, 10 aa, BK virus
SQNMSVMHFP

SEQ ID NO: 23749 - protein, 10 aa, BK virus
QNMSVMHFPS

SEQ ID NO: 23750 - protein, 10 aa, BK virus
AAPPCESCTF

SEQ ID NO: 23751 - protein, 10 aa, BK virus
APPCESCTFL

SEQ ID NO: 23752 - protein, 10 aa, BK virus
PPCESCTFLP

SEQ ID NO: 23753 - protein, 10 aa, BK virus
PCESCTFLPE

SEQ ID NO: 23754 - protein, 10 aa, BK virus
CESCTFLPEV

SEQ ID NO: 23755 - protein, 10 aa, BK virus
ESCTFLPEVM

SEQ ID NO: 23756 - protein, 10 aa, BK virus
SCTFLPEVMV

SEQ ID NO: 23757 - protein, 10 aa, BK virus
CTFLPEVMVW

SEQ ID NO: 23758 - protein, 10 aa, BK virus
TFLPEVMVWL

SEQ ID NO: 23759 - protein, 10 aa, BK virus
FLPEVMVWLH

SEQ ID NO: 23760 - protein, 10 aa, BK virus
LPEVMVWLHS

SEQ ID NO: 23761 - protein, 10 aa, BK virus
PEVMVWLHSP

SEQ ID NO: 23762 - protein, 10 aa, BK virus
EVMVWLHSPV

SEQ ID NO: 23763 - protein, 10 aa, BK virus
VMVWLHSPVS

SEQ ID NO: 23764 - protein, 10 aa, BK virus
MVWLHSPVSH

SEQ ID NO: 23765 - protein, 10 aa, BK virus
VWLHSPVSHA

SEQ ID NO: 23766 - protein, 10 aa, BK virus
WLHSPVSHAL

SEQ ID NO: 23767 - protein, 10 aa, BK virus
LHSPVSHALS

SEQ ID NO: 23768 - protein, 10 aa, BK virus
HSPVSHALSF

SEQ ID NO: 23769 - protein, 10 aa, BK virus
SPVSHALSFL

SEQ ID NO: 23770 - protein, 10 aa, BK virus
PVSHALSFLR

SEQ ID NO: 23771 - protein, 10 aa, BK virus
VSHALSFLRS

SEQ ID NO: 23772 - protein, 10 aa, BK virus
SHALSFLRSW

SEQ ID NO: 23773 - protein, 10 aa, BK virus
HALSFLRSWF

SEQ ID NO: 23774 - protein, 10 aa, BK virus
ALSFLRSWFG

SEQ ID NO: 23775 - protein, 10 aa, BK virus
LSFLRSWFGC

SEQ ID NO: 23776 - protein, 10 aa, BK virus
SFLRSWFGCI

SEQ ID NO: 23777 - protein, 10 aa, BK virus
FLRSWFGCIP

SEQ ID NO: 23778 - protein, 10 aa, BK virus
LRSWFGCIPW

SEQ ID NO: 23779 - protein, 10 aa, BK virus
RSWFGCIPWV

SEQ ID NO: 23780 - protein, 10 aa, BK virus
SWFGCIPWVS

SEQ ID NO: 23781 - protein, 10 aa, BK virus
WFGCIPWVSS

SEQ ID NO: 23782 - protein, 10 aa, BK virus
FGCIPWVSSS

SEQ ID NO: 23783 - protein, 10 aa, BK virus
GCIPWVSSSS

SEQ ID NO: 23784 - protein, 10 aa, BK virus
CIPWVSSSSL

SEQ ID NO: 23785 - protein, 10 aa, BK virus
IPWVSSSSLW

SEQ ID NO: 23786 - protein, 10 aa, BK virus
PWVSSSSLWP

SEQ ID NO: 23787 - protein, 10 aa, BK virus
WVSSSSLWPF

SEQ ID NO: 23788 - protein, 10 aa, BK virus
VSSSSLWPFF

SEQ ID NO: 23789 - protein, 10 aa, BK virus
SSSSLWPFFL

SEQ ID NO: 23790 - protein, 10 aa, BK virus
YIRGRGRLCL

SEQ ID NO: 23791 - protein, 10 aa, BK virus
IRGRGRLCLH

SEQ ID NO: 23792 - protein, 10 aa, BK virus
RGRGRLCLHP

SEQ ID NO: 23793 - protein, 10 aa, BK virus
GRGRLCLHPF

SEQ ID NO: 23794 - protein, 10 aa, BK virus
RGRLCLHPFS

SEQ ID NO: 23795 - protein, 10 aa, BK virus
GRLCLHPFSQ

SEQ ID NO: 23796 - protein, 10 aa, BK virus
RLCLHPFSQV

SEQ ID NO: 23797 - protein, 10 aa, BK virus
LCLHPFSQVV

SEQ ID NO: 23798 - protein, 10 aa, BK virus
CLHPFSQVVR

SEQ ID NO: 23799 - protein, 10 aa, BK virus
LHPFSQVVRV

SEQ ID NO: 23800 - protein, 10 aa, BK virus
HPFSQVVRVW

SEQ ID NO: 23801 - protein, 10 aa, BK virus
PFSQVVRVWR

SEQ ID NO: 23802 - protein, 10 aa, BK virus
FSQVVRVWRL

SEQ ID NO: 23803 - protein, 10 aa, BK virus
SQVVRVWRLF

SEQ ID NO: 23804 - protein, 10 aa, BK virus
QVVRVWRLFL

SEQ ID NO: 23805 - protein, 10 aa, BK virus
VVRVWRLFLR

SEQ ID NO: 23806 - protein, 10 aa, BK virus
VRVWRLFLRP

SEQ ID NO: 23807 - protein, 10 aa, BK virus
RVWRLFLRPS

SEQ ID NO: 23808 - protein, 10 aa, BK virus
VWRLFLRPSK

SEQ ID NO: 23809 - protein, 10 aa, BK virus
WRLFLRPSKT

SEQ ID NO: 23810 - protein, 10 aa, BK virus
RLFLRPSKTI

SEQ ID NO: 23811 - protein, 10 aa, BK virus
LFLRPSKTIW

SEQ ID NO: 23812 - protein, 10 aa, BK virus
FLRPSKTIWG

SEQ ID NO: 23813 - protein, 10 aa, BK virus
LRPSKTIWGN

SEQ ID NO: 23814 - protein, 10 aa, BK virus
RPSKTIWGNP

SEQ ID NO: 23815 - protein, 10 aa, BK virus
PSKTIWGNPY

SEQ ID NO: 23816 - protein, 10 aa, BK virus
SKTIWGNPYS

SEQ ID NO: 23817 - protein, 10 aa, BK virus
KTIWGNPYSF

SEQ ID NO: 23818 - protein, 10 aa, BK virus
TIWGNPYSFA

SEQ ID NO: 23819 - protein, 10 aa, BK virus
IWGNPYSFAI

SEQ ID NO: 23820 - protein, 10 aa, BK virus
WGNPYSFAIF

SEQ ID NO: 23821 - protein, 10 aa, BK virus
GNPYSFAIFA

SEQ ID NO: 23822 - protein, 10 aa, BK virus
NPYSFAIFAK

SEQ ID NO: 23823 - protein, 11 aa, BK virus
QGRIHGAHGPF

SEQ ID NO: 23824 - protein, 11 aa, BK virus
GRIHGAHGPFR

SEQ ID NO: 23825 - protein, 11 aa, BK virus
RIHGAHGPFRP

SEQ ID NO: 23826 - protein, 11 aa, BK virus
KSCLGKSSLNE

SEQ ID NO: 23827 - protein, 11 aa, BK virus
SCLGKSSLNEK

SEQ ID NO: 23828 - protein, 11 aa, BK virus
CLGKSSLNEKS

SEQ ID NO: 23829 - protein, 11 aa, BK virus
LGKSSLNEKSL

SEQ ID NO: 23830 - protein, 11 aa, BK virus
GKSSLNEKSLF

SEQ ID NO: 23831 - protein, 11 aa, BK virus
KSSLNEKSLFK

SEQ ID NO: 23832 - protein, 11 aa, BK virus
SSLNEKSLFKE

SEQ ID NO: 23833 - protein, 11 aa, BK virus
SLNEKSLFKEV

SEQ ID NO: 23834 - protein, 11 aa, BK virus
KNGAGCKGSSS

SEQ ID NO: 23835 - protein, 11 aa, BK virus
NGAGCKGSSSA

SEQ ID NO: 23836 - protein, 11 aa, BK virus
FSSLPRYPVLQ

SEQ ID NO: 23837 - protein, 11 aa, BK virus
SSLPRYPVLQG

SEQ ID NO: 23838 - protein, 11 aa, BK virus
SLPRYPVLQGM

SEQ ID NO: 23839 - protein, 11 aa, BK virus
LPRYPVLQGMA

SEQ ID NO: 23840 - protein, 11 aa, BK virus
PRYPVLQGMAY

SEQ ID NO: 23841 - protein, 11 aa, BK virus
RYPVLQGMAYL

SEQ ID NO: 23842 - protein, 11 aa, BK virus
YPVLQGMAYLF

SEQ ID NO: 23843 - protein, 11 aa, BK virus
PVLQGMAYLFQ

SEQ ID NO: 23844 - protein, 11 aa, BK virus
VLQGMAYLFQK

SEQ ID NO: 23845 - protein, 11 aa, BK virus
LQGMAYLFQKA

SEQ ID NO: 23846 - protein, 11 aa, BK virus
QGMAYLFQKAF

SEQ ID NO: 23847 - protein, 11 aa, BK virus
GMAYLFQKAFC

SEQ ID NO: 23848 - protein, 11 aa, BK virus
MAYLFQKAFCA

SEQ ID NO: 23849 - protein, 11 aa, BK virus
AYLFQKAFCAL

SEQ ID NO: 23850 - protein, 11 aa, BK virus
YLFQKAFCALP

SEQ ID NO: 23851 - protein, 11 aa, BK virus
LFQKAFCALPL

SEQ ID NO: 23852 - protein, 11 aa, BK virus
FQKAFCALPLH

SEQ ID NO: 23853 - protein, 11 aa, BK virus
QKAFCALPLHA

SEQ ID NO: 23854 - protein, 11 aa, BK virus
KAFCALPLHAM

SEQ ID NO: 23855 - protein, 11 aa, BK virus
AFCALPLHAMS

SEQ ID NO: 23856 - protein, 11 aa, BK virus
FCALPLHAMSA

SEQ ID NO: 23857 - protein, 11 aa, BK virus
KIFKKRALGLD

SEQ ID NO: 23858 - protein, 11 aa, BK virus
IFKKRALGLDR

SEQ ID NO: 23859 - protein, 11 aa, BK virus
FKKRALGLDRL

SEQ ID NO: 23860 - protein, 11 aa, BK virus
KKRALGLDRLL

SEQ ID NO: 23861 - protein, 11 aa, BK virus
KRALGLDRLLL

SEQ ID NO: 23862 - protein, 11 aa, BK virus
RALGLDRLLLH

SEQ ID NO: 23863 - protein, 11 aa, BK virus
LLHTVVWLRPN

SEQ ID NO: 23864 - protein, 11 aa, BK virus
RNSAMVGPNNW

SEQ ID NO: 23865 - protein, 11 aa, BK virus
NSAMVGPNNWR

SEQ ID NO: 23866 - protein, 11 aa, BK virus
SAMVGPNNWRN

SEQ ID NO: 23867 - protein, 11 aa, BK virus
AMVGPNNWRNS

SEQ ID NO: 23868 - protein, 11 aa, BK virus
MVGPNNWRNSL

SEQ ID NO: 23869 - protein, 11 aa, BK virus
VGPNNWRNSLQ

SEQ ID NO: 23870 - protein, 11 aa, BK virus
GPNNWRNSLQR

SEQ ID NO: 23871 - protein, 11 aa, BK virus
PNNWRNSLQRS

SEQ ID NO: 23872 - protein, 11 aa, BK virus
NNWRNSLQRSK

SEQ ID NO: 23873 - protein, 11 aa, BK virus
NWRNSLQRSKA

SEQ ID NO: 23874 - protein, 11 aa, BK virus
WRNSLQRSKAL

SEQ ID NO: 23875 - protein, 11 aa, BK virus
RNSLQRSKALR

SEQ ID NO: 23876 - protein, 11 aa, BK virus
VPTYGTEEWES

SEQ ID NO: 23877 - protein, 11 aa, BK virus
PTYGTEEWESW

SEQ ID NO: 23878 - protein, 11 aa, BK virus
TYGTEEWESWW

SEQ ID NO: 23879 - protein, 11 aa, BK virus
YGTEEWESWWS

SEQ ID NO: 23880 - protein, 11 aa, BK virus
GTEEWESWWSS

SEQ ID NO: 23881 - protein, 11 aa, BK virus
TEEWESWWSSF

SEQ ID NO: 23882 - protein, 11 aa, BK virus
EEWESWWSSFN

SEQ ID NO: 23883 - protein, 11 aa, BK virus
EWESWWSSFNE

SEQ ID NO: 23884 - protein, 11 aa, BK virus
WESWWSSFNEK

SEQ ID NO: 23885 - protein, 11 aa, BK virus
ESWWSSFNEKW

SEQ ID NO: 23886 - protein, 11 aa, BK virus
SWWSSFNEKWD

SEQ ID NO: 23887 - protein, 11 aa, BK virus
WWSSFNEKWDE

SEQ ID NO: 23888 - protein, 11 aa, BK virus
WSSFNEKWDED

SEQ ID NO: 23889 - protein, 11 aa, BK virus
SSFNEKWDEDL

SEQ ID NO: 23890 - protein, 11 aa, BK virus
SFNEKWDEDLF

SEQ ID NO: 23891 - protein, 11 aa, BK virus
FNEKWDEDLFC

SEQ ID NO: 23892 - protein, 11 aa, BK virus
NEKWDEDLFCH

SEQ ID NO: 23893 - protein, 11 aa, BK virus
EKWDEDLFCHE

SEQ ID NO: 23894 - protein, 11 aa, BK virus
KWDEDLFCHED

SEQ ID NO: 23895 - protein, 11 aa, BK virus
WDEDLFCHEDM

SEQ ID NO: 23896 - protein, 11 aa, BK virus
DEDLFCHEDMF

SEQ ID NO: 23897 - protein, 11 aa, BK virus
EDLFCHEDMFA

SEQ ID NO: 23898 - protein, 11 aa, BK virus
DLFCHEDMFAS

SEQ ID NO: 23899 - protein, 11 aa, BK virus
LFCHEDMFASD

SEQ ID NO: 23900 - protein, 11 aa, BK virus
FCHEDMFASDE

SEQ ID NO: 23901 - protein, 11 aa, BK virus
CHEDMFASDEE

SEQ ID NO: 23902 - protein, 11 aa, BK virus
HEDMFASDEEA

SEQ ID NO: 23903 - protein, 11 aa, BK virus
EDMFASDEEAT

SEQ ID NO: 23904 - protein, 11 aa, BK virus
DMFASDEEATA

SEQ ID NO: 23905 - protein, 11 aa, BK virus
MFASDEEATAD

SEQ ID NO: 23906 - protein, 11 aa, BK virus
FASDEEATADS

SEQ ID NO: 23907 - protein, 11 aa, BK virus
ASDEEATADSQ

SEQ ID NO: 23908 - protein, 11 aa, BK virus
SDEEATADSQH

SEQ ID NO: 23909 - protein, 11 aa, BK virus
DEEATADSQHS

SEQ ID NO: 23910 - protein, 11 aa, BK virus
EEATADSQHST

SEQ ID NO: 23911 - protein, 11 aa, BK virus
EATADSQHSTP

SEQ ID NO: 23912 - protein, 11 aa, BK virus
ATADSQHSTPP

SEQ ID NO: 23913 - protein, 11 aa, BK virus
TADSQHSTPPK

SEQ ID NO: 23914 - protein, 11 aa, BK virus
ADSQHSTPPKK

SEQ ID NO: 23915 - protein, 11 aa, BK virus
DSQHSTPPKKK

SEQ ID NO: 23916 - protein, 11 aa, BK virus
SQHSTPPKKKR

SEQ ID NO: 23917 - protein, 11 aa, BK virus
QHSTPPKKKRK

SEQ ID NO: 23918 - protein, 11 aa, BK virus
HSTPPKKKRKV

SEQ ID NO: 23919 - protein, 11 aa, BK virus
STPPKKKRKVE

SEQ ID NO: 23920 - protein, 11 aa, BK virus
TPPKKKRKVED

SEQ ID NO: 23921 - protein, 11 aa, BK virus
PPKKKRKVEDP

SEQ ID NO: 23922 - protein, 11 aa, BK virus
PKKKRKVEDPK

SEQ ID NO: 23923 - protein, 11 aa, BK virus
KKKRKVEDPKD

SEQ ID NO: 23924 - protein, 11 aa, BK virus
KKRKVEDPKDF

SEQ ID NO: 23925 - protein, 11 aa, BK virus
KRKVEDPKDFP

SEQ ID NO: 23926 - protein, 11 aa, BK virus
RKVEDPKDFPS

SEQ ID NO: 23927 - protein, 11 aa, BK virus
KVEDPKDFPSD

SEQ ID NO: 23928 - protein, 11 aa, BK virus
VEDPKDFPSDL

SEQ ID NO: 23929 - protein, 11 aa, BK virus
EDPKDFPSDLH

SEQ ID NO: 23930 - protein, 11 aa, BK virus
DPKDFPSDLHQ

SEQ ID NO: 23931 - protein, 11 aa, BK virus
PKDFPSDLHQF

SEQ ID NO: 23932 - protein, 11 aa, BK virus
KDFPSDLHQFL

SEQ ID NO: 23933 - protein, 11 aa, BK virus
DFPSDLHQFLS

SEQ ID NO: 23934 - protein, 11 aa, BK virus
FPSDLHQFLSQ

SEQ ID NO: 23935 - protein, 11 aa, BK virus
PSDLHQFLSQA

SEQ ID NO: 23936 - protein, 11 aa, BK virus
SDLHQFLSQAV

SEQ ID NO: 23937 - protein, 11 aa, BK virus
DLHQFLSQAVF

SEQ ID NO: 23938 - protein, 11 aa, BK virus
LHQFLSQAVFS

SEQ ID NO: 23939 - protein, 11 aa, BK virus
HQFLSQAVFSN

SEQ ID NO: 23940 - protein, 11 aa, BK virus
QFLSQAVFSNR

SEQ ID NO: 23941 - protein, 11 aa, BK virus
FLSQAVFSNRT

SEQ ID NO: 23942 - protein, 11 aa, BK virus
LSQAVFSNRTL

SEQ ID NO: 23943 - protein, 11 aa, BK virus
SQAVFSNRTLA

SEQ ID NO: 23944 - protein, 11 aa, BK virus
QAVFSNRTLAC

SEQ ID NO: 23945 - protein, 11 aa, BK virus
AVFSNRTLACF

SEQ ID NO: 23946 - protein, 11 aa, BK virus
VFSNRTLACFA

SEQ ID NO: 23947 - protein, 11 aa, BK virus
FSNRTLACFAV

SEQ ID NO: 23948 - protein, 11 aa, BK virus
SNRTLACFAVY

SEQ ID NO: 23949 - protein, 11 aa, BK virus
NRTLACFAVYT

SEQ ID NO: 23950 - protein, 11 aa, BK virus
RTLACFAVYTT

SEQ ID NO: 23951 - protein, 11 aa, BK virus
TLACFAVYTTK

SEQ ID NO: 23952 - protein, 11 aa, BK virus
LACFAVYTTKE

SEQ ID NO: 23953 - protein, 11 aa, BK virus
ACFAVYTTKEK

SEQ ID NO: 23954 - protein, 11 aa, BK virus
CFAVYTTKEKA

SEQ ID NO: 23955 - protein, 11 aa, BK virus
FAVYTTKEKAQ

SEQ ID NO: 23956 - protein, 11 aa, BK virus
AVYTTKEKAQI

SEQ ID NO: 23957 - protein, 11 aa, BK virus
VYTTKEKAQIL

SEQ ID NO: 23958 - protein, 11 aa, BK virus
YTTKEKAQILY

SEQ ID NO: 23959 - protein, 11 aa, BK virus
TTKEKAQILYK

SEQ ID NO: 23960 - protein, 11 aa, BK virus
TKEKAQILYKK

SEQ ID NO: 23961 - protein, 11 aa, BK virus
KEKAQILYKKL

SEQ ID NO: 23962 - protein, 11 aa, BK virus
EKAQILYKKLM

SEQ ID NO: 23963 - protein, 11 aa, BK virus
KAQILYKKLME

SEQ ID NO: 23964 - protein, 11 aa, BK virus
AQILYKKLMEK

SEQ ID NO: 23965 - protein, 11 aa, BK virus
QILYKKLMEKY

SEQ ID NO: 23966 - protein, 11 aa, BK virus
ILYKKLMEKYS

SEQ ID NO: 23967 - protein, 11 aa, BK virus
LYKKLMEKYSV

SEQ ID NO: 23968 - protein, 11 aa, BK virus
YKKLMEKYSVT

SEQ ID NO: 23969 - protein, 11 aa, BK virus
KKLMEKYSVTF

SEQ ID NO: 23970 - protein, 11 aa, BK virus
KLMEKYSVTFI

SEQ ID NO: 23971 - protein, 11 aa, BK virus
LMEKYSVTFIS

SEQ ID NO: 23972 - protein, 11 aa, BK virus
MEKYSVTFISR

SEQ ID NO: 23973 - protein, 11 aa, BK virus
EKYSVTFISRH

SEQ ID NO: 23974 - protein, 11 aa, BK virus
KYSVTFISRHM

SEQ ID NO: 23975 - protein, 11 aa, BK virus
YSVTFISRHMC

SEQ ID NO: 23976 - protein, 11 aa, BK virus
SVTFISRHMCA

SEQ ID NO: 23977 - protein, 11 aa, BK virus
VTFISRHMCAG

SEQ ID NO: 23978 - protein, 11 aa, BK virus
TFISRHMCAGH

SEQ ID NO: 23979 - protein, 11 aa, BK virus
FISRHMCAGHN

SEQ ID NO: 23980 - protein, 11 aa, BK virus
ISRHMCAGHNI

SEQ ID NO: 23981 - protein, 11 aa, BK virus
SRHMCAGHNII

SEQ ID NO: 23982 - protein, 11 aa, BK virus
RHMCAGHNIIF

SEQ ID NO: 23983 - protein, 11 aa, BK virus
HMCAGHNIIFF

SEQ ID NO: 23984 - protein, 11 aa, BK virus
MCAGHNIIFFL

SEQ ID NO: 23985 - protein, 11 aa, BK virus
CAGHNIIFFLT

SEQ ID NO: 23986 - protein, 11 aa, BK virus
AGHNIIFFLTP

SEQ ID NO: 23987 - protein, 11 aa, BK virus
GHNIIFFLTPH

SEQ ID NO: 23988 - protein, 11 aa, BK virus
HNIIFFLTPHR

SEQ ID NO: 23989 - protein, 11 aa, BK virus
NIIFFLTPHRH

SEQ ID NO: 23990 - protein, 11 aa, BK virus
IIFFLTPHRHR

SEQ ID NO: 23991 - protein, 11 aa, BK virus
IFFLTPHRHRV

SEQ ID NO: 23992 - protein, 11 aa, BK virus
FFLTPHRHRVS

SEQ ID NO: 23993 - protein, 11 aa, BK virus
FLTPHRHRVSA

SEQ ID NO: 23994 - protein, 11 aa, BK virus
LTPHRHRVSAI

SEQ ID NO: 23995 - protein, 11 aa, BK virus
TPHRHRVSAIN

SEQ ID NO: 23996 - protein, 11 aa, BK virus
PHRHRVSAINN

SEQ ID NO: 23997 - protein, 11 aa, BK virus
HRHRVSAINNF

SEQ ID NO: 23998 - protein, 11 aa, BK virus
RHRVSAINNFC

SEQ ID NO: 23999 - protein, 11 aa, BK virus
HRVSAINNFCQ

SEQ ID NO: 24000 - protein, 11 aa, BK virus
RVSAINNFCQK

SEQ ID NO: 24001 - protein, 11 aa, BK virus
VSAINNFCQKL

SEQ ID NO: 24002 - protein, 11 aa, BK virus
SAINNFCQKLC

SEQ ID NO: 24003 - protein, 11 aa, BK virus
AINNFCQKLCT

SEQ ID NO: 24004 - protein, 11 aa, BK virus
INNFCQKLCTF

SEQ ID NO: 24005 - protein, 11 aa, BK virus
NNFCQKLCTFS

SEQ ID NO: 24006 - protein, 11 aa, BK virus
NFCQKLCTFSF

SEQ ID NO: 24007 - protein, 11 aa, BK virus
FCQKLCTFSFL

SEQ ID NO: 24008 - protein, 11 aa, BK virus
CQKLCTFSFLI

SEQ ID NO: 24009 - protein, 11 aa, BK virus
QKLCTFSFLIC

SEQ ID NO: 24010 - protein, 11 aa, BK virus
KLCTFSFLICK

SEQ ID NO: 24011 - protein, 11 aa, BK virus
LCTFSFLICKG

SEQ ID NO: 24012 - protein, 11 aa, BK virus
CTFSFLICKGV

SEQ ID NO: 24013 - protein, 11 aa, BK virus
TFSFLICKGVN

SEQ ID NO: 24014 - protein, 11 aa, BK virus
FSFLICKGVNK

SEQ ID NO: 24015 - protein, 11 aa, BK virus
SFLICKGVNKE

SEQ ID NO: 24016 - protein, 11 aa, BK virus
FLICKGVNKEY

SEQ ID NO: 24017 - protein, 11 aa, BK virus
LICKGVNKEYL

SEQ ID NO: 24018 - protein, 11 aa, BK virus
ICKGVNKEYLL

SEQ ID NO: 24019 - protein, 11 aa, BK virus
CKGVNKEYLLY

SEQ ID NO: 24020 - protein, 11 aa, BK virus
KGVNKEYLLYS

SEQ ID NO: 24021 - protein, 11 aa, BK virus
GVNKEYLLYSA

SEQ ID NO: 24022 - protein, 11 aa, BK virus
VNKEYLLYSAL

SEQ ID NO: 24023 - protein, 11 aa, BK virus
NKEYLLYSALT

SEQ ID NO: 24024 - protein, 11 aa, BK virus
KEYLLYSALTR

SEQ ID NO: 24025 - protein, 11 aa, BK virus
EYLLYSALTRD

SEQ ID NO: 24026 - protein, 11 aa, BK virus
YLLYSALTRDP

SEQ ID NO: 24027 - protein, 11 aa, BK virus
LLYSALTRDPY

SEQ ID NO: 24028 - protein, 11 aa, BK virus
LYSALTRDPYH

SEQ ID NO: 24029 - protein, 11 aa, BK virus
YSALTRDPYHT

SEQ ID NO: 24030 - protein, 11 aa, BK virus
SALTRDPYHTI

SEQ ID NO: 24031 - protein, 11 aa, BK virus
ALTRDPYHTIE

SEQ ID NO: 24032 - protein, 11 aa, BK virus
LTRDPYHTIEE

SEQ ID NO: 24033 - protein, 11 aa, BK virus
TRDPYHTIEES

SEQ ID NO: 24034 - protein, 11 aa, BK virus
RDPYHTIEESI

SEQ ID NO: 24035 - protein, 11 aa, BK virus
DPYHTIEESIQ

SEQ ID NO: 24036 - protein, 11 aa, BK virus
PYHTIEESIQG

SEQ ID NO: 24037 - protein, 11 aa, BK virus
YHTIEESIQGG

SEQ ID NO: 24038 - protein, 11 aa, BK virus
HTIEESIQGGL

SEQ ID NO: 24039 - protein, 11 aa, BK virus
TIEESIQGGLK

SEQ ID NO: 24040 - protein, 11 aa, BK virus
IEESIQGGLKE

SEQ ID NO: 24041 - protein, 11 aa, BK virus
EESIQGGLKEH

SEQ ID NO: 24042 - protein, 11 aa, BK virus
ESIQGGLKEHD

SEQ ID NO: 24043 - protein, 11 aa, BK virus
SIQGGLKEHDF

SEQ ID NO: 24044 - protein, 11 aa, BK virus
IQGGLKEHDFS

SEQ ID NO: 24045 - protein, 11 aa, BK virus
QGGLKEHDFSP

SEQ ID NO: 24046 - protein, 11 aa, BK virus
GGLKEHDFSPE

SEQ ID NO: 24047 - protein, 11 aa, BK virus
GLKEHDFSPEE

SEQ ID NO: 24048 - protein, 11 aa, BK virus
LKEHDFSPEEP

SEQ ID NO: 24049 - protein, 11 aa, BK virus
KEHDFSPEEPE

SEQ ID NO: 24050 - protein, 11 aa, BK virus
EHDFSPEEPEE

SEQ ID NO: 24051 - protein, 11 aa, BK virus
HDFSPEEPEET

SEQ ID NO: 24052 - protein, 11 aa, BK virus
DFSPEEPEETK

SEQ ID NO: 24053 - protein, 11 aa, BK virus
FSPEEPEETKQ

SEQ ID NO: 24054 - protein, 11 aa, BK virus
SPEEPEETKQV

SEQ ID NO: 24055 - protein, 11 aa, BK virus
PEEPEETKQVS

SEQ ID NO: 24056 - protein, 11 aa, BK virus
EEPEETKQVSW

SEQ ID NO: 24057 - protein, 11 aa, BK virus
EPEETKQVSWK

SEQ ID NO: 24058 - protein, 11 aa, BK virus
PEETKQVSWKL

SEQ ID NO: 24059 - protein, 11 aa, BK virus
EETKQVSWKLI

SEQ ID NO: 24060 - protein, 11 aa, BK virus
ETKQVSWKLIT

SEQ ID NO: 24061 - protein, 11 aa, BK virus
TKQVSWKLITE

SEQ ID NO: 24062 - protein, 11 aa, BK virus
KQVSWKLITEY

SEQ ID NO: 24063 - protein, 11 aa, BK virus
QVSWKLITEYA

SEQ ID NO: 24064 - protein, 11 aa, BK virus
VSWKLITEYAV

SEQ ID NO: 24065 - protein, 11 aa, BK virus
SWKLITEYAVE

SEQ ID NO: 24066 - protein, 11 aa, BK virus
WKLITEYAVET

SEQ ID NO: 24067 - protein, 11 aa, BK virus
KLITEYAVETK

SEQ ID NO: 24068 - protein, 11 aa, BK virus
LITEYAVETKC

SEQ ID NO: 24069 - protein, 11 aa, BK virus
ITEYAVETKCE

SEQ ID NO: 24070 - protein, 11 aa, BK virus
TEYAVETKCED

SEQ ID NO: 24071 - protein, 11 aa, BK virus
EYAVETKCEDV

SEQ ID NO: 24072 - protein, 11 aa, BK virus
YAVETKCEDVF

SEQ ID NO: 24073 - protein, 11 aa, BK virus
AVETKCEDVFL

SEQ ID NO: 24074 - protein, 11 aa, BK virus
VETKCEDVFLL

SEQ ID NO: 24075 - protein, 11 aa, BK virus
ETKCEDVFLLL

SEQ ID NO: 24076 - protein, 11 aa, BK virus
TKCEDVFLLLG

SEQ ID NO: 24077 - protein, 11 aa, BK virus
KCEDVFLLLGM

SEQ ID NO: 24078 - protein, 11 aa, BK virus
CEDVFLLLGMY

SEQ ID NO: 24079 - protein, 11 aa, BK virus
EDVFLLLGMYL

SEQ ID NO: 24080 - protein, 11 aa, BK virus
DVFLLLGMYLE

SEQ ID NO: 24081 - protein, 11 aa, BK virus
VFLLLGMYLEF

SEQ ID NO: 24082 - protein, 11 aa, BK virus
FLLLGMYLEFQ

SEQ ID NO: 24083 - protein, 11 aa, BK virus
LLLGMYLEFQY

SEQ ID NO: 24084 - protein, 11 aa, BK virus
LLGMYLEFQYN

SEQ ID NO: 24085 - protein, 11 aa, BK virus
LGMYLEFQYNV

SEQ ID NO: 24086 - protein, 11 aa, BK virus
GMYLEFQYNVE

SEQ ID NO: 24087 - protein, 11 aa, BK virus
MYLEFQYNVEE

SEQ ID NO: 24088 - protein, 11 aa, BK virus
YLEFQYNVEEC

SEQ ID NO: 24089 - protein, 11 aa, BK virus
LEFQYNVEECK

SEQ ID NO: 24090 - protein, 11 aa, BK virus
EFQYNVEECKK

SEQ ID NO: 24091 - protein, 11 aa, BK virus
FQYNVEECKKC

SEQ ID NO: 24092 - protein, 11 aa, BK virus
QYNVEECKKCQ

SEQ ID NO: 24093 - protein, 11 aa, BK virus
YNVEECKKCQK

SEQ ID NO: 24094 - protein, 11 aa, BK virus
NVEECKKCQKK

SEQ ID NO: 24095 - protein, 11 aa, BK virus
VEECKKCQKKD

SEQ ID NO: 24096 - protein, 11 aa, BK virus
EECKKCQKKDQ

SEQ ID NO: 24097 - protein, 11 aa, BK virus
ECKKCQKKDQP

SEQ ID NO: 24098 - protein, 11 aa, BK virus
CKKCQKKDQPY

SEQ ID NO: 24099 - protein, 11 aa, BK virus
KKCQKKDQPYH

SEQ ID NO: 24100 - protein, 11 aa, BK virus
KCQKKDQPYHF

SEQ ID NO: 24101 - protein, 11 aa, BK virus
CQKKDQPYHFK

SEQ ID NO: 24102 - protein, 11 aa, BK virus
QKKDQPYHFKY

SEQ ID NO: 24103 - protein, 11 aa, BK virus
KKDQPYHFKYH

SEQ ID NO: 24104 - protein, 11 aa, BK virus
KDQPYHFKYHE

SEQ ID NO: 24105 - protein, 11 aa, BK virus
DQPYHFKYHEK

SEQ ID NO: 24106 - protein, 11 aa, BK virus
QPYHFKYHEKH

SEQ ID NO: 24107 - protein, 11 aa, BK virus
PYHFKYHEKHF

SEQ ID NO: 24108 - protein, 11 aa, BK virus
YHFKYHEKHFA

SEQ ID NO: 24109 - protein, 11 aa, BK virus
HFKYHEKHFAN

SEQ ID NO: 24110 - protein, 11 aa, BK virus
FKYHEKHFANA

SEQ ID NO: 24111 - protein, 11 aa, BK virus
KYHEKHFANAI

SEQ ID NO: 24112 - protein, 11 aa, BK virus
YHEKHFANAII

SEQ ID NO: 24113 - protein, 11 aa, BK virus
HEKHFANAIIF

SEQ ID NO: 24114 - protein, 11 aa, BK virus
EKHFANAIIFA

SEQ ID NO: 24115 - protein, 11 aa, BK virus
KHFANAIIFAE

SEQ ID NO: 24116 - protein, 11 aa, BK virus
HFANAIIFAES

SEQ ID NO: 24117 - protein, 11 aa, BK virus
FANAIIFAESK

SEQ ID NO: 24118 - protein, 11 aa, BK virus
ANAIIFAESKN

SEQ ID NO: 24119 - protein, 11 aa, BK virus
NAIIFAESKNQ

SEQ ID NO: 24120 - protein, 11 aa, BK virus
AIIFAESKNQK

SEQ ID NO: 24121 - protein, 11 aa, BK virus
IIFAESKNQKS

SEQ ID NO: 24122 - protein, 11 aa, BK virus
IFAESKNQKSI

SEQ ID NO: 24123 - protein, 11 aa, BK virus
FAESKNQKSIC

SEQ ID NO: 24124 - protein, 11 aa, BK virus
AESKNQKSICQ

SEQ ID NO: 24125 - protein, 11 aa, BK virus
ESKNQKSICQQ

SEQ ID NO: 24126 - protein, 11 aa, BK virus
SKNQKSICQQA

SEQ ID NO: 24127 - protein, 11 aa, BK virus
KNQKSICQQAV

SEQ ID NO: 24128 - protein, 11 aa, BK virus
NQKSICQQAVD

SEQ ID NO: 24129 - protein, 11 aa, BK virus
QKSICQQAVDT

SEQ ID NO: 24130 - protein, 11 aa, BK virus
KSICQQAVDTV

SEQ ID NO: 24131 - protein, 11 aa, BK virus
SICQQAVDTVL

SEQ ID NO: 24132 - protein, 11 aa, BK virus
ICQQAVDTVLA

SEQ ID NO: 24133 - protein, 11 aa, BK virus
CQQAVDTVLAK

SEQ ID NO: 24134 - protein, 11 aa, BK virus
QQAVDTVLAKK

SEQ ID NO: 24135 - protein, 11 aa, BK virus
QAVDTVLAKKR

SEQ ID NO: 24136 - protein, 11 aa, BK virus
AVDTVLAKKRV

SEQ ID NO: 24137 - protein, 11 aa, BK virus
VDTVLAKKRVD

SEQ ID NO: 24138 - protein, 11 aa, BK virus
DTVLAKKRVDT

SEQ ID NO: 24139 - protein, 11 aa, BK virus
TVLAKKRVDTL

SEQ ID NO: 24140 - protein, 11 aa, BK virus
VLAKKRVDTLH

SEQ ID NO: 24141 - protein, 11 aa, BK virus
LAKKRVDTLHM

SEQ ID NO: 24142 - protein, 11 aa, BK virus
AKKRVDTLHMT

SEQ ID NO: 24143 - protein, 11 aa, BK virus
KKRVDTLHMTR

SEQ ID NO: 24144 - protein, 11 aa, BK virus
KRVDTLHMTRE

SEQ ID NO: 24145 - protein, 11 aa, BK virus
RVDTLHMTREE

SEQ ID NO: 24146 - protein, 11 aa, BK virus
VDTLHMTREEM

SEQ ID NO: 24147 - protein, 11 aa, BK virus
DTLHMTREEML

SEQ ID NO: 24148 - protein, 11 aa, BK virus
TLHMTREEMLT

SEQ ID NO: 24149 - protein, 11 aa, BK virus
LHMTREEMLTE

SEQ ID NO: 24150 - protein, 11 aa, BK virus
HMTREEMLTER

SEQ ID NO: 24151 - protein, 11 aa, BK virus
MTREEMLTERF

SEQ ID NO: 24152 - protein, 11 aa, BK virus
TREEMLTERFN

SEQ ID NO: 24153 - protein, 11 aa, BK virus
REEMLTERFNH

SEQ ID NO: 24154 - protein, 11 aa, BK virus
EEMLTERFNHI

SEQ ID NO: 24155 - protein, 11 aa, BK virus
EMLTERFNHIL

SEQ ID NO: 24156 - protein, 11 aa, BK virus
MLTERFNHILD

SEQ ID NO: 24157 - protein, 11 aa, BK virus
LTERFNHILDK

SEQ ID NO: 24158 - protein, 11 aa, BK virus
TERFNHILDKM

SEQ ID NO: 24159 - protein, 11 aa, BK virus
ERFNHILDKMD

SEQ ID NO: 24160 - protein, 11 aa, BK virus
RFNHILDKMDL

SEQ ID NO: 24161 - protein, 11 aa, BK virus
FNHILDKMDLI

SEQ ID NO: 24162 - protein, 11 aa, BK virus
NHILDKMDLIF

SEQ ID NO: 24163 - protein, 11 aa, BK virus
HILDKMDLIFG

SEQ ID NO: 24164 - protein, 11 aa, BK virus
ILDKMDLIFGA

SEQ ID NO: 24165 - protein, 11 aa, BK virus
LDKMDLIFGAH

SEQ ID NO: 24166 - protein, 11 aa, BK virus
DKMDLIFGAHG

SEQ ID NO: 24167 - protein, 11 aa, BK virus
KMDLIFGAHGN

SEQ ID NO: 24168 - protein, 11 aa, BK virus
MDLIFGAHGNA

SEQ ID NO: 24169 - protein, 11 aa, BK virus
DLIFGAHGNAV

SEQ ID NO: 24170 - protein, 11 aa, BK virus
LIFGAHGNAVL

SEQ ID NO: 24171 - protein, 11 aa, BK virus
IFGAHGNAVLE

SEQ ID NO: 24172 - protein, 11 aa, BK virus
FGAHGNAVLEQ

SEQ ID NO: 24173 - protein, 11 aa, BK virus
GAHGNAVLEQY

SEQ ID NO: 24174 - protein, 11 aa, BK virus
AHGNAVLEQYM

SEQ ID NO: 24175 - protein, 11 aa, BK virus
HGNAVLEQYMA

SEQ ID NO: 24176 - protein, 11 aa, BK virus
GNAVLEQYMAG

SEQ ID NO: 24177 - protein, 11 aa, BK virus
NAVLEQYMAGV

SEQ ID NO: 24178 - protein, 11 aa, BK virus
AVLEQYMAGVA

SEQ ID NO: 24179 - protein, 11 aa, BK virus
VLEQYMAGVAW

SEQ ID NO: 24180 - protein, 11 aa, BK virus
LEQYMAGVAWL

SEQ ID NO: 24181 - protein, 11 aa, BK virus
EQYMAGVAWLH

SEQ ID NO: 24182 - protein, 11 aa, BK virus
QYMAGVAWLHC

SEQ ID NO: 24183 - protein, 11 aa, BK virus
YMAGVAWLHCL

SEQ ID NO: 24184 - protein, 11 aa, BK virus
MAGVAWLHCLL

SEQ ID NO: 24185 - protein, 11 aa, BK virus
AGVAWLHCLLP

SEQ ID NO: 24186 - protein, 11 aa, BK virus
GVAWLHCLLPK

SEQ ID NO: 24187 - protein, 11 aa, BK virus
VAWLHCLLPKM

SEQ ID NO: 24188 - protein, 11 aa, BK virus
AWLHCLLPKMD

SEQ ID NO: 24189 - protein, 11 aa, BK virus
WLHCLLPKMDS

SEQ ID NO: 24190 - protein, 11 aa, BK virus
LHCLLPKMDSV

SEQ ID NO: 24191 - protein, 11 aa, BK virus
HCLLPKMDSVI

SEQ ID NO: 24192 - protein, 11 aa, BK virus
CLLPKMDSVIF

SEQ ID NO: 24193 - protein, 11 aa, BK virus
LLPKMDSVIFD

SEQ ID NO: 24194 - protein, 11 aa, BK virus
LPKMDSVIFDF

SEQ ID NO: 24195 - protein, 11 aa, BK virus
PKMDSVIFDFL

SEQ ID NO: 24196 - protein, 11 aa, BK virus
KMDSVIFDFLH

SEQ ID NO: 24197 - protein, 11 aa, BK virus
MDSVIFDFLHC

SEQ ID NO: 24198 - protein, 11 aa, BK virus
DSVIFDFLHCI

SEQ ID NO: 24199 - protein, 11 aa, BK virus
SVIFDFLHCIV

SEQ ID NO: 24200 - protein, 11 aa, BK virus
VIFDFLHCIVF

SEQ ID NO: 24201 - protein, 11 aa, BK virus
IFDFLHCIVFN

SEQ ID NO: 24202 - protein, 11 aa, BK virus
FDFLHCIVFNV

SEQ ID NO: 24203 - protein, 11 aa, BK virus
DFLHCIVFNVP

SEQ ID NO: 24204 - protein, 11 aa, BK virus
FLHCIVFNVPK

SEQ ID NO: 24205 - protein, 11 aa, BK virus
LHCIVFNVPKR

SEQ ID NO: 24206 - protein, 11 aa, BK virus
HCIVFNVPKRR

SEQ ID NO: 24207 - protein, 11 aa, BK virus
CIVFNVPKRRY

SEQ ID NO: 24208 - protein, 11 aa, BK virus
IVFNVPKRRYW

SEQ ID NO: 24209 - protein, 11 aa, BK virus
VFNVPKRRYWL

SEQ ID NO: 24210 - protein, 11 aa, BK virus
FNVPKRRYWLF

SEQ ID NO: 24211 - protein, 11 aa, BK virus
NVPKRRYWLFK

SEQ ID NO: 24212 - protein, 11 aa, BK virus
VPKRRYWLFKG

SEQ ID NO: 24213 - protein, 11 aa, BK virus
PKRRYWLFKGP

SEQ ID NO: 24214 - protein, 11 aa, BK virus
KRRYWLFKGPI

SEQ ID NO: 24215 - protein, 11 aa, BK virus
RRYWLFKGPID

SEQ ID NO: 24216 - protein, 11 aa, BK virus
RYWLFKGPIDS

SEQ ID NO: 24217 - protein, 11 aa, BK virus
YWLFKGPIDSG

SEQ ID NO: 24218 - protein, 11 aa, BK virus
WLFKGPIDSGK

SEQ ID NO: 24219 - protein, 11 aa, BK virus
LFKGPIDSGKT

SEQ ID NO: 24220 - protein, 11 aa, BK virus
FKGPIDSGKTT

SEQ ID NO: 24221 - protein, 11 aa, BK virus
KGPIDSGKTTL

SEQ ID NO: 24222 - protein, 11 aa, BK virus
GPIDSGKTTLA

SEQ ID NO: 24223 - protein, 11 aa, BK virus
PIDSGKTTLAA

SEQ ID NO: 24224 - protein, 11 aa, BK virus
IDSGKTTLAAG

SEQ ID NO: 24225 - protein, 11 aa, BK virus
DSGKTTLAAGL

SEQ ID NO: 24226 - protein, 11 aa, BK virus
SGKTTLAAGLL

SEQ ID NO: 24227 - protein, 11 aa, BK virus
GKTTLAAGLLD

SEQ ID NO: 24228 - protein, 11 aa, BK virus
KTTLAAGLLDL

SEQ ID NO: 24229 - protein, 11 aa, BK virus
TTLAAGLLDLC

SEQ ID NO: 24230 - protein, 11 aa, BK virus
TLAAGLLDLCG

SEQ ID NO: 24231 - protein, 11 aa, BK virus
LAAGLLDLCGG

SEQ ID NO: 24232 - protein, 11 aa, BK virus
AAGLLDLCGGK

SEQ ID NO: 24233 - protein, 11 aa, BK virus
AGLLDLCGGKA

SEQ ID NO: 24234 - protein, 11 aa, BK virus
GLLDLCGGKAL

SEQ ID NO: 24235 - protein, 11 aa, BK virus
LLDLCGGKALN

SEQ ID NO: 24236 - protein, 11 aa, BK virus
LDLCGGKALNV

SEQ ID NO: 24237 - protein, 11 aa, BK virus
DLCGGKALNVN

SEQ ID NO: 24238 - protein, 11 aa, BK virus
LCGGKALNVNL

SEQ ID NO: 24239 - protein, 11 aa, BK virus
CGGKALNVNLP

SEQ ID NO: 24240 - protein, 11 aa, BK virus
GGKALNVNLPM

SEQ ID NO: 24241 - protein, 11 aa, BK virus
GKALNVNLPME

SEQ ID NO: 24242 - protein, 11 aa, BK virus
KALNVNLPMER

SEQ ID NO: 24243 - protein, 11 aa, BK virus
ALNVNLPMERL

SEQ ID NO: 24244 - protein, 11 aa, BK virus
LNVNLPMERLT

SEQ ID NO: 24245 - protein, 11 aa, BK virus
NVNLPMERLTF

SEQ ID NO: 24246 - protein, 11 aa, BK virus
VNLPMERLTFE

SEQ ID NO: 24247 - protein, 11 aa, BK virus
NLPMERLTFEL

SEQ ID NO: 24248 - protein, 11 aa, BK virus
LPMERLTFELG

SEQ ID NO: 24249 - protein, 11 aa, BK virus
PMERLTFELGV

SEQ ID NO: 24250 - protein, 11 aa, BK virus
MERLTFELGVA

SEQ ID NO: 24251 - protein, 11 aa, BK virus
ERLTFELGVAI

SEQ ID NO: 24252 - protein, 11 aa, BK virus
RLTFELGVAID

SEQ ID NO: 24253 - protein, 11 aa, BK virus
LTFELGVAIDQ

SEQ ID NO: 24254 - protein, 11 aa, BK virus
TFELGVAIDQY

SEQ ID NO: 24255 - protein, 11 aa, BK virus
FELGVAIDQYM

SEQ ID NO: 24256 - protein, 11 aa, BK virus
ELGVAIDQYMV

SEQ ID NO: 24257 - protein, 11 aa, BK virus
LGVAIDQYMVV

SEQ ID NO: 24258 - protein, 11 aa, BK virus
GVAIDQYMVVF

SEQ ID NO: 24259 - protein, 11 aa, BK virus
VAIDQYMVVFE

SEQ ID NO: 24260 - protein, 11 aa, BK virus
AIDQYMVVFED

SEQ ID NO: 24261 - protein, 11 aa, BK virus
IDQYMVVFEDV

SEQ ID NO: 24262 - protein, 11 aa, BK virus
DQYMVVFEDVK

SEQ ID NO: 24263 - protein, 11 aa, BK virus
QYMVVFEDVKG

SEQ ID NO: 24264 - protein, 11 aa, BK virus
YMVVFEDVKGT

SEQ ID NO: 24265 - protein, 11 aa, BK virus
MVVFEDVKGTG

SEQ ID NO: 24266 - protein, 11 aa, BK virus
VVFEDVKGTGA

SEQ ID NO: 24267 - protein, 11 aa, BK virus
VFEDVKGTGAE

SEQ ID NO: 24268 - protein, 11 aa, BK virus
FEDVKGTGAES

SEQ ID NO: 24269 - protein, 11 aa, BK virus
EDVKGTGAESK

SEQ ID NO: 24270 - protein, 11 aa, BK virus
DVKGTGAESKD

SEQ ID NO: 24271 - protein, 11 aa, BK virus
VKGTGAESKDL

SEQ ID NO: 24272 - protein, 11 aa, BK virus
KGTGAESKDLP

SEQ ID NO: 24273 - protein, 11 aa, BK virus
GTGAESKDLPS

SEQ ID NO: 24274 - protein, 11 aa, BK virus
TGAESKDLPSG

SEQ ID NO: 24275 - protein, 11 aa, BK virus
GAESKDLPSGH

SEQ ID NO: 24276 - protein, 11 aa, BK virus
AESKDLPSGHG

SEQ ID NO: 24277 - protein, 11 aa, BK virus
ESKDLPSGHGI

SEQ ID NO: 24278 - protein, 11 aa, BK virus
SKDLPSGHGIN

SEQ ID NO: 24279 - protein, 11 aa, BK virus
KDLPSGHGINN

SEQ ID NO: 24280 - protein, 11 aa, BK virus
DLPSGHGINNL

SEQ ID NO: 24281 - protein, 11 aa, BK virus
LPSGHGINNLD

SEQ ID NO: 24282 - protein, 11 aa, BK virus
PSGHGINNLDS

SEQ ID NO: 24283 - protein, 11 aa, BK virus
SGHGINNLDSL

SEQ ID NO: 24284 - protein, 11 aa, BK virus
GHGINNLDSLR

SEQ ID NO: 24285 - protein, 11 aa, BK virus
HGINNLDSLRD

SEQ ID NO: 24286 - protein, 11 aa, BK virus
GINNLDSLRDY

SEQ ID NO: 24287 - protein, 11 aa, BK virus
INNLDSLRDYL

SEQ ID NO: 24288 - protein, 11 aa, BK virus
NNLDSLRDYLD

SEQ ID NO: 24289 - protein, 11 aa, BK virus
NLDSLRDYLDG

SEQ ID NO: 24290 - protein, 11 aa, BK virus
LDSLRDYLDGS

SEQ ID NO: 24291 - protein, 11 aa, BK virus
DSLRDYLDGSV

SEQ ID NO: 24292 - protein, 11 aa, BK virus
SLRDYLDGSVK

SEQ ID NO: 24293 - protein, 11 aa, BK virus
LRDYLDGSVKV

SEQ ID NO: 24294 - protein, 11 aa, BK virus
RDYLDGSVKVN

SEQ ID NO: 24295 - protein, 11 aa, BK virus
DYLDGSVKVNL

SEQ ID NO: 24296 - protein, 11 aa, BK virus
YLDGSVKVNLE

SEQ ID NO: 24297 - protein, 11 aa, BK virus
LDGSVKVNLEK

SEQ ID NO: 24298 - protein, 11 aa, BK virus
DGSVKVNLEKK

SEQ ID NO: 24299 - protein, 11 aa, BK virus
GSVKVNLEKKH

SEQ ID NO: 24300 - protein, 11 aa, BK virus
SVKVNLEKKHL

SEQ ID NO: 24301 - protein, 11 aa, BK virus
VKVNLEKKHLN

SEQ ID NO: 24302 - protein, 11 aa, BK virus
KVNLEKKHLNK

SEQ ID NO: 24303 - protein, 11 aa, BK virus
VNLEKKHLNKR

SEQ ID NO: 24304 - protein, 11 aa, BK virus
NLEKKHLNKRT

SEQ ID NO: 24305 - protein, 11 aa, BK virus
LEKKHLNKRTQ

SEQ ID NO: 24306 - protein, 11 aa, BK virus
EKKHLNKRTQI

SEQ ID NO: 24307 - protein, 11 aa, BK virus
KKHLNKRTQIF

SEQ ID NO: 24308 - protein, 11 aa, BK virus
KHLNKRTQIFP

SEQ ID NO: 24309 - protein, 11 aa, BK virus
HLNKRTQIFPP

SEQ ID NO: 24310 - protein, 11 aa, BK virus
LNKRTQIFPPG

SEQ ID NO: 24311 - protein, 11 aa, BK virus
NKRTQIFPPGL

SEQ ID NO: 24312 - protein, 11 aa, BK virus
KRTQIFPPGLV

SEQ ID NO: 24313 - protein, 11 aa, BK virus
RTQIFPPGLVT

SEQ ID NO: 24314 - protein, 11 aa, BK virus
TQIFPPGLVTM

SEQ ID NO: 24315 - protein, 11 aa, BK virus
QIFPPGLVTMN

SEQ ID NO: 24316 - protein, 11 aa, BK virus
IFPPGLVTMNE

SEQ ID NO: 24317 - protein, 11 aa, BK virus
FPPGLVTMNEY

SEQ ID NO: 24318 - protein, 11 aa, BK virus
PPGLVTMNEYP

SEQ ID NO: 24319 - protein, 11 aa, BK virus
PGLVTMNEYPV

SEQ ID NO: 24320 - protein, 11 aa, BK virus
GLVTMNEYPVP

SEQ ID NO: 24321 - protein, 11 aa, BK virus
LVTMNEYPVPK

SEQ ID NO: 24322 - protein, 11 aa, BK virus
VTMNEYPVPKT

SEQ ID NO: 24323 - protein, 11 aa, BK virus
TMNEYPVPKTL

SEQ ID NO: 24324 - protein, 11 aa, BK virus
MNEYPVPKTLQ

SEQ ID NO: 24325 - protein, 11 aa, BK virus
NEYPVPKTLQA

SEQ ID NO: 24326 - protein, 11 aa, BK virus
EYPVPKTLQAR

SEQ ID NO: 24327 - protein, 11 aa, BK virus
YPVPKTLQARF

SEQ ID NO: 24328 - protein, 11 aa, BK virus
PVPKTLQARFV

SEQ ID NO: 24329 - protein, 11 aa, BK virus
VPKTLQARFVR

SEQ ID NO: 24330 - protein, 11 aa, BK virus
PKTLQARFVRQ

SEQ ID NO: 24331 - protein, 11 aa, BK virus
KTLQARFVRQI

SEQ ID NO: 24332 - protein, 11 aa, BK virus
TLQARFVRQID

SEQ ID NO: 24333 - protein, 11 aa, BK virus
LQARFVRQIDF

SEQ ID NO: 24334 - protein, 11 aa, BK virus
QARFVRQIDFR

SEQ ID NO: 24335 - protein, 11 aa, BK virus
ARFVRQIDFRP

SEQ ID NO: 24336 - protein, 11 aa, BK virus
RFVRQIDFRPK

SEQ ID NO: 24337 - protein, 11 aa, BK virus
FVRQIDFRPKI

SEQ ID NO: 24338 - protein, 11 aa, BK virus
VRQIDFRPKIY

SEQ ID NO: 24339 - protein, 11 aa, BK virus
RQIDFRPKIYL

SEQ ID NO: 24340 - protein, 11 aa, BK virus
QIDFRPKIYLR

SEQ ID NO: 24341 - protein, 11 aa, BK virus
IDFRPKIYLRK

SEQ ID NO: 24342 - protein, 11 aa, BK virus
DFRPKIYLRKS

SEQ ID NO: 24343 - protein, 11 aa, BK virus
FRPKIYLRKSL

SEQ ID NO: 24344 - protein, 11 aa, BK virus
RPKIYLRKSLQ

SEQ ID NO: 24345 - protein, 11 aa, BK virus
PKIYLRKSLQN

SEQ ID NO: 24346 - protein, 11 aa, BK virus
KIYLRKSLQNS

SEQ ID NO: 24347 - protein, 11 aa, BK virus
IYLRKSLQNSE

SEQ ID NO: 24348 - protein, 11 aa, BK virus
YLRKSLQNSEF

SEQ ID NO: 24349 - protein, 11 aa, BK virus
LRKSLQNSEFL

SEQ ID NO: 24350 - protein, 11 aa, BK virus
RKSLQNSEFLL

SEQ ID NO: 24351 - protein, 11 aa, BK virus
KSLQNSEFLLE

SEQ ID NO: 24352 - protein, 11 aa, BK virus
SLQNSEFLLEK

SEQ ID NO: 24353 - protein, 11 aa, BK virus
LQNSEFLLEKR

SEQ ID NO: 24354 - protein, 11 aa, BK virus
QNSEFLLEKRI

SEQ ID NO: 24355 - protein, 11 aa, BK virus
NSEFLLEKRIL

SEQ ID NO: 24356 - protein, 11 aa, BK virus
SEFLLEKRILQ

SEQ ID NO: 24357 - protein, 11 aa, BK virus
EFLLEKRILQS

SEQ ID NO: 24358 - protein, 11 aa, BK virus
FLLEKRILQSG

SEQ ID NO: 24359 - protein, 11 aa, BK virus
LLEKRILQSGM

SEQ ID NO: 24360 - protein, 11 aa, BK virus
LEKRILQSGMT

SEQ ID NO: 24361 - protein, 11 aa, BK virus
EKRILQSGMTL

SEQ ID NO: 24362 - protein, 11 aa, BK virus
KRILQSGMTLL

SEQ ID NO: 24363 - protein, 11 aa, BK virus
RILQSGMTLLL

SEQ ID NO: 24364 - protein, 11 aa, BK virus
ILQSGMTLLLL

SEQ ID NO: 24365 - protein, 11 aa, BK virus
LQSGMTLLLLL

SEQ ID NO: 24366 - protein, 11 aa, BK virus
QSGMTLLLLLI

SEQ ID NO: 24367 - protein, 11 aa, BK virus
SGMTLLLLLIW

SEQ ID NO: 24368 - protein, 11 aa, BK virus
GMTLLLLLIWF

SEQ ID NO: 24369 - protein, 11 aa, BK virus
MTLLLLLIWFR

SEQ ID NO: 24370 - protein, 11 aa, BK virus
TLLLLLIWFRP

SEQ ID NO: 24371 - protein, 11 aa, BK virus
LLLLLIWFRPV

SEQ ID NO: 24372 - protein, 11 aa, BK virus
LLLLIWFRPVA

SEQ ID NO: 24373 - protein, 11 aa, BK virus
LLLIWFRPVAD

SEQ ID NO: 24374 - protein, 11 aa, BK virus
LLIWFRPVADF

SEQ ID NO: 24375 - protein, 11 aa, BK virus
LIWFRPVADFA

SEQ ID NO: 24376 - protein, 11 aa, BK virus
IWFRPVADFAT

SEQ ID NO: 24377 - protein, 11 aa, BK virus
WFRPVADFATD

SEQ ID NO: 24378 - protein, 11 aa, BK virus
FRPVADFATDI

SEQ ID NO: 24379 - protein, 11 aa, BK virus
RPVADFATDIQ

SEQ ID NO: 24380 - protein, 11 aa, BK virus
PVADFATDIQS

SEQ ID NO: 24381 - protein, 11 aa, BK virus
VADFATDIQSR

SEQ ID NO: 24382 - protein, 11 aa, BK virus
ADFATDIQSRI

SEQ ID NO: 24383 - protein, 11 aa, BK virus
DFATDIQSRIV

SEQ ID NO: 24384 - protein, 11 aa, BK virus
FATDIQSRIVE

SEQ ID NO: 24385 - protein, 11 aa, BK virus
ATDIQSRIVEW

SEQ ID NO: 24386 - protein, 11 aa, BK virus
TDIQSRIVEWK

SEQ ID NO: 24387 - protein, 11 aa, BK virus
DIQSRIVEWKE

SEQ ID NO: 24388 - protein, 11 aa, BK virus
IQSRIVEWKER

SEQ ID NO: 24389 - protein, 11 aa, BK virus
QSRIVEWKERL

SEQ ID NO: 24390 - protein, 11 aa, BK virus
SRIVEWKERLD

SEQ ID NO: 24391 - protein, 11 aa, BK virus
RIVEWKERLDS

SEQ ID NO: 24392 - protein, 11 aa, BK virus
IVEWKERLDSE

SEQ ID NO: 24393 - protein, 11 aa, BK virus
VEWKERLDSEI

SEQ ID NO: 24394 - protein, 11 aa, BK virus
EWKERLDSEIS

SEQ ID NO: 24395 - protein, 11 aa, BK virus
WKERLDSEISM

SEQ ID NO: 24396 - protein, 11 aa, BK virus
KERLDSEISMY

SEQ ID NO: 24397 - protein, 11 aa, BK virus
ERLDSEISMYT

SEQ ID NO: 24398 - protein, 11 aa, BK virus
RLDSEISMYTF

SEQ ID NO: 24399 - protein, 11 aa, BK virus
LDSEISMYTFS

SEQ ID NO: 24400 - protein, 11 aa, BK virus
DSEISMYTFSR

SEQ ID NO: 24401 - protein, 11 aa, BK virus
SEISMYTFSRM

SEQ ID NO: 24402 - protein, 11 aa, BK virus
EISMYTFSRMK

SEQ ID NO: 24403 - protein, 11 aa, BK virus
ISMYTFSRMKY

SEQ ID NO: 24404 - protein, 11 aa, BK virus
SMYTFSRMKYN

SEQ ID NO: 24405 - protein, 11 aa, BK virus
MYTFSRMKYNI

SEQ ID NO: 24406 - protein, 11 aa, BK virus
YTFSRMKYNIC

SEQ ID NO: 24407 - protein, 11 aa, BK virus
TFSRMKYNICM

SEQ ID NO: 24408 - protein, 11 aa, BK virus
FSRMKYNICMG

SEQ ID NO: 24409 - protein, 11 aa, BK virus
SRMKYNICMGK

SEQ ID NO: 24410 - protein, 11 aa, BK virus
RMKYNICMGKC

SEQ ID NO: 24411 - protein, 11 aa, BK virus
MKYNICMGKCI

SEQ ID NO: 24412 - protein, 11 aa, BK virus
KYNICMGKCIL

SEQ ID NO: 24413 - protein, 11 aa, BK virus
YNICMGKCILD

SEQ ID NO: 24414 - protein, 11 aa, BK virus
NICMGKCILDI

SEQ ID NO: 24415 - protein, 11 aa, BK virus
ICMGKCILDIT

SEQ ID NO: 24416 - protein, 11 aa, BK virus
CMGKCILDITR

SEQ ID NO: 24417 - protein, 11 aa, BK virus
MGKCILDITRE

SEQ ID NO: 24418 - protein, 11 aa, BK virus
GKCILDITREE

SEQ ID NO: 24419 - protein, 11 aa, BK virus
KCILDITREED

SEQ ID NO: 24420 - protein, 11 aa, BK virus
CILDITREEDS

SEQ ID NO: 24421 - protein, 11 aa, BK virus
ILDITREEDSE

SEQ ID NO: 24422 - protein, 11 aa, BK virus
LDITREEDSET

SEQ ID NO: 24423 - protein, 11 aa, BK virus
DITREEDSETE

SEQ ID NO: 24424 - protein, 11 aa, BK virus
ITREEDSETED

SEQ ID NO: 24425 - protein, 11 aa, BK virus
TREEDSETEDS

SEQ ID NO: 24426 - protein, 11 aa, BK virus
REEDSETEDSG

SEQ ID NO: 24427 - protein, 11 aa, BK virus
EEDSETEDSGH

SEQ ID NO: 24428 - protein, 11 aa, BK virus
EDSETEDSGHG

SEQ ID NO: 24429 - protein, 11 aa, BK virus
DSETEDSGHGS

SEQ ID NO: 24430 - protein, 11 aa, BK virus
SETEDSGHGSS

SEQ ID NO: 24431 - protein, 11 aa, BK virus
ETEDSGHGSST

SEQ ID NO: 24432 - protein, 11 aa, BK virus
TEDSGHGSSTE

SEQ ID NO: 24433 - protein, 11 aa, BK virus
EDSGHGSSTES

SEQ ID NO: 24434 - protein, 11 aa, BK virus
DSGHGSSTESQ

SEQ ID NO: 24435 - protein, 11 aa, BK virus
SGHGSSTESQS

SEQ ID NO: 24436 - protein, 11 aa, BK virus
GHGSSTESQSQ

SEQ ID NO: 24437 - protein, 11 aa, BK virus
HGSSTESQSQC

SEQ ID NO: 24438 - protein, 11 aa, BK virus
GSSTESQSQCS

SEQ ID NO: 24439 - protein, 11 aa, BK virus
SSTESQSQCSS

SEQ ID NO: 24440 - protein, 11 aa, BK virus
STESQSQCSSQ

SEQ ID NO: 24441 - protein, 11 aa, BK virus
TESQSQCSSQV

SEQ ID NO: 24442 - protein, 11 aa, BK virus
ESQSQCSSQVS

SEQ ID NO: 24443 - protein, 11 aa, BK virus
SQSQCSSQVSD

SEQ ID NO: 24444 - protein, 11 aa, BK virus
QSQCSSQVSDT

SEQ ID NO: 24445 - protein, 11 aa, BK virus
SQCSSQVSDTS

SEQ ID NO: 24446 - protein, 11 aa, BK virus
QCSSQVSDTSA

SEQ ID NO: 24447 - protein, 11 aa, BK virus
CSSQVSDTSAP

SEQ ID NO: 24448 - protein, 11 aa, BK virus
SSQVSDTSAPA

SEQ ID NO: 24449 - protein, 11 aa, BK virus
SQVSDTSAPAE

SEQ ID NO: 24450 - protein, 11 aa, BK virus
QVSDTSAPAED

SEQ ID NO: 24451 - protein, 11 aa, BK virus
VSDTSAPAEDS

SEQ ID NO: 24452 - protein, 11 aa, BK virus
SDTSAPAEDSQ

SEQ ID NO: 24453 - protein, 11 aa, BK virus
DTSAPAEDSQR

SEQ ID NO: 24454 - protein, 11 aa, BK virus
TSAPAEDSQRS

SEQ ID NO: 24455 - protein, 11 aa, BK virus
SAPAEDSQRSD

SEQ ID NO: 24456 - protein, 11 aa, BK virus
APAEDSQRSDP

SEQ ID NO: 24457 - protein, 11 aa, BK virus
PAEDSQRSDPH

SEQ ID NO: 24458 - protein, 11 aa, BK virus
AEDSQRSDPHS

SEQ ID NO: 24459 - protein, 11 aa, BK virus
EDSQRSDPHSQ

SEQ ID NO: 24460 - protein, 11 aa, BK virus
DSQRSDPHSQE

SEQ ID NO: 24461 - protein, 11 aa, BK virus
SQRSDPHSQEL

SEQ ID NO: 24462 - protein, 11 aa, BK virus
QRSDPHSQELH

SEQ ID NO: 24463 - protein, 11 aa, BK virus
RSDPHSQELHL

SEQ ID NO: 24464 - protein, 11 aa, BK virus
SDPHSQELHLC

SEQ ID NO: 24465 - protein, 11 aa, BK virus
DPHSQELHLCK

SEQ ID NO: 24466 - protein, 11 aa, BK virus
PHSQELHLCKG

SEQ ID NO: 24467 - protein, 11 aa, BK virus
HSQELHLCKGF

SEQ ID NO: 24468 - protein, 11 aa, BK virus
SQELHLCKGFQ

SEQ ID NO: 24469 - protein, 11 aa, BK virus
QELHLCKGFQC

SEQ ID NO: 24470 - protein, 11 aa, BK virus
ELHLCKGFQCF

SEQ ID NO: 24471 - protein, 11 aa, BK virus
LHLCKGFQCFK

SEQ ID NO: 24472 - protein, 11 aa, BK virus
HLCKGFQCFKR

SEQ ID NO: 24473 - protein, 11 aa, BK virus
LCKGFQCFKRP

SEQ ID NO: 24474 - protein, 11 aa, BK virus
CKGFQCFKRPK

SEQ ID NO: 24475 - protein, 11 aa, BK virus
KGFQCFKRPKT

SEQ ID NO: 24476 - protein, 11 aa, BK virus
GFQCFKRPKTP

SEQ ID NO: 24477 - protein, 11 aa, BK virus
FQCFKRPKTPP

SEQ ID NO: 24478 - protein, 11 aa, BK virus
QCFKRPKTPPP

SEQ ID NO: 24479 - protein, 11 aa, BK virus
CFKRPKTPPPK

SEQ ID NO: 24480 - protein, 11 aa, BK virus
HKLKSGLYKSS

SEQ ID NO: 24481 - protein, 11 aa, BK virus
KLKSGLYKSSI

SEQ ID NO: 24482 - protein, 11 aa, BK virus
LKSGLYKSSIY

SEQ ID NO: 24483 - protein, 11 aa, BK virus
MYMYNKSTCLK

SEQ ID NO: 24484 - protein, 11 aa, BK virus
YMYNKSTCLKH

SEQ ID NO: 24485 - protein, 11 aa, BK virus
MYNKSTCLKHF

SEQ ID NO: 24486 - protein, 11 aa, BK virus
YNKSTCLKHFG

SEQ ID NO: 24487 - protein, 11 aa, BK virus
NKSTCLKHFGL

SEQ ID NO: 24488 - protein, 11 aa, BK virus
KSTCLKHFGLQ

SEQ ID NO: 24489 - protein, 11 aa, BK virus
STCLKHFGLQL

SEQ ID NO: 24490 - protein, 11 aa, BK virus
TCLKHFGLQLS

SEQ ID NO: 24491 - protein, 11 aa, BK virus
CLKHFGLQLSL

SEQ ID NO: 24492 - protein, 11 aa, BK virus
LKHFGLQLSLF

SEQ ID NO: 24493 - protein, 11 aa, BK virus
KHFGLQLSLFV

SEQ ID NO: 24494 - protein, 11 aa, BK virus
HFGLQLSLFVN

SEQ ID NO: 24495 - protein, 11 aa, BK virus
FGLQLSLFVNI

SEQ ID NO: 24496 - protein, 11 aa, BK virus
GLQLSLFVNIS

SEQ ID NO: 24497 - protein, 11 aa, BK virus
LQLSLFVNISY

SEQ ID NO: 24498 - protein, 11 aa, BK virus
QLSLFVNISYH

SEQ ID NO: 24499 - protein, 11 aa, BK virus
LSLFVNISYHI

SEQ ID NO: 24500 - protein, 11 aa, BK virus
SLFVNISYHIW

SEQ ID NO: 24501 - protein, 11 aa, BK virus
LFVNISYHIWV

SEQ ID NO: 24502 - protein, 11 aa, BK virus
FVNISYHIWVP

SEQ ID NO: 24503 - protein, 11 aa, BK virus
VNISYHIWVPW

SEQ ID NO: 24504 - protein, 11 aa, BK virus
NISYHIWVPWK

SEQ ID NO: 24505 - protein, 11 aa, BK virus
ISYHIWVPWKS

SEQ ID NO: 24506 - protein, 11 aa, BK virus
SYHIWVPWKSF

SEQ ID NO: 24507 - protein, 11 aa, BK virus
YHIWVPWKSFC

SEQ ID NO: 24508 - protein, 11 aa, BK virus
HIWVPWKSFCA

SEQ ID NO: 24509 - protein, 11 aa, BK virus
IWVPWKSFCAI

SEQ ID NO: 24510 - protein, 11 aa, BK virus
WVPWKSFCAIK

SEQ ID NO: 24511 - protein, 11 aa, BK virus
VPWKSFCAIKH

SEQ ID NO: 24512 - protein, 11 aa, BK virus
PWKSFCAIKHP

SEQ ID NO: 24513 - protein, 11 aa, BK virus
WKSFCAIKHPN

SEQ ID NO: 24514 - protein, 11 aa, BK virus
KSFCAIKHPNL

SEQ ID NO: 24515 - protein, 11 aa, BK virus
SFCAIKHPNLF

SEQ ID NO: 24516 - protein, 11 aa, BK virus
FCAIKHPNLFY

SEQ ID NO: 24517 - protein, 11 aa, BK virus
CAIKHPNLFYL

SEQ ID NO: 24518 - protein, 11 aa, BK virus
AIKHPNLFYLG

SEQ ID NO: 24519 - protein, 11 aa, BK virus
IKHPNLFYLGF

SEQ ID NO: 24520 - protein, 11 aa, BK virus
KHPNLFYLGFH

SEQ ID NO: 24521 - protein, 11 aa, BK virus
HPNLFYLGFHT

SEQ ID NO: 24522 - protein, 11 aa, BK virus
PNLFYLGFHTI

SEQ ID NO: 24523 - protein, 11 aa, BK virus
NLFYLGFHTIH

SEQ ID NO: 24524 - protein, 11 aa, BK virus
LFYLGFHTIHR

SEQ ID NO: 24525 - protein, 11 aa, BK virus
FYLGFHTIHRL

SEQ ID NO: 24526 - protein, 11 aa, BK virus
YLGFHTIHRLP

SEQ ID NO: 24527 - protein, 11 aa, BK virus
LGFHTIHRLPI

SEQ ID NO: 24528 - protein, 11 aa, BK virus
GFHTIHRLPIH

SEQ ID NO: 24529 - protein, 11 aa, BK virus
FHTIHRLPIHS

SEQ ID NO: 24530 - protein, 11 aa, BK virus
HTIHRLPIHSL

SEQ ID NO: 24531 - protein, 11 aa, BK virus
TIHRLPIHSLG

SEQ ID NO: 24532 - protein, 11 aa, BK virus
IHRLPIHSLGS

SEQ ID NO: 24533 - protein, 11 aa, BK virus
HRLPIHSLGSP

SEQ ID NO: 24534 - protein, 11 aa, BK virus
RLPIHSLGSPV

SEQ ID NO: 24535 - protein, 11 aa, BK virus
LPIHSLGSPVY

SEQ ID NO: 24536 - protein, 11 aa, BK virus
PIHSLGSPVYK

SEQ ID NO: 24537 - protein, 11 aa, BK virus
IHSLGSPVYKV

SEQ ID NO: 24538 - protein, 11 aa, BK virus
HSLGSPVYKVT

SEQ ID NO: 24539 - protein, 11 aa, BK virus
QKGNWVRILYR

SEQ ID NO: 24540 - protein, 11 aa, BK virus
KGNWVRILYRS

SEQ ID NO: 24541 - protein, 11 aa, BK virus
GNWVRILYRSF

SEQ ID NO: 24542 - protein, 11 aa, BK virus
NWVRILYRSFS

SEQ ID NO: 24543 - protein, 11 aa, BK virus
WVRILYRSFSQ

SEQ ID NO: 24544 - protein, 11 aa, BK virus
VRILYRSFSQA

SEQ ID NO: 24545 - protein, 11 aa, BK virus
RILYRSFSQAD

SEQ ID NO: 24546 - protein, 11 aa, BK virus
ILYRSFSQADL

SEQ ID NO: 24547 - protein, 11 aa, BK virus
LYRSFSQADLK

SEQ ID NO: 24548 - protein, 11 aa, BK virus
YRSFSQADLKI

SEQ ID NO: 24549 - protein, 11 aa, BK virus
RSFSQADLKIS

SEQ ID NO: 24550 - protein, 11 aa, BK virus
SFSQADLKISC

SEQ ID NO: 24551 - protein, 11 aa, BK virus
FSQADLKISCK

SEQ ID NO: 24552 - protein, 11 aa, BK virus
SQADLKISCKA

SEQ ID NO: 24553 - protein, 11 aa, BK virus
QADLKISCKAS

SEQ ID NO: 24554 - protein, 11 aa, BK virus
ADLKISCKASP

SEQ ID NO: 24555 - protein, 11 aa, BK virus
DLKISCKASPL

SEQ ID NO: 24556 - protein, 11 aa, BK virus
LKISCKASPLL

SEQ ID NO: 24557 - protein, 11 aa, BK virus
KISCKASPLLC

SEQ ID NO: 24558 - protein, 11 aa, BK virus
ISCKASPLLCS

SEQ ID NO: 24559 - protein, 11 aa, BK virus
SCKASPLLCSR

SEQ ID NO: 24560 - protein, 11 aa, BK virus
CKASPLLCSRA

SEQ ID NO: 24561 - protein, 11 aa, BK virus
KASPLLCSRAV

SEQ ID NO: 24562 - protein, 11 aa, BK virus
ASPLLCSRAVS

SEQ ID NO: 24563 - protein, 11 aa, BK virus
SPLLCSRAVSK

SEQ ID NO: 24564 - protein, 11 aa, BK virus
PLLCSRAVSKQ

SEQ ID NO: 24565 - protein, 11 aa, BK virus
LLCSRAVSKQA

SEQ ID NO: 24566 - protein, 11 aa, BK virus
LCSRAVSKQAT

SEQ ID NO: 24567 - protein, 11 aa, BK virus
CSRAVSKQATN

SEQ ID NO: 24568 - protein, 11 aa, BK virus
SRAVSKQATNI

SEQ ID NO: 24569 - protein, 11 aa, BK virus
RAVSKQATNIS

SEQ ID NO: 24570 - protein, 11 aa, BK virus
AVSKQATNISS

SEQ ID NO: 24571 - protein, 11 aa, BK virus
NIQAISFTKRP

SEQ ID NO: 24572 - protein, 11 aa, BK virus
IQAISFTKRPH

SEQ ID NO: 24573 - protein, 11 aa, BK virus
QAISFTKRPHT

SEQ ID NO: 24574 - protein, 11 aa, BK virus
AISFTKRPHTL

SEQ ID NO: 24575 - protein, 11 aa, BK virus
ISFTKRPHTLF

SEQ ID NO: 24576 - protein, 11 aa, BK virus
SFTKRPHTLFI

SEQ ID NO: 24577 - protein, 11 aa, BK virus
QHCGSCVGHMK

SEQ ID NO: 24578 - protein, 11 aa, BK virus
HCGSCVGHMKY

SEQ ID NO: 24579 - protein, 11 aa, BK virus
CGSCVGHMKYW

SEQ ID NO: 24580 - protein, 11 aa, BK virus
GSCVGHMKYWG

SEQ ID NO: 24581 - protein, 11 aa, BK virus
SCVGHMKYWGN

SEQ ID NO: 24582 - protein, 11 aa, BK virus
CVGHMKYWGNI

SEQ ID NO: 24583 - protein, 11 aa, BK virus
VGHMKYWGNIF

SEQ ID NO: 24584 - protein, 11 aa, BK virus
GHMKYWGNIFP

SEQ ID NO: 24585 - protein, 11 aa, BK virus
HMKYWGNIFPS

SEQ ID NO: 24586 - protein, 11 aa, BK virus
MKYWGNIFPSC

SEQ ID NO: 24587 - protein, 11 aa, BK virus
KYWGNIFPSCE

SEQ ID NO: 24588 - protein, 11 aa, BK virus
YWGNIFPSCES

SEQ ID NO: 24589 - protein, 11 aa, BK virus
WGNIFPSCESP

SEQ ID NO: 24590 - protein, 11 aa, BK virus
GNIFPSCESPK

SEQ ID NO: 24591 - protein, 11 aa, BK virus
NIFPSCESPKI

SEQ ID NO: 24592 - protein, 11 aa, BK virus
IFPSCESPKIP

SEQ ID NO: 24593 - protein, 11 aa, BK virus
FPSCESPKIPS

SEQ ID NO: 24594 - protein, 11 aa, BK virus
PSCESPKIPSI

SEQ ID NO: 24595 - protein, 11 aa, BK virus
SCESPKIPSIF

SEQ ID NO: 24596 - protein, 11 aa, BK virus
CESPKIPSIFI

SEQ ID NO: 24597 - protein, 11 aa, BK virus
ESPKIPSIFIS

SEQ ID NO: 24598 - protein, 11 aa, BK virus
SPKIPSIFIST

SEQ ID NO: 24599 - protein, 11 aa, BK virus
PKIPSIFISTG

SEQ ID NO: 24600 - protein, 11 aa, BK virus
KIPSIFISTGI

SEQ ID NO: 24601 - protein, 11 aa, BK virus
IPSIFISTGIR

SEQ ID NO: 24602 - protein, 11 aa, BK virus
PSIFISTGIRY

SEQ ID NO: 24603 - protein, 11 aa, BK virus
SIFISTGIRYP

SEQ ID NO: 24604 - protein, 11 aa, BK virus
IFISTGIRYPA

SEQ ID NO: 24605 - protein, 11 aa, BK virus
FISTGIRYPAL

SEQ ID NO: 24606 - protein, 11 aa, BK virus
ISTGIRYPALN

SEQ ID NO: 24607 - protein, 11 aa, BK virus
STGIRYPALNW

SEQ ID NO: 24608 - protein, 11 aa, BK virus
TGIRYPALNWI

SEQ ID NO: 24609 - protein, 11 aa, BK virus
GIRYPALNWIS

SEQ ID NO: 24610 - protein, 11 aa, BK virus
IRYPALNWISI

SEQ ID NO: 24611 - protein, 11 aa, BK virus
RYPALNWISIV

SEQ ID NO: 24612 - protein, 11 aa, BK virus
YPALNWISIVF

SEQ ID NO: 24613 - protein, 11 aa, BK virus
PALNWISIVFV

SEQ ID NO: 24614 - protein, 11 aa, BK virus
ALNWISIVFVQ

SEQ ID NO: 24615 - protein, 11 aa, BK virus
LNWISIVFVQI

SEQ ID NO: 24616 - protein, 11 aa, BK virus
NWISIVFVQIG

SEQ ID NO: 24617 - protein, 11 aa, BK virus
WISIVFVQIGL

SEQ ID NO: 24618 - protein, 11 aa, BK virus
ISIVFVQIGLM

SEQ ID NO: 24619 - protein, 11 aa, BK virus
SIVFVQIGLMV

SEQ ID NO: 24620 - protein, 11 aa, BK virus
IVFVQIGLMVS

SEQ ID NO: 24621 - protein, 11 aa, BK virus
VFVQIGLMVSI

SEQ ID NO: 24622 - protein, 11 aa, BK virus
FVQIGLMVSIH

SEQ ID NO: 24623 - protein, 11 aa, BK virus
VQIGLMVSIHY

SEQ ID NO: 24624 - protein, 11 aa, BK virus
QIGLMVSIHYL

SEQ ID NO: 24625 - protein, 11 aa, BK virus
IGLMVSIHYLG

SEQ ID NO: 24626 - protein, 11 aa, BK virus
GLMVSIHYLGL

SEQ ID NO: 24627 - protein, 11 aa, BK virus
LMVSIHYLGLG

SEQ ID NO: 24628 - protein, 11 aa, BK virus
MVSIHYLGLGC

SEQ ID NO: 24629 - protein, 11 aa, BK virus
VSIHYLGLGCW

SEQ ID NO: 24630 - protein, 11 aa, BK virus
SIHYLGLGCWV

SEQ ID NO: 24631 - protein, 11 aa, BK virus
IHYLGLGCWVF

SEQ ID NO: 24632 - protein, 11 aa, BK virus
HYLGLGCWVFR

SEQ ID NO: 24633 - protein, 11 aa, BK virus
YLGLGCWVFRG

SEQ ID NO: 24634 - protein, 11 aa, BK virus
LGLGCWVFRGY

SEQ ID NO: 24635 - protein, 11 aa, BK virus
GLGCWVFRGYS

SEQ ID NO: 24636 - protein, 11 aa, BK virus
LGCWVFRGYST

SEQ ID NO: 24637 - protein, 11 aa, BK virus
GCWVFRGYSTI

SEQ ID NO: 24638 - protein, 11 aa, BK virus
CWVFRGYSTIR

SEQ ID NO: 24639 - protein, 11 aa, BK virus
WVFRGYSTIRV

SEQ ID NO: 24640 - protein, 11 aa, BK virus
VFRGYSTIRVL

SEQ ID NO: 24641 - protein, 11 aa, BK virus
HSLHFQGFSTY

SEQ ID NO: 24642 - protein, 11 aa, BK virus
SLHFQGFSTYS

SEQ ID NO: 24643 - protein, 11 aa, BK virus
LHFQGFSTYSK

SEQ ID NO: 24644 - protein, 11 aa, BK virus
HFQGFSTYSKE

SEQ ID NO: 24645 - protein, 11 aa, BK virus
FQGFSTYSKEV

SEQ ID NO: 24646 - protein, 11 aa, BK virus
QGFSTYSKEVE

SEQ ID NO: 24647 - protein, 11 aa, BK virus
GFSTYSKEVEI

SEQ ID NO: 24648 - protein, 11 aa, BK virus
FSTYSKEVEIT

SEQ ID NO: 24649 - protein, 11 aa, BK virus
STYSKEVEITA

SEQ ID NO: 24650 - protein, 11 aa, BK virus
TYSKEVEITAL

SEQ ID NO: 24651 - protein, 11 aa, BK virus
YSKEVEITALN

SEQ ID NO: 24652 - protein, 11 aa, BK virus
SKEVEITALNR

SEQ ID NO: 24653 - protein, 11 aa, BK virus
KEVEITALNRF

SEQ ID NO: 24654 - protein, 11 aa, BK virus
EVEITALNRFS

SEQ ID NO: 24655 - protein, 11 aa, BK virus
VEITALNRFSS

SEQ ID NO: 24656 - protein, 11 aa, BK virus
EITALNRFSST

SEQ ID NO: 24657 - protein, 11 aa, BK virus
ITALNRFSSTM

SEQ ID NO: 24658 - protein, 11 aa, BK virus
TALNRFSSTML

SEQ ID NO: 24659 - protein, 11 aa, BK virus
ALNRFSSTMLM

SEQ ID NO: 24660 - protein, 11 aa, BK virus
LNRFSSTMLMH

SEQ ID NO: 24661 - protein, 11 aa, BK virus
NRFSSTMLMHF

SEQ ID NO: 24662 - protein, 11 aa, BK virus
RFSSTMLMHFL

SEQ ID NO: 24663 - protein, 11 aa, BK virus
PCMKVKHASYS

SEQ ID NO: 24664 - protein, 11 aa, BK virus
CMKVKHASYSN

SEQ ID NO: 24665 - protein, 11 aa, BK virus
MKVKHASYSNN

SEQ ID NO: 24666 - protein, 11 aa, BK virus
KVKHASYSNNL

SEQ ID NO: 24667 - protein, 11 aa, BK virus
VKHASYSNNLC

SEQ ID NO: 24668 - protein, 11 aa, BK virus
KHASYSNNLCL

SEQ ID NO: 24669 - protein, 11 aa, BK virus
HASYSNNLCLY

SEQ ID NO: 24670 - protein, 11 aa, BK virus
ASYSNNLCLYS

SEQ ID NO: 24671 - protein, 11 aa, BK virus
SYSNNLCLYSY

SEQ ID NO: 24672 - protein, 11 aa, BK virus
YSNNLCLYSYS

SEQ ID NO: 24673 - protein, 11 aa, BK virus
SNNLCLYSYSL

SEQ ID NO: 24674 - protein, 11 aa, BK virus
NNLCLYSYSLP

SEQ ID NO: 24675 - protein, 11 aa, BK virus
NLCLYSYSLPH

SEQ ID NO: 24676 - protein, 11 aa, BK virus
LCLYSYSLPHQ

SEQ ID NO: 24677 - protein, 11 aa, BK virus
IGEGNSCCAVT

SEQ ID NO: 24678 - protein, 11 aa, BK virus
GEGNSCCAVTG

SEQ ID NO: 24679 - protein, 11 aa, BK virus
EGNSCCAVTGK

SEQ ID NO: 24680 - protein, 11 aa, BK virus
GNSCCAVTGKH

SEQ ID NO: 24681 - protein, 11 aa, BK virus
NSCCAVTGKHF

SEQ ID NO: 24682 - protein, 11 aa, BK virus
SCCAVTGKHFS

SEQ ID NO: 24683 - protein, 11 aa, BK virus
CCAVTGKHFSL

SEQ ID NO: 24684 - protein, 11 aa, BK virus
CAVTGKHFSLW

SEQ ID NO: 24685 - protein, 11 aa, BK virus
AVTGKHFSLWA

SEQ ID NO: 24686 - protein, 11 aa, BK virus
VTGKHFSLWAI

SEQ ID NO: 24687 - protein, 11 aa, BK virus
TGKHFSLWAIT

SEQ ID NO: 24688 - protein, 11 aa, BK virus
GKHFSLWAITA

SEQ ID NO: 24689 - protein, 11 aa, BK virus
KHFSLWAITAK

SEQ ID NO: 24690 - protein, 11 aa, BK virus
HFSLWAITAKV

SEQ ID NO: 24691 - protein, 11 aa, BK virus
FSLWAITAKVI

SEQ ID NO: 24692 - protein, 11 aa, BK virus
SLWAITAKVIF

SEQ ID NO: 24693 - protein, 11 aa, BK virus
LWAITAKVIFS

SEQ ID NO: 24694 - protein, 11 aa, BK virus
WAITAKVIFST

SEQ ID NO: 24695 - protein, 11 aa, BK virus
TKAPKVFIWIP

SEQ ID NO: 24696 - protein, 11 aa, BK virus
KAPKVFIWIPH

SEQ ID NO: 24697 - protein, 11 aa, BK virus
APKVFIWIPHF

SEQ ID NO: 24698 - protein, 11 aa, BK virus
PKVFIWIPHFW

SEQ ID NO: 24699 - protein, 11 aa, BK virus
KVFIWIPHFWV

SEQ ID NO: 24700 - protein, 11 aa, BK virus
EAFYLCNSIYP

SEQ ID NO: 24701 - protein, 11 aa, BK virus
AFYLCNSIYPS

SEQ ID NO: 24702 - protein, 11 aa, BK virus
FYLCNSIYPSF

SEQ ID NO: 24703 - protein, 11 aa, BK virus
YLCNSIYPSFN

SEQ ID NO: 24704 - protein, 11 aa, BK virus
LCNSIYPSFNF

SEQ ID NO: 24705 - protein, 11 aa, BK virus
FWHLHGFLWLF

SEQ ID NO: 24706 - protein, 11 aa, BK virus
WHLHGFLWLFG

SEQ ID NO: 24707 - protein, 11 aa, BK virus
HLHGFLWLFGS

SEQ ID NO: 24708 - protein, 11 aa, BK virus
LHGFLWLFGSC

SEQ ID NO: 24709 - protein, 11 aa, BK virus
HGFLWLFGSCP

SEQ ID NO: 24710 - protein, 11 aa, BK virus
GFLWLFGSCPW

SEQ ID NO: 24711 - protein, 11 aa, BK virus
FLWLFGSCPWT

SEQ ID NO: 24712 - protein, 11 aa, BK virus
LWLFGSCPWTL

SEQ ID NO: 24713 - protein, 11 aa, BK virus
WLFGSCPWTLS

SEQ ID NO: 24714 - protein, 11 aa, BK virus
LFGSCPWTLSF

SEQ ID NO: 24715 - protein, 11 aa, BK virus
FGSCPWTLSFS

SEQ ID NO: 24716 - protein, 11 aa, BK virus
GSCPWTLSFSF

SEQ ID NO: 24717 - protein, 11 aa, BK virus
SCPWTLSFSFG

SEQ ID NO: 24718 - protein, 11 aa, BK virus
CPWTLSFSFGW

SEQ ID NO: 24719 - protein, 11 aa, BK virus
PWTLSFSFGWG

SEQ ID NO: 24720 - protein, 11 aa, BK virus
WTLSFSFGWGH

SEQ ID NO: 24721 - protein, 11 aa, BK virus
TLSFSFGWGHL

SEQ ID NO: 24722 - protein, 11 aa, BK virus
LSFSFGWGHLH

SEQ ID NO: 24723 - protein, 11 aa, BK virus
SFSFGWGHLHM

SEQ ID NO: 24724 - protein, 11 aa, BK virus
FSFGWGHLHML

SEQ ID NO: 24725 - protein, 11 aa, BK virus
SFGWGHLHMLQ

SEQ ID NO: 24726 - protein, 11 aa, BK virus
FGWGHLHMLQE

SEQ ID NO: 24727 - protein, 11 aa, BK virus
GWGHLHMLQEQ

SEQ ID NO: 24728 - protein, 11 aa, BK virus
WGHLHMLQEQV

SEQ ID NO: 24729 - protein, 11 aa, BK virus
GHLHMLQEQVL

SEQ ID NO: 24730 - protein, 11 aa, BK virus
HLHMLQEQVLQ

SEQ ID NO: 24731 - protein, 11 aa, BK virus
LHMLQEQVLQS

SEQ ID NO: 24732 - protein, 11 aa, BK virus
HMLQEQVLQSR

SEQ ID NO: 24733 - protein, 11 aa, BK virus
MLQEQVLQSRT

SEQ ID NO: 24734 - protein, 11 aa, BK virus
LQEQVLQSRTG

SEQ ID NO: 24735 - protein, 11 aa, BK virus
QEQVLQSRTGL

SEQ ID NO: 24736 - protein, 11 aa, BK virus
EQVLQSRTGLE

SEQ ID NO: 24737 - protein, 11 aa, BK virus
QVLQSRTGLEV

SEQ ID NO: 24738 - protein, 11 aa, BK virus
VLQSRTGLEVK

SEQ ID NO: 24739 - protein, 11 aa, BK virus
LQSRTGLEVKA

SEQ ID NO: 24740 - protein, 11 aa, BK virus
QSRTGLEVKAT

SEQ ID NO: 24741 - protein, 11 aa, BK virus
SRTGLEVKATS

SEQ ID NO: 24742 - protein, 11 aa, BK virus
RTGLEVKATSI

SEQ ID NO: 24743 - protein, 11 aa, BK virus
TGLEVKATSIE

SEQ ID NO: 24744 - protein, 11 aa, BK virus
GLEVKATSIEE

SEQ ID NO: 24745 - protein, 11 aa, BK virus
LEVKATSIEEQ

SEQ ID NO: 24746 - protein, 11 aa, BK virus
EVKATSIEEQF

SEQ ID NO: 24747 - protein, 11 aa, BK virus
VKATSIEEQFF

SEQ ID NO: 24748 - protein, 11 aa, BK virus
KATSIEEQFFD

SEQ ID NO: 24749 - protein, 11 aa, BK virus
TLLNVHFVDFL

SEQ ID NO: 24750 - protein, 11 aa, BK virus
LLNVHFVDFLS

SEQ ID NO: 24751 - protein, 11 aa, BK virus
LNVHFVDFLSP

SEQ ID NO: 24752 - protein, 11 aa, BK virus
NVHFVDFLSPF

SEQ ID NO: 24753 - protein, 11 aa, BK virus
VHFVDFLSPFF

SEQ ID NO: 24754 - protein, 11 aa, BK virus
HFVDFLSPFFV

SEQ ID NO: 24755 - protein, 11 aa, BK virus
LLLYCQHHLYY

SEQ ID NO: 24756 - protein, 11 aa, BK virus
LLYCQHHLYYK

SEQ ID NO: 24757 - protein, 11 aa, BK virus
LYCQHHLYYKY

SEQ ID NO: 24758 - protein, 11 aa, BK virus
YCQHHLYYKYG

SEQ ID NO: 24759 - protein, 11 aa, BK virus
CQHHLYYKYGQ

SEQ ID NO: 24760 - protein, 11 aa, BK virus
QHHLYYKYGQN

SEQ ID NO: 24761 - protein, 11 aa, BK virus
HHLYYKYGQNV

SEQ ID NO: 24762 - protein, 11 aa, BK virus
HLYYKYGQNVH

SEQ ID NO: 24763 - protein, 11 aa, BK virus
LYYKYGQNVHG

SEQ ID NO: 24764 - protein, 11 aa, BK virus
YYKYGQNVHGY

SEQ ID NO: 24765 - protein, 11 aa, BK virus
YKYGQNVHGYL

SEQ ID NO: 24766 - protein, 11 aa, BK virus
KYGQNVHGYLP

SEQ ID NO: 24767 - protein, 11 aa, BK virus
YGQNVHGYLPF

SEQ ID NO: 24768 - protein, 11 aa, BK virus
GQNVHGYLPFQ

SEQ ID NO: 24769 - protein, 11 aa, BK virus
QNVHGYLPFQL

SEQ ID NO: 24770 - protein, 11 aa, BK virus
NVHGYLPFQLL

SEQ ID NO: 24771 - protein, 11 aa, BK virus
VHGYLPFQLLV

SEQ ID NO: 24772 - protein, 11 aa, BK virus
GKDQNNIVEYN

SEQ ID NO: 24773 - protein, 11 aa, BK virus
KDQNNIVEYNY

SEQ ID NO: 24774 - protein, 11 aa, BK virus
DQNNIVEYNYK

SEQ ID NO: 24775 - protein, 11 aa, BK virus
QNNIVEYNYKS

SEQ ID NO: 24776 - protein, 11 aa, BK virus
NNIVEYNYKSL

SEQ ID NO: 24777 - protein, 11 aa, BK virus
KIFLFFSAIPV

SEQ ID NO: 24778 - protein, 11 aa, BK virus
IFLFFSAIPVR

SEQ ID NO: 24779 - protein, 11 aa, BK virus
FLFFSAIPVRL

SEQ ID NO: 24780 - protein, 11 aa, BK virus
QKYLHQETEYH

SEQ ID NO: 24781 - protein, 11 aa, BK virus
KYLHQETEYHS

SEQ ID NO: 24782 - protein, 11 aa, BK virus
YLHQETEYHST

SEQ ID NO: 24783 - protein, 11 aa, BK virus
LHQETEYHSTH

SEQ ID NO: 24784 - protein, 11 aa, BK virus
HQETEYHSTHL

SEQ ID NO: 24785 - protein, 11 aa, BK virus
QETEYHSTHLG

SEQ ID NO: 24786 - protein, 11 aa, BK virus
TIPKPCLIADR

SEQ ID NO: 24787 - protein, 11 aa, BK virus
IPKPCLIADRG

SEQ ID NO: 24788 - protein, 11 aa, BK virus
PKPCLIADRGL

SEQ ID NO: 24789 - protein, 11 aa, BK virus
KPCLIADRGLQ

SEQ ID NO: 24790 - protein, 11 aa, BK virus
PCLIADRGLQW

SEQ ID NO: 24791 - protein, 11 aa, BK virus
CLIADRGLQWK

SEQ ID NO: 24792 - protein, 11 aa, BK virus
LIADRGLQWKL

SEQ ID NO: 24793 - protein, 11 aa, BK virus
IADRGLQWKLC

SEQ ID NO: 24794 - protein, 11 aa, BK virus
ADRGLQWKLCD

SEQ ID NO: 24795 - protein, 11 aa, BK virus
DRGLQWKLCDP

SEQ ID NO: 24796 - protein, 11 aa, BK virus
RGLQWKLCDPN

SEQ ID NO: 24797 - protein, 11 aa, BK virus
GLQWKLCDPNH

SEQ ID NO: 24798 - protein, 11 aa, BK virus
LQWKLCDPNHQ

SEQ ID NO: 24799 - protein, 11 aa, BK virus
QWKLCDPNHQR

SEQ ID NO: 24800 - protein, 11 aa, BK virus
WKLCDPNHQRT

SEQ ID NO: 24801 - protein, 11 aa, BK virus
KLCDPNHQRTY

SEQ ID NO: 24802 - protein, 11 aa, BK virus
LCDPNHQRTYT

SEQ ID NO: 24803 - protein, 11 aa, BK virus
CDPNHQRTYTL

SEQ ID NO: 24804 - protein, 11 aa, BK virus
DPNHQRTYTLL

SEQ ID NO: 24805 - protein, 11 aa, BK virus
PNHQRTYTLLE

SEQ ID NO: 24806 - protein, 11 aa, BK virus
NHQRTYTLLEL

SEQ ID NO: 24807 - protein, 11 aa, BK virus
HQRTYTLLELR

SEQ ID NO: 24808 - protein, 11 aa, BK virus
QRTYTLLELRN

SEQ ID NO: 24809 - protein, 11 aa, BK virus
PQEHQQLQHMF

SEQ ID NO: 24810 - protein, 11 aa, BK virus
QEHQQLQHMFE

SEQ ID NO: 24811 - protein, 11 aa, BK virus
EHQQLQHMFEE

SEQ ID NO: 24812 - protein, 11 aa, BK virus
HQQLQHMFEEL

SEQ ID NO: 24813 - protein, 11 aa, BK virus
QQLQHMFEELG

SEQ ID NO: 24814 - protein, 11 aa, BK virus
QLQHMFEELGL

SEQ ID NO: 24815 - protein, 11 aa, BK virus
QQQPPQQQFQP

SEQ ID NO: 24816 - protein, 11 aa, BK virus
QQPPQQQFQPL

SEQ ID NO: 24817 - protein, 11 aa, BK virus
QPPQQQFQPLK

SEQ ID NO: 24818 - protein, 11 aa, BK virus
PPQQQFQPLKI

SEQ ID NO: 24819 - protein, 11 aa, BK virus
PQQQFQPLKIL

SEQ ID NO: 24820 - protein, 11 aa, BK virus
QQQFQPLKILW

SEQ ID NO: 24821 - protein, 11 aa, BK virus
QQFQPLKILWQ

SEQ ID NO: 24822 - protein, 11 aa, BK virus
QFQPLKILWQQ

SEQ ID NO: 24823 - protein, 11 aa, BK virus
FQPLKILWQQQ

SEQ ID NO: 24824 - protein, 11 aa, BK virus
QPLKILWQQQP

SEQ ID NO: 24825 - protein, 11 aa, BK virus
PLKILWQQQPQ

SEQ ID NO: 24826 - protein, 11 aa, BK virus
LKILWQQQPQI

SEQ ID NO: 24827 - protein, 11 aa, BK virus
KILWQQQPQIH

SEQ ID NO: 24828 - protein, 11 aa, BK virus
ILWQQQPQIHW

SEQ ID NO: 24829 - protein, 11 aa, BK virus
LWQQQPQIHWQ

SEQ ID NO: 24830 - protein, 11 aa, BK virus
WQQQPQIHWQL

SEQ ID NO: 24831 - protein, 11 aa, BK virus
QQQPQIHWQLG

SEQ ID NO: 24832 - protein, 11 aa, BK virus
QQPQIHWQLGP

SEQ ID NO: 24833 - protein, 11 aa, BK virus
QPQIHWQLGPP

SEQ ID NO: 24834 - protein, 11 aa, BK virus
PQIHWQLGPPK

SEQ ID NO: 24835 - protein, 11 aa, BK virus
QIHWQLGPPKV

SEQ ID NO: 24836 - protein, 11 aa, BK virus
IHWQLGPPKVL

SEQ ID NO: 24837 - protein, 11 aa, BK virus
HWQLGPPKVLE

SEQ ID NO: 24838 - protein, 11 aa, BK virus
WQLGPPKVLEQ

SEQ ID NO: 24839 - protein, 11 aa, BK virus
QLGPPKVLEQH

SEQ ID NO: 24840 - protein, 11 aa, BK virus
LGPPKVLEQHP

SEQ ID NO: 24841 - protein, 11 aa, BK virus
TWKYKKKGITY

SEQ ID NO: 24842 - protein, 11 aa, BK virus
WKYKKKGITYL

SEQ ID NO: 24843 - protein, 11 aa, BK virus
KYKKKGITYLG

SEQ ID NO: 24844 - protein, 11 aa, BK virus
YKKKGITYLGV

SEQ ID NO: 24845 - protein, 11 aa, BK virus
KKKGITYLGVF

SEQ ID NO: 24846 - protein, 11 aa, BK virus
KKGITYLGVFY

SEQ ID NO: 24847 - protein, 11 aa, BK virus
KGITYLGVFYR

SEQ ID NO: 24848 - protein, 11 aa, BK virus
GITYLGVFYRV

SEQ ID NO: 24849 - protein, 11 aa, BK virus
ITYLGVFYRVF

SEQ ID NO: 24850 - protein, 11 aa, BK virus
TYLGVFYRVFY

SEQ ID NO: 24851 - protein, 11 aa, BK virus
YLGVFYRVFYS

SEQ ID NO: 24852 - protein, 11 aa, BK virus
LGVFYRVFYSR

SEQ ID NO: 24853 - protein, 11 aa, BK virus
SSGTFVFPVYT

SEQ ID NO: 24854 - protein, 11 aa, BK virus
SGTFVFPVYTV

SEQ ID NO: 24855 - protein, 11 aa, BK virus
GTFVFPVYTVF

SEQ ID NO: 24856 - protein, 11 aa, BK virus
TFVFPVYTVFT

SEQ ID NO: 24857 - protein, 11 aa, BK virus
FVFPVYTVFTS

SEQ ID NO: 24858 - protein, 11 aa, BK virus
VFPVYTVFTST

SEQ ID NO: 24859 - protein, 11 aa, BK virus
FPVYTVFTSTK

SEQ ID NO: 24860 - protein, 11 aa, BK virus
PVYTVFTSTKF

SEQ ID NO: 24861 - protein, 11 aa, BK virus
VYTVFTSTKFQ

SEQ ID NO: 24862 - protein, 11 aa, BK virus
YTVFTSTKFQQ

SEQ ID NO: 24863 - protein, 11 aa, BK virus
TVFTSTKFQQK

SEQ ID NO: 24864 - protein, 11 aa, BK virus
VFTSTKFQQKL

SEQ ID NO: 24865 - protein, 11 aa, BK virus
NKNKNPLSSFF

SEQ ID NO: 24866 - protein, 11 aa, BK virus
KNKNPLSSFFC

SEQ ID NO: 24867 - protein, 11 aa, BK virus
NKNPLSSFFCS

SEQ ID NO: 24868 - protein, 11 aa, BK virus
KNPLSSFFCSS

SEQ ID NO: 24869 - protein, 11 aa, BK virus
NPLSSFFCSSP

SEQ ID NO: 24870 - protein, 11 aa, BK virus
PLSSFFCSSPG

SEQ ID NO: 24871 - protein, 11 aa, BK virus
LSSFFCSSPGF

SEQ ID NO: 24872 - protein, 11 aa, BK virus
SSFFCSSPGFT

SEQ ID NO: 24873 - protein, 11 aa, BK virus
SFFCSSPGFTN

SEQ ID NO: 24874 - protein, 11 aa, BK virus
FFCSSPGFTNF

SEQ ID NO: 24875 - protein, 11 aa, BK virus
FCSSPGFTNFH

SEQ ID NO: 24876 - protein, 11 aa, BK virus
QLAQNHGLCPV

SEQ ID NO: 24877 - protein, 11 aa, BK virus
LGTRPRFLGSQ

SEQ ID NO: 24878 - protein, 11 aa, BK virus
GTRPRFLGSQN

SEQ ID NO: 24879 - protein, 11 aa, BK virus
TRPRFLGSQNM

SEQ ID NO: 24880 - protein, 11 aa, BK virus
RPRFLGSQNMS

SEQ ID NO: 24881 - protein, 11 aa, BK virus
PRFLGSQNMSV

SEQ ID NO: 24882 - protein, 11 aa, BK virus
RFLGSQNMSVM

SEQ ID NO: 24883 - protein, 11 aa, BK virus
FLGSQNMSVMH

SEQ ID NO: 24884 - protein, 11 aa, BK virus
LGSQNMSVMHF

SEQ ID NO: 24885 - protein, 11 aa, BK virus
GSQNMSVMHFP

SEQ ID NO: 24886 - protein, 11 aa, BK virus
SQNMSVMHFPS

SEQ ID NO: 24887 - protein, 11 aa, BK virus
AAPPCESCTFL

SEQ ID NO: 24888 - protein, 11 aa, BK virus
APPCESCTFLP

SEQ ID NO: 24889 - protein, 11 aa, BK virus
PPCESCTFLPE

SEQ ID NO: 24890 - protein, 11 aa, BK virus
PCESCTFLPEV

SEQ ID NO: 24891 - protein, 11 aa, BK virus
CESCTFLPEVM

SEQ ID NO: 24892 - protein, 11 aa, BK virus
ESCTFLPEVMV

SEQ ID NO: 24893 - protein, 11 aa, BK virus
SCTFLPEVMVW

SEQ ID NO: 24894 - protein, 11 aa, BK virus
CTFLPEVMVWL

SEQ ID NO: 24895 - protein, 11 aa, BK virus
TFLPEVMVWLH

SEQ ID NO: 24896 - protein, 11 aa, BK virus
FLPEVMVWLHS

SEQ ID NO: 24897 - protein, 11 aa, BK virus
LPEVMVWLHSP

SEQ ID NO: 24898 - protein, 11 aa, BK virus
PEVMVWLHSPV

SEQ ID NO: 24899 - protein, 11 aa, BK virus
EVMVWLHSPVS

SEQ ID NO: 24900 - protein, 11 aa, BK virus
VMVWLHSPVSH

SEQ ID NO: 24901 - protein, 11 aa, BK virus
MVWLHSPVSHA

SEQ ID NO: 24902 - protein, 11 aa, BK virus
VWLHSPVSHAL

SEQ ID NO: 24903 - protein, 11 aa, BK virus
WLHSPVSHALS

SEQ ID NO: 24904 - protein, 11 aa, BK virus
LHSPVSHALSF

SEQ ID NO: 24905 - protein, 11 aa, BK virus
HSPVSHALSFL

SEQ ID NO: 24906 - protein, 11 aa, BK virus
SPVSHALSFLR

SEQ ID NO: 24907 - protein, 11 aa, BK virus
PVSHALSFLRS

SEQ ID NO: 24908 - protein, 11 aa, BK virus
VSHALSFLRSW

SEQ ID NO: 24909 - protein, 11 aa, BK virus
SHALSFLRSWF

SEQ ID NO: 24910 - protein, 11 aa, BK virus
HALSFLRSWFG

SEQ ID NO: 24911 - protein, 11 aa, BK virus
ALSFLRSWFGC

SEQ ID NO: 24912 - protein, 11 aa, BK virus
LSFLRSWFGCI

SEQ ID NO: 24913 - protein, 11 aa, BK virus
SFLRSWFGCIP

SEQ ID NO: 24914 - protein, 11 aa, BK virus
FLRSWFGCIPW

SEQ ID NO: 24915 - protein, 11 aa, BK virus
LRSWFGCIPWV

SEQ ID NO: 24916 - protein, 11 aa, BK virus
RSWFGCIPWVS

SEQ ID NO: 24917 - protein, 11 aa, BK virus
SWFGCIPWVSS

SEQ ID NO: 24918 - protein, 11 aa, BK virus
WFGCIPWVSSS

SEQ ID NO: 24919 - protein, 11 aa, BK virus
FGCIPWVSSSS

SEQ ID NO: 24920 - protein, 11 aa, BK virus
GCIPWVSSSSL

SEQ ID NO: 24921 - protein, 11 aa, BK virus
CIPWVSSSSLW

SEQ ID NO: 24922 - protein, 11 aa, BK virus
IPWVSSSSLWP

SEQ ID NO: 24923 - protein, 11 aa, BK virus
PWVSSSSLWPF

SEQ ID NO: 24924 - protein, 11 aa, BK virus
WVSSSSLWPFF

SEQ ID NO: 24925 - protein, 11 aa, BK virus
VSSSSLWPFFL

SEQ ID NO: 24926 - protein, 11 aa, BK virus
YIRGRGRLCLH

SEQ ID NO: 24927 - protein, 11 aa, BK virus
IRGRGRLCLHP

SEQ ID NO: 24928 - protein, 11 aa, BK virus
RGRGRLCLHPF

SEQ ID NO: 24929 - protein, 11 aa, BK virus
GRGRLCLHPFS

SEQ ID NO: 24930 - protein, 11 aa, BK virus
RGRLCLHPFSQ

SEQ ID NO: 24931 - protein, 11 aa, BK virus
GRLCLHPFSQV

SEQ ID NO: 24932 - protein, 22 aa, BK virus
RLCLHPFSQVVLCLHPFSQVVR

SEQ ID NO: 24933 - protein, 11 aa, BK virus
CLHPFSQVVRV

SEQ ID NO: 24934 - protein, 11 aa, BK virus
LHPFSQVVRVW

SEQ ID NO: 24935 - protein, 11 aa, BK virus
HPFSQVVRVWR

SEQ ID NO: 24936 - protein, 11 aa, BK virus
PFSQVVRVWRL

SEQ ID NO: 24937 - protein, 11 aa, BK virus
FSQVVRVWRLF

SEQ ID NO: 24938 - protein, 11 aa, BK virus
SQVVRVWRLFL

SEQ ID NO: 24939 - protein, 11 aa, BK virus
QVVRVWRLFLR

SEQ ID NO: 24940 - protein, 11 aa, BK virus
VVRVWRLFLRP

SEQ ID NO: 24941 - protein, 11 aa, BK virus
VRVWRLFLRPS

SEQ ID NO: 24942 - protein, 11 aa, BK virus
RVWRLFLRPSK

SEQ ID NO: 24943 - protein, 11 aa, BK virus
VWRLFLRPSKT

SEQ ID NO: 24944 - protein, 11 aa, BK virus
WRLFLRPSKTI

SEQ ID NO: 24945 - protein, 11 aa, BK virus
RLFLRPSKTIW

SEQ ID NO: 24946 - protein, 11 aa, BK virus
LFLRPSKTIWG

SEQ ID NO: 24947 - protein, 11 aa, BK virus
FLRPSKTIWGN

SEQ ID NO: 24948 - protein, 11 aa, BK virus
LRPSKTIWGNP

SEQ ID NO: 24949 - protein, 11 aa, BK virus
RPSKTIWGNPY

SEQ ID NO: 24950 - protein, 11 aa, BK virus
PSKTIWGNPYS

SEQ ID NO: 24951 - protein, 11 aa, BK virus
SKTIWGNPYSF

SEQ ID NO: 24952 - protein, 11 aa, BK virus
KTIWGNPYSFA

SEQ ID NO: 24953 - protein, 11 aa, BK virus
TIWGNPYSFAI

SEQ ID NO: 24954 - protein, 11 aa, BK virus
IWGNPYSFAIF

SEQ ID NO: 24955 - protein, 11 aa, BK virus
WGNPYSFAIFA

SEQ ID NO: 24956 - protein, 11 aa, BK virus
GNPYSFAIFAK

SEQ ID NO: 24957 - protein, 13 aa, BK virus
FCKNCKRIGISPN

SEQ ID NO: 24958 - protein, 13 aa, BK virus
CKNCKRIGISPNS

SEQ ID NO: 24959 - protein, 13 aa, BK virus
KNCKRIGISPNSF

SEQ ID NO: 24960 - protein, 13 aa, BK virus
NCKRIGISPNSFA

SEQ ID NO: 24961 - protein, 13 aa, BK virus
CKRIGISPNSFAR

SEQ ID NO: 24962 - protein, 13 aa, BK virus
KRIGISPNSFARP

SEQ ID NO: 24963 - protein, 13 aa, BK virus
RIGISPNSFARPQ

SEQ ID NO: 24964 - protein, 13 aa, BK virus
IGISPNSFARPQK

SEQ ID NO: 24965 - protein, 13 aa, BK virus
GISPNSFARPQKK

SEQ ID NO: 24966 - protein, 13 aa, BK virus
ISPNSFARPQKKP

SEQ ID NO: 24967 - protein, 13 aa, BK virus
SPNSFARPQKKPP

SEQ ID NO: 24968 - protein, 13 aa, BK virus
PNSFARPQKKPPH

SEQ ID NO: 24969 - protein, 13 aa, BK virus
NSFARPQKKPPHP

SEQ ID NO: 24970 - protein, 13 aa, BK virus
SFARPQKKPPHPY

SEQ ID NO: 24971 - protein, 13 aa, BK virus
FARPQKKPPHPYY

SEQ ID NO: 24972 - protein, 13 aa, BK virus
ARPQKKPPHPYYL

SEQ ID NO: 24973 - protein, 13 aa, BK virus
RPQKKPPHPYYLR

SEQ ID NO: 24974 - protein, 13 aa, BK virus
PQKKPPHPYYLRE

SEQ ID NO: 24975 - protein, 13 aa, BK virus
QKKPPHPYYLRER

SEQ ID NO: 24976 - protein, 13 aa, BK virus
KKPPHPYYLRERV

SEQ ID NO: 24977 - protein, 13 aa, BK virus
KPPHPYYLRERVE

SEQ ID NO: 24978 - protein, 13 aa, BK virus
PPHPYYLRERVEA

SEQ ID NO: 24979 - protein, 13 aa, BK virus
PHPYYLRERVEAE

SEQ ID NO: 24980 - protein, 13 aa, BK virus
HPYYLRERVEAEA

SEQ ID NO: 24981 - protein, 13 aa, BK virus
PYYLRERVEAEAA

SEQ ID NO: 24982 - protein, 13 aa, BK virus
YYLRERVEAEAAS

SEQ ID NO: 24983 - protein, 13 aa, BK virus
YLRERVEAEAASA

SEQ ID NO: 24984 - protein, 13 aa, BK virus
LRERVEAEAASAS

SEQ ID NO: 24985 - protein, 13 aa, BK virus
RERVEAEAASASY

SEQ ID NO: 24986 - protein, 13 aa, BK virus
ERVEAEAASASYI

SEQ ID NO: 24987 - protein, 13 aa, BK virus
RVEAEAASASYIL

SEQ ID NO: 24988 - protein, 13 aa, BK virus
KKRPQGGAAYPWN

SEQ ID NO: 24989 - protein, 13 aa, BK virus
KRPQGGAAYPWNA

SEQ ID NO: 24990 - protein, 13 aa, BK virus
RPQGGAAYPWNAA

SEQ ID NO: 24991 - protein, 13 aa, BK virus
PQGGAAYPWNAAK

SEQ ID NO: 24992 - protein, 13 aa, BK virus
QGGAAYPWNAAKP

SEQ ID NO: 24993 - protein, 13 aa, BK virus
PQEGKCMTHRGMQ

SEQ ID NO: 24994 - protein, 13 aa, BK virus
QEGKCMTHRGMQP

SEQ ID NO: 24995 - protein, 13 aa, BK virus
EGKCMTHRGMQPN

SEQ ID NO: 24996 - protein, 13 aa, BK virus
GKCMTHRGMQPNH

SEQ ID NO: 24997 - protein, 13 aa, BK virus
KCMTHRGMQPNHD

SEQ ID NO: 24998 - protein, 13 aa, BK virus
CMTHRGMQPNHDL

SEQ ID NO: 24999 - protein, 13 aa, BK virus
MTHRGMQPNHDLR

SEQ ID NO: 25000 - protein, 13 aa, BK virus
THRGMQPNHDLRK

SEQ ID NO: 25001 - protein, 13 aa, BK virus
HRGMQPNHDLRKE

SEQ ID NO: 25002 - protein, 13 aa, BK virus
RGMQPNHDLRKES

SEQ ID NO: 25003 - protein, 13 aa, BK virus
GMQPNHDLRKESA

SEQ ID NO: 25004 - protein, 13 aa, BK virus
LTGRSCLPMECSQ

SEQ ID NO: 25005 - protein, 13 aa, BK virus
TGRSCLPMECSQT

SEQ ID NO: 25006 - protein, 13 aa, BK virus
GRSCLPMECSQTM

SEQ ID NO: 25007 - protein, 13 aa, BK virus
RSCLPMECSQTMT

SEQ ID NO: 25008 - protein, 13 aa, BK virus
SCLPMECSQTMTS

SEQ ID NO: 25009 - protein, 13 aa, BK virus
CLPMECSQTMTSG

SEQ ID NO: 25010 - protein, 13 aa, BK virus
LPMECSQTMTSGR

SEQ ID NO: 25011 - protein, 13 aa, BK virus
PMECSQTMTSGRK

SEQ ID NO: 25012 - protein, 13 aa, BK virus
MECSQTMTSGRKV

SEQ ID NO: 25013 - protein, 13 aa, BK virus
ECSQTMTSGRKVH

SEQ ID NO: 25014 - protein, 13 aa, BK virus
CSQTMTSGRKVHD

SEQ ID NO: 25015 - protein, 13 aa, BK virus
SQTMTSGRKVHDR

SEQ ID NO: 25016 - protein, 13 aa, BK virus
QTMTSGRKVHDRH

SEQ ID NO: 25017 - protein, 13 aa, BK virus
TMTSGRKVHDRHV

SEQ ID NO: 25018 - protein, 13 aa, BK virus
MTSGRKVHDRHVL

SEQ ID NO: 25019 - protein, 13 aa, BK virus
TSGRKVHDRHVLR

SEQ ID NO: 25020 - protein, 13 aa, BK virus
SGRKVHDRHVLRA

SEQ ID NO: 25021 - protein, 13 aa, BK virus
ESWPCPQLNWTKA

SEQ ID NO: 25022 - protein, 13 aa, BK virus
SWPCPQLNWTKAM

SEQ ID NO: 25023 - protein, 13 aa, BK virus
WPCPQLNWTKAMV

SEQ ID NO: 25024 - protein, 13 aa, BK virus
PCPQLNWTKAMVL

SEQ ID NO: 25025 - protein, 13 aa, BK virus
CPQLNWTKAMVLR

SEQ ID NO: 25026 - protein, 13 aa, BK virus
PQLNWTKAMVLRQ

SEQ ID NO: 25027 - protein, 13 aa, BK virus
QLNWTKAMVLRQL

SEQ ID NO: 25028 - protein, 13 aa, BK virus
LNWTKAMVLRQLS

SEQ ID NO: 25029 - protein, 13 aa, BK virus
NWTKAMVLRQLSR

SEQ ID NO: 25030 - protein, 13 aa, BK virus
WTKAMVLRQLSRQ

SEQ ID NO: 25031 - protein, 13 aa, BK virus
TKAMVLRQLSRQA

SEQ ID NO: 25032 - protein, 13 aa, BK virus
KAMVLRQLSRQAS

SEQ ID NO: 25033 - protein, 13 aa, BK virus
AMVLRQLSRQASV

SEQ ID NO: 25034 - protein, 13 aa, BK virus
MVLRQLSRQASVK

SEQ ID NO: 25035 - protein, 13 aa, BK virus
VLRQLSRQASVKV

SEQ ID NO: 25036 - protein, 13 aa, BK virus
LRQLSRQASVKVG

SEQ ID NO: 25037 - protein, 13 aa, BK virus
RQLSRQASVKVGK

SEQ ID NO: 25038 - protein, 13 aa, BK virus
QLSRQASVKVGKT

SEQ ID NO: 25039 - protein, 13 aa, BK virus
LSRQASVKVGKTW

SEQ ID NO: 25040 - protein, 13 aa, BK virus
SRQASVKVGKTWT

SEQ ID NO: 25041 - protein, 13 aa, BK virus
RQASVKVGKTWTG

SEQ ID NO: 25042 - protein, 13 aa, BK virus
QASVKVGKTWTGT

SEQ ID NO: 25043 - protein, 13 aa, BK virus
ASVKVGKTWTGTK

SEQ ID NO: 25044 - protein, 13 aa, BK virus
SVKVGKTWTGTKK

SEQ ID NO: 25045 - protein, 13 aa, BK virus
VKVGKTWTGTKKR

SEQ ID NO: 25046 - protein, 13 aa, BK virus
KVGKTWTGTKKRA

SEQ ID NO: 25047 - protein, 13 aa, BK virus
VGKTWTGTKKRAQ

SEQ ID NO: 25048 - protein, 13 aa, BK virus
GKTWTGTKKRAQR

SEQ ID NO: 25049 - protein, 13 aa, BK virus
KTWTGTKKRAQRI

SEQ ID NO: 25050 - protein, 13 aa, BK virus
TWTGTKKRAQRIF

SEQ ID NO: 25051 - protein, 13 aa, BK virus
WTGTKKRAQRIFI

SEQ ID NO: 25052 - protein, 13 aa, BK virus
TGTKKRAQRIFIF

SEQ ID NO: 25053 - protein, 13 aa, BK virus
GTKKRAQRIFIFI

SEQ ID NO: 25054 - protein, 13 aa, BK virus
TKKRAQRIFIFIL

SEQ ID NO: 25055 - protein, 13 aa, BK virus
KKRAQRIFIFILE

SEQ ID NO: 25056 - protein, 13 aa, BK virus
KRAQRIFIFILEL

SEQ ID NO: 25057 - protein, 13 aa, BK virus
RAQRIFIFILELL

SEQ ID NO: 25058 - protein, 13 aa, BK virus
AQRIFIFILELLL

SEQ ID NO: 25059 - protein, 13 aa, BK virus
QRIFIFILELLLE

SEQ ID NO: 25060 - protein, 13 aa, BK virus
RIFIFILELLLEF

SEQ ID NO: 25061 - protein, 13 aa, BK virus
IFIFILELLLEFC

SEQ ID NO: 25062 - protein, 13 aa, BK virus
FIFILELLLEFCR

SEQ ID NO: 25063 - protein, 13 aa, BK virus
IFILELLLEFCRG

SEQ ID NO: 25064 - protein, 13 aa, BK virus
FILELLLEFCRGE

SEQ ID NO: 25065 - protein, 13 aa, BK virus
ILELLLEFCRGED

SEQ ID NO: 25066 - protein, 13 aa, BK virus
LELLLEFCRGEDS

SEQ ID NO: 25067 - protein, 13 aa, BK virus
ELLLEFCRGEDSV

SEQ ID NO: 25068 - protein, 13 aa, BK virus
LLLEFCRGEDSVD

SEQ ID NO: 25069 - protein, 13 aa, BK virus
LLEFCRGEDSVDG

SEQ ID NO: 25070 - protein, 13 aa, BK virus
LEFCRGEDSVDGK

SEQ ID NO: 25071 - protein, 13 aa, BK virus
EFCRGEDSVDGKN

SEQ ID NO: 25072 - protein, 13 aa, BK virus
FCRGEDSVDGKNK

SEQ ID NO: 25073 - protein, 13 aa, BK virus
CRGEDSVDGKNKS

SEQ ID NO: 25074 - protein, 13 aa, BK virus
RGEDSVDGKNKST

SEQ ID NO: 25075 - protein, 13 aa, BK virus
GEDSVDGKNKSTT

SEQ ID NO: 25076 - protein, 13 aa, BK virus
EDSVDGKNKSTTA

SEQ ID NO: 25077 - protein, 13 aa, BK virus
DSVDGKNKSTTAL

SEQ ID NO: 25078 - protein, 13 aa, BK virus
SVDGKNKSTTALP

SEQ ID NO: 25079 - protein, 13 aa, BK virus
VDGKNKSTTALPA

SEQ ID NO: 25080 - protein, 13 aa, BK virus
DGKNKSTTALPAV

SEQ ID NO: 25081 - protein, 13 aa, BK virus
GKNKSTTALPAVK

SEQ ID NO: 25082 - protein, 13 aa, BK virus
KNKSTTALPAVKD

SEQ ID NO: 25083 - protein, 13 aa, BK virus
NKSTTALPAVKDS

SEQ ID NO: 25084 - protein, 13 aa, BK virus
KSTTALPAVKDSV

SEQ ID NO: 25085 - protein, 13 aa, BK virus
STTALPAVKDSVK

SEQ ID NO: 25086 - protein, 13 aa, BK virus
TTALPAVKDSVKD

SEQ ID NO: 25087 - protein, 13 aa, BK virus
TALPAVKDSVKDS

SEQ ID NO: 25088 - protein, 13 aa, BK virus
VSNPFFFVFPGSW

SEQ ID NO: 25089 - protein, 13 aa, BK virus
SNPFFFVFPGSWV

SEQ ID NO: 25090 - protein, 13 aa, BK virus
NPFFFVFPGSWVL

SEQ ID NO: 25091 - protein, 13 aa, BK virus
PFFFVFPGSWVLL

SEQ ID NO: 25092 - protein, 13 aa, BK virus
LPVYLRLLLPQDF

SEQ ID NO: 25093 - protein, 13 aa, BK virus
PVYLRLLLPQDFQ

SEQ ID NO: 25094 - protein, 13 aa, BK virus
VYLRLLLPQDFQW

SEQ ID NO: 25095 - protein, 13 aa, BK virus
YLRLLLPQDFQWL

SEQ ID NO: 25096 - protein, 13 aa, BK virus
LRLLLPQDFQWLK

SEQ ID NO: 25097 - protein, 13 aa, BK virus
RLLLPQDFQWLKL

SEQ ID NO: 25098 - protein, 13 aa, BK virus
LLLPQDFQWLKLL

SEQ ID NO: 25099 - protein, 13 aa, BK virus
LLPQDFQWLKLLL

SEQ ID NO: 25100 - protein, 13 aa, BK virus
LPQDFQWLKLLLG

SEQ ID NO: 25101 - protein, 13 aa, BK virus
PQDFQWLKLLLGR

SEQ ID NO: 25102 - protein, 13 aa, BK virus
QDFQWLKLLLGRL

SEQ ID NO: 25103 - protein, 13 aa, BK virus
DFQWLKLLLGRLL

SEQ ID NO: 25104 - protein, 13 aa, BK virus
FQWLKLLLGRLLL

SEQ ID NO: 25105 - protein, 13 aa, BK virus
QWLKLLLGRLLLL

SEQ ID NO: 25106 - protein, 13 aa, BK virus
LLVLLGLLLGLLL

SEQ ID NO: 25107 - protein, 13 aa, BK virus
GISSLMIGITKFP

SEQ ID NO: 25108 - protein, 13 aa, BK virus
ISSLMIGITKFPL

SEQ ID NO: 25109 - protein, 13 aa, BK virus
ASISNQAWLWNCL

SEQ ID NO: 25110 - protein, 13 aa, BK virus
SISNQAWLWNCLT

SEQ ID NO: 25111 - protein, 13 aa, BK virus
ISNQAWLWNCLTQ

SEQ ID NO: 25112 - protein, 13 aa, BK virus
SNQAWLWNCLTQM

SEQ ID NO: 25113 - protein, 13 aa, BK virus
NQAWLWNCLTQMS

SEQ ID NO: 25114 - protein, 13 aa, BK virus
QAWLWNCLTQMST

SEQ ID NO: 25115 - protein, 13 aa, BK virus
AWLWNCLTQMSTM

SEQ ID NO: 25116 - protein, 13 aa, BK virus
WLWNCLTQMSTMI

SEQ ID NO: 25117 - protein, 13 aa, BK virus
LWNCLTQMSTMIF

SEQ ID NO: 25118 - protein, 13 aa, BK virus
WNCLTQMSTMIFC

SEQ ID NO: 25119 - protein, 13 aa, BK virus
NCLTQMSTMIFCF

SEQ ID NO: 25120 - protein, 13 aa, BK virus
CLTQMSTMIFCFL

SEQ ID NO: 25121 - protein, 13 aa, BK virus
LTQMSTMIFCFLV

SEQ ID NO: 25122 - protein, 13 aa, BK virus
ILLLIIFNTLILG

SEQ ID NO: 25123 - protein, 13 aa, BK virus
LLLIIFNTLILGI

SEQ ID NO: 25124 - protein, 13 aa, BK virus
LLIIFNTLILGIG

SEQ ID NO: 25125 - protein, 13 aa, BK virus
LIIFNTLILGIGV

SEQ ID NO: 25126 - protein, 13 aa, BK virus
IIFNTLILGIGVL

SEQ ID NO: 25127 - protein, 13 aa, BK virus
IFNTLILGIGVLL

SEQ ID NO: 25128 - protein, 13 aa, BK virus
FNTLILGIGVLLC

SEQ ID NO: 25129 - protein, 13 aa, BK virus
NTLILGIGVLLCL

SEQ ID NO: 25130 - protein, 13 aa, BK virus
TLILGIGVLLCLL

SEQ ID NO: 25131 - protein, 13 aa, BK virus
LILGIGVLLCLLL

SEQ ID NO: 25132 - protein, 13 aa, BK virus
ILGIGVLLCLLLF

SEQ ID NO: 25133 - protein, 13 aa, BK virus
LGIGVLLCLLLFP

SEQ ID NO: 25134 - protein, 13 aa, BK virus
GIGVLLCLLLFPR

SEQ ID NO: 25135 - protein, 13 aa, BK virus
IGVLLCLLLFPRL

SEQ ID NO: 25136 - protein, 13 aa, BK virus
GVLLCLLLFPRLC

SEQ ID NO: 25137 - protein, 13 aa, BK virus
VLLCLLLFPRLCG

SEQ ID NO: 25138 - protein, 13 aa, BK virus
LLCLLLFPRLCGM

SEQ ID NO: 25139 - protein, 13 aa, BK virus
LCLLLFPRLCGML

SEQ ID NO: 25140 - protein, 13 aa, BK virus
CLLLFPRLCGMLL

SEQ ID NO: 25141 - protein, 13 aa, BK virus
LLLFPRLCGMLLG

SEQ ID NO: 25142 - protein, 13 aa, BK virus
LLFPRLCGMLLGM

SEQ ID NO: 25143 - protein, 13 aa, BK virus
LFPRLCGMLLGMI

SEQ ID NO: 25144 - protein, 13 aa, BK virus
FPRLCGMLLGMIY

SEQ ID NO: 25145 - protein, 13 aa, BK virus
PRLCGMLLGMIYL

SEQ ID NO: 25146 - protein, 13 aa, BK virus
RLCGMLLGMIYLL

SEQ ID NO: 25147 - protein, 13 aa, BK virus
PHRNCREEQKDFL

SEQ ID NO: 25148 - protein, 13 aa, BK virus
HRNCREEQKDFLE

SEQ ID NO: 25149 - protein, 13 aa, BK virus
RNCREEQKDFLET

SEQ ID NO: 25150 - protein, 13 aa, BK virus
NCREEQKDFLETP

SEQ ID NO: 25151 - protein, 13 aa, BK virus
CREEQKDFLETPW

SEQ ID NO: 25152 - protein, 13 aa, BK virus
REEQKDFLETPWL

SEQ ID NO: 25153 - protein, 13 aa, BK virus
EEQKDFLETPWLD

SEQ ID NO: 25154 - protein, 13 aa, BK virus
EQKDFLETPWLDF

SEQ ID NO: 25155 - protein, 13 aa, BK virus
QKDFLETPWLDFW

SEQ ID NO: 25156 - protein, 13 aa, BK virus
KDFLETPWLDFWR

SEQ ID NO: 25157 - protein, 13 aa, BK virus
DFLETPWLDFWRK

SEQ ID NO: 25158 - protein, 13 aa, BK virus
FLETPWLDFWRKL

SEQ ID NO: 25159 - protein, 13 aa, BK virus
LETPWLDFWRKLP

SEQ ID NO: 25160 - protein, 13 aa, BK virus
ETPWLDFWRKLPG

SEQ ID NO: 25161 - protein, 13 aa, BK virus
TPWLDFWRKLPGQ

SEQ ID NO: 25162 - protein, 13 aa, BK virus
PWLDFWRKLPGQL

SEQ ID NO: 25163 - protein, 13 aa, BK virus
TFIIIFNNIILIF

SEQ ID NO: 25164 - protein, 13 aa, BK virus
FIIIFNNIILIFP

SEQ ID NO: 25165 - protein, 13 aa, BK virus
IIIFNNIILIFPL

SEQ ID NO: 25166 - protein, 13 aa, BK virus
IIFNNIILIFPLL

SEQ ID NO: 25167 - protein, 13 aa, BK virus
IFNNIILIFPLLG

SEQ ID NO: 25168 - protein, 13 aa, BK virus
FNNIILIFPLLGP

SEQ ID NO: 25169 - protein, 13 aa, BK virus
NNIILIFPLLGPQ

SEQ ID NO: 25170 - protein, 13 aa, BK virus
NIILIFPLLGPQW

SEQ ID NO: 25171 - protein, 13 aa, BK virus
IILIFPLLGPQWL

SEQ ID NO: 25172 - protein, 13 aa, BK virus
ILIFPLLGPQWLD

SEQ ID NO: 25173 - protein, 13 aa, BK virus
LIFPLLGPQWLDK

SEQ ID NO: 25174 - protein, 13 aa, BK virus
LKGKVPVYILAIL

SEQ ID NO: 25175 - protein, 13 aa, BK virus
KGKVPVYILAILI

SEQ ID NO: 25176 - protein, 13 aa, BK virus
GKVPVYILAILIV

SEQ ID NO: 25177 - protein, 13 aa, BK virus
KKLLPQEVLIKEL

SEQ ID NO: 25178 - protein, 13 aa, BK virus
KLLPQEVLIKELL

SEQ ID NO: 25179 - protein, 13 aa, BK virus
LLPQEVLIKELLL

SEQ ID NO: 25180 - protein, 13 aa, BK virus
LPQEVLIKELLLN

SEQ ID NO: 25181 - protein, 13 aa, BK virus
PQEVLIKELLLNG

SEQ ID NO: 25182 - protein, 13 aa, BK virus
QEVLIKELLLNGC

SEQ ID NO: 25183 - protein, 13 aa, BK virus
EVLIKELLLNGCC

SEQ ID NO: 25184 - protein, 13 aa, BK virus
VLIKELLLNGCCL

SEQ ID NO: 25185 - protein, 13 aa, BK virus
LIKELLLNGCCLY

SEQ ID NO: 25186 - protein, 13 aa, BK virus
IKELLLNGCCLYF

SEQ ID NO: 25187 - protein, 13 aa, BK virus
HLLLKHMKMAPTK

SEQ ID NO: 25188 - protein, 13 aa, BK virus
LLLKHMKMAPTKR

SEQ ID NO: 25189 - protein, 13 aa, BK virus
LLKHMKMAPTKRK

SEQ ID NO: 25190 - protein, 13 aa, BK virus
LKHMKMAPTKRKG

SEQ ID NO: 25191 - protein, 13 aa, BK virus
KHMKMAPTKRKGE

SEQ ID NO: 25192 - protein, 13 aa, BK virus
HMKMAPTKRKGEC

SEQ ID NO: 25193 - protein, 13 aa, BK virus
MKMAPTKRKGECP

SEQ ID NO: 25194 - protein, 13 aa, BK virus
KMAPTKRKGECPG

SEQ ID NO: 25195 - protein, 13 aa, BK virus
MAPTKRKGECPGA

SEQ ID NO: 25196 - protein, 13 aa, BK virus
APTKRKGECPGAA

SEQ ID NO: 25197 - protein, 13 aa, BK virus
PTKRKGECPGAAP

SEQ ID NO: 25198 - protein, 13 aa, BK virus
TKRKGECPGAAPK

SEQ ID NO: 25199 - protein, 13 aa, BK virus
KRKGECPGAAPKK

SEQ ID NO: 25200 - protein, 13 aa, BK virus
RKGECPGAAPKKP

SEQ ID NO: 25201 - protein, 13 aa, BK virus
KGECPGAAPKKPK

SEQ ID NO: 25202 - protein, 13 aa, BK virus
GECPGAAPKKPKE

SEQ ID NO: 25203 - protein, 13 aa, BK virus
ECPGAAPKKPKEP

SEQ ID NO: 25204 - protein, 13 aa, BK virus
CPGAAPKKPKEPV

SEQ ID NO: 25205 - protein, 13 aa, BK virus
PGAAPKKPKEPVQ

SEQ ID NO: 25206 - protein, 13 aa, BK virus
GAAPKKPKEPVQV

SEQ ID NO: 25207 - protein, 13 aa, BK virus
AAPKKPKEPVQVP

SEQ ID NO: 25208 - protein, 13 aa, BK virus
APKKPKEPVQVPK

SEQ ID NO: 25209 - protein, 13 aa, BK virus
PKKPKEPVQVPKL

SEQ ID NO: 25210 - protein, 13 aa, BK virus
KKPKEPVQVPKLL

SEQ ID NO: 25211 - protein, 13 aa, BK virus
KPKEPVQVPKLLI

SEQ ID NO: 25212 - protein, 13 aa, BK virus
PKEPVQVPKLLIK

SEQ ID NO: 25213 - protein, 13 aa, BK virus
KEPVQVPKLLIKG

SEQ ID NO: 25214 - protein, 13 aa, BK virus
EPVQVPKLLIKGG

SEQ ID NO: 25215 - protein, 13 aa, BK virus
PVQVPKLLIKGGV

SEQ ID NO: 25216 - protein, 13 aa, BK virus
VQVPKLLIKGGVE

SEQ ID NO: 25217 - protein, 13 aa, BK virus
QVPKLLIKGGVEV

SEQ ID NO: 25218 - protein, 13 aa, BK virus
VPKLLIKGGVEVL

SEQ ID NO: 25219 - protein, 13 aa, BK virus
PKLLIKGGVEVLE

SEQ ID NO: 25220 - protein, 13 aa, BK virus
KLLIKGGVEVLEV

SEQ ID NO: 25221 - protein, 13 aa, BK virus
LLIKGGVEVLEVK

SEQ ID NO: 25222 - protein, 13 aa, BK virus
LIKGGVEVLEVKT

SEQ ID NO: 25223 - protein, 13 aa, BK virus
IKGGVEVLEVKTG

SEQ ID NO: 25224 - protein, 13 aa, BK virus
KGGVEVLEVKTGV

SEQ ID NO: 25225 - protein, 13 aa, BK virus
GGVEVLEVKTGVD

SEQ ID NO: 25226 - protein, 13 aa, BK virus
GVEVLEVKTGVDA

SEQ ID NO: 25227 - protein, 13 aa, BK virus
VEVLEVKTGVDAI

SEQ ID NO: 25228 - protein, 13 aa, BK virus
EVLEVKTGVDAIT

SEQ ID NO: 25229 - protein, 13 aa, BK virus
VLEVKTGVDAITE

SEQ ID NO: 25230 - protein, 13 aa, BK virus
LEVKTGVDAITEV

SEQ ID NO: 25231 - protein, 13 aa, BK virus
EVKTGVDAITEVE

SEQ ID NO: 25232 - protein, 13 aa, BK virus
VKTGVDAITEVEC

SEQ ID NO: 25233 - protein, 13 aa, BK virus
KTGVDAITEVECF

SEQ ID NO: 25234 - protein, 13 aa, BK virus
TGVDAITEVECFL

SEQ ID NO: 25235 - protein, 13 aa, BK virus
GVDAITEVECFLN

SEQ ID NO: 25236 - protein, 13 aa, BK virus
VDAITEVECFLNP

SEQ ID NO: 25237 - protein, 13 aa, BK virus
DAITEVECFLNPE

SEQ ID NO: 25238 - protein, 13 aa, BK virus
AITEVECFLNPEM

SEQ ID NO: 25239 - protein, 13 aa, BK virus
ITEVECFLNPEMG

SEQ ID NO: 25240 - protein, 13 aa, BK virus
TEVECFLNPEMGD

SEQ ID NO: 25241 - protein, 13 aa, BK virus
EVECFLNPEMGDP

SEQ ID NO: 25242 - protein, 13 aa, BK virus
VECFLNPEMGDPD

SEQ ID NO: 25243 - protein, 13 aa, BK virus
ECFLNPEMGDPDE

SEQ ID NO: 25244 - protein, 13 aa, BK virus
CFLNPEMGDPDEN

SEQ ID NO: 25245 - protein, 13 aa, BK virus
FLNPEMGDPDENL

SEQ ID NO: 25246 - protein, 13 aa, BK virus
LNPEMGDPDENLR

SEQ ID NO: 25247 - protein, 13 aa, BK virus
NPEMGDPDENLRG

SEQ ID NO: 25248 - protein, 13 aa, BK virus
PEMGDPDENLRGF

SEQ ID NO: 25249 - protein, 13 aa, BK virus
EMGDPDENLRGFS

SEQ ID NO: 25250 - protein, 13 aa, BK virus
MGDPDENLRGFSL

SEQ ID NO: 25251 - protein, 13 aa, BK virus
GDPDENLRGFSLK

SEQ ID NO: 25252 - protein, 13 aa, BK virus
DPDENLRGFSLKL

SEQ ID NO: 25253 - protein, 13 aa, BK virus
PDENLRGFSLKLS

SEQ ID NO: 25254 - protein, 13 aa, BK virus
DENLRGFSLKLSA

SEQ ID NO: 25255 - protein, 13 aa, BK virus
ENLRGFSLKLSAE

SEQ ID NO: 25256 - protein, 13 aa, BK virus
NLRGFSLKLSAEN

SEQ ID NO: 25257 - protein, 13 aa, BK virus
LRGFSLKLSAEND

SEQ ID NO: 25258 - protein, 13 aa, BK virus
RGFSLKLSAENDF

SEQ ID NO: 25259 - protein, 13 aa, BK virus
GFSLKLSAENDFS

SEQ ID NO: 25260 - protein, 13 aa, BK virus
FSLKLSAENDFSS

SEQ ID NO: 25261 - protein, 13 aa, BK virus
SLKLSAENDFSSD

SEQ ID NO: 25262 - protein, 13 aa, BK virus
LKLSAENDFSSDS

SEQ ID NO: 25263 - protein, 13 aa, BK virus
KLSAENDFSSDSP

SEQ ID NO: 25264 - protein, 13 aa, BK virus
LSAENDFSSDSPE

SEQ ID NO: 25265 - protein, 13 aa, BK virus
SAENDFSSDSPER

SEQ ID NO: 25266 - protein, 13 aa, BK virus
AENDFSSDSPERK

SEQ ID NO: 25267 - protein, 13 aa, BK virus
ENDFSSDSPERKM

SEQ ID NO: 25268 - protein, 13 aa, BK virus
NDFSSDSPERKML

SEQ ID NO: 25269 - protein, 13 aa, BK virus
DFSSDSPERKMLP

SEQ ID NO: 25270 - protein, 13 aa, BK virus
FSSDSPERKMLPC

SEQ ID NO: 25271 - protein, 13 aa, BK virus
SSDSPERKMLPCY

SEQ ID NO: 25272 - protein, 13 aa, BK virus
SDSPERKMLPCYS

SEQ ID NO: 25273 - protein, 13 aa, BK virus
DSPERKMLPCYST

SEQ ID NO: 25274 - protein, 13 aa, BK virus
SPERKMLPCYSTA

SEQ ID NO: 25275 - protein, 13 aa, BK virus
PERKMLPCYSTAR

SEQ ID NO: 25276 - protein, 13 aa, BK virus
ERKMLPCYSTARI

SEQ ID NO: 25277 - protein, 13 aa, BK virus
RKMLPCYSTARIP

SEQ ID NO: 25278 - protein, 13 aa, BK virus
KMLPCYSTARIPL

SEQ ID NO: 25279 - protein, 13 aa, BK virus
MLPCYSTARIPLP

SEQ ID NO: 25280 - protein, 13 aa, BK virus
LPCYSTARIPLPN

SEQ ID NO: 25281 - protein, 13 aa, BK virus
PCYSTARIPLPNL

SEQ ID NO: 25282 - protein, 13 aa, BK virus
CYSTARIPLPNLN

SEQ ID NO: 25283 - protein, 13 aa, BK virus
YSTARIPLPNLNE

SEQ ID NO: 25284 - protein, 13 aa, BK virus
STARIPLPNLNED

SEQ ID NO: 25285 - protein, 13 aa, BK virus
TARIPLPNLNEDL

SEQ ID NO: 25286 - protein, 13 aa, BK virus
ARIPLPNLNEDLT

SEQ ID NO: 25287 - protein, 13 aa, BK virus
RIPLPNLNEDLTC

SEQ ID NO: 25288 - protein, 13 aa, BK virus
IPLPNLNEDLTCG

SEQ ID NO: 25289 - protein, 13 aa, BK virus
PLPNLNEDLTCGN

SEQ ID NO: 25290 - protein, 13 aa, BK virus
LPNLNEDLTCGNL

SEQ ID NO: 25291 - protein, 13 aa, BK virus
PNLNEDLTCGNLL

SEQ ID NO: 25292 - protein, 13 aa, BK virus
NLNEDLTCGNLLM

SEQ ID NO: 25293 - protein, 13 aa, BK virus
LNEDLTCGNLLMW

SEQ ID NO: 25294 - protein, 13 aa, BK virus
NEDLTCGNLLMWE

SEQ ID NO: 25295 - protein, 13 aa, BK virus
EDLTCGNLLMWEA

SEQ ID NO: 25296 - protein, 13 aa, BK virus
DLTCGNLLMWEAV

SEQ ID NO: 25297 - protein, 13 aa, BK virus
LTCGNLLMWEAVT

SEQ ID NO: 25298 - protein, 13 aa, BK virus
TCGNLLMWEAVTV

SEQ ID NO: 25299 - protein, 13 aa, BK virus
CGNLLMWEAVTVQ

SEQ ID NO: 25300 - protein, 13 aa, BK virus
GNLLMWEAVTVQT

SEQ ID NO: 25301 - protein, 13 aa, BK virus
NLLMWEAVTVQTE

SEQ ID NO: 25302 - protein, 13 aa, BK virus
LLMWEAVTVQTEV

SEQ ID NO: 25303 - protein, 13 aa, BK virus
LMWEAVTVQTEVI

SEQ ID NO: 25304 - protein, 13 aa, BK virus
MWEAVTVQTEVIG

SEQ ID NO: 25305 - protein, 13 aa, BK virus
WEAVTVQTEVIGI

SEQ ID NO: 25306 - protein, 13 aa, BK virus
EAVTVQTEVIGIT

SEQ ID NO: 25307 - protein, 13 aa, BK virus
AVTVQTEVIGITS

SEQ ID NO: 25308 - protein, 13 aa, BK virus
VTVQTEVIGITSM

SEQ ID NO: 25309 - protein, 13 aa, BK virus
TVQTEVIGITSML

SEQ ID NO: 25310 - protein, 13 aa, BK virus
VQTEVIGITSMLN

SEQ ID NO: 25311 - protein, 13 aa, BK virus
QTEVIGITSMLNL

SEQ ID NO: 25312 - protein, 13 aa, BK virus
TEVIGITSMLNLH

SEQ ID NO: 25313 - protein, 13 aa, BK virus
EVIGITSMLNLHA

SEQ ID NO: 25314 - protein, 13 aa, BK virus
VIGITSMLNLHAG

SEQ ID NO: 25315 - protein, 13 aa, BK virus
IGITSMLNLHAGS

SEQ ID NO: 25316 - protein, 13 aa, BK virus
GITSMLNLHAGSQ

SEQ ID NO: 25317 - protein, 13 aa, BK virus
ITSMLNLHAGSQK

SEQ ID NO: 25318 - protein, 13 aa, BK virus
TSMLNLHAGSQKV

SEQ ID NO: 25319 - protein, 13 aa, BK virus
SMLNLHAGSQKVH

SEQ ID NO: 25320 - protein, 13 aa, BK virus
MLNLHAGSQKVHE

SEQ ID NO: 25321 - protein, 13 aa, BK virus
LNLHAGSQKVHEH

SEQ ID NO: 25322 - protein, 13 aa, BK virus
NLHAGSQKVHEHG

SEQ ID NO: 25323 - protein, 13 aa, BK virus
LHAGSQKVHEHGG

SEQ ID NO: 25324 - protein, 13 aa, BK virus
HAGSQKVHEHGGG

SEQ ID NO: 25325 - protein, 13 aa, BK virus
AGSQKVHEHGGGK

SEQ ID NO: 25326 - protein, 13 aa, BK virus
GSQKVHEHGGGKP

SEQ ID NO: 25327 - protein, 13 aa, BK virus
SQKVHEHGGGKPI

SEQ ID NO: 25328 - protein, 13 aa, BK virus
QKVHEHGGGKPIQ

SEQ ID NO: 25329 - protein, 13 aa, BK virus
KVHEHGGGKPIQG

SEQ ID NO: 25330 - protein, 13 aa, BK virus
VHEHGGGKPIQGS

SEQ ID NO: 25331 - protein, 13 aa, BK virus
HEHGGGKPIQGSN

SEQ ID NO: 25332 - protein, 13 aa, BK virus
EHGGGKPIQGSNF

SEQ ID NO: 25333 - protein, 13 aa, BK virus
HGGGKPIQGSNFH

SEQ ID NO: 25334 - protein, 13 aa, BK virus
GGGKPIQGSNFHF

SEQ ID NO: 25335 - protein, 13 aa, BK virus
GGKPIQGSNFHFF

SEQ ID NO: 25336 - protein, 13 aa, BK virus
GKPIQGSNFHFFA

SEQ ID NO: 25337 - protein, 13 aa, BK virus
KPIQGSNFHFFAV

SEQ ID NO: 25338 - protein, 13 aa, BK virus
PIQGSNFHFFAVG

SEQ ID NO: 25339 - protein, 13 aa, BK virus
IQGSNFHFFAVGG

SEQ ID NO: 25340 - protein, 13 aa, BK virus
QGSNFHFFAVGGE

SEQ ID NO: 25341 - protein, 13 aa, BK virus
GSNFHFFAVGGEP

SEQ ID NO: 25342 - protein, 13 aa, BK virus
SNFHFFAVGGEPL

SEQ ID NO: 25343 - protein, 13 aa, BK virus
NFHFFAVGGEPLE

SEQ ID NO: 25344 - protein, 13 aa, BK virus
FHFFAVGGEPLEM

SEQ ID NO: 25345 - protein, 13 aa, BK virus
HFFAVGGEPLEMQ

SEQ ID NO: 25346 - protein, 13 aa, BK virus
FFAVGGEPLEMQG

SEQ ID NO: 25347 - protein, 13 aa, BK virus
FAVGGEPLEMQGV

SEQ ID NO: 25348 - protein, 13 aa, BK virus
AVGGEPLEMQGVL

SEQ ID NO: 25349 - protein, 13 aa, BK virus
VGGEPLEMQGVLM

SEQ ID NO: 25350 - protein, 13 aa, BK virus
GGEPLEMQGVLMN

SEQ ID NO: 25351 - protein, 13 aa, BK virus
GEPLEMQGVLMNY

SEQ ID NO: 25352 - protein, 13 aa, BK virus
EPLEMQGVLMNYR

SEQ ID NO: 25353 - protein, 13 aa, BK virus
PLEMQGVLMNYRS

SEQ ID NO: 25354 - protein, 13 aa, BK virus
LEMQGVLMNYRSK

SEQ ID NO: 25355 - protein, 13 aa, BK virus
EMQGVLMNYRSKY

SEQ ID NO: 25356 - protein, 13 aa, BK virus
MQGVLMNYRSKYP

SEQ ID NO: 25357 - protein, 13 aa, BK virus
QGVLMNYRSKYPD

SEQ ID NO: 25358 - protein, 13 aa, BK virus
GVLMNYRSKYPDG

SEQ ID NO: 25359 - protein, 13 aa, BK virus
VLMNYRSKYPDGT

SEQ ID NO: 25360 - protein, 13 aa, BK virus
LMNYRSKYPDGTI

SEQ ID NO: 25361 - protein, 13 aa, BK virus
MNYRSKYPDGTIT

SEQ ID NO: 25362 - protein, 13 aa, BK virus
NYRSKYPDGTITP

SEQ ID NO: 25363 - protein, 13 aa, BK virus
YRSKYPDGTITPK

SEQ ID NO: 25364 - protein, 13 aa, BK virus
RSKYPDGTITPKN

SEQ ID NO: 25365 - protein, 13 aa, BK virus
SKYPDGTITPKNP

SEQ ID NO: 25366 - protein, 13 aa, BK virus
KYPDGTITPKNPT

SEQ ID NO: 25367 - protein, 13 aa, BK virus
YPDGTITPKNPTA

SEQ ID NO: 25368 - protein, 13 aa, BK virus
PDGTITPKNPTAQ

SEQ ID NO: 25369 - protein, 13 aa, BK virus
DGTITPKNPTAQS

SEQ ID NO: 25370 - protein, 13 aa, BK virus
GTITPKNPTAQSQ

SEQ ID NO: 25371 - protein, 13 aa, BK virus
TITPKNPTAQSQV

SEQ ID NO: 25372 - protein, 13 aa, BK virus
ITPKNPTAQSQVM

SEQ ID NO: 25373 - protein, 13 aa, BK virus
TPKNPTAQSQVMN

SEQ ID NO: 25374 - protein, 13 aa, BK virus
PKNPTAQSQVMNT

SEQ ID NO: 25375 - protein, 13 aa, BK virus
KNPTAQSQVMNTD

SEQ ID NO: 25376 - protein, 13 aa, BK virus
NPTAQSQVMNTDH

SEQ ID NO: 25377 - protein, 13 aa, BK virus
PTAQSQVMNTDHK

SEQ ID NO: 25378 - protein, 13 aa, BK virus
TAQSQVMNTDHKA

SEQ ID NO: 25379 - protein, 13 aa, BK virus
AQSQVMNTDHKAY

SEQ ID NO: 25380 - protein, 13 aa, BK virus
QSQVMNTDHKAYL

SEQ ID NO: 25381 - protein, 13 aa, BK virus
SQVMNTDHKAYLD

SEQ ID NO: 25382 - protein, 13 aa, BK virus
QVMNTDHKAYLDK

SEQ ID NO: 25383 - protein, 13 aa, BK virus
VMNTDHKAYLDKN

SEQ ID NO: 25384 - protein, 13 aa, BK virus
MNTDHKAYLDKNN

SEQ ID NO: 25385 - protein, 13 aa, BK virus
NTDHKAYLDKNNA

SEQ ID NO: 25386 - protein, 13 aa, BK virus
TDHKAYLDKNNAY

SEQ ID NO: 25387 - protein, 13 aa, BK virus
DHKAYLDKNNAYP

SEQ ID NO: 25388 - protein, 13 aa, BK virus
HKAYLDKNNAYPV

SEQ ID NO: 25389 - protein, 13 aa, BK virus
KAYLDKNNAYPVE

SEQ ID NO: 25390 - protein, 13 aa, BK virus
AYLDKNNAYPVEC

SEQ ID NO: 25391 - protein, 13 aa, BK virus
YLDKNNAYPVECW

SEQ ID NO: 25392 - protein, 13 aa, BK virus
LDKNNAYPVECWV

SEQ ID NO: 25393 - protein, 13 aa, BK virus
DKNNAYPVECWVP

SEQ ID NO: 25394 - protein, 13 aa, BK virus
KNNAYPVECWVPD

SEQ ID NO: 25395 - protein, 13 aa, BK virus
NNAYPVECWVPDP

SEQ ID NO: 25396 - protein, 13 aa, BK virus
NAYPVECWVPDPS

SEQ ID NO: 25397 - protein, 13 aa, BK virus
AYPVECWVPDPSR

SEQ ID NO: 25398 - protein, 13 aa, BK virus
YPVECWVPDPSRN

SEQ ID NO: 25399 - protein, 13 aa, BK virus
PVECWVPDPSRNE

SEQ ID NO: 25400 - protein, 13 aa, BK virus
VECWVPDPSRNEN

SEQ ID NO: 25401 - protein, 13 aa, BK virus
ECWVPDPSRNENA

SEQ ID NO: 25402 - protein, 13 aa, BK virus
CWVPDPSRNENAR

SEQ ID NO: 25403 - protein, 13 aa, BK virus
WVPDPSRNENARY

SEQ ID NO: 25404 - protein, 13 aa, BK virus
VPDPSRNENARYF

SEQ ID NO: 25405 - protein, 13 aa, BK virus
PDPSRNENARYFG

SEQ ID NO: 25406 - protein, 13 aa, BK virus
DPSRNENARYFGT

SEQ ID NO: 25407 - protein, 13 aa, BK virus
PSRNENARYFGTF

SEQ ID NO: 25408 - protein, 13 aa, BK virus
SRNENARYFGTFT

SEQ ID NO: 25409 - protein, 13 aa, BK virus
RNENARYFGTFTG

SEQ ID NO: 25410 - protein, 13 aa, BK virus
NENARYFGTFTGG

SEQ ID NO: 25411 - protein, 13 aa, BK virus
ENARYFGTFTGGE

SEQ ID NO: 25412 - protein, 13 aa, BK virus
NARYFGTFTGGEN

SEQ ID NO: 25413 - protein, 13 aa, BK virus
ARYFGTFTGGENV

SEQ ID NO: 25414 - protein, 13 aa, BK virus
RYFGTFTGGENVP

SEQ ID NO: 25415 - protein, 13 aa, BK virus
YFGTFTGGENVPP

SEQ ID NO: 25416 - protein, 13 aa, BK virus
FGTFTGGENVPPV

SEQ ID NO: 25417 - protein, 13 aa, BK virus
GTFTGGENVPPVL

SEQ ID NO: 25418 - protein, 13 aa, BK virus
TFTGGENVPPVLH

SEQ ID NO: 25419 - protein, 13 aa, BK virus
FTGGENVPPVLHV

SEQ ID NO: 25420 - protein, 13 aa, BK virus
TGGENVPPVLHVT

SEQ ID NO: 25421 - protein, 13 aa, BK virus
GGENVPPVLHVTN

SEQ ID NO: 25422 - protein, 13 aa, BK virus
GENVPPVLHVTNT

SEQ ID NO: 25423 - protein, 13 aa, BK virus
ENVPPVLHVTNTA

SEQ ID NO: 25424 - protein, 13 aa, BK virus
NVPPVLHVTNTAT

SEQ ID NO: 25425 - protein, 13 aa, BK virus
VPPVLHVTNTATT

SEQ ID NO: 25426 - protein, 13 aa, BK virus
PPVLHVTNTATTV

SEQ ID NO: 25427 - protein, 13 aa, BK virus
PVLHVTNTATTVL

SEQ ID NO: 25428 - protein, 13 aa, BK virus
VLHVTNTATTVLL

SEQ ID NO: 25429 - protein, 13 aa, BK virus
LHVTNTATTVLLD

SEQ ID NO: 25430 - protein, 13 aa, BK virus
HVTNTATTVLLDE

SEQ ID NO: 25431 - protein, 13 aa, BK virus
VTNTATTVLLDEQ

SEQ ID NO: 25432 - protein, 13 aa, BK virus
TNTATTVLLDEQG

SEQ ID NO: 25433 - protein, 13 aa, BK virus
NTATTVLLDEQGV

SEQ ID NO: 25434 - protein, 13 aa, BK virus
TATTVLLDEQGVG

SEQ ID NO: 25435 - protein, 13 aa, BK virus
ATTVLLDEQGVGP

SEQ ID NO: 25436 - protein, 13 aa, BK virus
TTVLLDEQGVGPL

SEQ ID NO: 25437 - protein, 13 aa, BK virus
TVLLDEQGVGPLC

SEQ ID NO: 25438 - protein, 13 aa, BK virus
VLLDEQGVGPLCK

SEQ ID NO: 25439 - protein, 13 aa, BK virus
LLDEQGVGPLCKA

SEQ ID NO: 25440 - protein, 13 aa, BK virus
LDEQGVGPLCKAD

SEQ ID NO: 25441 - protein, 13 aa, BK virus
DEQGVGPLCKADS

SEQ ID NO: 25442 - protein, 13 aa, BK virus
EQGVGPLCKADSL

SEQ ID NO: 25443 - protein, 13 aa, BK virus
QGVGPLCKADSLY

SEQ ID NO: 25444 - protein, 13 aa, BK virus
GVGPLCKADSLYV

SEQ ID NO: 25445 - protein, 13 aa, BK virus
VGPLCKADSLYVS

SEQ ID NO: 25446 - protein, 13 aa, BK virus
GPLCKADSLYVSA

SEQ ID NO: 25447 - protein, 13 aa, BK virus
PLCKADSLYVSAA

SEQ ID NO: 25448 - protein, 13 aa, BK virus
LCKADSLYVSAAD

SEQ ID NO: 25449 - protein, 13 aa, BK virus
CKADSLYVSAADI

SEQ ID NO: 25450 - protein, 13 aa, BK virus
KADSLYVSAADIC

SEQ ID NO: 25451 - protein, 13 aa, BK virus
ADSLYVSAADICG

SEQ ID NO: 25452 - protein, 13 aa, BK virus
DSLYVSAADICGL

SEQ ID NO: 25453 - protein, 13 aa, BK virus
SLYVSAADICGLF

SEQ ID NO: 25454 - protein, 13 aa, BK virus
LYVSAADICGLFT

SEQ ID NO: 25455 - protein, 13 aa, BK virus
YVSAADICGLFTN

SEQ ID NO: 25456 - protein, 13 aa, BK virus
VSAADICGLFTNS

SEQ ID NO: 25457 - protein, 13 aa, BK virus
SAADICGLFTNSS

SEQ ID NO: 25458 - protein, 13 aa, BK virus
AADICGLFTNSSG

SEQ ID NO: 25459 - protein, 13 aa, BK virus
ADICGLFTNSSGT

SEQ ID NO: 25460 - protein, 13 aa, BK virus
DICGLFTNSSGTQ

SEQ ID NO: 25461 - protein, 13 aa, BK virus
ICGLFTNSSGTQQ

SEQ ID NO: 25462 - protein, 13 aa, BK virus
CGLFTNSSGTQQW

SEQ ID NO: 25463 - protein, 13 aa, BK virus
GLFTNSSGTQQWR

SEQ ID NO: 25464 - protein, 13 aa, BK virus
LFTNSSGTQQWRG

SEQ ID NO: 25465 - protein, 13 aa, BK virus
FTNSSGTQQWRGL

SEQ ID NO: 25466 - protein, 13 aa, BK virus
TNSSGTQQWRGLA

SEQ ID NO: 25467 - protein, 13 aa, BK virus
NSSGTQQWRGLAR

SEQ ID NO: 25468 - protein, 13 aa, BK virus
SSGTQQWRGLARY

SEQ ID NO: 25469 - protein, 13 aa, BK virus
SGTQQWRGLARYF

SEQ ID NO: 25470 - protein, 13 aa, BK virus
GTQQWRGLARYFK

SEQ ID NO: 25471 - protein, 13 aa, BK virus
TQQWRGLARYFKI

SEQ ID NO: 25472 - protein, 13 aa, BK virus
QQWRGLARYFKIR

SEQ ID NO: 25473 - protein, 13 aa, BK virus
QWRGLARYFKIRL

SEQ ID NO: 25474 - protein, 13 aa, BK virus
WRGLARYFKIRLR

SEQ ID NO: 25475 - protein, 13 aa, BK virus
RGLARYFKIRLRK

SEQ ID NO: 25476 - protein, 13 aa, BK virus
GLARYFKIRLRKR

SEQ ID NO: 25477 - protein, 13 aa, BK virus
LARYFKIRLRKRS

SEQ ID NO: 25478 - protein, 13 aa, BK virus
ARYFKIRLRKRSV

SEQ ID NO: 25479 - protein, 13 aa, BK virus
RYFKIRLRKRSVK

SEQ ID NO: 25480 - protein, 13 aa, BK virus
YFKIRLRKRSVKN

SEQ ID NO: 25481 - protein, 13 aa, BK virus
FKIRLRKRSVKNP

SEQ ID NO: 25482 - protein, 13 aa, BK virus
KIRLRKRSVKNPY

SEQ ID NO: 25483 - protein, 13 aa, BK virus
IRLRKRSVKNPYP

SEQ ID NO: 25484 - protein, 13 aa, BK virus
RLRKRSVKNPYPI

SEQ ID NO: 25485 - protein, 13 aa, BK virus
LRKRSVKNPYPIS

SEQ ID NO: 25486 - protein, 13 aa, BK virus
RKRSVKNPYPISF

SEQ ID NO: 25487 - protein, 13 aa, BK virus
KRSVKNPYPISFL

SEQ ID NO: 25488 - protein, 13 aa, BK virus
RSVKNPYPISFLL

SEQ ID NO: 25489 - protein, 13 aa, BK virus
SVKNPYPISFLLS

SEQ ID NO: 25490 - protein, 13 aa, BK virus
VKNPYPISFLLSD

SEQ ID NO: 25491 - protein, 13 aa, BK virus
KNPYPISFLLSDL

SEQ ID NO: 25492 - protein, 13 aa, BK virus
NPYPISFLLSDLI

SEQ ID NO: 25493 - protein, 13 aa, BK virus
PYPISFLLSDLIN

SEQ ID NO: 25494 - protein, 13 aa, BK virus
YPISFLLSDLINR

SEQ ID NO: 25495 - protein, 13 aa, BK virus
PISFLLSDLINRR

SEQ ID NO: 25496 - protein, 13 aa, BK virus
ISFLLSDLINRRT

SEQ ID NO: 25497 - protein, 13 aa, BK virus
SFLLSDLINRRTQ

SEQ ID NO: 25498 - protein, 13 aa, BK virus
FLLSDLINRRTQR

SEQ ID NO: 25499 - protein, 13 aa, BK virus
LLSDLINRRTQRV

SEQ ID NO: 25500 - protein, 13 aa, BK virus
LSDLINRRTQRVD

SEQ ID NO: 25501 - protein, 13 aa, BK virus
SDLINRRTQRVDG

SEQ ID NO: 25502 - protein, 13 aa, BK virus
DLINRRTQRVDGQ

SEQ ID NO: 25503 - protein, 13 aa, BK virus
LINRRTQRVDGQP

SEQ ID NO: 25504 - protein, 13 aa, BK virus
INRRTQRVDGQPM

SEQ ID NO: 25505 - protein, 13 aa, BK virus
NRRTQRVDGQPMY

SEQ ID NO: 25506 - protein, 13 aa, BK virus
RRTQRVDGQPMYG

SEQ ID NO: 25507 - protein, 13 aa, BK virus
RTQRVDGQPMYGM

SEQ ID NO: 25508 - protein, 13 aa, BK virus
TQRVDGQPMYGME

SEQ ID NO: 25509 - protein, 13 aa, BK virus
QRVDGQPMYGMES

SEQ ID NO: 25510 - protein, 13 aa, BK virus
RVDGQPMYGMESQ

SEQ ID NO: 25511 - protein, 13 aa, BK virus
VDGQPMYGMESQV

SEQ ID NO: 25512 - protein, 13 aa, BK virus
DGQPMYGMESQVE

SEQ ID NO: 25513 - protein, 13 aa, BK virus
GQPMYGMESQVEE

SEQ ID NO: 25514 - protein, 13 aa, BK virus
QPMYGMESQVEEV

SEQ ID NO: 25515 - protein, 13 aa, BK virus
PMYGMESQVEEVR

SEQ ID NO: 25516 - protein, 13 aa, BK virus
MYGMESQVEEVRV

SEQ ID NO: 25517 - protein, 13 aa, BK virus
YGMESQVEEVRVF

SEQ ID NO: 25518 - protein, 13 aa, BK virus
GMESQVEEVRVFD

SEQ ID NO: 25519 - protein, 13 aa, BK virus
MESQVEEVRVFDG

SEQ ID NO: 25520 - protein, 13 aa, BK virus
ESQVEEVRVFDGT

SEQ ID NO: 25521 - protein, 13 aa, BK virus
SQVEEVRVFDGTE

SEQ ID NO: 25522 - protein, 13 aa, BK virus
QVEEVRVFDGTER

SEQ ID NO: 25523 - protein, 13 aa, BK virus
VEEVRVFDGTERL

SEQ ID NO: 25524 - protein, 13 aa, BK virus
EEVRVFDGTERLP

SEQ ID NO: 25525 - protein, 13 aa, BK virus
EVRVFDGTERLPG

SEQ ID NO: 25526 - protein, 13 aa, BK virus
VRVFDGTERLPGD

SEQ ID NO: 25527 - protein, 13 aa, BK virus
RVFDGTERLPGDP

SEQ ID NO: 25528 - protein, 13 aa, BK virus
VFDGTERLPGDPD

SEQ ID NO: 25529 - protein, 13 aa, BK virus
FDGTERLPGDPDM

SEQ ID NO: 25530 - protein, 13 aa, BK virus
DGTERLPGDPDMI

SEQ ID NO: 25531 - protein, 13 aa, BK virus
GTERLPGDPDMIR

SEQ ID NO: 25532 - protein, 13 aa, BK virus
TERLPGDPDMIRY

SEQ ID NO: 25533 - protein, 13 aa, BK virus
ERLPGDPDMIRYI

SEQ ID NO: 25534 - protein, 13 aa, BK virus
RLPGDPDMIRYID

SEQ ID NO: 25535 - protein, 13 aa, BK virus
LPGDPDMIRYIDK

SEQ ID NO: 25536 - protein, 13 aa, BK virus
PGDPDMIRYIDKQ

SEQ ID NO: 25537 - protein, 13 aa, BK virus
GDPDMIRYIDKQG

SEQ ID NO: 25538 - protein, 13 aa, BK virus
DPDMIRYIDKQGQ

SEQ ID NO: 25539 - protein, 13 aa, BK virus
PDMIRYIDKQGQL

SEQ ID NO: 25540 - protein, 13 aa, BK virus
DMIRYIDKQGQLQ

SEQ ID NO: 25541 - protein, 13 aa, BK virus
MIRYIDKQGQLQT

SEQ ID NO: 25542 - protein, 13 aa, BK virus
IRYIDKQGQLQTK

SEQ ID NO: 25543 - protein, 13 aa, BK virus
RYIDKQGQLQTKM

SEQ ID NO: 25544 - protein, 13 aa, BK virus
YIDKQGQLQTKML

SEQ ID NO: 25545 - protein, 13 aa, BK virus
TGAFIVHIHLINA

SEQ ID NO: 25546 - protein, 13 aa, BK virus
GAFIVHIHLINAA

SEQ ID NO: 25547 - protein, 13 aa, BK virus
AFIVHIHLINAAF

SEQ ID NO: 25548 - protein, 13 aa, BK virus
FIVHIHLINAAFV

SEQ ID NO: 25549 - protein, 13 aa, BK virus
ATFKLVLFWGWCF

SEQ ID NO: 25550 - protein, 13 aa, BK virus
TFKLVLFWGWCFR

SEQ ID NO: 25551 - protein, 13 aa, BK virus
FKLVLFWGWCFRP

SEQ ID NO: 25552 - protein, 13 aa, BK virus
KLVLFWGWCFRPF

SEQ ID NO: 25553 - protein, 13 aa, BK virus
LVLFWGWCFRPFK

SEQ ID NO: 25554 - protein, 13 aa, BK virus
VLFWGWCFRPFKT

SEQ ID NO: 25555 - protein, 13 aa, BK virus
LFWGWCFRPFKTL

SEQ ID NO: 25556 - protein, 13 aa, BK virus
FWGWCFRPFKTLK

SEQ ID NO: 25557 - protein, 13 aa, BK virus
WGWCFRPFKTLKA

SEQ ID NO: 25558 - protein, 13 aa, BK virus
GWCFRPFKTLKAF

SEQ ID NO: 25559 - protein, 13 aa, BK virus
WCFRPFKTLKAFT

SEQ ID NO: 25560 - protein, 13 aa, BK virus
CFRPFKTLKAFTQ

SEQ ID NO: 25561 - protein, 13 aa, BK virus
FRPFKTLKAFTQM

SEQ ID NO: 25562 - protein, 13 aa, BK virus
RPFKTLKAFTQMQ

SEQ ID NO: 25563 - protein, 13 aa, BK virus
PFKTLKAFTQMQL

SEQ ID NO: 25564 - protein, 13 aa, BK virus
FKTLKAFTQMQLL

SEQ ID NO: 25565 - protein, 13 aa, BK virus
KTLKAFTQMQLLT

SEQ ID NO: 25566 - protein, 13 aa, BK virus
TLKAFTQMQLLTM

SEQ ID NO: 25567 - protein, 13 aa, BK virus
LKAFTQMQLLTMG

SEQ ID NO: 25568 - protein, 13 aa, BK virus
KAFTQMQLLTMGV

SEQ ID NO: 25569 - protein, 13 aa, BK virus
ILFSCNIKNTFPH

SEQ ID NO: 25570 - protein, 13 aa, BK virus
LFSCNIKNTFPHA

SEQ ID NO: 25571 - protein, 13 aa, BK virus
FSCNIKNTFPHAY

SEQ ID NO: 25572 - protein, 13 aa, BK virus
SCNIKNTFPHAYI

SEQ ID NO: 25573 - protein, 13 aa, BK virus
CNIKNTFPHAYII

SEQ ID NO: 25574 - protein, 13 aa, BK virus
NIKNTFPHAYIIF

SEQ ID NO: 25575 - protein, 13 aa, BK virus
IKNTFPHAYIIFH

SEQ ID NO: 25576 - protein, 13 aa, BK virus
KNTFPHAYIIFHP

SEQ ID NO: 25577 - protein, 13 aa, BK virus
KSIHTYLRIQPFL

SEQ ID NO: 25578 - protein, 13 aa, BK virus
SIHTYLRIQPFLP

SEQ ID NO: 25579 - protein, 13 aa, BK virus
IHTYLRIQPFLPF

SEQ ID NO: 25580 - protein, 13 aa, BK virus
HTYLRIQPFLPFN

SEQ ID NO: 25581 - protein, 13 aa, BK virus
TYLRIQPFLPFNN

SEQ ID NO: 25582 - protein, 13 aa, BK virus
YLRIQPFLPFNNS

SEQ ID NO: 25583 - protein, 13 aa, BK virus
LRIQPFLPFNNSR

SEQ ID NO: 25584 - protein, 13 aa, BK virus
RIQPFLPFNNSRL

SEQ ID NO: 25585 - protein, 13 aa, BK virus
IQPFLPFNNSRLY

SEQ ID NO: 25586 - protein, 13 aa, BK virus
QPFLPFNNSRLYI

SEQ ID NO: 25587 - protein, 13 aa, BK virus
PFLPFNNSRLYIS

SEQ ID NO: 25588 - protein, 13 aa, BK virus
FLPFNNSRLYISC

SEQ ID NO: 25589 - protein, 13 aa, BK virus
LPFNNSRLYISCK

SEQ ID NO: 25590 - protein, 13 aa, BK virus
PFNNSRLYISCKI

SEQ ID NO: 25591 - protein, 13 aa, BK virus
FNNSRLYISCKIS

SEQ ID NO: 25592 - protein, 13 aa, BK virus
NNSRLYISCKISY

SEQ ID NO: 25593 - protein, 13 aa, BK virus
NSRLYISCKISYR

SEQ ID NO: 25594 - protein, 13 aa, BK virus
SRLYISCKISYRP

SEQ ID NO: 25595 - protein, 13 aa, BK virus
RLYISCKISYRPK

SEQ ID NO: 25596 - protein, 13 aa, BK virus
LYISCKISYRPKP

SEQ ID NO: 25597 - protein, 13 aa, BK virus
YISCKISYRPKPN

SEQ ID NO: 25598 - protein, 13 aa, BK virus
IYFGPKIYLSYKS

SEQ ID NO: 25599 - protein, 13 aa, BK virus
YFGPKIYLSYKSS

SEQ ID NO: 25600 - protein, 13 aa, BK virus
FGPKIYLSYKSSL

SEQ ID NO: 25601 - protein, 13 aa, BK virus
GPKIYLSYKSSLQ

SEQ ID NO: 25602 - protein, 13 aa, BK virus
PKIYLSYKSSLQG

SEQ ID NO: 25603 - protein, 13 aa, BK virus
KIYLSYKSSLQGF

SEQ ID NO: 25604 - protein, 13 aa, BK virus
IYLSYKSSLQGFR

SEQ ID NO: 25605 - protein, 13 aa, BK virus
YLSYKSSLQGFRD

SEQ ID NO: 25606 - protein, 13 aa, BK virus
LSYKSSLQGFRDR

SEQ ID NO: 25607 - protein, 13 aa, BK virus
SYKSSLQGFRDRI

SEQ ID NO: 25608 - protein, 13 aa, BK virus
YKSSLQGFRDRIL

SEQ ID NO: 25609 - protein, 13 aa, BK virus
KSSLQGFRDRILI

SEQ ID NO: 25610 - protein, 13 aa, BK virus
SSLQGFRDRILIH

SEQ ID NO: 25611 - protein, 13 aa, BK virus
SLQGFRDRILIHC

SEQ ID NO: 25612 - protein, 13 aa, BK virus
LQGFRDRILIHCN

SEQ ID NO: 25613 - protein, 13 aa, BK virus
QGFRDRILIHCNQ

SEQ ID NO: 25614 - protein, 13 aa, BK virus
GFRDRILIHCNQA

SEQ ID NO: 25615 - protein, 13 aa, BK virus
FRDRILIHCNQAW

SEQ ID NO: 25616 - protein, 13 aa, BK virus
RDRILIHCNQAWW

SEQ ID NO: 25617 - protein, 13 aa, BK virus
DRILIHCNQAWWK

SEQ ID NO: 25618 - protein, 13 aa, BK virus
RILIHCNQAWWKY

SEQ ID NO: 25619 - protein, 13 aa, BK virus
ILIHCNQAWWKYL

SEQ ID NO: 25620 - protein, 13 aa, BK virus
LIHCNQAWWKYLG

SEQ ID NO: 25621 - protein, 13 aa, BK virus
IHCNQAWWKYLGS

SEQ ID NO: 25622 - protein, 13 aa, BK virus
HCNQAWWKYLGSF

SEQ ID NO: 25623 - protein, 13 aa, BK virus
CNQAWWKYLGSFV

SEQ ID NO: 25624 - protein, 13 aa, BK virus
FSSCPFYIFKNNH

SEQ ID NO: 25625 - protein, 13 aa, BK virus
SSCPFYIFKNNHV

SEQ ID NO: 25626 - protein, 13 aa, BK virus
SCPFYIFKNNHVL

SEQ ID NO: 25627 - protein, 13 aa, BK virus
CPFYIFKNNHVLI

SEQ ID NO: 25628 - protein, 13 aa, BK virus
PFYIFKNNHVLIY

SEQ ID NO: 25629 - protein, 13 aa, BK virus
FYIFKNNHVLIYS

SEQ ID NO: 25630 - protein, 13 aa, BK virus
YIFKNNHVLIYSY

SEQ ID NO: 25631 - protein, 13 aa, BK virus
IFKNNHVLIYSYT

SEQ ID NO: 25632 - protein, 13 aa, BK virus
PVSSFRYIENNTV

SEQ ID NO: 25633 - protein, 13 aa, BK virus
VSSFRYIENNTVQ

SEQ ID NO: 25634 - protein, 13 aa, BK virus
SSFRYIENNTVQK

SEQ ID NO: 25635 - protein, 13 aa, BK virus
SFRYIENNTVQKI

SEQ ID NO: 25636 - protein, 13 aa, BK virus
FRYIENNTVQKIK

SEQ ID NO: 25637 - protein, 13 aa, BK virus
RYIENNTVQKIKY

SEQ ID NO: 25638 - protein, 13 aa, BK virus
YIENNTVQKIKYY

SEQ ID NO: 25639 - protein, 13 aa, BK virus
IENNTVQKIKYYR

SEQ ID NO: 25640 - protein, 13 aa, BK virus
ENNTVQKIKYYRI

SEQ ID NO: 25641 - protein, 13 aa, BK virus
NNTVQKIKYYRIH

SEQ ID NO: 25642 - protein, 13 aa, BK virus
NTVQKIKYYRIHF

SEQ ID NO: 25643 - protein, 13 aa, BK virus
TVQKIKYYRIHFR

SEQ ID NO: 25644 - protein, 13 aa, BK virus
QTVQPSNTCHILF

SEQ ID NO: 25645 - protein, 13 aa, BK virus
HFFPGHMKGIYSF

SEQ ID NO: 25646 - protein, 13 aa, BK virus
FFPGHMKGIYSFF

SEQ ID NO: 25647 - protein, 13 aa, BK virus
FPGHMKGIYSFFS

SEQ ID NO: 25648 - protein, 13 aa, BK virus
NCIYCLLTNTFLI

SEQ ID NO: 25649 - protein, 13 aa, BK virus
CIYCLLTNTFLIF

SEQ ID NO: 25650 - protein, 13 aa, BK virus
IYCLLTNTFLIFT

SEQ ID NO: 25651 - protein, 13 aa, BK virus
YCLLTNTFLIFTF

SEQ ID NO: 25652 - protein, 13 aa, BK virus
CLLTNTFLIFTFC

SEQ ID NO: 25653 - protein, 13 aa, BK virus
LLTNTFLIFTFCK

SEQ ID NO: 25654 - protein, 13 aa, BK virus
LTNTFLIFTFCKN

SEQ ID NO: 25655 - protein, 13 aa, BK virus
TNTFLIFTFCKNN

SEQ ID NO: 25656 - protein, 13 aa, BK virus
NTFLIFTFCKNNS

SEQ ID NO: 25657 - protein, 13 aa, BK virus
TFLIFTFCKNNSI

SEQ ID NO: 25658 - protein, 13 aa, BK virus
FLIFTFCKNNSIC

SEQ ID NO: 25659 - protein, 13 aa, BK virus
LIFTFCKNNSICK

SEQ ID NO: 25660 - protein, 13 aa, BK virus
IFTFCKNNSICKV

SEQ ID NO: 25661 - protein, 13 aa, BK virus
FTFCKNNSICKVL

SEQ ID NO: 25662 - protein, 13 aa, BK virus
TFCKNNSICKVLF

SEQ ID NO: 25663 - protein, 13 aa, BK virus
FCKNNSICKVLFM

SEQ ID NO: 25664 - protein, 13 aa, BK virus
CKNNSICKVLFMI

SEQ ID NO: 25665 - protein, 13 aa, BK virus
KNNSICKVLFMIL

SEQ ID NO: 25666 - protein, 13 aa, BK virus
NNSICKVLFMILK

SEQ ID NO: 25667 - protein, 13 aa, BK virus
NSICKVLFMILKV

SEQ ID NO: 25668 - protein, 13 aa, BK virus
SICKVLFMILKVI

SEQ ID NO: 25669 - protein, 13 aa, BK virus
ICKVLFMILKVIR

SEQ ID NO: 25670 - protein, 13 aa, BK virus
CKVLFMILKVIRL

SEQ ID NO: 25671 - protein, 13 aa, BK virus
KVLFMILKVIRLV

SEQ ID NO: 25672 - protein, 13 aa, BK virus
VLFMILKVIRLVF

SEQ ID NO: 25673 - protein, 13 aa, BK virus
LFMILKVIRLVFF

SEQ ID NO: 25674 - protein, 13 aa, BK virus
FMILKVIRLVFFL

SEQ ID NO: 25675 - protein, 13 aa, BK virus
MILKVIRLVFFLT

SEQ ID NO: 25676 - protein, 13 aa, BK virus
ILKVIRLVFFLTL

SEQ ID NO: 25677 - protein, 13 aa, BK virus
LKVIRLVFFLTLF

SEQ ID NO: 25678 - protein, 13 aa, BK virus
KVIRLVFFLTLFT

SEQ ID NO: 25679 - protein, 13 aa, BK virus
VIRLVFFLTLFTL

SEQ ID NO: 25680 - protein, 13 aa, BK virus
IRLVFFLTLFTLL

SEQ ID NO: 25681 - protein, 13 aa, BK virus
RLVFFLTLFTLLY

SEQ ID NO: 25682 - protein, 13 aa, BK virus
LVFFLTLFTLLYI

SEQ ID NO: 25683 - protein, 13 aa, BK virus
VFFLTLFTLLYIV

SEQ ID NO: 25684 - protein, 13 aa, BK virus
FFLTLFTLLYIVL

SEQ ID NO: 25685 - protein, 13 aa, BK virus
FLTLFTLLYIVLK

SEQ ID NO: 25686 - protein, 13 aa, BK virus
LTLFTLLYIVLKF

SEQ ID NO: 25687 - protein, 13 aa, BK virus
KHILTLCLYCILS

SEQ ID NO: 25688 - protein, 13 aa, BK virus
HILTLCLYCILSN

SEQ ID NO: 25689 - protein, 13 aa, BK virus
FPRHLLCFFRLFW

SEQ ID NO: 25690 - protein, 13 aa, BK virus
PRHLLCFFRLFWA

SEQ ID NO: 25691 - protein, 13 aa, BK virus
RHLLCFFRLFWAK

SEQ ID NO: 25692 - protein, 13 aa, BK virus
HLLCFFRLFWAKI

SEQ ID NO: 25693 - protein, 13 aa, BK virus
LLCFFRLFWAKIM

SEQ ID NO: 25694 - protein, 13 aa, BK virus
LCFFRLFWAKIML

SEQ ID NO: 25695 - protein, 13 aa, BK virus
CFFRLFWAKIMLL

SEQ ID NO: 25696 - protein, 13 aa, BK virus
APLNAFFYSMVWI

SEQ ID NO: 25697 - protein, 13 aa, BK virus
PLNAFFYSMVWIS

SEQ ID NO: 25698 - protein, 13 aa, BK virus
LNAFFYSMVWISS

SEQ ID NO: 25699 - protein, 13 aa, BK virus
KTKGTQLLTEIIN

SEQ ID NO: 25700 - protein, 13 aa, BK virus
TKGTQLLTEIINC

SEQ ID NO: 25701 - protein, 13 aa, BK virus
KGTQLLTEIINCR

SEQ ID NO: 25702 - protein, 13 aa, BK virus
GTQLLTEIINCRN

SEQ ID NO: 25703 - protein, 13 aa, BK virus
TQLLTEIINCRNS

SEQ ID NO: 25704 - protein, 13 aa, BK virus
QLLTEIINCRNSM

SEQ ID NO: 25705 - protein, 13 aa, BK virus
LLTEIINCRNSMS

SEQ ID NO: 25706 - protein, 13 aa, BK virus
LTEIINCRNSMSM

SEQ ID NO: 25707 - protein, 13 aa, BK virus
TEIINCRNSMSMW

SEQ ID NO: 25708 - protein, 13 aa, BK virus
EIINCRNSMSMWS

SEQ ID NO: 25709 - protein, 13 aa, BK virus
KEYNIMPSTHVST

SEQ ID NO: 25710 - protein, 13 aa, BK virus
EYNIMPSTHVSTN

SEQ ID NO: 25711 - protein, 13 aa, BK virus
YNIMPSTHVSTNK

SEQ ID NO: 25712 - protein, 13 aa, BK virus
NIMPSTHVSTNKS

SEQ ID NO: 25713 - protein, 13 aa, BK virus
IMPSTHVSTNKSY

SEQ ID NO: 25714 - protein, 13 aa, BK virus
MPSTHVSTNKSYR

SEQ ID NO: 25715 - protein, 13 aa, BK virus
PSTHVSTNKSYRI

SEQ ID NO: 25716 - protein, 13 aa, BK virus
STHVSTNKSYRIF

SEQ ID NO: 25717 - protein, 13 aa, BK virus
THVSTNKSYRIFF

SEQ ID NO: 25718 - protein, 13 aa, BK virus
HVSTNKSYRIFFH

SEQ ID NO: 25719 - protein, 13 aa, BK virus
VSTNKSYRIFFHK

SEQ ID NO: 25720 - protein, 13 aa, BK virus
STNKSYRIFFHKF

SEQ ID NO: 25721 - protein, 13 aa, BK virus
TNKSYRIFFHKFF

SEQ ID NO: 25722 - protein, 13 aa, BK virus
NKSYRIFFHKFFI

SEQ ID NO: 25723 - protein, 13 aa, BK virus
KSYRIFFHKFFIQ

SEQ ID NO: 25724 - protein, 13 aa, BK virus
SYRIFFHKFFIQN

SEQ ID NO: 25725 - protein, 13 aa, BK virus
YRIFFHKFFIQNL

SEQ ID NO: 25726 - protein, 13 aa, BK virus
RIFFHKFFIQNLS

SEQ ID NO: 25727 - protein, 13 aa, BK virus
IFFHKFFIQNLSF

SEQ ID NO: 25728 - protein, 13 aa, BK virus
FFHKFFIQNLSFF

SEQ ID NO: 25729 - protein, 13 aa, BK virus
FHKFFIQNLSFFF

SEQ ID NO: 25730 - protein, 13 aa, BK virus
HKFFIQNLSFFFS

SEQ ID NO: 25731 - protein, 13 aa, BK virus
KFFIQNLSFFFSS

SEQ ID NO: 25732 - protein, 13 aa, BK virus
FFIQNLSFFFSSI

SEQ ID NO: 25733 - protein, 13 aa, BK virus
FIQNLSFFFSSIH

SEQ ID NO: 25734 - protein, 13 aa, BK virus
IQNLSFFFSSIHS

SEQ ID NO: 25735 - protein, 13 aa, BK virus
QNLSFFFSSIHSK

SEQ ID NO: 25736 - protein, 13 aa, BK virus
NLSFFFSSIHSKA

SEQ ID NO: 25737 - protein, 13 aa, BK virus
LSFFFSSIHSKAG

SEQ ID NO: 25738 - protein, 13 aa, BK virus
SFFFSSIHSKAGK

SEQ ID NO: 25739 - protein, 13 aa, BK virus
FFFSSIHSKAGKG

SEQ ID NO: 25740 - protein, 13 aa, BK virus
FFSSIHSKAGKGS

SEQ ID NO: 25741 - protein, 13 aa, BK virus
FSSIHSKAGKGSI

SEQ ID NO: 25742 - protein, 13 aa, BK virus
SSIHSKAGKGSIT

SEQ ID NO: 25743 - protein, 13 aa, BK virus
SIHSKAGKGSITK

SEQ ID NO: 25744 - protein, 13 aa, BK virus
IHSKAGKGSITKY

SEQ ID NO: 25745 - protein, 13 aa, BK virus
HSKAGKGSITKYS

SEQ ID NO: 25746 - protein, 13 aa, BK virus
SKAGKGSITKYSL

SEQ ID NO: 25747 - protein, 13 aa, BK virus
KAGKGSITKYSLT

SEQ ID NO: 25748 - protein, 13 aa, BK virus
AGKGSITKYSLTK

SEQ ID NO: 25749 - protein, 13 aa, BK virus
GKGSITKYSLTKK

SEQ ID NO: 25750 - protein, 13 aa, BK virus
KGSITKYSLTKKL

SEQ ID NO: 25751 - protein, 13 aa, BK virus
GSITKYSLTKKLV

SEQ ID NO: 25752 - protein, 13 aa, BK virus
IRGKVFRVFYLSF

SEQ ID NO: 25753 - protein, 13 aa, BK virus
RGKVFRVFYLSFF

SEQ ID NO: 25754 - protein, 13 aa, BK virus
GKVFRVFYLSFFF

SEQ ID NO: 25755 - protein, 13 aa, BK virus
KVFRVFYLSFFFG

SEQ ID NO: 25756 - protein, 13 aa, BK virus
VFRVFYLSFFFGW

SEQ ID NO: 25757 - protein, 13 aa, BK virus
FRVFYLSFFFGWC

SEQ ID NO: 25758 - protein, 13 aa, BK virus
VLRICCCFFITGK

SEQ ID NO: 25759 - protein, 13 aa, BK virus
LRICCCFFITGKH

SEQ ID NO: 25760 - protein, 13 aa, BK virus
RICCCFFITGKHI

SEQ ID NO: 25761 - protein, 13 aa, BK virus
ICCCFFITGKHIF

SEQ ID NO: 25762 - protein, 13 aa, BK virus
CCCFFITGKHIFM

SEQ ID NO: 25763 - protein, 13 aa, BK virus
CCFFITGKHIFMA

SEQ ID NO: 25764 - protein, 13 aa, BK virus
CFFITGKHIFMAK

SEQ ID NO: 25765 - protein, 13 aa, BK virus
IFIPFFIKGTPPG

SEQ ID NO: 25766 - protein, 13 aa, BK virus
FIPFFIKGTPPGL

SEQ ID NO: 25767 - protein, 13 aa, BK virus
IPFFIKGTPPGLP

SEQ ID NO: 25768 - protein, 13 aa, BK virus
PFFIKGTPPGLPL

SEQ ID NO: 25769 - protein, 13 aa, BK virus
FFIKGTPPGLPLF

SEQ ID NO: 25770 - protein, 13 aa, BK virus
FIKGTPPGLPLFC

SEQ ID NO: 25771 - protein, 13 aa, BK virus
IKGTPPGLPLFCS

SEQ ID NO: 25772 - protein, 13 aa, BK virus
KGTPPGLPLFCSI

SEQ ID NO: 25773 - protein, 13 aa, BK virus
GTPPGLPLFCSIG

SEQ ID NO: 25774 - protein, 13 aa, BK virus
TPPGLPLFCSIGW

SEQ ID NO: 25775 - protein, 13 aa, BK virus
PPGLPLFCSIGWH

SEQ ID NO: 25776 - protein, 13 aa, BK virus
PGLPLFCSIGWHL

SEQ ID NO: 25777 - protein, 13 aa, BK virus
SFRSLKGVSPIIW

SEQ ID NO: 25778 - protein, 13 aa, BK virus
FRSLKGVSPIIWT

SEQ ID NO: 25779 - protein, 13 aa, BK virus
RSLKGVSPIIWTH

SEQ ID NO: 25780 - protein, 13 aa, BK virus
SLKGVSPIIWTHH

SEQ ID NO: 25781 - protein, 13 aa, BK virus
LKGVSPIIWTHHC

SEQ ID NO: 25782 - protein, 13 aa, BK virus
KGVSPIIWTHHCR

SEQ ID NO: 25783 - protein, 13 aa, BK virus
GVSPIIWTHHCRV

SEQ ID NO: 25784 - protein, 13 aa, BK virus
VSPIIWTHHCRVS

SEQ ID NO: 25785 - protein, 13 aa, BK virus
SPIIWTHHCRVSS

SEQ ID NO: 25786 - protein, 13 aa, BK virus
PIIWTHHCRVSSV

SEQ ID NO: 25787 - protein, 13 aa, BK virus
IIWTHHCRVSSVR

SEQ ID NO: 25788 - protein, 13 aa, BK virus
IWTHHCRVSSVRS

SEQ ID NO: 25789 - protein, 13 aa, BK virus
WTHHCRVSSVRSK

SEQ ID NO: 25790 - protein, 13 aa, BK virus
THHCRVSSVRSKP

SEQ ID NO: 25791 - protein, 13 aa, BK virus
HHCRVSSVRSKPN

SEQ ID NO: 25792 - protein, 13 aa, BK virus
HCRVSSVRSKPNH

SEQ ID NO: 25793 - protein, 13 aa, BK virus
CRVSSVRSKPNHC

SEQ ID NO: 25794 - protein, 13 aa, BK virus
RVSSVRSKPNHCV

SEQ ID NO: 25795 - protein, 13 aa, BK virus
VSSVRSKPNHCVK

SEQ ID NO: 25796 - protein, 13 aa, BK virus
SSVRSKPNHCVKQ

SEQ ID NO: 25797 - protein, 13 aa, BK virus
SVRSKPNHCVKQS

SEQ ID NO: 25798 - protein, 13 aa, BK virus
VRSKPNHCVKQSM

SEQ ID NO: 25799 - protein, 13 aa, BK virus
RSKPNHCVKQSMQ

SEQ ID NO: 25800 - protein, 13 aa, BK virus
QSIQTKGSFLKNF

SEQ ID NO: 25801 - protein, 13 aa, BK virus
SIQTKGSFLKNFL

SEQ ID NO: 25802 - protein, 13 aa, BK virus
IQTKGSFLKNFLF

SEQ ID NO: 25803 - protein, 13 aa, BK virus
QTKGSFLKNFLFK

SEQ ID NO: 25804 - protein, 13 aa, BK virus
TKGSFLKNFLFKC

SEQ ID NO: 25805 - protein, 13 aa, BK virus
KGSFLKNFLFKCL

SEQ ID NO: 25806 - protein, 13 aa, BK virus
GSFLKNFLFKCLN

SEQ ID NO: 25807 - protein, 13 aa, BK virus
SFLKNFLFKCLNL

SEQ ID NO: 25808 - protein, 13 aa, BK virus
FLKNFLFKCLNLS

SEQ ID NO: 25809 - protein, 13 aa, BK virus
HSMQGQCTEGFLE

SEQ ID NO: 25810 - protein, 13 aa, BK virus
SMQGQCTEGFLEQ

SEQ ID NO: 25811 - protein, 13 aa, BK virus
MQGQCTEGFLEQI

SEQ ID NO: 25812 - protein, 13 aa, BK virus
QGQCTEGFLEQIG

SEQ ID NO: 25813 - protein, 13 aa, BK virus
GQCTEGFLEQIGH

SEQ ID NO: 25814 - protein, 13 aa, BK virus
QCTEGFLEQIGHS

SEQ ID NO: 25815 - protein, 13 aa, BK virus
CTEGFLEQIGHSL

SEQ ID NO: 25816 - protein, 13 aa, BK virus
TEGFLEQIGHSLQ

SEQ ID NO: 25817 - protein, 13 aa, BK virus
EGFLEQIGHSLQY

SEQ ID NO: 25818 - protein, 13 aa, BK virus
GFLEQIGHSLQYR

SEQ ID NO: 25819 - protein, 13 aa, BK virus
FLEQIGHSLQYRV

SEQ ID NO: 25820 - protein, 13 aa, BK virus
LEQIGHSLQYRVS

SEQ ID NO: 25821 - protein, 13 aa, BK virus
EQIGHSLQYRVSG

SEQ ID NO: 25822 - protein, 13 aa, BK virus
QIGHSLQYRVSGQ

SEQ ID NO: 25823 - protein, 13 aa, BK virus
IGHSLQYRVSGQR

SEQ ID NO: 25824 - protein, 13 aa, BK virus
GHSLQYRVSGQRG

SEQ ID NO: 25825 - protein, 13 aa, BK virus
HSLQYRVSGQRGK

SEQ ID NO: 25826 - protein, 13 aa, BK virus
SLQYRVSGQRGKS

SEQ ID NO: 25827 - protein, 13 aa, BK virus
LQYRVSGQRGKSA

SEQ ID NO: 25828 - protein, 13 aa, BK virus
QYRVSGQRGKSAQ

SEQ ID NO: 25829 - protein, 13 aa, BK virus
YRVSGQRGKSAQT

SEQ ID NO: 25830 - protein, 13 aa, BK virus
RVSGQRGKSAQTS

SEQ ID NO: 25831 - protein, 13 aa, BK virus
VSGQRGKSAQTSE

SEQ ID NO: 25832 - protein, 13 aa, BK virus
SGQRGKSAQTSEL

SEQ ID NO: 25833 - protein, 13 aa, BK virus
GQRGKSAQTSELL

SEQ ID NO: 25834 - protein, 13 aa, BK virus
QRGKSAQTSELLQ

SEQ ID NO: 25835 - protein, 13 aa, BK virus
RGKSAQTSELLQV

SEQ ID NO: 25836 - protein, 13 aa, BK virus
GKSAQTSELLQVP

SEQ ID NO: 25837 - protein, 13 aa, BK virus
KSAQTSELLQVPK

SEQ ID NO: 25838 - protein, 13 aa, BK virus
SAQTSELLQVPKS

SEQ ID NO: 25839 - protein, 13 aa, BK virus
AQTSELLQVPKSG

SEQ ID NO: 25840 - protein, 13 aa, BK virus
ATFTSCSIFLYKV

SEQ ID NO: 25841 - protein, 13 aa, BK virus
TFTSCSIFLYKVF

SEQ ID NO: 25842 - protein, 13 aa, BK virus
FTSCSIFLYKVFI

SEQ ID NO: 25843 - protein, 13 aa, BK virus
TSCSIFLYKVFIL

SEQ ID NO: 25844 - protein, 13 aa, BK virus
SCSIFLYKVFILF

SEQ ID NO: 25845 - protein, 13 aa, BK virus
CSIFLYKVFILFI

SEQ ID NO: 25846 - protein, 13 aa, BK virus
SIFLYKVFILFIL

SEQ ID NO: 25847 - protein, 13 aa, BK virus
IFLYKVFILFILS

SEQ ID NO: 25848 - protein, 13 aa, BK virus
FLYKVFILFILSS

SEQ ID NO: 25849 - protein, 13 aa, BK virus
LYKVFILFILSSS

SEQ ID NO: 25850 - protein, 13 aa, BK virus
YKVFILFILSSSP

SEQ ID NO: 25851 - protein, 13 aa, BK virus
KVFILFILSSSPP

SEQ ID NO: 25852 - protein, 13 aa, BK virus
VFILFILSSSPPL

SEQ ID NO: 25853 - protein, 13 aa, BK virus
FILFILSSSPPLS

SEQ ID NO: 25854 - protein, 13 aa, BK virus
ILFILSSSPPLSG

SEQ ID NO: 25855 - protein, 13 aa, BK virus
AFLIKGRFPQAAL

SEQ ID NO: 25856 - protein, 13 aa, BK virus
FLIKGRFPQAALS

SEQ ID NO: 25857 - protein, 13 aa, BK virus
LIKGRFPQAALSR

SEQ ID NO: 25858 - protein, 13 aa, BK virus
IKGRFPQAALSRP

SEQ ID NO: 25859 - protein, 13 aa, BK virus
KGRFPQAALSRPK

SEQ ID NO: 25860 - protein, 13 aa, BK virus
GRFPQAALSRPKR

SEQ ID NO: 25861 - protein, 13 aa, BK virus
RFPQAALSRPKRS

SEQ ID NO: 25862 - protein, 13 aa, BK virus
FPQAALSRPKRSM

SEQ ID NO: 25863 - protein, 13 aa, BK virus
PQAALSRPKRSMS

SEQ ID NO: 25864 - protein, 13 aa, BK virus
QAALSRPKRSMSS

SEQ ID NO: 25865 - protein, 13 aa, BK virus
AALSRPKRSMSSM

SEQ ID NO: 25866 - protein, 13 aa, BK virus
ALSRPKRSMSSMD

SEQ ID NO: 25867 - protein, 13 aa, BK virus
LSRPKRSMSSMDS

SEQ ID NO: 25868 - protein, 13 aa, BK virus
SRPKRSMSSMDSS

SEQ ID NO: 25869 - protein, 13 aa, BK virus
RPKRSMSSMDSSL

SEQ ID NO: 25870 - protein, 13 aa, BK virus
PKRSMSSMDSSLL

SEQ ID NO: 25871 - protein, 13 aa, BK virus
KRSMSSMDSSLLR

SEQ ID NO: 25872 - protein, 13 aa, BK virus
RSMSSMDSSLLRT

SEQ ID NO: 25873 - protein, 13 aa, BK virus
SMSSMDSSLLRTL

SEQ ID NO: 25874 - protein, 13 aa, BK virus
MSSMDSSLLRTLS

SEQ ID NO: 25875 - protein, 14 aa, BK virus
FCKNCKRIGISPNS

SEQ ID NO: 25876 - protein, 14 aa, BK virus
CKNCKRIGISPNSF

SEQ ID NO: 25877 - protein, 14 aa, BK virus
KNCKRIGISPNSFA

SEQ ID NO: 25878 - protein, 14 aa, BK virus
NCKRIGISPNSFAR

SEQ ID NO: 25879 - protein, 14 aa, BK virus
CKRIGISPNSFARP

SEQ ID NO: 25880 - protein, 14 aa, BK virus
KRIGISPNSFARPQ

SEQ ID NO: 25881 - protein, 14 aa, BK virus
RIGISPNSFARPQK

SEQ ID NO: 25882 - protein, 14 aa, BK virus
IGISPNSFARPQKK

SEQ ID NO: 25883 - protein, 14 aa, BK virus
GISPNSFARPQKKP

SEQ ID NO: 25884 - protein, 14 aa, BK virus
ISPNSFARPQKKPP

SEQ ID NO: 25885 - protein, 14 aa, BK virus
SPNSFARPQKKPPH

SEQ ID NO: 25886 - protein, 14 aa, BK virus
PNSFARPQKKPPHP

SEQ ID NO: 25887 - protein, 14 aa, BK virus
NSFARPQKKPPHPY

SEQ ID NO: 25888 - protein, 14 aa, BK virus
SFARPQKKPPHPYY

SEQ ID NO: 25889 - protein, 14 aa, BK virus
FARPQKKPPHPYYL

SEQ ID NO: 25890 - protein, 14 aa, BK virus
ARPQKKPPHPYYLR

SEQ ID NO: 25891 - protein, 14 aa, BK virus
RPQKKPPHPYYLRE

SEQ ID NO: 25892 - protein, 14 aa, BK virus
PQKKPPHPYYLRER

SEQ ID NO: 25893 - protein, 14 aa, BK virus
QKKPPHPYYLRERV

SEQ ID NO: 25894 - protein, 14 aa, BK virus
KKPPHPYYLRERVE

SEQ ID NO: 25895 - protein, 14 aa, BK virus
KPPHPYYLRERVEA

SEQ ID NO: 25896 - protein, 14 aa, BK virus
PPHPYYLRERVEAE

SEQ ID NO: 25897 - protein, 14 aa, BK virus
PHPYYLRERVEAEA

SEQ ID NO: 25898 - protein, 14 aa, BK virus
HPYYLRERVEAEAA

SEQ ID NO: 25899 - protein, 14 aa, BK virus
PYYLRERVEAEAAS

SEQ ID NO: 25900 - protein, 14 aa, BK virus
YYLRERVEAEAASA

SEQ ID NO: 25901 - protein, 14 aa, BK virus
YLRERVEAEAASAS

SEQ ID NO: 25902 - protein, 14 aa, BK virus
LRERVEAEAASASY

SEQ ID NO: 25903 - protein, 14 aa, BK virus
RERVEAEAASASYI

SEQ ID NO: 25904 - protein, 14 aa, BK virus
ERVEAEAASASYIL

SEQ ID NO: 25905 - protein, 14 aa, BK virus
KKRPQGGAAYPWNA

SEQ ID NO: 25906 - protein, 14 aa, BK virus
KRPQGGAAYPWNAA

SEQ ID NO: 25907 - protein, 14 aa, BK virus
RPQGGAAYPWNAAK

SEQ ID NO: 25908 - protein, 14 aa, BK virus
PQGGAAYPWNAAKP

SEQ ID NO: 25909 - protein, 14 aa, BK virus
PQEGKCMTHRGMQP

SEQ ID NO: 25910 - protein, 14 aa, BK virus
QEGKCMTHRGMQPN

SEQ ID NO: 25911 - protein, 14 aa, BK virus
EGKCMTHRGMQPNH

SEQ ID NO: 25912 - protein, 14 aa, BK virus
GKCMTHRGMQPNHD

SEQ ID NO: 25913 - protein, 14 aa, BK virus
KCMTHRGMQPNHDL

SEQ ID NO: 25914 - protein, 14 aa, BK virus
CMTHRGMQPNHDLR

SEQ ID NO: 25915 - protein, 14 aa, BK virus
MTHRGMQPNHDLRK

SEQ ID NO: 25916 - protein, 14 aa, BK virus
THRGMQPNHDLRKE

SEQ ID NO: 25917 - protein, 14 aa, BK virus
HRGMQPNHDLRKES

SEQ ID NO: 25918 - protein, 14 aa, BK virus
RGMQPNHDLRKESA

SEQ ID NO: 25919 - protein, 14 aa, BK virus
LTGRSCLPMECSQT

SEQ ID NO: 25920 - protein, 14 aa, BK virus
TGRSCLPMECSQTM

SEQ ID NO: 25921 - protein, 14 aa, BK virus
GRSCLPMECSQTMT

SEQ ID NO: 25922 - protein, 14 aa, BK virus
RSCLPMECSQTMTS

SEQ ID NO: 25923 - protein, 14 aa, BK virus
SCLPMECSQTMTSG

SEQ ID NO: 25924 - protein, 14 aa, BK virus
CLPMECSQTMTSGR

SEQ ID NO: 25925 - protein, 14 aa, BK virus
LPMECSQTMTSGRK

SEQ ID NO: 25926 - protein, 14 aa, BK virus
PMECSQTMTSGRKV

SEQ ID NO: 25927 - protein, 14 aa, BK virus
MECSQTMTSGRKVH

SEQ ID NO: 25928 - protein, 14 aa, BK virus
ECSQTMTSGRKVHD

SEQ ID NO: 25929 - protein, 14 aa, BK virus
CSQTMTSGRKVHDR

SEQ ID NO: 25930 - protein, 14 aa, BK virus
SQTMTSGRKVHDRH

SEQ ID NO: 25931 - protein, 14 aa, BK virus
QTMTSGRKVHDRHV

SEQ ID NO: 25932 - protein, 14 aa, BK virus
TMTSGRKVHDRHVL

SEQ ID NO: 25933 - protein, 14 aa, BK virus
MTSGRKVHDRHVLR

SEQ ID NO: 25934 - protein, 14 aa, BK virus
TSGRKVHDRHVLRA

SEQ ID NO: 25935 - protein, 14 aa, BK virus
ESWPCPQLNWTKAM

SEQ ID NO: 25936 - protein, 14 aa, BK virus
SWPCPQLNWTKAMV

SEQ ID NO: 25937 - protein, 14 aa, BK virus
WPCPQLNWTKAMVL

SEQ ID NO: 25938 - protein, 14 aa, BK virus
PCPQLNWTKAMVLR

SEQ ID NO: 25939 - protein, 14 aa, BK virus
CPQLNWTKAMVLRQ

SEQ ID NO: 25940 - protein, 14 aa, BK virus
PQLNWTKAMVLRQL

SEQ ID NO: 25941 - protein, 14 aa, BK virus
QLNWTKAMVLRQLS

SEQ ID NO: 25942 - protein, 14 aa, BK virus
LNWTKAMVLRQLSR

SEQ ID NO: 25943 - protein, 14 aa, BK virus
NWTKAMVLRQLSRQ

SEQ ID NO: 25944 - protein, 14 aa, BK virus
WTKAMVLRQLSRQA

SEQ ID NO: 25945 - protein, 14 aa, BK virus
TKAMVLRQLSRQAS

SEQ ID NO: 25946 - protein, 14 aa, BK virus
KAMVLRQLSRQASV

SEQ ID NO: 25947 - protein, 14 aa, BK virus
AMVLRQLSRQASVK

SEQ ID NO: 25948 - protein, 14 aa, BK virus
MVLRQLSRQASVKV

SEQ ID NO: 25949 - protein, 14 aa, BK virus
VLRQLSRQASVKVG

SEQ ID NO: 25950 - protein, 14 aa, BK virus
LRQLSRQASVKVGK

SEQ ID NO: 25951 - protein, 14 aa, BK virus
RQLSRQASVKVGKT

SEQ ID NO: 25952 - protein, 14 aa, BK virus
QLSRQASVKVGKTW

SEQ ID NO: 25953 - protein, 14 aa, BK virus
LSRQASVKVGKTWT

SEQ ID NO: 25954 - protein, 14 aa, BK virus
SRQASVKVGKTWTG

SEQ ID NO: 25955 - protein, 14 aa, BK virus
RQASVKVGKTWTGT

SEQ ID NO: 25956 - protein, 14 aa, BK virus
QASVKVGKTWTGTK

SEQ ID NO: 25957 - protein, 14 aa, BK virus
ASVKVGKTWTGTKK

SEQ ID NO: 25958 - protein, 14 aa, BK virus
SVKVGKTWTGTKKR

SEQ ID NO: 25959 - protein, 14 aa, BK virus
VKVGKTWTGTKKRA

SEQ ID NO: 25960 - protein, 14 aa, BK virus
KVGKTWTGTKKRAQ

SEQ ID NO: 25961 - protein, 14 aa, BK virus
VGKTWTGTKKRAQR

SEQ ID NO: 25962 - protein, 14 aa, BK virus
GKTWTGTKKRAQRI

SEQ ID NO: 25963 - protein, 14 aa, BK virus
KTWTGTKKRAQRIF

SEQ ID NO: 25964 - protein, 14 aa, BK virus
TWTGTKKRAQRIFI

SEQ ID NO: 25965 - protein, 14 aa, BK virus
WTGTKKRAQRIFIF

SEQ ID NO: 25966 - protein, 14 aa, BK virus
TGTKKRAQRIFIFI

SEQ ID NO: 25967 - protein, 14 aa, BK virus
GTKKRAQRIFIFIL

SEQ ID NO: 25968 - protein, 14 aa, BK virus
TKKRAQRIFIFILE

SEQ ID NO: 25969 - protein, 14 aa, BK virus
KKRAQRIFIFILEL

SEQ ID NO: 25970 - protein, 14 aa, BK virus
KRAQRIFIFILELL

SEQ ID NO: 25971 - protein, 14 aa, BK virus
RAQRIFIFILELLL

SEQ ID NO: 25972 - protein, 14 aa, BK virus
AQRIFIFILELLLE

SEQ ID NO: 25973 - protein, 14 aa, BK virus
QRIFIFILELLLEF

SEQ ID NO: 25974 - protein, 14 aa, BK virus
RIFIFILELLLEFC

SEQ ID NO: 25975 - protein, 14 aa, BK virus
IFIFILELLLEFCR

SEQ ID NO: 25976 - protein, 14 aa, BK virus
FIFILELLLEFCRG

SEQ ID NO: 25977 - protein, 14 aa, BK virus
IFILELLLEFCRGE

SEQ ID NO: 25978 - protein, 14 aa, BK virus
FILELLLEFCRGED

SEQ ID NO: 25979 - protein, 14 aa, BK virus
ILELLLEFCRGEDS

SEQ ID NO: 25980 - protein, 14 aa, BK virus
LELLLEFCRGEDSV

SEQ ID NO: 25981 - protein, 14 aa, BK virus
ELLLEFCRGEDSVD

SEQ ID NO: 25982 - protein, 14 aa, BK virus
LLLEFCRGEDSVDG

SEQ ID NO: 25983 - protein, 14 aa, BK virus
LLEFCRGEDSVDGK

SEQ ID NO: 25984 - protein, 14 aa, BK virus
LEFCRGEDSVDGKN

SEQ ID NO: 25985 - protein, 14 aa, BK virus
EFCRGEDSVDGKNK

SEQ ID NO: 25986 - protein, 14 aa, BK virus
FCRGEDSVDGKNKS

SEQ ID NO: 25987 - protein, 14 aa, BK virus
CRGEDSVDGKNKST

SEQ ID NO: 25988 - protein, 14 aa, BK virus
RGEDSVDGKNKSTT

SEQ ID NO: 25989 - protein, 14 aa, BK virus
GEDSVDGKNKSTTA

SEQ ID NO: 25990 - protein, 14 aa, BK virus
EDSVDGKNKSTTAL

SEQ ID NO: 25991 - protein, 14 aa, BK virus
DSVDGKNKSTTALP

SEQ ID NO: 25992 - protein, 14 aa, BK virus
SVDGKNKSTTALPA

SEQ ID NO: 25993 - protein, 14 aa, BK virus
VDGKNKSTTALPAV

SEQ ID NO: 25994 - protein, 14 aa, BK virus
DGKNKSTTALPAVK

SEQ ID NO: 25995 - protein, 14 aa, BK virus
GKNKSTTALPAVKD

SEQ ID NO: 25996 - protein, 14 aa, BK virus
KNKSTTALPAVKDS

SEQ ID NO: 25997 - protein, 14 aa, BK virus
NKSTTALPAVKDSV

SEQ ID NO: 25998 - protein, 14 aa, BK virus
KSTTALPAVKDSVK

SEQ ID NO: 25999 - protein, 14 aa, BK virus
STTALPAVKDSVKD

SEQ ID NO: 26000 - protein, 14 aa, BK virus
TTALPAVKDSVKDS

SEQ ID NO: 26001 - protein, 14 aa, BK virus
VSNPFFFVFPGSWV

SEQ ID NO: 26002 - protein, 14 aa, BK virus
SNPFFFVFPGSWVL

SEQ ID NO: 26003 - protein, 14 aa, BK virus
NPFFFVFPGSWVLL

SEQ ID NO: 26004 - protein, 14 aa, BK virus
LPVYLRLLLPQDFQ

SEQ ID NO: 26005 - protein, 14 aa, BK virus
PVYLRLLLPQDFQW

SEQ ID NO: 26006 - protein, 14 aa, BK virus
VYLRLLLPQDFQWL

SEQ ID NO: 26007 - protein, 14 aa, BK virus
YLRLLLPQDFQWLK

SEQ ID NO: 26008 - protein, 14 aa, BK virus
LRLLLPQDFQWLKL

SEQ ID NO: 26009 - protein, 14 aa, BK virus
RLLLPQDFQWLKLL

SEQ ID NO: 26010 - protein, 14 aa, BK virus
LLLPQDFQWLKLLL

SEQ ID NO: 26011 - protein, 14 aa, BK virus
LLPQDFQWLKLLLG

SEQ ID NO: 26012 - protein, 14 aa, BK virus
LPQDFQWLKLLLGR

SEQ ID NO: 26013 - protein, 14 aa, BK virus
PQDFQWLKLLLGRL

SEQ ID NO: 26014 - protein, 14 aa, BK virus
QDFQWLKLLLGRLL

SEQ ID NO: 26015 - protein, 14 aa, BK virus
DFQWLKLLLGRLLL

SEQ ID NO: 26016 - protein, 14 aa, BK virus
FQWLKLLLGRLLLL

SEQ ID NO: 26017 - protein, 14 aa, BK virus
GISSLMIGITKFPL

SEQ ID NO: 26018 - protein, 14 aa, BK virus
ASISNQAWLWNCLT

SEQ ID NO: 26019 - protein, 14 aa, BK virus
SISNQAWLWNCLTQ

SEQ ID NO: 26020 - protein, 14 aa, BK virus
ISNQAWLWNCLTQM

SEQ ID NO: 26021 - protein, 14 aa, BK virus
SNQAWLWNCLTQMS

SEQ ID NO: 26022 - protein, 14 aa, BK virus
NQAWLWNCLTQMST

SEQ ID NO: 26023 - protein, 14 aa, BK virus
QAWLWNCLTQMSTM

SEQ ID NO: 26024 - protein, 14 aa, BK virus
AWLWNCLTQMSTMI

SEQ ID NO: 26025 - protein, 14 aa, BK virus
WLWNCLTQMSTMIF

SEQ ID NO: 26026 - protein, 14 aa, BK virus
LWNCLTQMSTMIFC

SEQ ID NO: 26027 - protein, 14 aa, BK virus
WNCLTQMSTMIFCF

SEQ ID NO: 26028 - protein, 14 aa, BK virus
NCLTQMSTMIFCFL

SEQ ID NO: 26029 - protein, 14 aa, BK virus
CLTQMSTMIFCFLV

SEQ ID NO: 26030 - protein, 14 aa, BK virus
ILLLIIFNTLILGI

SEQ ID NO: 26031 - protein, 14 aa, BK virus
LLLIIFNTLILGIG

SEQ ID NO: 26032 - protein, 14 aa, BK virus
LLIIFNTLILGIGV

SEQ ID NO: 26033 - protein, 14 aa, BK virus
LIIFNTLILGIGVL

SEQ ID NO: 26034 - protein, 14 aa, BK virus
IIFNTLILGIGVLL

SEQ ID NO: 26035 - protein, 14 aa, BK virus
IFNTLILGIGVLLC

SEQ ID NO: 26036 - protein, 14 aa, BK virus
FNTLILGIGVLLCL

SEQ ID NO: 26037 - protein, 14 aa, BK virus
NTLILGIGVLLCLL

SEQ ID NO: 26038 - protein, 14 aa, BK virus
TLILGIGVLLCLLL

SEQ ID NO: 26039 - protein, 14 aa, BK virus
LILGIGVLLCLLLF

SEQ ID NO: 26040 - protein, 14 aa, BK virus
ILGIGVLLCLLLFP

SEQ ID NO: 26041 - protein, 14 aa, BK virus
LGIGVLLCLLLFPR

SEQ ID NO: 26042 - protein, 14 aa, BK virus
GIGVLLCLLLFPRL

SEQ ID NO: 26043 - protein, 14 aa, BK virus
IGVLLCLLLFPRLC

SEQ ID NO: 26044 - protein, 14 aa, BK virus
GVLLCLLLFPRLCG

SEQ ID NO: 26045 - protein, 14 aa, BK virus
VLLCLLLFPRLCGM

SEQ ID NO: 26046 - protein, 14 aa, BK virus
LLCLLLFPRLCGML

SEQ ID NO: 26047 - protein, 14 aa, BK virus
LCLLLFPRLCGMLL

SEQ ID NO: 26048 - protein, 14 aa, BK virus
CLLLFPRLCGMLLG

SEQ ID NO: 26049 - protein, 14 aa, BK virus
LLLFPRLCGMLLGM

SEQ ID NO: 26050 - protein, 14 aa, BK virus
LLFPRLCGMLLGMI

SEQ ID NO: 26051 - protein, 14 aa, BK virus
LFPRLCGMLLGMIY

SEQ ID NO: 26052 - protein, 14 aa, BK virus
FPRLCGMLLGMIYL

SEQ ID NO: 26053 - protein, 14 aa, BK virus
PRLCGMLLGMIYLL

SEQ ID NO: 26054 - protein, 14 aa, BK virus
PHRNCREEQKDFLE

SEQ ID NO: 26055 - protein, 14 aa, BK virus
HRNCREEQKDFLET

SEQ ID NO: 26056 - protein, 14 aa, BK virus
RNCREEQKDFLETP

SEQ ID NO: 26057 - protein, 14 aa, BK virus
NCREEQKDFLETPW

SEQ ID NO: 26058 - protein, 14 aa, BK virus
CREEQKDFLETPWL

SEQ ID NO: 26059 - protein, 14 aa, BK virus
REEQKDFLETPWLD

SEQ ID NO: 26060 - protein, 14 aa, BK virus
EEQKDFLETPWLDF

SEQ ID NO: 26061 - protein, 14 aa, BK virus
EQKDFLETPWLDFW

SEQ ID NO: 26062 - protein, 14 aa, BK virus
QKDFLETPWLDFWR

SEQ ID NO: 26063 - protein, 14 aa, BK virus
KDFLETPWLDFWRK

SEQ ID NO: 26064 - protein, 14 aa, BK virus
DFLETPWLDFWRKL

SEQ ID NO: 26065 - protein, 14 aa, BK virus
FLETPWLDFWRKLP

SEQ ID NO: 26066 - protein, 14 aa, BK virus
LETPWLDFWRKLPG

SEQ ID NO: 26067 - protein, 14 aa, BK virus
ETPWLDFWRKLPGQ

SEQ ID NO: 26068 - protein, 14 aa, BK virus
TPWLDFWRKLPGQL

SEQ ID NO: 26069 - protein, 14 aa, BK virus
TFIIIFNNIILIFP

SEQ ID NO: 26070 - protein, 14 aa, BK virus
FIIIFNNIILIFPL

SEQ ID NO: 26071 - protein, 14 aa, BK virus
IIIFNNIILIFPLL

SEQ ID NO: 26072 - protein, 14 aa, BK virus
IIFNNIILIFPLLG

SEQ ID NO: 26073 - protein, 14 aa, BK virus
IFNNIILIFPLLGP

SEQ ID NO: 26074 - protein, 14 aa, BK virus
FNNIILIFPLLGPQ

SEQ ID NO: 26075 - protein, 14 aa, BK virus
NNIILIFPLLGPQW

SEQ ID NO: 26076 - protein, 14 aa, BK virus
NIILIFPLLGPQWL

SEQ ID NO: 26077 - protein, 14 aa, BK virus
IILIFPLLGPQWLD

SEQ ID NO: 26078 - protein, 14 aa, BK virus
ILIFPLLGPQWLDK

SEQ ID NO: 26079 - protein, 14 aa, BK virus
LKGKVPVYILAILI

SEQ ID NO: 26080 - protein, 14 aa, BK virus
KGKVPVYILAILIV

SEQ ID NO: 26081 - protein, 14 aa, BK virus
KKLLPQEVLIKELL

SEQ ID NO: 26082 - protein, 14 aa, BK virus
KLLPQEVLIKELLL

SEQ ID NO: 26083 - protein, 14 aa, BK virus
LLPQEVLIKELLLN

SEQ ID NO: 26084 - protein, 14 aa, BK virus
LPQEVLIKELLLNG

SEQ ID NO: 26085 - protein, 14 aa, BK virus
PQEVLIKELLLNGC

SEQ ID NO: 26086 - protein, 14 aa, BK virus
QEVLIKELLLNGCC

SEQ ID NO: 26087 - protein, 14 aa, BK virus
EVLIKELLLNGCCL

SEQ ID NO: 26088 - protein, 14 aa, BK virus
VLIKELLLNGCCLY

SEQ ID NO: 26089 - protein, 14 aa, BK virus
LIKELLLNGCCLYF

SEQ ID NO: 26090 - protein, 14 aa, BK virus
HLLLKHMKMAPTKR

SEQ ID NO: 26091 - protein, 14 aa, BK virus
LLLKHMKMAPTKRK

SEQ ID NO: 26092 - protein, 14 aa, BK virus
LLKHMKMAPTKRKG

SEQ ID NO: 26093 - protein, 14 aa, BK virus
LKHMKMAPTKRKGE

SEQ ID NO: 26094 - protein, 14 aa, BK virus
KHMKMAPTKRKGEC

SEQ ID NO: 26095 - protein, 14 aa, BK virus
HMKMAPTKRKGECP

SEQ ID NO: 26096 - protein, 14 aa, BK virus
MKMAPTKRKGECPG

SEQ ID NO: 26097 - protein, 14 aa, BK virus
KMAPTKRKGECPGA

SEQ ID NO: 26098 - protein, 14 aa, BK virus
MAPTKRKGECPGAA

SEQ ID NO: 26099 - protein, 14 aa, BK virus
APTKRKGECPGAAP

SEQ ID NO: 26100 - protein, 14 aa, BK virus
PTKRKGECPGAAPK

SEQ ID NO: 26101 - protein, 14 aa, BK virus
TKRKGECPGAAPKK

SEQ ID NO: 26102 - protein, 14 aa, BK virus
KRKGECPGAAPKKP

SEQ ID NO: 26103 - protein, 14 aa, BK virus
RKGECPGAAPKKPK

SEQ ID NO: 26104 - protein, 14 aa, BK virus
KGECPGAAPKKPKE

SEQ ID NO: 26105 - protein, 14 aa, BK virus
GECPGAAPKKPKEP

SEQ ID NO: 26106 - protein, 14 aa, BK virus
ECPGAAPKKPKEPV

SEQ ID NO: 26107 - protein, 14 aa, BK virus
CPGAAPKKPKEPVQ

SEQ ID NO: 26108 - protein, 14 aa, BK virus
PGAAPKKPKEPVQV

SEQ ID NO: 26109 - protein, 14 aa, BK virus
GAAPKKPKEPVQVP

SEQ ID NO: 26110 - protein, 14 aa, BK virus
AAPKKPKEPVQVPK

SEQ ID NO: 26111 - protein, 14 aa, BK virus
APKKPKEPVQVPKL

SEQ ID NO: 26112 - protein, 14 aa, BK virus
PKKPKEPVQVPKLL

SEQ ID NO: 26113 - protein, 14 aa, BK virus
KKPKEPVQVPKLLI

SEQ ID NO: 26114 - protein, 14 aa, BK virus
KPKEPVQVPKLLIK

SEQ ID NO: 26115 - protein, 14 aa, BK virus
PKEPVQVPKLLIKG

SEQ ID NO: 26116 - protein, 14 aa, BK virus
KEPVQVPKLLIKGG

SEQ ID NO: 26117 - protein, 14 aa, BK virus
EPVQVPKLLIKGGV

SEQ ID NO: 26118 - protein, 14 aa, BK virus
PVQVPKLLIKGGVE

SEQ ID NO: 26119 - protein, 14 aa, BK virus
VQVPKLLIKGGVEV

SEQ ID NO: 26120 - protein, 14 aa, BK virus
QVPKLLIKGGVEVL

SEQ ID NO: 26121 - protein, 14 aa, BK virus
VPKLLIKGGVEVLE

SEQ ID NO: 26122 - protein, 14 aa, BK virus
PKLLIKGGVEVLEV

SEQ ID NO: 26123 - protein, 14 aa, BK virus
KLLIKGGVEVLEVK

SEQ ID NO: 26124 - protein, 14 aa, BK virus
LLIKGGVEVLEVKT

SEQ ID NO: 26125 - protein, 14 aa, BK virus
LIKGGVEVLEVKTG

SEQ ID NO: 26126 - protein, 14 aa, BK virus
IKGGVEVLEVKTGV

SEQ ID NO: 26127 - protein, 14 aa, BK virus
KGGVEVLEVKTGVD

SEQ ID NO: 26128 - protein, 14 aa, BK virus
GGVEVLEVKTGVDA

SEQ ID NO: 26129 - protein, 14 aa, BK virus
GVEVLEVKTGVDAI

SEQ ID NO: 26130 - protein, 14 aa, BK virus
VEVLEVKTGVDAIT

SEQ ID NO: 26131 - protein, 14 aa, BK virus
EVLEVKTGVDAITE

SEQ ID NO: 26132 - protein, 14 aa, BK virus
VLEVKTGVDAITEV

SEQ ID NO: 26133 - protein, 14 aa, BK virus
LEVKTGVDAITEVE

SEQ ID NO: 26134 - protein, 14 aa, BK virus
EVKTGVDAITEVEC

SEQ ID NO: 26135 - protein, 14 aa, BK virus
VKTGVDAITEVECF

SEQ ID NO: 26136 - protein, 14 aa, BK virus
KTGVDAITEVECFL

SEQ ID NO: 26137 - protein, 14 aa, BK virus
TGVDAITEVECFLN

SEQ ID NO: 26138 - protein, 14 aa, BK virus
GVDAITEVECFLNP

SEQ ID NO: 26139 - protein, 14 aa, BK virus
VDAITEVECFLNPE

SEQ ID NO: 26140 - protein, 14 aa, BK virus
DAITEVECFLNPEM

SEQ ID NO: 26141 - protein, 14 aa, BK virus
AITEVECFLNPEMG

SEQ ID NO: 26142 - protein, 14 aa, BK virus
ITEVECFLNPEMGD

SEQ ID NO: 26143 - protein, 14 aa, BK virus
TEVECFLNPEMGDP

SEQ ID NO: 26144 - protein, 14 aa, BK virus
EVECFLNPEMGDPD

SEQ ID NO: 26145 - protein, 14 aa, BK virus
VECFLNPEMGDPDE

SEQ ID NO: 26146 - protein, 14 aa, BK virus
ECFLNPEMGDPDEN

SEQ ID NO: 26147 - protein, 14 aa, BK virus
CFLNPEMGDPDENL

SEQ ID NO: 26148 - protein, 14 aa, BK virus
FLNPEMGDPDENLR

SEQ ID NO: 26149 - protein, 14 aa, BK virus
LNPEMGDPDENLRG

SEQ ID NO: 26150 - protein, 14 aa, BK virus
NPEMGDPDENLRGF

SEQ ID NO: 26151 - protein, 14 aa, BK virus
PEMGDPDENLRGFS

SEQ ID NO: 26152 - protein, 14 aa, BK virus
EMGDPDENLRGFSL

SEQ ID NO: 26153 - protein, 14 aa, BK virus
MGDPDENLRGFSLK

SEQ ID NO: 26154 - protein, 14 aa, BK virus
GDPDENLRGFSLKL

SEQ ID NO: 26155 - protein, 14 aa, BK virus
DPDENLRGFSLKLS

SEQ ID NO: 26156 - protein, 14 aa, BK virus
PDENLRGFSLKLSA

SEQ ID NO: 26157 - protein, 14 aa, BK virus
DENLRGFSLKLSAE

SEQ ID NO: 26158 - protein, 14 aa, BK virus
ENLRGFSLKLSAEN

SEQ ID NO: 26159 - protein, 14 aa, BK virus
NLRGFSLKLSAEND

SEQ ID NO: 26160 - protein, 14 aa, BK virus
LRGFSLKLSAENDF

SEQ ID NO: 26161 - protein, 14 aa, BK virus
RGFSLKLSAENDFS

SEQ ID NO: 26162 - protein, 14 aa, BK virus
GFSLKLSAENDFSS

SEQ ID NO: 26163 - protein, 14 aa, BK virus
FSLKLSAENDFSSD

SEQ ID NO: 26164 - protein, 14 aa, BK virus
SLKLSAENDFSSDS

SEQ ID NO: 26165 - protein, 14 aa, BK virus
LKLSAENDFSSDSP

SEQ ID NO: 26166 - protein, 14 aa, BK virus
KLSAENDFSSDSPE

SEQ ID NO: 26167 - protein, 14 aa, BK virus
LSAENDFSSDSPER

SEQ ID NO: 26168 - protein, 14 aa, BK virus
SAENDFSSDSPERK

SEQ ID NO: 26169 - protein, 14 aa, BK virus
AENDFSSDSPERKM

SEQ ID NO: 26170 - protein, 14 aa, BK virus
ENDFSSDSPERKML

SEQ ID NO: 26171 - protein, 14 aa, BK virus
NDFSSDSPERKMLP

SEQ ID NO: 26172 - protein, 14 aa, BK virus
DFSSDSPERKMLPC

SEQ ID NO: 26173 - protein, 14 aa, BK virus
FSSDSPERKMLPCY

SEQ ID NO: 26174 - protein, 14 aa, BK virus
SSDSPERKMLPCYS

SEQ ID NO: 26175 - protein, 14 aa, BK virus
SDSPERKMLPCYST

SEQ ID NO: 26176 - protein, 14 aa, BK virus
DSPERKMLPCYSTA

SEQ ID NO: 26177 - protein, 14 aa, BK virus
SPERKMLPCYSTAR

SEQ ID NO: 26178 - protein, 14 aa, BK virus
PERKMLPCYSTARI

SEQ ID NO: 26179 - protein, 14 aa, BK virus
ERKMLPCYSTARIP

SEQ ID NO: 26180 - protein, 14 aa, BK virus
RKMLPCYSTARIPL

SEQ ID NO: 26181 - protein, 14 aa, BK virus
KMLPCYSTARIPLP

SEQ ID NO: 26182 - protein, 14 aa, BK virus
MLPCYSTARIPLPN

SEQ ID NO: 26183 - protein, 14 aa, BK virus
LPCYSTARIPLPNL

SEQ ID NO: 26184 - protein, 14 aa, BK virus
PCYSTARIPLPNLN

SEQ ID NO: 26185 - protein, 14 aa, BK virus
CYSTARIPLPNLNE

SEQ ID NO: 26186 - protein, 14 aa, BK virus
YSTARIPLPNLNED

SEQ ID NO: 26187 - protein, 14 aa, BK virus
STARIPLPNLNEDL

SEQ ID NO: 26188 - protein, 14 aa, BK virus
TARIPLPNLNEDLT

SEQ ID NO: 26189 - protein, 14 aa, BK virus
ARIPLPNLNEDLTC

SEQ ID NO: 26190 - protein, 14 aa, BK virus
RIPLPNLNEDLTCG

SEQ ID NO: 26191 - protein, 14 aa, BK virus
IPLPNLNEDLTCGN

SEQ ID NO: 26192 - protein, 14 aa, BK virus
PLPNLNEDLTCGNL

SEQ ID NO: 26193 - protein, 14 aa, BK virus
LPNLNEDLTCGNLL

SEQ ID NO: 26194 - protein, 14 aa, BK virus
PNLNEDLTCGNLLM

SEQ ID NO: 26195 - protein, 14 aa, BK virus
NLNEDLTCGNLLMW

SEQ ID NO: 26196 - protein, 14 aa, BK virus
LNEDLTCGNLLMWE

SEQ ID NO: 26197 - protein, 14 aa, BK virus
NEDLTCGNLLMWEA

SEQ ID NO: 26198 - protein, 14 aa, BK virus
EDLTCGNLLMWEAV

SEQ ID NO: 26199 - protein, 14 aa, BK virus
DLTCGNLLMWEAVT

SEQ ID NO: 26200 - protein, 14 aa, BK virus
LTCGNLLMWEAVTV

SEQ ID NO: 26201 - protein, 14 aa, BK virus
TCGNLLMWEAVTVQ

SEQ ID NO: 26202 - protein, 14 aa, BK virus
CGNLLMWEAVTVQT

SEQ ID NO: 26203 - protein, 14 aa, BK virus
GNLLMWEAVTVQTE

SEQ ID NO: 26204 - protein, 14 aa, BK virus
NLLMWEAVTVQTEV

SEQ ID NO: 26205 - protein, 14 aa, BK virus
LLMWEAVTVQTEVI

SEQ ID NO: 26206 - protein, 14 aa, BK virus
LMWEAVTVQTEVIG

SEQ ID NO: 26207 - protein, 14 aa, BK virus
MWEAVTVQTEVIGI

SEQ ID NO: 26208 - protein, 14 aa, BK virus
WEAVTVQTEVIGIT

SEQ ID NO: 26209 - protein, 14 aa, BK virus
EAVTVQTEVIGITS

SEQ ID NO: 26210 - protein, 14 aa, BK virus
AVTVQTEVIGITSM

SEQ ID NO: 26211 - protein, 14 aa, BK virus
VTVQTEVIGITSML

SEQ ID NO: 26212 - protein, 14 aa, BK virus
TVQTEVIGITSMLN

SEQ ID NO: 26213 - protein, 14 aa, BK virus
VQTEVIGITSMLNL

SEQ ID NO: 26214 - protein, 14 aa, BK virus
QTEVIGITSMLNLH

SEQ ID NO: 26215 - protein, 14 aa, BK virus
TEVIGITSMLNLHA

SEQ ID NO: 26216 - protein, 14 aa, BK virus
EVIGITSMLNLHAG

SEQ ID NO: 26217 - protein, 14 aa, BK virus
VIGITSMLNLHAGS

SEQ ID NO: 26218 - protein, 14 aa, BK virus
IGITSMLNLHAGSQ

SEQ ID NO: 26219 - protein, 14 aa, BK virus
GITSMLNLHAGSQK

SEQ ID NO: 26220 - protein, 14 aa, BK virus
ITSMLNLHAGSQKV

SEQ ID NO: 26221 - protein, 14 aa, BK virus
TSMLNLHAGSQKVH

SEQ ID NO: 26222 - protein, 14 aa, BK virus
SMLNLHAGSQKVHE

SEQ ID NO: 26223 - protein, 14 aa, BK virus
MLNLHAGSQKVHEH

SEQ ID NO: 26224 - protein, 14 aa, BK virus
LNLHAGSQKVHEHG

SEQ ID NO: 26225 - protein, 14 aa, BK virus
NLHAGSQKVHEHGG

SEQ ID NO: 26226 - protein, 14 aa, BK virus
LHAGSQKVHEHGGG

SEQ ID NO: 26227 - protein, 14 aa, BK virus
HAGSQKVHEHGGGK

SEQ ID NO: 26228 - protein, 14 aa, BK virus
AGSQKVHEHGGGKP

SEQ ID NO: 26229 - protein, 14 aa, BK virus
GSQKVHEHGGGKPI

SEQ ID NO: 26230 - protein, 14 aa, BK virus
SQKVHEHGGGKPIQ

SEQ ID NO: 26231 - protein, 14 aa, BK virus
QKVHEHGGGKPIQG

SEQ ID NO: 26232 - protein, 14 aa, BK virus
KVHEHGGGKPIQGS

SEQ ID NO: 26233 - protein, 14 aa, BK virus
VHEHGGGKPIQGSN

SEQ ID NO: 26234 - protein, 14 aa, BK virus
HEHGGGKPIQGSNF

SEQ ID NO: 26235 - protein, 14 aa, BK virus
EHGGGKPIQGSNFH

SEQ ID NO: 26236 - protein, 14 aa, BK virus
HGGGKPIQGSNFHF

SEQ ID NO: 26237 - protein, 14 aa, BK virus
GGGKPIQGSNFHFF

SEQ ID NO: 26238 - protein, 14 aa, BK virus
GGKPIQGSNFHFFA

SEQ ID NO: 26239 - protein, 14 aa, BK virus
GKPIQGSNFHFFAV

SEQ ID NO: 26240 - protein, 14 aa, BK virus
KPIQGSNFHFFAVG

SEQ ID NO: 26241 - protein, 14 aa, BK virus
PIQGSNFHFFAVGG

SEQ ID NO: 26242 - protein, 14 aa, BK virus
IQGSNFHFFAVGGE

SEQ ID NO: 26243 - protein, 14 aa, BK virus
QGSNFHFFAVGGEP

SEQ ID NO: 26244 - protein, 14 aa, BK virus
GSNFHFFAVGGEPL

SEQ ID NO: 26245 - protein, 14 aa, BK virus
SNFHFFAVGGEPLE

SEQ ID NO: 26246 - protein, 14 aa, BK virus
NFHFFAVGGEPLEM

SEQ ID NO: 26247 - protein, 14 aa, BK virus
FHFFAVGGEPLEMQ

SEQ ID NO: 26248 - protein, 14 aa, BK virus
HFFAVGGEPLEMQG

SEQ ID NO: 26249 - protein, 14 aa, BK virus
FFAVGGEPLEMQGV

SEQ ID NO: 26250 - protein, 14 aa, BK virus
FAVGGEPLEMQGVL

SEQ ID NO: 26251 - protein, 14 aa, BK virus
AVGGEPLEMQGVLM

SEQ ID NO: 26252 - protein, 14 aa, BK virus
VGGEPLEMQGVLMN

SEQ ID NO: 26253 - protein, 14 aa, BK virus
GGEPLEMQGVLMNY

SEQ ID NO: 26254 - protein, 14 aa, BK virus
GEPLEMQGVLMNYR

SEQ ID NO: 26255 - protein, 14 aa, BK virus
EPLEMQGVLMNYRS

SEQ ID NO: 26256 - protein, 14 aa, BK virus
PLEMQGVLMNYRSK

SEQ ID NO: 26257 - protein, 14 aa, BK virus
LEMQGVLMNYRSKY

SEQ ID NO: 26258 - protein, 14 aa, BK virus
EMQGVLMNYRSKYP

SEQ ID NO: 26259 - protein, 14 aa, BK virus
MQGVLMNYRSKYPD

SEQ ID NO: 26260 - protein, 14 aa, BK virus
QGVLMNYRSKYPDG

SEQ ID NO: 26261 - protein, 14 aa, BK virus
GVLMNYRSKYPDGT

SEQ ID NO: 26262 - protein, 14 aa, BK virus
VLMNYRSKYPDGTI

SEQ ID NO: 26263 - protein, 14 aa, BK virus
LMNYRSKYPDGTIT

SEQ ID NO: 26264 - protein, 14 aa, BK virus
MNYRSKYPDGTITP

SEQ ID NO: 26265 - protein, 14 aa, BK virus
NYRSKYPDGTITPK

SEQ ID NO: 26266 - protein, 14 aa, BK virus
YRSKYPDGTITPKN

SEQ ID NO: 26267 - protein, 14 aa, BK virus
RSKYPDGTITPKNP

SEQ ID NO: 26268 - protein, 14 aa, BK virus
SKYPDGTITPKNPT

SEQ ID NO: 26269 - protein, 14 aa, BK virus
KYPDGTITPKNPTA

SEQ ID NO: 26270 - protein, 14 aa, BK virus
YPDGTITPKNPTAQ

SEQ ID NO: 26271 - protein, 14 aa, BK virus
PDGTITPKNPTAQS

SEQ ID NO: 26272 - protein, 14 aa, BK virus
DGTITPKNPTAQSQ

SEQ ID NO: 26273 - protein, 14 aa, BK virus
GTITPKNPTAQSQV

SEQ ID NO: 26274 - protein, 14 aa, BK virus
TITPKNPTAQSQVM

SEQ ID NO: 26275 - protein, 14 aa, BK virus
ITPKNPTAQSQVMN

SEQ ID NO: 26276 - protein, 14 aa, BK virus
TPKNPTAQSQVMNT

SEQ ID NO: 26277 - protein, 14 aa, BK virus
PKNPTAQSQVMNTD

SEQ ID NO: 26278 - protein, 14 aa, BK virus
KNPTAQSQVMNTDH

SEQ ID NO: 26279 - protein, 14 aa, BK virus
NPTAQSQVMNTDHK

SEQ ID NO: 26280 - protein, 14 aa, BK virus
PTAQSQVMNTDHKA

SEQ ID NO: 26281 - protein, 14 aa, BK virus
TAQSQVMNTDHKAY

SEQ ID NO: 26282 - protein, 14 aa, BK virus
AQSQVMNTDHKAYL

SEQ ID NO: 26283 - protein, 14 aa, BK virus
QSQVMNTDHKAYLD

SEQ ID NO: 26284 - protein, 14 aa, BK virus
SQVMNTDHKAYLDK

SEQ ID NO: 26285 - protein, 14 aa, BK virus
QVMNTDHKAYLDKN

SEQ ID NO: 26286 - protein, 14 aa, BK virus
VMNTDHKAYLDKNN

SEQ ID NO: 26287 - protein, 14 aa, BK virus
MNTDHKAYLDKNNA

SEQ ID NO: 26288 - protein, 14 aa, BK virus
NTDHKAYLDKNNAY

SEQ ID NO: 26289 - protein, 14 aa, BK virus
TDHKAYLDKNNAYP

SEQ ID NO: 26290 - protein, 14 aa, BK virus
DHKAYLDKNNAYPV

SEQ ID NO: 26291 - protein, 14 aa, BK virus
HKAYLDKNNAYPVE

SEQ ID NO: 26292 - protein, 14 aa, BK virus
KAYLDKNNAYPVEC

SEQ ID NO: 26293 - protein, 14 aa, BK virus
AYLDKNNAYPVECW

SEQ ID NO: 26294 - protein, 14 aa, BK virus
YLDKNNAYPVECWV

SEQ ID NO: 26295 - protein, 14 aa, BK virus
LDKNNAYPVECWVP

SEQ ID NO: 26296 - protein, 14 aa, BK virus
DKNNAYPVECWVPD

SEQ ID NO: 26297 - protein, 14 aa, BK virus
KNNAYPVECWVPDP

SEQ ID NO: 26298 - protein, 14 aa, BK virus
NNAYPVECWVPDPS

SEQ ID NO: 26299 - protein, 14 aa, BK virus
NAYPVECWVPDPSR

SEQ ID NO: 26300 - protein, 14 aa, BK virus
AYPVECWVPDPSRN

SEQ ID NO: 26301 - protein, 14 aa, BK virus
YPVECWVPDPSRNE

SEQ ID NO: 26302 - protein, 14 aa, BK virus
PVECWVPDPSRNEN

SEQ ID NO: 26303 - protein, 14 aa, BK virus
VECWVPDPSRNENA

SEQ ID NO: 26304 - protein, 14 aa, BK virus
ECWVPDPSRNENAR

SEQ ID NO: 26305 - protein, 14 aa, BK virus
CWVPDPSRNENARY

SEQ ID NO: 26306 - protein, 14 aa, BK virus
WVPDPSRNENARYF

SEQ ID NO: 26307 - protein, 14 aa, BK virus
VPDPSRNENARYFG

SEQ ID NO: 26308 - protein, 14 aa, BK virus
PDPSRNENARYFGT

SEQ ID NO: 26309 - protein, 14 aa, BK virus
DPSRNENARYFGTF

SEQ ID NO: 26310 - protein, 14 aa, BK virus
PSRNENARYFGTFT

SEQ ID NO: 26311 - protein, 14 aa, BK virus
SRNENARYFGTFTG

SEQ ID NO: 26312 - protein, 14 aa, BK virus
RNENARYFGTFTGG

SEQ ID NO: 26313 - protein, 14 aa, BK virus
NENARYFGTFTGGE

SEQ ID NO: 26314 - protein, 14 aa, BK virus
ENARYFGTFTGGEN

SEQ ID NO: 26315 - protein, 14 aa, BK virus
NARYFGTFTGGENV

SEQ ID NO: 26316 - protein, 14 aa, BK virus
ARYFGTFTGGENVP

SEQ ID NO: 26317 - protein, 14 aa, BK virus
RYFGTFTGGENVPP

SEQ ID NO: 26318 - protein, 14 aa, BK virus
YFGTFTGGENVPPV

SEQ ID NO: 26319 - protein, 14 aa, BK virus
FGTFTGGENVPPVL

SEQ ID NO: 26320 - protein, 14 aa, BK virus
GTFTGGENVPPVLH

SEQ ID NO: 26321 - protein, 14 aa, BK virus
TFTGGENVPPVLHV

SEQ ID NO: 26322 - protein, 14 aa, BK virus
FTGGENVPPVLHVT

SEQ ID NO: 26323 - protein, 14 aa, BK virus
TGGENVPPVLHVTN

SEQ ID NO: 26324 - protein, 14 aa, BK virus
GGENVPPVLHVTNT

SEQ ID NO: 26325 - protein, 14 aa, BK virus
GENVPPVLHVTNTA

SEQ ID NO: 26326 - protein, 14 aa, BK virus
ENVPPVLHVTNTAT

SEQ ID NO: 26327 - protein, 14 aa, BK virus
NVPPVLHVTNTATT

SEQ ID NO: 26328 - protein, 14 aa, BK virus
VPPVLHVTNTATTV

SEQ ID NO: 26329 - protein, 14 aa, BK virus
PPVLHVTNTATTVL

SEQ ID NO: 26330 - protein, 14 aa, BK virus
PVLHVTNTATTVLL

SEQ ID NO: 26331 - protein, 14 aa, BK virus
VLHVTNTATTVLLD

SEQ ID NO: 26332 - protein, 14 aa, BK virus
LHVTNTATTVLLDE

SEQ ID NO: 26333 - protein, 14 aa, BK virus
HVTNTATTVLLDEQ

SEQ ID NO: 26334 - protein, 14 aa, BK virus
VTNTATTVLLDEQG

SEQ ID NO: 26335 - protein, 14 aa, BK virus
TNTATTVLLDEQGV

SEQ ID NO: 26336 - protein, 14 aa, BK virus
NTATTVLLDEQGVG

SEQ ID NO: 26337 - protein, 14 aa, BK virus
TATTVLLDEQGVGP

SEQ ID NO: 26338 - protein, 14 aa, BK virus
ATTVLLDEQGVGPL

SEQ ID NO: 26339 - protein, 14 aa, BK virus
TTVLLDEQGVGPLC

SEQ ID NO: 26340 - protein, 14 aa, BK virus
TVLLDEQGVGPLCK

SEQ ID NO: 26341 - protein, 14 aa, BK virus
VLLDEQGVGPLCKA

SEQ ID NO: 26342 - protein, 14 aa, BK virus
LLDEQGVGPLCKAD

SEQ ID NO: 26343 - protein, 14 aa, BK virus
LDEQGVGPLCKADS

SEQ ID NO: 26344 - protein, 14 aa, BK virus
DEQGVGPLCKADSL

SEQ ID NO: 26345 - protein, 14 aa, BK virus
EQGVGPLCKADSLY

SEQ ID NO: 26346 - protein, 14 aa, BK virus
QGVGPLCKADSLYV

SEQ ID NO: 26347 - protein, 14 aa, BK virus
GVGPLCKADSLYVS

SEQ ID NO: 26348 - protein, 14 aa, BK virus
VGPLCKADSLYVSA

SEQ ID NO: 26349 - protein, 14 aa, BK virus
GPLCKADSLYVSAA

SEQ ID NO: 26350 - protein, 14 aa, BK virus
PLCKADSLYVSAAD

SEQ ID NO: 26351 - protein, 14 aa, BK virus
LCKADSLYVSAADI

SEQ ID NO: 26352 - protein, 14 aa, BK virus
CKADSLYVSAADIC

SEQ ID NO: 26353 - protein, 14 aa, BK virus
KADSLYVSAADICG

SEQ ID NO: 26354 - protein, 14 aa, BK virus
ADSLYVSAADICGL

SEQ ID NO: 26355 - protein, 14 aa, BK virus
DSLYVSAADICGLF

SEQ ID NO: 26356 - protein, 14 aa, BK virus
SLYVSAADICGLFT

SEQ ID NO: 26357 - protein, 14 aa, BK virus
LYVSAADICGLFTN

SEQ ID NO: 26358 - protein, 14 aa, BK virus
YVSAADICGLFTNS

SEQ ID NO: 26359 - protein, 14 aa, BK virus
VSAADICGLFTNSS

SEQ ID NO: 26360 - protein, 14 aa, BK virus
SAADICGLFTNSSG

SEQ ID NO: 26361 - protein, 14 aa, BK virus
AADICGLFTNSSGT

SEQ ID NO: 26362 - protein, 14 aa, BK virus
ADICGLFTNSSGTQ

SEQ ID NO: 26363 - protein, 14 aa, BK virus
DICGLFTNSSGTQQ

SEQ ID NO: 26364 - protein, 14 aa, BK virus
ICGLFTNSSGTQQW

SEQ ID NO: 26365 - protein, 14 aa, BK virus
CGLFTNSSGTQQWR

SEQ ID NO: 26366 - protein, 14 aa, BK virus
GLFTNSSGTQQWRG

SEQ ID NO: 26367 - protein, 14 aa, BK virus
LFTNSSGTQQWRGL

SEQ ID NO: 26368 - protein, 14 aa, BK virus
FTNSSGTQQWRGLA

SEQ ID NO: 26369 - protein, 14 aa, BK virus
TNSSGTQQWRGLAR

SEQ ID NO: 26370 - protein, 14 aa, BK virus
NSSGTQQWRGLARY

SEQ ID NO: 26371 - protein, 14 aa, BK virus
SSGTQQWRGLARYF

SEQ ID NO: 26372 - protein, 14 aa, BK virus
SGTQQWRGLARYFK

SEQ ID NO: 26373 - protein, 14 aa, BK virus
GTQQWRGLARYFKI

SEQ ID NO: 26374 - protein, 14 aa, BK virus
TQQWRGLARYFKIR

SEQ ID NO: 26375 - protein, 14 aa, BK virus
QQWRGLARYFKIRL

SEQ ID NO: 26376 - protein, 14 aa, BK virus
QWRGLARYFKIRLR

SEQ ID NO: 26377 - protein, 14 aa, BK virus
WRGLARYFKIRLRK

SEQ ID NO: 26378 - protein, 14 aa, BK virus
RGLARYFKIRLRKR

SEQ ID NO: 26379 - protein, 14 aa, BK virus
GLARYFKIRLRKRS

SEQ ID NO: 26380 - protein, 14 aa, BK virus
LARYFKIRLRKRSV

SEQ ID NO: 26381 - protein, 14 aa, BK virus
ARYFKIRLRKRSVK

SEQ ID NO: 26382 - protein, 14 aa, BK virus
RYFKIRLRKRSVKN

SEQ ID NO: 26383 - protein, 14 aa, BK virus
YFKIRLRKRSVKNP

SEQ ID NO: 26384 - protein, 14 aa, BK virus
FKIRLRKRSVKNPY

SEQ ID NO: 26385 - protein, 14 aa, BK virus
KIRLRKRSVKNPYP

SEQ ID NO: 26386 - protein, 14 aa, BK virus
IRLRKRSVKNPYPI

SEQ ID NO: 26387 - protein, 14 aa, BK virus
RLRKRSVKNPYPIS

SEQ ID NO: 26388 - protein, 14 aa, BK virus
LRKRSVKNPYPISF

SEQ ID NO: 26389 - protein, 14 aa, BK virus
RKRSVKNPYPISFL

SEQ ID NO: 26390 - protein, 14 aa, BK virus
KRSVKNPYPISFLL

SEQ ID NO: 26391 - protein, 14 aa, BK virus
RSVKNPYPISFLLS

SEQ ID NO: 26392 - protein, 14 aa, BK virus
SVKNPYPISFLLSD

SEQ ID NO: 26393 - protein, 14 aa, BK virus
VKNPYPISFLLSDL

SEQ ID NO: 26394 - protein, 14 aa, BK virus
KNPYPISFLLSDLI

SEQ ID NO: 26395 - protein, 14 aa, BK virus
NPYPISFLLSDLIN

SEQ ID NO: 26396 - protein, 14 aa, BK virus
PYPISFLLSDLINR

SEQ ID NO: 26397 - protein, 14 aa, BK virus
YPISFLLSDLINRR

SEQ ID NO: 26398 - protein, 14 aa, BK virus
PISFLLSDLINRRT

SEQ ID NO: 26399 - protein, 14 aa, BK virus
ISFLLSDLINRRTQ

SEQ ID NO: 26400 - protein, 14 aa, BK virus
SFLLSDLINRRTQR

SEQ ID NO: 26401 - protein, 14 aa, BK virus
FLLSDLINRRTQRV

SEQ ID NO: 26402 - protein, 14 aa, BK virus
LLSDLINRRTQRVD

SEQ ID NO: 26403 - protein, 14 aa, BK virus
LSDLINRRTQRVDG

SEQ ID NO: 26404 - protein, 14 aa, BK virus
SDLINRRTQRVDGQ

SEQ ID NO: 26405 - protein, 14 aa, BK virus
DLINRRTQRVDGQP

SEQ ID NO: 26406 - protein, 14 aa, BK virus
LINRRTQRVDGQPM

SEQ ID NO: 26407 - protein, 14 aa, BK virus
INRRTQRVDGQPMY

SEQ ID NO: 26408 - protein, 14 aa, BK virus
NRRTQRVDGQPMYG

SEQ ID NO: 26409 - protein, 14 aa, BK virus
RRTQRVDGQPMYGM

SEQ ID NO: 26410 - protein, 14 aa, BK virus
RTQRVDGQPMYGME

SEQ ID NO: 26411 - protein, 14 aa, BK virus
TQRVDGQPMYGMES

SEQ ID NO: 26412 - protein, 14 aa, BK virus
QRVDGQPMYGMESQ

SEQ ID NO: 26413 - protein, 14 aa, BK virus
RVDGQPMYGMESQV

SEQ ID NO: 26414 - protein, 14 aa, BK virus
VDGQPMYGMESQVE

SEQ ID NO: 26415 - protein, 14 aa, BK virus
DGQPMYGMESQVEE

SEQ ID NO: 26416 - protein, 14 aa, BK virus
GQPMYGMESQVEEV

SEQ ID NO: 26417 - protein, 14 aa, BK virus
QPMYGMESQVEEVR

SEQ ID NO: 26418 - protein, 14 aa, BK virus
PMYGMESQVEEVRV

SEQ ID NO: 26419 - protein, 14 aa, BK virus
MYGMESQVEEVRVF

SEQ ID NO: 26420 - protein, 14 aa, BK virus
YGMESQVEEVRVFD

SEQ ID NO: 26421 - protein, 14 aa, BK virus
GMESQVEEVRVFDG

SEQ ID NO: 26422 - protein, 14 aa, BK virus
MESQVEEVRVFDGT

SEQ ID NO: 26423 - protein, 14 aa, BK virus
ESQVEEVRVFDGTE

SEQ ID NO: 26424 - protein, 14 aa, BK virus
SQVEEVRVFDGTER

SEQ ID NO: 26425 - protein, 14 aa, BK virus
QVEEVRVFDGTERL

SEQ ID NO: 26426 - protein, 14 aa, BK virus
VEEVRVFDGTERLP

SEQ ID NO: 26427 - protein, 14 aa, BK virus
EEVRVFDGTERLPG

SEQ ID NO: 26428 - protein, 14 aa, BK virus
EVRVFDGTERLPGD

SEQ ID NO: 26429 - protein, 14 aa, BK virus
VRVFDGTERLPGDP

SEQ ID NO: 26430 - protein, 14 aa, BK virus
RVFDGTERLPGDPD

SEQ ID NO: 26431 - protein, 14 aa, BK virus
VFDGTERLPGDPDM

SEQ ID NO: 26432 - protein, 14 aa, BK virus
FDGTERLPGDPDMI

SEQ ID NO: 26433 - protein, 14 aa, BK virus
DGTERLPGDPDMIR

SEQ ID NO: 26434 - protein, 14 aa, BK virus
GTERLPGDPDMIRY

SEQ ID NO: 26435 - protein, 14 aa, BK virus
TERLPGDPDMIRYI

SEQ ID NO: 26436 - protein, 14 aa, BK virus
ERLPGDPDMIRYID

SEQ ID NO: 26437 - protein, 14 aa, BK virus
RLPGDPDMIRYIDK

SEQ ID NO: 26438 - protein, 14 aa, BK virus
LPGDPDMIRYIDKQ

SEQ ID NO: 26439 - protein, 14 aa, BK virus
PGDPDMIRYIDKQG

SEQ ID NO: 26440 - protein, 14 aa, BK virus
GDPDMIRYIDKQGQ

SEQ ID NO: 26441 - protein, 14 aa, BK virus
DPDMIRYIDKQGQL

SEQ ID NO: 26442 - protein, 14 aa, BK virus
PDMIRYIDKQGQLQ

SEQ ID NO: 26443 - protein, 14 aa, BK virus
DMIRYIDKQGQLQT

SEQ ID NO: 26444 - protein, 14 aa, BK virus
MIRYIDKQGQLQTK

SEQ ID NO: 26445 - protein, 14 aa, BK virus
IRYIDKQGQLQTKM

SEQ ID NO: 26446 - protein, 14 aa, BK virus
RYIDKQGQLQTKML

SEQ ID NO: 26447 - protein, 14 aa, BK virus
TGAFIVHIHLINAA

SEQ ID NO: 26448 - protein, 14 aa, BK virus
GAFIVHIHLINAAF

SEQ ID NO: 26449 - protein, 14 aa, BK virus
AFIVHIHLINAAFV

SEQ ID NO: 26450 - protein, 14 aa, BK virus
ATFKLVLFWGWCFR

SEQ ID NO: 26451 - protein, 14 aa, BK virus
TFKLVLFWGWCFRP

SEQ ID NO: 26452 - protein, 14 aa, BK virus
FKLVLFWGWCFRPF

SEQ ID NO: 26453 - protein, 14 aa, BK virus
KLVLFWGWCFRPFK

SEQ ID NO: 26454 - protein, 14 aa, BK virus
LVLFWGWCFRPFKT

SEQ ID NO: 26455 - protein, 14 aa, BK virus
VLFWGWCFRPFKTL

SEQ ID NO: 26456 - protein, 14 aa, BK virus
LFWGWCFRPFKTLK

SEQ ID NO: 26457 - protein, 14 aa, BK virus
FWGWCFRPFKTLKA

SEQ ID NO: 26458 - protein, 14 aa, BK virus
WGWCFRPFKTLKAF

SEQ ID NO: 26459 - protein, 14 aa, BK virus
GWCFRPFKTLKAFT

SEQ ID NO: 26460 - protein, 14 aa, BK virus
WCFRPFKTLKAFTQ

SEQ ID NO: 26461 - protein, 14 aa, BK virus
CFRPFKTLKAFTQM

SEQ ID NO: 26462 - protein, 14 aa, BK virus
FRPFKTLKAFTQMQ

SEQ ID NO: 26463 - protein, 14 aa, BK virus
RPFKTLKAFTQMQL

SEQ ID NO: 26464 - protein, 14 aa, BK virus
PFKTLKAFTQMQLL

SEQ ID NO: 26465 - protein, 14 aa, BK virus
FKTLKAFTQMQLLT

SEQ ID NO: 26466 - protein, 14 aa, BK virus
KTLKAFTQMQLLTM

SEQ ID NO: 26467 - protein, 14 aa, BK virus
TLKAFTQMQLLTMG

SEQ ID NO: 26468 - protein, 14 aa, BK virus
LKAFTQMQLLTMGV

SEQ ID NO: 26469 - protein, 14 aa, BK virus
ILFSCNIKNTFPHA

SEQ ID NO: 26470 - protein, 14 aa, BK virus
LFSCNIKNTFPHAY

SEQ ID NO: 26471 - protein, 14 aa, BK virus
FSCNIKNTFPHAYI

SEQ ID NO: 26472 - protein, 14 aa, BK virus
SCNIKNTFPHAYII

SEQ ID NO: 26473 - protein, 14 aa, BK virus
CNIKNTFPHAYIIF

SEQ ID NO: 26474 - protein, 14 aa, BK virus
NIKNTFPHAYIIFH

SEQ ID NO: 26475 - protein, 14 aa, BK virus
IKNTFPHAYIIFHP

SEQ ID NO: 26476 - protein, 14 aa, BK virus
KSIHTYLRIQPFLP

SEQ ID NO: 26477 - protein, 14 aa, BK virus
SIHTYLRIQPFLPF

SEQ ID NO: 26478 - protein, 14 aa, BK virus
IHTYLRIQPFLPFN

SEQ ID NO: 26479 - protein, 14 aa, BK virus
HTYLRIQPFLPFNN

SEQ ID NO: 26480 - protein, 14 aa, BK virus
TYLRIQPFLPFNNS

SEQ ID NO: 26481 - protein, 14 aa, BK virus
YLRIQPFLPFNNSR

SEQ ID NO: 26482 - protein, 14 aa, BK virus
LRIQPFLPFNNSRL

SEQ ID NO: 26483 - protein, 14 aa, BK virus
RIQPFLPFNNSRLY

SEQ ID NO: 26484 - protein, 14 aa, BK virus
IQPFLPFNNSRLYI

SEQ ID NO: 26485 - protein, 14 aa, BK virus
QPFLPFNNSRLYIS

SEQ ID NO: 26486 - protein, 14 aa, BK virus
PFLPFNNSRLYISC

SEQ ID NO: 26487 - protein, 14 aa, BK virus
FLPFNNSRLYISCK

SEQ ID NO: 26488 - protein, 14 aa, BK virus
LPFNNSRLYISCKI

SEQ ID NO: 26489 - protein, 14 aa, BK virus
PFNNSRLYISCKIS

SEQ ID NO: 26490 - protein, 14 aa, BK virus
FNNSRLYISCKISY

SEQ ID NO: 26491 - protein, 14 aa, BK virus
NNSRLYISCKISYR

SEQ ID NO: 26492 - protein, 14 aa, BK virus
NSRLYISCKISYRP

SEQ ID NO: 26493 - protein, 14 aa, BK virus
SRLYISCKISYRPK

SEQ ID NO: 26494 - protein, 14 aa, BK virus
RLYISCKISYRPKP

SEQ ID NO: 26495 - protein, 14 aa, BK virus
LYISCKISYRPKPN

SEQ ID NO: 26496 - protein, 14 aa, BK virus
IYFGPKIYLSYKSS

SEQ ID NO: 26497 - protein, 14 aa, BK virus
YFGPKIYLSYKSSL

SEQ ID NO: 26498 - protein, 14 aa, BK virus
FGPKIYLSYKSSLQ

SEQ ID NO: 26499 - protein, 14 aa, BK virus
GPKIYLSYKSSLQG

SEQ ID NO: 26500 - protein, 14 aa, BK virus
PKIYLSYKSSLQGF

SEQ ID NO: 26501 - protein, 14 aa, BK virus
KIYLSYKSSLQGFR

SEQ ID NO: 26502 - protein, 14 aa, BK virus
IYLSYKSSLQGFRD

SEQ ID NO: 26503 - protein, 14 aa, BK virus
YLSYKSSLQGFRDR

SEQ ID NO: 26504 - protein, 14 aa, BK virus
LSYKSSLQGFRDRI

SEQ ID NO: 26505 - protein, 14 aa, BK virus
SYKSSLQGFRDRIL

SEQ ID NO: 26506 - protein, 14 aa, BK virus
YKSSLQGFRDRILI

SEQ ID NO: 26507 - protein, 14 aa, BK virus
KSSLQGFRDRILIH

SEQ ID NO: 26508 - protein, 14 aa, BK virus
SSLQGFRDRILIHC

SEQ ID NO: 26509 - protein, 14 aa, BK virus
SLQGFRDRILIHCN

SEQ ID NO: 26510 - protein, 14 aa, BK virus
LQGFRDRILIHCNQ

SEQ ID NO: 26511 - protein, 14 aa, BK virus
QGFRDRILIHCNQA

SEQ ID NO: 26512 - protein, 14 aa, BK virus
GFRDRILIHCNQAW

SEQ ID NO: 26513 - protein, 14 aa, BK virus
FRDRILIHCNQAWW

SEQ ID NO: 26514 - protein, 14 aa, BK virus
RDRILIHCNQAWWK

SEQ ID NO: 26515 - protein, 14 aa, BK virus
DRILIHCNQAWWKY

SEQ ID NO: 26516 - protein, 14 aa, BK virus
RILIHCNQAWWKYL

SEQ ID NO: 26517 - protein, 14 aa, BK virus
ILIHCNQAWWKYLG

SEQ ID NO: 26518 - protein, 14 aa, BK virus
LIHCNQAWWKYLGS

SEQ ID NO: 26519 - protein, 14 aa, BK virus
IHCNQAWWKYLGSF

SEQ ID NO: 26520 - protein, 14 aa, BK virus
HCNQAWWKYLGSFV

SEQ ID NO: 26521 - protein, 14 aa, BK virus
FSSCPFYIFKNNHV

SEQ ID NO: 26522 - protein, 14 aa, BK virus
SSCPFYIFKNNHVL

SEQ ID NO: 26523 - protein, 14 aa, BK virus
SCPFYIFKNNHVLI

SEQ ID NO: 26524 - protein, 14 aa, BK virus
CPFYIFKNNHVLIY

SEQ ID NO: 26525 - protein, 14 aa, BK virus
PFYIFKNNHVLIYS

SEQ ID NO: 26526 - protein, 14 aa, BK virus
FYIFKNNHVLIYSY

SEQ ID NO: 26527 - protein, 14 aa, BK virus
YIFKNNHVLIYSYT

SEQ ID NO: 26528 - protein, 14 aa, BK virus
PVSSFRYIENNTVQ

SEQ ID NO: 26529 - protein, 14 aa, BK virus
VSSFRYIENNTVQK

SEQ ID NO: 26530 - protein, 14 aa, BK virus
SSFRYIENNTVQKI

SEQ ID NO: 26531 - protein, 14 aa, BK virus
SFRYIENNTVQKIK

SEQ ID NO: 26532 - protein, 14 aa, BK virus
FRYIENNTVQKIKY

SEQ ID NO: 26533 - protein, 14 aa, BK virus
RYIENNTVQKIKYY

SEQ ID NO: 26534 - protein, 14 aa, BK virus
YIENNTVQKIKYYR

SEQ ID NO: 26535 - protein, 14 aa, BK virus
IENNTVQKIKYYRI

SEQ ID NO: 26536 - protein, 14 aa, BK virus
ENNTVQKIKYYRIH

SEQ ID NO: 26537 - protein, 14 aa, BK virus
NNTVQKIKYYRIHF

SEQ ID NO: 26538 - protein, 14 aa, BK virus
NTVQKIKYYRIHFR

SEQ ID NO: 26539 - protein, 14 aa, BK virus
HFFPGHMKGIYSFF

SEQ ID NO: 26540 - protein, 14 aa, BK virus
FFPGHMKGIYSFFS

SEQ ID NO: 26541 - protein, 14 aa, BK virus
NCIYCLLTNTFLIF

SEQ ID NO: 26542 - protein, 14 aa, BK virus
CIYCLLTNTFLIFT

SEQ ID NO: 26543 - protein, 14 aa, BK virus
IYCLLTNTFLIFTF

SEQ ID NO: 26544 - protein, 14 aa, BK virus
YCLLTNTFLIFTFC

SEQ ID NO: 26545 - protein, 14 aa, BK virus
CLLTNTFLIFTFCK

SEQ ID NO: 26546 - protein, 14 aa, BK virus
LLTNTFLIFTFCKN

SEQ ID NO: 26547 - protein, 14 aa, BK virus
LTNTFLIFTFCKNN

SEQ ID NO: 26548 - protein, 14 aa, BK virus
TNTFLIFTFCKNNS

SEQ ID NO: 26549 - protein, 14 aa, BK virus
NTFLIFTFCKNNSI

SEQ ID NO: 26550 - protein, 14 aa, BK virus
TFLIFTFCKNNSIC

SEQ ID NO: 26551 - protein, 14 aa, BK virus
FLIFTFCKNNSICK

SEQ ID NO: 26552 - protein, 14 aa, BK virus
LIFTFCKNNSICKV

SEQ ID NO: 26553 - protein, 14 aa, BK virus
IFTFCKNNSICKVL

SEQ ID NO: 26554 - protein, 14 aa, BK virus
FTFCKNNSICKVLF

SEQ ID NO: 26555 - protein, 14 aa, BK virus
TFCKNNSICKVLFM

SEQ ID NO: 26556 - protein, 14 aa, BK virus
FCKNNSICKVLFMI

SEQ ID NO: 26557 - protein, 14 aa, BK virus
CKNNSICKVLFMIL

SEQ ID NO: 26558 - protein, 14 aa, BK virus
KNNSICKVLFMILK

SEQ ID NO: 26559 - protein, 14 aa, BK virus
NNSICKVLFMILKV

SEQ ID NO: 26560 - protein, 14 aa, BK virus
NSICKVLFMILKVI

SEQ ID NO: 26561 - protein, 14 aa, BK virus
SICKVLFMILKVIR

SEQ ID NO: 26562 - protein, 14 aa, BK virus
ICKVLFMILKVIRL

SEQ ID NO: 26563 - protein, 14 aa, BK virus
CKVLFMILKVIRLV

SEQ ID NO: 26564 - protein, 14 aa, BK virus
KVLFMILKVIRLVF

SEQ ID NO: 26565 - protein, 14 aa, BK virus
VLFMILKVIRLVFF

SEQ ID NO: 26566 - protein, 14 aa, BK virus
LFMILKVIRLVFFL

SEQ ID NO: 26567 - protein, 14 aa, BK virus
FMILKVIRLVFFLT

SEQ ID NO: 26568 - protein, 14 aa, BK virus
MILKVIRLVFFLTL

SEQ ID NO: 26569 - protein, 14 aa, BK virus
ILKVIRLVFFLTLF

SEQ ID NO: 26570 - protein, 14 aa, BK virus
LKVIRLVFFLTLFT

SEQ ID NO: 26571 - protein, 14 aa, BK virus
KVIRLVFFLTLFTL

SEQ ID NO: 26572 - protein, 14 aa, BK virus
VIRLVFFLTLFTLL

SEQ ID NO: 26573 - protein, 14 aa, BK virus
IRLVFFLTLFTLLY

SEQ ID NO: 26574 - protein, 14 aa, BK virus
RLVFFLTLFTLLYI

SEQ ID NO: 26575 - protein, 14 aa, BK virus
LVFFLTLFTLLYIV

SEQ ID NO: 26576 - protein, 14 aa, BK virus
VFFLTLFTLLYIVL

SEQ ID NO: 26577 - protein, 14 aa, BK virus
FFLTLFTLLYIVLK

SEQ ID NO: 26578 - protein, 14 aa, BK virus
FLTLFTLLYIVLKF

SEQ ID NO: 26579 - protein, 14 aa, BK virus
KHILTLCLYCILSN

SEQ ID NO: 26580 - protein, 14 aa, BK virus
FPRHLLCFFRLFWA

SEQ ID NO: 26581 - protein, 14 aa, BK virus
PRHLLCFFRLFWAK

SEQ ID NO: 26582 - protein, 14 aa, BK virus
RHLLCFFRLFWAKI

SEQ ID NO: 26583 - protein, 14 aa, BK virus
HLLCFFRLFWAKIM

SEQ ID NO: 26584 - protein, 14 aa, BK virus
LLCFFRLFWAKIML

SEQ ID NO: 26585 - protein, 14 aa, BK virus
LCFFRLFWAKIMLL

SEQ ID NO: 26586 - protein, 14 aa, BK virus
APLNAFFYSMVWIS

SEQ ID NO: 26587 - protein, 14 aa, BK virus
PLNAFFYSMVWISS

SEQ ID NO: 26588 - protein, 14 aa, BK virus
KTKGTQLLTEIINC

SEQ ID NO: 26589 - protein, 14 aa, BK virus
TKGTQLLTEIINCR

SEQ ID NO: 26590 - protein, 14 aa, BK virus
KGTQLLTEIINCRN

SEQ ID NO: 26591 - protein, 14 aa, BK virus
GTQLLTEIINCRNS

SEQ ID NO: 26592 - protein, 14 aa, BK virus
TQLLTEIINCRNSM

SEQ ID NO: 26593 - protein, 14 aa, BK virus
QLLTEIINCRNSMS

SEQ ID NO: 26594 - protein, 14 aa, BK virus
LLTEIINCRNSMSM

SEQ ID NO: 26595 - protein, 14 aa, BK virus
LTEIINCRNSMSMW

SEQ ID NO: 26596 - protein, 14 aa, BK virus
TEIINCRNSMSMWS

SEQ ID NO: 26597 - protein, 14 aa, BK virus
KEYNIMPSTHVSTN

SEQ ID NO: 26598 - protein, 14 aa, BK virus
EYNIMPSTHVSTNK

SEQ ID NO: 26599 - protein, 14 aa, BK virus
YNIMPSTHVSTNKS

SEQ ID NO: 26600 - protein, 14 aa, BK virus
NIMPSTHVSTNKSY

SEQ ID NO: 26601 - protein, 14 aa, BK virus
IMPSTHVSTNKSYR

SEQ ID NO: 26602 - protein, 14 aa, BK virus
MPSTHVSTNKSYRI

SEQ ID NO: 26603 - protein, 14 aa, BK virus
PSTHVSTNKSYRIF

SEQ ID NO: 26604 - protein, 14 aa, BK virus
STHVSTNKSYRIFF

SEQ ID NO: 26605 - protein, 14 aa, BK virus
THVSTNKSYRIFFH

SEQ ID NO: 26606 - protein, 14 aa, BK virus
HVSTNKSYRIFFHK

SEQ ID NO: 26607 - protein, 14 aa, BK virus
VSTNKSYRIFFHKF

SEQ ID NO: 26608 - protein, 14 aa, BK virus
STNKSYRIFFHKFF

SEQ ID NO: 26609 - protein, 14 aa, BK virus
TNKSYRIFFHKFFI

SEQ ID NO: 26610 - protein, 14 aa, BK virus
NKSYRIFFHKFFIQ

SEQ ID NO: 26611 - protein, 14 aa, BK virus
KSYRIFFHKFFIQN

SEQ ID NO: 26612 - protein, 14 aa, BK virus
SYRIFFHKFFIQNL

SEQ ID NO: 26613 - protein, 14 aa, BK virus
YRIFFHKFFIQNLS

SEQ ID NO: 26614 - protein, 14 aa, BK virus
RIFFHKFFIQNLSF

SEQ ID NO: 26615 - protein, 14 aa, BK virus
IFFHKFFIQNLSFF

SEQ ID NO: 26616 - protein, 14 aa, BK virus
FFHKFFIQNLSFFF

SEQ ID NO: 26617 - protein, 14 aa, BK virus
FHKFFIQNLSFFFS

SEQ ID NO: 26618 - protein, 14 aa, BK virus
HKFFIQNLSFFFSS

SEQ ID NO: 26619 - protein, 14 aa, BK virus
KFFIQNLSFFFSSI

SEQ ID NO: 26620 - protein, 14 aa, BK virus
FFIQNLSFFFSSIH

SEQ ID NO: 26621 - protein, 14 aa, BK virus
FIQNLSFFFSSIHS

SEQ ID NO: 26622 - protein, 14 aa, BK virus
IQNLSFFFSSIHSK

SEQ ID NO: 26623 - protein, 14 aa, BK virus
QNLSFFFSSIHSKA

SEQ ID NO: 26624 - protein, 14 aa, BK virus
NLSFFFSSIHSKAG

SEQ ID NO: 26625 - protein, 14 aa, BK virus
LSFFFSSIHSKAGK

SEQ ID NO: 26626 - protein, 14 aa, BK virus
SFFFSSIHSKAGKG

SEQ ID NO: 26627 - protein, 14 aa, BK virus
FFFSSIHSKAGKGS

SEQ ID NO: 26628 - protein, 14 aa, BK virus
FFSSIHSKAGKGSI

SEQ ID NO: 26629 - protein, 14 aa, BK virus
FSSIHSKAGKGSIT

SEQ ID NO: 26630 - protein, 14 aa, BK virus
SSIHSKAGKGSITK

SEQ ID NO: 26631 - protein, 14 aa, BK virus
SIHSKAGKGSITKY

SEQ ID NO: 26632 - protein, 14 aa, BK virus
IHSKAGKGSITKYS

SEQ ID NO: 26633 - protein, 14 aa, BK virus
HSKAGKGSITKYSL

SEQ ID NO: 26634 - protein, 14 aa, BK virus
SKAGKGSITKYSLT

SEQ ID NO: 26635 - protein, 14 aa, BK virus
KAGKGSITKYSLTK

SEQ ID NO: 26636 - protein, 14 aa, BK virus
AGKGSITKYSLTKK

SEQ ID NO: 26637 - protein, 14 aa, BK virus
GKGSITKYSLTKKL

SEQ ID NO: 26638 - protein, 14 aa, BK virus
KGSITKYSLTKKLV

SEQ ID NO: 26639 - protein, 14 aa, BK virus
IRGKVFRVFYLSFF

SEQ ID NO: 26640 - protein, 14 aa, BK virus
RGKVFRVFYLSFFF

SEQ ID NO: 26641 - protein, 14 aa, BK virus
GKVFRVFYLSFFFG

SEQ ID NO: 26642 - protein, 14 aa, BK virus
KVFRVFYLSFFFGW

SEQ ID NO: 26643 - protein, 14 aa, BK virus
VFRVFYLSFFFGWC

SEQ ID NO: 26644 - protein, 14 aa, BK virus
VLRICCCFFITGKH

SEQ ID NO: 26645 - protein, 14 aa, BK virus
LRICCCFFITGKHI

SEQ ID NO: 26646 - protein, 14 aa, BK virus
RICCCFFITGKHIF

SEQ ID NO: 26647 - protein, 14 aa, BK virus
ICCCFFITGKHIFM

SEQ ID NO: 26648 - protein, 14 aa, BK virus
CCCFFITGKHIFMA

SEQ ID NO: 26649 - protein, 14 aa, BK virus
CCFFITGKHIFMAK

SEQ ID NO: 26650 - protein, 14 aa, BK virus
IFIPFFIKGTPPGL

SEQ ID NO: 26651 - protein, 14 aa, BK virus
FIPFFIKGTPPGLP

SEQ ID NO: 26652 - protein, 14 aa, BK virus
IPFFIKGTPPGLPL

SEQ ID NO: 26653 - protein, 14 aa, BK virus
PFFIKGTPPGLPLF

SEQ ID NO: 26654 - protein, 14 aa, BK virus
FFIKGTPPGLPLFC

SEQ ID NO: 26655 - protein, 14 aa, BK virus
FIKGTPPGLPLFCS

SEQ ID NO: 26656 - protein, 14 aa, BK virus
IKGTPPGLPLFCSI

SEQ ID NO: 26657 - protein, 14 aa, BK virus
KGTPPGLPLFCSIG

SEQ ID NO: 26658 - protein, 14 aa, BK virus
GTPPGLPLFCSIGW

SEQ ID NO: 26659 - protein, 14 aa, BK virus
TPPGLPLFCSIGWH

SEQ ID NO: 26660 - protein, 14 aa, BK virus
PPGLPLFCSIGWHL

SEQ ID NO: 26661 - protein, 14 aa, BK virus
SFRSLKGVSPIIWT

SEQ ID NO: 26662 - protein, 14 aa, BK virus
FRSLKGVSPIIWTH

SEQ ID NO: 26663 - protein, 14 aa, BK virus
RSLKGVSPIIWTHH

SEQ ID NO: 26664 - protein, 14 aa, BK virus
SLKGVSPIIWTHHC

SEQ ID NO: 26665 - protein, 14 aa, BK virus
LKGVSPIIWTHHCR

SEQ ID NO: 26666 - protein, 14 aa, BK virus
KGVSPIIWTHHCRV

SEQ ID NO: 26667 - protein, 14 aa, BK virus
GVSPIIWTHHCRVS

SEQ ID NO: 26668 - protein, 14 aa, BK virus
VSPIIWTHHCRVSS

SEQ ID NO: 26669 - protein, 14 aa, BK virus
SPIIWTHHCRVSSV

SEQ ID NO: 26670 - protein, 14 aa, BK virus
PIIWTHHCRVSSVR

SEQ ID NO: 26671 - protein, 14 aa, BK virus
IIWTHHCRVSSVRS

SEQ ID NO: 26672 - protein, 14 aa, BK virus
IWTHHCRVSSVRSK

SEQ ID NO: 26673 - protein, 14 aa, BK virus
WTHHCRVSSVRSKP

SEQ ID NO: 26674 - protein, 14 aa, BK virus
THHCRVSSVRSKPN

SEQ ID NO: 26675 - protein, 14 aa, BK virus
HHCRVSSVRSKPNH

SEQ ID NO: 26676 - protein, 14 aa, BK virus
HCRVSSVRSKPNHC

SEQ ID NO: 26677 - protein, 14 aa, BK virus
CRVSSVRSKPNHCV

SEQ ID NO: 26678 - protein, 14 aa, BK virus
RVSSVRSKPNHCVK

SEQ ID NO: 26679 - protein, 14 aa, BK virus
VSSVRSKPNHCVKQ

SEQ ID NO: 26680 - protein, 14 aa, BK virus
SSVRSKPNHCVKQS

SEQ ID NO: 26681 - protein, 14 aa, BK virus
SVRSKPNHCVKQSM

SEQ ID NO: 26682 - protein, 14 aa, BK virus
VRSKPNHCVKQSMQ

SEQ ID NO: 26683 - protein, 14 aa, BK virus
QSIQTKGSFLKNFL

SEQ ID NO: 26684 - protein, 14 aa, BK virus
SIQTKGSFLKNFLF

SEQ ID NO: 26685 - protein, 14 aa, BK virus
IQTKGSFLKNFLFK

SEQ ID NO: 26686 - protein, 14 aa, BK virus
QTKGSFLKNFLFKC

SEQ ID NO: 26687 - protein, 14 aa, BK virus
TKGSFLKNFLFKCL

SEQ ID NO: 26688 - protein, 14 aa, BK virus
KGSFLKNFLFKCLN

SEQ ID NO: 26689 - protein, 14 aa, BK virus
GSFLKNFLFKCLNL

SEQ ID NO: 26690 - protein, 14 aa, BK virus
SFLKNFLFKCLNLS

SEQ ID NO: 26691 - protein, 14 aa, BK virus
HSMQGQCTEGFLEQ

SEQ ID NO: 26692 - protein, 14 aa, BK virus
SMQGQCTEGFLEQI

SEQ ID NO: 26693 - protein, 14 aa, BK virus
MQGQCTEGFLEQIG

SEQ ID NO: 26694 - protein, 14 aa, BK virus
QGQCTEGFLEQIGH

SEQ ID NO: 26695 - protein, 14 aa, BK virus
GQCTEGFLEQIGHS

SEQ ID NO: 26696 - protein, 14 aa, BK virus
QCTEGFLEQIGHSL

SEQ ID NO: 26697 - protein, 14 aa, BK virus
CTEGFLEQIGHSLQ

SEQ ID NO: 26698 - protein, 14 aa, BK virus
TEGFLEQIGHSLQY

SEQ ID NO: 26699 - protein, 14 aa, BK virus
EGFLEQIGHSLQYR

SEQ ID NO: 26700 - protein, 14 aa, BK virus
GFLEQIGHSLQYRV

SEQ ID NO: 26701 - protein, 14 aa, BK virus
FLEQIGHSLQYRVS

SEQ ID NO: 26702 - protein, 14 aa, BK virus
LEQIGHSLQYRVSG

SEQ ID NO: 26703 - protein, 14 aa, BK virus
EQIGHSLQYRVSGQ

SEQ ID NO: 26704 - protein, 14 aa, BK virus
QIGHSLQYRVSGQR

SEQ ID NO: 26705 - protein, 14 aa, BK virus
IGHSLQYRVSGQRG

SEQ ID NO: 26706 - protein, 14 aa, BK virus
GHSLQYRVSGQRGK

SEQ ID NO: 26707 - protein, 14 aa, BK virus
HSLQYRVSGQRGKS

SEQ ID NO: 26708 - protein, 14 aa, BK virus
SLQYRVSGQRGKSA

SEQ ID NO: 26709 - protein, 14 aa, BK virus
LQYRVSGQRGKSAQ

SEQ ID NO: 26710 - protein, 14 aa, BK virus
QYRVSGQRGKSAQT

SEQ ID NO: 26711 - protein, 14 aa, BK virus
YRVSGQRGKSAQTS

SEQ ID NO: 26712 - protein, 14 aa, BK virus
RVSGQRGKSAQTSE

SEQ ID NO: 26713 - protein, 14 aa, BK virus
VSGQRGKSAQTSEL

SEQ ID NO: 26714 - protein, 14 aa, BK virus
SGQRGKSAQTSELL

SEQ ID NO: 26715 - protein, 14 aa, BK virus
GQRGKSAQTSELLQ

SEQ ID NO: 26716 - protein, 14 aa, BK virus
QRGKSAQTSELLQV

SEQ ID NO: 26717 - protein, 14 aa, BK virus
RGKSAQTSELLQVP

SEQ ID NO: 26718 - protein, 14 aa, BK virus
GKSAQTSELLQVPK

SEQ ID NO: 26719 - protein, 14 aa, BK virus
KSAQTSELLQVPKS

SEQ ID NO: 26720 - protein, 14 aa, BK virus
SAQTSELLQVPKSG

SEQ ID NO: 26721 - protein, 14 aa, BK virus
ATFTSCSIFLYKVF

SEQ ID NO: 26722 - protein, 14 aa, BK virus
TFTSCSIFLYKVFI

SEQ ID NO: 26723 - protein, 14 aa, BK virus
FTSCSIFLYKVFIL

SEQ ID NO: 26724 - protein, 14 aa, BK virus
TSCSIFLYKVFILF

SEQ ID NO: 26725 - protein, 14 aa, BK virus
SCSIFLYKVFILFI

SEQ ID NO: 26726 - protein, 14 aa, BK virus
CSIFLYKVFILFIL

SEQ ID NO: 26727 - protein, 14 aa, BK virus
SIFLYKVFILFILS

SEQ ID NO: 26728 - protein, 14 aa, BK virus
IFLYKVFILFILSS

SEQ ID NO: 26729 - protein, 14 aa, BK virus
FLYKVFILFILSSS

SEQ ID NO: 26730 - protein, 14 aa, BK virus
LYKVFILFILSSSP

SEQ ID NO: 26731 - protein, 14 aa, BK virus
YKVFILFILSSSPP

SEQ ID NO: 26732 - protein, 14 aa, BK virus
KVFILFILSSSPPL

SEQ ID NO: 26733 - protein, 14 aa, BK virus
VFILFILSSSPPLS

SEQ ID NO: 26734 - protein, 14 aa, BK virus
FILFILSSSPPLSG

SEQ ID NO: 26735 - protein, 14 aa, BK virus
AFLIKGRFPQAALS

SEQ ID NO: 26736 - protein, 14 aa, BK virus
FLIKGRFPQAALSR

SEQ ID NO: 26737 - protein, 14 aa, BK virus
LIKGRFPQAALSRP

SEQ ID NO: 26738 - protein, 14 aa, BK virus
IKGRFPQAALSRPK

SEQ ID NO: 26739 - protein, 14 aa, BK virus
KGRFPQAALSRPKR

SEQ ID NO: 26740 - protein, 14 aa, BK virus
GRFPQAALSRPKRS

SEQ ID NO: 26741 - protein, 14 aa, BK virus
RFPQAALSRPKRSM

SEQ ID NO: 26742 - protein, 14 aa, BK virus
FPQAALSRPKRSMS

SEQ ID NO: 26743 - protein, 14 aa, BK virus
PQAALSRPKRSMSS

SEQ ID NO: 26744 - protein, 14 aa, BK virus
QAALSRPKRSMSSM

SEQ ID NO: 26745 - protein, 14 aa, BK virus
AALSRPKRSMSSMD

SEQ ID NO: 26746 - protein, 14 aa, BK virus
ALSRPKRSMSSMDS

SEQ ID NO: 26747 - protein, 14 aa, BK virus
LSRPKRSMSSMDSS

SEQ ID NO: 26748 - protein, 14 aa, BK virus
SRPKRSMSSMDSSL

SEQ ID NO: 26749 - protein, 14 aa, BK virus
RPKRSMSSMDSSLL

SEQ ID NO: 26750 - protein, 14 aa, BK virus
PKRSMSSMDSSLLR

SEQ ID NO: 26751 - protein, 14 aa, BK virus
KRSMSSMDSSLLRT

SEQ ID NO: 26752 - protein, 14 aa, BK virus
RSMSSMDSSLLRTL

SEQ ID NO: 26753 - protein, 14 aa, BK virus
SMSSMDSSLLRTLS

SEQ ID NO: 26754 - protein, 15 aa, BK virus
FCKNCKRIGISPNSF

SEQ ID NO: 26755 - protein, 15 aa, BK virus
CKNCKRIGISPNSFA

SEQ ID NO: 26756 - protein, 15 aa, BK virus
KNCKRIGISPNSFAR

SEQ ID NO: 26757 - protein, 15 aa, BK virus
NCKRIGISPNSFARP

SEQ ID NO: 26758 - protein, 15 aa, BK virus
CKRIGISPNSFARPQ

SEQ ID NO: 26759 - protein, 15 aa, BK virus
KRIGISPNSFARPQK

SEQ ID NO: 26760 - protein, 15 aa, BK virus
RIGISPNSFARPQKK

SEQ ID NO: 26761 - protein, 15 aa, BK virus
IGISPNSFARPQKKP

SEQ ID NO: 26762 - protein, 15 aa, BK virus
GISPNSFARPQKKPP

SEQ ID NO: 26763 - protein, 15 aa, BK virus
ISPNSFARPQKKPPH

SEQ ID NO: 26764 - protein, 15 aa, BK virus
SPNSFARPQKKPPHP

SEQ ID NO: 26765 - protein, 15 aa, BK virus
PNSFARPQKKPPHPY

SEQ ID NO: 26766 - protein, 15 aa, BK virus
NSFARPQKKPPHPYY

SEQ ID NO: 26767 - protein, 15 aa, BK virus
SFARPQKKPPHPYYL

SEQ ID NO: 26768 - protein, 15 aa, BK virus
FARPQKKPPHPYYLR

SEQ ID NO: 26769 - protein, 15 aa, BK virus
ARPQKKPPHPYYLRE

SEQ ID NO: 26770 - protein, 15 aa, BK virus
RPQKKPPHPYYLRER

SEQ ID NO: 26771 - protein, 15 aa, BK virus
PQKKPPHPYYLRERV

SEQ ID NO: 26772 - protein, 15 aa, BK virus
QKKPPHPYYLRERVE

SEQ ID NO: 26773 - protein, 15 aa, BK virus
KKPPHPYYLRERVEA

SEQ ID NO: 26774 - protein, 15 aa, BK virus
KPPHPYYLRERVEAE

SEQ ID NO: 26775 - protein, 15 aa, BK virus
PPHPYYLRERVEAEA

SEQ ID NO: 26776 - protein, 15 aa, BK virus
PHPYYLRERVEAEAA

SEQ ID NO: 26777 - protein, 15 aa, BK virus
HPYYLRERVEAEAAS

SEQ ID NO: 26778 - protein, 15 aa, BK virus
PYYLRERVEAEAASA

SEQ ID NO: 26779 - protein, 15 aa, BK virus
YYLRERVEAEAASAS

SEQ ID NO: 26780 - protein, 15 aa, BK virus
YLRERVEAEAASASY

SEQ ID NO: 26781 - protein, 15 aa, BK virus
LRERVEAEAASASYI

SEQ ID NO: 26782 - protein, 15 aa, BK virus
RERVEAEAASASYIL

SEQ ID NO: 26783 - protein, 15 aa, BK virus
KKRPQGGAAYPWNAA

SEQ ID NO: 26784 - protein, 15 aa, BK virus
KRPQGGAAYPWNAAK

SEQ ID NO: 26785 - protein, 15 aa, BK virus
RPQGGAAYPWNAAKP

SEQ ID NO: 26786 - protein, 15 aa, BK virus
PQEGKCMTHRGMQPN

SEQ ID NO: 26787 - protein, 15 aa, BK virus
QEGKCMTHRGMQPNH

SEQ ID NO: 26788 - protein, 15 aa, BK virus
EGKCMTHRGMQPNHD

SEQ ID NO: 26789 - protein, 15 aa, BK virus
GKCMTHRGMQPNHDL

SEQ ID NO: 26790 - protein, 15 aa, BK virus
KCMTHRGMQPNHDLR

SEQ ID NO: 26791 - protein, 15 aa, BK virus
CMTHRGMQPNHDLRK

SEQ ID NO: 26792 - protein, 15 aa, BK virus
MTHRGMQPNHDLRKE

SEQ ID NO: 26793 - protein, 15 aa, BK virus
THRGMQPNHDLRKES

SEQ ID NO: 26794 - protein, 15 aa, BK virus
HRGMQPNHDLRKESA

SEQ ID NO: 26795 - protein, 15 aa, BK virus
LTGRSCLPMECSQTM

SEQ ID NO: 26796 - protein, 15 aa, BK virus
TGRSCLPMECSQTMT

SEQ ID NO: 26797 - protein, 15 aa, BK virus
GRSCLPMECSQTMTS

SEQ ID NO: 26798 - protein, 15 aa, BK virus
RSCLPMECSQTMTSG

SEQ ID NO: 26799 - protein, 15 aa, BK virus
SCLPMECSQTMTSGR

SEQ ID NO: 26800 - protein, 15 aa, BK virus
CLPMECSQTMTSGRK

SEQ ID NO: 26801 - protein, 15 aa, BK virus
LPMECSQTMTSGRKV

SEQ ID NO: 26802 - protein, 15 aa, BK virus
PMECSQTMTSGRKVH

SEQ ID NO: 26803 - protein, 15 aa, BK virus
MECSQTMTSGRKVHD

SEQ ID NO: 26804 - protein, 15 aa, BK virus
ECSQTMTSGRKVHDR

SEQ ID NO: 26805 - protein, 15 aa, BK virus
CSQTMTSGRKVHDRH

SEQ ID NO: 26806 - protein, 15 aa, BK virus
SQTMTSGRKVHDRHV

SEQ ID NO: 26807 - protein, 15 aa, BK virus
QTMTSGRKVHDRHVL

SEQ ID NO: 26808 - protein, 15 aa, BK virus
TMTSGRKVHDRHVLR

SEQ ID NO: 26809 - protein, 15 aa, BK virus
MTSGRKVHDRHVLRA

SEQ ID NO: 26810 - protein, 15 aa, BK virus
ESWPCPQLNWTKAMV

SEQ ID NO: 26811 - protein, 15 aa, BK virus
SWPCPQLNWTKAMVL

SEQ ID NO: 26812 - protein, 15 aa, BK virus
WPCPQLNWTKAMVLR

SEQ ID NO: 26813 - protein, 15 aa, BK virus
PCPQLNWTKAMVLRQ

SEQ ID NO: 26814 - protein, 15 aa, BK virus
CPQLNWTKAMVLRQL

SEQ ID NO: 26815 - protein, 15 aa, BK virus
PQLNWTKAMVLRQLS

SEQ ID NO: 26816 - protein, 15 aa, BK virus
QLNWTKAMVLRQLSR

SEQ ID NO: 26817 - protein, 15 aa, BK virus
LNWTKAMVLRQLSRQ

SEQ ID NO: 26818 - protein, 15 aa, BK virus
NWTKAMVLRQLSRQA

SEQ ID NO: 26819 - protein, 15 aa, BK virus
WTKAMVLRQLSRQAS

SEQ ID NO: 26820 - protein, 15 aa, BK virus
TKAMVLRQLSRQASV

SEQ ID NO: 26821 - protein, 15 aa, BK virus
KAMVLRQLSRQASVK

SEQ ID NO: 26822 - protein, 15 aa, BK virus
AMVLRQLSRQASVKV

SEQ ID NO: 26823 - protein, 15 aa, BK virus
MVLRQLSRQASVKVG

SEQ ID NO: 26824 - protein, 15 aa, BK virus
VLRQLSRQASVKVGK

SEQ ID NO: 26825 - protein, 15 aa, BK virus
LRQLSRQASVKVGKT

SEQ ID NO: 26826 - protein, 15 aa, BK virus
RQLSRQASVKVGKTW

SEQ ID NO: 26827 - protein, 15 aa, BK virus
QLSRQASVKVGKTWT

SEQ ID NO: 26828 - protein, 15 aa, BK virus
LSRQASVKVGKTWTG

SEQ ID NO: 26829 - protein, 15 aa, BK virus
SRQASVKVGKTWTGT

SEQ ID NO: 26830 - protein, 15 aa, BK virus
RQASVKVGKTWTGTK

SEQ ID NO: 26831 - protein, 15 aa, BK virus
QASVKVGKTWTGTKK

SEQ ID NO: 26832 - protein, 15 aa, BK virus
ASVKVGKTWTGTKKR

SEQ ID NO: 26833 - protein, 15 aa, BK virus
SVKVGKTWTGTKKRA

SEQ ID NO: 26834 - protein, 15 aa, BK virus
VKVGKTWTGTKKRAQ

SEQ ID NO: 26835 - protein, 15 aa, BK virus
KVGKTWTGTKKRAQR

SEQ ID NO: 26836 - protein, 15 aa, BK virus
VGKTWTGTKKRAQRI

SEQ ID NO: 26837 - protein, 15 aa, BK virus
GKTWTGTKKRAQRIF

SEQ ID NO: 26838 - protein, 15 aa, BK virus
KTWTGTKKRAQRIFI

SEQ ID NO: 26839 - protein, 15 aa, BK virus
TWTGTKKRAQRIFIF

SEQ ID NO: 26840 - protein, 15 aa, BK virus
WTGTKKRAQRIFIFI

SEQ ID NO: 26841 - protein, 15 aa, BK virus
TGTKKRAQRIFIFIL

SEQ ID NO: 26842 - protein, 15 aa, BK virus
GTKKRAQRIFIFILE

SEQ ID NO: 26843 - protein, 15 aa, BK virus
TKKRAQRIFIFILEL

SEQ ID NO: 26844 - protein, 15 aa, BK virus
KKRAQRIFIFILELL

SEQ ID NO: 26845 - protein, 15 aa, BK virus
KRAQRIFIFILELLL

SEQ ID NO: 26846 - protein, 15 aa, BK virus
RAQRIFIFILELLLE

SEQ ID NO: 26847 - protein, 15 aa, BK virus
AQRIFIFILELLLEF

SEQ ID NO: 26848 - protein, 15 aa, BK virus
QRIFIFILELLLEFC

SEQ ID NO: 26849 - protein, 15 aa, BK virus
RIFIFILELLLEFCR

SEQ ID NO: 26850 - protein, 15 aa, BK virus
IFIFILELLLEFCRG

SEQ ID NO: 26851 - protein, 15 aa, BK virus
FIFILELLLEFCRGE

SEQ ID NO: 26852 - protein, 15 aa, BK virus
IFILELLLEFCRGED

SEQ ID NO: 26853 - protein, 15 aa, BK virus
FILELLLEFCRGEDS

SEQ ID NO: 26854 - protein, 15 aa, BK virus
ILELLLEFCRGEDSV

SEQ ID NO: 26855 - protein, 15 aa, BK virus
LELLLEFCRGEDSVD

SEQ ID NO: 26856 - protein, 15 aa, BK virus
ELLLEFCRGEDSVDG

SEQ ID NO: 26857 - protein, 15 aa, BK virus
LLLEFCRGEDSVDGK

SEQ ID NO: 26858 - protein, 15 aa, BK virus
LLEFCRGEDSVDGKN

SEQ ID NO: 26859 - protein, 15 aa, BK virus
LEFCRGEDSVDGKNK

SEQ ID NO: 26860 - protein, 15 aa, BK virus
EFCRGEDSVDGKNKS

SEQ ID NO: 26861 - protein, 15 aa, BK virus
FCRGEDSVDGKNKST

SEQ ID NO: 26862 - protein, 15 aa, BK virus
CRGEDSVDGKNKSTT

SEQ ID NO: 26863 - protein, 15 aa, BK virus
RGEDSVDGKNKSTTA

SEQ ID NO: 26864 - protein, 15 aa, BK virus
GEDSVDGKNKSTTAL

SEQ ID NO: 26865 - protein, 15 aa, BK virus
EDSVDGKNKSTTALP

SEQ ID NO: 26866 - protein, 15 aa, BK virus
DSVDGKNKSTTALPA

SEQ ID NO: 26867 - protein, 15 aa, BK virus
SVDGKNKSTTALPAV

SEQ ID NO: 26868 - protein, 15 aa, BK virus
VDGKNKSTTALPAVK

SEQ ID NO: 26869 - protein, 15 aa, BK virus
DGKNKSTTALPAVKD

SEQ ID NO: 26870 - protein, 15 aa, BK virus
GKNKSTTALPAVKDS

SEQ ID NO: 26871 - protein, 15 aa, BK virus
KNKSTTALPAVKDSV

SEQ ID NO: 26872 - protein, 15 aa, BK virus
NKSTTALPAVKDSVK

SEQ ID NO: 26873 - protein, 15 aa, BK virus
KSTTALPAVKDSVKD

SEQ ID NO: 26874 - protein, 15 aa, BK virus
STTALPAVKDSVKDS

SEQ ID NO: 26875 - protein, 15 aa, BK virus
VSNPFFFVFPGSWVL

SEQ ID NO: 26876 - protein, 15 aa, BK virus
SNPFFFVFPGSWVLL

SEQ ID NO: 26877 - protein, 15 aa, BK virus
LPVYLRLLLPQDFQW

SEQ ID NO: 26878 - protein, 15 aa, BK virus
PVYLRLLLPQDFQWL

SEQ ID NO: 26879 - protein, 15 aa, BK virus
VYLRLLLPQDFQWLK

SEQ ID NO: 26880 - protein, 15 aa, BK virus
YLRLLLPQDFQWLKL

SEQ ID NO: 26881 - protein, 15 aa, BK virus
LRLLLPQDFQWLKLL

SEQ ID NO: 26882 - protein, 15 aa, BK virus
RLLLPQDFQWLKLLL

SEQ ID NO: 26883 - protein, 15 aa, BK virus
LLLPQDFQWLKLLLG

SEQ ID NO: 26884 - protein, 15 aa, BK virus
LLPQDFQWLKLLLGR

SEQ ID NO: 26885 - protein, 15 aa, BK virus
LPQDFQWLKLLLGRL

SEQ ID NO: 26886 - protein, 15 aa, BK virus
PQDFQWLKLLLGRLL

SEQ ID NO: 26887 - protein, 15 aa, BK virus
QDFQWLKLLLGRLLL

SEQ ID NO: 26888 - protein, 15 aa, BK virus
DFQWLKLLLGRLLLL

SEQ ID NO: 26889 - protein, 15 aa, BK virus
ASISNQAWLWNCLTQ

SEQ ID NO: 26890 - protein, 15 aa, BK virus
SISNQAWLWNCLTQM

SEQ ID NO: 26891 - protein, 15 aa, BK virus
ISNQAWLWNCLTQMS

SEQ ID NO: 26892 - protein, 15 aa, BK virus
SNQAWLWNCLTQMST

SEQ ID NO: 26893 - protein, 15 aa, BK virus
NQAWLWNCLTQMSTM

SEQ ID NO: 26894 - protein, 15 aa, BK virus
QAWLWNCLTQMSTMI

SEQ ID NO: 26895 - protein, 15 aa, BK virus
AWLWNCLTQMSTMIF

SEQ ID NO: 26896 - protein, 15 aa, BK virus
WLWNCLTQMSTMIFC

SEQ ID NO: 26897 - protein, 15 aa, BK virus
LWNCLTQMSTMIFCF

SEQ ID NO: 26898 - protein, 15 aa, BK virus
WNCLTQMSTMIFCFL

SEQ ID NO: 26899 - protein, 15 aa, BK virus
NCLTQMSTMIFCFLV

SEQ ID NO: 26900 - protein, 15 aa, BK virus
ILLLIIFNTLILGIG

SEQ ID NO: 26901 - protein, 15 aa, BK virus
LLLIIFNTLILGIGV

SEQ ID NO: 26902 - protein, 15 aa, BK virus
LLIIFNTLILGIGVL

SEQ ID NO: 26903 - protein, 15 aa, BK virus
LIIFNTLILGIGVLL

SEQ ID NO: 26904 - protein, 15 aa, BK virus
IIFNTLILGIGVLLC

SEQ ID NO: 26905 - protein, 15 aa, BK virus
IFNTLILGIGVLLCL

SEQ ID NO: 26906 - protein, 15 aa, BK virus
FNTLILGIGVLLCLL

SEQ ID NO: 26907 - protein, 15 aa, BK virus
NTLILGIGVLLCLLL

SEQ ID NO: 26908 - protein, 15 aa, BK virus
TLILGIGVLLCLLLF

SEQ ID NO: 26909 - protein, 15 aa, BK virus
LILGIGVLLCLLLFP

SEQ ID NO: 26910 - protein, 15 aa, BK virus
ILGIGVLLCLLLFPR

SEQ ID NO: 26911 - protein, 15 aa, BK virus
LGIGVLLCLLLFPRL

SEQ ID NO: 26912 - protein, 15 aa, BK virus
GIGVLLCLLLFPRLC

SEQ ID NO: 26913 - protein, 15 aa, BK virus
IGVLLCLLLFPRLCG

SEQ ID NO: 26914 - protein, 15 aa, BK virus
GVLLCLLLFPRLCGM

SEQ ID NO: 26915 - protein, 15 aa, BK virus
VLLCLLLFPRLCGML

SEQ ID NO: 26916 - protein, 15 aa, BK virus
LLCLLLFPRLCGMLL

SEQ ID NO: 26917 - protein, 15 aa, BK virus
LCLLLFPRLCGMLLG

SEQ ID NO: 26918 - protein, 15 aa, BK virus
CLLLFPRLCGMLLGM

SEQ ID NO: 26919 - protein, 15 aa, BK virus
LLLFPRLCGMLLGMI

SEQ ID NO: 26920 - protein, 15 aa, BK virus
LLFPRLCGMLLGMIY

SEQ ID NO: 26921 - protein, 15 aa, BK virus
LFPRLCGMLLGMIYL

SEQ ID NO: 26922 - protein, 15 aa, BK virus
FPRLCGMLLGMIYLL

SEQ ID NO: 26923 - protein, 15 aa, BK virus
PHRNCREEQKDFLET

SEQ ID NO: 26924 - protein, 15 aa, BK virus
HRNCREEQKDFLETP

SEQ ID NO: 26925 - protein, 15 aa, BK virus
RNCREEQKDFLETPW

SEQ ID NO: 26926 - protein, 15 aa, BK virus
NCREEQKDFLETPWL

SEQ ID NO: 26927 - protein, 15 aa, BK virus
CREEQKDFLETPWLD

SEQ ID NO: 26928 - protein, 15 aa, BK virus
REEQKDFLETPWLDF

SEQ ID NO: 26929 - protein, 15 aa, BK virus
EEQKDFLETPWLDFW

SEQ ID NO: 26930 - protein, 15 aa, BK virus
EQKDFLETPWLDFWR

SEQ ID NO: 26931 - protein, 15 aa, BK virus
QKDFLETPWLDFWRK

SEQ ID NO: 26932 - protein, 15 aa, BK virus
KDFLETPWLDFWRKL

SEQ ID NO: 26933 - protein, 15 aa, BK virus
DFLETPWLDFWRKLP

SEQ ID NO: 26934 - protein, 15 aa, BK virus
FLETPWLDFWRKLPG

SEQ ID NO: 26935 - protein, 15 aa, BK virus
LETPWLDFWRKLPGQ

SEQ ID NO: 26936 - protein, 15 aa, BK virus
ETPWLDFWRKLPGQL

SEQ ID NO: 26937 - protein, 15 aa, BK virus
TFIIIFNNIILIFPL

SEQ ID NO: 26938 - protein, 15 aa, BK virus
FIIIFNNIILIFPLL

SEQ ID NO: 26939 - protein, 15 aa, BK virus
IIIFNNIILIFPLLG

SEQ ID NO: 26940 - protein, 15 aa, BK virus
IIFNNIILIFPLLGP

SEQ ID NO: 26941 - protein, 15 aa, BK virus
IFNNIILIFPLLGPQ

SEQ ID NO: 26942 - protein, 15 aa, BK virus
FNNIILIFPLLGPQW

SEQ ID NO: 26943 - protein, 15 aa, BK virus
NNIILIFPLLGPQWL

SEQ ID NO: 26944 - protein, 15 aa, BK virus
NIILIFPLLGPQWLD

SEQ ID NO: 26945 - protein, 15 aa, BK virus
IILIFPLLGPQWLDK

SEQ ID NO: 26946 - protein, 15 aa, BK virus
LKGKVPVYILAILIV

SEQ ID NO: 26947 - protein, 15 aa, BK virus
KKLLPQEVLIKELLL

SEQ ID NO: 26948 - protein, 15 aa, BK virus
KLLPQEVLIKELLLN

SEQ ID NO: 26949 - protein, 15 aa, BK virus
LLPQEVLIKELLLNG

SEQ ID NO: 26950 - protein, 15 aa, BK virus
LPQEVLIKELLLNGC

SEQ ID NO: 26951 - protein, 15 aa, BK virus
PQEVLIKELLLNGCC

SEQ ID NO: 26952 - protein, 15 aa, BK virus
QEVLIKELLLNGCCL

SEQ ID NO: 26953 - protein, 15 aa, BK virus
EVLIKELLLNGCCLY

SEQ ID NO: 26954 - protein, 15 aa, BK virus
VLIKELLLNGCCLYF

SEQ ID NO: 26955 - protein, 15 aa, BK virus
HLLLKHMKMAPTKRK

SEQ ID NO: 26956 - protein, 15 aa, BK virus
LLLKHMKMAPTKRKG

SEQ ID NO: 26957 - protein, 15 aa, BK virus
LLKHMKMAPTKRKGE

SEQ ID NO: 26958 - protein, 15 aa, BK virus
LKHMKMAPTKRKGEC

SEQ ID NO: 26959 - protein, 15 aa, BK virus
KHMKMAPTKRKGECP

SEQ ID NO: 26960 - protein, 15 aa, BK virus
HMKMAPTKRKGECPG

SEQ ID NO: 26961 - protein, 15 aa, BK virus
MKMAPTKRKGECPGA

SEQ ID NO: 26962 - protein, 15 aa, BK virus
KMAPTKRKGECPGAA

SEQ ID NO: 26963 - protein, 15 aa, BK virus
MAPTKRKGECPGAAP

SEQ ID NO: 26964 - protein, 15 aa, BK virus
APTKRKGECPGAAPK

SEQ ID NO: 26965 - protein, 15 aa, BK virus
PTKRKGECPGAAPKK

SEQ ID NO: 26966 - protein, 15 aa, BK virus
TKRKGECPGAAPKKP

SEQ ID NO: 26967 - protein, 15 aa, BK virus
KRKGECPGAAPKKPK

SEQ ID NO: 26968 - protein, 15 aa, BK virus
RKGECPGAAPKKPKE

SEQ ID NO: 26969 - protein, 15 aa, BK virus
KGECPGAAPKKPKEP

SEQ ID NO: 26970 - protein, 15 aa, BK virus
GECPGAAPKKPKEPV

SEQ ID NO: 26971 - protein, 15 aa, BK virus
ECPGAAPKKPKEPVQ

SEQ ID NO: 26972 - protein, 15 aa, BK virus
CPGAAPKKPKEPVQV

SEQ ID NO: 26973 - protein, 15 aa, BK virus
PGAAPKKPKEPVQVP

SEQ ID NO: 26974 - protein, 15 aa, BK virus
GAAPKKPKEPVQVPK

SEQ ID NO: 26975 - protein, 15 aa, BK virus
AAPKKPKEPVQVPKL

SEQ ID NO: 26976 - protein, 15 aa, BK virus
APKKPKEPVQVPKLL

SEQ ID NO: 26977 - protein, 15 aa, BK virus
PKKPKEPVQVPKLLI

SEQ ID NO: 26978 - protein, 15 aa, BK virus
KKPKEPVQVPKLLIK

SEQ ID NO: 26979 - protein, 15 aa, BK virus
KPKEPVQVPKLLIKG

SEQ ID NO: 26980 - protein, 15 aa, BK virus
PKEPVQVPKLLIKGG

SEQ ID NO: 26981 - protein, 15 aa, BK virus
KEPVQVPKLLIKGGV

SEQ ID NO: 26982 - protein, 15 aa, BK virus
EPVQVPKLLIKGGVE

SEQ ID NO: 26983 - protein, 15 aa, BK virus
PVQVPKLLIKGGVEV

SEQ ID NO: 26984 - protein, 15 aa, BK virus
VQVPKLLIKGGVEVL

SEQ ID NO: 26985 - protein, 15 aa, BK virus
QVPKLLIKGGVEVLE

SEQ ID NO: 26986 - protein, 15 aa, BK virus
VPKLLIKGGVEVLEV

SEQ ID NO: 26987 - protein, 15 aa, BK virus
PKLLIKGGVEVLEVK

SEQ ID NO: 26988 - protein, 15 aa, BK virus
KLLIKGGVEVLEVKT

SEQ ID NO: 26989 - protein, 15 aa, BK virus
LLIKGGVEVLEVKTG

SEQ ID NO: 26990 - protein, 15 aa, BK virus
LIKGGVEVLEVKTGV

SEQ ID NO: 26991 - protein, 15 aa, BK virus
IKGGVEVLEVKTGVD

SEQ ID NO: 26992 - protein, 15 aa, BK virus
KGGVEVLEVKTGVDA

SEQ ID NO: 26993 - protein, 15 aa, BK virus
GGVEVLEVKTGVDAI

SEQ ID NO: 26994 - protein, 15 aa, BK virus
GVEVLEVKTGVDAIT

SEQ ID NO: 26995 - protein, 15 aa, BK virus
VEVLEVKTGVDAITE

SEQ ID NO: 26996 - protein, 15 aa, BK virus
EVLEVKTGVDAITEV

SEQ ID NO: 26997 - protein, 15 aa, BK virus
VLEVKTGVDAITEVE

SEQ ID NO: 26998 - protein, 15 aa, BK virus
LEVKTGVDAITEVEC

SEQ ID NO: 26999 - protein, 15 aa, BK virus
EVKTGVDAITEVECF

SEQ ID NO: 27000 - protein, 15 aa, BK virus
VKTGVDAITEVECFL

SEQ ID NO: 27001 - protein, 15 aa, BK virus
KTGVDAITEVECFLN

SEQ ID NO: 27002 - protein, 15 aa, BK virus
TGVDAITEVECFLNP

SEQ ID NO: 27003 - protein, 15 aa, BK virus
GVDAITEVECFLNPE

SEQ ID NO: 27004 - protein, 15 aa, BK virus
VDAITEVECFLNPEM

SEQ ID NO: 27005 - protein, 15 aa, BK virus
DAITEVECFLNPEMG

SEQ ID NO: 27006 - protein, 15 aa, BK virus
AITEVECFLNPEMGD

SEQ ID NO: 27007 - protein, 15 aa, BK virus
ITEVECFLNPEMGDP

SEQ ID NO: 27008 - protein, 15 aa, BK virus
TEVECFLNPEMGDPD

SEQ ID NO: 27009 - protein, 15 aa, BK virus
EVECFLNPEMGDPDE

SEQ ID NO: 27010 - protein, 15 aa, BK virus
VECFLNPEMGDPDEN

SEQ ID NO: 27011 - protein, 15 aa, BK virus
ECFLNPEMGDPDENL

SEQ ID NO: 27012 - protein, 15 aa, BK virus
CFLNPEMGDPDENLR

SEQ ID NO: 27013 - protein, 15 aa, BK virus
FLNPEMGDPDENLRG

SEQ ID NO: 27014 - protein, 15 aa, BK virus
LNPEMGDPDENLRGF

SEQ ID NO: 27015 - protein, 15 aa, BK virus
NPEMGDPDENLRGFS

SEQ ID NO: 27016 - protein, 15 aa, BK virus
PEMGDPDENLRGFSL

SEQ ID NO: 27017 - protein, 15 aa, BK virus
EMGDPDENLRGFSLK

SEQ ID NO: 27018 - protein, 15 aa, BK virus
MGDPDENLRGFSLKL

SEQ ID NO: 27019 - protein, 15 aa, BK virus
GDPDENLRGFSLKLS

SEQ ID NO: 27020 - protein, 15 aa, BK virus
DPDENLRGFSLKLSA

SEQ ID NO: 27021 - protein, 15 aa, BK virus
PDENLRGFSLKLSAE

SEQ ID NO: 27022 - protein, 15 aa, BK virus
DENLRGFSLKLSAEN

SEQ ID NO: 27023 - protein, 15 aa, BK virus
ENLRGFSLKLSAEND

SEQ ID NO: 27024 - protein, 15 aa, BK virus
NLRGFSLKLSAENDF

SEQ ID NO: 27025 - protein, 15 aa, BK virus
LRGFSLKLSAENDFS

SEQ ID NO: 27026 - protein, 15 aa, BK virus
RGFSLKLSAENDFSS

SEQ ID NO: 27027 - protein, 15 aa, BK virus
GFSLKLSAENDFSSD

SEQ ID NO: 27028 - protein, 15 aa, BK virus
FSLKLSAENDFSSDS

SEQ ID NO: 27029 - protein, 15 aa, BK virus
SLKLSAENDFSSDSP

SEQ ID NO: 27030 - protein, 15 aa, BK virus
LKLSAENDFSSDSPE

SEQ ID NO: 27031 - protein, 15 aa, BK virus
KLSAENDFSSDSPER

SEQ ID NO: 27032 - protein, 15 aa, BK virus
LSAENDFSSDSPERK

SEQ ID NO: 27033 - protein, 15 aa, BK virus
SAENDFSSDSPERKM

SEQ ID NO: 27034 - protein, 15 aa, BK virus
AENDFSSDSPERKML

SEQ ID NO: 27035 - protein, 15 aa, BK virus
ENDFSSDSPERKMLP

SEQ ID NO: 27036 - protein, 15 aa, BK virus
NDFSSDSPERKMLPC

SEQ ID NO: 27037 - protein, 15 aa, BK virus
DFSSDSPERKMLPCY

SEQ ID NO: 27038 - protein, 15 aa, BK virus
FSSDSPERKMLPCYS

SEQ ID NO: 27039 - protein, 15 aa, BK virus
SSDSPERKMLPCYST

SEQ ID NO: 27040 - protein, 15 aa, BK virus
SDSPERKMLPCYSTA

SEQ ID NO: 27041 - protein, 15 aa, BK virus
DSPERKMLPCYSTAR

SEQ ID NO: 27042 - protein, 15 aa, BK virus
SPERKMLPCYSTARI

SEQ ID NO: 27043 - protein, 15 aa, BK virus
PERKMLPCYSTARIP

SEQ ID NO: 27044 - protein, 15 aa, BK virus
ERKMLPCYSTARIPL

SEQ ID NO: 27045 - protein, 15 aa, BK virus
RKMLPCYSTARIPLP

SEQ ID NO: 27046 - protein, 15 aa, BK virus
KMLPCYSTARIPLPN

SEQ ID NO: 27047 - protein, 15 aa, BK virus
MLPCYSTARIPLPNL

SEQ ID NO: 27048 - protein, 15 aa, BK virus
LPCYSTARIPLPNLN

SEQ ID NO: 27049 - protein, 15 aa, BK virus
PCYSTARIPLPNLNE

SEQ ID NO: 27050 - protein, 15 aa, BK virus
CYSTARIPLPNLNED

SEQ ID NO: 27051 - protein, 15 aa, BK virus
YSTARIPLPNLNEDL

SEQ ID NO: 27052 - protein, 15 aa, BK virus
STARIPLPNLNEDLT

SEQ ID NO: 27053 - protein, 15 aa, BK virus
TARIPLPNLNEDLTC

SEQ ID NO: 27054 - protein, 15 aa, BK virus
ARIPLPNLNEDLTCG

SEQ ID NO: 27055 - protein, 15 aa, BK virus
RIPLPNLNEDLTCGN

SEQ ID NO: 27056 - protein, 15 aa, BK virus
IPLPNLNEDLTCGNL

SEQ ID NO: 27057 - protein, 15 aa, BK virus
PLPNLNEDLTCGNLL

SEQ ID NO: 27058 - protein, 15 aa, BK virus
LPNLNEDLTCGNLLM

SEQ ID NO: 27059 - protein, 15 aa, BK virus
PNLNEDLTCGNLLMW

SEQ ID NO: 27060 - protein, 15 aa, BK virus
NLNEDLTCGNLLMWE

SEQ ID NO: 27061 - protein, 15 aa, BK virus
LNEDLTCGNLLMWEA

SEQ ID NO: 27062 - protein, 15 aa, BK virus
NEDLTCGNLLMWEAV

SEQ ID NO: 27063 - protein, 15 aa, BK virus
EDLTCGNLLMWEAVT

SEQ ID NO: 27064 - protein, 15 aa, BK virus
DLTCGNLLMWEAVTV

SEQ ID NO: 27065 - protein, 15 aa, BK virus
LTCGNLLMWEAVTVQ

SEQ ID NO: 27066 - protein, 15 aa, BK virus
TCGNLLMWEAVTVQT

SEQ ID NO: 27067 - protein, 15 aa, BK virus
CGNLLMWEAVTVQTE

SEQ ID NO: 27068 - protein, 15 aa, BK virus
GNLLMWEAVTVQTEV

SEQ ID NO: 27069 - protein, 15 aa, BK virus
NLLMWEAVTVQTEVI

SEQ ID NO: 27070 - protein, 15 aa, BK virus
LLMWEAVTVQTEVIG

SEQ ID NO: 27071 - protein, 15 aa, BK virus
LMWEAVTVQTEVIGI

SEQ ID NO: 27072 - protein, 15 aa, BK virus
MWEAVTVQTEVIGIT

SEQ ID NO: 27073 - protein, 15 aa, BK virus
WEAVTVQTEVIGITS

SEQ ID NO: 27074 - protein, 15 aa, BK virus
EAVTVQTEVIGITSM

SEQ ID NO: 27075 - protein, 15 aa, BK virus
AVTVQTEVIGITSML

SEQ ID NO: 27076 - protein, 15 aa, BK virus
VTVQTEVIGITSMLN

SEQ ID NO: 27077 - protein, 15 aa, BK virus
TVQTEVIGITSMLNL

SEQ ID NO: 27078 - protein, 15 aa, BK virus
VQTEVIGITSMLNLH

SEQ ID NO: 27079 - protein, 15 aa, BK virus
QTEVIGITSMLNLHA

SEQ ID NO: 27080 - protein, 15 aa, BK virus
TEVIGITSMLNLHAG

SEQ ID NO: 27081 - protein, 15 aa, BK virus
EVIGITSMLNLHAGS

SEQ ID NO: 27082 - protein, 15 aa, BK virus
VIGITSMLNLHAGSQ

SEQ ID NO: 27083 - protein, 15 aa, BK virus
IGITSMLNLHAGSQK

SEQ ID NO: 27084 - protein, 15 aa, BK virus
GITSMLNLHAGSQKV

SEQ ID NO: 27085 - protein, 15 aa, BK virus
ITSMLNLHAGSQKVH

SEQ ID NO: 27086 - protein, 15 aa, BK virus
TSMLNLHAGSQKVHE

SEQ ID NO: 27087 - protein, 15 aa, BK virus
SMLNLHAGSQKVHEH

SEQ ID NO: 27088 - protein, 15 aa, BK virus
MLNLHAGSQKVHEHG

SEQ ID NO: 27089 - protein, 15 aa, BK virus
LNLHAGSQKVHEHGG

SEQ ID NO: 27090 - protein, 15 aa, BK virus
NLHAGSQKVHEHGGG

SEQ ID NO: 27091 - protein, 15 aa, BK virus
LHAGSQKVHEHGGGK

SEQ ID NO: 27092 - protein, 15 aa, BK virus
HAGSQKVHEHGGGKP

SEQ ID NO: 27093 - protein, 15 aa, BK virus
AGSQKVHEHGGGKPI

SEQ ID NO: 27094 - protein, 15 aa, BK virus
GSQKVHEHGGGKPIQ

SEQ ID NO: 27095 - protein, 15 aa, BK virus
SQKVHEHGGGKPIQG

SEQ ID NO: 27096 - protein, 15 aa, BK virus
QKVHEHGGGKPIQGS

SEQ ID NO: 27097 - protein, 15 aa, BK virus
KVHEHGGGKPIQGSN

SEQ ID NO: 27098 - protein, 15 aa, BK virus
VHEHGGGKPIQGSNF

SEQ ID NO: 27099 - protein, 15 aa, BK virus
HEHGGGKPIQGSNFH

SEQ ID NO: 27100 - protein, 15 aa, BK virus
EHGGGKPIQGSNFHF

SEQ ID NO: 27101 - protein, 15 aa, BK virus
HGGGKPIQGSNFHFF

SEQ ID NO: 27102 - protein, 15 aa, BK virus
GGGKPIQGSNFHFFA

SEQ ID NO: 27103 - protein, 15 aa, BK virus
GGKPIQGSNFHFFAV

SEQ ID NO: 27104 - protein, 15 aa, BK virus
GKPIQGSNFHFFAVG

SEQ ID NO: 27105 - protein, 15 aa, BK virus
KPIQGSNFHFFAVGG

SEQ ID NO: 27106 - protein, 15 aa, BK virus
PIQGSNFHFFAVGGE

SEQ ID NO: 27107 - protein, 15 aa, BK virus
IQGSNFHFFAVGGEP

SEQ ID NO: 27108 - protein, 15 aa, BK virus
QGSNFHFFAVGGEPL

SEQ ID NO: 27109 - protein, 15 aa, BK virus
GSNFHFFAVGGEPLE

SEQ ID NO: 27110 - protein, 15 aa, BK virus
SNFHFFAVGGEPLEM

SEQ ID NO: 27111 - protein, 15 aa, BK virus
NFHFFAVGGEPLEMQ

SEQ ID NO: 27112 - protein, 15 aa, BK virus
FHFFAVGGEPLEMQG

SEQ ID NO: 27113 - protein, 15 aa, BK virus
HFFAVGGEPLEMQGV

SEQ ID NO: 27114 - protein, 15 aa, BK virus
FFAVGGEPLEMQGVL

SEQ ID NO: 27115 - protein, 15 aa, BK virus
FAVGGEPLEMQGVLM

SEQ ID NO: 27116 - protein, 15 aa, BK virus
AVGGEPLEMQGVLMN

SEQ ID NO: 27117 - protein, 15 aa, BK virus
VGGEPLEMQGVLMNY

SEQ ID NO: 27118 - protein, 15 aa, BK virus
GGEPLEMQGVLMNYR

SEQ ID NO: 27119 - protein, 15 aa, BK virus
GEPLEMQGVLMNYRS

SEQ ID NO: 27120 - protein, 15 aa, BK virus
EPLEMQGVLMNYRSK

SEQ ID NO: 27121 - protein, 15 aa, BK virus
PLEMQGVLMNYRSKY

SEQ ID NO: 27122 - protein, 15 aa, BK virus
LEMQGVLMNYRSKYP

SEQ ID NO: 27123 - protein, 15 aa, BK virus
EMQGVLMNYRSKYPD

SEQ ID NO: 27124 - protein, 15 aa, BK virus
MQGVLMNYRSKYPDG

SEQ ID NO: 27125 - protein, 15 aa, BK virus
QGVLMNYRSKYPDGT

SEQ ID NO: 27126 - protein, 15 aa, BK virus
GVLMNYRSKYPDGTI

SEQ ID NO: 27127 - protein, 15 aa, BK virus
VLMNYRSKYPDGTIT

SEQ ID NO: 27128 - protein, 15 aa, BK virus
LMNYRSKYPDGTITP

SEQ ID NO: 27129 - protein, 15 aa, BK virus
MNYRSKYPDGTITPK

SEQ ID NO: 27130 - protein, 15 aa, BK virus
NYRSKYPDGTITPKN

SEQ ID NO: 27131 - protein, 15 aa, BK virus
YRSKYPDGTITPKNP

SEQ ID NO: 27132 - protein, 15 aa, BK virus
RSKYPDGTITPKNPT

SEQ ID NO: 27133 - protein, 15 aa, BK virus
SKYPDGTITPKNPTA

SEQ ID NO: 27134 - protein, 15 aa, BK virus
KYPDGTITPKNPTAQ

SEQ ID NO: 27135 - protein, 15 aa, BK virus
YPDGTITPKNPTAQS

SEQ ID NO: 27136 - protein, 15 aa, BK virus
PDGTITPKNPTAQSQ

SEQ ID NO: 27137 - protein, 15 aa, BK virus
DGTITPKNPTAQSQV

SEQ ID NO: 27138 - protein, 15 aa, BK virus
GTITPKNPTAQSQVM

SEQ ID NO: 27139 - protein, 15 aa, BK virus
TITPKNPTAQSQVMN

SEQ ID NO: 27140 - protein, 15 aa, BK virus
ITPKNPTAQSQVMNT

SEQ ID NO: 27141 - protein, 15 aa, BK virus
TPKNPTAQSQVMNTD

SEQ ID NO: 27142 - protein, 15 aa, BK virus
PKNPTAQSQVMNTDH

SEQ ID NO: 27143 - protein, 15 aa, BK virus
KNPTAQSQVMNTDHK

SEQ ID NO: 27144 - protein, 15 aa, BK virus
NPTAQSQVMNTDHKA

SEQ ID NO: 27145 - protein, 15 aa, BK virus
PTAQSQVMNTDHKAY

SEQ ID NO: 27146 - protein, 15 aa, BK virus
TAQSQVMNTDHKAYL

SEQ ID NO: 27147 - protein, 15 aa, BK virus
AQSQVMNTDHKAYLD

SEQ ID NO: 27148 - protein, 15 aa, BK virus
QSQVMNTDHKAYLDK

SEQ ID NO: 27149 - protein, 15 aa, BK virus
SQVMNTDHKAYLDKN

SEQ ID NO: 27150 - protein, 15 aa, BK virus
QVMNTDHKAYLDKNN

SEQ ID NO: 27151 - protein, 15 aa, BK virus
VMNTDHKAYLDKNNA

SEQ ID NO: 27152 - protein, 15 aa, BK virus
MNTDHKAYLDKNNAY

SEQ ID NO: 27153 - protein, 15 aa, BK virus
NTDHKAYLDKNNAYP

SEQ ID NO: 27154 - protein, 15 aa, BK virus
TDHKAYLDKNNAYPV

SEQ ID NO: 27155 - protein, 15 aa, BK virus
DHKAYLDKNNAYPVE

SEQ ID NO: 27156 - protein, 15 aa, BK virus
HKAYLDKNNAYPVEC

SEQ ID NO: 27157 - protein, 15 aa, BK virus
KAYLDKNNAYPVECW

SEQ ID NO: 27158 - protein, 15 aa, BK virus
AYLDKNNAYPVECWV

SEQ ID NO: 27159 - protein, 15 aa, BK virus
YLDKNNAYPVECWVP

SEQ ID NO: 27160 - protein, 15 aa, BK virus
LDKNNAYPVECWVPD

SEQ ID NO: 27161 - protein, 15 aa, BK virus
DKNNAYPVECWVPDP

SEQ ID NO: 27162 - protein, 15 aa, BK virus
KNNAYPVECWVPDPS

SEQ ID NO: 27163 - protein, 15 aa, BK virus
NNAYPVECWVPDPSR

SEQ ID NO: 27164 - protein, 15 aa, BK virus
NAYPVECWVPDPSRN

SEQ ID NO: 27165 - protein, 15 aa, BK virus
AYPVECWVPDPSRNE

SEQ ID NO: 27166 - protein, 15 aa, BK virus
YPVECWVPDPSRNEN

SEQ ID NO: 27167 - protein, 15 aa, BK virus
PVECWVPDPSRNENA

SEQ ID NO: 27168 - protein, 15 aa, BK virus
VECWVPDPSRNENAR

SEQ ID NO: 27169 - protein, 15 aa, BK virus
ECWVPDPSRNENARY

SEQ ID NO: 27170 - protein, 15 aa, BK virus
CWVPDPSRNENARYF

SEQ ID NO: 27171 - protein, 15 aa, BK virus
WVPDPSRNENARYFG

SEQ ID NO: 27172 - protein, 15 aa, BK virus
VPDPSRNENARYFGT

SEQ ID NO: 27173 - protein, 15 aa, BK virus
PDPSRNENARYFGTF

SEQ ID NO: 27174 - protein, 15 aa, BK virus
DPSRNENARYFGTFT

SEQ ID NO: 27175 - protein, 15 aa, BK virus
PSRNENARYFGTFTG

SEQ ID NO: 27176 - protein, 15 aa, BK virus
SRNENARYFGTFTGG

SEQ ID NO: 27177 - protein, 15 aa, BK virus
RNENARYFGTFTGGE

SEQ ID NO: 27178 - protein, 15 aa, BK virus
NENARYFGTFTGGEN

SEQ ID NO: 27179 - protein, 15 aa, BK virus
ENARYFGTFTGGENV

SEQ ID NO: 27180 - protein, 15 aa, BK virus
NARYFGTFTGGENVP

SEQ ID NO: 27181 - protein, 15 aa, BK virus
ARYFGTFTGGENVPP

SEQ ID NO: 27182 - protein, 15 aa, BK virus
RYFGTFTGGENVPPV

SEQ ID NO: 27183 - protein, 15 aa, BK virus
YFGTFTGGENVPPVL

SEQ ID NO: 27184 - protein, 15 aa, BK virus
FGTFTGGENVPPVLH

SEQ ID NO: 27185 - protein, 15 aa, BK virus
GTFTGGENVPPVLHV

SEQ ID NO: 27186 - protein, 15 aa, BK virus
TFTGGENVPPVLHVT

SEQ ID NO: 27187 - protein, 15 aa, BK virus
FTGGENVPPVLHVTN

SEQ ID NO: 27188 - protein, 15 aa, BK virus
TGGENVPPVLHVTNT

SEQ ID NO: 27189 - protein, 15 aa, BK virus
GGENVPPVLHVTNTA

SEQ ID NO: 27190 - protein, 15 aa, BK virus
GENVPPVLHVTNTAT

SEQ ID NO: 27191 - protein, 15 aa, BK virus
ENVPPVLHVTNTATT

SEQ ID NO: 27192 - protein, 15 aa, BK virus
NVPPVLHVTNTATTV

SEQ ID NO: 27193 - protein, 15 aa, BK virus
VPPVLHVTNTATTVL

SEQ ID NO: 27194 - protein, 15 aa, BK virus
PPVLHVTNTATTVLL

SEQ ID NO: 27195 - protein, 15 aa, BK virus
PVLHVTNTATTVLLD

SEQ ID NO: 27196 - protein, 15 aa, BK virus
VLHVTNTATTVLLDE

SEQ ID NO: 27197 - protein, 15 aa, BK virus
LHVTNTATTVLLDEQ

SEQ ID NO: 27198 - protein, 15 aa, BK virus
HVTNTATTVLLDEQG

SEQ ID NO: 27199 - protein, 15 aa, BK virus
VTNTATTVLLDEQGV

SEQ ID NO: 27200 - protein, 15 aa, BK virus
TNTATTVLLDEQGVG

SEQ ID NO: 27201 - protein, 15 aa, BK virus
NTATTVLLDEQGVGP

SEQ ID NO: 27202 - protein, 15 aa, BK virus
TATTVLLDEQGVGPL

SEQ ID NO: 27203 - protein, 15 aa, BK virus
ATTVLLDEQGVGPLC

SEQ ID NO: 27204 - protein, 15 aa, BK virus
TTVLLDEQGVGPLCK

SEQ ID NO: 27205 - protein, 15 aa, BK virus
TVLLDEQGVGPLCKA

SEQ ID NO: 27206 - protein, 15 aa, BK virus
VLLDEQGVGPLCKAD

SEQ ID NO: 27207 - protein, 15 aa, BK virus
LLDEQGVGPLCKADS

SEQ ID NO: 27208 - protein, 15 aa, BK virus
LDEQGVGPLCKADSL

SEQ ID NO: 27209 - protein, 15 aa, BK virus
DEQGVGPLCKADSLY

SEQ ID NO: 27210 - protein, 15 aa, BK virus
EQGVGPLCKADSLYV

SEQ ID NO: 27211 - protein, 15 aa, BK virus
QGVGPLCKADSLYVS

SEQ ID NO: 27212 - protein, 15 aa, BK virus
GVGPLCKADSLYVSA

SEQ ID NO: 27213 - protein, 15 aa, BK virus
VGPLCKADSLYVSAA

SEQ ID NO: 27214 - protein, 15 aa, BK virus
GPLCKADSLYVSAAD

SEQ ID NO: 27215 - protein, 15 aa, BK virus
PLCKADSLYVSAADI

SEQ ID NO: 27216 - protein, 15 aa, BK virus
LCKADSLYVSAADIC

SEQ ID NO: 27217 - protein, 15 aa, BK virus
CKADSLYVSAADICG

SEQ ID NO: 27218 - protein, 15 aa, BK virus
KADSLYVSAADICGL

SEQ ID NO: 27219 - protein, 15 aa, BK virus
ADSLYVSAADICGLF

SEQ ID NO: 27220 - protein, 15 aa, BK virus
DSLYVSAADICGLFT

SEQ ID NO: 27221 - protein, 15 aa, BK virus
SLYVSAADICGLFTN

SEQ ID NO: 27222 - protein, 15 aa, BK virus
LYVSAADICGLFTNS

SEQ ID NO: 27223 - protein, 15 aa, BK virus
YVSAADICGLFTNSS

SEQ ID NO: 27224 - protein, 15 aa, BK virus
VSAADICGLFTNSSG

SEQ ID NO: 27225 - protein, 15 aa, BK virus
SAADICGLFTNSSGT

SEQ ID NO: 27226 - protein, 15 aa, BK virus
AADICGLFTNSSGTQ

SEQ ID NO: 27227 - protein, 15 aa, BK virus
ADICGLFTNSSGTQQ

SEQ ID NO: 27228 - protein, 15 aa, BK virus
DICGLFTNSSGTQQW

SEQ ID NO: 27229 - protein, 15 aa, BK virus
ICGLFTNSSGTQQWR

SEQ ID NO: 27230 - protein, 15 aa, BK virus
CGLFTNSSGTQQWRG

SEQ ID NO: 27231 - protein, 15 aa, BK virus
GLFTNSSGTQQWRGL

SEQ ID NO: 27232 - protein, 15 aa, BK virus
LFTNSSGTQQWRGLA

SEQ ID NO: 27233 - protein, 15 aa, BK virus
FTNSSGTQQWRGLAR

SEQ ID NO: 27234 - protein, 15 aa, BK virus
TNSSGTQQWRGLARY

SEQ ID NO: 27235 - protein, 15 aa, BK virus
NSSGTQQWRGLARYF

SEQ ID NO: 27236 - protein, 15 aa, BK virus
SSGTQQWRGLARYFK

SEQ ID NO: 27237 - protein, 15 aa, BK virus
SGTQQWRGLARYFKI

SEQ ID NO: 27238 - protein, 15 aa, BK virus
GTQQWRGLARYFKIR

SEQ ID NO: 27239 - protein, 15 aa, BK virus
TQQWRGLARYFKIRL

SEQ ID NO: 27240 - protein, 15 aa, BK virus
QQWRGLARYFKIRLR

SEQ ID NO: 27241 - protein, 15 aa, BK virus
QWRGLARYFKIRLRK

SEQ ID NO: 27242 - protein, 15 aa, BK virus
WRGLARYFKIRLRKR

SEQ ID NO: 27243 - protein, 15 aa, BK virus
RGLARYFKIRLRKRS

SEQ ID NO: 27244 - protein, 15 aa, BK virus
GLARYFKIRLRKRSV

SEQ ID NO: 27245 - protein, 15 aa, BK virus
LARYFKIRLRKRSVK

SEQ ID NO: 27246 - protein, 15 aa, BK virus
ARYFKIRLRKRSVKN

SEQ ID NO: 27247 - protein, 15 aa, BK virus
RYFKIRLRKRSVKNP

SEQ ID NO: 27248 - protein, 15 aa, BK virus
YFKIRLRKRSVKNPY

SEQ ID NO: 27249 - protein, 15 aa, BK virus
FKIRLRKRSVKNPYP

SEQ ID NO: 27250 - protein, 15 aa, BK virus
KIRLRKRSVKNPYPI

SEQ ID NO: 27251 - protein, 15 aa, BK virus
IRLRKRSVKNPYPIS

SEQ ID NO: 27252 - protein, 15 aa, BK virus
RLRKRSVKNPYPISF

SEQ ID NO: 27253 - protein, 15 aa, BK virus
LRKRSVKNPYPISFL

SEQ ID NO: 27254 - protein, 15 aa, BK virus
RKRSVKNPYPISFLL

SEQ ID NO: 27255 - protein, 15 aa, BK virus
KRSVKNPYPISFLLS

SEQ ID NO: 27256 - protein, 15 aa, BK virus
RSVKNPYPISFLLSD

SEQ ID NO: 27257 - protein, 15 aa, BK virus
SVKNPYPISFLLSDL

SEQ ID NO: 27258 - protein, 15 aa, BK virus
VKNPYPISFLLSDLI

SEQ ID NO: 27259 - protein, 15 aa, BK virus
KNPYPISFLLSDLIN

SEQ ID NO: 27260 - protein, 15 aa, BK virus
NPYPISFLLSDLINR

SEQ ID NO: 27261 - protein, 15 aa, BK virus
PYPISFLLSDLINRR

SEQ ID NO: 27262 - protein, 15 aa, BK virus
YPISFLLSDLINRRT

SEQ ID NO: 27263 - protein, 15 aa, BK virus
PISFLLSDLINRRTQ

SEQ ID NO: 27264 - protein, 15 aa, BK virus
ISFLLSDLINRRTQR

SEQ ID NO: 27265 - protein, 15 aa, BK virus
SFLLSDLINRRTQRV

SEQ ID NO: 27266 - protein, 15 aa, BK virus
FLLSDLINRRTQRVD

SEQ ID NO: 27267 - protein, 15 aa, BK virus
LLSDLINRRTQRVDG

SEQ ID NO: 27268 - protein, 15 aa, BK virus
LSDLINRRTQRVDGQ

SEQ ID NO: 27269 - protein, 15 aa, BK virus
SDLINRRTQRVDGQP

SEQ ID NO: 27270 - protein, 15 aa, BK virus
DLINRRTQRVDGQPM

SEQ ID NO: 27271 - protein, 15 aa, BK virus
LINRRTQRVDGQPMY

SEQ ID NO: 27272 - protein, 15 aa, BK virus
INRRTQRVDGQPMYG

SEQ ID NO: 27273 - protein, 15 aa, BK virus
NRRTQRVDGQPMYGM

SEQ ID NO: 27274 - protein, 15 aa, BK virus
RRTQRVDGQPMYGME

SEQ ID NO: 27275 - protein, 15 aa, BK virus
RTQRVDGQPMYGMES

SEQ ID NO: 27276 - protein, 15 aa, BK virus
TQRVDGQPMYGMESQ

SEQ ID NO: 27277 - protein, 15 aa, BK virus
QRVDGQPMYGMESQV

SEQ ID NO: 27278 - protein, 15 aa, BK virus
RVDGQPMYGMESQVE

SEQ ID NO: 27279 - protein, 15 aa, BK virus
VDGQPMYGMESQVEE

SEQ ID NO: 27280 - protein, 15 aa, BK virus
DGQPMYGMESQVEEV

SEQ ID NO: 27281 - protein, 15 aa, BK virus
GQPMYGMESQVEEVR

SEQ ID NO: 27282 - protein, 15 aa, BK virus
QPMYGMESQVEEVRV

SEQ ID NO: 27283 - protein, 15 aa, BK virus
PMYGMESQVEEVRVF

SEQ ID NO: 27284 - protein, 15 aa, BK virus
MYGMESQVEEVRVFD

SEQ ID NO: 27285 - protein, 15 aa, BK virus
YGMESQVEEVRVFDG

SEQ ID NO: 27286 - protein, 15 aa, BK virus
GMESQVEEVRVFDGT

SEQ ID NO: 27287 - protein, 15 aa, BK virus
MESQVEEVRVFDGTE

SEQ ID NO: 27288 - protein, 15 aa, BK virus
ESQVEEVRVFDGTER

SEQ ID NO: 27289 - protein, 15 aa, BK virus
SQVEEVRVFDGTERL

SEQ ID NO: 27290 - protein, 15 aa, BK virus
QVEEVRVFDGTERLP

SEQ ID NO: 27291 - protein, 15 aa, BK virus
VEEVRVFDGTERLPG

SEQ ID NO: 27292 - protein, 15 aa, BK virus
EEVRVFDGTERLPGD

SEQ ID NO: 27293 - protein, 15 aa, BK virus
EVRVFDGTERLPGDP

SEQ ID NO: 27294 - protein, 15 aa, BK virus
VRVFDGTERLPGDPD

SEQ ID NO: 27295 - protein, 15 aa, BK virus
RVFDGTERLPGDPDM

SEQ ID NO: 27296 - protein, 15 aa, BK virus
VFDGTERLPGDPDMI

SEQ ID NO: 27297 - protein, 15 aa, BK virus
FDGTERLPGDPDMIR

SEQ ID NO: 27298 - protein, 15 aa, BK virus
DGTERLPGDPDMIRY

SEQ ID NO: 27299 - protein, 15 aa, BK virus
GTERLPGDPDMIRYI

SEQ ID NO: 27300 - protein, 15 aa, BK virus
TERLPGDPDMIRYID

SEQ ID NO: 27301 - protein, 15 aa, BK virus
ERLPGDPDMIRYIDK

SEQ ID NO: 27302 - protein, 15 aa, BK virus
RLPGDPDMIRYIDKQ

SEQ ID NO: 27303 - protein, 15 aa, BK virus
LPGDPDMIRYIDKQG

SEQ ID NO: 27304 - protein, 15 aa, BK virus
PGDPDMIRYIDKQGQ

SEQ ID NO: 27305 - protein, 15 aa, BK virus
GDPDMIRYIDKQGQL

SEQ ID NO: 27306 - protein, 15 aa, BK virus
DPDMIRYIDKQGQLQ

SEQ ID NO: 27307 - protein, 15 aa, BK virus
PDMIRYIDKQGQLQT

SEQ ID NO: 27308 - protein, 15 aa, BK virus
DMIRYIDKQGQLQTK

SEQ ID NO: 27309 - protein, 15 aa, BK virus
MIRYIDKQGQLQTKM

SEQ ID NO: 27310 - protein, 15 aa, BK virus
IRYIDKQGQLQTKML

SEQ ID NO: 27311 - protein, 15 aa, BK virus
TGAFIVHIHLINAAF

SEQ ID NO: 27312 - protein, 15 aa, BK virus
GAFIVHIHLINAAFV

SEQ ID NO: 27313 - protein, 15 aa, BK virus
ATFKLVLFWGWCFRP

SEQ ID NO: 27314 - protein, 15 aa, BK virus
TFKLVLFWGWCFRPF

SEQ ID NO: 27315 - protein, 15 aa, BK virus
FKLVLFWGWCFRPFK

SEQ ID NO: 27316 - protein, 15 aa, BK virus
KLVLFWGWCFRPFKT

SEQ ID NO: 27317 - protein, 15 aa, BK virus
LVLFWGWCFRPFKTL

SEQ ID NO: 27318 - protein, 15 aa, BK virus
VLFWGWCFRPFKTLK

SEQ ID NO: 27319 - protein, 15 aa, BK virus
LFWGWCFRPFKTLKA

SEQ ID NO: 27320 - protein, 15 aa, BK virus
FWGWCFRPFKTLKAF

SEQ ID NO: 27321 - protein, 15 aa, BK virus
WGWCFRPFKTLKAFT

SEQ ID NO: 27322 - protein, 15 aa, BK virus
GWCFRPFKTLKAFTQ

SEQ ID NO: 27323 - protein, 15 aa, BK virus
WCFRPFKTLKAFTQM

SEQ ID NO: 27324 - protein, 15 aa, BK virus
CFRPFKTLKAFTQMQ

SEQ ID NO: 27325 - protein, 15 aa, BK virus
FRPFKTLKAFTQMQL

SEQ ID NO: 27326 - protein, 15 aa, BK virus
RPFKTLKAFTQMQLL

SEQ ID NO: 27327 - protein, 15 aa, BK virus
PFKTLKAFTQMQLLT

SEQ ID NO: 27328 - protein, 15 aa, BK virus
FKTLKAFTQMQLLTM

SEQ ID NO: 27329 - protein, 15 aa, BK virus
KTLKAFTQMQLLTMG

SEQ ID NO: 27330 - protein, 15 aa, BK virus
TLKAFTQMQLLTMGV

SEQ ID NO: 27331 - protein, 15 aa, BK virus
ILFSCNIKNTFPHAY

SEQ ID NO: 27332 - protein, 15 aa, BK virus
LFSCNIKNTFPHAYI

SEQ ID NO: 27333 - protein, 15 aa, BK virus
FSCNIKNTFPHAYII

SEQ ID NO: 27334 - protein, 15 aa, BK virus
SCNIKNTFPHAYIIF

SEQ ID NO: 27335 - protein, 15 aa, BK virus
CNIKNTFPHAYIIFH

SEQ ID NO: 27336 - protein, 15 aa, BK virus
NIKNTFPHAYIIFHP

SEQ ID NO: 27337 - protein, 15 aa, BK virus
KSIHTYLRIQPFLPF

SEQ ID NO: 27338 - protein, 15 aa, BK virus
SIHTYLRIQPFLPFN

SEQ ID NO: 27339 - protein, 15 aa, BK virus
IHTYLRIQPFLPFNN

SEQ ID NO: 27340 - protein, 15 aa, BK virus
HTYLRIQPFLPFNNS

SEQ ID NO: 27341 - protein, 15 aa, BK virus
TYLRIQPFLPFNNSR

SEQ ID NO: 27342 - protein, 15 aa, BK virus
YLRIQPFLPFNNSRL

SEQ ID NO: 27343 - protein, 15 aa, BK virus
LRIQPFLPFNNSRLY

SEQ ID NO: 27344 - protein, 15 aa, BK virus
RIQPFLPFNNSRLYI

SEQ ID NO: 27345 - protein, 15 aa, BK virus
IQPFLPFNNSRLYIS

SEQ ID NO: 27346 - protein, 15 aa, BK virus
QPFLPFNNSRLYISC

SEQ ID NO: 27347 - protein, 15 aa, BK virus
PFLPFNNSRLYISCK

SEQ ID NO: 27348 - protein, 15 aa, BK virus
FLPFNNSRLYISCKI

SEQ ID NO: 27349 - protein, 15 aa, BK virus
LPFNNSRLYISCKIS

SEQ ID NO: 27350 - protein, 15 aa, BK virus
PFNNSRLYISCKISY

SEQ ID NO: 27351 - protein, 15 aa, BK virus
FNNSRLYISCKISYR

SEQ ID NO: 27352 - protein, 15 aa, BK virus
NNSRLYISCKISYRP

SEQ ID NO: 27353 - protein, 15 aa, BK virus
NSRLYISCKISYRPK

SEQ ID NO: 27354 - protein, 15 aa, BK virus
SRLYISCKISYRPKP

SEQ ID NO: 27355 - protein, 15 aa, BK virus
RLYISCKISYRPKPN

SEQ ID NO: 27356 - protein, 15 aa, BK virus
IYFGPKIYLSYKSSL

SEQ ID NO: 27357 - protein, 15 aa, BK virus
YFGPKIYLSYKSSLQ

SEQ ID NO: 27358 - protein, 15 aa, BK virus
FGPKIYLSYKSSLQG

SEQ ID NO: 27359 - protein, 15 aa, BK virus
GPKIYLSYKSSLQGF

SEQ ID NO: 27360 - protein, 15 aa, BK virus
PKIYLSYKSSLQGFR

SEQ ID NO: 27361 - protein, 15 aa, BK virus
KIYLSYKSSLQGFRD

SEQ ID NO: 27362 - protein, 15 aa, BK virus
IYLSYKSSLQGFRDR

SEQ ID NO: 27363 - protein, 15 aa, BK virus
YLSYKSSLQGFRDRI

SEQ ID NO: 27364 - protein, 15 aa, BK virus
LSYKSSLQGFRDRIL

SEQ ID NO: 27365 - protein, 15 aa, BK virus
SYKSSLQGFRDRILI

SEQ ID NO: 27366 - protein, 15 aa, BK virus
YKSSLQGFRDRILIH

SEQ ID NO: 27367 - protein, 15 aa, BK virus
KSSLQGFRDRILIHC

SEQ ID NO: 27368 - protein, 15 aa, BK virus
SSLQGFRDRILIHCN

SEQ ID NO: 27369 - protein, 15 aa, BK virus
SLQGFRDRILIHCNQ

SEQ ID NO: 27370 - protein, 15 aa, BK virus
LQGFRDRILIHCNQA

SEQ ID NO: 27371 - protein, 15 aa, BK virus
QGFRDRILIHCNQAW

SEQ ID NO: 27372 - protein, 15 aa, BK virus
GFRDRILIHCNQAWW

SEQ ID NO: 27373 - protein, 15 aa, BK virus
FRDRILIHCNQAWWK

SEQ ID NO: 27374 - protein, 15 aa, BK virus
RDRILIHCNQAWWKY

SEQ ID NO: 27375 - protein, 15 aa, BK virus
DRILIHCNQAWWKYL

SEQ ID NO: 27376 - protein, 15 aa, BK virus
RILIHCNQAWWKYLG

SEQ ID NO: 27377 - protein, 15 aa, BK virus
ILIHCNQAWWKYLGS

SEQ ID NO: 27378 - protein, 15 aa, BK virus
LIHCNQAWWKYLGSF

SEQ ID NO: 27379 - protein, 15 aa, BK virus
IHCNQAWWKYLGSFV

SEQ ID NO: 27380 - protein, 15 aa, BK virus
FSSCPFYIFKNNHVL

SEQ ID NO: 27381 - protein, 15 aa, BK virus
SSCPFYIFKNNHVLI

SEQ ID NO: 27382 - protein, 15 aa, BK virus
SCPFYIFKNNHVLIY

SEQ ID NO: 27383 - protein, 15 aa, BK virus
CPFYIFKNNHVLIYS

SEQ ID NO: 27384 - protein, 15 aa, BK virus
PFYIFKNNHVLIYSY

SEQ ID NO: 27385 - protein, 15 aa, BK virus
FYIFKNNHVLIYSYT

SEQ ID NO: 27386 - protein, 15 aa, BK virus
PVSSFRYIENNTVQK

SEQ ID NO: 27387 - protein, 15 aa, BK virus
VSSFRYIENNTVQKI

SEQ ID NO: 27388 - protein, 15 aa, BK virus
SSFRYIENNTVQKIK

SEQ ID NO: 27389 - protein, 15 aa, BK virus
SFRYIENNTVQKIKY

SEQ ID NO: 27390 - protein, 15 aa, BK virus
FRYIENNTVQKIKYY

SEQ ID NO: 27391 - protein, 15 aa, BK virus
RYIENNTVQKIKYYR

SEQ ID NO: 27392 - protein, 15 aa, BK virus
YIENNTVQKIKYYRI

SEQ ID NO: 27393 - protein, 15 aa, BK virus
IENNTVQKIKYYRIH

SEQ ID NO: 27394 - protein, 15 aa, BK virus
ENNTVQKIKYYRIHF

SEQ ID NO: 27395 - protein, 15 aa, BK virus
NNTVQKIKYYRIHFR

SEQ ID NO: 27396 - protein, 15 aa, BK virus
HFFPGHMKGIYSFFS

SEQ ID NO: 27397 - protein, 15 aa, BK virus
NCIYCLLTNTFLIFT

SEQ ID NO: 27398 - protein, 15 aa, BK virus
CIYCLLTNTFLIFTF

SEQ ID NO: 27399 - protein, 15 aa, BK virus
IYCLLTNTFLIFTFC

SEQ ID NO: 27400 - protein, 15 aa, BK virus
YCLLTNTFLIFTFCK

SEQ ID NO: 27401 - protein, 15 aa, BK virus
CLLTNTFLIFTFCKN

SEQ ID NO: 27402 - protein, 15 aa, BK virus
LLTNTFLIFTFCKNN

SEQ ID NO: 27403 - protein, 15 aa, BK virus
LTNTFLIFTFCKNNS

SEQ ID NO: 27404 - protein, 15 aa, BK virus
TNTFLIFTFCKNNSI

SEQ ID NO: 27405 - protein, 15 aa, BK virus
NTFLIFTFCKNNSIC

SEQ ID NO: 27406 - protein, 15 aa, BK virus
TFLIFTFCKNNSICK

SEQ ID NO: 27407 - protein, 15 aa, BK virus
FLIFTFCKNNSICKV

SEQ ID NO: 27408 - protein, 15 aa, BK virus
LIFTFCKNNSICKVL

SEQ ID NO: 27409 - protein, 15 aa, BK virus
IFTFCKNNSICKVLF

SEQ ID NO: 27410 - protein, 15 aa, BK virus
FTFCKNNSICKVLFM

SEQ ID NO: 27411 - protein, 15 aa, BK virus
TFCKNNSICKVLFMI

SEQ ID NO: 27412 - protein, 15 aa, BK virus
FCKNNSICKVLFMIL

SEQ ID NO: 27413 - protein, 15 aa, BK virus
CKNNSICKVLFMILK

SEQ ID NO: 27414 - protein, 15 aa, BK virus
KNNSICKVLFMILKV

SEQ ID NO: 27415 - protein, 15 aa, BK virus
NNSICKVLFMILKVI

SEQ ID NO: 27416 - protein, 15 aa, BK virus
NSICKVLFMILKVIR

SEQ ID NO: 27417 - protein, 15 aa, BK virus
SICKVLFMILKVIRL

SEQ ID NO: 27418 - protein, 15 aa, BK virus
ICKVLFMILKVIRLV

SEQ ID NO: 27419 - protein, 15 aa, BK virus
CKVLFMILKVIRLVF

SEQ ID NO: 27420 - protein, 15 aa, BK virus
KVLFMILKVIRLVFF

SEQ ID NO: 27421 - protein, 15 aa, BK virus
VLFMILKVIRLVFFL

SEQ ID NO: 27422 - protein, 15 aa, BK virus
LFMILKVIRLVFFLT

SEQ ID NO: 27423 - protein, 15 aa, BK virus
FMILKVIRLVFFLTL

SEQ ID NO: 27424 - protein, 15 aa, BK virus
MILKVIRLVFFLTLF

SEQ ID NO: 27425 - protein, 15 aa, BK virus
ILKVIRLVFFLTLFT

SEQ ID NO: 27426 - protein, 15 aa, BK virus
LKVIRLVFFLTLFTL

SEQ ID NO: 27427 - protein, 15 aa, BK virus
KVIRLVFFLTLFTLL

SEQ ID NO: 27428 - protein, 15 aa, BK virus
VIRLVFFLTLFTLLY

SEQ ID NO: 27429 - protein, 15 aa, BK virus
IRLVFFLTLFTLLYI

SEQ ID NO: 27430 - protein, 15 aa, BK virus
RLVFFLTLFTLLYIV

SEQ ID NO: 27431 - protein, 15 aa, BK virus
LVFFLTLFTLLYIVL

SEQ ID NO: 27432 - protein, 15 aa, BK virus
VFFLTLFTLLYIVLK

SEQ ID NO: 27433 - protein, 15 aa, BK virus
FFLTLFTLLYIVLKF

SEQ ID NO: 27434 - protein, 15 aa, BK virus
FPRHLLCFFRLFWAK

SEQ ID NO: 27435 - protein, 15 aa, BK virus
PRHLLCFFRLFWAKI

SEQ ID NO: 27436 - protein, 15 aa, BK virus
RHLLCFFRLFWAKIM

SEQ ID NO: 27437 - protein, 15 aa, BK virus
HLLCFFRLFWAKIML

SEQ ID NO: 27438 - protein, 15 aa, BK virus
LLCFFRLFWAKIMLL

SEQ ID NO: 27439 - protein, 15 aa, BK virus
APLNAFFYSMVWISS

SEQ ID NO: 27440 - protein, 15 aa, BK virus
KTKGTQLLTEIINCR

SEQ ID NO: 27441 - protein, 15 aa, BK virus
TKGTQLLTEIINCRN

SEQ ID NO: 27442 - protein, 15 aa, BK virus
KGTQLLTEIINCRNS

SEQ ID NO: 27443 - protein, 15 aa, BK virus
GTQLLTEIINCRNSM

SEQ ID NO: 27444 - protein, 15 aa, BK virus
TQLLTEIINCRNSMS

SEQ ID NO: 27445 - protein, 15 aa, BK virus
QLLTEIINCRNSMSM

SEQ ID NO: 27446 - protein, 15 aa, BK virus
LLTEIINCRNSMSMW

SEQ ID NO: 27447 - protein, 15 aa, BK virus
LTEIINCRNSMSMWS

SEQ ID NO: 27448 - protein, 15 aa, BK virus
KEYNIMPSTHVSTNK

SEQ ID NO: 27449 - protein, 15 aa, BK virus
EYNIMPSTHVSTNKS

SEQ ID NO: 27450 - protein, 15 aa, BK virus
YNIMPSTHVSTNKSY

SEQ ID NO: 27451 - protein, 15 aa, BK virus
NIMPSTHVSTNKSYR

SEQ ID NO: 27452 - protein, 15 aa, BK virus
IMPSTHVSTNKSYRI

SEQ ID NO: 27453 - protein, 15 aa, BK virus
MPSTHVSTNKSYRIF

SEQ ID NO: 27454 - protein, 15 aa, BK virus
PSTHVSTNKSYRIFF

SEQ ID NO: 27455 - protein, 15 aa, BK virus
STHVSTNKSYRIFFH

SEQ ID NO: 27456 - protein, 15 aa, BK virus
THVSTNKSYRIFFHK

SEQ ID NO: 27457 - protein, 15 aa, BK virus
HVSTNKSYRIFFHKF

SEQ ID NO: 27458 - protein, 15 aa, BK virus
VSTNKSYRIFFHKFF

SEQ ID NO: 27459 - protein, 15 aa, BK virus
STNKSYRIFFHKFFI

SEQ ID NO: 27460 - protein, 15 aa, BK virus
TNKSYRIFFHKFFIQ

SEQ ID NO: 27461 - protein, 15 aa, BK virus
NKSYRIFFHKFFIQN

SEQ ID NO: 27462 - protein, 15 aa, BK virus
KSYRIFFHKFFIQNL

SEQ ID NO: 27463 - protein, 15 aa, BK virus
SYRIFFHKFFIQNLS

SEQ ID NO: 27464 - protein, 15 aa, BK virus
YRIFFHKFFIQNLSF

SEQ ID NO: 27465 - protein, 15 aa, BK virus
RIFFHKFFIQNLSFF

SEQ ID NO: 27466 - protein, 15 aa, BK virus
IFFHKFFIQNLSFFF

SEQ ID NO: 27467 - protein, 15 aa, BK virus
FFHKFFIQNLSFFFS

SEQ ID NO: 27468 - protein, 15 aa, BK virus
FHKFFIQNLSFFFSS

SEQ ID NO: 27469 - protein, 15 aa, BK virus
HKFFIQNLSFFFSSI

SEQ ID NO: 27470 - protein, 15 aa, BK virus
KFFIQNLSFFFSSIH

SEQ ID NO: 27471 - protein, 15 aa, BK virus
FFIQNLSFFFSSIHS

SEQ ID NO: 27472 - protein, 15 aa, BK virus
FIQNLSFFFSSIHSK

SEQ ID NO: 27473 - protein, 15 aa, BK virus
IQNLSFFFSSIHSKA

SEQ ID NO: 27474 - protein, 15 aa, BK virus
QNLSFFFSSIHSKAG

SEQ ID NO: 27475 - protein, 15 aa, BK virus
NLSFFFSSIHSKAGK

SEQ ID NO: 27476 - protein, 15 aa, BK virus
LSFFFSSIHSKAGKG

SEQ ID NO: 27477 - protein, 15 aa, BK virus
SFFFSSIHSKAGKGS

SEQ ID NO: 27478 - protein, 15 aa, BK virus
FFFSSIHSKAGKGSI

SEQ ID NO: 27479 - protein, 15 aa, BK virus
FFSSIHSKAGKGSIT

SEQ ID NO: 27480 - protein, 15 aa, BK virus
FSSIHSKAGKGSITK

SEQ ID NO: 27481 - protein, 15 aa, BK virus
SSIHSKAGKGSITKY

SEQ ID NO: 27482 - protein, 15 aa, BK virus
SIHSKAGKGSITKYS

SEQ ID NO: 27483 - protein, 15 aa, BK virus
IHSKAGKGSITKYSL

SEQ ID NO: 27484 - protein, 15 aa, BK virus
HSKAGKGSITKYSLT

SEQ ID NO: 27485 - protein, 15 aa, BK virus
SKAGKGSITKYSLTK

SEQ ID NO: 27486 - protein, 15 aa, BK virus
KAGKGSITKYSLTKK

SEQ ID NO: 27487 - protein, 15 aa, BK virus
AGKGSITKYSLTKKL

SEQ ID NO: 27488 - protein, 15 aa, BK virus
GKGSITKYSLTKKLV

SEQ ID NO: 27489 - protein, 15 aa, BK virus
IRGKVFRVFYLSFFF

SEQ ID NO: 27490 - protein, 15 aa, BK virus
RGKVFRVFYLSFFFG

SEQ ID NO: 27491 - protein, 15 aa, BK virus
GKVFRVFYLSFFFGW

SEQ ID NO: 27492 - protein, 15 aa, BK virus
KVFRVFYLSFFFGWC

SEQ ID NO: 27493 - protein, 15 aa, BK virus
VLRICCCFFITGKHI

SEQ ID NO: 27494 - protein, 15 aa, BK virus
LRICCCFFITGKHIF

SEQ ID NO: 27495 - protein, 15 aa, BK virus
RICCCFFITGKHIFM

SEQ ID NO: 27496 - protein, 15 aa, BK virus
ICCCFFITGKHIFMA

SEQ ID NO: 27497 - protein, 15 aa, BK virus
CCCFFITGKHIFMAK

SEQ ID NO: 27498 - protein, 15 aa, BK virus
IFIPFFIKGTPPGLP

SEQ ID NO: 27499 - protein, 15 aa, BK virus
FIPFFIKGTPPGLPL

SEQ ID NO: 27500 - protein, 15 aa, BK virus
IPFFIKGTPPGLPLF

SEQ ID NO: 27501 - protein, 15 aa, BK virus
PFFIKGTPPGLPLFC

SEQ ID NO: 27502 - protein, 15 aa, BK virus
FFIKGTPPGLPLFCS

SEQ ID NO: 27503 - protein, 15 aa, BK virus
FIKGTPPGLPLFCSI

SEQ ID NO: 27504 - protein, 15 aa, BK virus
IKGTPPGLPLFCSIG

SEQ ID NO: 27505 - protein, 15 aa, BK virus
KGTPPGLPLFCSIGW

SEQ ID NO: 27506 - protein, 15 aa, BK virus
GTPPGLPLFCSIGWH

SEQ ID NO: 27507 - protein, 15 aa, BK virus
TPPGLPLFCSIGWHL

SEQ ID NO: 27508 - protein, 15 aa, BK virus
SFRSLKGVSPIIWTH

SEQ ID NO: 27509 - protein, 15 aa, BK virus
FRSLKGVSPIIWTHH

SEQ ID NO: 27510 - protein, 15 aa, BK virus
RSLKGVSPIIWTHHC

SEQ ID NO: 27511 - protein, 15 aa, BK virus
SLKGVSPIIWTHHCR

SEQ ID NO: 27512 - protein, 15 aa, BK virus
LKGVSPIIWTHHCRV

SEQ ID NO: 27513 - protein, 15 aa, BK virus
KGVSPIIWTHHCRVS

SEQ ID NO: 27514 - protein, 15 aa, BK virus
GVSPIIWTHHCRVSS

SEQ ID NO: 27515 - protein, 15 aa, BK virus
VSPIIWTHHCRVSSV

SEQ ID NO: 27516 - protein, 15 aa, BK virus
SPIIWTHHCRVSSVR

SEQ ID NO: 27517 - protein, 15 aa, BK virus
PIIWTHHCRVSSVRS

SEQ ID NO: 27518 - protein, 15 aa, BK virus
IIWTHHCRVSSVRSK

SEQ ID NO: 27519 - protein, 15 aa, BK virus
IWTHHCRVSSVRSKP

SEQ ID NO: 27520 - protein, 15 aa, BK virus
WTHHCRVSSVRSKPN

SEQ ID NO: 27521 - protein, 15 aa, BK virus
THHCRVSSVRSKPNH

SEQ ID NO: 27522 - protein, 15 aa, BK virus
HHCRVSSVRSKPNHC

SEQ ID NO: 27523 - protein, 15 aa, BK virus
HCRVSSVRSKPNHCV

SEQ ID NO: 27524 - protein, 15 aa, BK virus
CRVSSVRSKPNHCVK

SEQ ID NO: 27525 - protein, 15 aa, BK virus
RVSSVRSKPNHCVKQ

SEQ ID NO: 27526 - protein, 15 aa, BK virus
VSSVRSKPNHCVKQS

SEQ ID NO: 27527 - protein, 15 aa, BK virus
SSVRSKPNHCVKQSM

SEQ ID NO: 27528 - protein, 15 aa, BK virus
SVRSKPNHCVKQSMQ

SEQ ID NO: 27529 - protein, 15 aa, BK virus
QSIQTKGSFLKNFLF

SEQ ID NO: 27530 - protein, 15 aa, BK virus
SIQTKGSFLKNFLFK

SEQ ID NO: 27531 - protein, 15 aa, BK virus
IQTKGSFLKNFLFKC

SEQ ID NO: 27532 - protein, 15 aa, BK virus
QTKGSFLKNFLFKCL

SEQ ID NO: 27533 - protein, 15 aa, BK virus
TKGSFLKNFLFKCLN

SEQ ID NO: 27534 - protein, 15 aa, BK virus
KGSFLKNFLFKCLNL

SEQ ID NO: 27535 - protein, 15 aa, BK virus
GSFLKNFLFKCLNLS

SEQ ID NO: 27536 - protein, 15 aa, BK virus
HSMQGQCTEGFLEQI

SEQ ID NO: 27537 - protein, 15 aa, BK virus
SMQGQCTEGFLEQIG

SEQ ID NO: 27538 - protein, 15 aa, BK virus
MQGQCTEGFLEQIGH

SEQ ID NO: 27539 - protein, 15 aa, BK virus
QGQCTEGFLEQIGHS

SEQ ID NO: 27540 - protein, 15 aa, BK virus
GQCTEGFLEQIGHSL

SEQ ID NO: 27541 - protein, 15 aa, BK virus
QCTEGFLEQIGHSLQ

SEQ ID NO: 27542 - protein, 15 aa, BK virus
CTEGFLEQIGHSLQY

SEQ ID NO: 27543 - protein, 15 aa, BK virus
TEGFLEQIGHSLQYR

SEQ ID NO: 27544 - protein, 15 aa, BK virus
EGFLEQIGHSLQYRV

SEQ ID NO: 27545 - protein, 15 aa, BK virus
GFLEQIGHSLQYRVS

SEQ ID NO: 27546 - protein, 15 aa, BK virus
FLEQIGHSLQYRVSG

SEQ ID NO: 27547 - protein, 15 aa, BK virus
LEQIGHSLQYRVSGQ

SEQ ID NO: 27548 - protein, 15 aa, BK virus
EQIGHSLQYRVSGQR

SEQ ID NO: 27549 - protein, 15 aa, BK virus
QIGHSLQYRVSGQRG

SEQ ID NO: 27550 - protein, 15 aa, BK virus
IGHSLQYRVSGQRGK

SEQ ID NO: 27551 - protein, 15 aa, BK virus
GHSLQYRVSGQRGKS

SEQ ID NO: 27552 - protein, 15 aa, BK virus
HSLQYRVSGQRGKSA

SEQ ID NO: 27553 - protein, 15 aa, BK virus
SLQYRVSGQRGKSAQ

SEQ ID NO: 27554 - protein, 15 aa, BK virus
LQYRVSGQRGKSAQT

SEQ ID NO: 27555 - protein, 15 aa, BK virus
QYRVSGQRGKSAQTS

SEQ ID NO: 27556 - protein, 15 aa, BK virus
YRVSGQRGKSAQTSE

SEQ ID NO: 27557 - protein, 15 aa, BK virus
RVSGQRGKSAQTSEL

SEQ ID NO: 27558 - protein, 15 aa, BK virus
VSGQRGKSAQTSELL

SEQ ID NO: 27559 - protein, 15 aa, BK virus
SGQRGKSAQTSELLQ

SEQ ID NO: 27560 - protein, 15 aa, BK virus
GQRGKSAQTSELLQV

SEQ ID NO: 27561 - protein, 15 aa, BK virus
QRGKSAQTSELLQVP

SEQ ID NO: 27562 - protein, 15 aa, BK virus
RGKSAQTSELLQVPK

SEQ ID NO: 27563 - protein, 15 aa, BK virus
GKSAQTSELLQVPKS

SEQ ID NO: 27564 - protein, 15 aa, BK virus
KSAQTSELLQVPKSG

SEQ ID NO: 27565 - protein, 15 aa, BK virus
ATFTSCSIFLYKVFI

SEQ ID NO: 27566 - protein, 15 aa, BK virus
TFTSCSIFLYKVFIL

SEQ ID NO: 27567 - protein, 15 aa, BK virus
FTSCSIFLYKVFILF

SEQ ID NO: 27568 - protein, 15 aa, BK virus
TSCSIFLYKVFILFI

SEQ ID NO: 27569 - protein, 15 aa, BK virus
SCSIFLYKVFILFIL

SEQ ID NO: 27570 - protein, 15 aa, BK virus
CSIFLYKVFILFILS

SEQ ID NO: 27571 - protein, 15 aa, BK virus
SIFLYKVFILFILSS

SEQ ID NO: 27572 - protein, 15 aa, BK virus
IFLYKVFILFILSSS

SEQ ID NO: 27573 - protein, 15 aa, BK virus
FLYKVFILFILSSSP

SEQ ID NO: 27574 - protein, 15 aa, BK virus
LYKVFILFILSSSPP

SEQ ID NO: 27575 - protein, 15 aa, BK virus
YKVFILFILSSSPPL

SEQ ID NO: 27576 - protein, 15 aa, BK virus
KVFILFILSSSPPLS

SEQ ID NO: 27577 - protein, 15 aa, BK virus
VFILFILSSSPPLSG

SEQ ID NO: 27578 - protein, 15 aa, BK virus
AFLIKGRFPQAALSR

SEQ ID NO: 27579 - protein, 15 aa, BK virus
FLIKGRFPQAALSRP

SEQ ID NO: 27580 - protein, 15 aa, BK virus
LIKGRFPQAALSRPK

SEQ ID NO: 27581 - protein, 15 aa, BK virus
IKGRFPQAALSRPKR

SEQ ID NO: 27582 - protein, 15 aa, BK virus
KGRFPQAALSRPKRS

SEQ ID NO: 27583 - protein, 15 aa, BK virus
GRFPQAALSRPKRSM

SEQ ID NO: 27584 - protein, 15 aa, BK virus
RFPQAALSRPKRSMS

SEQ ID NO: 27585 - protein, 15 aa, BK virus
FPQAALSRPKRSMSS

SEQ ID NO: 27586 - protein, 15 aa, BK virus
PQAALSRPKRSMSSM

SEQ ID NO: 27587 - protein, 15 aa, BK virus
QAALSRPKRSMSSMD

SEQ ID NO: 27588 - protein, 15 aa, BK virus
AALSRPKRSMSSMDS

SEQ ID NO: 27589 - protein, 15 aa, BK virus
ALSRPKRSMSSMDSS

SEQ ID NO: 27590 - protein, 15 aa, BK virus
LSRPKRSMSSMDSSL

SEQ ID NO: 27591 - protein, 15 aa, BK virus
SRPKRSMSSMDSSLL

SEQ ID NO: 27592 - protein, 15 aa, BK virus
RPKRSMSSMDSSLLR

SEQ ID NO: 27593 - protein, 15 aa, BK virus
PKRSMSSMDSSLLRT

SEQ ID NO: 27594 - protein, 15 aa, BK virus
KRSMSSMDSSLLRTL

SEQ ID NO: 27595 - protein, 15 aa, BK virus
RSMSSMDSSLLRTLS

SEQ ID NO: 27596 - protein, 16 aa, BK virus
FCKNCKRIGISPNSFA

SEQ ID NO: 27597 - protein, 16 aa, BK virus
CKNCKRIGISPNSFAR

SEQ ID NO: 27598 - protein, 16 aa, BK virus
KNCKRIGISPNSFARP

SEQ ID NO: 27599 - protein, 16 aa, BK virus
NCKRIGISPNSFARPQ

SEQ ID NO: 27600 - protein, 16 aa, BK virus
CKRIGISPNSFARPQK

SEQ ID NO: 27601 - protein, 16 aa, BK virus
KRIGISPNSFARPQKK

SEQ ID NO: 27602 - protein, 16 aa, BK virus
RIGISPNSFARPQKKP

SEQ ID NO: 27603 - protein, 16 aa, BK virus
IGISPNSFARPQKKPP

SEQ ID NO: 27604 - protein, 16 aa, BK virus
GISPNSFARPQKKPPH

SEQ ID NO: 27605 - protein, 16 aa, BK virus
ISPNSFARPQKKPPHP

SEQ ID NO: 27606 - protein, 16 aa, BK virus
SPNSFARPQKKPPHPY

SEQ ID NO: 27607 - protein, 16 aa, BK virus
PNSFARPQKKPPHPYY

SEQ ID NO: 27608 - protein, 16 aa, BK virus
NSFARPQKKPPHPYYL

SEQ ID NO: 27609 - protein, 16 aa, BK virus
SFARPQKKPPHPYYLR

SEQ ID NO: 27610 - protein, 16 aa, BK virus
FARPQKKPPHPYYLRE

SEQ ID NO: 27611 - protein, 16 aa, BK virus
ARPQKKPPHPYYLRER

SEQ ID NO: 27612 - protein, 16 aa, BK virus
RPQKKPPHPYYLRERV

SEQ ID NO: 27613 - protein, 16 aa, BK virus
PQKKPPHPYYLRERVE

SEQ ID NO: 27614 - protein, 16 aa, BK virus
QKKPPHPYYLRERVEA

SEQ ID NO: 27615 - protein, 16 aa, BK virus
KKPPHPYYLRERVEAE

SEQ ID NO: 27616 - protein, 16 aa, BK virus
KPPHPYYLRERVEAEA

SEQ ID NO: 27617 - protein, 16 aa, BK virus
PPHPYYLRERVEAEAA

SEQ ID NO: 27618 - protein, 16 aa, BK virus
PHPYYLRERVEAEAAS

SEQ ID NO: 27619 - protein, 16 aa, BK virus
HPYYLRERVEAEAASA

SEQ ID NO: 27620 - protein, 16 aa, BK virus
PYYLRERVEAEAASAS

SEQ ID NO: 27621 - protein, 16 aa, BK virus
YYLRERVEAEAASASY

SEQ ID NO: 27622 - protein, 16 aa, BK virus
YLRERVEAEAASASYI

SEQ ID NO: 27623 - protein, 16 aa, BK virus
LRERVEAEAASASYIL

SEQ ID NO: 27624 - protein, 16 aa, BK virus
KKRPQGGAAYPWNAAK

SEQ ID NO: 27625 - protein, 16 aa, BK virus
KRPQGGAAYPWNAAKP

SEQ ID NO: 27626 - protein, 16 aa, BK virus
PQEGKCMTHRGMQPNH

SEQ ID NO: 27627 - protein, 16 aa, BK virus
QEGKCMTHRGMQPNHD

SEQ ID NO: 27628 - protein, 16 aa, BK virus
EGKCMTHRGMQPNHDL

SEQ ID NO: 27629 - protein, 16 aa, BK virus
GKCMTHRGMQPNHDLR

SEQ ID NO: 27630 - protein, 16 aa, BK virus
KCMTHRGMQPNHDLRK

SEQ ID NO: 27631 - protein, 16 aa, BK virus
CMTHRGMQPNHDLRKE

SEQ ID NO: 27632 - protein, 16 aa, BK virus
MTHRGMQPNHDLRKES

SEQ ID NO: 27633 - protein, 16 aa, BK virus
THRGMQPNHDLRKESA

SEQ ID NO: 27634 - protein, 16 aa, BK virus
LTGRSCLPMECSQTMT

SEQ ID NO: 27635 - protein, 16 aa, BK virus
TGRSCLPMECSQTMTS

SEQ ID NO: 27636 - protein, 16 aa, BK virus
GRSCLPMECSQTMTSG

SEQ ID NO: 27637 - protein, 16 aa, BK virus
RSCLPMECSQTMTSGR

SEQ ID NO: 27638 - protein, 16 aa, BK virus
SCLPMECSQTMTSGRK

SEQ ID NO: 27639 - protein, 16 aa, BK virus
CLPMECSQTMTSGRKV

SEQ ID NO: 27640 - protein, 16 aa, BK virus
LPMECSQTMTSGRKVH

SEQ ID NO: 27641 - protein, 16 aa, BK virus
PMECSQTMTSGRKVHD

SEQ ID NO: 27642 - protein, 16 aa, BK virus
MECSQTMTSGRKVHDR

SEQ ID NO: 27643 - protein, 16 aa, BK virus
ECSQTMTSGRKVHDRH

SEQ ID NO: 27644 - protein, 16 aa, BK virus
CSQTMTSGRKVHDRHV

SEQ ID NO: 27645 - protein, 16 aa, BK virus
SQTMTSGRKVHDRHVL

SEQ ID NO: 27646 - protein, 16 aa, BK virus
QTMTSGRKVHDRHVLR

SEQ ID NO: 27647 - protein, 16 aa, BK virus
TMTSGRKVHDRHVLRA

SEQ ID NO: 27648 - protein, 16 aa, BK virus
ESWPCPQLNWTKAMVL

SEQ ID NO: 27649 - protein, 16 aa, BK virus
SWPCPQLNWTKAMVLR

SEQ ID NO: 27650 - protein, 16 aa, BK virus
WPCPQLNWTKAMVLRQ

SEQ ID NO: 27651 - protein, 16 aa, BK virus
PCPQLNWTKAMVLRQL

SEQ ID NO: 27652 - protein, 16 aa, BK virus
CPQLNWTKAMVLRQLS

SEQ ID NO: 27653 - protein, 16 aa, BK virus
PQLNWTKAMVLRQLSR

SEQ ID NO: 27654 - protein, 16 aa, BK virus
QLNWTKAMVLRQLSRQ

SEQ ID NO: 27655 - protein, 16 aa, BK virus
LNWTKAMVLRQLSRQA

SEQ ID NO: 27656 - protein, 16 aa, BK virus
NWTKAMVLRQLSRQAS

SEQ ID NO: 27657 - protein, 16 aa, BK virus
WTKAMVLRQLSRQASV

SEQ ID NO: 27658 - protein, 16 aa, BK virus
TKAMVLRQLSRQASVK

SEQ ID NO: 27659 - protein, 16 aa, BK virus
KAMVLRQLSRQASVKV

SEQ ID NO: 27660 - protein, 16 aa, BK virus
AMVLRQLSRQASVKVG

SEQ ID NO: 27661 - protein, 16 aa, BK virus
MVLRQLSRQASVKVGK

SEQ ID NO: 27662 - protein, 16 aa, BK virus
VLRQLSRQASVKVGKT

SEQ ID NO: 27663 - protein, 16 aa, BK virus
LRQLSRQASVKVGKTW

SEQ ID NO: 27664 - protein, 16 aa, BK virus
RQLSRQASVKVGKTWT

SEQ ID NO: 27665 - protein, 16 aa, BK virus
QLSRQASVKVGKTWTG

SEQ ID NO: 27666 - protein, 16 aa, BK virus
LSRQASVKVGKTWTGT

SEQ ID NO: 27667 - protein, 16 aa, BK virus
SRQASVKVGKTWTGTK

SEQ ID NO: 27668 - protein, 16 aa, BK virus
RQASVKVGKTWTGTKK

SEQ ID NO: 27669 - protein, 16 aa, BK virus
QASVKVGKTWTGTKKR

SEQ ID NO: 27670 - protein, 16 aa, BK virus
ASVKVGKTWTGTKKRA

SEQ ID NO: 27671 - protein, 16 aa, BK virus
SVKVGKTWTGTKKRAQ

SEQ ID NO: 27672 - protein, 16 aa, BK virus
VKVGKTWTGTKKRAQR

SEQ ID NO: 27673 - protein, 16 aa, BK virus
KVGKTWTGTKKRAQRI

SEQ ID NO: 27674 - protein, 16 aa, BK virus
VGKTWTGTKKRAQRIF

SEQ ID NO: 27675 - protein, 16 aa, BK virus
GKTWTGTKKRAQRIFI

SEQ ID NO: 27676 - protein, 16 aa, BK virus
KTWTGTKKRAQRIFIF

SEQ ID NO: 27677 - protein, 16 aa, BK virus
TWTGTKKRAQRIFIFI

SEQ ID NO: 27678 - protein, 16 aa, BK virus
WTGTKKRAQRIFIFIL

SEQ ID NO: 27679 - protein, 16 aa, BK virus
TGTKKRAQRIFIFILE

SEQ ID NO: 27680 - protein, 16 aa, BK virus
GTKKRAQRIFIFILEL

SEQ ID NO: 27681 - protein, 16 aa, BK virus
TKKRAQRIFIFILELL

SEQ ID NO: 27682 - protein, 16 aa, BK virus
KKRAQRIFIFILELLL

SEQ ID NO: 27683 - protein, 16 aa, BK virus
KRAQRIFIFILELLLE

SEQ ID NO: 27684 - protein, 16 aa, BK virus
RAQRIFIFILELLLEF

SEQ ID NO: 27685 - protein, 16 aa, BK virus
AQRIFIFILELLLEFC

SEQ ID NO: 27686 - protein, 16 aa, BK virus
QRIFIFILELLLEFCR

SEQ ID NO: 27687 - protein, 16 aa, BK virus
RIFIFILELLLEFCRG

SEQ ID NO: 27688 - protein, 16 aa, BK virus
IFIFILELLLEFCRGE

SEQ ID NO: 27689 - protein, 16 aa, BK virus
FIFILELLLEFCRGED

SEQ ID NO: 27690 - protein, 16 aa, BK virus
IFILELLLEFCRGEDS

SEQ ID NO: 27691 - protein, 16 aa, BK virus
FILELLLEFCRGEDSV

SEQ ID NO: 27692 - protein, 16 aa, BK virus
ILELLLEFCRGEDSVD

SEQ ID NO: 27693 - protein, 16 aa, BK virus
LELLLEFCRGEDSVDG

SEQ ID NO: 27694 - protein, 16 aa, BK virus
ELLLEFCRGEDSVDGK

SEQ ID NO: 27695 - protein, 16 aa, BK virus
LLLEFCRGEDSVDGKN

SEQ ID NO: 27696 - protein, 16 aa, BK virus
LLEFCRGEDSVDGKNK

SEQ ID NO: 27697 - protein, 16 aa, BK virus
LEFCRGEDSVDGKNKS

SEQ ID NO: 27698 - protein, 16 aa, BK virus
EFCRGEDSVDGKNKST

SEQ ID NO: 27699 - protein, 16 aa, BK virus
FCRGEDSVDGKNKSTT

SEQ ID NO: 27700 - protein, 16 aa, BK virus
CRGEDSVDGKNKSTTA

SEQ ID NO: 27701 - protein, 16 aa, BK virus
RGEDSVDGKNKSTTAL

SEQ ID NO: 27702 - protein, 16 aa, BK virus
GEDSVDGKNKSTTALP

SEQ ID NO: 27703 - protein, 16 aa, BK virus
EDSVDGKNKSTTALPA

SEQ ID NO: 27704 - protein, 16 aa, BK virus
DSVDGKNKSTTALPAV

SEQ ID NO: 27705 - protein, 16 aa, BK virus
SVDGKNKSTTALPAVK

SEQ ID NO: 27706 - protein, 16 aa, BK virus
VDGKNKSTTALPAVKD

SEQ ID NO: 27707 - protein, 16 aa, BK virus
DGKNKSTTALPAVKDS

SEQ ID NO: 27708 - protein, 16 aa, BK virus
GKNKSTTALPAVKDSV

SEQ ID NO: 27709 - protein, 16 aa, BK virus
KNKSTTALPAVKDSVK

SEQ ID NO: 27710 - protein, 16 aa, BK virus
NKSTTALPAVKDSVKD

SEQ ID NO: 27711 - protein, 16 aa, BK virus
KSTTALPAVKDSVKDS

SEQ ID NO: 27712 - protein, 16 aa, BK virus
VSNPFFFVFPGSWVLL

SEQ ID NO: 27713 - protein, 16 aa, BK virus
LPVYLRLLLPQDFQWL

SEQ ID NO: 27714 - protein, 16 aa, BK virus
PVYLRLLLPQDFQWLK

SEQ ID NO: 27715 - protein, 16 aa, BK virus
VYLRLLLPQDFQWLKL

SEQ ID NO: 27716 - protein, 16 aa, BK virus
YLRLLLPQDFQWLKLL

SEQ ID NO: 27717 - protein, 16 aa, BK virus
LRLLLPQDFQWLKLLL

SEQ ID NO: 27718 - protein, 16 aa, BK virus
RLLLPQDFQWLKLLLG

SEQ ID NO: 27719 - protein, 16 aa, BK virus
LLLPQDFQWLKLLLGR

SEQ ID NO: 27720 - protein, 16 aa, BK virus
LLPQDFQWLKLLLGRL

SEQ ID NO: 27721 - protein, 16 aa, BK virus
LPQDFQWLKLLLGRLL

SEQ ID NO: 27722 - protein, 16 aa, BK virus
PQDFQWLKLLLGRLLL

SEQ ID NO: 27723 - protein, 16 aa, BK virus
QDFQWLKLLLGRLLLL

SEQ ID NO: 27724 - protein, 16 aa, BK virus
ASISNQAWLWNCLTQM

SEQ ID NO: 27725 - protein, 16 aa, BK virus
SISNQAWLWNCLTQMS

SEQ ID NO: 27726 - protein, 16 aa, BK virus
ISNQAWLWNCLTQMST

SEQ ID NO: 27727 - protein, 16 aa, BK virus
SNQAWLWNCLTQMSTM

SEQ ID NO: 27728 - protein, 16 aa, BK virus
NQAWLWNCLTQMSTMI

SEQ ID NO: 27729 - protein, 16 aa, BK virus
QAWLWNCLTQMSTMIF

SEQ ID NO: 27730 - protein, 16 aa, BK virus
AWLWNCLTQMSTMIFC

SEQ ID NO: 27731 - protein, 16 aa, BK virus
WLWNCLTQMSTMIFCF

SEQ ID NO: 27732 - protein, 16 aa, BK virus
LWNCLTQMSTMIFCFL

SEQ ID NO: 27733 - protein, 16 aa, BK virus
WNCLTQMSTMIFCFLV

SEQ ID NO: 27734 - protein, 16 aa, BK virus
ILLLIIFNTLILGIGV

SEQ ID NO: 27735 - protein, 16 aa, BK virus
LLLIIFNTLILGIGVL

SEQ ID NO: 27736 - protein, 16 aa, BK virus
LLIIFNTLILGIGVLL

SEQ ID NO: 27737 - protein, 16 aa, BK virus
LIIFNTLILGIGVLLC

SEQ ID NO: 27738 - protein, 16 aa, BK virus
IIFNTLILGIGVLLCL

SEQ ID NO: 27739 - protein, 16 aa, BK virus
IFNTLILGIGVLLCLL

SEQ ID NO: 27740 - protein, 16 aa, BK virus
FNTLILGIGVLLCLLL

SEQ ID NO: 27741 - protein, 16 aa, BK virus
NTLILGIGVLLCLLLF

SEQ ID NO: 27742 - protein, 16 aa, BK virus
TLILGIGVLLCLLLFP

SEQ ID NO: 27743 - protein, 16 aa, BK virus
LILGIGVLLCLLLFPR

SEQ ID NO: 27744 - protein, 16 aa, BK virus
ILGIGVLLCLLLFPRL

SEQ ID NO: 27745 - protein, 16 aa, BK virus
LGIGVLLCLLLFPRLC

SEQ ID NO: 27746 - protein, 16 aa, BK virus
GIGVLLCLLLFPRLCG

SEQ ID NO: 27747 - protein, 16 aa, BK virus
IGVLLCLLLFPRLCGM

SEQ ID NO: 27748 - protein, 16 aa, BK virus
GVLLCLLLFPRLCGML

SEQ ID NO: 27749 - protein, 16 aa, BK virus
VLLCLLLFPRLCGMLL

SEQ ID NO: 27750 - protein, 16 aa, BK virus
LLCLLLFPRLCGMLLG

SEQ ID NO: 27751 - protein, 16 aa, BK virus
LCLLLFPRLCGMLLGM

SEQ ID NO: 27752 - protein, 16 aa, BK virus
CLLLFPRLCGMLLGMI

SEQ ID NO: 27753 - protein, 16 aa, BK virus
LLLFPRLCGMLLGMIY

SEQ ID NO: 27754 - protein, 16 aa, BK virus
LLFPRLCGMLLGMIYL

SEQ ID NO: 27755 - protein, 16 aa, BK virus
LFPRLCGMLLGMIYLL

SEQ ID NO: 27756 - protein, 16 aa, BK virus
PHRNCREEQKDFLETP

SEQ ID NO: 27757 - protein, 16 aa, BK virus
HRNCREEQKDFLETPW

SEQ ID NO: 27758 - protein, 16 aa, BK virus
RNCREEQKDFLETPWL

SEQ ID NO: 27759 - protein, 16 aa, BK virus
NCREEQKDFLETPWLD

SEQ ID NO: 27760 - protein, 16 aa, BK virus
CREEQKDFLETPWLDF

SEQ ID NO: 27761 - protein, 16 aa, BK virus
REEQKDFLETPWLDFW

SEQ ID NO: 27762 - protein, 16 aa, BK virus
EEQKDFLETPWLDFWR

SEQ ID NO: 27763 - protein, 16 aa, BK virus
EQKDFLETPWLDFWRK

SEQ ID NO: 27764 - protein, 16 aa, BK virus
QKDFLETPWLDFWRKL

SEQ ID NO: 27765 - protein, 16 aa, BK virus
KDFLETPWLDFWRKLP

SEQ ID NO: 27766 - protein, 16 aa, BK virus
DFLETPWLDFWRKLPG

SEQ ID NO: 27767 - protein, 16 aa, BK virus
FLETPWLDFWRKLPGQ

SEQ ID NO: 27768 - protein, 16 aa, BK virus
LETPWLDFWRKLPGQL

SEQ ID NO: 27769 - protein, 16 aa, BK virus
TFIIIFNNIILIFPLL

SEQ ID NO: 27770 - protein, 16 aa, BK virus
FIIIFNNIILIFPLLG

SEQ ID NO: 27771 - protein, 16 aa, BK virus
IIIFNNIILIFPLLGP

SEQ ID NO: 27772 - protein, 16 aa, BK virus
IIFNNIILIFPLLGPQ

SEQ ID NO: 27773 - protein, 16 aa, BK virus
IFNNIILIFPLLGPQW

SEQ ID NO: 27774 - protein, 16 aa, BK virus
FNNIILIFPLLGPQWL

SEQ ID NO: 27775 - protein, 16 aa, BK virus
NNIILIFPLLGPQWLD

SEQ ID NO: 27776 - protein, 16 aa, BK virus
NIILIFPLLGPQWLDK

SEQ ID NO: 27777 - protein, 16 aa, BK virus
KKLLPQEVLIKELLLN

SEQ ID NO: 27778 - protein, 16 aa, BK virus
KLLPQEVLIKELLLNG

SEQ ID NO: 27779 - protein, 16 aa, BK virus
LLPQEVLIKELLLNGC

SEQ ID NO: 27780 - protein, 16 aa, BK virus
LPQEVLIKELLLNGCC

SEQ ID NO: 27781 - protein, 16 aa, BK virus
PQEVLIKELLLNGCCL

SEQ ID NO: 27782 - protein, 16 aa, BK virus
QEVLIKELLLNGCCLY

SEQ ID NO: 27783 - protein, 16 aa, BK virus
EVLIKELLLNGCCLYF

SEQ ID NO: 27784 - protein, 16 aa, BK virus
HLLLKHMKMAPTKRKG

SEQ ID NO: 27785 - protein, 16 aa, BK virus
LLLKHMKMAPTKRKGE

SEQ ID NO: 27786 - protein, 16 aa, BK virus
LLKHMKMAPTKRKGEC

SEQ ID NO: 27787 - protein, 16 aa, BK virus
LKHMKMAPTKRKGECP

SEQ ID NO: 27788 - protein, 16 aa, BK virus
KHMKMAPTKRKGECPG

SEQ ID NO: 27789 - protein, 16 aa, BK virus
HMKMAPTKRKGECPGA

SEQ ID NO: 27790 - protein, 16 aa, BK virus
MKMAPTKRKGECPGAA

SEQ ID NO: 27791 - protein, 16 aa, BK virus
KMAPTKRKGECPGAAP

SEQ ID NO: 27792 - protein, 16 aa, BK virus
MAPTKRKGECPGAAPK

SEQ ID NO: 27793 - protein, 16 aa, BK virus
APTKRKGECPGAAPKK

SEQ ID NO: 27794 - protein, 16 aa, BK virus
PTKRKGECPGAAPKKP

SEQ ID NO: 27795 - protein, 16 aa, BK virus
TKRKGECPGAAPKKPK

SEQ ID NO: 27796 - protein, 16 aa, BK virus
KRKGECPGAAPKKPKE

SEQ ID NO: 27797 - protein, 16 aa, BK virus
RKGECPGAAPKKPKEP

SEQ ID NO: 27798 - protein, 16 aa, BK virus
KGECPGAAPKKPKEPV

SEQ ID NO: 27799 - protein, 16 aa, BK virus
GECPGAAPKKPKEPVQ

SEQ ID NO: 27800 - protein, 16 aa, BK virus
ECPGAAPKKPKEPVQV

SEQ ID NO: 27801 - protein, 16 aa, BK virus
CPGAAPKKPKEPVQVP

SEQ ID NO: 27802 - protein, 16 aa, BK virus
PGAAPKKPKEPVQVPK

SEQ ID NO: 27803 - protein, 16 aa, BK virus
GAAPKKPKEPVQVPKL

SEQ ID NO: 27804 - protein, 16 aa, BK virus
AAPKKPKEPVQVPKLL

SEQ ID NO: 27805 - protein, 16 aa, BK virus
APKKPKEPVQVPKLLI

SEQ ID NO: 27806 - protein, 16 aa, BK virus
PKKPKEPVQVPKLLIK

SEQ ID NO: 27807 - protein, 16 aa, BK virus
KKPKEPVQVPKLLIKG

SEQ ID NO: 27808 - protein, 16 aa, BK virus
KPKEPVQVPKLLIKGG

SEQ ID NO: 27809 - protein, 16 aa, BK virus
PKEPVQVPKLLIKGGV

SEQ ID NO: 27810 - protein, 16 aa, BK virus
KEPVQVPKLLIKGGVE

SEQ ID NO: 27811 - protein, 16 aa, BK virus
EPVQVPKLLIKGGVEV

SEQ ID NO: 27812 - protein, 16 aa, BK virus
PVQVPKLLIKGGVEVL

SEQ ID NO: 27813 - protein, 16 aa, BK virus
VQVPKLLIKGGVEVLE

SEQ ID NO: 27814 - protein, 16 aa, BK virus
QVPKLLIKGGVEVLEV

SEQ ID NO: 27815 - protein, 16 aa, BK virus
VPKLLIKGGVEVLEVK

SEQ ID NO: 27816 - protein, 16 aa, BK virus
PKLLIKGGVEVLEVKT

SEQ ID NO: 27817 - protein, 16 aa, BK virus
KLLIKGGVEVLEVKTG

SEQ ID NO: 27818 - protein, 16 aa, BK virus
LLIKGGVEVLEVKTGV

SEQ ID NO: 27819 - protein, 16 aa, BK virus
LIKGGVEVLEVKTGVD

SEQ ID NO: 27820 - protein, 16 aa, BK virus
IKGGVEVLEVKTGVDA

SEQ ID NO: 27821 - protein, 16 aa, BK virus
KGGVEVLEVKTGVDAI

SEQ ID NO: 27822 - protein, 16 aa, BK virus
GGVEVLEVKTGVDAIT

SEQ ID NO: 27823 - protein, 16 aa, BK virus
GVEVLEVKTGVDAITE

SEQ ID NO: 27824 - protein, 16 aa, BK virus
VEVLEVKTGVDAITEV

SEQ ID NO: 27825 - protein, 16 aa, BK virus
EVLEVKTGVDAITEVE

SEQ ID NO: 27826 - protein, 16 aa, BK virus
VLEVKTGVDAITEVEC

SEQ ID NO: 27827 - protein, 16 aa, BK virus
LEVKTGVDAITEVECF

SEQ ID NO: 27828 - protein, 16 aa, BK virus
EVKTGVDAITEVECFL

SEQ ID NO: 27829 - protein, 16 aa, BK virus
VKTGVDAITEVECFLN

SEQ ID NO: 27830 - protein, 16 aa, BK virus
KTGVDAITEVECFLNP

SEQ ID NO: 27831 - protein, 16 aa, BK virus
TGVDAITEVECFLNPE

SEQ ID NO: 27832 - protein, 16 aa, BK virus
GVDAITEVECFLNPEM

SEQ ID NO: 27833 - protein, 16 aa, BK virus
VDAITEVECFLNPEMG

SEQ ID NO: 27834 - protein, 16 aa, BK virus
DAITEVECFLNPEMGD

SEQ ID NO: 27835 - protein, 16 aa, BK virus
AITEVECFLNPEMGDP

SEQ ID NO: 27836 - protein, 16 aa, BK virus
ITEVECFLNPEMGDPD

SEQ ID NO: 27837 - protein, 16 aa, BK virus
TEVECFLNPEMGDPDE

SEQ ID NO: 27838 - protein, 16 aa, BK virus
EVECFLNPEMGDPDEN

SEQ ID NO: 27839 - protein, 16 aa, BK virus
VECFLNPEMGDPDENL

SEQ ID NO: 27840 - protein, 16 aa, BK virus
ECFLNPEMGDPDENLR

SEQ ID NO: 27841 - protein, 16 aa, BK virus
CFLNPEMGDPDENLRG

SEQ ID NO: 27842 - protein, 16 aa, BK virus
FLNPEMGDPDENLRGF

SEQ ID NO: 27843 - protein, 16 aa, BK virus
LNPEMGDPDENLRGFS

SEQ ID NO: 27844 - protein, 16 aa, BK virus
NPEMGDPDENLRGFSL

SEQ ID NO: 27845 - protein, 16 aa, BK virus
PEMGDPDENLRGFSLK

SEQ ID NO: 27846 - protein, 16 aa, BK virus
EMGDPDENLRGFSLKL

SEQ ID NO: 27847 - protein, 16 aa, BK virus
MGDPDENLRGFSLKLS

SEQ ID NO: 27848 - protein, 16 aa, BK virus
GDPDENLRGFSLKLSA

SEQ ID NO: 27849 - protein, 16 aa, BK virus
DPDENLRGFSLKLSAE

SEQ ID NO: 27850 - protein, 16 aa, BK virus
PDENLRGFSLKLSAEN

SEQ ID NO: 27851 - protein, 16 aa, BK virus
DENLRGFSLKLSAEND

SEQ ID NO: 27852 - protein, 16 aa, BK virus
ENLRGFSLKLSAENDF

SEQ ID NO: 27853 - protein, 16 aa, BK virus
NLRGFSLKLSAENDFS

SEQ ID NO: 27854 - protein, 16 aa, BK virus
LRGFSLKLSAENDFSS

SEQ ID NO: 27855 - protein, 16 aa, BK virus
RGFSLKLSAENDFSSD

SEQ ID NO: 27856 - protein, 16 aa, BK virus
GFSLKLSAENDFSSDS

SEQ ID NO: 27857 - protein, 16 aa, BK virus
FSLKLSAENDFSSDSP

SEQ ID NO: 27858 - protein, 16 aa, BK virus
SLKLSAENDFSSDSPE

SEQ ID NO: 27859 - protein, 16 aa, BK virus
LKLSAENDFSSDSPER

SEQ ID NO: 27860 - protein, 16 aa, BK virus
KLSAENDFSSDSPERK

SEQ ID NO: 27861 - protein, 16 aa, BK virus
LSAENDFSSDSPERKM

SEQ ID NO: 27862 - protein, 16 aa, BK virus
SAENDFSSDSPERKML

SEQ ID NO: 27863 - protein, 16 aa, BK virus
AENDFSSDSPERKMLP

SEQ ID NO: 27864 - protein, 16 aa, BK virus
ENDFSSDSPERKMLPC

SEQ ID NO: 27865 - protein, 16 aa, BK virus
NDFSSDSPERKMLPCY

SEQ ID NO: 27866 - protein, 16 aa, BK virus
DFSSDSPERKMLPCYS

SEQ ID NO: 27867 - protein, 16 aa, BK virus
FSSDSPERKMLPCYST

SEQ ID NO: 27868 - protein, 16 aa, BK virus
SSDSPERKMLPCYSTA

SEQ ID NO: 27869 - protein, 16 aa, BK virus
SDSPERKMLPCYSTAR

SEQ ID NO: 27870 - protein, 16 aa, BK virus
DSPERKMLPCYSTARI

SEQ ID NO: 27871 - protein, 16 aa, BK virus
SPERKMLPCYSTARIP

SEQ ID NO: 27872 - protein, 16 aa, BK virus
PERKMLPCYSTARIPL

SEQ ID NO: 27873 - protein, 16 aa, BK virus
ERKMLPCYSTARIPLP

SEQ ID NO: 27874 - protein, 16 aa, BK virus
RKMLPCYSTARIPLPN

SEQ ID NO: 27875 - protein, 16 aa, BK virus
KMLPCYSTARIPLPNL

SEQ ID NO: 27876 - protein, 16 aa, BK virus
MLPCYSTARIPLPNLN

SEQ ID NO: 27877 - protein, 16 aa, BK virus
LPCYSTARIPLPNLNE

SEQ ID NO: 27878 - protein, 16 aa, BK virus
PCYSTARIPLPNLNED

SEQ ID NO: 27879 - protein, 16 aa, BK virus
CYSTARIPLPNLNEDL

SEQ ID NO: 27880 - protein, 16 aa, BK virus
YSTARIPLPNLNEDLT

SEQ ID NO: 27881 - protein, 16 aa, BK virus
STARIPLPNLNEDLTC

SEQ ID NO: 27882 - protein, 16 aa, BK virus
TARIPLPNLNEDLTCG

SEQ ID NO: 27883 - protein, 16 aa, BK virus
ARIPLPNLNEDLTCGN

SEQ ID NO: 27884 - protein, 16 aa, BK virus
RIPLPNLNEDLTCGNL

SEQ ID NO: 27885 - protein, 16 aa, BK virus
IPLPNLNEDLTCGNLL

SEQ ID NO: 27886 - protein, 16 aa, BK virus
PLPNLNEDLTCGNLLM

SEQ ID NO: 27887 - protein, 16 aa, BK virus
LPNLNEDLTCGNLLMW

SEQ ID NO: 27888 - protein, 16 aa, BK virus
PNLNEDLTCGNLLMWE

SEQ ID NO: 27889 - protein, 16 aa, BK virus
NLNEDLTCGNLLMWEA

SEQ ID NO: 27890 - protein, 16 aa, BK virus
LNEDLTCGNLLMWEAV

SEQ ID NO: 27891 - protein, 16 aa, BK virus
NEDLTCGNLLMWEAVT

SEQ ID NO: 27892 - protein, 16 aa, BK virus
EDLTCGNLLMWEAVTV

SEQ ID NO: 27893 - protein, 16 aa, BK virus
DLTCGNLLMWEAVTVQ

SEQ ID NO: 27894 - protein, 16 aa, BK virus
LTCGNLLMWEAVTVQT

SEQ ID NO: 27895 - protein, 16 aa, BK virus
TCGNLLMWEAVTVQTE

SEQ ID NO: 27896 - protein, 16 aa, BK virus
CGNLLMWEAVTVQTEV

SEQ ID NO: 27897 - protein, 16 aa, BK virus
GNLLMWEAVTVQTEVI

SEQ ID NO: 27898 - protein, 16 aa, BK virus
NLLMWEAVTVQTEVIG

SEQ ID NO: 27899 - protein, 16 aa, BK virus
LLMWEAVTVQTEVIGI

SEQ ID NO: 27900 - protein, 16 aa, BK virus
LMWEAVTVQTEVIGIT

SEQ ID NO: 27901 - protein, 16 aa, BK virus
MWEAVTVQTEVIGITS

SEQ ID NO: 27902 - protein, 16 aa, BK virus
WEAVTVQTEVIGITSM

SEQ ID NO: 27903 - protein, 16 aa, BK virus
EAVTVQTEVIGITSML

SEQ ID NO: 27904 - protein, 16 aa, BK virus
AVTVQTEVIGITSMLN

SEQ ID NO: 27905 - protein, 16 aa, BK virus
VTVQTEVIGITSMLNL

SEQ ID NO: 27906 - protein, 16 aa, BK virus
TVQTEVIGITSMLNLH

SEQ ID NO: 27907 - protein, 16 aa, BK virus
VQTEVIGITSMLNLHA

SEQ ID NO: 27908 - protein, 16 aa, BK virus
QTEVIGITSMLNLHAG

SEQ ID NO: 27909 - protein, 16 aa, BK virus
TEVIGITSMLNLHAGS

SEQ ID NO: 27910 - protein, 16 aa, BK virus
EVIGITSMLNLHAGSQ

SEQ ID NO: 27911 - protein, 16 aa, BK virus
VIGITSMLNLHAGSQK

SEQ ID NO: 27912 - protein, 16 aa, BK virus
IGITSMLNLHAGSQKV

SEQ ID NO: 27913 - protein, 16 aa, BK virus
GITSMLNLHAGSQKVH

SEQ ID NO: 27914 - protein, 16 aa, BK virus
ITSMLNLHAGSQKVHE

SEQ ID NO: 27915 - protein, 16 aa, BK virus
TSMLNLHAGSQKVHEH

SEQ ID NO: 27916 - protein, 16 aa, BK virus
SMLNLHAGSQKVHEHG

SEQ ID NO: 27917 - protein, 16 aa, BK virus
MLNLHAGSQKVHEHGG

SEQ ID NO: 27918 - protein, 16 aa, BK virus
LNLHAGSQKVHEHGGG

SEQ ID NO: 27919 - protein, 16 aa, BK virus
NLHAGSQKVHEHGGGK

SEQ ID NO: 27920 - protein, 16 aa, BK virus
LHAGSQKVHEHGGGKP

SEQ ID NO: 27921 - protein, 16 aa, BK virus
HAGSQKVHEHGGGKPI

SEQ ID NO: 27922 - protein, 16 aa, BK virus
AGSQKVHEHGGGKPIQ

SEQ ID NO: 27923 - protein, 16 aa, BK virus
GSQKVHEHGGGKPIQG

SEQ ID NO: 27924 - protein, 16 aa, BK virus
SQKVHEHGGGKPIQGS

SEQ ID NO: 27925 - protein, 16 aa, BK virus
QKVHEHGGGKPIQGSN

SEQ ID NO: 27926 - protein, 16 aa, BK virus
KVHEHGGGKPIQGSNF

SEQ ID NO: 27927 - protein, 16 aa, BK virus
VHEHGGGKPIQGSNFH

SEQ ID NO: 27928 - protein, 16 aa, BK virus
HEHGGGKPIQGSNFHF

SEQ ID NO: 27929 - protein, 16 aa, BK virus
EHGGGKPIQGSNFHFF

SEQ ID NO: 27930 - protein, 16 aa, BK virus
HGGGKPIQGSNFHFFA

SEQ ID NO: 27931 - protein, 16 aa, BK virus
GGGKPIQGSNFHFFAV

SEQ ID NO: 27932 - protein, 16 aa, BK virus
GGKPIQGSNFHFFAVG

SEQ ID NO: 27933 - protein, 16 aa, BK virus
GKPIQGSNFHFFAVGG

SEQ ID NO: 27934 - protein, 16 aa, BK virus
KPIQGSNFHFFAVGGE

SEQ ID NO: 27935 - protein, 16 aa, BK virus
PIQGSNFHFFAVGGEP

SEQ ID NO: 27936 - protein, 16 aa, BK virus
IQGSNFHFFAVGGEPL

SEQ ID NO: 27937 - protein, 16 aa, BK virus
QGSNFHFFAVGGEPLE

SEQ ID NO: 27938 - protein, 16 aa, BK virus
GSNFHFFAVGGEPLEM

SEQ ID NO: 27939 - protein, 16 aa, BK virus
SNFHFFAVGGEPLEMQ

SEQ ID NO: 27940 - protein, 16 aa, BK virus
NFHFFAVGGEPLEMQG

SEQ ID NO: 27941 - protein, 16 aa, BK virus
FHFFAVGGEPLEMQGV

SEQ ID NO: 27942 - protein, 16 aa, BK virus
HFFAVGGEPLEMQGVL

SEQ ID NO: 27943 - protein, 16 aa, BK virus
FFAVGGEPLEMQGVLM

SEQ ID NO: 27944 - protein, 16 aa, BK virus
FAVGGEPLEMQGVLMN

SEQ ID NO: 27945 - protein, 16 aa, BK virus
AVGGEPLEMQGVLMNY

SEQ ID NO: 27946 - protein, 16 aa, BK virus
VGGEPLEMQGVLMNYR

SEQ ID NO: 27947 - protein, 16 aa, BK virus
GGEPLEMQGVLMNYRS

SEQ ID NO: 27948 - protein, 16 aa, BK virus
GEPLEMQGVLMNYRSK

SEQ ID NO: 27949 - protein, 16 aa, BK virus
EPLEMQGVLMNYRSKY

SEQ ID NO: 27950 - protein, 16 aa, BK virus
PLEMQGVLMNYRSKYP

SEQ ID NO: 27951 - protein, 16 aa, BK virus
LEMQGVLMNYRSKYPD

SEQ ID NO: 27952 - protein, 16 aa, BK virus
EMQGVLMNYRSKYPDG

SEQ ID NO: 27953 - protein, 16 aa, BK virus
MQGVLMNYRSKYPDGT

SEQ ID NO: 27954 - protein, 16 aa, BK virus
QGVLMNYRSKYPDGTI

SEQ ID NO: 27955 - protein, 16 aa, BK virus
GVLMNYRSKYPDGTIT

SEQ ID NO: 27956 - protein, 16 aa, BK virus
VLMNYRSKYPDGTITP

SEQ ID NO: 27957 - protein, 16 aa, BK virus
LMNYRSKYPDGTITPK

SEQ ID NO: 27958 - protein, 16 aa, BK virus
MNYRSKYPDGTITPKN

SEQ ID NO: 27959 - protein, 16 aa, BK virus
NYRSKYPDGTITPKNP

SEQ ID NO: 27960 - protein, 16 aa, BK virus
YRSKYPDGTITPKNPT

SEQ ID NO: 27961 - protein, 16 aa, BK virus
RSKYPDGTITPKNPTA

SEQ ID NO: 27962 - protein, 16 aa, BK virus
SKYPDGTITPKNPTAQ

SEQ ID NO: 27963 - protein, 16 aa, BK virus
KYPDGTITPKNPTAQS

SEQ ID NO: 27964 - protein, 16 aa, BK virus
YPDGTITPKNPTAQSQ

SEQ ID NO: 27965 - protein, 16 aa, BK virus
PDGTITPKNPTAQSQV

SEQ ID NO: 27966 - protein, 16 aa, BK virus
DGTITPKNPTAQSQVM

SEQ ID NO: 27967 - protein, 16 aa, BK virus
GTITPKNPTAQSQVMN

SEQ ID NO: 27968 - protein, 16 aa, BK virus
TITPKNPTAQSQVMNT

SEQ ID NO: 27969 - protein, 16 aa, BK virus
ITPKNPTAQSQVMNTD

SEQ ID NO: 27970 - protein, 16 aa, BK virus
TPKNPTAQSQVMNTDH

SEQ ID NO: 27971 - protein, 16 aa, BK virus
PKNPTAQSQVMNTDHK

SEQ ID NO: 27972 - protein, 16 aa, BK virus
KNPTAQSQVMNTDHKA

SEQ ID NO: 27973 - protein, 16 aa, BK virus
NPTAQSQVMNTDHKAY

SEQ ID NO: 27974 - protein, 16 aa, BK virus
PTAQSQVMNTDHKAYL

SEQ ID NO: 27975 - protein, 16 aa, BK virus
TAQSQVMNTDHKAYLD

SEQ ID NO: 27976 - protein, 16 aa, BK virus
AQSQVMNTDHKAYLDK

SEQ ID NO: 27977 - protein, 16 aa, BK virus
QSQVMNTDHKAYLDKN

SEQ ID NO: 27978 - protein, 16 aa, BK virus
SQVMNTDHKAYLDKNN

SEQ ID NO: 27979 - protein, 16 aa, BK virus
QVMNTDHKAYLDKNNA

SEQ ID NO: 27980 - protein, 16 aa, BK virus
VMNTDHKAYLDKNNAY

SEQ ID NO: 27981 - protein, 16 aa, BK virus
MNTDHKAYLDKNNAYP

SEQ ID NO: 27982 - protein, 16 aa, BK virus
NTDHKAYLDKNNAYPV

SEQ ID NO: 27983 - protein, 16 aa, BK virus
TDHKAYLDKNNAYPVE

SEQ ID NO: 27984 - protein, 16 aa, BK virus
DHKAYLDKNNAYPVEC

SEQ ID NO: 27985 - protein, 16 aa, BK virus
HKAYLDKNNAYPVECW

SEQ ID NO: 27986 - protein, 16 aa, BK virus
KAYLDKNNAYPVECWV

SEQ ID NO: 27987 - protein, 16 aa, BK virus
AYLDKNNAYPVECWVP

SEQ ID NO: 27988 - protein, 16 aa, BK virus
YLDKNNAYPVECWVPD

SEQ ID NO: 27989 - protein, 16 aa, BK virus
LDKNNAYPVECWVPDP

SEQ ID NO: 27990 - protein, 16 aa, BK virus
DKNNAYPVECWVPDPS

SEQ ID NO: 27991 - protein, 16 aa, BK virus
KNNAYPVECWVPDPSR

SEQ ID NO: 27992 - protein, 16 aa, BK virus
NNAYPVECWVPDPSRN

SEQ ID NO: 27993 - protein, 16 aa, BK virus
NAYPVECWVPDPSRNE

SEQ ID NO: 27994 - protein, 16 aa, BK virus
AYPVECWVPDPSRNEN

SEQ ID NO: 27995 - protein, 16 aa, BK virus
YPVECWVPDPSRNENA

SEQ ID NO: 27996 - protein, 16 aa, BK virus
PVECWVPDPSRNENAR

SEQ ID NO: 27997 - protein, 16 aa, BK virus
VECWVPDPSRNENARY

SEQ ID NO: 27998 - protein, 16 aa, BK virus
ECWVPDPSRNENARYF

SEQ ID NO: 27999 - protein, 16 aa, BK virus
CWVPDPSRNENARYFG

SEQ ID NO: 28000 - protein, 16 aa, BK virus
WVPDPSRNENARYFGT

SEQ ID NO: 28001 - protein, 16 aa, BK virus
VPDPSRNENARYFGTF

SEQ ID NO: 28002 - protein, 16 aa, BK virus
PDPSRNENARYFGTFT

SEQ ID NO: 28003 - protein, 16 aa, BK virus
DPSRNENARYFGTFTG

SEQ ID NO: 28004 - protein, 16 aa, BK virus
PSRNENARYFGTFTGG

SEQ ID NO: 28005 - protein, 16 aa, BK virus
SRNENARYFGTFTGGE

SEQ ID NO: 28006 - protein, 16 aa, BK virus
RNENARYFGTFTGGEN

SEQ ID NO: 28007 - protein, 16 aa, BK virus
NENARYFGTFTGGENV

SEQ ID NO: 28008 - protein, 16 aa, BK virus
ENARYFGTFTGGENVP

SEQ ID NO: 28009 - protein, 16 aa, BK virus
NARYFGTFTGGENVPP

SEQ ID NO: 28010 - protein, 16 aa, BK virus
ARYFGTFTGGENVPPV

SEQ ID NO: 28011 - protein, 16 aa, BK virus
RYFGTFTGGENVPPVL

SEQ ID NO: 28012 - protein, 16 aa, BK virus
YFGTFTGGENVPPVLH

SEQ ID NO: 28013 - protein, 16 aa, BK virus
FGTFTGGENVPPVLHV

SEQ ID NO: 28014 - protein, 16 aa, BK virus
GTFTGGENVPPVLHVT

SEQ ID NO: 28015 - protein, 16 aa, BK virus
TFTGGENVPPVLHVTN

SEQ ID NO: 28016 - protein, 16 aa, BK virus
FTGGENVPPVLHVTNT

SEQ ID NO: 28017 - protein, 16 aa, BK virus
TGGENVPPVLHVTNTA

SEQ ID NO: 28018 - protein, 16 aa, BK virus
GGENVPPVLHVTNTAT

SEQ ID NO: 28019 - protein, 16 aa, BK virus
GENVPPVLHVTNTATT

SEQ ID NO: 28020 - protein, 16 aa, BK virus
ENVPPVLHVTNTATTV

SEQ ID NO: 28021 - protein, 16 aa, BK virus
NVPPVLHVTNTATTVL

SEQ ID NO: 28022 - protein, 16 aa, BK virus
VPPVLHVTNTATTVLL

SEQ ID NO: 28023 - protein, 16 aa, BK virus
PPVLHVTNTATTVLLD

SEQ ID NO: 28024 - protein, 16 aa, BK virus
PVLHVTNTATTVLLDE

SEQ ID NO: 28025 - protein, 16 aa, BK virus
VLHVTNTATTVLLDEQ

SEQ ID NO: 28026 - protein, 16 aa, BK virus
LHVTNTATTVLLDEQG

SEQ ID NO: 28027 - protein, 16 aa, BK virus
HVTNTATTVLLDEQGV

SEQ ID NO: 28028 - protein, 16 aa, BK virus
VTNTATTVLLDEQGVG

SEQ ID NO: 28029 - protein, 16 aa, BK virus
TNTATTVLLDEQGVGP

SEQ ID NO: 28030 - protein, 16 aa, BK virus
NTATTVLLDEQGVGPL

SEQ ID NO: 28031 - protein, 16 aa, BK virus
TATTVLLDEQGVGPLC

SEQ ID NO: 28032 - protein, 16 aa, BK virus
ATTVLLDEQGVGPLCK

SEQ ID NO: 28033 - protein, 16 aa, BK virus
TTVLLDEQGVGPLCKA

SEQ ID NO: 28034 - protein, 16 aa, BK virus
TVLLDEQGVGPLCKAD

SEQ ID NO: 28035 - protein, 16 aa, BK virus
VLLDEQGVGPLCKADS

SEQ ID NO: 28036 - protein, 16 aa, BK virus
LLDEQGVGPLCKADSL

SEQ ID NO: 28037 - protein, 16 aa, BK virus
LDEQGVGPLCKADSLY

SEQ ID NO: 28038 - protein, 16 aa, BK virus
DEQGVGPLCKADSLYV

SEQ ID NO: 28039 - protein, 16 aa, BK virus
EQGVGPLCKADSLYVS

SEQ ID NO: 28040 - protein, 16 aa, BK virus
QGVGPLCKADSLYVSA

SEQ ID NO: 28041 - protein, 16 aa, BK virus
GVGPLCKADSLYVSAA

SEQ ID NO: 28042 - protein, 16 aa, BK virus
VGPLCKADSLYVSAAD

SEQ ID NO: 28043 - protein, 16 aa, BK virus
GPLCKADSLYVSAADI

SEQ ID NO: 28044 - protein, 16 aa, BK virus
PLCKADSLYVSAADIC

SEQ ID NO: 28045 - protein, 16 aa, BK virus
LCKADSLYVSAADICG

SEQ ID NO: 28046 - protein, 16 aa, BK virus
CKADSLYVSAADICGL

SEQ ID NO: 28047 - protein, 16 aa, BK virus
KADSLYVSAADICGLF

SEQ ID NO: 28048 - protein, 16 aa, BK virus
ADSLYVSAADICGLFT

SEQ ID NO: 28049 - protein, 16 aa, BK virus
DSLYVSAADICGLFTN

SEQ ID NO: 28050 - protein, 16 aa, BK virus
SLYVSAADICGLFTNS

SEQ ID NO: 28051 - protein, 16 aa, BK virus
LYVSAADICGLFTNSS

SEQ ID NO: 28052 - protein, 16 aa, BK virus
YVSAADICGLFTNSSG

SEQ ID NO: 28053 - protein, 16 aa, BK virus
VSAADICGLFTNSSGT

SEQ ID NO: 28054 - protein, 16 aa, BK virus
SAADICGLFTNSSGTQ

SEQ ID NO: 28055 - protein, 16 aa, BK virus
AADICGLFTNSSGTQQ

SEQ ID NO: 28056 - protein, 16 aa, BK virus
ADICGLFTNSSGTQQW

SEQ ID NO: 28057 - protein, 16 aa, BK virus
DICGLFTNSSGTQQWR

SEQ ID NO: 28058 - protein, 16 aa, BK virus
ICGLFTNSSGTQQWRG

SEQ ID NO: 28059 - protein, 16 aa, BK virus
CGLFTNSSGTQQWRGL

SEQ ID NO: 28060 - protein, 16 aa, BK virus
GLFTNSSGTQQWRGLA

SEQ ID NO: 28061 - protein, 16 aa, BK virus
LFTNSSGTQQWRGLAR

SEQ ID NO: 28062 - protein, 16 aa, BK virus
FTNSSGTQQWRGLARY

SEQ ID NO: 28063 - protein, 16 aa, BK virus
TNSSGTQQWRGLARYF

SEQ ID NO: 28064 - protein, 16 aa, BK virus
NSSGTQQWRGLARYFK

SEQ ID NO: 28065 - protein, 16 aa, BK virus
SSGTQQWRGLARYFKI

SEQ ID NO: 28066 - protein, 16 aa, BK virus
SGTQQWRGLARYFKIR

SEQ ID NO: 28067 - protein, 16 aa, BK virus
GTQQWRGLARYFKIRL

SEQ ID NO: 28068 - protein, 16 aa, BK virus
TQQWRGLARYFKIRLR

SEQ ID NO: 28069 - protein, 16 aa, BK virus
QQWRGLARYFKIRLRK

SEQ ID NO: 28070 - protein, 16 aa, BK virus
QWRGLARYFKIRLRKR

SEQ ID NO: 28071 - protein, 16 aa, BK virus
WRGLARYFKIRLRKRS

SEQ ID NO: 28072 - protein, 16 aa, BK virus
RGLARYFKIRLRKRSV

SEQ ID NO: 28073 - protein, 16 aa, BK virus
GLARYFKIRLRKRSVK

SEQ ID NO: 28074 - protein, 16 aa, BK virus
LARYFKIRLRKRSVKN

SEQ ID NO: 28075 - protein, 16 aa, BK virus
ARYFKIRLRKRSVKNP

SEQ ID NO: 28076 - protein, 16 aa, BK virus
RYFKIRLRKRSVKNPY

SEQ ID NO: 28077 - protein, 16 aa, BK virus
YFKIRLRKRSVKNPYP

SEQ ID NO: 28078 - protein, 16 aa, BK virus
FKIRLRKRSVKNPYPI

SEQ ID NO: 28079 - protein, 16 aa, BK virus
KIRLRKRSVKNPYPIS

SEQ ID NO: 28080 - protein, 16 aa, BK virus
IRLRKRSVKNPYPISF

SEQ ID NO: 28081 - protein, 16 aa, BK virus
RLRKRSVKNPYPISFL

SEQ ID NO: 28082 - protein, 16 aa, BK virus
LRKRSVKNPYPISFLL

SEQ ID NO: 28083 - protein, 16 aa, BK virus
RKRSVKNPYPISFLLS

SEQ ID NO: 28084 - protein, 16 aa, BK virus
KRSVKNPYPISFLLSD

SEQ ID NO: 28085 - protein, 16 aa, BK virus
RSVKNPYPISFLLSDL

SEQ ID NO: 28086 - protein, 16 aa, BK virus
SVKNPYPISFLLSDLI

SEQ ID NO: 28087 - protein, 16 aa, BK virus
VKNPYPISFLLSDLIN

SEQ ID NO: 28088 - protein, 16 aa, BK virus
KNPYPISFLLSDLINR

SEQ ID NO: 28089 - protein, 16 aa, BK virus
NPYPISFLLSDLINRR

SEQ ID NO: 28090 - protein, 16 aa, BK virus
PYPISFLLSDLINRRT

SEQ ID NO: 28091 - protein, 16 aa, BK virus
YPISFLLSDLINRRTQ

SEQ ID NO: 28092 - protein, 16 aa, BK virus
PISFLLSDLINRRTQR

SEQ ID NO: 28093 - protein, 16 aa, BK virus
ISFLLSDLINRRTQRV

SEQ ID NO: 28094 - protein, 16 aa, BK virus
SFLLSDLINRRTQRVD

SEQ ID NO: 28095 - protein, 16 aa, BK virus
FLLSDLINRRTQRVDG

SEQ ID NO: 28096 - protein, 16 aa, BK virus
LLSDLINRRTQRVDGQ

SEQ ID NO: 28097 - protein, 16 aa, BK virus
LSDLINRRTQRVDGQP

SEQ ID NO: 28098 - protein, 16 aa, BK virus
SDLINRRTQRVDGQPM

SEQ ID NO: 28099 - protein, 16 aa, BK virus
DLINRRTQRVDGQPMY

SEQ ID NO: 28100 - protein, 16 aa, BK virus
LINRRTQRVDGQPMYG

SEQ ID NO: 28101 - protein, 16 aa, BK virus
INRRTQRVDGQPMYGM

SEQ ID NO: 28102 - protein, 16 aa, BK virus
NRRTQRVDGQPMYGME

SEQ ID NO: 28103 - protein, 16 aa, BK virus
RRTQRVDGQPMYGMES

SEQ ID NO: 28104 - protein, 16 aa, BK virus
RTQRVDGQPMYGMESQ

SEQ ID NO: 28105 - protein, 16 aa, BK virus
TQRVDGQPMYGMESQV

SEQ ID NO: 28106 - protein, 16 aa, BK virus
QRVDGQPMYGMESQVE

SEQ ID NO: 28107 - protein, 16 aa, BK virus
RVDGQPMYGMESQVEE

SEQ ID NO: 28108 - protein, 16 aa, BK virus
VDGQPMYGMESQVEEV

SEQ ID NO: 28109 - protein, 16 aa, BK virus
DGQPMYGMESQVEEVR

SEQ ID NO: 28110 - protein, 16 aa, BK virus
GQPMYGMESQVEEVRV

SEQ ID NO: 28111 - protein, 16 aa, BK virus
QPMYGMESQVEEVRVF

SEQ ID NO: 28112 - protein, 16 aa, BK virus
PMYGMESQVEEVRVFD

SEQ ID NO: 28113 - protein, 16 aa, BK virus
MYGMESQVEEVRVFDG

SEQ ID NO: 28114 - protein, 16 aa, BK virus
YGMESQVEEVRVFDGT

SEQ ID NO: 28115 - protein, 16 aa, BK virus
GMESQVEEVRVFDGTE

SEQ ID NO: 28116 - protein, 16 aa, BK virus
MESQVEEVRVFDGTER

SEQ ID NO: 28117 - protein, 16 aa, BK virus
ESQVEEVRVFDGTERL

SEQ ID NO: 28118 - protein, 16 aa, BK virus
SQVEEVRVFDGTERLP

SEQ ID NO: 28119 - protein, 16 aa, BK virus
QVEEVRVFDGTERLPG

SEQ ID NO: 28120 - protein, 16 aa, BK virus
VEEVRVFDGTERLPGD

SEQ ID NO: 28121 - protein, 16 aa, BK virus
EEVRVFDGTERLPGDP

SEQ ID NO: 28122 - protein, 16 aa, BK virus
EVRVFDGTERLPGDPD

SEQ ID NO: 28123 - protein, 16 aa, BK virus
VRVFDGTERLPGDPDM

SEQ ID NO: 28124 - protein, 16 aa, BK virus
RVFDGTERLPGDPDMI

SEQ ID NO: 28125 - protein, 16 aa, BK virus
VFDGTERLPGDPDMIR

SEQ ID NO: 28126 - protein, 16 aa, BK virus
FDGTERLPGDPDMIRY

SEQ ID NO: 28127 - protein, 16 aa, BK virus
DGTERLPGDPDMIRYI

SEQ ID NO: 28128 - protein, 16 aa, BK virus
GTERLPGDPDMIRYID

SEQ ID NO: 28129 - protein, 16 aa, BK virus
TERLPGDPDMIRYIDK

SEQ ID NO: 28130 - protein, 16 aa, BK virus
ERLPGDPDMIRYIDKQ

SEQ ID NO: 28131 - protein, 16 aa, BK virus
RLPGDPDMIRYIDKQG

SEQ ID NO: 28132 - protein, 16 aa, BK virus
LPGDPDMIRYIDKQGQ

SEQ ID NO: 28133 - protein, 16 aa, BK virus
PGDPDMIRYIDKQGQL

SEQ ID NO: 28134 - protein, 16 aa, BK virus
GDPDMIRYIDKQGQLQ

SEQ ID NO: 28135 - protein, 16 aa, BK virus
DPDMIRYIDKQGQLQT

SEQ ID NO: 28136 - protein, 16 aa, BK virus
PDMIRYIDKQGQLQTK

SEQ ID NO: 28137 - protein, 16 aa, BK virus
DMIRYIDKQGQLQTKM

SEQ ID NO: 28138 - protein, 16 aa, BK virus
MIRYIDKQGQLQTKML

SEQ ID NO: 28139 - protein, 16 aa, BK virus
TGAFIVHIHLINAAFV

SEQ ID NO: 28140 - protein, 16 aa, BK virus
ATFKLVLFWGWCFRPF

SEQ ID NO: 28141 - protein, 16 aa, BK virus
TFKLVLFWGWCFRPFK

SEQ ID NO: 28142 - protein, 16 aa, BK virus
FKLVLFWGWCFRPFKT

SEQ ID NO: 28143 - protein, 16 aa, BK virus
KLVLFWGWCFRPFKTL

SEQ ID NO: 28144 - protein, 16 aa, BK virus
LVLFWGWCFRPFKTLK

SEQ ID NO: 28145 - protein, 16 aa, BK virus
VLFWGWCFRPFKTLKA

SEQ ID NO: 28146 - protein, 16 aa, BK virus
LFWGWCFRPFKTLKAF

SEQ ID NO: 28147 - protein, 16 aa, BK virus
FWGWCFRPFKTLKAFT

SEQ ID NO: 28148 - protein, 16 aa, BK virus
WGWCFRPFKTLKAFTQ

SEQ ID NO: 28149 - protein, 16 aa, BK virus
GWCFRPFKTLKAFTQM

SEQ ID NO: 28150 - protein, 16 aa, BK virus
WCFRPFKTLKAFTQMQ

SEQ ID NO: 28151 - protein, 16 aa, BK virus
CFRPFKTLKAFTQMQL

SEQ ID NO: 28152 - protein, 16 aa, BK virus
FRPFKTLKAFTQMQLL

SEQ ID NO: 28153 - protein, 16 aa, BK virus
RPFKTLKAFTQMQLLT

SEQ ID NO: 28154 - protein, 16 aa, BK virus
PFKTLKAFTQMQLLTM

SEQ ID NO: 28155 - protein, 16 aa, BK virus
FKTLKAFTQMQLLTMG

SEQ ID NO: 28156 - protein, 16 aa, BK virus
KTLKAFTQMQLLTMGV

SEQ ID NO: 28157 - protein, 16 aa, BK virus
ILFSCNIKNTFPHAYI

SEQ ID NO: 28158 - protein, 16 aa, BK virus
LFSCNIKNTFPHAYII

SEQ ID NO: 28159 - protein, 16 aa, BK virus
FSCNIKNTFPHAYIIF

SEQ ID NO: 28160 - protein, 16 aa, BK virus
SCNIKNTFPHAYIIFH

SEQ ID NO: 28161 - protein, 16 aa, BK virus
CNIKNTFPHAYIIFHP

SEQ ID NO: 28162 - protein, 16 aa, BK virus
KSIHTYLRIQPFLPFN

SEQ ID NO: 28163 - protein, 16 aa, BK virus
SIHTYLRIQPFLPFNN

SEQ ID NO: 28164 - protein, 16 aa, BK virus
IHTYLRIQPFLPFNNS

SEQ ID NO: 28165 - protein, 16 aa, BK virus
HTYLRIQPFLPFNNSR

SEQ ID NO: 28166 - protein, 16 aa, BK virus
TYLRIQPFLPFNNSRL

SEQ ID NO: 28167 - protein, 16 aa, BK virus
YLRIQPFLPFNNSRLY

SEQ ID NO: 28168 - protein, 16 aa, BK virus
LRIQPFLPFNNSRLYI

SEQ ID NO: 28169 - protein, 16 aa, BK virus
RIQPFLPFNNSRLYIS

SEQ ID NO: 28170 - protein, 16 aa, BK virus
IQPFLPFNNSRLYISC

SEQ ID NO: 28171 - protein, 16 aa, BK virus
QPFLPFNNSRLYISCK

SEQ ID NO: 28172 - protein, 16 aa, BK virus
PFLPFNNSRLYISCKI

SEQ ID NO: 28173 - protein, 16 aa, BK virus
FLPFNNSRLYISCKIS

SEQ ID NO: 28174 - protein, 16 aa, BK virus
LPFNNSRLYISCKISY

SEQ ID NO: 28175 - protein, 16 aa, BK virus
PFNNSRLYISCKISYR

SEQ ID NO: 28176 - protein, 16 aa, BK virus
FNNSRLYISCKISYRP

SEQ ID NO: 28177 - protein, 16 aa, BK virus
NNSRLYISCKISYRPK

SEQ ID NO: 28178 - protein, 16 aa, BK virus
NSRLYISCKISYRPKP

SEQ ID NO: 28179 - protein, 16 aa, BK virus
SRLYISCKISYRPKPN

SEQ ID NO: 28180 - protein, 16 aa, BK virus
IYFGPKIYLSYKSSLQ

SEQ ID NO: 28181 - protein, 16 aa, BK virus
YFGPKIYLSYKSSLQG

SEQ ID NO: 28182 - protein, 16 aa, BK virus
FGPKIYLSYKSSLQGF

SEQ ID NO: 28183 - protein, 16 aa, BK virus
GPKIYLSYKSSLQGFR

SEQ ID NO: 28184 - protein, 16 aa, BK virus
PKIYLSYKSSLQGFRD

SEQ ID NO: 28185 - protein, 16 aa, BK virus
KIYLSYKSSLQGFRDR

SEQ ID NO: 28186 - protein, 16 aa, BK virus
IYLSYKSSLQGFRDRI

SEQ ID NO: 28187 - protein, 16 aa, BK virus
YLSYKSSLQGFRDRIL

SEQ ID NO: 28188 - protein, 16 aa, BK virus
LSYKSSLQGFRDRILI

SEQ ID NO: 28189 - protein, 16 aa, BK virus
SYKSSLQGFRDRILIH

SEQ ID NO: 28190 - protein, 16 aa, BK virus
YKSSLQGFRDRILIHC

SEQ ID NO: 28191 - protein, 16 aa, BK virus
KSSLQGFRDRILIHCN

SEQ ID NO: 28192 - protein, 16 aa, BK virus
SSLQGFRDRILIHCNQ

SEQ ID NO: 28193 - protein, 16 aa, BK virus
SLQGFRDRILIHCNQA

SEQ ID NO: 28194 - protein, 16 aa, BK virus
LQGFRDRILIHCNQAW

SEQ ID NO: 28195 - protein, 16 aa, BK virus
QGFRDRILIHCNQAWW

SEQ ID NO: 28196 - protein, 16 aa, BK virus
GFRDRILIHCNQAWWK

SEQ ID NO: 28197 - protein, 16 aa, BK virus
FRDRILIHCNQAWWKY

SEQ ID NO: 28198 - protein, 16 aa, BK virus
RDRILIHCNQAWWKYL

SEQ ID NO: 28199 - protein, 16 aa, BK virus
DRILIHCNQAWWKYLG

SEQ ID NO: 28200 - protein, 16 aa, BK virus
RILIHCNQAWWKYLGS

SEQ ID NO: 28201 - protein, 16 aa, BK virus
ILIHCNQAWWKYLGSF

SEQ ID NO: 28202 - protein, 16 aa, BK virus
LIHCNQAWWKYLGSFV

SEQ ID NO: 28203 - protein, 16 aa, BK virus
FSSCPFYIFKNNHVLI

SEQ ID NO: 28204 - protein, 16 aa, BK virus
SSCPFYIFKNNHVLIY

SEQ ID NO: 28205 - protein, 16 aa, BK virus
SCPFYIFKNNHVLIYS

SEQ ID NO: 28206 - protein, 16 aa, BK virus
CPFYIFKNNHVLIYSY

SEQ ID NO: 28207 - protein, 16 aa, BK virus
PFYIFKNNHVLIYSYT

SEQ ID NO: 28208 - protein, 16 aa, BK virus
PVSSFRYIENNTVQKI

SEQ ID NO: 28209 - protein, 16 aa, BK virus
VSSFRYIENNTVQKIK

SEQ ID NO: 28210 - protein, 16 aa, BK virus
SSFRYIENNTVQKIKY

SEQ ID NO: 28211 - protein, 16 aa, BK virus
SFRYIENNTVQKIKYY

SEQ ID NO: 28212 - protein, 16 aa, BK virus
FRYIENNTVQKIKYYR

SEQ ID NO: 28213 - protein, 16 aa, BK virus
RYIENNTVQKIKYYRI

SEQ ID NO: 28214 - protein, 16 aa, BK virus
YIENNTVQKIKYYRIH

SEQ ID NO: 28215 - protein, 16 aa, BK virus
IENNTVQKIKYYRIHF

SEQ ID NO: 28216 - protein, 16 aa, BK virus
ENNTVQKIKYYRIHFR

SEQ ID NO: 28217 - protein, 16 aa, BK virus
NCIYCLLTNTFLIFTF

SEQ ID NO: 28218 - protein, 16 aa, BK virus
CIYCLLTNTFLIFTFC

SEQ ID NO: 28219 - protein, 16 aa, BK virus
IYCLLTNTFLIFTFCK

SEQ ID NO: 28220 - protein, 16 aa, BK virus
YCLLTNTFLIFTFCKN

SEQ ID NO: 28221 - protein, 16 aa, BK virus
CLLTNTFLIFTFCKNN

SEQ ID NO: 28222 - protein, 16 aa, BK virus
LLTNTFLIFTFCKNNS

SEQ ID NO: 28223 - protein, 16 aa, BK virus
LTNTFLIFTFCKNNSI

SEQ ID NO: 28224 - protein, 16 aa, BK virus
TNTFLIFTFCKNNSIC

SEQ ID NO: 28225 - protein, 16 aa, BK virus
NTFLIFTFCKNNSICK

SEQ ID NO: 28226 - protein, 16 aa, BK virus
TFLIFTFCKNNSICKV

SEQ ID NO: 28227 - protein, 16 aa, BK virus
FLIFTFCKNNSICKVL

SEQ ID NO: 28228 - protein, 16 aa, BK virus
LIFTFCKNNSICKVLF

SEQ ID NO: 28229 - protein, 16 aa, BK virus
IFTFCKNNSICKVLFM

SEQ ID NO: 28230 - protein, 16 aa, BK virus
FTFCKNNSICKVLFMI

SEQ ID NO: 28231 - protein, 16 aa, BK virus
TFCKNNSICKVLFMIL

SEQ ID NO: 28232 - protein, 16 aa, BK virus
FCKNNSICKVLFMILK

SEQ ID NO: 28233 - protein, 16 aa, BK virus
CKNNSICKVLFMILKV

SEQ ID NO: 28234 - protein, 16 aa, BK virus
KNNSICKVLFMILKVI

SEQ ID NO: 28235 - protein, 16 aa, BK virus
NNSICKVLFMILKVIR

SEQ ID NO: 28236 - protein, 16 aa, BK virus
NSICKVLFMILKVIRL

SEQ ID NO: 28237 - protein, 16 aa, BK virus
SICKVLFMILKVIRLV

SEQ ID NO: 28238 - protein, 16 aa, BK virus
ICKVLFMILKVIRLVF

SEQ ID NO: 28239 - protein, 16 aa, BK virus
CKVLFMILKVIRLVFF

SEQ ID NO: 28240 - protein, 16 aa, BK virus
KVLFMILKVIRLVFFL

SEQ ID NO: 28241 - protein, 16 aa, BK virus
VLFMILKVIRLVFFLT

SEQ ID NO: 28242 - protein, 16 aa, BK virus
LFMILKVIRLVFFLTL

SEQ ID NO: 28243 - protein, 16 aa, BK virus
FMILKVIRLVFFLTLF

SEQ ID NO: 28244 - protein, 16 aa, BK virus
MILKVIRLVFFLTLFT

SEQ ID NO: 28245 - protein, 16 aa, BK virus
ILKVIRLVFFLTLFTL

SEQ ID NO: 28246 - protein, 16 aa, BK virus
LKVIRLVFFLTLFTLL

SEQ ID NO: 28247 - protein, 16 aa, BK virus
KVIRLVFFLTLFTLLY

SEQ ID NO: 28248 - protein, 16 aa, BK virus
VIRLVFFLTLFTLLYI

SEQ ID NO: 28249 - protein, 16 aa, BK virus
IRLVFFLTLFTLLYIV

SEQ ID NO: 28250 - protein, 16 aa, BK virus
RLVFFLTLFTLLYIVL

SEQ ID NO: 28251 - protein, 16 aa, BK virus
LVFFLTLFTLLYIVLK

SEQ ID NO: 28252 - protein, 16 aa, BK virus
VFFLTLFTLLYIVLKF

SEQ ID NO: 28253 - protein, 16 aa, BK virus
FPRHLLCFFRLFWAKI

SEQ ID NO: 28254 - protein, 16 aa, BK virus
PRHLLCFFRLFWAKIM

SEQ ID NO: 28255 - protein, 16 aa, BK virus
RHLLCFFRLFWAKIML

SEQ ID NO: 28256 - protein, 16 aa, BK virus
HLLCFFRLFWAKIMLL

SEQ ID NO: 28257 - protein, 16 aa, BK virus
KTKGTQLLTEIINCRN

SEQ ID NO: 28258 - protein, 16 aa, BK virus
TKGTQLLTEIINCRNS

SEQ ID NO: 28259 - protein, 16 aa, BK virus
KGTQLLTEIINCRNSM

SEQ ID NO: 28260 - protein, 16 aa, BK virus
GTQLLTEIINCRNSMS

SEQ ID NO: 28261 - protein, 16 aa, BK virus
TQLLTEIINCRNSMSM

SEQ ID NO: 28262 - protein, 16 aa, BK virus
QLLTEIINCRNSMSMW

SEQ ID NO: 28263 - protein, 16 aa, BK virus
LLTEIINCRNSMSMWS

SEQ ID NO: 28264 - protein, 16 aa, BK virus
KEYNIMPSTHVSTNKS

SEQ ID NO: 28265 - protein, 16 aa, BK virus
EYNIMPSTHVSTNKSY

SEQ ID NO: 28266 - protein, 16 aa, BK virus
YNIMPSTHVSTNKSYR

SEQ ID NO: 28267 - protein, 16 aa, BK virus
NIMPSTHVSTNKSYRI

SEQ ID NO: 28268 - protein, 16 aa, BK virus
IMPSTHVSTNKSYRIF

SEQ ID NO: 28269 - protein, 16 aa, BK virus
MPSTHVSTNKSYRIFF

SEQ ID NO: 28270 - protein, 16 aa, BK virus
PSTHVSTNKSYRIFFH

SEQ ID NO: 28271 - protein, 16 aa, BK virus
STHVSTNKSYRIFFHK

SEQ ID NO: 28272 - protein, 16 aa, BK virus
THVSTNKSYRIFFHKF

SEQ ID NO: 28273 - protein, 16 aa, BK virus
HVSTNKSYRIFFHKFF

SEQ ID NO: 28274 - protein, 16 aa, BK virus
VSTNKSYRIFFHKFFI

SEQ ID NO: 28275 - protein, 16 aa, BK virus
STNKSYRIFFHKFFIQ

SEQ ID NO: 28276 - protein, 16 aa, BK virus
TNKSYRIFFHKFFIQN

SEQ ID NO: 28277 - protein, 16 aa, BK virus
NKSYRIFFHKFFIQNL

SEQ ID NO: 28278 - protein, 16 aa, BK virus
KSYRIFFHKFFIQNLS

SEQ ID NO: 28279 - protein, 16 aa, BK virus
SYRIFFHKFFIQNLSF

SEQ ID NO: 28280 - protein, 16 aa, BK virus
YRIFFHKFFIQNLSFF

SEQ ID NO: 28281 - protein, 16 aa, BK virus
RIFFHKFFIQNLSFFF

SEQ ID NO: 28282 - protein, 16 aa, BK virus
IFFHKFFIQNLSFFFS

SEQ ID NO: 28283 - protein, 16 aa, BK virus
FFHKFFIQNLSFFFSS

SEQ ID NO: 28284 - protein, 16 aa, BK virus
FHKFFIQNLSFFFSSI

SEQ ID NO: 28285 - protein, 16 aa, BK virus
HKFFIQNLSFFFSSIH

SEQ ID NO: 28286 - protein, 16 aa, BK virus
KFFIQNLSFFFSSIHS

SEQ ID NO: 28287 - protein, 16 aa, BK virus
FFIQNLSFFFSSIHSK

SEQ ID NO: 28288 - protein, 16 aa, BK virus
FIQNLSFFFSSIHSKA

SEQ ID NO: 28289 - protein, 16 aa, BK virus
IQNLSFFFSSIHSKAG

SEQ ID NO: 28290 - protein, 16 aa, BK virus
QNLSFFFSSIHSKAGK

SEQ ID NO: 28291 - protein, 16 aa, BK virus
NLSFFFSSIHSKAGKG

SEQ ID NO: 28292 - protein, 16 aa, BK virus
LSFFFSSIHSKAGKGS

SEQ ID NO: 28293 - protein, 16 aa, BK virus
SFFFSSIHSKAGKGSI

SEQ ID NO: 28294 - protein, 16 aa, BK virus
FFFSSIHSKAGKGSIT

SEQ ID NO: 28295 - protein, 16 aa, BK virus
FFSSIHSKAGKGSITK

SEQ ID NO: 28296 - protein, 16 aa, BK virus
FSSIHSKAGKGSITKY

SEQ ID NO: 28297 - protein, 16 aa, BK virus
SSIHSKAGKGSITKYS

SEQ ID NO: 28298 - protein, 16 aa, BK virus
SIHSKAGKGSITKYSL

SEQ ID NO: 28299 - protein, 16 aa, BK virus
IHSKAGKGSITKYSLT

SEQ ID NO: 28300 - protein, 16 aa, BK virus
HSKAGKGSITKYSLTK

SEQ ID NO: 28301 - protein, 16 aa, BK virus
SKAGKGSITKYSLTKK

SEQ ID NO: 28302 - protein, 16 aa, BK virus
KAGKGSITKYSLTKKL

SEQ ID NO: 28303 - protein, 16 aa, BK virus
AGKGSITKYSLTKKLV

SEQ ID NO: 28304 - protein, 16 aa, BK virus
IRGKVFRVFYLSFFFG

SEQ ID NO: 28305 - protein, 16 aa, BK virus
RGKVFRVFYLSFFFGW

SEQ ID NO: 28306 - protein, 16 aa, BK virus
GKVFRVFYLSFFFGWC

SEQ ID NO: 28307 - protein, 16 aa, BK virus
VLRICCCFFITGKHIF

SEQ ID NO: 28308 - protein, 16 aa, BK virus
LRICCCFFITGKHIFM

SEQ ID NO: 28309 - protein, 16 aa, BK virus
RICCCFFITGKHIFMA

SEQ ID NO: 28310 - protein, 16 aa, BK virus
ICCCFFITGKHIFMAK

SEQ ID NO: 28311 - protein, 16 aa, BK virus
IFIPFFIKGTPPGLPL

SEQ ID NO: 28312 - protein, 16 aa, BK virus
FIPFFIKGTPPGLPLF

SEQ ID NO: 28313 - protein, 16 aa, BK virus
IPFFIKGTPPGLPLFC

SEQ ID NO: 28314 - protein, 16 aa, BK virus
PFFIKGTPPGLPLFCS

SEQ ID NO: 28315 - protein, 16 aa, BK virus
FFIKGTPPGLPLFCSI

SEQ ID NO: 28316 - protein, 16 aa, BK virus
FIKGTPPGLPLFCSIG

SEQ ID NO: 28317 - protein, 16 aa, BK virus
IKGTPPGLPLFCSIGW

SEQ ID NO: 28318 - protein, 16 aa, BK virus
KGTPPGLPLFCSIGWH

SEQ ID NO: 28319 - protein, 16 aa, BK virus
GTPPGLPLFCSIGWHL

SEQ ID NO: 28320 - protein, 16 aa, BK virus
SFRSLKGVSPIIWTHH

SEQ ID NO: 28321 - protein, 16 aa, BK virus
FRSLKGVSPIIWTHHC

SEQ ID NO: 28322 - protein, 16 aa, BK virus
RSLKGVSPIIWTHHCR

SEQ ID NO: 28323 - protein, 16 aa, BK virus
SLKGVSPIIWTHHCRV

SEQ ID NO: 28324 - protein, 16 aa, BK virus
LKGVSPIIWTHHCRVS

SEQ ID NO: 28325 - protein, 16 aa, BK virus
KGVSPIIWTHHCRVSS

SEQ ID NO: 28326 - protein, 16 aa, BK virus
GVSPIIWTHHCRVSSV

SEQ ID NO: 28327 - protein, 16 aa, BK virus
VSPIIWTHHCRVSSVR

SEQ ID NO: 28328 - protein, 16 aa, BK virus
SPIIWTHHCRVSSVRS

SEQ ID NO: 28329 - protein, 16 aa, BK virus
PIIWTHHCRVSSVRSK

SEQ ID NO: 28330 - protein, 16 aa, BK virus
IIWTHHCRVSSVRSKP

SEQ ID NO: 28331 - protein, 16 aa, BK virus
IWTHHCRVSSVRSKPN

SEQ ID NO: 28332 - protein, 16 aa, BK virus
WTHHCRVSSVRSKPNH

SEQ ID NO: 28333 - protein, 16 aa, BK virus
THHCRVSSVRSKPNHC

SEQ ID NO: 28334 - protein, 16 aa, BK virus
HHCRVSSVRSKPNHCV

SEQ ID NO: 28335 - protein, 16 aa, BK virus
HCRVSSVRSKPNHCVK

SEQ ID NO: 28336 - protein, 16 aa, BK virus
CRVSSVRSKPNHCVKQ

SEQ ID NO: 28337 - protein, 16 aa, BK virus
RVSSVRSKPNHCVKQS

SEQ ID NO: 28338 - protein, 16 aa, BK virus
VSSVRSKPNHCVKQSM

SEQ ID NO: 28339 - protein, 16 aa, BK virus
SSVRSKPNHCVKQSMQ

SEQ ID NO: 28340 - protein, 16 aa, BK virus
QSIQTKGSFLKNFLFK

SEQ ID NO: 28341 - protein, 16 aa, BK virus
SIQTKGSFLKNFLFKC

SEQ ID NO: 28342 - protein, 16 aa, BK virus
IQTKGSFLKNFLFKCL

SEQ ID NO: 28343 - protein, 16 aa, BK virus
QTKGSFLKNFLFKCLN

SEQ ID NO: 28344 - protein, 16 aa, BK virus
TKGSFLKNFLFKCLNL

SEQ ID NO: 28345 - protein, 16 aa, BK virus
KGSFLKNFLFKCLNLS

SEQ ID NO: 28346 - protein, 16 aa, BK virus
HSMQGQCTEGFLEQIG

SEQ ID NO: 28347 - protein, 16 aa, BK virus
SMQGQCTEGFLEQIGH

SEQ ID NO: 28348 - protein, 16 aa, BK virus
MQGQCTEGFLEQIGHS

SEQ ID NO: 28349 - protein, 16 aa, BK virus
QGQCTEGFLEQIGHSL

SEQ ID NO: 28350 - protein, 16 aa, BK virus
GQCTEGFLEQIGHSLQ

SEQ ID NO: 28351 - protein, 16 aa, BK virus
QCTEGFLEQIGHSLQY

SEQ ID NO: 28352 - protein, 16 aa, BK virus
CTEGFLEQIGHSLQYR

SEQ ID NO: 28353 - protein, 16 aa, BK virus
TEGFLEQIGHSLQYRV

SEQ ID NO: 28354 - protein, 16 aa, BK virus
EGFLEQIGHSLQYRVS

SEQ ID NO: 28355 - protein, 16 aa, BK virus
GFLEQIGHSLQYRVSG

SEQ ID NO: 28356 - protein, 16 aa, BK virus
FLEQIGHSLQYRVSGQ

SEQ ID NO: 28357 - protein, 16 aa, BK virus
LEQIGHSLQYRVSGQR

SEQ ID NO: 28358 - protein, 16 aa, BK virus
EQIGHSLQYRVSGQRG

SEQ ID NO: 28359 - protein, 16 aa, BK virus
QIGHSLQYRVSGQRGK

SEQ ID NO: 28360 - protein, 16 aa, BK virus
IGHSLQYRVSGQRGKS

SEQ ID NO: 28361 - protein, 16 aa, BK virus
GHSLQYRVSGQRGKSA

SEQ ID NO: 28362 - protein, 16 aa, BK virus
HSLQYRVSGQRGKSAQ

SEQ ID NO: 28363 - protein, 16 aa, BK virus
SLQYRVSGQRGKSAQT

SEQ ID NO: 28364 - protein, 16 aa, BK virus
LQYRVSGQRGKSAQTS

SEQ ID NO: 28365 - protein, 16 aa, BK virus
QYRVSGQRGKSAQTSE

SEQ ID NO: 28366 - protein, 16 aa, BK virus
YRVSGQRGKSAQTSEL

SEQ ID NO: 28367 - protein, 16 aa, BK virus
RVSGQRGKSAQTSELL

SEQ ID NO: 28368 - protein, 16 aa, BK virus
VSGQRGKSAQTSELLQ

SEQ ID NO: 28369 - protein, 16 aa, BK virus
SGQRGKSAQTSELLQV

SEQ ID NO: 28370 - protein, 16 aa, BK virus
GQRGKSAQTSELLQVP

SEQ ID NO: 28371 - protein, 16 aa, BK virus
QRGKSAQTSELLQVPK

SEQ ID NO: 28372 - protein, 16 aa, BK virus
RGKSAQTSELLQVPKS

SEQ ID NO: 28373 - protein, 16 aa, BK virus
GKSAQTSELLQVPKSG

SEQ ID NO: 28374 - protein, 16 aa, BK virus
ATFTSCSIFLYKVFIL

SEQ ID NO: 28375 - protein, 16 aa, BK virus
TFTSCSIFLYKVFILF

SEQ ID NO: 28376 - protein, 16 aa, BK virus
FTSCSIFLYKVFILFI

SEQ ID NO: 28377 - protein, 16 aa, BK virus
TSCSIFLYKVFILFIL

SEQ ID NO: 28378 - protein, 16 aa, BK virus
SCSIFLYKVFILFILS

SEQ ID NO: 28379 - protein, 16 aa, BK virus
CSIFLYKVFILFILSS

SEQ ID NO: 28380 - protein, 16 aa, BK virus
SIFLYKVFILFILSSS

SEQ ID NO: 28381 - protein, 16 aa, BK virus
IFLYKVFILFILSSSP

SEQ ID NO: 28382 - protein, 16 aa, BK virus
FLYKVFILFILSSSPP

SEQ ID NO: 28383 - protein, 16 aa, BK virus
LYKVFILFILSSSPPL

SEQ ID NO: 28384 - protein, 16 aa, BK virus
YKVFILFILSSSPPLS

SEQ ID NO: 28385 - protein, 16 aa, BK virus
KVFILFILSSSPPLSG

SEQ ID NO: 28386 - protein, 16 aa, BK virus
AFLIKGRFPQAALSRP

SEQ ID NO: 28387 - protein, 16 aa, BK virus
FLIKGRFPQAALSRPK

SEQ ID NO: 28388 - protein, 16 aa, BK virus
LIKGRFPQAALSRPKR

SEQ ID NO: 28389 - protein, 16 aa, BK virus
IKGRFPQAALSRPKRS

SEQ ID NO: 28390 - protein, 16 aa, BK virus
KGRFPQAALSRPKRSM

SEQ ID NO: 28391 - protein, 16 aa, BK virus
GRFPQAALSRPKRSMS

SEQ ID NO: 28392 - protein, 16 aa, BK virus
RFPQAALSRPKRSMSS

SEQ ID NO: 28393 - protein, 16 aa, BK virus
FPQAALSRPKRSMSSM

SEQ ID NO: 28394 - protein, 16 aa, BK virus
PQAALSRPKRSMSSMD

SEQ ID NO: 28395 - protein, 16 aa, BK virus
QAALSRPKRSMSSMDS

SEQ ID NO: 28396 - protein, 16 aa, BK virus
AALSRPKRSMSSMDSS

SEQ ID NO: 28397 - protein, 16 aa, BK virus
ALSRPKRSMSSMDSSL

SEQ ID NO: 28398 - protein, 16 aa, BK virus
LSRPKRSMSSMDSSLL

SEQ ID NO: 28399 - protein, 16 aa, BK virus
SRPKRSMSSMDSSLLR

SEQ ID NO: 28400 - protein, 16 aa, BK virus
RPKRSMSSMDSSLLRT

SEQ ID NO: 28401 - protein, 16 aa, BK virus
PKRSMSSMDSSLLRTL

SEQ ID NO: 28402 - protein, 16 aa, BK virus
KRSMSSMDSSLLRTLS

SEQ ID NO: 28403 - protein, 13 aa, BK virus
GFPQIVLLGLRKS

SEQ ID NO: 28404 - protein, 13 aa, BK virus
FPQIVLLGLRKSL

SEQ ID NO: 28405 - protein, 13 aa, BK virus
PQIVLLGLRKSLH

SEQ ID NO: 28406 - protein, 13 aa, BK virus
QIVLLGLRKSLHT

SEQ ID NO: 28407 - protein, 13 aa, BK virus
IVLLGLRKSLHTL

SEQ ID NO: 28408 - protein, 13 aa, BK virus
VLLGLRKSLHTLT

SEQ ID NO: 28409 - protein, 13 aa, BK virus
LLGLRKSLHTLTT

SEQ ID NO: 28410 - protein, 13 aa, BK virus
EKGWRQRRPRPLI

SEQ ID NO: 28411 - protein, 13 aa, BK virus
KGWRQRRPRPLIY

SEQ ID NO: 28412 - protein, 13 aa, BK virus
GWRQRRPRPLIYY

SEQ ID NO: 28413 - protein, 13 aa, BK virus
WRQRRPRPLIYYK

SEQ ID NO: 28414 - protein, 13 aa, BK virus
RQRRPRPLIYYKK

SEQ ID NO: 28415 - protein, 13 aa, BK virus
QRRPRPLIYYKKK

SEQ ID NO: 28416 - protein, 13 aa, BK virus
RRPRPLIYYKKKG

SEQ ID NO: 28417 - protein, 13 aa, BK virus
RPRPLIYYKKKGH

SEQ ID NO: 28418 - protein, 13 aa, BK virus
PRPLIYYKKKGHR

SEQ ID NO: 28419 - protein, 13 aa, BK virus
RPLIYYKKKGHRE

SEQ ID NO: 28420 - protein, 13 aa, BK virus
PLIYYKKKGHREE

SEQ ID NO: 28421 - protein, 13 aa, BK virus
LIYYKKKGHREEL

SEQ ID NO: 28422 - protein, 13 aa, BK virus
IYYKKKGHREELL

SEQ ID NO: 28423 - protein, 13 aa, BK virus
YYKKKGHREELLT

SEQ ID NO: 28424 - protein, 13 aa, BK virus
YKKKGHREELLTH

SEQ ID NO: 28425 - protein, 13 aa, BK virus
KKKGHREELLTHG

SEQ ID NO: 28426 - protein, 13 aa, BK virus
KKGHREELLTHGM

SEQ ID NO: 28427 - protein, 13 aa, BK virus
KGHREELLTHGMQ

SEQ ID NO: 28428 - protein, 13 aa, BK virus
GHREELLTHGMQP

SEQ ID NO: 28429 - protein, 13 aa, BK virus
HREELLTHGMQPN

SEQ ID NO: 28430 - protein, 13 aa, BK virus
REELLTHGMQPNH

SEQ ID NO: 28431 - protein, 13 aa, BK virus
EELLTHGMQPNHD

SEQ ID NO: 28432 - protein, 13 aa, BK virus
ELLTHGMQPNHDL

SEQ ID NO: 28433 - protein, 13 aa, BK virus
LLTHGMQPNHDLR

SEQ ID NO: 28434 - protein, 13 aa, BK virus
LTHGMQPNHDLRK

SEQ ID NO: 28435 - protein, 13 aa, BK virus
THGMQPNHDLRKE

SEQ ID NO: 28436 - protein, 13 aa, BK virus
HGMQPNHDLRKES

SEQ ID NO: 28437 - protein, 13 aa, BK virus
GMQPNHDLRKESA

SEQ ID NO: 28438 - protein, 13 aa, BK virus
LTGECSQTMTSGR

SEQ ID NO: 28439 - protein, 13 aa, BK virus
TGECSQTMTSGRK

SEQ ID NO: 28440 - protein, 13 aa, BK virus
GECSQTMTSGRKV

SEQ ID NO: 28441 - protein, 13 aa, BK virus
ECSQTMTSGRKVH

SEQ ID NO: 28442 - protein, 13 aa, BK virus
CSQTMTSGRKVHD

SEQ ID NO: 28443 - protein, 13 aa, BK virus
SQTMTSGRKVHDS

SEQ ID NO: 28444 - protein, 13 aa, BK virus
QTMTSGRKVHDSQ

SEQ ID NO: 28445 - protein, 13 aa, BK virus
TMTSGRKVHDSQG

SEQ ID NO: 28446 - protein, 13 aa, BK virus
MTSGRKVHDSQGG

SEQ ID NO: 28447 - protein, 13 aa, BK virus
TSGRKVHDSQGGA

SEQ ID NO: 28448 - protein, 13 aa, BK virus
SGRKVHDSQGGAA

SEQ ID NO: 28449 - protein, 13 aa, BK virus
GRKVHDSQGGAAY

SEQ ID NO: 28450 - protein, 13 aa, BK virus
RKVHDSQGGAAYP

SEQ ID NO: 28451 - protein, 13 aa, BK virus
KVHDSQGGAAYPW

SEQ ID NO: 28452 - protein, 13 aa, BK virus
VHDSQGGAAYPWN

SEQ ID NO: 28453 - protein, 13 aa, BK virus
HDSQGGAAYPWNA

SEQ ID NO: 28454 - protein, 13 aa, BK virus
DSQGGAAYPWNAA

SEQ ID NO: 28455 - protein, 13 aa, BK virus
SQGGAAYPWNAAK

SEQ ID NO: 28456 - protein, 13 aa, BK virus
QGGAAYPWNAAKP

SEQ ID NO: 28457 - protein, 13 aa, BK virus
PQEGKCMTDMFCE

SEQ ID NO: 28458 - protein, 13 aa, BK virus
QEGKCMTDMFCEP

SEQ ID NO: 28459 - protein, 13 aa, BK virus
EGKCMTDMFCEPR

SEQ ID NO: 28460 - protein, 13 aa, BK virus
GKCMTDMFCEPRN

SEQ ID NO: 28461 - protein, 13 aa, BK virus
KCMTDMFCEPRNL

SEQ ID NO: 28462 - protein, 13 aa, BK virus
CMTDMFCEPRNLG

SEQ ID NO: 28463 - protein, 13 aa, BK virus
MTDMFCEPRNLGL

SEQ ID NO: 28464 - protein, 13 aa, BK virus
TDMFCEPRNLGLV

SEQ ID NO: 28465 - protein, 13 aa, BK virus
DMFCEPRNLGLVP

SEQ ID NO: 28466 - protein, 13 aa, BK virus
MFCEPRNLGLVPS

SEQ ID NO: 28467 - protein, 13 aa, BK virus
TGQRPWFCASCHD

SEQ ID NO: 28468 - protein, 13 aa, BK virus
GQRPWFCASCHDK

SEQ ID NO: 28469 - protein, 13 aa, BK virus
QRPWFCASCHDKL

SEQ ID NO: 28470 - protein, 13 aa, BK virus
RPWFCASCHDKLQ

SEQ ID NO: 28471 - protein, 13 aa, BK virus
KLVKPGLEQKKEL

SEQ ID NO: 28472 - protein, 13 aa, BK virus
LVKPGLEQKKELR

SEQ ID NO: 28473 - protein, 13 aa, BK virus
VKPGLEQKKELRG

SEQ ID NO: 28474 - protein, 13 aa, BK virus
KPGLEQKKELRGF

SEQ ID NO: 28475 - protein, 13 aa, BK virus
PGLEQKKELRGFL

SEQ ID NO: 28476 - protein, 13 aa, BK virus
GLEQKKELRGFLF

SEQ ID NO: 28477 - protein, 13 aa, BK virus
LEQKKELRGFLFL

SEQ ID NO: 28478 - protein, 13 aa, BK virus
EQKKELRGFLFLF

SEQ ID NO: 28479 - protein, 13 aa, BK virus
VIPFFLYFQVHGC

SEQ ID NO: 28480 - protein, 13 aa, BK virus
IPFFLYFQVHGCC

SEQ ID NO: 28481 - protein, 13 aa, BK virus
PFFLYFQVHGCCS

SEQ ID NO: 28482 - protein, 13 aa, BK virus
FFLYFQVHGCCSS

SEQ ID NO: 28483 - protein, 13 aa, BK virus
FLYFQVHGCCSST

SEQ ID NO: 28484 - protein, 13 aa, BK virus
LYFQVHGCCSSTF

SEQ ID NO: 28485 - protein, 13 aa, BK virus
YFQVHGCCSSTFG

SEQ ID NO: 28486 - protein, 13 aa, BK virus
FQVHGCCSSTFGG

SEQ ID NO: 28487 - protein, 13 aa, BK virus
QVHGCCSSTFGGP

SEQ ID NO: 28488 - protein, 13 aa, BK virus
VHGCCSSTFGGPS

SEQ ID NO: 28489 - protein, 13 aa, BK virus
HGCCSSTFGGPSC

SEQ ID NO: 28490 - protein, 13 aa, BK virus
GCCSSTFGGPSCQ

SEQ ID NO: 28491 - protein, 13 aa, BK virus
CCSSTFGGPSCQC

SEQ ID NO: 28492 - protein, 13 aa, BK virus
CSSTFGGPSCQCI

SEQ ID NO: 28493 - protein, 13 aa, BK virus
NCCWGGCCCYRSS

SEQ ID NO: 28494 - protein, 13 aa, BK virus
CCWGGCCCYRSSN

SEQ ID NO: 28495 - protein, 13 aa, BK virus
CWGGCCCYRSSNC

SEQ ID NO: 28496 - protein, 13 aa, BK virus
WGGCCCYRSSNCI

SEQ ID NO: 28497 - protein, 13 aa, BK virus
GGCCCYRSSNCIP

SEQ ID NO: 28498 - protein, 13 aa, BK virus
GCCCYRSSNCIPC

SEQ ID NO: 28499 - protein, 13 aa, BK virus
CCCYRSSNCIPCY

SEQ ID NO: 28500 - protein, 13 aa, BK virus
CCYRSSNCIPCYC

SEQ ID NO: 28501 - protein, 13 aa, BK virus
CYRSSNCIPCYCR

SEQ ID NO: 28502 - protein, 13 aa, BK virus
YRSSNCIPCYCRG

SEQ ID NO: 28503 - protein, 13 aa, BK virus
RSSNCIPCYCRGH

SEQ ID NO: 28504 - protein, 13 aa, BK virus
SSNCIPCYCRGHN

SEQ ID NO: 28505 - protein, 13 aa, BK virus
SNCIPCYCRGHNK

SEQ ID NO: 28506 - protein, 13 aa, BK virus
NCIPCYCRGHNKY

SEQ ID NO: 28507 - protein, 13 aa, BK virus
CIPCYCRGHNKYL

SEQ ID NO: 28508 - protein, 13 aa, BK virus
IPCYCRGHNKYLR

SEQ ID NO: 28509 - protein, 13 aa, BK virus
PCYCRGHNKYLRG

SEQ ID NO: 28510 - protein, 13 aa, BK virus
CYCRGHNKYLRGY

SEQ ID NO: 28511 - protein, 13 aa, BK virus
YCRGHNKYLRGYS

SEQ ID NO: 28512 - protein, 13 aa, BK virus
CRGHNKYLRGYSC

SEQ ID NO: 28513 - protein, 13 aa, BK virus
RGHNKYLRGYSCY

SEQ ID NO: 28514 - protein, 13 aa, BK virus
GHNKYLRGYSCYR

SEQ ID NO: 28515 - protein, 13 aa, BK virus
HNKYLRGYSCYRP

SEQ ID NO: 28516 - protein, 13 aa, BK virus
NKYLRGYSCYRPN

SEQ ID NO: 28517 - protein, 13 aa, BK virus
KYLRGYSCYRPNS

SEQ ID NO: 28518 - protein, 13 aa, BK virus
YLRGYSCYRPNSS

SEQ ID NO: 28519 - protein, 13 aa, BK virus
LRGYSCYRPNSSN

SEQ ID NO: 28520 - protein, 13 aa, BK virus
RGYSCYRPNSSNI

SEQ ID NO: 28521 - protein, 13 aa, BK virus
GYSCYRPNSSNIC

SEQ ID NO: 28522 - protein, 13 aa, BK virus
YSCYRPNSSNICC

SEQ ID NO: 28523 - protein, 13 aa, BK virus
SCYRPNSSNICCN

SEQ ID NO: 28524 - protein, 13 aa, BK virus
CYRPNSSNICCNC

SEQ ID NO: 28525 - protein, 13 aa, BK virus
YRPNSSNICCNCW

SEQ ID NO: 28526 - protein, 13 aa, BK virus
RPNSSNICCNCWC

SEQ ID NO: 28527 - protein, 13 aa, BK virus
PNSSNICCNCWCS

SEQ ID NO: 28528 - protein, 13 aa, BK virus
NSSNICCNCWCSW

SEQ ID NO: 28529 - protein, 13 aa, BK virus
SSNICCNCWCSWG

SEQ ID NO: 28530 - protein, 13 aa, BK virus
SNICCNCWCSWGY

SEQ ID NO: 28531 - protein, 13 aa, BK virus
NICCNCWCSWGYC

SEQ ID NO: 28532 - protein, 13 aa, BK virus
ICCNCWCSWGYCW

SEQ ID NO: 28533 - protein, 13 aa, BK virus
CCNCWCSWGYCWV

SEQ ID NO: 28534 - protein, 13 aa, BK virus
CNCWCSWGYCWVC

SEQ ID NO: 28535 - protein, 13 aa, BK virus
NCWCSWGYCWVCC

SEQ ID NO: 28536 - protein, 13 aa, BK virus
CWCSWGYCWVCCF

SEQ ID NO: 28537 - protein, 13 aa, BK virus
WCSWGYCWVCCFN

SEQ ID NO: 28538 - protein, 13 aa, BK virus
CSWGYCWVCCFNS

SEQ ID NO: 28539 - protein, 13 aa, BK virus
SWGYCWVCCFNSN

SEQ ID NO: 28540 - protein, 13 aa, BK virus
WGYCWVCCFNSNC

SEQ ID NO: 28541 - protein, 13 aa, BK virus
LGSQSFHCRPLSA

SEQ ID NO: 28542 - protein, 13 aa, BK virus
GSQSFHCRPLSAI

SEQ ID NO: 28543 - protein, 13 aa, BK virus
SQSFHCRPLSAIR

SEQ ID NO: 28544 - protein, 13 aa, BK virus
QSFHCRPLSAIRH

SEQ ID NO: 28545 - protein, 13 aa, BK virus
SFHCRPLSAIRHG

SEQ ID NO: 28546 - protein, 13 aa, BK virus
FHCRPLSAIRHGF

SEQ ID NO: 28547 - protein, 13 aa, BK virus
HCRPLSAIRHGFG

SEQ ID NO: 28548 - protein, 13 aa, BK virus
CRPLSAIRHGFGI

SEQ ID NO: 28549 - protein, 13 aa, BK virus
RPLSAIRHGFGIV

SEQ ID NO: 28550 - protein, 13 aa, BK virus
ALGSFFVCYYFPG

SEQ ID NO: 28551 - protein, 13 aa, BK virus
LGSFFVCYYFPGF

SEQ ID NO: 28552 - protein, 13 aa, BK virus
GSFFVCYYFPGFV

SEQ ID NO: 28553 - protein, 13 aa, BK virus
SFFVCYYFPGFVA

SEQ ID NO: 28554 - protein, 13 aa, BK virus
FFVCYYFPGFVAC

SEQ ID NO: 28555 - protein, 13 aa, BK virus
FVCYYFPGFVACY

SEQ ID NO: 28556 - protein, 13 aa, BK virus
YTFYNLTGIAEKN

SEQ ID NO: 28557 - protein, 13 aa, BK virus
TFYNLTGIAEKNR

SEQ ID NO: 28558 - protein, 13 aa, BK virus
FYNLTGIAEKNRK

SEQ ID NO: 28559 - protein, 13 aa, BK virus
YNLTGIAEKNRKI

SEQ ID NO: 28560 - protein, 13 aa, BK virus
NLTGIAEKNRKIF

SEQ ID NO: 28561 - protein, 13 aa, BK virus
IFGGNYLDNCKCP

SEQ ID NO: 28562 - protein, 13 aa, BK virus
FGGNYLDNCKCPY

SEQ ID NO: 28563 - protein, 13 aa, BK virus
GGNYLDNCKCPYK

SEQ ID NO: 28564 - protein, 13 aa, BK virus
GNYLDNCKCPYKL

SEQ ID NO: 28565 - protein, 13 aa, BK virus
NYLDNCKCPYKLL

SEQ ID NO: 28566 - protein, 13 aa, BK virus
QYRRSYTKNGLKK

SEQ ID NO: 28567 - protein, 13 aa, BK virus
YRRSYTKNGLKKS

SEQ ID NO: 28568 - protein, 13 aa, BK virus
RRSYTKNGLKKST

SEQ ID NO: 28569 - protein, 13 aa, BK virus
RSYTKNGLKKSTK

SEQ ID NO: 28570 - protein, 13 aa, BK virus
SYTKNGLKKSTKC

SEQ ID NO: 28571 - protein, 13 aa, BK virus
YTKNGLKKSTKCT

SEQ ID NO: 28572 - protein, 13 aa, BK virus
TKNGLKKSTKCTF

SEQ ID NO: 28573 - protein, 13 aa, BK virus
KNGLKKSTKCTFR

SEQ ID NO: 28574 - protein, 13 aa, BK virus
NGLKKSTKCTFRR

SEQ ID NO: 28575 - protein, 13 aa, BK virus
GLKKSTKCTFRRV

SEQ ID NO: 28576 - protein, 13 aa, BK virus
LKKSTKCTFRRVY

SEQ ID NO: 28577 - protein, 13 aa, BK virus
KKSTKCTFRRVYR

SEQ ID NO: 28578 - protein, 13 aa, BK virus
KSTKCTFRRVYRK

SEQ ID NO: 28579 - protein, 13 aa, BK virus
STKCTFRRVYRKN

SEQ ID NO: 28580 - protein, 13 aa, BK virus
TKCTFRRVYRKNY

SEQ ID NO: 28581 - protein, 13 aa, BK virus
KCTFRRVYRKNYC

SEQ ID NO: 28582 - protein, 13 aa, BK virus
CTFRRVYRKNYCP

SEQ ID NO: 28583 - protein, 13 aa, BK virus
TFRRVYRKNYCPR

SEQ ID NO: 28584 - protein, 13 aa, BK virus
FRRVYRKNYCPRR

SEQ ID NO: 28585 - protein, 13 aa, BK virus
RRVYRKNYCPRRC

SEQ ID NO: 28586 - protein, 13 aa, BK virus
SKNCSSMDVAFTS

SEQ ID NO: 28587 - protein, 13 aa, BK virus
KNCSSMDVAFTSR

SEQ ID NO: 28588 - protein, 13 aa, BK virus
NCSSMDVAFTSRP

SEQ ID NO: 28589 - protein, 13 aa, BK virus
CSSMDVAFTSRPV

SEQ ID NO: 28590 - protein, 13 aa, BK virus
SSMDVAFTSRPVR

SEQ ID NO: 28591 - protein, 13 aa, BK virus
SMDVAFTSRPVRD

SEQ ID NO: 28592 - protein, 13 aa, BK virus
MDVAFTSRPVRDC

SEQ ID NO: 28593 - protein, 13 aa, BK virus
DVAFTSRPVRDCN

SEQ ID NO: 28594 - protein, 13 aa, BK virus
VAFTSRPVRDCNT

SEQ ID NO: 28595 - protein, 13 aa, BK virus
AFTSRPVRDCNTC

SEQ ID NO: 28596 - protein, 13 aa, BK virus
FTSRPVRDCNTCS

SEQ ID NO: 28597 - protein, 13 aa, BK virus
RWPQPKEKESVQG

SEQ ID NO: 28598 - protein, 13 aa, BK virus
WPQPKEKESVQGQ

SEQ ID NO: 28599 - protein, 13 aa, BK virus
PQPKEKESVQGQL

SEQ ID NO: 28600 - protein, 13 aa, BK virus
QPKEKESVQGQLP

SEQ ID NO: 28601 - protein, 13 aa, BK virus
PKEKESVQGQLPK

SEQ ID NO: 28602 - protein, 13 aa, BK virus
KEKESVQGQLPKS

SEQ ID NO: 28603 - protein, 13 aa, BK virus
EKESVQGQLPKSQ

SEQ ID NO: 28604 - protein, 13 aa, BK virus
KESVQGQLPKSQR

SEQ ID NO: 28605 - protein, 13 aa, BK virus
ESVQGQLPKSQRN

SEQ ID NO: 28606 - protein, 13 aa, BK virus
SVQGQLPKSQRNP

SEQ ID NO: 28607 - protein, 13 aa, BK virus
VQGQLPKSQRNPC

SEQ ID NO: 28608 - protein, 13 aa, BK virus
QGQLPKSQRNPCK

SEQ ID NO: 28609 - protein, 13 aa, BK virus
GQLPKSQRNPCKC

SEQ ID NO: 28610 - protein, 13 aa, BK virus
QLPKSQRNPCKCQ

SEQ ID NO: 28611 - protein, 13 aa, BK virus
LPKSQRNPCKCQN

SEQ ID NO: 28612 - protein, 13 aa, BK virus
PKSQRNPCKCQNY

SEQ ID NO: 28613 - protein, 13 aa, BK virus
TQKWGIQMKTLGA

SEQ ID NO: 28614 - protein, 13 aa, BK virus
QKWGIQMKTLGAL

SEQ ID NO: 28615 - protein, 13 aa, BK virus
KWGIQMKTLGALV

SEQ ID NO: 28616 - protein, 13 aa, BK virus
VLKMTLAVIAQRE

SEQ ID NO: 28617 - protein, 13 aa, BK virus
LKMTLAVIAQREK

SEQ ID NO: 28618 - protein, 13 aa, BK virus
KMTLAVIAQREKC

SEQ ID NO: 28619 - protein, 13 aa, BK virus
MTLAVIAQREKCF

SEQ ID NO: 28620 - protein, 13 aa, BK virus
TLAVIAQREKCFP

SEQ ID NO: 28621 - protein, 13 aa, BK virus
LAVIAQREKCFPV

SEQ ID NO: 28622 - protein, 13 aa, BK virus
AVIAQREKCFPVT

SEQ ID NO: 28623 - protein, 13 aa, BK virus
VIAQREKCFPVTA

SEQ ID NO: 28624 - protein, 13 aa, BK virus
IAQREKCFPVTAQ

SEQ ID NO: 28625 - protein, 13 aa, BK virus
AQREKCFPVTAQQ

SEQ ID NO: 28626 - protein, 13 aa, BK virus
QREKCFPVTAQQE

SEQ ID NO: 28627 - protein, 13 aa, BK virus
REKCFPVTAQQEF

SEQ ID NO: 28628 - protein, 13 aa, BK virus
EKCFPVTAQQEFP

SEQ ID NO: 28629 - protein, 13 aa, BK virus
KCFPVTAQQEFPS

SEQ ID NO: 28630 - protein, 13 aa, BK virus
CFPVTAQQEFPSP

SEQ ID NO: 28631 - protein, 13 aa, BK virus
FPVTAQQEFPSPI

SEQ ID NO: 28632 - protein, 13 aa, BK virus
LACLTFMQGHKKC

SEQ ID NO: 28633 - protein, 13 aa, BK virus
ACLTFMQGHKKCM

SEQ ID NO: 28634 - protein, 13 aa, BK virus
CLTFMQGHKKCMS

SEQ ID NO: 28635 - protein, 13 aa, BK virus
LTFMQGHKKCMSM

SEQ ID NO: 28636 - protein, 13 aa, BK virus
TFMQGHKKCMSMV

SEQ ID NO: 28637 - protein, 13 aa, BK virus
FMQGHKKCMSMVE

SEQ ID NO: 28638 - protein, 13 aa, BK virus
MQGHKKCMSMVEE

SEQ ID NO: 28639 - protein, 13 aa, BK virus
QGHKKCMSMVEEN

SEQ ID NO: 28640 - protein, 13 aa, BK virus
GHKKCMSMVEENL

SEQ ID NO: 28641 - protein, 13 aa, BK virus
HKKCMSMVEENLF

SEQ ID NO: 28642 - protein, 13 aa, BK virus
KKCMSMVEENLFK

SEQ ID NO: 28643 - protein, 13 aa, BK virus
KCMSMVEENLFKA

SEQ ID NO: 28644 - protein, 13 aa, BK virus
CMSMVEENLFKAV

SEQ ID NO: 28645 - protein, 13 aa, BK virus
MSMVEENLFKAVI

SEQ ID NO: 28646 - protein, 13 aa, BK virus
SMVEENLFKAVIS

SEQ ID NO: 28647 - protein, 13 aa, BK virus
MVEENLFKAVIST

SEQ ID NO: 28648 - protein, 13 aa, BK virus
VEENLFKAVISTS

SEQ ID NO: 28649 - protein, 13 aa, BK virus
EENLFKAVISTSL

SEQ ID NO: 28650 - protein, 13 aa, BK virus
ENLFKAVISTSLL

SEQ ID NO: 28651 - protein, 13 aa, BK virus
ILTIRPIWTKTML

SEQ ID NO: 28652 - protein, 13 aa, BK virus
LTIRPIWTKTMLI

SEQ ID NO: 28653 - protein, 13 aa, BK virus
TIRPIWTKTMLIQ

SEQ ID NO: 28654 - protein, 13 aa, BK virus
IRPIWTKTMLIQL

SEQ ID NO: 28655 - protein, 13 aa, BK virus
RPIWTKTMLIQLS

SEQ ID NO: 28656 - protein, 13 aa, BK virus
PIWTKTMLIQLSA

SEQ ID NO: 28657 - protein, 13 aa, BK virus
IWTKTMLIQLSAG

SEQ ID NO: 28658 - protein, 13 aa, BK virus
WTKTMLIQLSAGY

SEQ ID NO: 28659 - protein, 13 aa, BK virus
TKTMLIQLSAGYL

SEQ ID NO: 28660 - protein, 13 aa, BK virus
KTMLIQLSAGYLI

SEQ ID NO: 28661 - protein, 13 aa, BK virus
TMLIQLSAGYLIP

SEQ ID NO: 28662 - protein, 13 aa, BK virus
MLIQLSAGYLIPV

SEQ ID NO: 28663 - protein, 13 aa, BK virus
LIQLSAGYLIPVE

SEQ ID NO: 28664 - protein, 13 aa, BK virus
IQLSAGYLIPVEM

SEQ ID NO: 28665 - protein, 13 aa, BK virus
QLSAGYLIPVEMK

SEQ ID NO: 28666 - protein, 13 aa, BK virus
LSAGYLIPVEMKM

SEQ ID NO: 28667 - protein, 13 aa, BK virus
SAGYLIPVEMKML

SEQ ID NO: 28668 - protein, 13 aa, BK virus
AGYLIPVEMKMLG

SEQ ID NO: 28669 - protein, 13 aa, BK virus
GYLIPVEMKMLGI

SEQ ID NO: 28670 - protein, 13 aa, BK virus
YLIPVEMKMLGIL

SEQ ID NO: 28671 - protein, 13 aa, BK virus
LIPVEMKMLGILG

SEQ ID NO: 28672 - protein, 13 aa, BK virus
IPVEMKMLGILGL

SEQ ID NO: 28673 - protein, 13 aa, BK virus
PVEMKMLGILGLS

SEQ ID NO: 28674 - protein, 13 aa, BK virus
VEMKMLGILGLSQ

SEQ ID NO: 28675 - protein, 13 aa, BK virus
EMKMLGILGLSQE

SEQ ID NO: 28676 - protein, 13 aa, BK virus
MKMLGILGLSQEG

SEQ ID NO: 28677 - protein, 13 aa, BK virus
KMLGILGLSQEGK

SEQ ID NO: 28678 - protein, 13 aa, BK virus
MLGILGLSQEGKM

SEQ ID NO: 28679 - protein, 13 aa, BK virus
LGILGLSQEGKMF

SEQ ID NO: 28680 - protein, 13 aa, BK virus
GILGLSQEGKMFP

SEQ ID NO: 28681 - protein, 13 aa, BK virus
ILGLSQEGKMFPQ

SEQ ID NO: 28682 - protein, 13 aa, BK virus
LGLSQEGKMFPQY

SEQ ID NO: 28683 - protein, 13 aa, BK virus
GLSQEGKMFPQYF

SEQ ID NO: 28684 - protein, 13 aa, BK virus
LSQEGKMFPQYFM

SEQ ID NO: 28685 - protein, 13 aa, BK virus
MNRVWGLFVKLIA

SEQ ID NO: 28686 - protein, 13 aa, BK virus
NRVWGLFVKLIAC

SEQ ID NO: 28687 - protein, 13 aa, BK virus
RVWGLFVKLIACM

SEQ ID NO: 28688 - protein, 13 aa, BK virus
VWGLFVKLIACMF

SEQ ID NO: 28689 - protein, 13 aa, BK virus
WGLFVKLIACMFQ

SEQ ID NO: 28690 - protein, 13 aa, BK virus
GLFVKLIACMFQL

SEQ ID NO: 28691 - protein, 13 aa, BK virus
LFVKLIACMFQLL

SEQ ID NO: 28692 - protein, 13 aa, BK virus
FVKLIACMFQLLI

SEQ ID NO: 28693 - protein, 13 aa, BK virus
VKLIACMFQLLIF

SEQ ID NO: 28694 - protein, 13 aa, BK virus
KLIACMFQLLIFV

SEQ ID NO: 28695 - protein, 13 aa, BK virus
LIACMFQLLIFVA

SEQ ID NO: 28696 - protein, 13 aa, BK virus
IACMFQLLIFVAC

SEQ ID NO: 28697 - protein, 13 aa, BK virus
ACMFQLLIFVACL

SEQ ID NO: 28698 - protein, 13 aa, BK virus
CMFQLLIFVACLL

SEQ ID NO: 28699 - protein, 13 aa, BK virus
MFQLLIFVACLLT

SEQ ID NO: 28700 - protein, 13 aa, BK virus
FQLLIFVACLLTA

SEQ ID NO: 28701 - protein, 13 aa, BK virus
QLLIFVACLLTAL

SEQ ID NO: 28702 - protein, 13 aa, BK virus
LLIFVACLLTALE

SEQ ID NO: 28703 - protein, 13 aa, BK virus
LIFVACLLTALEH

SEQ ID NO: 28704 - protein, 13 aa, BK virus
IFVACLLTALEHN

SEQ ID NO: 28705 - protein, 13 aa, BK virus
FVACLLTALEHNS

SEQ ID NO: 28706 - protein, 13 aa, BK virus
VACLLTALEHNSG

SEQ ID NO: 28707 - protein, 13 aa, BK virus
ACLLTALEHNSGE

SEQ ID NO: 28708 - protein, 13 aa, BK virus
CLLTALEHNSGEA

SEQ ID NO: 28709 - protein, 13 aa, BK virus
LLTALEHNSGEAL

SEQ ID NO: 28710 - protein, 13 aa, BK virus
LTALEHNSGEALQ

SEQ ID NO: 28711 - protein, 13 aa, BK virus
TALEHNSGEALQD

SEQ ID NO: 28712 - protein, 13 aa, BK virus
ALEHNSGEALQDI

SEQ ID NO: 28713 - protein, 13 aa, BK virus
LEHNSGEALQDIL

SEQ ID NO: 28714 - protein, 13 aa, BK virus
EHNSGEALQDILR

SEQ ID NO: 28715 - protein, 13 aa, BK virus
HNSGEALQDILRS

SEQ ID NO: 28716 - protein, 13 aa, BK virus
NSGEALQDILRSA

SEQ ID NO: 28717 - protein, 13 aa, BK virus
TGEPREWMGSLCM

SEQ ID NO: 28718 - protein, 13 aa, BK virus
GEPREWMGSLCMV

SEQ ID NO: 28719 - protein, 13 aa, BK virus
EPREWMGSLCMVW

SEQ ID NO: 28720 - protein, 13 aa, BK virus
PREWMGSLCMVWN

SEQ ID NO: 28721 - protein, 13 aa, BK virus
REWMGSLCMVWNP

SEQ ID NO: 28722 - protein, 13 aa, BK virus
EWMGSLCMVWNPR

SEQ ID NO: 28723 - protein, 13 aa, BK virus
KRLGCLMAQKDFQ

SEQ ID NO: 28724 - protein, 13 aa, BK virus
RLGCLMAQKDFQG

SEQ ID NO: 28725 - protein, 13 aa, BK virus
LGCLMAQKDFQGT

SEQ ID NO: 28726 - protein, 13 aa, BK virus
GCLMAQKDFQGTQ

SEQ ID NO: 28727 - protein, 13 aa, BK virus
CLMAQKDFQGTQI

SEQ ID NO: 28728 - protein, 13 aa, BK virus
DILTNRDNCKPKC

SEQ ID NO: 28729 - protein, 13 aa, BK virus
ILTNRDNCKPKCF

SEQ ID NO: 28730 - protein, 13 aa, BK virus
LTNRDNCKPKCFK

SEQ ID NO: 28731 - protein, 13 aa, BK virus
TNRDNCKPKCFKQ

SEQ ID NO: 28732 - protein, 13 aa, BK virus
NRDNCKPKCFKQV

SEQ ID NO: 28733 - protein, 13 aa, BK virus
RDNCKPKCFKQVL

SEQ ID NO: 28734 - protein, 13 aa, BK virus
DNCKPKCFKQVLL

SEQ ID NO: 28735 - protein, 13 aa, BK virus
NCKPKCFKQVLLL

SEQ ID NO: 28736 - protein, 13 aa, BK virus
CKPKCFKQVLLLY

SEQ ID NO: 28737 - protein, 13 aa, BK virus
KPKCFKQVLLLYI

SEQ ID NO: 28738 - protein, 13 aa, BK virus
PKCFKQVLLLYIY

SEQ ID NO: 28739 - protein, 13 aa, BK virus
KCFKQVLLLYIYI

SEQ ID NO: 28740 - protein, 13 aa, BK virus
MLLLYKPLLSLCY

SEQ ID NO: 28741 - protein, 13 aa, BK virus
LLLYKPLLSLCYF

SEQ ID NO: 28742 - protein, 13 aa, BK virus
LLYKPLLSLCYFG

SEQ ID NO: 28743 - protein, 13 aa, BK virus
LYKPLLSLCYFGG

SEQ ID NO: 28744 - protein, 13 aa, BK virus
YKPLLSLCYFGGG

SEQ ID NO: 28745 - protein, 13 aa, BK virus
KPLLSLCYFGGGV

SEQ ID NO: 28746 - protein, 13 aa, BK virus
PLLSLCYFGGGVL

SEQ ID NO: 28747 - protein, 13 aa, BK virus
LLSLCYFGGGVLG

SEQ ID NO: 28748 - protein, 13 aa, BK virus
LSLCYFGGGVLGL

SEQ ID NO: 28749 - protein, 13 aa, BK virus
SLCYFGGGVLGLL

SEQ ID NO: 28750 - protein, 13 aa, BK virus
LCYFGGGVLGLLK

SEQ ID NO: 28751 - protein, 13 aa, BK virus
CYFGGGVLGLLKH

SEQ ID NO: 28752 - protein, 13 aa, BK virus
LWGSDLWESSAGA

SEQ ID NO: 28753 - protein, 13 aa, BK virus
WGSDLWESSAGAE

SEQ ID NO: 28754 - protein, 13 aa, BK virus
GSDLWESSAGAEV

SEQ ID NO: 28755 - protein, 13 aa, BK virus
SDLWESSAGAEVS

SEQ ID NO: 28756 - protein, 13 aa, BK virus
DLWESSAGAEVSE

SEQ ID NO: 28757 - protein, 13 aa, BK virus
LWESSAGAEVSET

SEQ ID NO: 28758 - protein, 13 aa, BK virus
WESSAGAEVSETW

SEQ ID NO: 28759 - protein, 13 aa, BK virus
ESSAGAEVSETWE

SEQ ID NO: 28760 - protein, 13 aa, BK virus
SSAGAEVSETWEE

SEQ ID NO: 28761 - protein, 13 aa, BK virus
SAGAEVSETWEEH

SEQ ID NO: 28762 - protein, 13 aa, BK virus
AGAEVSETWEEHC

SEQ ID NO: 28763 - protein, 13 aa, BK virus
GAEVSETWEEHCD

SEQ ID NO: 28764 - protein, 13 aa, BK virus
AEVSETWEEHCDW

SEQ ID NO: 28765 - protein, 13 aa, BK virus
EVSETWEEHCDWD

SEQ ID NO: 28766 - protein, 13 aa, BK virus
VSETWEEHCDWDS

SEQ ID NO: 28767 - protein, 13 aa, BK virus
SETWEEHCDWDSV

SEQ ID NO: 28768 - protein, 13 aa, BK virus
ETWEEHCDWDSVL

SEQ ID NO: 28769 - protein, 13 aa, BK virus
TWEEHCDWDSVLD

SEQ ID NO: 28770 - protein, 13 aa, BK virus
WEEHCDWDSVLDP

SEQ ID NO: 28771 - protein, 13 aa, BK virus
EEHCDWDSVLDPC

SEQ ID NO: 28772 - protein, 13 aa, BK virus
EHCDWDSVLDPCP

SEQ ID NO: 28773 - protein, 13 aa, BK virus
HCDWDSVLDPCPE

SEQ ID NO: 28774 - protein, 13 aa, BK virus
CDWDSVLDPCPES

SEQ ID NO: 28775 - protein, 13 aa, BK virus
DWDSVLDPCPESS

SEQ ID NO: 28776 - protein, 13 aa, BK virus
WDSVLDPCPESSV

SEQ ID NO: 28777 - protein, 13 aa, BK virus
DSVLDPCPESSVS

SEQ ID NO: 28778 - protein, 13 aa, BK virus
SVLDPCPESSVSE

SEQ ID NO: 28779 - protein, 13 aa, BK virus
VLDPCPESSVSES

SEQ ID NO: 28780 - protein, 13 aa, BK virus
LDPCPESSVSESS

SEQ ID NO: 28781 - protein, 13 aa, BK virus
DPCPESSVSESSS

SEQ ID NO: 28782 - protein, 13 aa, BK virus
PCPESSVSESSSL

SEQ ID NO: 28783 - protein, 13 aa, BK virus
CPESSVSESSSLV

SEQ ID NO: 28784 - protein, 13 aa, BK virus
PESSVSESSSLVI

SEQ ID NO: 28785 - protein, 13 aa, BK virus
ESSVSESSSLVIS

SEQ ID NO: 28786 - protein, 13 aa, BK virus
SSVSESSSLVISR

SEQ ID NO: 28787 - protein, 13 aa, BK virus
SVSESSSLVISRI

SEQ ID NO: 28788 - protein, 13 aa, BK virus
VSESSSLVISRIH

SEQ ID NO: 28789 - protein, 13 aa, BK virus
SESSSLVISRIHF

SEQ ID NO: 28790 - protein, 13 aa, BK virus
ESSSLVISRIHFP

SEQ ID NO: 28791 - protein, 13 aa, BK virus
SSSLVISRIHFPM

SEQ ID NO: 28792 - protein, 13 aa, BK virus
SSLVISRIHFPMH

SEQ ID NO: 28793 - protein, 13 aa, BK virus
SLVISRIHFPMHI

SEQ ID NO: 28794 - protein, 13 aa, BK virus
LVISRIHFPMHIL

SEQ ID NO: 28795 - protein, 13 aa, BK virus
VISRIHFPMHILY

SEQ ID NO: 28796 - protein, 13 aa, BK virus
ISRIHFPMHILYF

SEQ ID NO: 28797 - protein, 13 aa, BK virus
SRIHFPMHILYFI

SEQ ID NO: 28798 - protein, 13 aa, BK virus
RIHFPMHILYFIL

SEQ ID NO: 28799 - protein, 13 aa, BK virus
IHFPMHILYFILE

SEQ ID NO: 28800 - protein, 13 aa, BK virus
HFPMHILYFILEK

SEQ ID NO: 28801 - protein, 13 aa, BK virus
FPMHILYFILEKV

SEQ ID NO: 28802 - protein, 13 aa, BK virus
PMHILYFILEKVY

SEQ ID NO: 28803 - protein, 13 aa, BK virus
MHILYFILEKVYI

SEQ ID NO: 28804 - protein, 13 aa, BK virus
HILYFILEKVYIL

SEQ ID NO: 28805 - protein, 13 aa, BK virus
ILYFILEKVYILI

SEQ ID NO: 28806 - protein, 13 aa, BK virus
LYFILEKVYILIS

SEQ ID NO: 28807 - protein, 13 aa, BK virus
YFILEKVYILISE

SEQ ID NO: 28808 - protein, 13 aa, BK virus
FILEKVYILISES

SEQ ID NO: 28809 - protein, 13 aa, BK virus
ILEKVYILISESS

SEQ ID NO: 28810 - protein, 13 aa, BK virus
LEKVYILISESSL

SEQ ID NO: 28811 - protein, 13 aa, BK virus
EKVYILISESSLS

SEQ ID NO: 28812 - protein, 13 aa, BK virus
KVYILISESSLSF

SEQ ID NO: 28813 - protein, 13 aa, BK virus
VYILISESSLSFH

SEQ ID NO: 28814 - protein, 13 aa, BK virus
YILISESSLSFHS

SEQ ID NO: 28815 - protein, 13 aa, BK virus
ILISESSLSFHST

SEQ ID NO: 28816 - protein, 13 aa, BK virus
LISESSLSFHSTI

SEQ ID NO: 28817 - protein, 13 aa, BK virus
ISESSLSFHSTIL

SEQ ID NO: 28818 - protein, 13 aa, BK virus
SESSLSFHSTILD

SEQ ID NO: 28819 - protein, 13 aa, BK virus
ESSLSFHSTILDC

SEQ ID NO: 28820 - protein, 13 aa, BK virus
SSLSFHSTILDCI

SEQ ID NO: 28821 - protein, 13 aa, BK virus
SLSFHSTILDCIS

SEQ ID NO: 28822 - protein, 13 aa, BK virus
LSFHSTILDCISV

SEQ ID NO: 28823 - protein, 13 aa, BK virus
SFHSTILDCISVA

SEQ ID NO: 28824 - protein, 13 aa, BK virus
FHSTILDCISVAK

SEQ ID NO: 28825 - protein, 13 aa, BK virus
HSTILDCISVAKS

SEQ ID NO: 28826 - protein, 13 aa, BK virus
STILDCISVAKSA

SEQ ID NO: 28827 - protein, 13 aa, BK virus
TILDCISVAKSAT

SEQ ID NO: 28828 - protein, 13 aa, BK virus
ILDCISVAKSATG

SEQ ID NO: 28829 - protein, 13 aa, BK virus
LDCISVAKSATGL

SEQ ID NO: 28830 - protein, 13 aa, BK virus
DCISVAKSATGLN

SEQ ID NO: 28831 - protein, 13 aa, BK virus
CISVAKSATGLNQ

SEQ ID NO: 28832 - protein, 13 aa, BK virus
ISVAKSATGLNQI

SEQ ID NO: 28833 - protein, 13 aa, BK virus
SVAKSATGLNQIS

SEQ ID NO: 28834 - protein, 13 aa, BK virus
VAKSATGLNQISS

SEQ ID NO: 28835 - protein, 13 aa, BK virus
AKSATGLNQISSS

SEQ ID NO: 28836 - protein, 13 aa, BK virus
KSATGLNQISSSN

SEQ ID NO: 28837 - protein, 13 aa, BK virus
SATGLNQISSSNK

SEQ ID NO: 28838 - protein, 13 aa, BK virus
ATGLNQISSSNKV

SEQ ID NO: 28839 - protein, 13 aa, BK virus
TGLNQISSSNKVI

SEQ ID NO: 28840 - protein, 13 aa, BK virus
GLNQISSSNKVIP

SEQ ID NO: 28841 - protein, 13 aa, BK virus
LNQISSSNKVIPL

SEQ ID NO: 28842 - protein, 13 aa, BK virus
NQISSSNKVIPLC

SEQ ID NO: 28843 - protein, 13 aa, BK virus
QISSSNKVIPLCK

SEQ ID NO: 28844 - protein, 13 aa, BK virus
ISSSNKVIPLCKI

SEQ ID NO: 28845 - protein, 13 aa, BK virus
SSSNKVIPLCKIL

SEQ ID NO: 28846 - protein, 13 aa, BK virus
SSNKVIPLCKILF

SEQ ID NO: 28847 - protein, 13 aa, BK virus
SNKVIPLCKILFS

SEQ ID NO: 28848 - protein, 13 aa, BK virus
NKVIPLCKILFSS

SEQ ID NO: 28849 - protein, 13 aa, BK virus
KVIPLCKILFSSK

SEQ ID NO: 28850 - protein, 13 aa, BK virus
VIPLCKILFSSKN

SEQ ID NO: 28851 - protein, 13 aa, BK virus
IPLCKILFSSKNS

SEQ ID NO: 28852 - protein, 13 aa, BK virus
PLCKILFSSKNSE

SEQ ID NO: 28853 - protein, 13 aa, BK virus
LCKILFSSKNSEF

SEQ ID NO: 28854 - protein, 13 aa, BK virus
CKILFSSKNSEFC

SEQ ID NO: 28855 - protein, 13 aa, BK virus
KILFSSKNSEFCK

SEQ ID NO: 28856 - protein, 13 aa, BK virus
ILFSSKNSEFCKD

SEQ ID NO: 28857 - protein, 13 aa, BK virus
LFSSKNSEFCKDF

SEQ ID NO: 28858 - protein, 13 aa, BK virus
FSSKNSEFCKDFL

SEQ ID NO: 28859 - protein, 13 aa, BK virus
SSKNSEFCKDFLK

SEQ ID NO: 28860 - protein, 13 aa, BK virus
SKNSEFCKDFLKY

SEQ ID NO: 28861 - protein, 13 aa, BK virus
KNSEFCKDFLKYI

SEQ ID NO: 28862 - protein, 13 aa, BK virus
NSEFCKDFLKYIL

SEQ ID NO: 28863 - protein, 13 aa, BK virus
SEFCKDFLKYILG

SEQ ID NO: 28864 - protein, 13 aa, BK virus
EFCKDFLKYILGL

SEQ ID NO: 28865 - protein, 13 aa, BK virus
FCKDFLKYILGLK

SEQ ID NO: 28866 - protein, 13 aa, BK virus
CKDFLKYILGLKS

SEQ ID NO: 28867 - protein, 13 aa, BK virus
KDFLKYILGLKSI

SEQ ID NO: 28868 - protein, 13 aa, BK virus
DFLKYILGLKSIC

SEQ ID NO: 28869 - protein, 13 aa, BK virus
FLKYILGLKSICL

SEQ ID NO: 28870 - protein, 13 aa, BK virus
LKYILGLKSICLT

SEQ ID NO: 28871 - protein, 13 aa, BK virus
KYILGLKSICLTN

SEQ ID NO: 28872 - protein, 13 aa, BK virus
YILGLKSICLTNL

SEQ ID NO: 28873 - protein, 13 aa, BK virus
ILGLKSICLTNLA

SEQ ID NO: 28874 - protein, 13 aa, BK virus
LGLKSICLTNLAC

SEQ ID NO: 28875 - protein, 13 aa, BK virus
GLKSICLTNLACR

SEQ ID NO: 28876 - protein, 13 aa, BK virus
LKSICLTNLACRV

SEQ ID NO: 28877 - protein, 13 aa, BK virus
KSICLTNLACRVL

SEQ ID NO: 28878 - protein, 13 aa, BK virus
SICLTNLACRVLG

SEQ ID NO: 28879 - protein, 13 aa, BK virus
ICLTNLACRVLGT

SEQ ID NO: 28880 - protein, 13 aa, BK virus
CLTNLACRVLGTG

SEQ ID NO: 28881 - protein, 13 aa, BK virus
LTNLACRVLGTGY

SEQ ID NO: 28882 - protein, 13 aa, BK virus
TNLACRVLGTGYS

SEQ ID NO: 28883 - protein, 13 aa, BK virus
NLACRVLGTGYSF

SEQ ID NO: 28884 - protein, 13 aa, BK virus
LACRVLGTGYSFI

SEQ ID NO: 28885 - protein, 13 aa, BK virus
ACRVLGTGYSFIV

SEQ ID NO: 28886 - protein, 13 aa, BK virus
CRVLGTGYSFIVT

SEQ ID NO: 28887 - protein, 13 aa, BK virus
RVLGTGYSFIVTK

SEQ ID NO: 28888 - protein, 13 aa, BK virus
VLGTGYSFIVTKP

SEQ ID NO: 28889 - protein, 13 aa, BK virus
LGTGYSFIVTKPG

SEQ ID NO: 28890 - protein, 13 aa, BK virus
GTGYSFIVTKPGG

SEQ ID NO: 28891 - protein, 13 aa, BK virus
TGYSFIVTKPGGN

SEQ ID NO: 28892 - protein, 13 aa, BK virus
GYSFIVTKPGGNI

SEQ ID NO: 28893 - protein, 13 aa, BK virus
YSFIVTKPGGNIW

SEQ ID NO: 28894 - protein, 13 aa, BK virus
SFIVTKPGGNIWV

SEQ ID NO: 28895 - protein, 13 aa, BK virus
FIVTKPGGNIWVL

SEQ ID NO: 28896 - protein, 13 aa, BK virus
IVTKPGGNIWVLL

SEQ ID NO: 28897 - protein, 13 aa, BK virus
VTKPGGNIWVLLF

SEQ ID NO: 28898 - protein, 13 aa, BK virus
TKPGGNIWVLLFK

SEQ ID NO: 28899 - protein, 13 aa, BK virus
KPGGNIWVLLFKC

SEQ ID NO: 28900 - protein, 13 aa, BK virus
PGGNIWVLLFKCF

SEQ ID NO: 28901 - protein, 13 aa, BK virus
GGNIWVLLFKCFF

SEQ ID NO: 28902 - protein, 13 aa, BK virus
GNIWVLLFKCFFS

SEQ ID NO: 28903 - protein, 13 aa, BK virus
NIWVLLFKCFFSK

SEQ ID NO: 28904 - protein, 13 aa, BK virus
IWVLLFKCFFSKF

SEQ ID NO: 28905 - protein, 13 aa, BK virus
WVLLFKCFFSKFT

SEQ ID NO: 28906 - protein, 13 aa, BK virus
VLLFKCFFSKFTL

SEQ ID NO: 28907 - protein, 13 aa, BK virus
LLFKCFFSKFTLT

SEQ ID NO: 28908 - protein, 13 aa, BK virus
LFKCFFSKFTLTL

SEQ ID NO: 28909 - protein, 13 aa, BK virus
FKCFFSKFTLTLP

SEQ ID NO: 28910 - protein, 13 aa, BK virus
KCFFSKFTLTLPS

SEQ ID NO: 28911 - protein, 13 aa, BK virus
CFFSKFTLTLPSK

SEQ ID NO: 28912 - protein, 13 aa, BK virus
SLKLSKLFIPCPE

SEQ ID NO: 28913 - protein, 13 aa, BK virus
LKLSKLFIPCPEG

SEQ ID NO: 28914 - protein, 13 aa, BK virus
KLSKLFIPCPEGK

SEQ ID NO: 28915 - protein, 13 aa, BK virus
LSKLFIPCPEGKS

SEQ ID NO: 28916 - protein, 13 aa, BK virus
SKLFIPCPEGKSF

SEQ ID NO: 28917 - protein, 13 aa, BK virus
KLFIPCPEGKSFD

SEQ ID NO: 28918 - protein, 13 aa, BK virus
LFIPCPEGKSFDS

SEQ ID NO: 28919 - protein, 13 aa, BK virus
FIPCPEGKSFDSA

SEQ ID NO: 28920 - protein, 13 aa, BK virus
IPCPEGKSFDSAP

SEQ ID NO: 28921 - protein, 13 aa, BK virus
PCPEGKSFDSAPV

SEQ ID NO: 28922 - protein, 13 aa, BK virus
CPEGKSFDSAPVP

SEQ ID NO: 28923 - protein, 13 aa, BK virus
PEGKSFDSAPVPF

SEQ ID NO: 28924 - protein, 13 aa, BK virus
EGKSFDSAPVPFT

SEQ ID NO: 28925 - protein, 13 aa, BK virus
GKSFDSAPVPFTS

SEQ ID NO: 28926 - protein, 13 aa, BK virus
KSFDSAPVPFTSS

SEQ ID NO: 28927 - protein, 13 aa, BK virus
SFDSAPVPFTSSK

SEQ ID NO: 28928 - protein, 13 aa, BK virus
FDSAPVPFTSSKT

SEQ ID NO: 28929 - protein, 13 aa, BK virus
DSAPVPFTSSKTT

SEQ ID NO: 28930 - protein, 13 aa, BK virus
SAPVPFTSSKTTM

SEQ ID NO: 28931 - protein, 13 aa, BK virus
APVPFTSSKTTMY

SEQ ID NO: 28932 - protein, 13 aa, BK virus
SIATPSSKVSLSM

SEQ ID NO: 28933 - protein, 13 aa, BK virus
IATPSSKVSLSMG

SEQ ID NO: 28934 - protein, 13 aa, BK virus
ATPSSKVSLSMGR

SEQ ID NO: 28935 - protein, 13 aa, BK virus
TPSSKVSLSMGRF

SEQ ID NO: 28936 - protein, 13 aa, BK virus
PSSKVSLSMGRFT

SEQ ID NO: 28937 - protein, 13 aa, BK virus
SSKVSLSMGRFTF

SEQ ID NO: 28938 - protein, 13 aa, BK virus
SKVSLSMGRFTFK

SEQ ID NO: 28939 - protein, 13 aa, BK virus
KVSLSMGRFTFKA

SEQ ID NO: 28940 - protein, 13 aa, BK virus
VSLSMGRFTFKAL

SEQ ID NO: 28941 - protein, 13 aa, BK virus
SLSMGRFTFKALP

SEQ ID NO: 28942 - protein, 13 aa, BK virus
LSMGRFTFKALPP

SEQ ID NO: 28943 - protein, 13 aa, BK virus
SMGRFTFKALPPH

SEQ ID NO: 28944 - protein, 13 aa, BK virus
MGRFTFKALPPHK

SEQ ID NO: 28945 - protein, 13 aa, BK virus
GRFTFKALPPHKS

SEQ ID NO: 28946 - protein, 13 aa, BK virus
RFTFKALPPHKSN

SEQ ID NO: 28947 - protein, 13 aa, BK virus
FTFKALPPHKSNN

SEQ ID NO: 28948 - protein, 13 aa, BK virus
TFKALPPHKSNNP

SEQ ID NO: 28949 - protein, 13 aa, BK virus
FKALPPHKSNNPA

SEQ ID NO: 28950 - protein, 13 aa, BK virus
KALPPHKSNNPAA

SEQ ID NO: 28951 - protein, 13 aa, BK virus
ALPPHKSNNPAAS

SEQ ID NO: 28952 - protein, 13 aa, BK virus
LPPHKSNNPAASV

SEQ ID NO: 28953 - protein, 13 aa, BK virus
PPHKSNNPAASVV

SEQ ID NO: 28954 - protein, 13 aa, BK virus
PHKSNNPAASVVF

SEQ ID NO: 28955 - protein, 13 aa, BK virus
HKSNNPAASVVFP

SEQ ID NO: 28956 - protein, 13 aa, BK virus
KSNNPAASVVFPL

SEQ ID NO: 28957 - protein, 13 aa, BK virus
SNNPAASVVFPLS

SEQ ID NO: 28958 - protein, 13 aa, BK virus
NNPAASVVFPLSM

SEQ ID NO: 28959 - protein, 13 aa, BK virus
NPAASVVFPLSMG

SEQ ID NO: 28960 - protein, 13 aa, BK virus
PAASVVFPLSMGP

SEQ ID NO: 28961 - protein, 13 aa, BK virus
AASVVFPLSMGPL

SEQ ID NO: 28962 - protein, 13 aa, BK virus
ASVVFPLSMGPLN

SEQ ID NO: 28963 - protein, 13 aa, BK virus
SVVFPLSMGPLNN

SEQ ID NO: 28964 - protein, 13 aa, BK virus
VVFPLSMGPLNNQ

SEQ ID NO: 28965 - protein, 13 aa, BK virus
VFPLSMGPLNNQY

SEQ ID NO: 28966 - protein, 13 aa, BK virus
FPLSMGPLNNQYL

SEQ ID NO: 28967 - protein, 13 aa, BK virus
PLSMGPLNNQYLL

SEQ ID NO: 28968 - protein, 13 aa, BK virus
LSMGPLNNQYLLL

SEQ ID NO: 28969 - protein, 13 aa, BK virus
SMGPLNNQYLLLG

SEQ ID NO: 28970 - protein, 13 aa, BK virus
MGPLNNQYLLLGT

SEQ ID NO: 28971 - protein, 13 aa, BK virus
GPLNNQYLLLGTL

SEQ ID NO: 28972 - protein, 13 aa, BK virus
PLNNQYLLLGTLK

SEQ ID NO: 28973 - protein, 13 aa, BK virus
LNNQYLLLGTLKT

SEQ ID NO: 28974 - protein, 13 aa, BK virus
NNQYLLLGTLKTI

SEQ ID NO: 28975 - protein, 13 aa, BK virus
NQYLLLGTLKTIQ

SEQ ID NO: 28976 - protein, 13 aa, BK virus
QYLLLGTLKTIQC

SEQ ID NO: 28977 - protein, 13 aa, BK virus
YLLLGTLKTIQCK

SEQ ID NO: 28978 - protein, 13 aa, BK virus
LLLGTLKTIQCKK

SEQ ID NO: 28979 - protein, 13 aa, BK virus
LLGTLKTIQCKKS

SEQ ID NO: 28980 - protein, 13 aa, BK virus
LGTLKTIQCKKSN

SEQ ID NO: 28981 - protein, 13 aa, BK virus
GTLKTIQCKKSNI

SEQ ID NO: 28982 - protein, 13 aa, BK virus
TLKTIQCKKSNIT

SEQ ID NO: 28983 - protein, 13 aa, BK virus
LKTIQCKKSNITE

SEQ ID NO: 28984 - protein, 13 aa, BK virus
KTIQCKKSNITES

SEQ ID NO: 28985 - protein, 13 aa, BK virus
TIQCKKSNITESI

SEQ ID NO: 28986 - protein, 13 aa, BK virus
IQCKKSNITESIL

SEQ ID NO: 28987 - protein, 13 aa, BK virus
QCKKSNITESILG

SEQ ID NO: 28988 - protein, 13 aa, BK virus
CKKSNITESILGS

SEQ ID NO: 28989 - protein, 13 aa, BK virus
KKSNITESILGSK

SEQ ID NO: 28990 - protein, 13 aa, BK virus
KSNITESILGSKQ

SEQ ID NO: 28991 - protein, 13 aa, BK virus
SNITESILGSKQC

SEQ ID NO: 28992 - protein, 13 aa, BK virus
NITESILGSKQCS

SEQ ID NO: 28993 - protein, 13 aa, BK virus
ITESILGSKQCSQ

SEQ ID NO: 28994 - protein, 13 aa, BK virus
TESILGSKQCSQA

SEQ ID NO: 28995 - protein, 13 aa, BK virus
ESILGSKQCSQAT

SEQ ID NO: 28996 - protein, 13 aa, BK virus
SILGSKQCSQATP

SEQ ID NO: 28997 - protein, 13 aa, BK virus
ILGSKQCSQATPA

SEQ ID NO: 28998 - protein, 13 aa, BK virus
LGSKQCSQATPAI

SEQ ID NO: 28999 - protein, 13 aa, BK virus
GSKQCSQATPAIY

SEQ ID NO: 29000 - protein, 13 aa, BK virus
SKQCSQATPAIYC

SEQ ID NO: 29001 - protein, 13 aa, BK virus
KQCSQATPAIYCS

SEQ ID NO: 29002 - protein, 13 aa, BK virus
QCSQATPAIYCSS

SEQ ID NO: 29003 - protein, 13 aa, BK virus
CSQATPAIYCSST

SEQ ID NO: 29004 - protein, 13 aa, BK virus
SQATPAIYCSSTA

SEQ ID NO: 29005 - protein, 13 aa, BK virus
QATPAIYCSSTAF

SEQ ID NO: 29006 - protein, 13 aa, BK virus
ATPAIYCSSTAFP

SEQ ID NO: 29007 - protein, 13 aa, BK virus
RVSTLFLAKTVST

SEQ ID NO: 29008 - protein, 13 aa, BK virus
VSTLFLAKTVSTA

SEQ ID NO: 29009 - protein, 13 aa, BK virus
STLFLAKTVSTAC

SEQ ID NO: 29010 - protein, 13 aa, BK virus
FLLSAKIIAFAKC

SEQ ID NO: 29011 - protein, 13 aa, BK virus
LLSAKIIAFAKCF

SEQ ID NO: 29012 - protein, 13 aa, BK virus
LSAKIIAFAKCFS

SEQ ID NO: 29013 - protein, 13 aa, BK virus
NSKYIPNNKNTSS

SEQ ID NO: 29014 - protein, 13 aa, BK virus
SKYIPNNKNTSSH

SEQ ID NO: 29015 - protein, 13 aa, BK virus
KYIPNNKNTSSHF

SEQ ID NO: 29016 - protein, 13 aa, BK virus
YIPNNKNTSSHFV

SEQ ID NO: 29017 - protein, 13 aa, BK virus
IPNNKNTSSHFVS

SEQ ID NO: 29018 - protein, 13 aa, BK virus
PNNKNTSSHFVST

SEQ ID NO: 29019 - protein, 13 aa, BK virus
NNKNTSSHFVSTA

SEQ ID NO: 29020 - protein, 13 aa, BK virus
NKNTSSHFVSTAY

SEQ ID NO: 29021 - protein, 13 aa, BK virus
KNTSSHFVSTAYS

SEQ ID NO: 29022 - protein, 13 aa, BK virus
NTSSHFVSTAYSV

SEQ ID NO: 29023 - protein, 13 aa, BK virus
TSSHFVSTAYSVI

SEQ ID NO: 29024 - protein, 13 aa, BK virus
SSHFVSTAYSVIN

SEQ ID NO: 29025 - protein, 13 aa, BK virus
SHFVSTAYSVINF

SEQ ID NO: 29026 - protein, 13 aa, BK virus
HFVSTAYSVINFQ

SEQ ID NO: 29027 - protein, 13 aa, BK virus
FVSTAYSVINFQD

SEQ ID NO: 29028 - protein, 13 aa, BK virus
VSTAYSVINFQDT

SEQ ID NO: 29029 - protein, 13 aa, BK virus
STAYSVINFQDTC

SEQ ID NO: 29030 - protein, 13 aa, BK virus
TAYSVINFQDTCF

SEQ ID NO: 29031 - protein, 13 aa, BK virus
AYSVINFQDTCFV

SEQ ID NO: 29032 - protein, 13 aa, BK virus
YSVINFQDTCFVS

SEQ ID NO: 29033 - protein, 13 aa, BK virus
SVINFQDTCFVSS

SEQ ID NO: 29034 - protein, 13 aa, BK virus
VINFQDTCFVSSG

SEQ ID NO: 29035 - protein, 13 aa, BK virus
INFQDTCFVSSGS

SEQ ID NO: 29036 - protein, 13 aa, BK virus
NFQDTCFVSSGSS

SEQ ID NO: 29037 - protein, 13 aa, BK virus
FQDTCFVSSGSSG

SEQ ID NO: 29038 - protein, 13 aa, BK virus
QDTCFVSSGSSGL

SEQ ID NO: 29039 - protein, 13 aa, BK virus
DTCFVSSGSSGLK

SEQ ID NO: 29040 - protein, 13 aa, BK virus
TCFVSSGSSGLKS

SEQ ID NO: 29041 - protein, 13 aa, BK virus
CFVSSGSSGLKSC

SEQ ID NO: 29042 - protein, 13 aa, BK virus
FVSSGSSGLKSCS

SEQ ID NO: 29043 - protein, 13 aa, BK virus
VSSGSSGLKSCSF

SEQ ID NO: 29044 - protein, 13 aa, BK virus
SSGSSGLKSCSFK

SEQ ID NO: 29045 - protein, 13 aa, BK virus
SGSSGLKSCSFKP

SEQ ID NO: 29046 - protein, 13 aa, BK virus
GSSGLKSCSFKPP

SEQ ID NO: 29047 - protein, 13 aa, BK virus
MLSSIVWYGSLVK

SEQ ID NO: 29048 - protein, 13 aa, BK virus
LSSIVWYGSLVKA

SEQ ID NO: 29049 - protein, 13 aa, BK virus
SSIVWYGSLVKAL

SEQ ID NO: 29050 - protein, 13 aa, BK virus
SIVWYGSLVKALY

SEQ ID NO: 29051 - protein, 13 aa, BK virus
IVWYGSLVKALYS

SEQ ID NO: 29052 - protein, 13 aa, BK virus
VWYGSLVKALYSK

SEQ ID NO: 29053 - protein, 13 aa, BK virus
WYGSLVKALYSKY

SEQ ID NO: 29054 - protein, 13 aa, BK virus
YGSLVKALYSKYS

SEQ ID NO: 29055 - protein, 13 aa, BK virus
GSLVKALYSKYSL

SEQ ID NO: 29056 - protein, 13 aa, BK virus
SLVKALYSKYSLL

SEQ ID NO: 29057 - protein, 13 aa, BK virus
LVKALYSKYSLLT

SEQ ID NO: 29058 - protein, 13 aa, BK virus
VKALYSKYSLLTP

SEQ ID NO: 29059 - protein, 13 aa, BK virus
KALYSKYSLLTPL

SEQ ID NO: 29060 - protein, 13 aa, BK virus
ALYSKYSLLTPLQ

SEQ ID NO: 29061 - protein, 13 aa, BK virus
LYSKYSLLTPLQI

SEQ ID NO: 29062 - protein, 13 aa, BK virus
YSKYSLLTPLQIK

SEQ ID NO: 29063 - protein, 13 aa, BK virus
SKYSLLTPLQIKK

SEQ ID NO: 29064 - protein, 13 aa, BK virus
KYSLLTPLQIKKL

SEQ ID NO: 29065 - protein, 13 aa, BK virus
YSLLTPLQIKKLK

SEQ ID NO: 29066 - protein, 13 aa, BK virus
SLLTPLQIKKLKV

SEQ ID NO: 29067 - protein, 13 aa, BK virus
LLTPLQIKKLKVH

SEQ ID NO: 29068 - protein, 13 aa, BK virus
LTPLQIKKLKVHS

SEQ ID NO: 29069 - protein, 13 aa, BK virus
TPLQIKKLKVHSF

SEQ ID NO: 29070 - protein, 13 aa, BK virus
QKLLIAETLCLCG

SEQ ID NO: 29071 - protein, 13 aa, BK virus
KLLIAETLCLCGV

SEQ ID NO: 29072 - protein, 13 aa, BK virus
LLIAETLCLCGVK

SEQ ID NO: 29073 - protein, 13 aa, BK virus
LIAETLCLCGVKK

SEQ ID NO: 29074 - protein, 13 aa, BK virus
IAETLCLCGVKKN

SEQ ID NO: 29075 - protein, 13 aa, BK virus
AETLCLCGVKKNI

SEQ ID NO: 29076 - protein, 13 aa, BK virus
ETLCLCGVKKNII

SEQ ID NO: 29077 - protein, 13 aa, BK virus
TLCLCGVKKNIIL

SEQ ID NO: 29078 - protein, 13 aa, BK virus
LCLCGVKKNIILC

SEQ ID NO: 29079 - protein, 13 aa, BK virus
CLCGVKKNIILCP

SEQ ID NO: 29080 - protein, 13 aa, BK virus
LCGVKKNIILCPA

SEQ ID NO: 29081 - protein, 13 aa, BK virus
CGVKKNIILCPAH

SEQ ID NO: 29082 - protein, 13 aa, BK virus
GVKKNIILCPAHM

SEQ ID NO: 29083 - protein, 13 aa, BK virus
VKKNIILCPAHMC

SEQ ID NO: 29084 - protein, 13 aa, BK virus
KKNIILCPAHMCL

SEQ ID NO: 29085 - protein, 13 aa, BK virus
KNIILCPAHMCLL

SEQ ID NO: 29086 - protein, 13 aa, BK virus
NIILCPAHMCLLI

SEQ ID NO: 29087 - protein, 13 aa, BK virus
IILCPAHMCLLIK

SEQ ID NO: 29088 - protein, 13 aa, BK virus
ILCPAHMCLLIKV

SEQ ID NO: 29089 - protein, 13 aa, BK virus
LCPAHMCLLIKVT

SEQ ID NO: 29090 - protein, 13 aa, BK virus
CPAHMCLLIKVTE

SEQ ID NO: 29091 - protein, 13 aa, BK virus
PAHMCLLIKVTEY

SEQ ID NO: 29092 - protein, 13 aa, BK virus
AHMCLLIKVTEYF

SEQ ID NO: 29093 - protein, 13 aa, BK virus
HMCLLIKVTEYFS

SEQ ID NO: 29094 - protein, 13 aa, BK virus
MCLLIKVTEYFSI

SEQ ID NO: 29095 - protein, 13 aa, BK virus
CLLIKVTEYFSIS

SEQ ID NO: 29096 - protein, 13 aa, BK virus
LLIKVTEYFSISF

SEQ ID NO: 29097 - protein, 13 aa, BK virus
LIKVTEYFSISFL

SEQ ID NO: 29098 - protein, 13 aa, BK virus
IKVTEYFSISFLY

SEQ ID NO: 29099 - protein, 13 aa, BK virus
KVTEYFSISFLYR

SEQ ID NO: 29100 - protein, 13 aa, BK virus
VTEYFSISFLYRI

SEQ ID NO: 29101 - protein, 13 aa, BK virus
AFSLVVYTAKQAR

SEQ ID NO: 29102 - protein, 13 aa, BK virus
FSLVVYTAKQARV

SEQ ID NO: 29103 - protein, 13 aa, BK virus
SLVVYTAKQARVL

SEQ ID NO: 29104 - protein, 13 aa, BK virus
LVVYTAKQARVLL

SEQ ID NO: 29105 - protein, 13 aa, BK virus
VVYTAKQARVLLL

SEQ ID NO: 29106 - protein, 13 aa, BK virus
VYTAKQARVLLLN

SEQ ID NO: 29107 - protein, 13 aa, BK virus
YTAKQARVLLLNT

SEQ ID NO: 29108 - protein, 13 aa, BK virus
TAKQARVLLLNTA

SEQ ID NO: 29109 - protein, 13 aa, BK virus
LRNWCRSEGKSLG

SEQ ID NO: 29110 - protein, 13 aa, BK virus
RNWCRSEGKSLGS

SEQ ID NO: 29111 - protein, 13 aa, BK virus
NWCRSEGKSLGSS

SEQ ID NO: 29112 - protein, 13 aa, BK virus
WCRSEGKSLGSST

SEQ ID NO: 29113 - protein, 13 aa, BK virus
CRSEGKSLGSSTF

SEQ ID NO: 29114 - protein, 13 aa, BK virus
RSEGKSLGSSTFL

SEQ ID NO: 29115 - protein, 13 aa, BK virus
SEGKSLGSSTFLF

SEQ ID NO: 29116 - protein, 13 aa, BK virus
EGKSLGSSTFLFF

SEQ ID NO: 29117 - protein, 13 aa, BK virus
GKSLGSSTFLFFL

SEQ ID NO: 29118 - protein, 13 aa, BK virus
KSLGSSTFLFFLG

SEQ ID NO: 29119 - protein, 13 aa, BK virus
SLGSSTFLFFLGG

SEQ ID NO: 29120 - protein, 13 aa, BK virus
LGSSTFLFFLGGV

SEQ ID NO: 29121 - protein, 13 aa, BK virus
GSSTFLFFLGGVE

SEQ ID NO: 29122 - protein, 13 aa, BK virus
SSTFLFFLGGVEC

SEQ ID NO: 29123 - protein, 13 aa, BK virus
ESAVASSSLANIS

SEQ ID NO: 29124 - protein, 13 aa, BK virus
SAVASSSLANISS

SEQ ID NO: 29125 - protein, 13 aa, BK virus
AVASSSLANISSW

SEQ ID NO: 29126 - protein, 13 aa, BK virus
VASSSLANISSWQ

SEQ ID NO: 29127 - protein, 13 aa, BK virus
ASSSLANISSWQN

SEQ ID NO: 29128 - protein, 13 aa, BK virus
SSSLANISSWQNK

SEQ ID NO: 29129 - protein, 13 aa, BK virus
SSLANISSWQNKS

SEQ ID NO: 29130 - protein, 13 aa, BK virus
SLANISSWQNKSS

SEQ ID NO: 29131 - protein, 13 aa, BK virus
LANISSWQNKSSS

SEQ ID NO: 29132 - protein, 13 aa, BK virus
ANISSWQNKSSSH

SEQ ID NO: 29133 - protein, 13 aa, BK virus
NISSWQNKSSSHF

SEQ ID NO: 29134 - protein, 13 aa, BK virus
ISSWQNKSSSHFS

SEQ ID NO: 29135 - protein, 13 aa, BK virus
SSWQNKSSSHFSL

SEQ ID NO: 29136 - protein, 13 aa, BK virus
SWQNKSSSHFSLK

SEQ ID NO: 29137 - protein, 13 aa, BK virus
WQNKSSSHFSLKE

SEQ ID NO: 29138 - protein, 13 aa, BK virus
QNKSSSHFSLKEL

SEQ ID NO: 29139 - protein, 13 aa, BK virus
NKSSSHFSLKELH

SEQ ID NO: 29140 - protein, 13 aa, BK virus
KSSSHFSLKELHQ

SEQ ID NO: 29141 - protein, 13 aa, BK virus
SSSHFSLKELHQD

SEQ ID NO: 29142 - protein, 13 aa, BK virus
SSHFSLKELHQDS

SEQ ID NO: 29143 - protein, 13 aa, BK virus
SHFSLKELHQDSH

SEQ ID NO: 29144 - protein, 13 aa, BK virus
HFSLKELHQDSHS

SEQ ID NO: 29145 - protein, 13 aa, BK virus
FSLKELHQDSHSS

SEQ ID NO: 29146 - protein, 13 aa, BK virus
SLKELHQDSHSSV

SEQ ID NO: 29147 - protein, 13 aa, BK virus
LKELHQDSHSSVP

SEQ ID NO: 29148 - protein, 13 aa, BK virus
VGTYKKNNYLGPF

SEQ ID NO: 29149 - protein, 13 aa, BK virus
GTYKKNNYLGPFN

SEQ ID NO: 29150 - protein, 13 aa, BK virus
TYKKNNYLGPFNI

SEQ ID NO: 29151 - protein, 13 aa, BK virus
YKKNNYLGPFNIL

SEQ ID NO: 29152 - protein, 13 aa, BK virus
KKNNYLGPFNILL

SEQ ID NO: 29153 - protein, 13 aa, BK virus
KNNYLGPFNILLF

SEQ ID NO: 29154 - protein, 13 aa, BK virus
NNYLGPFNILLFI

SEQ ID NO: 29155 - protein, 13 aa, BK virus
REFLQLFGPTIAE

SEQ ID NO: 29156 - protein, 13 aa, BK virus
EFLQLFGPTIAEF

SEQ ID NO: 29157 - protein, 13 aa, BK virus
FLQLFGPTIAEFL

SEQ ID NO: 29158 - protein, 13 aa, BK virus
LQLFGPTIAEFLQ

SEQ ID NO: 29159 - protein, 13 aa, BK virus
QLFGPTIAEFLQL

SEQ ID NO: 29160 - protein, 13 aa, BK virus
LFGPTIAEFLQLG

SEQ ID NO: 29161 - protein, 13 aa, BK virus
FGPTIAEFLQLGL

SEQ ID NO: 29162 - protein, 13 aa, BK virus
GPTIAEFLQLGLS

SEQ ID NO: 29163 - protein, 13 aa, BK virus
PTIAEFLQLGLSQ

SEQ ID NO: 29164 - protein, 13 aa, BK virus
TIAEFLQLGLSQT

SEQ ID NO: 29165 - protein, 13 aa, BK virus
IAEFLQLGLSQTT

SEQ ID NO: 29166 - protein, 13 aa, BK virus
AEFLQLGLSQTTV

SEQ ID NO: 29167 - protein, 13 aa, BK virus
SSQCSSNLSKPRA

SEQ ID NO: 29168 - protein, 13 aa, BK virus
SQCSSNLSKPRAL

SEQ ID NO: 29169 - protein, 13 aa, BK virus
QCSSNLSKPRALF

SEQ ID NO: 29170 - protein, 13 aa, BK virus
CSSNLSKPRALFL

SEQ ID NO: 29171 - protein, 13 aa, BK virus
SSNLSKPRALFLK

SEQ ID NO: 29172 - protein, 13 aa, BK virus
SNLSKPRALFLKI

SEQ ID NO: 29173 - protein, 13 aa, BK virus
NLSKPRALFLKIF

SEQ ID NO: 29174 - protein, 13 aa, BK virus
LSKPRALFLKIFY

SEQ ID NO: 29175 - protein, 13 aa, BK virus
SKPRALFLKIFYL

SEQ ID NO: 29176 - protein, 13 aa, BK virus
KPRALFLKIFYLN

SEQ ID NO: 29177 - protein, 13 aa, BK virus
PRALFLKIFYLNA

SEQ ID NO: 29178 - protein, 13 aa, BK virus
RALFLKIFYLNAL

SEQ ID NO: 29179 - protein, 13 aa, BK virus
ALFLKIFYLNALI

SEQ ID NO: 29180 - protein, 13 aa, BK virus
ADIACKGSAQKAF

SEQ ID NO: 29181 - protein, 13 aa, BK virus
DIACKGSAQKAFW

SEQ ID NO: 29182 - protein, 13 aa, BK virus
IACKGSAQKAFWN

SEQ ID NO: 29183 - protein, 13 aa, BK virus
ACKGSAQKAFWNK

SEQ ID NO: 29184 - protein, 13 aa, BK virus
AIPCSTGYLGKEE

SEQ ID NO: 29185 - protein, 13 aa, BK virus
IPCSTGYLGKEEN

SEQ ID NO: 29186 - protein, 13 aa, BK virus
PCSTGYLGKEENQ

SEQ ID NO: 29187 - protein, 13 aa, BK virus
CSTGYLGKEENQH

SEQ ID NO: 29188 - protein, 13 aa, BK virus
STGYLGKEENQHK

SEQ ID NO: 29189 - protein, 13 aa, BK virus
TGYLGKEENQHKP

SEQ ID NO: 29190 - protein, 13 aa, BK virus
GYLGKEENQHKPL

SEQ ID NO: 29191 - protein, 13 aa, BK virus
YLGKEENQHKPLS

SEQ ID NO: 29192 - protein, 13 aa, BK virus
LGKEENQHKPLSY

SEQ ID NO: 29193 - protein, 13 aa, BK virus
GKEENQHKPLSYS

SEQ ID NO: 29194 - protein, 13 aa, BK virus
KEENQHKPLSYSR

SEQ ID NO: 29195 - protein, 13 aa, BK virus
EENQHKPLSYSRF

SEQ ID NO: 29196 - protein, 13 aa, BK virus
ENQHKPLSYSRFQ

SEQ ID NO: 29197 - protein, 13 aa, BK virus
NQHKPLSYSRFQN

SEQ ID NO: 29198 - protein, 13 aa, BK virus
QHKPLSYSRFQNQ

SEQ ID NO: 29199 - protein, 13 aa, BK virus
HKPLSYSRFQNQA

SEQ ID NO: 29200 - protein, 13 aa, BK virus
KPLSYSRFQNQAD

SEQ ID NO: 29201 - protein, 13 aa, BK virus
PLSYSRFQNQADE

SEQ ID NO: 29202 - protein, 13 aa, BK virus
LSYSRFQNQADEL

SEQ ID NO: 29203 - protein, 13 aa, BK virus
SYSRFQNQADELP

SEQ ID NO: 29204 - protein, 13 aa, BK virus
YSRFQNQADELPL

SEQ ID NO: 29205 - protein, 13 aa, BK virus
SRFQNQADELPLH

SEQ ID NO: 29206 - protein, 13 aa, BK virus
RFQNQADELPLHP

SEQ ID NO: 29207 - protein, 13 aa, BK virus
FQNQADELPLHPA

SEQ ID NO: 29208 - protein, 13 aa, BK virus
QNQADELPLHPAP

SEQ ID NO: 29209 - protein, 13 aa, BK virus
NQADELPLHPAPF

SEQ ID NO: 29210 - protein, 13 aa, BK virus
QADELPLHPAPFF

SEQ ID NO: 29211 - protein, 13 aa, BK virus
ADELPLHPAPFFY

SEQ ID NO: 29212 - protein, 13 aa, BK virus
DELPLHPAPFFYT

SEQ ID NO: 29213 - protein, 13 aa, BK virus
ELPLHPAPFFYTK

SEQ ID NO: 29214 - protein, 13 aa, BK virus
LPLHPAPFFYTKY

SEQ ID NO: 29215 - protein, 13 aa, BK virus
PLHPAPFFYTKYS

SEQ ID NO: 29216 - protein, 13 aa, BK virus
LHPAPFFYTKYSF

SEQ ID NO: 29217 - protein, 13 aa, BK virus
HPAPFFYTKYSFS

SEQ ID NO: 29218 - protein, 13 aa, BK virus
PAPFFYTKYSFSS

SEQ ID NO: 29219 - protein, 13 aa, BK virus
APFFYTKYSFSSF

SEQ ID NO: 29220 - protein, 13 aa, BK virus
PFFYTKYSFSSFY

SEQ ID NO: 29221 - protein, 13 aa, BK virus
FFYTKYSFSSFYP

SEQ ID NO: 29222 - protein, 13 aa, BK virus
FYTKYSFSSFYPR

SEQ ID NO: 29223 - protein, 13 aa, BK virus
YTKYSFSSFYPRR

SEQ ID NO: 29224 - protein, 13 aa, BK virus
TKYSFSSFYPRRP

SEQ ID NO: 29225 - protein, 13 aa, BK virus
KYSFSSFYPRRPL

SEQ ID NO: 29226 - protein, 13 aa, BK virus
YSFSSFYPRRPLC

SEQ ID NO: 29227 - protein, 13 aa, BK virus
SFSSFYPRRPLCQ

SEQ ID NO: 29228 - protein, 13 aa, BK virus
FSSFYPRRPLCQG

SEQ ID NO: 29229 - protein, 13 aa, BK virus
SSFYPRRPLCQGE

SEQ ID NO: 29230 - protein, 13 aa, BK virus
SFYPRRPLCQGEI

SEQ ID NO: 29231 - protein, 13 aa, BK virus
FYPRRPLCQGEIP

SEQ ID NO: 29232 - protein, 13 aa, BK virus
YPRRPLCQGEIPY

SEQ ID NO: 29233 - protein, 13 aa, BK virus
PRRPLCQGEIPYT

SEQ ID NO: 29234 - protein, 13 aa, BK virus
RRPLCQGEIPYTS

SEQ ID NO: 29235 - protein, 13 aa, BK virus
RPLCQGEIPYTSL

SEQ ID NO: 29236 - protein, 13 aa, BK virus
PLCQGEIPYTSLN

SEQ ID NO: 29237 - protein, 13 aa, BK virus
LCQGEIPYTSLNK

SEQ ID NO: 29238 - protein, 13 aa, BK virus
CQGEIPYTSLNKL

SEQ ID NO: 29239 - protein, 13 aa, BK virus
QGEIPYTSLNKLF

SEQ ID NO: 29240 - protein, 13 aa, BK virus
GEIPYTSLNKLFS

SEQ ID NO: 29241 - protein, 13 aa, BK virus
EIPYTSLNKLFSL

SEQ ID NO: 29242 - protein, 13 aa, BK virus
IPYTSLNKLFSLR

SEQ ID NO: 29243 - protein, 13 aa, BK virus
PYTSLNKLFSLRE

SEQ ID NO: 29244 - protein, 13 aa, BK virus
YTSLNKLFSLRED

SEQ ID NO: 29245 - protein, 13 aa, BK virus
TSLNKLFSLREDF

SEQ ID NO: 29246 - protein, 13 aa, BK virus
SLNKLFSLREDFP

SEQ ID NO: 29247 - protein, 13 aa, BK virus
LNKLFSLREDFPR

SEQ ID NO: 29248 - protein, 13 aa, BK virus
NKLFSLREDFPRQ

SEQ ID NO: 29249 - protein, 13 aa, BK virus
KLFSLREDFPRQL

SEQ ID NO: 29250 - protein, 13 aa, BK virus
LFSLREDFPRQLF

SEQ ID NO: 29251 - protein, 13 aa, BK virus
FSLREDFPRQLFQ

SEQ ID NO: 29252 - protein, 13 aa, BK virus
SLREDFPRQLFQG

SEQ ID NO: 29253 - protein, 13 aa, BK virus
LREDFPRQLFQGL

SEQ ID NO: 29254 - protein, 13 aa, BK virus
REDFPRQLFQGLK

SEQ ID NO: 29255 - protein, 13 aa, BK virus
EDFPRQLFQGLKG

SEQ ID NO: 29256 - protein, 13 aa, BK virus
DFPRQLFQGLKGP

SEQ ID NO: 29257 - protein, 14 aa, BK virus
GFPQIVLLGLRKSL

SEQ ID NO: 29258 - protein, 14 aa, BK virus
FPQIVLLGLRKSLH

SEQ ID NO: 29259 - protein, 14 aa, BK virus
PQIVLLGLRKSLHT

SEQ ID NO: 29260 - protein, 14 aa, BK virus
QIVLLGLRKSLHTL

SEQ ID NO: 29261 - protein, 14 aa, BK virus
IVLLGLRKSLHTLT

SEQ ID NO: 29262 - protein, 14 aa, BK virus
VLLGLRKSLHTLTT

SEQ ID NO: 29263 - protein, 14 aa, BK virus
EKGWRQRRPRPLIY

SEQ ID NO: 29264 - protein, 14 aa, BK virus
KGWRQRRPRPLIYY

SEQ ID NO: 29265 - protein, 14 aa, BK virus
GWRQRRPRPLIYYK

SEQ ID NO: 29266 - protein, 14 aa, BK virus
WRQRRPRPLIYYKK

SEQ ID NO: 29267 - protein, 14 aa, BK virus
RQRRPRPLIYYKKK

SEQ ID NO: 29268 - protein, 14 aa, BK virus
QRRPRPLIYYKKKG

SEQ ID NO: 29269 - protein, 14 aa, BK virus
RRPRPLIYYKKKGH

SEQ ID NO: 29270 - protein, 14 aa, BK virus
RPRPLIYYKKKGHR

SEQ ID NO: 29271 - protein, 14 aa, BK virus
PRPLIYYKKKGHRE

SEQ ID NO: 29272 - protein, 14 aa, BK virus
RPLIYYKKKGHREE

SEQ ID NO: 29273 - protein, 14 aa, BK virus
PLIYYKKKGHREEL

SEQ ID NO: 29274 - protein, 14 aa, BK virus
LIYYKKKGHREELL

SEQ ID NO: 29275 - protein, 14 aa, BK virus
IYYKKKGHREELLT

SEQ ID NO: 29276 - protein, 14 aa, BK virus
YYKKKGHREELLTH

SEQ ID NO: 29277 - protein, 14 aa, BK virus
YKKKGHREELLTHG

SEQ ID NO: 29278 - protein, 14 aa, BK virus
KKKGHREELLTHGM

SEQ ID NO: 29279 - protein, 14 aa, BK virus
KKGHREELLTHGMQ

SEQ ID NO: 29280 - protein, 14 aa, BK virus
KGHREELLTHGMQP

SEQ ID NO: 29281 - protein, 14 aa, BK virus
GHREELLTHGMQPN

SEQ ID NO: 29282 - protein, 14 aa, BK virus
HREELLTHGMQPNH

SEQ ID NO: 29283 - protein, 14 aa, BK virus
REELLTHGMQPNHD

SEQ ID NO: 29284 - protein, 14 aa, BK virus
EELLTHGMQPNHDL

SEQ ID NO: 29285 - protein, 14 aa, BK virus
ELLTHGMQPNHDLR

SEQ ID NO: 29286 - protein, 14 aa, BK virus
LLTHGMQPNHDLRK

SEQ ID NO: 29287 - protein, 14 aa, BK virus
LTHGMQPNHDLRKE

SEQ ID NO: 29288 - protein, 14 aa, BK virus
THGMQPNHDLRKES

SEQ ID NO: 29289 - protein, 14 aa, BK virus
HGMQPNHDLRKESA

SEQ ID NO: 29290 - protein, 14 aa, BK virus
LTGECSQTMTSGRK

SEQ ID NO: 29291 - protein, 14 aa, BK virus
TGECSQTMTSGRKV

SEQ ID NO: 29292 - protein, 14 aa, BK virus
GECSQTMTSGRKVH

SEQ ID NO: 29293 - protein, 14 aa, BK virus
ECSQTMTSGRKVHD

SEQ ID NO: 29294 - protein, 14 aa, BK virus
CSQTMTSGRKVHDS

SEQ ID NO: 29295 - protein, 14 aa, BK virus
SQTMTSGRKVHDSQ

SEQ ID NO: 29296 - protein, 14 aa, BK virus
QTMTSGRKVHDSQG

SEQ ID NO: 29297 - protein, 14 aa, BK virus
TMTSGRKVHDSQGG

SEQ ID NO: 29298 - protein, 14 aa, BK virus
MTSGRKVHDSQGGA

SEQ ID NO: 29299 - protein, 14 aa, BK virus
TSGRKVHDSQGGAA

SEQ ID NO: 29300 - protein, 14 aa, BK virus
SGRKVHDSQGGAAY

SEQ ID NO: 29301 - protein, 14 aa, BK virus
GRKVHDSQGGAAYP

SEQ ID NO: 29302 - protein, 14 aa, BK virus
RKVHDSQGGAAYPW

SEQ ID NO: 29303 - protein, 14 aa, BK virus
KVHDSQGGAAYPWN

SEQ ID NO: 29304 - protein, 14 aa, BK virus
VHDSQGGAAYPWNA

SEQ ID NO: 29305 - protein, 14 aa, BK virus
HDSQGGAAYPWNAA

SEQ ID NO: 29306 - protein, 14 aa, BK virus
DSQGGAAYPWNAAK

SEQ ID NO: 29307 - protein, 14 aa, BK virus
SQGGAAYPWNAAKP

SEQ ID NO: 29308 - protein, 14 aa, BK virus
PQEGKCMTDMFCEP

SEQ ID NO: 29309 - protein, 14 aa, BK virus
QEGKCMTDMFCEPR

SEQ ID NO: 29310 - protein, 14 aa, BK virus
EGKCMTDMFCEPRN

SEQ ID NO: 29311 - protein, 14 aa, BK virus
GKCMTDMFCEPRNL

SEQ ID NO: 29312 - protein, 14 aa, BK virus
KCMTDMFCEPRNLG

SEQ ID NO: 29313 - protein, 14 aa, BK virus
CMTDMFCEPRNLGL

SEQ ID NO: 29314 - protein, 14 aa, BK virus
MTDMFCEPRNLGLV

SEQ ID NO: 29315 - protein, 14 aa, BK virus
TDMFCEPRNLGLVP

SEQ ID NO: 29316 - protein, 14 aa, BK virus
DMFCEPRNLGLVPS

SEQ ID NO: 29317 - protein, 14 aa, BK virus
TGQRPWFCASCHDK

SEQ ID NO: 29318 - protein, 14 aa, BK virus
GQRPWFCASCHDKL

SEQ ID NO: 29319 - protein, 14 aa, BK virus
QRPWFCASCHDKLQ

SEQ ID NO: 29320 - protein, 14 aa, BK virus
KLVKPGLEQKKELR

SEQ ID NO: 29321 - protein, 14 aa, BK virus
LVKPGLEQKKELRG

SEQ ID NO: 29322 - protein, 14 aa, BK virus
VKPGLEQKKELRGF

SEQ ID NO: 29323 - protein, 14 aa, BK virus
KPGLEQKKELRGFL

SEQ ID NO: 29324 - protein, 14 aa, BK virus
PGLEQKKELRGFLF

SEQ ID NO: 29325 - protein, 14 aa, BK virus
GLEQKKELRGFLFL

SEQ ID NO: 29326 - protein, 14 aa, BK virus
LEQKKELRGFLFLF

SEQ ID NO: 29327 - protein, 14 aa, BK virus
VIPFFLYFQVHGCC

SEQ ID NO: 29328 - protein, 14 aa, BK virus
IPFFLYFQVHGCCS

SEQ ID NO: 29329 - protein, 14 aa, BK virus
PFFLYFQVHGCCSS

SEQ ID NO: 29330 - protein, 14 aa, BK virus
FFLYFQVHGCCSST

SEQ ID NO: 29331 - protein, 14 aa, BK virus
FLYFQVHGCCSSTF

SEQ ID NO: 29332 - protein, 14 aa, BK virus
LYFQVHGCCSSTFG

SEQ ID NO: 29333 - protein, 14 aa, BK virus
YFQVHGCCSSTFGG

SEQ ID NO: 29334 - protein, 14 aa, BK virus
FQVHGCCSSTFGGP

SEQ ID NO: 29335 - protein, 14 aa, BK virus
QVHGCCSSTFGGPS

SEQ ID NO: 29336 - protein, 14 aa, BK virus
VHGCCSSTFGGPSC

SEQ ID NO: 29337 - protein, 14 aa, BK virus
HGCCSSTFGGPSCQ

SEQ ID NO: 29338 - protein, 14 aa, BK virus
GCCSSTFGGPSCQC

SEQ ID NO: 29339 - protein, 14 aa, BK virus
CCSSTFGGPSCQCI

SEQ ID NO: 29340 - protein, 14 aa, BK virus
NCCWGGCCCYRSSN

SEQ ID NO: 29341 - protein, 14 aa, BK virus
CCWGGCCCYRSSNC

SEQ ID NO: 29342 - protein, 14 aa, BK virus
CWGGCCCYRSSNCI

SEQ ID NO: 29343 - protein, 14 aa, BK virus
WGGCCCYRSSNCIP

SEQ ID NO: 29344 - protein, 14 aa, BK virus
GGCCCYRSSNCIPC

SEQ ID NO: 29345 - protein, 14 aa, BK virus
GCCCYRSSNCIPCY

SEQ ID NO: 29346 - protein, 14 aa, BK virus
CCCYRSSNCIPCYC

SEQ ID NO: 29347 - protein, 14 aa, BK virus
CCYRSSNCIPCYCR

SEQ ID NO: 29348 - protein, 14 aa, BK virus
CYRSSNCIPCYCRG

SEQ ID NO: 29349 - protein, 14 aa, BK virus
YRSSNCIPCYCRGH

SEQ ID NO: 29350 - protein, 14 aa, BK virus
RSSNCIPCYCRGHN

SEQ ID NO: 29351 - protein, 14 aa, BK virus
SSNCIPCYCRGHNK

SEQ ID NO: 29352 - protein, 14 aa, BK virus
SNCIPCYCRGHNKY

SEQ ID NO: 29353 - protein, 14 aa, BK virus
NCIPCYCRGHNKYL

SEQ ID NO: 29354 - protein, 14 aa, BK virus
CIPCYCRGHNKYLR

SEQ ID NO: 29355 - protein, 14 aa, BK virus
IPCYCRGHNKYLRG

SEQ ID NO: 29356 - protein, 14 aa, BK virus
PCYCRGHNKYLRGY

SEQ ID NO: 29357 - protein, 14 aa, BK virus
CYCRGHNKYLRGYS

SEQ ID NO: 29358 - protein, 14 aa, BK virus
YCRGHNKYLRGYSC

SEQ ID NO: 29359 - protein, 14 aa, BK virus
CRGHNKYLRGYSCY

SEQ ID NO: 29360 - protein, 14 aa, BK virus
RGHNKYLRGYSCYR

SEQ ID NO: 29361 - protein, 14 aa, BK virus
GHNKYLRGYSCYRP

SEQ ID NO: 29362 - protein, 14 aa, BK virus
HNKYLRGYSCYRPN

SEQ ID NO: 29363 - protein, 14 aa, BK virus
NKYLRGYSCYRPNS

SEQ ID NO: 29364 - protein, 14 aa, BK virus
KYLRGYSCYRPNSS

SEQ ID NO: 29365 - protein, 14 aa, BK virus
YLRGYSCYRPNSSN

SEQ ID NO: 29366 - protein, 14 aa, BK virus
LRGYSCYRPNSSNI

SEQ ID NO: 29367 - protein, 14 aa, BK virus
RGYSCYRPNSSNIC

SEQ ID NO: 29368 - protein, 14 aa, BK virus
GYSCYRPNSSNICC

SEQ ID NO: 29369 - protein, 14 aa, BK virus
YSCYRPNSSNICCN

SEQ ID NO: 29370 - protein, 14 aa, BK virus
SCYRPNSSNICCNC

SEQ ID NO: 29371 - protein, 14 aa, BK virus
CYRPNSSNICCNCW

SEQ ID NO: 29372 - protein, 14 aa, BK virus
YRPNSSNICCNCWC

SEQ ID NO: 29373 - protein, 14 aa, BK virus
RPNSSNICCNCWCS

SEQ ID NO: 29374 - protein, 14 aa, BK virus
PNSSNICCNCWCSW

SEQ ID NO: 29375 - protein, 14 aa, BK virus
NSSNICCNCWCSWG

SEQ ID NO: 29376 - protein, 14 aa, BK virus
SSNICCNCWCSWGY

SEQ ID NO: 29377 - protein, 14 aa, BK virus
SNICCNCWCSWGYC

SEQ ID NO: 29378 - protein, 14 aa, BK virus
NICCNCWCSWGYCW

SEQ ID NO: 29379 - protein, 14 aa, BK virus
ICCNCWCSWGYCWV

SEQ ID NO: 29380 - protein, 14 aa, BK virus
CCNCWCSWGYCWVC

SEQ ID NO: 29381 - protein, 14 aa, BK virus
CNCWCSWGYCWVCC

SEQ ID NO: 29382 - protein, 14 aa, BK virus
NCWCSWGYCWVCCF

SEQ ID NO: 29383 - protein, 14 aa, BK virus
CWCSWGYCWVCCFN

SEQ ID NO: 29384 - protein, 14 aa, BK virus
WCSWGYCWVCCFNS

SEQ ID NO: 29385 - protein, 14 aa, BK virus
CSWGYCWVCCFNSN

SEQ ID NO: 29386 - protein, 14 aa, BK virus
SWGYCWVCCFNSNC

SEQ ID NO: 29387 - protein, 14 aa, BK virus
LGSQSFHCRPLSAI

SEQ ID NO: 29388 - protein, 14 aa, BK virus
GSQSFHCRPLSAIR

SEQ ID NO: 29389 - protein, 14 aa, BK virus
SQSFHCRPLSAIRH

SEQ ID NO: 29390 - protein, 14 aa, BK virus
QSFHCRPLSAIRHG

SEQ ID NO: 29391 - protein, 14 aa, BK virus
SFHCRPLSAIRHGF

SEQ ID NO: 29392 - protein, 14 aa, BK virus
FHCRPLSAIRHGFG

SEQ ID NO: 29393 - protein, 14 aa, BK virus
HCRPLSAIRHGFGI

SEQ ID NO: 29394 - protein, 14 aa, BK virus
CRPLSAIRHGFGIV

SEQ ID NO: 29395 - protein, 14 aa, BK virus
ALGSFFVCYYFPGF

SEQ ID NO: 29396 - protein, 14 aa, BK virus
LGSFFVCYYFPGFV

SEQ ID NO: 29397 - protein, 14 aa, BK virus
GSFFVCYYFPGFVA

SEQ ID NO: 29398 - protein, 14 aa, BK virus
SFFVCYYFPGFVAC

SEQ ID NO: 29399 - protein, 14 aa, BK virus
FFVCYYFPGFVACY

SEQ ID NO: 29400 - protein, 14 aa, BK virus
YTFYNLTGIAEKNR

SEQ ID NO: 29401 - protein, 14 aa, BK virus
TFYNLTGIAEKNRK

SEQ ID NO: 29402 - protein, 14 aa, BK virus
FYNLTGIAEKNRKI

SEQ ID NO: 29403 - protein, 14 aa, BK virus
YNLTGIAEKNRKIF

SEQ ID NO: 29404 - protein, 14 aa, BK virus
IFGGNYLDNCKCPY

SEQ ID NO: 29405 - protein, 14 aa, BK virus
FGGNYLDNCKCPYK

SEQ ID NO: 29406 - protein, 14 aa, BK virus
GGNYLDNCKCPYKL

SEQ ID NO: 29407 - protein, 14 aa, BK virus
GNYLDNCKCPYKLL

SEQ ID NO: 29408 - protein, 14 aa, BK virus
QYRRSYTKNGLKKS

SEQ ID NO: 29409 - protein, 14 aa, BK virus
YRRSYTKNGLKKST

SEQ ID NO: 29410 - protein, 14 aa, BK virus
RRSYTKNGLKKSTK

SEQ ID NO: 29411 - protein, 14 aa, BK virus
RSYTKNGLKKSTKC

SEQ ID NO: 29412 - protein, 14 aa, BK virus
SYTKNGLKKSTKCT

SEQ ID NO: 29413 - protein, 14 aa, BK virus
YTKNGLKKSTKCTF

SEQ ID NO: 29414 - protein, 14 aa, BK virus
TKNGLKKSTKCTFR

SEQ ID NO: 29415 - protein, 14 aa, BK virus
KNGLKKSTKCTFRR

SEQ ID NO: 29416 - protein, 14 aa, BK virus
NGLKKSTKCTFRRV

SEQ ID NO: 29417 - protein, 14 aa, BK virus
GLKKSTKCTFRRVY

SEQ ID NO: 29418 - protein, 14 aa, BK virus
LKKSTKCTFRRVYR

SEQ ID NO: 29419 - protein, 14 aa, BK virus
KKSTKCTFRRVYRK

SEQ ID NO: 29420 - protein, 14 aa, BK virus
KSTKCTFRRVYRKN

SEQ ID NO: 29421 - protein, 14 aa, BK virus
STKCTFRRVYRKNY

SEQ ID NO: 29422 - protein, 14 aa, BK virus
TKCTFRRVYRKNYC

SEQ ID NO: 29423 - protein, 14 aa, BK virus
KCTFRRVYRKNYCP

SEQ ID NO: 29424 - protein, 14 aa, BK virus
CTFRRVYRKNYCPR

SEQ ID NO: 29425 - protein, 14 aa, BK virus
TFRRVYRKNYCPRR

SEQ ID NO: 29426 - protein, 14 aa, BK virus
FRRVYRKNYCPRRC

SEQ ID NO: 29427 - protein, 14 aa, BK virus
SKNCSSMDVAFTSR

SEQ ID NO: 29428 - protein, 14 aa, BK virus
KNCSSMDVAFTSRP

SEQ ID NO: 29429 - protein, 14 aa, BK virus
NCSSMDVAFTSRPV

SEQ ID NO: 29430 - protein, 14 aa, BK virus
CSSMDVAFTSRPVR

SEQ ID NO: 29431 - protein, 14 aa, BK virus
SSMDVAFTSRPVRD

SEQ ID NO: 29432 - protein, 14 aa, BK virus
SMDVAFTSRPVRDC

SEQ ID NO: 29433 - protein, 14 aa, BK virus
MDVAFTSRPVRDCN

SEQ ID NO: 29434 - protein, 14 aa, BK virus
DVAFTSRPVRDCNT

SEQ ID NO: 29435 - protein, 14 aa, BK virus
VAFTSRPVRDCNTC

SEQ ID NO: 29436 - protein, 14 aa, BK virus
AFTSRPVRDCNTCS

SEQ ID NO: 29437 - protein, 14 aa, BK virus
RWPQPKEKESVQGQ

SEQ ID NO: 29438 - protein, 14 aa, BK virus
WPQPKEKESVQGQL

SEQ ID NO: 29439 - protein, 14 aa, BK virus
PQPKEKESVQGQLP

SEQ ID NO: 29440 - protein, 14 aa, BK virus
QPKEKESVQGQLPK

SEQ ID NO: 29441 - protein, 14 aa, BK virus
PKEKESVQGQLPKS

SEQ ID NO: 29442 - protein, 14 aa, BK virus
KEKESVQGQLPKSQ

SEQ ID NO: 29443 - protein, 14 aa, BK virus
EKESVQGQLPKSQR

SEQ ID NO: 29444 - protein, 14 aa, BK virus
KESVQGQLPKSQRN

SEQ ID NO: 29445 - protein, 14 aa, BK virus
ESVQGQLPKSQRNP

SEQ ID NO: 29446 - protein, 14 aa, BK virus
SVQGQLPKSQRNPC

SEQ ID NO: 29447 - protein, 14 aa, BK virus
VQGQLPKSQRNPCK

SEQ ID NO: 29448 - protein, 14 aa, BK virus
QGQLPKSQRNPCKC

SEQ ID NO: 29449 - protein, 14 aa, BK virus
GQLPKSQRNPCKCQ

SEQ ID NO: 29450 - protein, 14 aa, BK virus
QLPKSQRNPCKCQN

SEQ ID NO: 29451 - protein, 14 aa, BK virus
LPKSQRNPCKCQNY

SEQ ID NO: 29452 - protein, 14 aa, BK virus
TQKWGIQMKTLGAL

SEQ ID NO: 29453 - protein, 14 aa, BK virus
QKWGIQMKTLGALV

SEQ ID NO: 29454 - protein, 14 aa, BK virus
VLKMTLAVIAQREK

SEQ ID NO: 29455 - protein, 14 aa, BK virus
LKMTLAVIAQREKC

SEQ ID NO: 29456 - protein, 14 aa, BK virus
KMTLAVIAQREKCF

SEQ ID NO: 29457 - protein, 14 aa, BK virus
MTLAVIAQREKCFP

SEQ ID NO: 29458 - protein, 14 aa, BK virus
TLAVIAQREKCFPV

SEQ ID NO: 29459 - protein, 14 aa, BK virus
LAVIAQREKCFPVT

SEQ ID NO: 29460 - protein, 14 aa, BK virus
AVIAQREKCFPVTA

SEQ ID NO: 29461 - protein, 14 aa, BK virus
VIAQREKCFPVTAQ

SEQ ID NO: 29462 - protein, 14 aa, BK virus
IAQREKCFPVTAQQ

SEQ ID NO: 29463 - protein, 14 aa, BK virus
AQREKCFPVTAQQE

SEQ ID NO: 29464 - protein, 14 aa, BK virus
QREKCFPVTAQQEF

SEQ ID NO: 29465 - protein, 14 aa, BK virus
REKCFPVTAQQEFP

SEQ ID NO: 29466 - protein, 14 aa, BK virus
EKCFPVTAQQEFPS

SEQ ID NO: 29467 - protein, 14 aa, BK virus
KCFPVTAQQEFPSP

SEQ ID NO: 29468 - protein, 14 aa, BK virus
CFPVTAQQEFPSPI

SEQ ID NO: 29469 - protein, 14 aa, BK virus
LACLTFMQGHKKCM

SEQ ID NO: 29470 - protein, 14 aa, BK virus
ACLTFMQGHKKCMS

SEQ ID NO: 29471 - protein, 14 aa, BK virus
CLTFMQGHKKCMSM

SEQ ID NO: 29472 - protein, 14 aa, BK virus
LTFMQGHKKCMSMV

SEQ ID NO: 29473 - protein, 14 aa, BK virus
TFMQGHKKCMSMVE

SEQ ID NO: 29474 - protein, 14 aa, BK virus
FMQGHKKCMSMVEE

SEQ ID NO: 29475 - protein, 14 aa, BK virus
MQGHKKCMSMVEEN

SEQ ID NO: 29476 - protein, 14 aa, BK virus
QGHKKCMSMVEENL

SEQ ID NO: 29477 - protein, 14 aa, BK virus
GHKKCMSMVEENLF

SEQ ID NO: 29478 - protein, 14 aa, BK virus
HKKCMSMVEENLFK

SEQ ID NO: 29479 - protein, 14 aa, BK virus
KKCMSMVEENLFKA

SEQ ID NO: 29480 - protein, 14 aa, BK virus
KCMSMVEENLFKAV

SEQ ID NO: 29481 - protein, 14 aa, BK virus
CMSMVEENLFKAVI

SEQ ID NO: 29482 - protein, 14 aa, BK virus
MSMVEENLFKAVIS

SEQ ID NO: 29483 - protein, 14 aa, BK virus
SMVEENLFKAVIST

SEQ ID NO: 29484 - protein, 14 aa, BK virus
MVEENLFKAVISTS

SEQ ID NO: 29485 - protein, 14 aa, BK virus
VEENLFKAVISTSL

SEQ ID NO: 29486 - protein, 14 aa, BK virus
EENLFKAVISTSLL

SEQ ID NO: 29487 - protein, 14 aa, BK virus
ILTIRPIWTKTMLI

SEQ ID NO: 29488 - protein, 14 aa, BK virus
LTIRPIWTKTMLIQ

SEQ ID NO: 29489 - protein, 14 aa, BK virus
TIRPIWTKTMLIQL

SEQ ID NO: 29490 - protein, 14 aa, BK virus
IRPIWTKTMLIQLS

SEQ ID NO: 29491 - protein, 14 aa, BK virus
RPIWTKTMLIQLSA

SEQ ID NO: 29492 - protein, 14 aa, BK virus
PIWTKTMLIQLSAG

SEQ ID NO: 29493 - protein, 14 aa, BK virus
IWTKTMLIQLSAGY

SEQ ID NO: 29494 - protein, 14 aa, BK virus
WTKTMLIQLSAGYL

SEQ ID NO: 29495 - protein, 14 aa, BK virus
TKTMLIQLSAGYLI

SEQ ID NO: 29496 - protein, 14 aa, BK virus
KTMLIQLSAGYLIP

SEQ ID NO: 29497 - protein, 14 aa, BK virus
TMLIQLSAGYLIPV

SEQ ID NO: 29498 - protein, 14 aa, BK virus
MLIQLSAGYLIPVE

SEQ ID NO: 29499 - protein, 14 aa, BK virus
LIQLSAGYLIPVEM

SEQ ID NO: 29500 - protein, 14 aa, BK virus
IQLSAGYLIPVEMK

SEQ ID NO: 29501 - protein, 14 aa, BK virus
QLSAGYLIPVEMKM

SEQ ID NO: 29502 - protein, 14 aa, BK virus
LSAGYLIPVEMKML

SEQ ID NO: 29503 - protein, 14 aa, BK virus
SAGYLIPVEMKMLG

SEQ ID NO: 29504 - protein, 14 aa, BK virus
AGYLIPVEMKMLGI

SEQ ID NO: 29505 - protein, 14 aa, BK virus
GYLIPVEMKMLGIL

SEQ ID NO: 29506 - protein, 14 aa, BK virus
YLIPVEMKMLGILG

SEQ ID NO: 29507 - protein, 14 aa, BK virus
LIPVEMKMLGILGL

SEQ ID NO: 29508 - protein, 14 aa, BK virus
IPVEMKMLGILGLS

SEQ ID NO: 29509 - protein, 14 aa, BK virus
PVEMKMLGILGLSQ

SEQ ID NO: 29510 - protein, 14 aa, BK virus
VEMKMLGILGLSQE

SEQ ID NO: 29511 - protein, 14 aa, BK virus
EMKMLGILGLSQEG

SEQ ID NO: 29512 - protein, 14 aa, BK virus
MKMLGILGLSQEGK

SEQ ID NO: 29513 - protein, 14 aa, BK virus
KMLGILGLSQEGKM

SEQ ID NO: 29514 - protein, 14 aa, BK virus
MLGILGLSQEGKMF

SEQ ID NO: 29515 - protein, 14 aa, BK virus
LGILGLSQEGKMFP

SEQ ID NO: 29516 - protein, 14 aa, BK virus
GILGLSQEGKMFPQ

SEQ ID NO: 29517 - protein, 14 aa, BK virus
ILGLSQEGKMFPQY

SEQ ID NO: 29518 - protein, 14 aa, BK virus
LGLSQEGKMFPQYF

SEQ ID NO: 29519 - protein, 14 aa, BK virus
GLSQEGKMFPQYFM

SEQ ID NO: 29520 - protein, 14 aa, BK virus
MNRVWGLFVKLIAC

SEQ ID NO: 29521 - protein, 14 aa, BK virus
NRVWGLFVKLIACM

SEQ ID NO: 29522 - protein, 14 aa, BK virus
RVWGLFVKLIACMF

SEQ ID NO: 29523 - protein, 14 aa, BK virus
VWGLFVKLIACMFQ

SEQ ID NO: 29524 - protein, 14 aa, BK virus
WGLFVKLIACMFQL

SEQ ID NO: 29525 - protein, 14 aa, BK virus
GLFVKLIACMFQLL

SEQ ID NO: 29526 - protein, 14 aa, BK virus
LFVKLIACMFQLLI

SEQ ID NO: 29527 - protein, 14 aa, BK virus
FVKLIACMFQLLIF

SEQ ID NO: 29528 - protein, 14 aa, BK virus
VKLIACMFQLLIFV

SEQ ID NO: 29529 - protein, 14 aa, BK virus
KLIACMFQLLIFVA

SEQ ID NO: 29530 - protein, 14 aa, BK virus
LIACMFQLLIFVAC

SEQ ID NO: 29531 - protein, 14 aa, BK virus
IACMFQLLIFVACL

SEQ ID NO: 29532 - protein, 14 aa, BK virus
ACMFQLLIFVACLL

SEQ ID NO: 29533 - protein, 14 aa, BK virus
CMFQLLIFVACLLT

SEQ ID NO: 29534 - protein, 14 aa, BK virus
MFQLLIFVACLLTA

SEQ ID NO: 29535 - protein, 14 aa, BK virus
FQLLIFVACLLTAL

SEQ ID NO: 29536 - protein, 14 aa, BK virus
QLLIFVACLLTALE

SEQ ID NO: 29537 - protein, 14 aa, BK virus
LLIFVACLLTALEH

SEQ ID NO: 29538 - protein, 14 aa, BK virus
LIFVACLLTALEHN

SEQ ID NO: 29539 - protein, 14 aa, BK virus
IFVACLLTALEHNS

SEQ ID NO: 29540 - protein, 14 aa, BK virus
FVACLLTALEHNSG

SEQ ID NO: 29541 - protein, 14 aa, BK virus
VACLLTALEHNSGE

SEQ ID NO: 29542 - protein, 14 aa, BK virus
ACLLTALEHNSGEA

SEQ ID NO: 29543 - protein, 14 aa, BK virus
CLLTALEHNSGEAL

SEQ ID NO: 29544 - protein, 14 aa, BK virus
LLTALEHNSGEALQ

SEQ ID NO: 29545 - protein, 14 aa, BK virus
LTALEHNSGEALQD

SEQ ID NO: 29546 - protein, 14 aa, BK virus
TALEHNSGEALQDI

SEQ ID NO: 29547 - protein, 14 aa, BK virus
ALEHNSGEALQDIL

SEQ ID NO: 29548 - protein, 14 aa, BK virus
LEHNSGEALQDILR

SEQ ID NO: 29549 - protein, 14 aa, BK virus
EHNSGEALQDILRS

SEQ ID NO: 29550 - protein, 14 aa, BK virus
HNSGEALQDILRSA

SEQ ID NO: 29551 - protein, 14 aa, BK virus
TGEPREWMGSLCMV

SEQ ID NO: 29552 - protein, 14 aa, BK virus
GEPREWMGSLCMVW

SEQ ID NO: 29553 - protein, 14 aa, BK virus
EPREWMGSLCMVWN

SEQ ID NO: 29554 - protein, 14 aa, BK virus
PREWMGSLCMVWNP

SEQ ID NO: 29555 - protein, 14 aa, BK virus
REWMGSLCMVWNPR

SEQ ID NO: 29556 - protein, 14 aa, BK virus
KRLGCLMAQKDFQG

SEQ ID NO: 29557 - protein, 14 aa, BK virus
RLGCLMAQKDFQGT

SEQ ID NO: 29558 - protein, 14 aa, BK virus
LGCLMAQKDFQGTQ

SEQ ID NO: 29559 - protein, 14 aa, BK virus
GCLMAQKDFQGTQI

SEQ ID NO: 29560 - protein, 14 aa, BK virus
DILTNRDNCKPKCF

SEQ ID NO: 29561 - protein, 14 aa, BK virus
ILTNRDNCKPKCFK

SEQ ID NO: 29562 - protein, 14 aa, BK virus
LTNRDNCKPKCFKQ

SEQ ID NO: 29563 - protein, 14 aa, BK virus
TNRDNCKPKCFKQV

SEQ ID NO: 29564 - protein, 14 aa, BK virus
NRDNCKPKCFKQVL

SEQ ID NO: 29565 - protein, 14 aa, BK virus
RDNCKPKCFKQVLL

SEQ ID NO: 29566 - protein, 14 aa, BK virus
DNCKPKCFKQVLLL

SEQ ID NO: 29567 - protein, 14 aa, BK virus
NCKPKCFKQVLLLY

SEQ ID NO: 29568 - protein, 14 aa, BK virus
CKPKCFKQVLLLYI

SEQ ID NO: 29569 - protein, 14 aa, BK virus
KPKCFKQVLLLYIY

SEQ ID NO: 29570 - protein, 14 aa, BK virus
PKCFKQVLLLYIYI

SEQ ID NO: 29571 - protein, 14 aa, BK virus
MLLLYKPLLSLCYF

SEQ ID NO: 29572 - protein, 14 aa, BK virus
LLLYKPLLSLCYFG

SEQ ID NO: 29573 - protein, 14 aa, BK virus
LLYKPLLSLCYFGG

SEQ ID NO: 29574 - protein, 14 aa, BK virus
LYKPLLSLCYFGGG

SEQ ID NO: 29575 - protein, 14 aa, BK virus
YKPLLSLCYFGGGV

SEQ ID NO: 29576 - protein, 14 aa, BK virus
KPLLSLCYFGGGVL

SEQ ID NO: 29577 - protein, 14 aa, BK virus
PLLSLCYFGGGVLG

SEQ ID NO: 29578 - protein, 14 aa, BK virus
LLSLCYFGGGVLGL

SEQ ID NO: 29579 - protein, 14 aa, BK virus
LSLCYFGGGVLGLL

SEQ ID NO: 29580 - protein, 14 aa, BK virus
SLCYFGGGVLGLLK

SEQ ID NO: 29581 - protein, 14 aa, BK virus
LCYFGGGVLGLLKH

SEQ ID NO: 29582 - protein, 14 aa, BK virus
LWGSDLWESSAGAE

SEQ ID NO: 29583 - protein, 14 aa, BK virus
WGSDLWESSAGAEV

SEQ ID NO: 29584 - protein, 14 aa, BK virus
GSDLWESSAGAEVS

SEQ ID NO: 29585 - protein, 14 aa, BK virus
SDLWESSAGAEVSE

SEQ ID NO: 29586 - protein, 14 aa, BK virus
DLWESSAGAEVSET

SEQ ID NO: 29587 - protein, 14 aa, BK virus
LWESSAGAEVSETW

SEQ ID NO: 29588 - protein, 14 aa, BK virus
WESSAGAEVSETWE

SEQ ID NO: 29589 - protein, 14 aa, BK virus
ESSAGAEVSETWEE

SEQ ID NO: 29590 - protein, 14 aa, BK virus
SSAGAEVSETWEEH

SEQ ID NO: 29591 - protein, 14 aa, BK virus
SAGAEVSETWEEHC

SEQ ID NO: 29592 - protein, 14 aa, BK virus
AGAEVSETWEEHCD

SEQ ID NO: 29593 - protein, 14 aa, BK virus
GAEVSETWEEHCDW

SEQ ID NO: 29594 - protein, 14 aa, BK virus
AEVSETWEEHCDWD

SEQ ID NO: 29595 - protein, 14 aa, BK virus
EVSETWEEHCDWDS

SEQ ID NO: 29596 - protein, 14 aa, BK virus
VSETWEEHCDWDSV

SEQ ID NO: 29597 - protein, 14 aa, BK virus
SETWEEHCDWDSVL

SEQ ID NO: 29598 - protein, 14 aa, BK virus
ETWEEHCDWDSVLD

SEQ ID NO: 29599 - protein, 14 aa, BK virus
TWEEHCDWDSVLDP

SEQ ID NO: 29600 - protein, 14 aa, BK virus
WEEHCDWDSVLDPC

SEQ ID NO: 29601 - protein, 14 aa, BK virus
EEHCDWDSVLDPCP

SEQ ID NO: 29602 - protein, 14 aa, BK virus
EHCDWDSVLDPCPE

SEQ ID NO: 29603 - protein, 14 aa, BK virus
HCDWDSVLDPCPES

SEQ ID NO: 29604 - protein, 14 aa, BK virus
CDWDSVLDPCPESS

SEQ ID NO: 29605 - protein, 14 aa, BK virus
DWDSVLDPCPESSV

SEQ ID NO: 29606 - protein, 14 aa, BK virus
WDSVLDPCPESSVS

SEQ ID NO: 29607 - protein, 14 aa, BK virus
DSVLDPCPESSVSE

SEQ ID NO: 29608 - protein, 14 aa, BK virus
SVLDPCPESSVSES

SEQ ID NO: 29609 - protein, 14 aa, BK virus
VLDPCPESSVSESS

SEQ ID NO: 29610 - protein, 14 aa, BK virus
LDPCPESSVSESSS

SEQ ID NO: 29611 - protein, 14 aa, BK virus
DPCPESSVSESSSL

SEQ ID NO: 29612 - protein, 14 aa, BK virus
PCPESSVSESSSLV

SEQ ID NO: 29613 - protein, 14 aa, BK virus
CPESSVSESSSLVI

SEQ ID NO: 29614 - protein, 14 aa, BK virus
PESSVSESSSLVIS

SEQ ID NO: 29615 - protein, 14 aa, BK virus
ESSVSESSSLVISR

SEQ ID NO: 29616 - protein, 14 aa, BK virus
SSVSESSSLVISRI

SEQ ID NO: 29617 - protein, 14 aa, BK virus
SVSESSSLVISRIH

SEQ ID NO: 29618 - protein, 14 aa, BK virus
VSESSSLVISRIHF

SEQ ID NO: 29619 - protein, 14 aa, BK virus
SESSSLVISRIHFP

SEQ ID NO: 29620 - protein, 14 aa, BK virus
ESSSLVISRIHFPM

SEQ ID NO: 29621 - protein, 14 aa, BK virus
SSSLVISRIHFPMH

SEQ ID NO: 29622 - protein, 14 aa, BK virus
SSLVISRIHFPMHI

SEQ ID NO: 29623 - protein, 14 aa, BK virus
SLVISRIHFPMHIL

SEQ ID NO: 29624 - protein, 14 aa, BK virus
LVISRIHFPMHILY

SEQ ID NO: 29625 - protein, 14 aa, BK virus
VISRIHFPMHILYF

SEQ ID NO: 29626 - protein, 14 aa, BK virus
ISRIHFPMHILYFI

SEQ ID NO: 29627 - protein, 14 aa, BK virus
SRIHFPMHILYFIL

SEQ ID NO: 29628 - protein, 14 aa, BK virus
RIHFPMHILYFILE

SEQ ID NO: 29629 - protein, 14 aa, BK virus
IHFPMHILYFILEK

SEQ ID NO: 29630 - protein, 14 aa, BK virus
HFPMHILYFILEKV

SEQ ID NO: 29631 - protein, 14 aa, BK virus
FPMHILYFILEKVY

SEQ ID NO: 29632 - protein, 14 aa, BK virus
PMHILYFILEKVYI

SEQ ID NO: 29633 - protein, 14 aa, BK virus
MHILYFILEKVYIL

SEQ ID NO: 29634 - protein, 14 aa, BK virus
HILYFILEKVYILI

SEQ ID NO: 29635 - protein, 14 aa, BK virus
ILYFILEKVYILIS

SEQ ID NO: 29636 - protein, 14 aa, BK virus
LYFILEKVYILISE

SEQ ID NO: 29637 - protein, 14 aa, BK virus
YFILEKVYILISES

SEQ ID NO: 29638 - protein, 14 aa, BK virus
FILEKVYILISESS

SEQ ID NO: 29639 - protein, 14 aa, BK virus
ILEKVYILISESSL

SEQ ID NO: 29640 - protein, 14 aa, BK virus
LEKVYILISESSLS

SEQ ID NO: 29641 - protein, 14 aa, BK virus
EKVYILISESSLSF

SEQ ID NO: 29642 - protein, 14 aa, BK virus
KVYILISESSLSFH

SEQ ID NO: 29643 - protein, 14 aa, BK virus
VYILISESSLSFHS

SEQ ID NO: 29644 - protein, 14 aa, BK virus
YILISESSLSFHST

SEQ ID NO: 29645 - protein, 14 aa, BK virus
ILISESSLSFHSTI

SEQ ID NO: 29646 - protein, 14 aa, BK virus
LISESSLSFHSTIL

SEQ ID NO: 29647 - protein, 14 aa, BK virus
ISESSLSFHSTILD

SEQ ID NO: 29648 - protein, 14 aa, BK virus
SESSLSFHSTILDC

SEQ ID NO: 29649 - protein, 14 aa, BK virus
ESSLSFHSTILDCI

SEQ ID NO: 29650 - protein, 14 aa, BK virus
SSLSFHSTILDCIS

SEQ ID NO: 29651 - protein, 14 aa, BK virus
SLSFHSTILDCISV

SEQ ID NO: 29652 - protein, 14 aa, BK virus
LSFHSTILDCISVA

SEQ ID NO: 29653 - protein, 14 aa, BK virus
SFHSTILDCISVAK

SEQ ID NO: 29654 - protein, 14 aa, BK virus
FHSTILDCISVAKS

SEQ ID NO: 29655 - protein, 14 aa, BK virus
HSTILDCISVAKSA

SEQ ID NO: 29656 - protein, 14 aa, BK virus
STILDCISVAKSAT

SEQ ID NO: 29657 - protein, 14 aa, BK virus
TILDCISVAKSATG

SEQ ID NO: 29658 - protein, 14 aa, BK virus
ILDCISVAKSATGL

SEQ ID NO: 29659 - protein, 14 aa, BK virus
LDCISVAKSATGLN

SEQ ID NO: 29660 - protein, 14 aa, BK virus
DCISVAKSATGLNQ

SEQ ID NO: 29661 - protein, 14 aa, BK virus
CISVAKSATGLNQI

SEQ ID NO: 29662 - protein, 14 aa, BK virus
ISVAKSATGLNQIS

SEQ ID NO: 29663 - protein, 14 aa, BK virus
SVAKSATGLNQISS

SEQ ID NO: 29664 - protein, 14 aa, BK virus
VAKSATGLNQISSS

SEQ ID NO: 29665 - protein, 14 aa, BK virus
AKSATGLNQISSSN

SEQ ID NO: 29666 - protein, 14 aa, BK virus
KSATGLNQISSSNK

SEQ ID NO: 29667 - protein, 14 aa, BK virus
SATGLNQISSSNKV

SEQ ID NO: 29668 - protein, 14 aa, BK virus
ATGLNQISSSNKVI

SEQ ID NO: 29669 - protein, 14 aa, BK virus
TGLNQISSSNKVIP

SEQ ID NO: 29670 - protein, 14 aa, BK virus
GLNQISSSNKVIPL

SEQ ID NO: 29671 - protein, 14 aa, BK virus
LNQISSSNKVIPLC

SEQ ID NO: 29672 - protein, 14 aa, BK virus
NQISSSNKVIPLCK

SEQ ID NO: 29673 - protein, 14 aa, BK virus
QISSSNKVIPLCKI

SEQ ID NO: 29674 - protein, 14 aa, BK virus
ISSSNKVIPLCKIL

SEQ ID NO: 29675 - protein, 14 aa, BK virus
SSSNKVIPLCKILF

SEQ ID NO: 29676 - protein, 14 aa, BK virus
SSNKVIPLCKILFS

SEQ ID NO: 29677 - protein, 14 aa, BK virus
SNKVIPLCKILFSS

SEQ ID NO: 29678 - protein, 14 aa, BK virus
NKVIPLCKILFSSK

SEQ ID NO: 29679 - protein, 14 aa, BK virus
KVIPLCKILFSSKN

SEQ ID NO: 29680 - protein, 14 aa, BK virus
VIPLCKILFSSKNS

SEQ ID NO: 29681 - protein, 14 aa, BK virus
IPLCKILFSSKNSE

SEQ ID NO: 29682 - protein, 14 aa, BK virus
PLCKILFSSKNSEF

SEQ ID NO: 29683 - protein, 14 aa, BK virus
LCKILFSSKNSEFC

SEQ ID NO: 29684 - protein, 14 aa, BK virus
CKILFSSKNSEFCK

SEQ ID NO: 29685 - protein, 14 aa, BK virus
KILFSSKNSEFCKD

SEQ ID NO: 29686 - protein, 14 aa, BK virus
ILFSSKNSEFCKDF

SEQ ID NO: 29687 - protein, 14 aa, BK virus
LFSSKNSEFCKDFL

SEQ ID NO: 29688 - protein, 14 aa, BK virus
FSSKNSEFCKDFLK

SEQ ID NO: 29689 - protein, 14 aa, BK virus
SSKNSEFCKDFLKY

SEQ ID NO: 29690 - protein, 14 aa, BK virus
SKNSEFCKDFLKYI

SEQ ID NO: 29691 - protein, 14 aa, BK virus
KNSEFCKDFLKYIL

SEQ ID NO: 29692 - protein, 14 aa, BK virus
NSEFCKDFLKYILG

SEQ ID NO: 29693 - protein, 14 aa, BK virus
SEFCKDFLKYILGL

SEQ ID NO: 29694 - protein, 14 aa, BK virus
EFCKDFLKYILGLK

SEQ ID NO: 29695 - protein, 14 aa, BK virus
FCKDFLKYILGLKS

SEQ ID NO: 29696 - protein, 14 aa, BK virus
CKDFLKYILGLKSI

SEQ ID NO: 29697 - protein, 14 aa, BK virus
KDFLKYILGLKSIC

SEQ ID NO: 29698 - protein, 14 aa, BK virus
DFLKYILGLKSICL

SEQ ID NO: 29699 - protein, 14 aa, BK virus
FLKYILGLKSICLT

SEQ ID NO: 29700 - protein, 14 aa, BK virus
LKYILGLKSICLTN

SEQ ID NO: 29701 - protein, 14 aa, BK virus
KYILGLKSICLTNL

SEQ ID NO: 29702 - protein, 14 aa, BK virus
YILGLKSICLTNLA

SEQ ID NO: 29703 - protein, 14 aa, BK virus
ILGLKSICLTNLAC

SEQ ID NO: 29704 - protein, 14 aa, BK virus
LGLKSICLTNLACR

SEQ ID NO: 29705 - protein, 14 aa, BK virus
GLKSICLTNLACRV

SEQ ID NO: 29706 - protein, 14 aa, BK virus
LKSICLTNLACRVL

SEQ ID NO: 29707 - protein, 14 aa, BK virus
KSICLTNLACRVLG

SEQ ID NO: 29708 - protein, 14 aa, BK virus
SICLTNLACRVLGT

SEQ ID NO: 29709 - protein, 14 aa, BK virus
ICLTNLACRVLGTG

SEQ ID NO: 29710 - protein, 14 aa, BK virus
CLTNLACRVLGTGY

SEQ ID NO: 29711 - protein, 14 aa, BK virus
LTNLACRVLGTGYS

SEQ ID NO: 29712 - protein, 14 aa, BK virus
TNLACRVLGTGYSF

SEQ ID NO: 29713 - protein, 14 aa, BK virus
NLACRVLGTGYSFI

SEQ ID NO: 29714 - protein, 14 aa, BK virus
LACRVLGTGYSFIV

SEQ ID NO: 29715 - protein, 14 aa, BK virus
ACRVLGTGYSFIVT

SEQ ID NO: 29716 - protein, 14 aa, BK virus
CRVLGTGYSFIVTK

SEQ ID NO: 29717 - protein, 14 aa, BK virus
RVLGTGYSFIVTKP

SEQ ID NO: 29718 - protein, 14 aa, BK virus
VLGTGYSFIVTKPG

SEQ ID NO: 29719 - protein, 14 aa, BK virus
LGTGYSFIVTKPGG

SEQ ID NO: 29720 - protein, 14 aa, BK virus
GTGYSFIVTKPGGN

SEQ ID NO: 29721 - protein, 14 aa, BK virus
TGYSFIVTKPGGNI

SEQ ID NO: 29722 - protein, 14 aa, BK virus
GYSFIVTKPGGNIW

SEQ ID NO: 29723 - protein, 14 aa, BK virus
YSFIVTKPGGNIWV

SEQ ID NO: 29724 - protein, 14 aa, BK virus
SFIVTKPGGNIWVL

SEQ ID NO: 29725 - protein, 14 aa, BK virus
FIVTKPGGNIWVLL

SEQ ID NO: 29726 - protein, 14 aa, BK virus
IVTKPGGNIWVLLF

SEQ ID NO: 29727 - protein, 14 aa, BK virus
VTKPGGNIWVLLFK

SEQ ID NO: 29728 - protein, 14 aa, BK virus
TKPGGNIWVLLFKC

SEQ ID NO: 29729 - protein, 14 aa, BK virus
KPGGNIWVLLFKCF

SEQ ID NO: 29730 - protein, 14 aa, BK virus
PGGNIWVLLFKCFF

SEQ ID NO: 29731 - protein, 14 aa, BK virus
GGNIWVLLFKCFFS

SEQ ID NO: 29732 - protein, 14 aa, BK virus
GNIWVLLFKCFFSK

SEQ ID NO: 29733 - protein, 14 aa, BK virus
NIWVLLFKCFFSKF

SEQ ID NO: 29734 - protein, 14 aa, BK virus
IWVLLFKCFFSKFT

SEQ ID NO: 29735 - protein, 14 aa, BK virus
WVLLFKCFFSKFTL

SEQ ID NO: 29736 - protein, 14 aa, BK virus
VLLFKCFFSKFTLT

SEQ ID NO: 29737 - protein, 14 aa, BK virus
LLFKCFFSKFTLTL

SEQ ID NO: 29738 - protein, 14 aa, BK virus
LFKCFFSKFTLTLP

SEQ ID NO: 29739 - protein, 14 aa, BK virus
FKCFFSKFTLTLPS

SEQ ID NO: 29740 - protein, 14 aa, BK virus
KCFFSKFTLTLPSK

SEQ ID NO: 29741 - protein, 14 aa, BK virus
SLKLSKLFIPCPEG

SEQ ID NO: 29742 - protein, 14 aa, BK virus
LKLSKLFIPCPEGK

SEQ ID NO: 29743 - protein, 14 aa, BK virus
KLSKLFIPCPEGKS

SEQ ID NO: 29744 - protein, 14 aa, BK virus
LSKLFIPCPEGKSF

SEQ ID NO: 29745 - protein, 14 aa, BK virus
SKLFIPCPEGKSFD

SEQ ID NO: 29746 - protein, 14 aa, BK virus
KLFIPCPEGKSFDS

SEQ ID NO: 29747 - protein, 14 aa, BK virus
LFIPCPEGKSFDSA

SEQ ID NO: 29748 - protein, 14 aa, BK virus
FIPCPEGKSFDSAP

SEQ ID NO: 29749 - protein, 14 aa, BK virus
IPCPEGKSFDSAPV

SEQ ID NO: 29750 - protein, 14 aa, BK virus
PCPEGKSFDSAPVP

SEQ ID NO: 29751 - protein, 14 aa, BK virus
CPEGKSFDSAPVPF

SEQ ID NO: 29752 - protein, 14 aa, BK virus
PEGKSFDSAPVPFT

SEQ ID NO: 29753 - protein, 14 aa, BK virus
EGKSFDSAPVPFTS

SEQ ID NO: 29754 - protein, 14 aa, BK virus
GKSFDSAPVPFTSS

SEQ ID NO: 29755 - protein, 14 aa, BK virus
KSFDSAPVPFTSSK

SEQ ID NO: 29756 - protein, 14 aa, BK virus
SFDSAPVPFTSSKT

SEQ ID NO: 29757 - protein, 14 aa, BK virus
FDSAPVPFTSSKTT

SEQ ID NO: 29758 - protein, 14 aa, BK virus
DSAPVPFTSSKTTM

SEQ ID NO: 29759 - protein, 14 aa, BK virus
SAPVPFTSSKTTMY

SEQ ID NO: 29760 - protein, 14 aa, BK virus
SIATPSSKVSLSMG

SEQ ID NO: 29761 - protein, 14 aa, BK virus
IATPSSKVSLSMGR

SEQ ID NO: 29762 - protein, 14 aa, BK virus
ATPSSKVSLSMGRF

SEQ ID NO: 29763 - protein, 14 aa, BK virus
TPSSKVSLSMGRFT

SEQ ID NO: 29764 - protein, 14 aa, BK virus
PSSKVSLSMGRFTF

SEQ ID NO: 29765 - protein, 14 aa, BK virus
SSKVSLSMGRFTFK

SEQ ID NO: 29766 - protein, 14 aa, BK virus
SKVSLSMGRFTFKA

SEQ ID NO: 29767 - protein, 14 aa, BK virus
KVSLSMGRFTFKAL

SEQ ID NO: 29768 - protein, 14 aa, BK virus
VSLSMGRFTFKALP

SEQ ID NO: 29769 - protein, 14 aa, BK virus
SLSMGRFTFKALPP

SEQ ID NO: 29770 - protein, 14 aa, BK virus
LSMGRFTFKALPPH

SEQ ID NO: 29771 - protein, 14 aa, BK virus
SMGRFTFKALPPHK

SEQ ID NO: 29772 - protein, 14 aa, BK virus
MGRFTFKALPPHKS

SEQ ID NO: 29773 - protein, 14 aa, BK virus
GRFTFKALPPHKSN

SEQ ID NO: 29774 - protein, 14 aa, BK virus
RFTFKALPPHKSNN

SEQ ID NO: 29775 - protein, 14 aa, BK virus
FTFKALPPHKSNNP

SEQ ID NO: 29776 - protein, 14 aa, BK virus
TFKALPPHKSNNPA

SEQ ID NO: 29777 - protein, 14 aa, BK virus
FKALPPHKSNNPAA

SEQ ID NO: 29778 - protein, 14 aa, BK virus
KALPPHKSNNPAAS

SEQ ID NO: 29779 - protein, 14 aa, BK virus
ALPPHKSNNPAASV

SEQ ID NO: 29780 - protein, 14 aa, BK virus
LPPHKSNNPAASVV

SEQ ID NO: 29781 - protein, 14 aa, BK virus
PPHKSNNPAASVVF

SEQ ID NO: 29782 - protein, 14 aa, BK virus
PHKSNNPAASVVFP

SEQ ID NO: 29783 - protein, 14 aa, BK virus
HKSNNPAASVVFPL

SEQ ID NO: 29784 - protein, 14 aa, BK virus
KSNNPAASVVFPLS

SEQ ID NO: 29785 - protein, 14 aa, BK virus
SNNPAASVVFPLSM

SEQ ID NO: 29786 - protein, 14 aa, BK virus
NNPAASVVFPLSMG

SEQ ID NO: 29787 - protein, 14 aa, BK virus
NPAASVVFPLSMGP

SEQ ID NO: 29788 - protein, 14 aa, BK virus
PAASVVFPLSMGPL

SEQ ID NO: 29789 - protein, 14 aa, BK virus
AASVVFPLSMGPLN

SEQ ID NO: 29790 - protein, 14 aa, BK virus
ASVVFPLSMGPLNN

SEQ ID NO: 29791 - protein, 14 aa, BK virus
SVVFPLSMGPLNNQ

SEQ ID NO: 29792 - protein, 14 aa, BK virus
VVFPLSMGPLNNQY

SEQ ID NO: 29793 - protein, 14 aa, BK virus
VFPLSMGPLNNQYL

SEQ ID NO: 29794 - protein, 14 aa, BK virus
FPLSMGPLNNQYLL

SEQ ID NO: 29795 - protein, 14 aa, BK virus
PLSMGPLNNQYLLL

SEQ ID NO: 29796 - protein, 14 aa, BK virus
LSMGPLNNQYLLLG

SEQ ID NO: 29797 - protein, 14 aa, BK virus
SMGPLNNQYLLLGT

SEQ ID NO: 29798 - protein, 14 aa, BK virus
MGPLNNQYLLLGTL

SEQ ID NO: 29799 - protein, 14 aa, BK virus
GPLNNQYLLLGTLK

SEQ ID NO: 29800 - protein, 14 aa, BK virus
PLNNQYLLLGTLKT

SEQ ID NO: 29801 - protein, 14 aa, BK virus
LNNQYLLLGTLKTI

SEQ ID NO: 29802 - protein, 14 aa, BK virus
NNQYLLLGTLKTIQ

SEQ ID NO: 29803 - protein, 14 aa, BK virus
NQYLLLGTLKTIQC

SEQ ID NO: 29804 - protein, 14 aa, BK virus
QYLLLGTLKTIQCK

SEQ ID NO: 29805 - protein, 14 aa, BK virus
YLLLGTLKTIQCKK

SEQ ID NO: 29806 - protein, 14 aa, BK virus
LLLGTLKTIQCKKS

SEQ ID NO: 29807 - protein, 14 aa, BK virus
LLGTLKTIQCKKSN

SEQ ID NO: 29808 - protein, 14 aa, BK virus
LGTLKTIQCKKSNI

SEQ ID NO: 29809 - protein, 14 aa, BK virus
GTLKTIQCKKSNIT

SEQ ID NO: 29810 - protein, 14 aa, BK virus
TLKTIQCKKSNITE

SEQ ID NO: 29811 - protein, 14 aa, BK virus
LKTIQCKKSNITES

SEQ ID NO: 29812 - protein, 14 aa, BK virus
KTIQCKKSNITESI

SEQ ID NO: 29813 - protein, 14 aa, BK virus
TIQCKKSNITESIL

SEQ ID NO: 29814 - protein, 14 aa, BK virus
IQCKKSNITESILG

SEQ ID NO: 29815 - protein, 14 aa, BK virus
QCKKSNITESILGS

SEQ ID NO: 29816 - protein, 14 aa, BK virus
CKKSNITESILGSK

SEQ ID NO: 29817 - protein, 14 aa, BK virus
KKSNITESILGSKQ

SEQ ID NO: 29818 - protein, 14 aa, BK virus
KSNITESILGSKQC

SEQ ID NO: 29819 - protein, 14 aa, BK virus
SNITESILGSKQCS

SEQ ID NO: 29820 - protein, 14 aa, BK virus
NITESILGSKQCSQ

SEQ ID NO: 29821 - protein, 14 aa, BK virus
ITESILGSKQCSQA

SEQ ID NO: 29822 - protein, 14 aa, BK virus
TESILGSKQCSQAT

SEQ ID NO: 29823 - protein, 14 aa, BK virus
ESILGSKQCSQATP

SEQ ID NO: 29824 - protein, 14 aa, BK virus
SILGSKQCSQATPA

SEQ ID NO: 29825 - protein, 14 aa, BK virus
ILGSKQCSQATPAI

SEQ ID NO: 29826 - protein, 14 aa, BK virus
LGSKQCSQATPAIY

SEQ ID NO: 29827 - protein, 14 aa, BK virus
GSKQCSQATPAIYC

SEQ ID NO: 29828 - protein, 14 aa, BK virus
SKQCSQATPAIYCS

SEQ ID NO: 29829 - protein, 14 aa, BK virus
KQCSQATPAIYCSS

SEQ ID NO: 29830 - protein, 14 aa, BK virus
QCSQATPAIYCSST

SEQ ID NO: 29831 - protein, 14 aa, BK virus
CSQATPAIYCSSTA

SEQ ID NO: 29832 - protein, 14 aa, BK virus
SQATPAIYCSSTAF

SEQ ID NO: 29833 - protein, 14 aa, BK virus
QATPAIYCSSTAFP

SEQ ID NO: 29834 - protein, 14 aa, BK virus
RVSTLFLAKTVSTA

SEQ ID NO: 29835 - protein, 14 aa, BK virus
VSTLFLAKTVSTAC

SEQ ID NO: 29836 - protein, 14 aa, BK virus
FLLSAKIIAFAKCF

SEQ ID NO: 29837 - protein, 14 aa, BK virus
LLSAKIIAFAKCFS

SEQ ID NO: 29838 - protein, 14 aa, BK virus
NSKYIPNNKNTSSH

SEQ ID NO: 29839 - protein, 14 aa, BK virus
SKYIPNNKNTSSHF

SEQ ID NO: 29840 - protein, 14 aa, BK virus
KYIPNNKNTSSHFV

SEQ ID NO: 29841 - protein, 14 aa, BK virus
YIPNNKNTSSHFVS

SEQ ID NO: 29842 - protein, 14 aa, BK virus
IPNNKNTSSHFVST

SEQ ID NO: 29843 - protein, 14 aa, BK virus
PNNKNTSSHFVSTA

SEQ ID NO: 29844 - protein, 14 aa, BK virus
NNKNTSSHFVSTAY

SEQ ID NO: 29845 - protein, 14 aa, BK virus
NKNTSSHFVSTAYS

SEQ ID NO: 29846 - protein, 14 aa, BK virus
KNTSSHFVSTAYSV

SEQ ID NO: 29847 - protein, 14 aa, BK virus
NTSSHFVSTAYSVI

SEQ ID NO: 29848 - protein, 14 aa, BK virus
TSSHFVSTAYSVIN

SEQ ID NO: 29849 - protein, 14 aa, BK virus
SSHFVSTAYSVINF

SEQ ID NO: 29850 - protein, 14 aa, BK virus
SHFVSTAYSVINFQ

SEQ ID NO: 29851 - protein, 14 aa, BK virus
HFVSTAYSVINFQD

SEQ ID NO: 29852 - protein, 14 aa, BK virus
FVSTAYSVINFQDT

SEQ ID NO: 29853 - protein, 14 aa, BK virus
VSTAYSVINFQDTC

SEQ ID NO: 29854 - protein, 14 aa, BK virus
STAYSVINFQDTCF

SEQ ID NO: 29855 - protein, 14 aa, BK virus
TAYSVINFQDTCFV

SEQ ID NO: 29856 - protein, 14 aa, BK virus
AYSVINFQDTCFVS

SEQ ID NO: 29857 - protein, 14 aa, BK virus
YSVINFQDTCFVSS

SEQ ID NO: 29858 - protein, 14 aa, BK virus
SVINFQDTCFVSSG

SEQ ID NO: 29859 - protein, 14 aa, BK virus
VINFQDTCFVSSGS

SEQ ID NO: 29860 - protein, 14 aa, BK virus
INFQDTCFVSSGSS

SEQ ID NO: 29861 - protein, 14 aa, BK virus
NFQDTCFVSSGSSG

SEQ ID NO: 29862 - protein, 14 aa, BK virus
FQDTCFVSSGSSGL

SEQ ID NO: 29863 - protein, 14 aa, BK virus
QDTCFVSSGSSGLK

SEQ ID NO: 29864 - protein, 14 aa, BK virus
DTCFVSSGSSGLKS

SEQ ID NO: 29865 - protein, 14 aa, BK virus
TCFVSSGSSGLKSC

SEQ ID NO: 29866 - protein, 14 aa, BK virus
CFVSSGSSGLKSCS

SEQ ID NO: 29867 - protein, 14 aa, BK virus
FVSSGSSGLKSCSF

SEQ ID NO: 29868 - protein, 14 aa, BK virus
VSSGSSGLKSCSFK

SEQ ID NO: 29869 - protein, 14 aa, BK virus
SSGSSGLKSCSFKP

SEQ ID NO: 29870 - protein, 14 aa, BK virus
SGSSGLKSCSFKPP

SEQ ID NO: 29871 - protein, 14 aa, BK virus
MLSSIVWYGSLVKA

SEQ ID NO: 29872 - protein, 14 aa, BK virus
LSSIVWYGSLVKAL

SEQ ID NO: 29873 - protein, 14 aa, BK virus
SSIVWYGSLVKALY

SEQ ID NO: 29874 - protein, 14 aa, BK virus
SIVWYGSLVKALYS

SEQ ID NO: 29875 - protein, 14 aa, BK virus
IVWYGSLVKALYSK

SEQ ID NO: 29876 - protein, 14 aa, BK virus
VWYGSLVKALYSKY

SEQ ID NO: 29877 - protein, 14 aa, BK virus
WYGSLVKALYSKYS

SEQ ID NO: 29878 - protein, 14 aa, BK virus
YGSLVKALYSKYSL

SEQ ID NO: 29879 - protein, 14 aa, BK virus
GSLVKALYSKYSLL

SEQ ID NO: 29880 - protein, 14 aa, BK virus
SLVKALYSKYSLLT

SEQ ID NO: 29881 - protein, 14 aa, BK virus
LVKALYSKYSLLTP

SEQ ID NO: 29882 - protein, 14 aa, BK virus
VKALYSKYSLLTPL

SEQ ID NO: 29883 - protein, 14 aa, BK virus
KALYSKYSLLTPLQ

SEQ ID NO: 29884 - protein, 14 aa, BK virus
ALYSKYSLLTPLQI

SEQ ID NO: 29885 - protein, 14 aa, BK virus
LYSKYSLLTPLQIK

SEQ ID NO: 29886 - protein, 14 aa, BK virus
YSKYSLLTPLQIKK

SEQ ID NO: 29887 - protein, 14 aa, BK virus
SKYSLLTPLQIKKL

SEQ ID NO: 29888 - protein, 14 aa, BK virus
KYSLLTPLQIKKLK

SEQ ID NO: 29889 - protein, 14 aa, BK virus
YSLLTPLQIKKLKV

SEQ ID NO: 29890 - protein, 14 aa, BK virus
SLLTPLQIKKLKVH

SEQ ID NO: 29891 - protein, 14 aa, BK virus
LLTPLQIKKLKVHS

SEQ ID NO: 29892 - protein, 14 aa, BK virus
LTPLQIKKLKVHSF

SEQ ID NO: 29893 - protein, 14 aa, BK virus
QKLLIAETLCLCGV

SEQ ID NO: 29894 - protein, 14 aa, BK virus
KLLIAETLCLCGVK

SEQ ID NO: 29895 - protein, 14 aa, BK virus
LLIAETLCLCGVKK

SEQ ID NO: 29896 - protein, 14 aa, BK virus
LIAETLCLCGVKKN

SEQ ID NO: 29897 - protein, 14 aa, BK virus
IAETLCLCGVKKNI

SEQ ID NO: 29898 - protein, 14 aa, BK virus
AETLCLCGVKKNII

SEQ ID NO: 29899 - protein, 14 aa, BK virus
ETLCLCGVKKNIIL

SEQ ID NO: 29900 - protein, 14 aa, BK virus
TLCLCGVKKNIILC

SEQ ID NO: 29901 - protein, 14 aa, BK virus
LCLCGVKKNIILCP

SEQ ID NO: 29902 - protein, 14 aa, BK virus
CLCGVKKNIILCPA

SEQ ID NO: 29903 - protein, 14 aa, BK virus
LCGVKKNIILCPAH

SEQ ID NO: 29904 - protein, 14 aa, BK virus
CGVKKNIILCPAHM

SEQ ID NO: 29905 - protein, 14 aa, BK virus
GVKKNIILCPAHMC

SEQ ID NO: 29906 - protein, 14 aa, BK virus
VKKNIILCPAHMCL

SEQ ID NO: 29907 - protein, 14 aa, BK virus
KKNIILCPAHMCLL

SEQ ID NO: 29908 - protein, 14 aa, BK virus
KNIILCPAHMCLLI

SEQ ID NO: 29909 - protein, 14 aa, BK virus
NIILCPAHMCLLIK

SEQ ID NO: 29910 - protein, 14 aa, BK virus
IILCPAHMCLLIKV

SEQ ID NO: 29911 - protein, 14 aa, BK virus
ILCPAHMCLLIKVT

SEQ ID NO: 29912 - protein, 14 aa, BK virus
LCPAHMCLLIKVTE

SEQ ID NO: 29913 - protein, 14 aa, BK virus
CPAHMCLLIKVTEY

SEQ ID NO: 29914 - protein, 14 aa, BK virus
PAHMCLLIKVTEYF

SEQ ID NO: 29915 - protein, 14 aa, BK virus
AHMCLLIKVTEYFS

SEQ ID NO: 29916 - protein, 14 aa, BK virus
HMCLLIKVTEYFSI

SEQ ID NO: 29917 - protein, 14 aa, BK virus
MCLLIKVTEYFSIS

SEQ ID NO: 29918 - protein, 14 aa, BK virus
CLLIKVTEYFSISF

SEQ ID NO: 29919 - protein, 14 aa, BK virus
LLIKVTEYFSISFL

SEQ ID NO: 29920 - protein, 14 aa, BK virus
LIKVTEYFSISFLY

SEQ ID NO: 29921 - protein, 14 aa, BK virus
IKVTEYFSISFLYR

SEQ ID NO: 29922 - protein, 14 aa, BK virus
KVTEYFSISFLYRI

SEQ ID NO: 29923 - protein, 14 aa, BK virus
AFSLVVYTAKQARV

SEQ ID NO: 29924 - protein, 14 aa, BK virus
FSLVVYTAKQARVL

SEQ ID NO: 29925 - protein, 14 aa, BK virus
SLVVYTAKQARVLL

SEQ ID NO: 29926 - protein, 14 aa, BK virus
LVVYTAKQARVLLL

SEQ ID NO: 29927 - protein, 14 aa, BK virus
VVYTAKQARVLLLN

SEQ ID NO: 29928 - protein, 14 aa, BK virus
VYTAKQARVLLLNT

SEQ ID NO: 29929 - protein, 14 aa, BK virus
YTAKQARVLLLNTA

SEQ ID NO: 29930 - protein, 14 aa, BK virus
LRNWCRSEGKSLGS

SEQ ID NO: 29931 - protein, 14 aa, BK virus
RNWCRSEGKSLGSS

SEQ ID NO: 29932 - protein, 14 aa, BK virus
NWCRSEGKSLGSST

SEQ ID NO: 29933 - protein, 14 aa, BK virus
WCRSEGKSLGSSTF

SEQ ID NO: 29934 - protein, 14 aa, BK virus
CRSEGKSLGSSTFL

SEQ ID NO: 29935 - protein, 14 aa, BK virus
RSEGKSLGSSTFLF

SEQ ID NO: 29936 - protein, 14 aa, BK virus
SEGKSLGSSTFLFF

SEQ ID NO: 29937 - protein, 14 aa, BK virus
EGKSLGSSTFLFFL

SEQ ID NO: 29938 - protein, 14 aa, BK virus
GKSLGSSTFLFFLG

SEQ ID NO: 29939 - protein, 14 aa, BK virus
KSLGSSTFLFFLGG

SEQ ID NO: 29940 - protein, 14 aa, BK virus
SLGSSTFLFFLGGV

SEQ ID NO: 29941 - protein, 14 aa, BK virus
LGSSTFLFFLGGVE

SEQ ID NO: 29942 - protein, 14 aa, BK virus
GSSTFLFFLGGVEC

SEQ ID NO: 29943 - protein, 14 aa, BK virus
ESAVASSSLANISS

SEQ ID NO: 29944 - protein, 14 aa, BK virus
SAVASSSLANISSW

SEQ ID NO: 29945 - protein, 14 aa, BK virus
AVASSSLANISSWQ

SEQ ID NO: 29946 - protein, 14 aa, BK virus
VASSSLANISSWQN

SEQ ID NO: 29947 - protein, 14 aa, BK virus
ASSSLANISSWQNK

SEQ ID NO: 29948 - protein, 14 aa, BK virus
SSSLANISSWQNKS

SEQ ID NO: 29949 - protein, 14 aa, BK virus
SSLANISSWQNKSS

SEQ ID NO: 29950 - protein, 14 aa, BK virus
SLANISSWQNKSSS

SEQ ID NO: 29951 - protein, 14 aa, BK virus
LANISSWQNKSSSH

SEQ ID NO: 29952 - protein, 14 aa, BK virus
ANISSWQNKSSSHF

SEQ ID NO: 29953 - protein, 14 aa, BK virus
NISSWQNKSSSHFS

SEQ ID NO: 29954 - protein, 14 aa, BK virus
ISSWQNKSSSHFSL

SEQ ID NO: 29955 - protein, 14 aa, BK virus
SSWQNKSSSHFSLK

SEQ ID NO: 29956 - protein, 14 aa, BK virus
SWQNKSSSHFSLKE

SEQ ID NO: 29957 - protein, 14 aa, BK virus
WQNKSSSHFSLKEL

SEQ ID NO: 29958 - protein, 14 aa, BK virus
QNKSSSHFSLKELH

SEQ ID NO: 29959 - protein, 14 aa, BK virus
NKSSSHFSLKELHQ

SEQ ID NO: 29960 - protein, 14 aa, BK virus
KSSSHFSLKELHQD

SEQ ID NO: 29961 - protein, 14 aa, BK virus
SSSHFSLKELHQDS

SEQ ID NO: 29962 - protein, 14 aa, BK virus
SSHFSLKELHQDSH

SEQ ID NO: 29963 - protein, 14 aa, BK virus
SHFSLKELHQDSHS

SEQ ID NO: 29964 - protein, 14 aa, BK virus
HFSLKELHQDSHSS

SEQ ID NO: 29965 - protein, 14 aa, BK virus
FSLKELHQDSHSSV

SEQ ID NO: 29966 - protein, 14 aa, BK virus
SLKELHQDSHSSVP

SEQ ID NO: 29967 - protein, 14 aa, BK virus
VGTYKKNNYLGPFN

SEQ ID NO: 29968 - protein, 14 aa, BK virus
GTYKKNNYLGPFNI

SEQ ID NO: 29969 - protein, 14 aa, BK virus
TYKKNNYLGPFNIL

SEQ ID NO: 29970 - protein, 14 aa, BK virus
YKKNNYLGPFNILL

SEQ ID NO: 29971 - protein, 14 aa, BK virus
KKNNYLGPFNILLF

SEQ ID NO: 29972 - protein, 14 aa, BK virus
KNNYLGPFNILLFI

SEQ ID NO: 29973 - protein, 14 aa, BK virus
REFLQLFGPTIAEF

SEQ ID NO: 29974 - protein, 14 aa, BK virus
EFLQLFGPTIAEFL

SEQ ID NO: 29975 - protein, 14 aa, BK virus
FLQLFGPTIAEFLQ

SEQ ID NO: 29976 - protein, 14 aa, BK virus
LQLFGPTIAEFLQL

SEQ ID NO: 29977 - protein, 14 aa, BK virus
QLFGPTIAEFLQLG

SEQ ID NO: 29978 - protein, 14 aa, BK virus
LFGPTIAEFLQLGL

SEQ ID NO: 29979 - protein, 14 aa, BK virus
FGPTIAEFLQLGLS

SEQ ID NO: 29980 - protein, 14 aa, BK virus
GPTIAEFLQLGLSQ

SEQ ID NO: 29981 - protein, 14 aa, BK virus
PTIAEFLQLGLSQT

SEQ ID NO: 29982 - protein, 14 aa, BK virus
TIAEFLQLGLSQTT

SEQ ID NO: 29983 - protein, 14 aa, BK virus
IAEFLQLGLSQTTV

SEQ ID NO: 29984 - protein, 14 aa, BK virus
SSQCSSNLSKPRAL

SEQ ID NO: 29985 - protein, 14 aa, BK virus
SQCSSNLSKPRALF

SEQ ID NO: 29986 - protein, 14 aa, BK virus
QCSSNLSKPRALFL

SEQ ID NO: 29987 - protein, 14 aa, BK virus
CSSNLSKPRALFLK

SEQ ID NO: 29988 - protein, 14 aa, BK virus
SSNLSKPRALFLKI

SEQ ID NO: 29989 - protein, 14 aa, BK virus
SNLSKPRALFLKIF

SEQ ID NO: 29990 - protein, 14 aa, BK virus
NLSKPRALFLKIFY

SEQ ID NO: 29991 - protein, 14 aa, BK virus
LSKPRALFLKIFYL

SEQ ID NO: 29992 - protein, 14 aa, BK virus
SKPRALFLKIFYLN

SEQ ID NO: 29993 - protein, 14 aa, BK virus
KPRALFLKIFYLNA

SEQ ID NO: 29994 - protein, 14 aa, BK virus
PRALFLKIFYLNAL

SEQ ID NO: 29995 - protein, 14 aa, BK virus
RALFLKIFYLNALI

SEQ ID NO: 29996 - protein, 14 aa, BK virus
ADIACKGSAQKAFW

SEQ ID NO: 29997 - protein, 14 aa, BK virus
DIACKGSAQKAFWN

SEQ ID NO: 29998 - protein, 14 aa, BK virus
IACKGSAQKAFWNK

SEQ ID NO: 29999 - protein, 14 aa, BK virus
AIPCSTGYLGKEEN

SEQ ID NO: 30000 - protein, 14 aa, BK virus
IPCSTGYLGKEENQ

SEQ ID NO: 30001 - protein, 14 aa, BK virus
PCSTGYLGKEENQH

SEQ ID NO: 30002 - protein, 14 aa, BK virus
CSTGYLGKEENQHK

SEQ ID NO: 30003 - protein, 14 aa, BK virus
STGYLGKEENQHKP

SEQ ID NO: 30004 - protein, 14 aa, BK virus
TGYLGKEENQHKPL

SEQ ID NO: 30005 - protein, 14 aa, BK virus
GYLGKEENQHKPLS

SEQ ID NO: 30006 - protein, 14 aa, BK virus
YLGKEENQHKPLSY

SEQ ID NO: 30007 - protein, 14 aa, BK virus
LGKEENQHKPLSYS

SEQ ID NO: 30008 - protein, 14 aa, BK virus
GKEENQHKPLSYSR

SEQ ID NO: 30009 - protein, 14 aa, BK virus
KEENQHKPLSYSRF

SEQ ID NO: 30010 - protein, 14 aa, BK virus
EENQHKPLSYSRFQ

SEQ ID NO: 30011 - protein, 14 aa, BK virus
ENQHKPLSYSRFQN

SEQ ID NO: 30012 - protein, 14 aa, BK virus
NQHKPLSYSRFQNQ

SEQ ID NO: 30013 - protein, 14 aa, BK virus
QHKPLSYSRFQNQA

SEQ ID NO: 30014 - protein, 14 aa, BK virus
HKPLSYSRFQNQAD

SEQ ID NO: 30015 - protein, 14 aa, BK virus
KPLSYSRFQNQADE

SEQ ID NO: 30016 - protein, 14 aa, BK virus
PLSYSRFQNQADEL

SEQ ID NO: 30017 - protein, 14 aa, BK virus
LSYSRFQNQADELP

SEQ ID NO: 30018 - protein, 14 aa, BK virus
SYSRFQNQADELPL

SEQ ID NO: 30019 - protein, 14 aa, BK virus
YSRFQNQADELPLH

SEQ ID NO: 30020 - protein, 14 aa, BK virus
SRFQNQADELPLHP

SEQ ID NO: 30021 - protein, 14 aa, BK virus
RFQNQADELPLHPA

SEQ ID NO: 30022 - protein, 14 aa, BK virus
FQNQADELPLHPAP

SEQ ID NO: 30023 - protein, 14 aa, BK virus
QNQADELPLHPAPF

SEQ ID NO: 30024 - protein, 14 aa, BK virus
NQADELPLHPAPFF

SEQ ID NO: 30025 - protein, 14 aa, BK virus
QADELPLHPAPFFY

SEQ ID NO: 30026 - protein, 14 aa, BK virus
ADELPLHPAPFFYT

SEQ ID NO: 30027 - protein, 14 aa, BK virus
DELPLHPAPFFYTK

SEQ ID NO: 30028 - protein, 14 aa, BK virus
ELPLHPAPFFYTKY

SEQ ID NO: 30029 - protein, 14 aa, BK virus
LPLHPAPFFYTKYS

SEQ ID NO: 30030 - protein, 14 aa, BK virus
PLHPAPFFYTKYSF

SEQ ID NO: 30031 - protein, 14 aa, BK virus
LHPAPFFYTKYSFS

SEQ ID NO: 30032 - protein, 14 aa, BK virus
HPAPFFYTKYSFSS

SEQ ID NO: 30033 - protein, 14 aa, BK virus
PAPFFYTKYSFSSF

SEQ ID NO: 30034 - protein, 14 aa, BK virus
APFFYTKYSFSSFY

SEQ ID NO: 30035 - protein, 14 aa, BK virus
PFFYTKYSFSSFYP

SEQ ID NO: 30036 - protein, 14 aa, BK virus
FFYTKYSFSSFYPR

SEQ ID NO: 30037 - protein, 14 aa, BK virus
FYTKYSFSSFYPRR

SEQ ID NO: 30038 - protein, 14 aa, BK virus
YTKYSFSSFYPRRP

SEQ ID NO: 30039 - protein, 14 aa, BK virus
TKYSFSSFYPRRPL

SEQ ID NO: 30040 - protein, 14 aa, BK virus
KYSFSSFYPRRPLC

SEQ ID NO: 30041 - protein, 14 aa, BK virus
YSFSSFYPRRPLCQ

SEQ ID NO: 30042 - protein, 14 aa, BK virus
SFSSFYPRRPLCQG

SEQ ID NO: 30043 - protein, 14 aa, BK virus
FSSFYPRRPLCQGE

SEQ ID NO: 30044 - protein, 14 aa, BK virus
SSFYPRRPLCQGEI

SEQ ID NO: 30045 - protein, 14 aa, BK virus
SFYPRRPLCQGEIP

SEQ ID NO: 30046 - protein, 14 aa, BK virus
FYPRRPLCQGEIPY

SEQ ID NO: 30047 - protein, 14 aa, BK virus
YPRRPLCQGEIPYT

SEQ ID NO: 30048 - protein, 14 aa, BK virus
PRRPLCQGEIPYTS

SEQ ID NO: 30049 - protein, 14 aa, BK virus
RRPLCQGEIPYTSL

SEQ ID NO: 30050 - protein, 14 aa, BK virus
RPLCQGEIPYTSLN

SEQ ID NO: 30051 - protein, 14 aa, BK virus
PLCQGEIPYTSLNK

SEQ ID NO: 30052 - protein, 14 aa, BK virus
LCQGEIPYTSLNKL

SEQ ID NO: 30053 - protein, 14 aa, BK virus
CQGEIPYTSLNKLF

SEQ ID NO: 30054 - protein, 14 aa, BK virus
QGEIPYTSLNKLFS

SEQ ID NO: 30055 - protein, 14 aa, BK virus
GEIPYTSLNKLFSL

SEQ ID NO: 30056 - protein, 14 aa, BK virus
EIPYTSLNKLFSLR

SEQ ID NO: 30057 - protein, 14 aa, BK virus
IPYTSLNKLFSLRE

SEQ ID NO: 30058 - protein, 14 aa, BK virus
PYTSLNKLFSLRED

SEQ ID NO: 30059 - protein, 14 aa, BK virus
YTSLNKLFSLREDF

SEQ ID NO: 30060 - protein, 14 aa, BK virus
TSLNKLFSLREDFP

SEQ ID NO: 30061 - protein, 14 aa, BK virus
SLNKLFSLREDFPR

SEQ ID NO: 30062 - protein, 14 aa, BK virus
LNKLFSLREDFPRQ

SEQ ID NO: 30063 - protein, 14 aa, BK virus
NKLFSLREDFPRQL

SEQ ID NO: 30064 - protein, 14 aa, BK virus
KLFSLREDFPRQLF

SEQ ID NO: 30065 - protein, 14 aa, BK virus
LFSLREDFPRQLFQ

SEQ ID NO: 30066 - protein, 14 aa, BK virus
FSLREDFPRQLFQG

SEQ ID NO: 30067 - protein, 14 aa, BK virus
SLREDFPRQLFQGL

SEQ ID NO: 30068 - protein, 14 aa, BK virus
LREDFPRQLFQGLK

SEQ ID NO: 30069 - protein, 14 aa, BK virus
REDFPRQLFQGLKG

SEQ ID NO: 30070 - protein, 14 aa, BK virus
EDFPRQLFQGLKGP

SEQ ID NO: 30071 - protein, 15 aa, BK virus
GFPQIVLLGLRKSLH

SEQ ID NO: 30072 - protein, 15 aa, BK virus
FPQIVLLGLRKSLHT

SEQ ID NO: 30073 - protein, 15 aa, BK virus
PQIVLLGLRKSLHTL

SEQ ID NO: 30074 - protein, 15 aa, BK virus
QIVLLGLRKSLHTLT

SEQ ID NO: 30075 - protein, 15 aa, BK virus
IVLLGLRKSLHTLTT

SEQ ID NO: 30076 - protein, 15 aa, BK virus
EKGWRQRRPRPLIYY

SEQ ID NO: 30077 - protein, 15 aa, BK virus
KGWRQRRPRPLIYYK

SEQ ID NO: 30078 - protein, 15 aa, BK virus
GWRQRRPRPLIYYKK

SEQ ID NO: 30079 - protein, 15 aa, BK virus
WRQRRPRPLIYYKKK

SEQ ID NO: 30080 - protein, 15 aa, BK virus
RQRRPRPLIYYKKKG

SEQ ID NO: 30081 - protein, 15 aa, BK virus
QRRPRPLIYYKKKGH

SEQ ID NO: 30082 - protein, 15 aa, BK virus
RRPRPLIYYKKKGHR

SEQ ID NO: 30083 - protein, 15 aa, BK virus
RPRPLIYYKKKGHRE

SEQ ID NO: 30084 - protein, 15 aa, BK virus
PRPLIYYKKKGHREE

SEQ ID NO: 30085 - protein, 15 aa, BK virus
RPLIYYKKKGHREEL

SEQ ID NO: 30086 - protein, 15 aa, BK virus
PLIYYKKKGHREELL

SEQ ID NO: 30087 - protein, 15 aa, BK virus
LIYYKKKGHREELLT

SEQ ID NO: 30088 - protein, 15 aa, BK virus
IYYKKKGHREELLTH

SEQ ID NO: 30089 - protein, 15 aa, BK virus
YYKKKGHREELLTHG

SEQ ID NO: 30090 - protein, 15 aa, BK virus
YKKKGHREELLTHGM

SEQ ID NO: 30091 - protein, 15 aa, BK virus
KKKGHREELLTHGMQ

SEQ ID NO: 30092 - protein, 15 aa, BK virus
KKGHREELLTHGMQP

SEQ ID NO: 30093 - protein, 15 aa, BK virus
KGHREELLTHGMQPN

SEQ ID NO: 30094 - protein, 15 aa, BK virus
GHREELLTHGMQPNH

SEQ ID NO: 30095 - protein, 15 aa, BK virus
HREELLTHGMQPNHD

SEQ ID NO: 30096 - protein, 15 aa, BK virus
REELLTHGMQPNHDL

SEQ ID NO: 30097 - protein, 15 aa, BK virus
EELLTHGMQPNHDLR

SEQ ID NO: 30098 - protein, 15 aa, BK virus
ELLTHGMQPNHDLRK

SEQ ID NO: 30099 - protein, 15 aa, BK virus
LLTHGMQPNHDLRKE

SEQ ID NO: 30100 - protein, 15 aa, BK virus
LTHGMQPNHDLRKES

SEQ ID NO: 30101 - protein, 15 aa, BK virus
THGMQPNHDLRKESA

SEQ ID NO: 30102 - protein, 15 aa, BK virus
LTGECSQTMTSGRKV

SEQ ID NO: 30103 - protein, 15 aa, BK virus
TGECSQTMTSGRKVH

SEQ ID NO: 30104 - protein, 15 aa, BK virus
GECSQTMTSGRKVHD

SEQ ID NO: 30105 - protein, 15 aa, BK virus
ECSQTMTSGRKVHDS

SEQ ID NO: 30106 - protein, 15 aa, BK virus
CSQTMTSGRKVHDSQ

SEQ ID NO: 30107 - protein, 15 aa, BK virus
SQTMTSGRKVHDSQG

SEQ ID NO: 30108 - protein, 15 aa, BK virus
QTMTSGRKVHDSQGG

SEQ ID NO: 30109 - protein, 15 aa, BK virus
TMTSGRKVHDSQGGA

SEQ ID NO: 30110 - protein, 15 aa, BK virus
MTSGRKVHDSQGGAA

SEQ ID NO: 30111 - protein, 15 aa, BK virus
TSGRKVHDSQGGAAY

SEQ ID NO: 30112 - protein, 15 aa, BK virus
SGRKVHDSQGGAAYP

SEQ ID NO: 30113 - protein, 15 aa, BK virus
GRKVHDSQGGAAYPW

SEQ ID NO: 30114 - protein, 15 aa, BK virus
RKVHDSQGGAAYPWN

SEQ ID NO: 30115 - protein, 15 aa, BK virus
KVHDSQGGAAYPWNA

SEQ ID NO: 30116 - protein, 15 aa, BK virus
VHDSQGGAAYPWNAA

SEQ ID NO: 30117 - protein, 15 aa, BK virus
HDSQGGAAYPWNAAK

SEQ ID NO: 30118 - protein, 15 aa, BK virus
DSQGGAAYPWNAAKP

SEQ ID NO: 30119 - protein, 15 aa, BK virus
PQEGKCMTDMFCEPR

SEQ ID NO: 30120 - protein, 15 aa, BK virus
QEGKCMTDMFCEPRN

SEQ ID NO: 30121 - protein, 15 aa, BK virus
EGKCMTDMFCEPRNL

SEQ ID NO: 30122 - protein, 15 aa, BK virus
GKCMTDMFCEPRNLG

SEQ ID NO: 30123 - protein, 15 aa, BK virus
KCMTDMFCEPRNLGL

SEQ ID NO: 30124 - protein, 15 aa, BK virus
CMTDMFCEPRNLGLV

SEQ ID NO: 30125 - protein, 15 aa, BK virus
MTDMFCEPRNLGLVP

SEQ ID NO: 30126 - protein, 15 aa, BK virus
TDMFCEPRNLGLVPS

SEQ ID NO: 30127 - protein, 15 aa, BK virus
TGQRPWFCASCHDKL

SEQ ID NO: 30128 - protein, 15 aa, BK virus
GQRPWFCASCHDKLQ

SEQ ID NO: 30129 - protein, 15 aa, BK virus
KLVKPGLEQKKELRG

SEQ ID NO: 30130 - protein, 15 aa, BK virus
LVKPGLEQKKELRGF

SEQ ID NO: 30131 - protein, 15 aa, BK virus
VKPGLEQKKELRGFL

SEQ ID NO: 30132 - protein, 15 aa, BK virus
KPGLEQKKELRGFLF

SEQ ID NO: 30133 - protein, 15 aa, BK virus
PGLEQKKELRGFLFL

SEQ ID NO: 30134 - protein, 15 aa, BK virus
GLEQKKELRGFLFLF

SEQ ID NO: 30135 - protein, 15 aa, BK virus
VIPFFLYFQVHGCCS

SEQ ID NO: 30136 - protein, 15 aa, BK virus
IPFFLYFQVHGCCSS

SEQ ID NO: 30137 - protein, 15 aa, BK virus
PFFLYFQVHGCCSST

SEQ ID NO: 30138 - protein, 15 aa, BK virus
FFLYFQVHGCCSSTF

SEQ ID NO: 30139 - protein, 15 aa, BK virus
FLYFQVHGCCSSTFG

SEQ ID NO: 30140 - protein, 15 aa, BK virus
LYFQVHGCCSSTFGG

SEQ ID NO: 30141 - protein, 15 aa, BK virus
YFQVHGCCSSTFGGP

SEQ ID NO: 30142 - protein, 15 aa, BK virus
FQVHGCCSSTFGGPS

SEQ ID NO: 30143 - protein, 15 aa, BK virus
QVHGCCSSTFGGPSC

SEQ ID NO: 30144 - protein, 15 aa, BK virus
VHGCCSSTFGGPSCQ

SEQ ID NO: 30145 - protein, 15 aa, BK virus
HGCCSSTFGGPSCQC

SEQ ID NO: 30146 - protein, 15 aa, BK virus
GCCSSTFGGPSCQCI

SEQ ID NO: 30147 - protein, 15 aa, BK virus
NCCWGGCCCYRSSNC

SEQ ID NO: 30148 - protein, 15 aa, BK virus
CCWGGCCCYRSSNCI

SEQ ID NO: 30149 - protein, 15 aa, BK virus
CWGGCCCYRSSNCIP

SEQ ID NO: 30150 - protein, 15 aa, BK virus
WGGCCCYRSSNCIPC

SEQ ID NO: 30151 - protein, 15 aa, BK virus
GGCCCYRSSNCIPCY

SEQ ID NO: 30152 - protein, 15 aa, BK virus
GCCCYRSSNCIPCYC

SEQ ID NO: 30153 - protein, 15 aa, BK virus
CCCYRSSNCIPCYCR

SEQ ID NO: 30154 - protein, 15 aa, BK virus
CCYRSSNCIPCYCRG

SEQ ID NO: 30155 - protein, 15 aa, BK virus
CYRSSNCIPCYCRGH

SEQ ID NO: 30156 - protein, 15 aa, BK virus
YRSSNCIPCYCRGHN

SEQ ID NO: 30157 - protein, 15 aa, BK virus
RSSNCIPCYCRGHNK

SEQ ID NO: 30158 - protein, 15 aa, BK virus
SSNCIPCYCRGHNKY

SEQ ID NO: 30159 - protein, 15 aa, BK virus
SNCIPCYCRGHNKYL

SEQ ID NO: 30160 - protein, 15 aa, BK virus
NCIPCYCRGHNKYLR

SEQ ID NO: 30161 - protein, 15 aa, BK virus
CIPCYCRGHNKYLRG

SEQ ID NO: 30162 - protein, 15 aa, BK virus
IPCYCRGHNKYLRGY

SEQ ID NO: 30163 - protein, 15 aa, BK virus
PCYCRGHNKYLRGYS

SEQ ID NO: 30164 - protein, 15 aa, BK virus
CYCRGHNKYLRGYSC

SEQ ID NO: 30165 - protein, 15 aa, BK virus
YCRGHNKYLRGYSCY

SEQ ID NO: 30166 - protein, 15 aa, BK virus
CRGHNKYLRGYSCYR

SEQ ID NO: 30167 - protein, 15 aa, BK virus
RGHNKYLRGYSCYRP

SEQ ID NO: 30168 - protein, 15 aa, BK virus
GHNKYLRGYSCYRPN

SEQ ID NO: 30169 - protein, 15 aa, BK virus
HNKYLRGYSCYRPNS

SEQ ID NO: 30170 - protein, 15 aa, BK virus
NKYLRGYSCYRPNSS

SEQ ID NO: 30171 - protein, 15 aa, BK virus
KYLRGYSCYRPNSSN

SEQ ID NO: 30172 - protein, 15 aa, BK virus
YLRGYSCYRPNSSNI

SEQ ID NO: 30173 - protein, 15 aa, BK virus
LRGYSCYRPNSSNIC

SEQ ID NO: 30174 - protein, 15 aa, BK virus
RGYSCYRPNSSNICC

SEQ ID NO: 30175 - protein, 15 aa, BK virus
GYSCYRPNSSNICCN

SEQ ID NO: 30176 - protein, 15 aa, BK virus
YSCYRPNSSNICCNC

SEQ ID NO: 30177 - protein, 15 aa, BK virus
SCYRPNSSNICCNCW

SEQ ID NO: 30178 - protein, 15 aa, BK virus
CYRPNSSNICCNCWC

SEQ ID NO: 30179 - protein, 15 aa, BK virus
YRPNSSNICCNCWCS

SEQ ID NO: 30180 - protein, 15 aa, BK virus
RPNSSNICCNCWCSW

SEQ ID NO: 30181 - protein, 15 aa, BK virus
PNSSNICCNCWCSWG

SEQ ID NO: 30182 - protein, 15 aa, BK virus
NSSNICCNCWCSWGY

SEQ ID NO: 30183 - protein, 15 aa, BK virus
SSNICCNCWCSWGYC

SEQ ID NO: 30184 - protein, 15 aa, BK virus
SNICCNCWCSWGYCW

SEQ ID NO: 30185 - protein, 15 aa, BK virus
NICCNCWCSWGYCWV

SEQ ID NO: 30186 - protein, 15 aa, BK virus
ICCNCWCSWGYCWVC

SEQ ID NO: 30187 - protein, 15 aa, BK virus
CCNCWCSWGYCWVCC

SEQ ID NO: 30188 - protein, 15 aa, BK virus
CNCWCSWGYCWVCCF

SEQ ID NO: 30189 - protein, 15 aa, BK virus
NCWCSWGYCWVCCFN

SEQ ID NO: 30190 - protein, 15 aa, BK virus
CWCSWGYCWVCCFNS

SEQ ID NO: 30191 - protein, 15 aa, BK virus
WCSWGYCWVCCFNSN

SEQ ID NO: 30192 - protein, 15 aa, BK virus
CSWGYCWVCCFNSNC

SEQ ID NO: 30193 - protein, 15 aa, BK virus
LGSQSFHCRPLSAIR

SEQ ID NO: 30194 - protein, 15 aa, BK virus
GSQSFHCRPLSAIRH

SEQ ID NO: 30195 - protein, 15 aa, BK virus
SQSFHCRPLSAIRHG

SEQ ID NO: 30196 - protein, 15 aa, BK virus
QSFHCRPLSAIRHGF

SEQ ID NO: 30197 - protein, 15 aa, BK virus
SFHCRPLSAIRHGFG

SEQ ID NO: 30198 - protein, 15 aa, BK virus
FHCRPLSAIRHGFGI

SEQ ID NO: 30199 - protein, 15 aa, BK virus
HCRPLSAIRHGFGIV

SEQ ID NO: 30200 - protein, 15 aa, BK virus
ALGSFFVCYYFPGFV

SEQ ID NO: 30201 - protein, 15 aa, BK virus
LGSFFVCYYFPGFVA

SEQ ID NO: 30202 - protein, 15 aa, BK virus
GSFFVCYYFPGFVAC

SEQ ID NO: 30203 - protein, 15 aa, BK virus
SFFVCYYFPGFVACY

SEQ ID NO: 30204 - protein, 15 aa, BK virus
YTFYNLTGIAEKNRK

SEQ ID NO: 30205 - protein, 15 aa, BK virus
TFYNLTGIAEKNRKI

SEQ ID NO: 30206 - protein, 15 aa, BK virus
FYNLTGIAEKNRKIF

SEQ ID NO: 30207 - protein, 15 aa, BK virus
IFGGNYLDNCKCPYK

SEQ ID NO: 30208 - protein, 15 aa, BK virus
FGGNYLDNCKCPYKL

SEQ ID NO: 30209 - protein, 15 aa, BK virus
GGNYLDNCKCPYKLL

SEQ ID NO: 30210 - protein, 15 aa, BK virus
QYRRSYTKNGLKKST

SEQ ID NO: 30211 - protein, 15 aa, BK virus
YRRSYTKNGLKKSTK

SEQ ID NO: 30212 - protein, 15 aa, BK virus
RRSYTKNGLKKSTKC

SEQ ID NO: 30213 - protein, 15 aa, BK virus
RSYTKNGLKKSTKCT

SEQ ID NO: 30214 - protein, 15 aa, BK virus
SYTKNGLKKSTKCTF

SEQ ID NO: 30215 - protein, 15 aa, BK virus
YTKNGLKKSTKCTFR

SEQ ID NO: 30216 - protein, 15 aa, BK virus
TKNGLKKSTKCTFRR

SEQ ID NO: 30217 - protein, 15 aa, BK virus
KNGLKKSTKCTFRRV

SEQ ID NO: 30218 - protein, 15 aa, BK virus
NGLKKSTKCTFRRVY

SEQ ID NO: 30219 - protein, 15 aa, BK virus
GLKKSTKCTFRRVYR

SEQ ID NO: 30220 - protein, 15 aa, BK virus
LKKSTKCTFRRVYRK

SEQ ID NO: 30221 - protein, 15 aa, BK virus
KKSTKCTFRRVYRKN

SEQ ID NO: 30222 - protein, 15 aa, BK virus
KSTKCTFRRVYRKNY

SEQ ID NO: 30223 - protein, 15 aa, BK virus
STKCTFRRVYRKNYC

SEQ ID NO: 30224 - protein, 15 aa, BK virus
TKCTFRRVYRKNYCP

SEQ ID NO: 30225 - protein, 15 aa, BK virus
KCTFRRVYRKNYCPR

SEQ ID NO: 30226 - protein, 15 aa, BK virus
CTFRRVYRKNYCPRR

SEQ ID NO: 30227 - protein, 15 aa, BK virus
TFRRVYRKNYCPRRC

SEQ ID NO: 30228 - protein, 15 aa, BK virus
SKNCSSMDVAFTSRP

SEQ ID NO: 30229 - protein, 15 aa, BK virus
KNCSSMDVAFTSRPV

SEQ ID NO: 30230 - protein, 15 aa, BK virus
NCSSMDVAFTSRPVR

SEQ ID NO: 30231 - protein, 15 aa, BK virus
CSSMDVAFTSRPVRD

SEQ ID NO: 30232 - protein, 15 aa, BK virus
SSMDVAFTSRPVRDC

SEQ ID NO: 30233 - protein, 15 aa, BK virus
SMDVAFTSRPVRDCN

SEQ ID NO: 30234 - protein, 15 aa, BK virus
MDVAFTSRPVRDCNT

SEQ ID NO: 30235 - protein, 15 aa, BK virus
DVAFTSRPVRDCNTC

SEQ ID NO: 30236 - protein, 15 aa, BK virus
VAFTSRPVRDCNTCS

SEQ ID NO: 30237 - protein, 15 aa, BK virus
RWPQPKEKESVQGQL

SEQ ID NO: 30238 - protein, 15 aa, BK virus
WPQPKEKESVQGQLP

SEQ ID NO: 30239 - protein, 15 aa, BK virus
PQPKEKESVQGQLPK

SEQ ID NO: 30240 - protein, 15 aa, BK virus
QPKEKESVQGQLPKS

SEQ ID NO: 30241 - protein, 15 aa, BK virus
PKEKESVQGQLPKSQ

SEQ ID NO: 30242 - protein, 15 aa, BK virus
KEKESVQGQLPKSQR

SEQ ID NO: 30243 - protein, 15 aa, BK virus
EKESVQGQLPKSQRN

SEQ ID NO: 30244 - protein, 15 aa, BK virus
KESVQGQLPKSQRNP

SEQ ID NO: 30245 - protein, 15 aa, BK virus
ESVQGQLPKSQRNPC

SEQ ID NO: 30246 - protein, 15 aa, BK virus
SVQGQLPKSQRNPCK

SEQ ID NO: 30247 - protein, 15 aa, BK virus
VQGQLPKSQRNPCKC

SEQ ID NO: 30248 - protein, 15 aa, BK virus
QGQLPKSQRNPCKCQ

SEQ ID NO: 30249 - protein, 15 aa, BK virus
GQLPKSQRNPCKCQN

SEQ ID NO: 30250 - protein, 15 aa, BK virus
QLPKSQRNPCKCQNY

SEQ ID NO: 30251 - protein, 15 aa, BK virus
TQKWGIQMKTLGALV

SEQ ID NO: 30252 - protein, 15 aa, BK virus
VLKMTLAVIAQREKC

SEQ ID NO: 30253 - protein, 15 aa, BK virus
LKMTLAVIAQREKCF

SEQ ID NO: 30254 - protein, 15 aa, BK virus
KMTLAVIAQREKCFP

SEQ ID NO: 30255 - protein, 15 aa, BK virus
MTLAVIAQREKCFPV

SEQ ID NO: 30256 - protein, 15 aa, BK virus
TLAVIAQREKCFPVT

SEQ ID NO: 30257 - protein, 15 aa, BK virus
LAVIAQREKCFPVTA

SEQ ID NO: 30258 - protein, 15 aa, BK virus
AVIAQREKCFPVTAQ

SEQ ID NO: 30259 - protein, 15 aa, BK virus
VIAQREKCFPVTAQQ

SEQ ID NO: 30260 - protein, 15 aa, BK virus
IAQREKCFPVTAQQE

SEQ ID NO: 30261 - protein, 15 aa, BK virus
AQREKCFPVTAQQEF

SEQ ID NO: 30262 - protein, 15 aa, BK virus
QREKCFPVTAQQEFP

SEQ ID NO: 30263 - protein, 15 aa, BK virus
REKCFPVTAQQEFPS

SEQ ID NO: 30264 - protein, 15 aa, BK virus
EKCFPVTAQQEFPSP

SEQ ID NO: 30265 - protein, 15 aa, BK virus
KCFPVTAQQEFPSPI

SEQ ID NO: 30266 - protein, 15 aa, BK virus
LACLTFMQGHKKCMS

SEQ ID NO: 30267 - protein, 15 aa, BK virus
ACLTFMQGHKKCMSM

SEQ ID NO: 30268 - protein, 15 aa, BK virus
CLTFMQGHKKCMSMV

SEQ ID NO: 30269 - protein, 15 aa, BK virus
LTFMQGHKKCMSMVE

SEQ ID NO: 30270 - protein, 15 aa, BK virus
TFMQGHKKCMSMVEE

SEQ ID NO: 30271 - protein, 15 aa, BK virus
FMQGHKKCMSMVEEN

SEQ ID NO: 30272 - protein, 15 aa, BK virus
MQGHKKCMSMVEENL

SEQ ID NO: 30273 - protein, 15 aa, BK virus
QGHKKCMSMVEENLF

SEQ ID NO: 30274 - protein, 15 aa, BK virus
GHKKCMSMVEENLFK

SEQ ID NO: 30275 - protein, 15 aa, BK virus
HKKCMSMVEENLFKA

SEQ ID NO: 30276 - protein, 15 aa, BK virus
KKCMSMVEENLFKAV

SEQ ID NO: 30277 - protein, 15 aa, BK virus
KCMSMVEENLFKAVI

SEQ ID NO: 30278 - protein, 15 aa, BK virus
CMSMVEENLFKAVIS

SEQ ID NO: 30279 - protein, 15 aa, BK virus
MSMVEENLFKAVIST

SEQ ID NO: 30280 - protein, 15 aa, BK virus
SMVEENLFKAVISTS

SEQ ID NO: 30281 - protein, 15 aa, BK virus
MVEENLFKAVISTSL

SEQ ID NO: 30282 - protein, 15 aa, BK virus
VEENLFKAVISTSLL

SEQ ID NO: 30283 - protein, 15 aa, BK virus
ILTIRPIWTKTMLIQ

SEQ ID NO: 30284 - protein, 15 aa, BK virus
LTIRPIWTKTMLIQL

SEQ ID NO: 30285 - protein, 15 aa, BK virus
TIRPIWTKTMLIQLS

SEQ ID NO: 30286 - protein, 15 aa, BK virus
IRPIWTKTMLIQLSA

SEQ ID NO: 30287 - protein, 15 aa, BK virus
RPIWTKTMLIQLSAG

SEQ ID NO: 30288 - protein, 15 aa, BK virus
PIWTKTMLIQLSAGY

SEQ ID NO: 30289 - protein, 15 aa, BK virus
IWTKTMLIQLSAGYL

SEQ ID NO: 30290 - protein, 15 aa, BK virus
WTKTMLIQLSAGYLI

SEQ ID NO: 30291 - protein, 15 aa, BK virus
TKTMLIQLSAGYLIP

SEQ ID NO: 30292 - protein, 15 aa, BK virus
KTMLIQLSAGYLIPV

SEQ ID NO: 30293 - protein, 15 aa, BK virus
TMLIQLSAGYLIPVE

SEQ ID NO: 30294 - protein, 15 aa, BK virus
MLIQLSAGYLIPVEM

SEQ ID NO: 30295 - protein, 15 aa, BK virus
LIQLSAGYLIPVEMK

SEQ ID NO: 30296 - protein, 15 aa, BK virus
IQLSAGYLIPVEMKM

SEQ ID NO: 30297 - protein, 15 aa, BK virus
QLSAGYLIPVEMKML

SEQ ID NO: 30298 - protein, 15 aa, BK virus
LSAGYLIPVEMKMLG

SEQ ID NO: 30299 - protein, 15 aa, BK virus
SAGYLIPVEMKMLGI

SEQ ID NO: 30300 - protein, 15 aa, BK virus
AGYLIPVEMKMLGIL

SEQ ID NO: 30301 - protein, 15 aa, BK virus
GYLIPVEMKMLGILG

SEQ ID NO: 30302 - protein, 15 aa, BK virus
YLIPVEMKMLGILGL

SEQ ID NO: 30303 - protein, 15 aa, BK virus
LIPVEMKMLGILGLS

SEQ ID NO: 30304 - protein, 15 aa, BK virus
IPVEMKMLGILGLSQ

SEQ ID NO: 30305 - protein, 15 aa, BK virus
PVEMKMLGILGLSQE

SEQ ID NO: 30306 - protein, 15 aa, BK virus
VEMKMLGILGLSQEG

SEQ ID NO: 30307 - protein, 15 aa, BK virus
EMKMLGILGLSQEGK

SEQ ID NO: 30308 - protein, 15 aa, BK virus
MKMLGILGLSQEGKM

SEQ ID NO: 30309 - protein, 15 aa, BK virus
KMLGILGLSQEGKMF

SEQ ID NO: 30310 - protein, 15 aa, BK virus
MLGILGLSQEGKMFP

SEQ ID NO: 30311 - protein, 15 aa, BK virus
LGILGLSQEGKMFPQ

SEQ ID NO: 30312 - protein, 15 aa, BK virus
GILGLSQEGKMFPQY

SEQ ID NO: 30313 - protein, 15 aa, BK virus
ILGLSQEGKMFPQYF

SEQ ID NO: 30314 - protein, 15 aa, BK virus
LGLSQEGKMFPQYFM

SEQ ID NO: 30315 - protein, 15 aa, BK virus
MNRVWGLFVKLIACM

SEQ ID NO: 30316 - protein, 15 aa, BK virus
NRVWGLFVKLIACMF

SEQ ID NO: 30317 - protein, 15 aa, BK virus
RVWGLFVKLIACMFQ

SEQ ID NO: 30318 - protein, 15 aa, BK virus
VWGLFVKLIACMFQL

SEQ ID NO: 30319 - protein, 15 aa, BK virus
WGLFVKLIACMFQLL

SEQ ID NO: 30320 - protein, 15 aa, BK virus
GLFVKLIACMFQLLI

SEQ ID NO: 30321 - protein, 15 aa, BK virus
LFVKLIACMFQLLIF

SEQ ID NO: 30322 - protein, 15 aa, BK virus
FVKLIACMFQLLIFV

SEQ ID NO: 30323 - protein, 15 aa, BK virus
VKLIACMFQLLIFVA

SEQ ID NO: 30324 - protein, 15 aa, BK virus
KLIACMFQLLIFVAC

SEQ ID NO: 30325 - protein, 15 aa, BK virus
LIACMFQLLIFVACL

SEQ ID NO: 30326 - protein, 15 aa, BK virus
IACMFQLLIFVACLL

SEQ ID NO: 30327 - protein, 15 aa, BK virus
ACMFQLLIFVACLLT

SEQ ID NO: 30328 - protein, 15 aa, BK virus
CMFQLLIFVACLLTA

SEQ ID NO: 30329 - protein, 15 aa, BK virus
MFQLLIFVACLLTAL

SEQ ID NO: 30330 - protein, 15 aa, BK virus
FQLLIFVACLLTALE

SEQ ID NO: 30331 - protein, 15 aa, BK virus
QLLIFVACLLTALEH

SEQ ID NO: 30332 - protein, 15 aa, BK virus
LLIFVACLLTALEHN

SEQ ID NO: 30333 - protein, 15 aa, BK virus
LIFVACLLTALEHNS

SEQ ID NO: 30334 - protein, 15 aa, BK virus
IFVACLLTALEHNSG

SEQ ID NO: 30335 - protein, 15 aa, BK virus
FVACLLTALEHNSGE

SEQ ID NO: 30336 - protein, 15 aa, BK virus
VACLLTALEHNSGEA

SEQ ID NO: 30337 - protein, 15 aa, BK virus
ACLLTALEHNSGEAL

SEQ ID NO: 30338 - protein, 15 aa, BK virus
CLLTALEHNSGEALQ

SEQ ID NO: 30339 - protein, 15 aa, BK virus
LLTALEHNSGEALQD

SEQ ID NO: 30340 - protein, 15 aa, BK virus
LTALEHNSGEALQDI

SEQ ID NO: 30341 - protein, 15 aa, BK virus
TALEHNSGEALQDIL

SEQ ID NO: 30342 - protein, 15 aa, BK virus
ALEHNSGEALQDILR

SEQ ID NO: 30343 - protein, 15 aa, BK virus
LEHNSGEALQDILRS

SEQ ID NO: 30344 - protein, 15 aa, BK virus
EHNSGEALQDILRSA

SEQ ID NO: 30345 - protein, 15 aa, BK virus
TGEPREWMGSLCMVW

SEQ ID NO: 30346 - protein, 15 aa, BK virus
GEPREWMGSLCMVWN

SEQ ID NO: 30347 - protein, 15 aa, BK virus
EPREWMGSLCMVWNP

SEQ ID NO: 30348 - protein, 15 aa, BK virus
PREWMGSLCMVWNPR

SEQ ID NO: 30349 - protein, 15 aa, BK virus
KRLGCLMAQKDFQGT

SEQ ID NO: 30350 - protein, 15 aa, BK virus
RLGCLMAQKDFQGTQ

SEQ ID NO: 30351 - protein, 15 aa, BK virus
LGCLMAQKDFQGTQI

SEQ ID NO: 30352 - protein, 15 aa, BK virus
DILTNRDNCKPKCFK

SEQ ID NO: 30353 - protein, 15 aa, BK virus
ILTNRDNCKPKCFKQ

SEQ ID NO: 30354 - protein, 15 aa, BK virus
LTNRDNCKPKCFKQV

SEQ ID NO: 30355 - protein, 15 aa, BK virus
TNRDNCKPKCFKQVL

SEQ ID NO: 30356 - protein, 15 aa, BK virus
NRDNCKPKCFKQVLL

SEQ ID NO: 30357 - protein, 15 aa, BK virus
RDNCKPKCFKQVLLL

SEQ ID NO: 30358 - protein, 15 aa, BK virus
DNCKPKCFKQVLLLY

SEQ ID NO: 30359 - protein, 15 aa, BK virus
NCKPKCFKQVLLLYI

SEQ ID NO: 30360 - protein, 15 aa, BK virus
CKPKCFKQVLLLYIY

SEQ ID NO: 30361 - protein, 15 aa, BK virus
KPKCFKQVLLLYIYI

SEQ ID NO: 30362 - protein, 15 aa, BK virus
MLLLYKPLLSLCYFG

SEQ ID NO: 30363 - protein, 15 aa, BK virus
LLLYKPLLSLCYFGG

SEQ ID NO: 30364 - protein, 15 aa, BK virus
LLYKPLLSLCYFGGG

SEQ ID NO: 30365 - protein, 15 aa, BK virus
LYKPLLSLCYFGGGV

SEQ ID NO: 30366 - protein, 15 aa, BK virus
YKPLLSLCYFGGGVL

SEQ ID NO: 30367 - protein, 15 aa, BK virus
KPLLSLCYFGGGVLG

SEQ ID NO: 30368 - protein, 15 aa, BK virus
PLLSLCYFGGGVLGL

SEQ ID NO: 30369 - protein, 15 aa, BK virus
LLSLCYFGGGVLGLL

SEQ ID NO: 30370 - protein, 15 aa, BK virus
LSLCYFGGGVLGLLK

SEQ ID NO: 30371 - protein, 15 aa, BK virus
SLCYFGGGVLGLLKH

SEQ ID NO: 30372 - protein, 15 aa, BK virus
LWGSDLWESSAGAEV

SEQ ID NO: 30373 - protein, 15 aa, BK virus
WGSDLWESSAGAEVS

SEQ ID NO: 30374 - protein, 15 aa, BK virus
GSDLWESSAGAEVSE

SEQ ID NO: 30375 - protein, 15 aa, BK virus
SDLWESSAGAEVSET

SEQ ID NO: 30376 - protein, 15 aa, BK virus
DLWESSAGAEVSETW

SEQ ID NO: 30377 - protein, 15 aa, BK virus
LWESSAGAEVSETWE

SEQ ID NO: 30378 - protein, 15 aa, BK virus
WESSAGAEVSETWEE

SEQ ID NO: 30379 - protein, 15 aa, BK virus
ESSAGAEVSETWEEH

SEQ ID NO: 30380 - protein, 15 aa, BK virus
SSAGAEVSETWEEHC

SEQ ID NO: 30381 - protein, 15 aa, BK virus
SAGAEVSETWEEHCD

SEQ ID NO: 30382 - protein, 15 aa, BK virus
AGAEVSETWEEHCDW

SEQ ID NO: 30383 - protein, 15 aa, BK virus
GAEVSETWEEHCDWD

SEQ ID NO: 30384 - protein, 15 aa, BK virus
AEVSETWEEHCDWDS

SEQ ID NO: 30385 - protein, 15 aa, BK virus
EVSETWEEHCDWDSV

SEQ ID NO: 30386 - protein, 15 aa, BK virus
VSETWEEHCDWDSVL

SEQ ID NO: 30387 - protein, 15 aa, BK virus
SETWEEHCDWDSVLD

SEQ ID NO: 30388 - protein, 15 aa, BK virus
ETWEEHCDWDSVLDP

SEQ ID NO: 30389 - protein, 15 aa, BK virus
TWEEHCDWDSVLDPC

SEQ ID NO: 30390 - protein, 15 aa, BK virus
WEEHCDWDSVLDPCP

SEQ ID NO: 30391 - protein, 15 aa, BK virus
EEHCDWDSVLDPCPE

SEQ ID NO: 30392 - protein, 15 aa, BK virus
EHCDWDSVLDPCPES

SEQ ID NO: 30393 - protein, 15 aa, BK virus
HCDWDSVLDPCPESS

SEQ ID NO: 30394 - protein, 15 aa, BK virus
CDWDSVLDPCPESSV

SEQ ID NO: 30395 - protein, 15 aa, BK virus
DWDSVLDPCPESSVS

SEQ ID NO: 30396 - protein, 15 aa, BK virus
WDSVLDPCPESSVSE

SEQ ID NO: 30397 - protein, 15 aa, BK virus
DSVLDPCPESSVSES

SEQ ID NO: 30398 - protein, 15 aa, BK virus
SVLDPCPESSVSESS

SEQ ID NO: 30399 - protein, 15 aa, BK virus
VLDPCPESSVSESSS

SEQ ID NO: 30400 - protein, 15 aa, BK virus
LDPCPESSVSESSSL

SEQ ID NO: 30401 - protein, 15 aa, BK virus
DPCPESSVSESSSLV

SEQ ID NO: 30402 - protein, 15 aa, BK virus
PCPESSVSESSSLVI

SEQ ID NO: 30403 - protein, 15 aa, BK virus
CPESSVSESSSLVIS

SEQ ID NO: 30404 - protein, 15 aa, BK virus
PESSVSESSSLVISR

SEQ ID NO: 30405 - protein, 15 aa, BK virus
ESSVSESSSLVISRI

SEQ ID NO: 30406 - protein, 15 aa, BK virus
SSVSESSSLVISRIH

SEQ ID NO: 30407 - protein, 15 aa, BK virus
SVSESSSLVISRIHF

SEQ ID NO: 30408 - protein, 15 aa, BK virus
VSESSSLVISRIHFP

SEQ ID NO: 30409 - protein, 15 aa, BK virus
SESSSLVISRIHFPM

SEQ ID NO: 30410 - protein, 15 aa, BK virus
ESSSLVISRIHFPMH

SEQ ID NO: 30411 - protein, 15 aa, BK virus
SSSLVISRIHFPMHI

SEQ ID NO: 30412 - protein, 15 aa, BK virus
SSLVISRIHFPMHIL

SEQ ID NO: 30413 - protein, 15 aa, BK virus
SLVISRIHFPMHILY

SEQ ID NO: 30414 - protein, 15 aa, BK virus
LVISRIHFPMHILYF

SEQ ID NO: 30415 - protein, 15 aa, BK virus
VISRIHFPMHILYFI

SEQ ID NO: 30416 - protein, 15 aa, BK virus
ISRIHFPMHILYFIL

SEQ ID NO: 30417 - protein, 15 aa, BK virus
SRIHFPMHILYFILE

SEQ ID NO: 30418 - protein, 15 aa, BK virus
RIHFPMHILYFILEK

SEQ ID NO: 30419 - protein, 15 aa, BK virus
IHFPMHILYFILEKV

SEQ ID NO: 30420 - protein, 15 aa, BK virus
HFPMHILYFILEKVY

SEQ ID NO: 30421 - protein, 15 aa, BK virus
FPMHILYFILEKVYI

SEQ ID NO: 30422 - protein, 15 aa, BK virus
PMHILYFILEKVYIL

SEQ ID NO: 30423 - protein, 15 aa, BK virus
MHILYFILEKVYILI

SEQ ID NO: 30424 - protein, 15 aa, BK virus
HILYFILEKVYILIS

SEQ ID NO: 30425 - protein, 15 aa, BK virus
ILYFILEKVYILISE

SEQ ID NO: 30426 - protein, 15 aa, BK virus
LYFILEKVYILISES

SEQ ID NO: 30427 - protein, 15 aa, BK virus
YFILEKVYILISESS

SEQ ID NO: 30428 - protein, 15 aa, BK virus
FILEKVYILISESSL

SEQ ID NO: 30429 - protein, 15 aa, BK virus
ILEKVYILISESSLS

SEQ ID NO: 30430 - protein, 15 aa, BK virus
LEKVYILISESSLSF

SEQ ID NO: 30431 - protein, 15 aa, BK virus
EKVYILISESSLSFH

SEQ ID NO: 30432 - protein, 15 aa, BK virus
KVYILISESSLSFHS

SEQ ID NO: 30433 - protein, 15 aa, BK virus
VYILISESSLSFHST

SEQ ID NO: 30434 - protein, 15 aa, BK virus
YILISESSLSFHSTI

SEQ ID NO: 30435 - protein, 15 aa, BK virus
ILISESSLSFHSTIL

SEQ ID NO: 30436 - protein, 15 aa, BK virus
LISESSLSFHSTILD

SEQ ID NO: 30437 - protein, 15 aa, BK virus
ISESSLSFHSTILDC

SEQ ID NO: 30438 - protein, 15 aa, BK virus
SESSLSFHSTILDCI

SEQ ID NO: 30439 - protein, 15 aa, BK virus
ESSLSFHSTILDCIS

SEQ ID NO: 30440 - protein, 15 aa, BK virus
SSLSFHSTILDCISV

SEQ ID NO: 30441 - protein, 15 aa, BK virus
SLSFHSTILDCISVA

SEQ ID NO: 30442 - protein, 15 aa, BK virus
LSFHSTILDCISVAK

SEQ ID NO: 30443 - protein, 15 aa, BK virus
SFHSTILDCISVAKS

SEQ ID NO: 30444 - protein, 15 aa, BK virus
FHSTILDCISVAKSA

SEQ ID NO: 30445 - protein, 15 aa, BK virus
HSTILDCISVAKSAT

SEQ ID NO: 30446 - protein, 15 aa, BK virus
STILDCISVAKSATG

SEQ ID NO: 30447 - protein, 15 aa, BK virus
TILDCISVAKSATGL

SEQ ID NO: 30448 - protein, 15 aa, BK virus
ILDCISVAKSATGLN

SEQ ID NO: 30449 - protein, 15 aa, BK virus
LDCISVAKSATGLNQ

SEQ ID NO: 30450 - protein, 15 aa, BK virus
DCISVAKSATGLNQI

SEQ ID NO: 30451 - protein, 15 aa, BK virus
CISVAKSATGLNQIS

SEQ ID NO: 30452 - protein, 15 aa, BK virus
ISVAKSATGLNQISS

SEQ ID NO: 30453 - protein, 15 aa, BK virus
SVAKSATGLNQISSS

SEQ ID NO: 30454 - protein, 15 aa, BK virus
VAKSATGLNQISSSN

SEQ ID NO: 30455 - protein, 15 aa, BK virus
AKSATGLNQISSSNK

SEQ ID NO: 30456 - protein, 15 aa, BK virus
KSATGLNQISSSNKV

SEQ ID NO: 30457 - protein, 15 aa, BK virus
SATGLNQISSSNKVI

SEQ ID NO: 30458 - protein, 15 aa, BK virus
ATGLNQISSSNKVIP

SEQ ID NO: 30459 - protein, 15 aa, BK virus
TGLNQISSSNKVIPL

SEQ ID NO: 30460 - protein, 15 aa, BK virus
GLNQISSSNKVIPLC

SEQ ID NO: 30461 - protein, 15 aa, BK virus
LNQISSSNKVIPLCK

SEQ ID NO: 30462 - protein, 15 aa, BK virus
NQISSSNKVIPLCKI

SEQ ID NO: 30463 - protein, 15 aa, BK virus
QISSSNKVIPLCKIL

SEQ ID NO: 30464 - protein, 15 aa, BK virus
ISSSNKVIPLCKILF

SEQ ID NO: 30465 - protein, 15 aa, BK virus
SSSNKVIPLCKILFS

SEQ ID NO: 30466 - protein, 15 aa, BK virus
SSNKVIPLCKILFSS

SEQ ID NO: 30467 - protein, 15 aa, BK virus
SNKVIPLCKILFSSK

SEQ ID NO: 30468 - protein, 15 aa, BK virus
NKVIPLCKILFSSKN

SEQ ID NO: 30469 - protein, 15 aa, BK virus
KVIPLCKILFSSKNS

SEQ ID NO: 30470 - protein, 15 aa, BK virus
VIPLCKILFSSKNSE

SEQ ID NO: 30471 - protein, 15 aa, BK virus
IPLCKILFSSKNSEF

SEQ ID NO: 30472 - protein, 15 aa, BK virus
PLCKILFSSKNSEFC

SEQ ID NO: 30473 - protein, 15 aa, BK virus
LCKILFSSKNSEFCK

SEQ ID NO: 30474 - protein, 15 aa, BK virus
CKILFSSKNSEFCKD

SEQ ID NO: 30475 - protein, 15 aa, BK virus
KILFSSKNSEFCKDF

SEQ ID NO: 30476 - protein, 15 aa, BK virus
ILFSSKNSEFCKDFL

SEQ ID NO: 30477 - protein, 15 aa, BK virus
LFSSKNSEFCKDFLK

SEQ ID NO: 30478 - protein, 15 aa, BK virus
FSSKNSEFCKDFLKY

SEQ ID NO: 30479 - protein, 15 aa, BK virus
SSKNSEFCKDFLKYI

SEQ ID NO: 30480 - protein, 15 aa, BK virus
SKNSEFCKDFLKYIL

SEQ ID NO: 30481 - protein, 15 aa, BK virus
KNSEFCKDFLKYILG

SEQ ID NO: 30482 - protein, 15 aa, BK virus
NSEFCKDFLKYILGL

SEQ ID NO: 30483 - protein, 15 aa, BK virus
SEFCKDFLKYILGLK

SEQ ID NO: 30484 - protein, 15 aa, BK virus
EFCKDFLKYILGLKS

SEQ ID NO: 30485 - protein, 15 aa, BK virus
FCKDFLKYILGLKSI

SEQ ID NO: 30486 - protein, 15 aa, BK virus
CKDFLKYILGLKSIC

SEQ ID NO: 30487 - protein, 15 aa, BK virus
KDFLKYILGLKSICL

SEQ ID NO: 30488 - protein, 15 aa, BK virus
DFLKYILGLKSICLT

SEQ ID NO: 30489 - protein, 15 aa, BK virus
FLKYILGLKSICLTN

SEQ ID NO: 30490 - protein, 15 aa, BK virus
LKYILGLKSICLTNL

SEQ ID NO: 30491 - protein, 15 aa, BK virus
KYILGLKSICLTNLA

SEQ ID NO: 30492 - protein, 15 aa, BK virus
YILGLKSICLTNLAC

SEQ ID NO: 30493 - protein, 15 aa, BK virus
ILGLKSICLTNLACR

SEQ ID NO: 30494 - protein, 15 aa, BK virus
LGLKSICLTNLACRV

SEQ ID NO: 30495 - protein, 15 aa, BK virus
GLKSICLTNLACRVL

SEQ ID NO: 30496 - protein, 15 aa, BK virus
LKSICLTNLACRVLG

SEQ ID NO: 30497 - protein, 15 aa, BK virus
KSICLTNLACRVLGT

SEQ ID NO: 30498 - protein, 15 aa, BK virus
SICLTNLACRVLGTG

SEQ ID NO: 30499 - protein, 15 aa, BK virus
ICLTNLACRVLGTGY

SEQ ID NO: 30500 - protein, 15 aa, BK virus
CLTNLACRVLGTGYS

SEQ ID NO: 30501 - protein, 15 aa, BK virus
LTNLACRVLGTGYSF

SEQ ID NO: 30502 - protein, 15 aa, BK virus
TNLACRVLGTGYSFI

SEQ ID NO: 30503 - protein, 15 aa, BK virus
NLACRVLGTGYSFIV

SEQ ID NO: 30504 - protein, 15 aa, BK virus
LACRVLGTGYSFIVT

SEQ ID NO: 30505 - protein, 15 aa, BK virus
ACRVLGTGYSFIVTK

SEQ ID NO: 30506 - protein, 15 aa, BK virus
CRVLGTGYSFIVTKP

SEQ ID NO: 30507 - protein, 15 aa, BK virus
RVLGTGYSFIVTKPG

SEQ ID NO: 30508 - protein, 15 aa, BK virus
VLGTGYSFIVTKPGG

SEQ ID NO: 30509 - protein, 15 aa, BK virus
LGTGYSFIVTKPGGN

SEQ ID NO: 30510 - protein, 15 aa, BK virus
GTGYSFIVTKPGGNI

SEQ ID NO: 30511 - protein, 15 aa, BK virus
TGYSFIVTKPGGNIW

SEQ ID NO: 30512 - protein, 15 aa, BK virus
GYSFIVTKPGGNIWV

SEQ ID NO: 30513 - protein, 15 aa, BK virus
YSFIVTKPGGNIWVL

SEQ ID NO: 30514 - protein, 15 aa, BK virus
SFIVTKPGGNIWVLL

SEQ ID NO: 30515 - protein, 15 aa, BK virus
FIVTKPGGNIWVLLF

SEQ ID NO: 30516 - protein, 15 aa, BK virus
IVTKPGGNIWVLLFK

SEQ ID NO: 30517 - protein, 15 aa, BK virus
VTKPGGNIWVLLFKC

SEQ ID NO: 30518 - protein, 15 aa, BK virus
TKPGGNIWVLLFKCF

SEQ ID NO: 30519 - protein, 15 aa, BK virus
KPGGNIWVLLFKCFF

SEQ ID NO: 30520 - protein, 15 aa, BK virus
PGGNIWVLLFKCFFS

SEQ ID NO: 30521 - protein, 15 aa, BK virus
GGNIWVLLFKCFFSK

SEQ ID NO: 30522 - protein, 15 aa, BK virus
GNIWVLLFKCFFSKF

SEQ ID NO: 30523 - protein, 15 aa, BK virus
NIWVLLFKCFFSKFT

SEQ ID NO: 30524 - protein, 15 aa, BK virus
IWVLLFKCFFSKFTL

SEQ ID NO: 30525 - protein, 15 aa, BK virus
WVLLFKCFFSKFTLT

SEQ ID NO: 30526 - protein, 15 aa, BK virus
VLLFKCFFSKFTLTL

SEQ ID NO: 30527 - protein, 15 aa, BK virus
LLFKCFFSKFTLTLP

SEQ ID NO: 30528 - protein, 15 aa, BK virus
LFKCFFSKFTLTLPS

SEQ ID NO: 30529 - protein, 15 aa, BK virus
FKCFFSKFTLTLPSK

SEQ ID NO: 30530 - protein, 15 aa, BK virus
SLKLSKLFIPCPEGK

SEQ ID NO: 30531 - protein, 15 aa, BK virus
LKLSKLFIPCPEGKS

SEQ ID NO: 30532 - protein, 15 aa, BK virus
KLSKLFIPCPEGKSF

SEQ ID NO: 30533 - protein, 15 aa, BK virus
LSKLFIPCPEGKSFD

SEQ ID NO: 30534 - protein, 15 aa, BK virus
SKLFIPCPEGKSFDS

SEQ ID NO: 30535 - protein, 15 aa, BK virus
KLFIPCPEGKSFDSA

SEQ ID NO: 30536 - protein, 15 aa, BK virus
LFIPCPEGKSFDSAP

SEQ ID NO: 30537 - protein, 15 aa, BK virus
FIPCPEGKSFDSAPV

SEQ ID NO: 30538 - protein, 15 aa, BK virus
IPCPEGKSFDSAPVP

SEQ ID NO: 30539 - protein, 15 aa, BK virus
PCPEGKSFDSAPVPF

SEQ ID NO: 30540 - protein, 15 aa, BK virus
CPEGKSFDSAPVPFT

SEQ ID NO: 30541 - protein, 15 aa, BK virus
PEGKSFDSAPVPFTS

SEQ ID NO: 30542 - protein, 15 aa, BK virus
EGKSFDSAPVPFTSS

SEQ ID NO: 30543 - protein, 15 aa, BK virus
GKSFDSAPVPFTSSK

SEQ ID NO: 30544 - protein, 15 aa, BK virus
KSFDSAPVPFTSSKT

SEQ ID NO: 30545 - protein, 15 aa, BK virus
SFDSAPVPFTSSKTT

SEQ ID NO: 30546 - protein, 15 aa, BK virus
FDSAPVPFTSSKTTM

SEQ ID NO: 30547 - protein, 15 aa, BK virus
DSAPVPFTSSKTTMY

SEQ ID NO: 30548 - protein, 15 aa, BK virus
SIATPSSKVSLSMGR

SEQ ID NO: 30549 - protein, 15 aa, BK virus
IATPSSKVSLSMGRF

SEQ ID NO: 30550 - protein, 15 aa, BK virus
ATPSSKVSLSMGRFT

SEQ ID NO: 30551 - protein, 15 aa, BK virus
TPSSKVSLSMGRFTF

SEQ ID NO: 30552 - protein, 15 aa, BK virus
PSSKVSLSMGRFTFK

SEQ ID NO: 30553 - protein, 15 aa, BK virus
SSKVSLSMGRFTFKA

SEQ ID NO: 30554 - protein, 15 aa, BK virus
SKVSLSMGRFTFKAL

SEQ ID NO: 30555 - protein, 15 aa, BK virus
KVSLSMGRFTFKALP

SEQ ID NO: 30556 - protein, 15 aa, BK virus
VSLSMGRFTFKALPP

SEQ ID NO: 30557 - protein, 15 aa, BK virus
SLSMGRFTFKALPPH

SEQ ID NO: 30558 - protein, 15 aa, BK virus
LSMGRFTFKALPPHK

SEQ ID NO: 30559 - protein, 15 aa, BK virus
SMGRFTFKALPPHKS

SEQ ID NO: 30560 - protein, 15 aa, BK virus
MGRFTFKALPPHKSN

SEQ ID NO: 30561 - protein, 15 aa, BK virus
GRFTFKALPPHKSNN

SEQ ID NO: 30562 - protein, 15 aa, BK virus
RFTFKALPPHKSNNP

SEQ ID NO: 30563 - protein, 15 aa, BK virus
FTFKALPPHKSNNPA

SEQ ID NO: 30564 - protein, 15 aa, BK virus
TFKALPPHKSNNPAA

SEQ ID NO: 30565 - protein, 15 aa, BK virus
FKALPPHKSNNPAAS

SEQ ID NO: 30566 - protein, 15 aa, BK virus
KALPPHKSNNPAASV

SEQ ID NO: 30567 - protein, 15 aa, BK virus
ALPPHKSNNPAASVV

SEQ ID NO: 30568 - protein, 15 aa, BK virus
LPPHKSNNPAASVVF

SEQ ID NO: 30569 - protein, 15 aa, BK virus
PPHKSNNPAASVVFP

SEQ ID NO: 30570 - protein, 15 aa, BK virus
PHKSNNPAASVVFPL

SEQ ID NO: 30571 - protein, 15 aa, BK virus
HKSNNPAASVVFPLS

SEQ ID NO: 30572 - protein, 15 aa, BK virus
KSNNPAASVVFPLSM

SEQ ID NO: 30573 - protein, 15 aa, BK virus
SNNPAASVVFPLSMG

SEQ ID NO: 30574 - protein, 15 aa, BK virus
NNPAASVVFPLSMGP

SEQ ID NO: 30575 - protein, 15 aa, BK virus
NPAASVVFPLSMGPL

SEQ ID NO: 30576 - protein, 15 aa, BK virus
PAASVVFPLSMGPLN

SEQ ID NO: 30577 - protein, 15 aa, BK virus
AASVVFPLSMGPLNN

SEQ ID NO: 30578 - protein, 15 aa, BK virus
ASVVFPLSMGPLNNQ

SEQ ID NO: 30579 - protein, 15 aa, BK virus
SVVFPLSMGPLNNQY

SEQ ID NO: 30580 - protein, 15 aa, BK virus
VVFPLSMGPLNNQYL

SEQ ID NO: 30581 - protein, 15 aa, BK virus
VFPLSMGPLNNQYLL

SEQ ID NO: 30582 - protein, 15 aa, BK virus
FPLSMGPLNNQYLLL

SEQ ID NO: 30583 - protein, 15 aa, BK virus
PLSMGPLNNQYLLLG

SEQ ID NO: 30584 - protein, 15 aa, BK virus
LSMGPLNNQYLLLGT

SEQ ID NO: 30585 - protein, 15 aa, BK virus
SMGPLNNQYLLLGTL

SEQ ID NO: 30586 - protein, 15 aa, BK virus
MGPLNNQYLLLGTLK

SEQ ID NO: 30587 - protein, 15 aa, BK virus
GPLNNQYLLLGTLKT

SEQ ID NO: 30588 - protein, 15 aa, BK virus
PLNNQYLLLGTLKTI

SEQ ID NO: 30589 - protein, 15 aa, BK virus
LNNQYLLLGTLKTIQ

SEQ ID NO: 30590 - protein, 15 aa, BK virus
NNQYLLLGTLKTIQC

SEQ ID NO: 30591 - protein, 15 aa, BK virus
NQYLLLGTLKTIQCK

SEQ ID NO: 30592 - protein, 15 aa, BK virus
QYLLLGTLKTIQCKK

SEQ ID NO: 30593 - protein, 15 aa, BK virus
YLLLGTLKTIQCKKS

SEQ ID NO: 30594 - protein, 15 aa, BK virus
LLLGTLKTIQCKKSN

SEQ ID NO: 30595 - protein, 15 aa, BK virus
LLGTLKTIQCKKSNI

SEQ ID NO: 30596 - protein, 15 aa, BK virus
LGTLKTIQCKKSNIT

SEQ ID NO: 30597 - protein, 15 aa, BK virus
GTLKTIQCKKSNITE

SEQ ID NO: 30598 - protein, 15 aa, BK virus
TLKTIQCKKSNITES

SEQ ID NO: 30599 - protein, 15 aa, BK virus
LKTIQCKKSNITESI

SEQ ID NO: 30600 - protein, 15 aa, BK virus
KTIQCKKSNITESIL

SEQ ID NO: 30601 - protein, 15 aa, BK virus
TIQCKKSNITESILG

SEQ ID NO: 30602 - protein, 15 aa, BK virus
IQCKKSNITESILGS

SEQ ID NO: 30603 - protein, 15 aa, BK virus
QCKKSNITESILGSK

SEQ ID NO: 30604 - protein, 15 aa, BK virus
CKKSNITESILGSKQ

SEQ ID NO: 30605 - protein, 15 aa, BK virus
KKSNITESILGSKQC

SEQ ID NO: 30606 - protein, 15 aa, BK virus
KSNITESILGSKQCS

SEQ ID NO: 30607 - protein, 15 aa, BK virus
SNITESILGSKQCSQ

SEQ ID NO: 30608 - protein, 15 aa, BK virus
NITESILGSKQCSQA

SEQ ID NO: 30609 - protein, 15 aa, BK virus
ITESILGSKQCSQAT

SEQ ID NO: 30610 - protein, 15 aa, BK virus
TESILGSKQCSQATP

SEQ ID NO: 30611 - protein, 15 aa, BK virus
ESILGSKQCSQATPA

SEQ ID NO: 30612 - protein, 15 aa, BK virus
SILGSKQCSQATPAI

SEQ ID NO: 30613 - protein, 15 aa, BK virus
ILGSKQCSQATPAIY

SEQ ID NO: 30614 - protein, 15 aa, BK virus
LGSKQCSQATPAIYC

SEQ ID NO: 30615 - protein, 15 aa, BK virus
GSKQCSQATPAIYCS

SEQ ID NO: 30616 - protein, 15 aa, BK virus
SKQCSQATPAIYCSS

SEQ ID NO: 30617 - protein, 15 aa, BK virus
KQCSQATPAIYCSST

SEQ ID NO: 30618 - protein, 15 aa, BK virus
QCSQATPAIYCSSTA

SEQ ID NO: 30619 - protein, 15 aa, BK virus
CSQATPAIYCSSTAF

SEQ ID NO: 30620 - protein, 15 aa, BK virus
SQATPAIYCSSTAFP

SEQ ID NO: 30621 - protein, 15 aa, BK virus
RVSTLFLAKTVSTAC

SEQ ID NO: 30622 - protein, 15 aa, BK virus
FLLSAKIIAFAKCFS

SEQ ID NO: 30623 - protein, 15 aa, BK virus
NSKYIPNNKNTSSHF

SEQ ID NO: 30624 - protein, 15 aa, BK virus
SKYIPNNKNTSSHFV

SEQ ID NO: 30625 - protein, 15 aa, BK virus
KYIPNNKNTSSHFVS

SEQ ID NO: 30626 - protein, 15 aa, BK virus
YIPNNKNTSSHFVST

SEQ ID NO: 30627 - protein, 15 aa, BK virus
IPNNKNTSSHFVSTA

SEQ ID NO: 30628 - protein, 15 aa, BK virus
PNNKNTSSHFVSTAY

SEQ ID NO: 30629 - protein, 15 aa, BK virus
NNKNTSSHFVSTAYS

SEQ ID NO: 30630 - protein, 15 aa, BK virus
NKNTSSHFVSTAYSV

SEQ ID NO: 30631 - protein, 15 aa, BK virus
KNTSSHFVSTAYSVI

SEQ ID NO: 30632 - protein, 15 aa, BK virus
NTSSHFVSTAYSVIN

SEQ ID NO: 30633 - protein, 15 aa, BK virus
TSSHFVSTAYSVINF

SEQ ID NO: 30634 - protein, 15 aa, BK virus
SSHFVSTAYSVINFQ

SEQ ID NO: 30635 - protein, 15 aa, BK virus
SHFVSTAYSVINFQD

SEQ ID NO: 30636 - protein, 15 aa, BK virus
HFVSTAYSVINFQDT

SEQ ID NO: 30637 - protein, 15 aa, BK virus
FVSTAYSVINFQDTC

SEQ ID NO: 30638 - protein, 15 aa, BK virus
VSTAYSVINFQDTCF

SEQ ID NO: 30639 - protein, 15 aa, BK virus
STAYSVINFQDTCFV

SEQ ID NO: 30640 - protein, 15 aa, BK virus
TAYSVINFQDTCFVS

SEQ ID NO: 30641 - protein, 15 aa, BK virus
AYSVINFQDTCFVSS

SEQ ID NO: 30642 - protein, 15 aa, BK virus
YSVINFQDTCFVSSG

SEQ ID NO: 30643 - protein, 15 aa, BK virus
SVINFQDTCFVSSGS

SEQ ID NO: 30644 - protein, 15 aa, BK virus
VINFQDTCFVSSGSS

SEQ ID NO: 30645 - protein, 15 aa, BK virus
INFQDTCFVSSGSSG

SEQ ID NO: 30646 - protein, 15 aa, BK virus
NFQDTCFVSSGSSGL

SEQ ID NO: 30647 - protein, 15 aa, BK virus
FQDTCFVSSGSSGLK

SEQ ID NO: 30648 - protein, 15 aa, BK virus
QDTCFVSSGSSGLKS

SEQ ID NO: 30649 - protein, 15 aa, BK virus
DTCFVSSGSSGLKSC

SEQ ID NO: 30650 - protein, 15 aa, BK virus
TCFVSSGSSGLKSCS

SEQ ID NO: 30651 - protein, 15 aa, BK virus
CFVSSGSSGLKSCSF

SEQ ID NO: 30652 - protein, 15 aa, BK virus
FVSSGSSGLKSCSFK

SEQ ID NO: 30653 - protein, 15 aa, BK virus
VSSGSSGLKSCSFKP

SEQ ID NO: 30654 - protein, 15 aa, BK virus
SSGSSGLKSCSFKPP

SEQ ID NO: 30655 - protein, 15 aa, BK virus
MLSSIVWYGSLVKAL

SEQ ID NO: 30656 - protein, 15 aa, BK virus
LSSIVWYGSLVKALY

SEQ ID NO: 30657 - protein, 15 aa, BK virus
SSIVWYGSLVKALYS

SEQ ID NO: 30658 - protein, 15 aa, BK virus
SIVWYGSLVKALYSK

SEQ ID NO: 30659 - protein, 15 aa, BK virus
IVWYGSLVKALYSKY

SEQ ID NO: 30660 - protein, 15 aa, BK virus
VWYGSLVKALYSKYS

SEQ ID NO: 30661 - protein, 15 aa, BK virus
WYGSLVKALYSKYSL

SEQ ID NO: 30662 - protein, 15 aa, BK virus
YGSLVKALYSKYSLL

SEQ ID NO: 30663 - protein, 15 aa, BK virus
GSLVKALYSKYSLLT

SEQ ID NO: 30664 - protein, 15 aa, BK virus
SLVKALYSKYSLLTP

SEQ ID NO: 30665 - protein, 15 aa, BK virus
LVKALYSKYSLLTPL

SEQ ID NO: 30666 - protein, 15 aa, BK virus
VKALYSKYSLLTPLQ

SEQ ID NO: 30667 - protein, 15 aa, BK virus
KALYSKYSLLTPLQI

SEQ ID NO: 30668 - protein, 15 aa, BK virus
ALYSKYSLLTPLQIK

SEQ ID NO: 30669 - protein, 15 aa, BK virus
LYSKYSLLTPLQIKK

SEQ ID NO: 30670 - protein, 15 aa, BK virus
YSKYSLLTPLQIKKL

SEQ ID NO: 30671 - protein, 15 aa, BK virus
SKYSLLTPLQIKKLK

SEQ ID NO: 30672 - protein, 15 aa, BK virus
KYSLLTPLQIKKLKV

SEQ ID NO: 30673 - protein, 15 aa, BK virus
YSLLTPLQIKKLKVH

SEQ ID NO: 30674 - protein, 15 aa, BK virus
SLLTPLQIKKLKVHS

SEQ ID NO: 30675 - protein, 15 aa, BK virus
LLTPLQIKKLKVHSF

SEQ ID NO: 30676 - protein, 15 aa, BK virus
QKLLIAETLCLCGVK

SEQ ID NO: 30677 - protein, 15 aa, BK virus
KLLIAETLCLCGVKK

SEQ ID NO: 30678 - protein, 15 aa, BK virus
LLIAETLCLCGVKKN

SEQ ID NO: 30679 - protein, 15 aa, BK virus
LIAETLCLCGVKKNI

SEQ ID NO: 30680 - protein, 15 aa, BK virus
IAETLCLCGVKKNII

SEQ ID NO: 30681 - protein, 15 aa, BK virus
AETLCLCGVKKNIIL

SEQ ID NO: 30682 - protein, 15 aa, BK virus
ETLCLCGVKKNIILC

SEQ ID NO: 30683 - protein, 15 aa, BK virus
TLCLCGVKKNIILCP

SEQ ID NO: 30684 - protein, 15 aa, BK virus
LCLCGVKKNIILCPA

SEQ ID NO: 30685 - protein, 15 aa, BK virus
CLCGVKKNIILCPAH

SEQ ID NO: 30686 - protein, 15 aa, BK virus
LCGVKKNIILCPAHM

SEQ ID NO: 30687 - protein, 15 aa, BK virus
CGVKKNIILCPAHMC

SEQ ID NO: 30688 - protein, 15 aa, BK virus
GVKKNIILCPAHMCL

SEQ ID NO: 30689 - protein, 15 aa, BK virus
VKKNIILCPAHMCLL

SEQ ID NO: 30690 - protein, 15 aa, BK virus
KKNIILCPAHMCLLI

SEQ ID NO: 30691 - protein, 15 aa, BK virus
KNIILCPAHMCLLIK

SEQ ID NO: 30692 - protein, 15 aa, BK virus
NIILCPAHMCLLIKV

SEQ ID NO: 30693 - protein, 15 aa, BK virus
IILCPAHMCLLIKVT

SEQ ID NO: 30694 - protein, 15 aa, BK virus
ILCPAHMCLLIKVTE

SEQ ID NO: 30695 - protein, 15 aa, BK virus
LCPAHMCLLIKVTEY

SEQ ID NO: 30696 - protein, 15 aa, BK virus
CPAHMCLLIKVTEYF

SEQ ID NO: 30697 - protein, 15 aa, BK virus
PAHMCLLIKVTEYFS

SEQ ID NO: 30698 - protein, 15 aa, BK virus
AHMCLLIKVTEYFSI

SEQ ID NO: 30699 - protein, 15 aa, BK virus
HMCLLIKVTEYFSIS

SEQ ID NO: 30700 - protein, 15 aa, BK virus
MCLLIKVTEYFSISF

SEQ ID NO: 30701 - protein, 15 aa, BK virus
CLLIKVTEYFSISFL

SEQ ID NO: 30702 - protein, 15 aa, BK virus
LLIKVTEYFSISFLY

SEQ ID NO: 30703 - protein, 15 aa, BK virus
LIKVTEYFSISFLYR

SEQ ID NO: 30704 - protein, 15 aa, BK virus
IKVTEYFSISFLYRI

SEQ ID NO: 30705 - protein, 15 aa, BK virus
AFSLVVYTAKQARVL

SEQ ID NO: 30706 - protein, 15 aa, BK virus
FSLVVYTAKQARVLL

SEQ ID NO: 30707 - protein, 15 aa, BK virus
SLVVYTAKQARVLLL

SEQ ID NO: 30708 - protein, 15 aa, BK virus
LVVYTAKQARVLLLN

SEQ ID NO: 30709 - protein, 15 aa, BK virus
VVYTAKQARVLLLNT

SEQ ID NO: 30710 - protein, 15 aa, BK virus
VYTAKQARVLLLNTA

SEQ ID NO: 30711 - protein, 15 aa, BK virus
LRNWCRSEGKSLGSS

SEQ ID NO: 30712 - protein, 15 aa, BK virus
RNWCRSEGKSLGSST

SEQ ID NO: 30713 - protein, 15 aa, BK virus
NWCRSEGKSLGSSTF

SEQ ID NO: 30714 - protein, 15 aa, BK virus
WCRSEGKSLGSSTFL

SEQ ID NO: 30715 - protein, 15 aa, BK virus
CRSEGKSLGSSTFLF

SEQ ID NO: 30716 - protein, 15 aa, BK virus
RSEGKSLGSSTFLFF

SEQ ID NO: 30717 - protein, 15 aa, BK virus
SEGKSLGSSTFLFFL

SEQ ID NO: 30718 - protein, 15 aa, BK virus
EGKSLGSSTFLFFLG

SEQ ID NO: 30719 - protein, 15 aa, BK virus
GKSLGSSTFLFFLGG

SEQ ID NO: 30720 - protein, 15 aa, BK virus
KSLGSSTFLFFLGGV

SEQ ID NO: 30721 - protein, 15 aa, BK virus
SLGSSTFLFFLGGVE

SEQ ID NO: 30722 - protein, 15 aa, BK virus
LGSSTFLFFLGGVEC

SEQ ID NO: 30723 - protein, 15 aa, BK virus
ESAVASSSLANISSW

SEQ ID NO: 30724 - protein, 15 aa, BK virus
SAVASSSLANISSWQ

SEQ ID NO: 30725 - protein, 15 aa, BK virus
AVASSSLANISSWQN

SEQ ID NO: 30726 - protein, 15 aa, BK virus
VASSSLANISSWQNK

SEQ ID NO: 30727 - protein, 15 aa, BK virus
ASSSLANISSWQNKS

SEQ ID NO: 30728 - protein, 15 aa, BK virus
SSSLANISSWQNKSS

SEQ ID NO: 30729 - protein, 15 aa, BK virus
SSLANISSWQNKSSS

SEQ ID NO: 30730 - protein, 15 aa, BK virus
SLANISSWQNKSSSH

SEQ ID NO: 30731 - protein, 15 aa, BK virus
LANISSWQNKSSSHF

SEQ ID NO: 30732 - protein, 15 aa, BK virus
ANISSWQNKSSSHFS

SEQ ID NO: 30733 - protein, 15 aa, BK virus
NISSWQNKSSSHFSL

SEQ ID NO: 30734 - protein, 15 aa, BK virus
ISSWQNKSSSHFSLK

SEQ ID NO: 30735 - protein, 15 aa, BK virus
SSWQNKSSSHFSLKE

SEQ ID NO: 30736 - protein, 15 aa, BK virus
SWQNKSSSHFSLKEL

SEQ ID NO: 30737 - protein, 15 aa, BK virus
WQNKSSSHFSLKELH

SEQ ID NO: 30738 - protein, 15 aa, BK virus
QNKSSSHFSLKELHQ

SEQ ID NO: 30739 - protein, 15 aa, BK virus
NKSSSHFSLKELHQD

SEQ ID NO: 30740 - protein, 15 aa, BK virus
KSSSHFSLKELHQDS

SEQ ID NO: 30741 - protein, 15 aa, BK virus
SSSHFSLKELHQDSH

SEQ ID NO: 30742 - protein, 15 aa, BK virus
SSHFSLKELHQDSHS

SEQ ID NO: 30743 - protein, 15 aa, BK virus
SHFSLKELHQDSHSS

SEQ ID NO: 30744 - protein, 15 aa, BK virus
HFSLKELHQDSHSSV

SEQ ID NO: 30745 - protein, 15 aa, BK virus
FSLKELHQDSHSSVP

SEQ ID NO: 30746 - protein, 15 aa, BK virus
VGTYKKNNYLGPFNI

SEQ ID NO: 30747 - protein, 15 aa, BK virus
GTYKKNNYLGPFNIL

SEQ ID NO: 30748 - protein, 15 aa, BK virus
TYKKNNYLGPFNILL

SEQ ID NO: 30749 - protein, 15 aa, BK virus
YKKNNYLGPFNILLF

SEQ ID NO: 30750 - protein, 15 aa, BK virus
KKNNYLGPFNILLFI

SEQ ID NO: 30751 - protein, 15 aa, BK virus
REFLQLFGPTIAEFL

SEQ ID NO: 30752 - protein, 15 aa, BK virus
EFLQLFGPTIAEFLQ

SEQ ID NO: 30753 - protein, 15 aa, BK virus
FLQLFGPTIAEFLQL

SEQ ID NO: 30754 - protein, 15 aa, BK virus
LQLFGPTIAEFLQLG

SEQ ID NO: 30755 - protein, 15 aa, BK virus
QLFGPTIAEFLQLGL

SEQ ID NO: 30756 - protein, 15 aa, BK virus
LFGPTIAEFLQLGLS

SEQ ID NO: 30757 - protein, 15 aa, BK virus
FGPTIAEFLQLGLSQ

SEQ ID NO: 30758 - protein, 15 aa, BK virus
GPTIAEFLQLGLSQT

SEQ ID NO: 30759 - protein, 15 aa, BK virus
PTIAEFLQLGLSQTT

SEQ ID NO: 30760 - protein, 15 aa, BK virus
TIAEFLQLGLSQTTV

SEQ ID NO: 30761 - protein, 15 aa, BK virus
SSQCSSNLSKPRALF

SEQ ID NO: 30762 - protein, 15 aa, BK virus
SQCSSNLSKPRALFL

SEQ ID NO: 30763 - protein, 15 aa, BK virus
QCSSNLSKPRALFLK

SEQ ID NO: 30764 - protein, 15 aa, BK virus
CSSNLSKPRALFLKI

SEQ ID NO: 30765 - protein, 15 aa, BK virus
SSNLSKPRALFLKIF

SEQ ID NO: 30766 - protein, 15 aa, BK virus
SNLSKPRALFLKIFY

SEQ ID NO: 30767 - protein, 15 aa, BK virus
NLSKPRALFLKIFYL

SEQ ID NO: 30768 - protein, 15 aa, BK virus
LSKPRALFLKIFYLN

SEQ ID NO: 30769 - protein, 15 aa, BK virus
SKPRALFLKIFYLNA

SEQ ID NO: 30770 - protein, 15 aa, BK virus
KPRALFLKIFYLNAL

SEQ ID NO: 30771 - protein, 15 aa, BK virus
PRALFLKIFYLNALI

SEQ ID NO: 30772 - protein, 15 aa, BK virus
ADIACKGSAQKAFWN

SEQ ID NO: 30773 - protein, 15 aa, BK virus
DIACKGSAQKAFWNK

SEQ ID NO: 30774 - protein, 15 aa, BK virus
AIPCSTGYLGKEENQ

SEQ ID NO: 30775 - protein, 15 aa, BK virus
IPCSTGYLGKEENQH

SEQ ID NO: 30776 - protein, 15 aa, BK virus
PCSTGYLGKEENQHK

SEQ ID NO: 30777 - protein, 15 aa, BK virus
CSTGYLGKEENQHKP

SEQ ID NO: 30778 - protein, 15 aa, BK virus
STGYLGKEENQHKPL

SEQ ID NO: 30779 - protein, 15 aa, BK virus
TGYLGKEENQHKPLS

SEQ ID NO: 30780 - protein, 15 aa, BK virus
GYLGKEENQHKPLSY

SEQ ID NO: 30781 - protein, 15 aa, BK virus
YLGKEENQHKPLSYS

SEQ ID NO: 30782 - protein, 15 aa, BK virus
LGKEENQHKPLSYSR

SEQ ID NO: 30783 - protein, 15 aa, BK virus
GKEENQHKPLSYSRF

SEQ ID NO: 30784 - protein, 15 aa, BK virus
KEENQHKPLSYSRFQ

SEQ ID NO: 30785 - protein, 15 aa, BK virus
EENQHKPLSYSRFQN

SEQ ID NO: 30786 - protein, 15 aa, BK virus
ENQHKPLSYSRFQNQ

SEQ ID NO: 30787 - protein, 15 aa, BK virus
NQHKPLSYSRFQNQA

SEQ ID NO: 30788 - protein, 15 aa, BK virus
QHKPLSYSRFQNQAD

SEQ ID NO: 30789 - protein, 15 aa, BK virus
HKPLSYSRFQNQADE

SEQ ID NO: 30790 - protein, 15 aa, BK virus
KPLSYSRFQNQADEL

SEQ ID NO: 30791 - protein, 15 aa, BK virus
PLSYSRFQNQADELP

SEQ ID NO: 30792 - protein, 15 aa, BK virus
LSYSRFQNQADELPL

SEQ ID NO: 30793 - protein, 15 aa, BK virus
SYSRFQNQADELPLH

SEQ ID NO: 30794 - protein, 15 aa, BK virus
YSRFQNQADELPLHP

SEQ ID NO: 30795 - protein, 15 aa, BK virus
SRFQNQADELPLHPA

SEQ ID NO: 30796 - protein, 15 aa, BK virus
RFQNQADELPLHPAP

SEQ ID NO: 30797 - protein, 15 aa, BK virus
FQNQADELPLHPAPF

SEQ ID NO: 30798 - protein, 15 aa, BK virus
QNQADELPLHPAPFF

SEQ ID NO: 30799 - protein, 15 aa, BK virus
NQADELPLHPAPFFY

SEQ ID NO: 30800 - protein, 15 aa, BK virus
QADELPLHPAPFFYT

SEQ ID NO: 30801 - protein, 15 aa, BK virus
ADELPLHPAPFFYTK

SEQ ID NO: 30802 - protein, 15 aa, BK virus
DELPLHPAPFFYTKY

SEQ ID NO: 30803 - protein, 15 aa, BK virus
ELPLHPAPFFYTKYS

SEQ ID NO: 30804 - protein, 15 aa, BK virus
LPLHPAPFFYTKYSF

SEQ ID NO: 30805 - protein, 15 aa, BK virus
PLHPAPFFYTKYSFS

SEQ ID NO: 30806 - protein, 15 aa, BK virus
LHPAPFFYTKYSFSS

SEQ ID NO: 30807 - protein, 15 aa, BK virus
HPAPFFYTKYSFSSF

SEQ ID NO: 30808 - protein, 15 aa, BK virus
PAPFFYTKYSFSSFY

SEQ ID NO: 30809 - protein, 15 aa, BK virus
APFFYTKYSFSSFYP

SEQ ID NO: 30810 - protein, 15 aa, BK virus
PFFYTKYSFSSFYPR

SEQ ID NO: 30811 - protein, 15 aa, BK virus
FFYTKYSFSSFYPRR

SEQ ID NO: 30812 - protein, 15 aa, BK virus
FYTKYSFSSFYPRRP

SEQ ID NO: 30813 - protein, 15 aa, BK virus
YTKYSFSSFYPRRPL

SEQ ID NO: 30814 - protein, 15 aa, BK virus
TKYSFSSFYPRRPLC

SEQ ID NO: 30815 - protein, 15 aa, BK virus
KYSFSSFYPRRPLCQ

SEQ ID NO: 30816 - protein, 15 aa, BK virus
YSFSSFYPRRPLCQG

SEQ ID NO: 30817 - protein, 15 aa, BK virus
SFSSFYPRRPLCQGE

SEQ ID NO: 30818 - protein, 15 aa, BK virus
FSSFYPRRPLCQGEI

SEQ ID NO: 30819 - protein, 15 aa, BK virus
SSFYPRRPLCQGEIP

SEQ ID NO: 30820 - protein, 15 aa, BK virus
SFYPRRPLCQGEIPY

SEQ ID NO: 30821 - protein, 15 aa, BK virus
FYPRRPLCQGEIPYT

SEQ ID NO: 30822 - protein, 15 aa, BK virus
YPRRPLCQGEIPYTS

SEQ ID NO: 30823 - protein, 15 aa, BK virus
PRRPLCQGEIPYTSL

SEQ ID NO: 30824 - protein, 15 aa, BK virus
RRPLCQGEIPYTSLN

SEQ ID NO: 30825 - protein, 15 aa, BK virus
RPLCQGEIPYTSLNK

SEQ ID NO: 30826 - protein, 15 aa, BK virus
PLCQGEIPYTSLNKL

SEQ ID NO: 30827 - protein, 15 aa, BK virus
LCQGEIPYTSLNKLF

SEQ ID NO: 30828 - protein, 15 aa, BK virus
CQGEIPYTSLNKLFS

SEQ ID NO: 30829 - protein, 15 aa, BK virus
QGEIPYTSLNKLFSL

SEQ ID NO: 30830 - protein, 15 aa, BK virus
GEIPYTSLNKLFSLR

SEQ ID NO: 30831 - protein, 15 aa, BK virus
EIPYTSLNKLFSLRE

SEQ ID NO: 30832 - protein, 15 aa, BK virus
IPYTSLNKLFSLRED

SEQ ID NO: 30833 - protein, 15 aa, BK virus
PYTSLNKLFSLREDF

SEQ ID NO: 30834 - protein, 15 aa, BK virus
YTSLNKLFSLREDFP

SEQ ID NO: 30835 - protein, 15 aa, BK virus
TSLNKLFSLREDFPR

SEQ ID NO: 30836 - protein, 15 aa, BK virus
SLNKLFSLREDFPRQ

SEQ ID NO: 30837 - protein, 15 aa, BK virus
LNKLFSLREDFPRQL

SEQ ID NO: 30838 - protein, 15 aa, BK virus
NKLFSLREDFPRQLF

SEQ ID NO: 30839 - protein, 15 aa, BK virus
KLFSLREDFPRQLFQ

SEQ ID NO: 30840 - protein, 15 aa, BK virus
LFSLREDFPRQLFQG

SEQ ID NO: 30841 - protein, 15 aa, BK virus
FSLREDFPRQLFQGL

SEQ ID NO: 30842 - protein, 15 aa, BK virus
SLREDFPRQLFQGLK

SEQ ID NO: 30843 - protein, 15 aa, BK virus
LREDFPRQLFQGLKG

SEQ ID NO: 30844 - protein, 15 aa, BK virus
REDFPRQLFQGLKGP

SEQ ID NO: 30845 - protein, 16 aa, BK virus
GFPQIVLLGLRKSLHT

SEQ ID NO: 30846 - protein, 16 aa, BK virus
FPQIVLLGLRKSLHTL

SEQ ID NO: 30847 - protein, 16 aa, BK virus
PQIVLLGLRKSLHTLT

SEQ ID NO: 30848 - protein, 16 aa, BK virus
QIVLLGLRKSLHTLTT

SEQ ID NO: 30849 - protein, 16 aa, BK virus
EKGWRQRRPRPLIYYK

SEQ ID NO: 30850 - protein, 16 aa, BK virus
KGWRQRRPRPLIYYKK

SEQ ID NO: 30851 - protein, 16 aa, BK virus
GWRQRRPRPLIYYKKK

SEQ ID NO: 30852 - protein, 16 aa, BK virus
WRQRRPRPLIYYKKKG

SEQ ID NO: 30853 - protein, 16 aa, BK virus
RQRRPRPLIYYKKKGH

SEQ ID NO: 30854 - protein, 16 aa, BK virus
QRRPRPLIYYKKKGHR

SEQ ID NO: 30855 - protein, 16 aa, BK virus
RRPRPLIYYKKKGHRE

SEQ ID NO: 30856 - protein, 16 aa, BK virus
RPRPLIYYKKKGHREE

SEQ ID NO: 30857 - protein, 16 aa, BK virus
PRPLIYYKKKGHREEL

SEQ ID NO: 30858 - protein, 16 aa, BK virus
RPLIYYKKKGHREELL

SEQ ID NO: 30859 - protein, 16 aa, BK virus
PLIYYKKKGHREELLT

SEQ ID NO: 30860 - protein, 16 aa, BK virus
LIYYKKKGHREELLTH

SEQ ID NO: 30861 - protein, 16 aa, BK virus
IYYKKKGHREELLTHG

SEQ ID NO: 30862 - protein, 16 aa, BK virus
YYKKKGHREELLTHGM

SEQ ID NO: 30863 - protein, 16 aa, BK virus
YKKKGHREELLTHGMQ

SEQ ID NO: 30864 - protein, 16 aa, BK virus
KKKGHREELLTHGMQP

SEQ ID NO: 30865 - protein, 16 aa, BK virus
KKGHREELLTHGMQPN

SEQ ID NO: 30866 - protein, 16 aa, BK virus
KGHREELLTHGMQPNH

SEQ ID NO: 30867 - protein, 16 aa, BK virus
GHREELLTHGMQPNHD

SEQ ID NO: 30868 - protein, 16 aa, BK virus
HREELLTHGMQPNHDL

SEQ ID NO: 30869 - protein, 16 aa, BK virus
REELLTHGMQPNHDLR

SEQ ID NO: 30870 - protein, 16 aa, BK virus
EELLTHGMQPNHDLRK

SEQ ID NO: 30871 - protein, 16 aa, BK virus
ELLTHGMQPNHDLRKE

SEQ ID NO: 30872 - protein, 16 aa, BK virus
LLTHGMQPNHDLRKES

SEQ ID NO: 30873 - protein, 16 aa, BK virus
LTHGMQPNHDLRKESA

SEQ ID NO: 30874 - protein, 16 aa, BK virus
LTGECSQTMTSGRKVH

SEQ ID NO: 30875 - protein, 16 aa, BK virus
TGECSQTMTSGRKVHD

SEQ ID NO: 30876 - protein, 16 aa, BK virus
GECSQTMTSGRKVHDS

SEQ ID NO: 30877 - protein, 16 aa, BK virus
ECSQTMTSGRKVHDSQ

SEQ ID NO: 30878 - protein, 16 aa, BK virus
CSQTMTSGRKVHDSQG

SEQ ID NO: 30879 - protein, 16 aa, BK virus
SQTMTSGRKVHDSQGG

SEQ ID NO: 30880 - protein, 16 aa, BK virus
QTMTSGRKVHDSQGGA

SEQ ID NO: 30881 - protein, 16 aa, BK virus
TMTSGRKVHDSQGGAA

SEQ ID NO: 30882 - protein, 16 aa, BK virus
MTSGRKVHDSQGGAAY

SEQ ID NO: 30883 - protein, 16 aa, BK virus
TSGRKVHDSQGGAAYP

SEQ ID NO: 30884 - protein, 16 aa, BK virus
SGRKVHDSQGGAAYPW

SEQ ID NO: 30885 - protein, 16 aa, BK virus
GRKVHDSQGGAAYPWN

SEQ ID NO: 30886 - protein, 16 aa, BK virus
RKVHDSQGGAAYPWNA

SEQ ID NO: 30887 - protein, 16 aa, BK virus
KVHDSQGGAAYPWNAA

SEQ ID NO: 30888 - protein, 16 aa, BK virus
VHDSQGGAAYPWNAAK

SEQ ID NO: 30889 - protein, 16 aa, BK virus
HDSQGGAAYPWNAAKP

SEQ ID NO: 30890 - protein, 16 aa, BK virus
PQEGKCMTDMFCEPRN

SEQ ID NO: 30891 - protein, 16 aa, BK virus
QEGKCMTDMFCEPRNL

SEQ ID NO: 30892 - protein, 16 aa, BK virus
EGKCMTDMFCEPRNLG

SEQ ID NO: 30893 - protein, 16 aa, BK virus
GKCMTDMFCEPRNLGL

SEQ ID NO: 30894 - protein, 16 aa, BK virus
KCMTDMFCEPRNLGLV

SEQ ID NO: 30895 - protein, 16 aa, BK virus
CMTDMFCEPRNLGLVP

SEQ ID NO: 30896 - protein, 16 aa, BK virus
MTDMFCEPRNLGLVPS

SEQ ID NO: 30897 - protein, 16 aa, BK virus
TGQRPWFCASCHDKLQ

SEQ ID NO: 30898 - protein, 16 aa, BK virus
KLVKPGLEQKKELRGF

SEQ ID NO: 30899 - protein, 16 aa, BK virus
LVKPGLEQKKELRGFL

SEQ ID NO: 30900 - protein, 16 aa, BK virus
VKPGLEQKKELRGFLF

SEQ ID NO: 30901 - protein, 16 aa, BK virus
KPGLEQKKELRGFLFL

SEQ ID NO: 30902 - protein, 16 aa, BK virus
PGLEQKKELRGFLFLF

SEQ ID NO: 30903 - protein, 16 aa, BK virus
VIPFFLYFQVHGCCSS

SEQ ID NO: 30904 - protein, 16 aa, BK virus
IPFFLYFQVHGCCSST

SEQ ID NO: 30905 - protein, 16 aa, BK virus
PFFLYFQVHGCCSSTF

SEQ ID NO: 30906 - protein, 16 aa, BK virus
FFLYFQVHGCCSSTFG

SEQ ID NO: 30907 - protein, 16 aa, BK virus
FLYFQVHGCCSSTFGG

SEQ ID NO: 30908 - protein, 16 aa, BK virus
LYFQVHGCCSSTFGGP

SEQ ID NO: 30909 - protein, 16 aa, BK virus
YFQVHGCCSSTFGGPS

SEQ ID NO: 30910 - protein, 16 aa, BK virus
FQVHGCCSSTFGGPSC

SEQ ID NO: 30911 - protein, 16 aa, BK virus
QVHGCCSSTFGGPSCQ

SEQ ID NO: 30912 - protein, 16 aa, BK virus
VHGCCSSTFGGPSCQC

SEQ ID NO: 30913 - protein, 16 aa, BK virus
HGCCSSTFGGPSCQCI

SEQ ID NO: 30914 - protein, 16 aa, BK virus
NCCWGGCCCYRSSNCI

SEQ ID NO: 30915 - protein, 16 aa, BK virus
CCWGGCCCYRSSNCIP

SEQ ID NO: 30916 - protein, 16 aa, BK virus
CWGGCCCYRSSNCIPC

SEQ ID NO: 30917 - protein, 16 aa, BK virus
WGGCCCYRSSNCIPCY

SEQ ID NO: 30918 - protein, 16 aa, BK virus
GGCCCYRSSNCIPCYC

SEQ ID NO: 30919 - protein, 16 aa, BK virus
GCCCYRSSNCIPCYCR

SEQ ID NO: 30920 - protein, 16 aa, BK virus
CCCYRSSNCIPCYCRG

SEQ ID NO: 30921 - protein, 16 aa, BK virus
CCYRSSNCIPCYCRGH

SEQ ID NO: 30922 - protein, 16 aa, BK virus
CYRSSNCIPCYCRGHN

SEQ ID NO: 30923 - protein, 16 aa, BK virus
YRSSNCIPCYCRGHNK

SEQ ID NO: 30924 - protein, 16 aa, BK virus
RSSNCIPCYCRGHNKY

SEQ ID NO: 30925 - protein, 16 aa, BK virus
SSNCIPCYCRGHNKYL

SEQ ID NO: 30926 - protein, 16 aa, BK virus
SNCIPCYCRGHNKYLR

SEQ ID NO: 30927 - protein, 16 aa, BK virus
NCIPCYCRGHNKYLRG

SEQ ID NO: 30928 - protein, 16 aa, BK virus
CIPCYCRGHNKYLRGY

SEQ ID NO: 30929 - protein, 16 aa, BK virus
IPCYCRGHNKYLRGYS

SEQ ID NO: 30930 - protein, 16 aa, BK virus
PCYCRGHNKYLRGYSC

SEQ ID NO: 30931 - protein, 16 aa, BK virus
CYCRGHNKYLRGYSCY

SEQ ID NO: 30932 - protein, 16 aa, BK virus
YCRGHNKYLRGYSCYR

SEQ ID NO: 30933 - protein, 16 aa, BK virus
CRGHNKYLRGYSCYRP

SEQ ID NO: 30934 - protein, 16 aa, BK virus
RGHNKYLRGYSCYRPN

SEQ ID NO: 30935 - protein, 16 aa, BK virus
GHNKYLRGYSCYRPNS

SEQ ID NO: 30936 - protein, 16 aa, BK virus
HNKYLRGYSCYRPNSS

SEQ ID NO: 30937 - protein, 16 aa, BK virus
NKYLRGYSCYRPNSSN

SEQ ID NO: 30938 - protein, 16 aa, BK virus
KYLRGYSCYRPNSSNI

SEQ ID NO: 30939 - protein, 16 aa, BK virus
YLRGYSCYRPNSSNIC

SEQ ID NO: 30940 - protein, 16 aa, BK virus
LRGYSCYRPNSSNICC

SEQ ID NO: 30941 - protein, 16 aa, BK virus
RGYSCYRPNSSNICCN

SEQ ID NO: 30942 - protein, 16 aa, BK virus
GYSCYRPNSSNICCNC

SEQ ID NO: 30943 - protein, 16 aa, BK virus
YSCYRPNSSNICCNCW

SEQ ID NO: 30944 - protein, 16 aa, BK virus
SCYRPNSSNICCNCWC

SEQ ID NO: 30945 - protein, 16 aa, BK virus
CYRPNSSNICCNCWCS

SEQ ID NO: 30946 - protein, 16 aa, BK virus
YRPNSSNICCNCWCSW

SEQ ID NO: 30947 - protein, 16 aa, BK virus
RPNSSNICCNCWCSWG

SEQ ID NO: 30948 - protein, 16 aa, BK virus
PNSSNICCNCWCSWGY

SEQ ID NO: 30949 - protein, 16 aa, BK virus
NSSNICCNCWCSWGYC

SEQ ID NO: 30950 - protein, 16 aa, BK virus
SSNICCNCWCSWGYCW

SEQ ID NO: 30951 - protein, 16 aa, BK virus
SNICCNCWCSWGYCWV

SEQ ID NO: 30952 - protein, 16 aa, BK virus
NICCNCWCSWGYCWVC

SEQ ID NO: 30953 - protein, 16 aa, BK virus
ICCNCWCSWGYCWVCC

SEQ ID NO: 30954 - protein, 16 aa, BK virus
CCNCWCSWGYCWVCCF

SEQ ID NO: 30955 - protein, 16 aa, BK virus
CNCWCSWGYCWVCCFN

SEQ ID NO: 30956 - protein, 16 aa, BK virus
NCWCSWGYCWVCCFNS

SEQ ID NO: 30957 - protein, 16 aa, BK virus
CWCSWGYCWVCCFNSN

SEQ ID NO: 30958 - protein, 16 aa, BK virus
WCSWGYCWVCCFNSNC

SEQ ID NO: 30959 - protein, 16 aa, BK virus
LGSQSFHCRPLSAIRH

SEQ ID NO: 30960 - protein, 16 aa, BK virus
GSQSFHCRPLSAIRHG

SEQ ID NO: 30961 - protein, 16 aa, BK virus
SQSFHCRPLSAIRHGF

SEQ ID NO: 30962 - protein, 16 aa, BK virus
QSFHCRPLSAIRHGFG

SEQ ID NO: 30963 - protein, 16 aa, BK virus
SFHCRPLSAIRHGFGI

SEQ ID NO: 30964 - protein, 16 aa, BK virus
FHCRPLSAIRHGFGIV

SEQ ID NO: 30965 - protein, 16 aa, BK virus
ALGSFFVCYYFPGFVA

SEQ ID NO: 30966 - protein, 16 aa, BK virus
LGSFFVCYYFPGFVAC

SEQ ID NO: 30967 - protein, 16 aa, BK virus
GSFFVCYYFPGFVACY

SEQ ID NO: 30968 - protein, 16 aa, BK virus
YTFYNLTGIAEKNRKI

SEQ ID NO: 30969 - protein, 16 aa, BK virus
TFYNLTGIAEKNRKIF

SEQ ID NO: 30970 - protein, 16 aa, BK virus
IFGGNYLDNCKCPYKL

SEQ ID NO: 30971 - protein, 16 aa, BK virus
FGGNYLDNCKCPYKLL

SEQ ID NO: 30972 - protein, 16 aa, BK virus
QYRRSYTKNGLKKSTK

SEQ ID NO: 30973 - protein, 16 aa, BK virus
YRRSYTKNGLKKSTKC

SEQ ID NO: 30974 - protein, 16 aa, BK virus
RRSYTKNGLKKSTKCT

SEQ ID NO: 30975 - protein, 16 aa, BK virus
RSYTKNGLKKSTKCTF

SEQ ID NO: 30976 - protein, 16 aa, BK virus
SYTKNGLKKSTKCTFR

SEQ ID NO: 30977 - protein, 16 aa, BK virus
YTKNGLKKSTKCTFRR

SEQ ID NO: 30978 - protein, 16 aa, BK virus
TKNGLKKSTKCTFRRV

SEQ ID NO: 30979 - protein, 16 aa, BK virus
KNGLKKSTKCTFRRVY

SEQ ID NO: 30980 - protein, 16 aa, BK virus
NGLKKSTKCTFRRVYR

SEQ ID NO: 30981 - protein, 16 aa, BK virus
GLKKSTKCTFRRVYRK

SEQ ID NO: 30982 - protein, 16 aa, BK virus
LKKSTKCTFRRVYRKN

SEQ ID NO: 30983 - protein, 16 aa, BK virus
KKSTKCTFRRVYRKNY

SEQ ID NO: 30984 - protein, 16 aa, BK virus
KSTKCTFRRVYRKNYC

SEQ ID NO: 30985 - protein, 16 aa, BK virus
STKCTFRRVYRKNYCP

SEQ ID NO: 30986 - protein, 16 aa, BK virus
TKCTFRRVYRKNYCPR

SEQ ID NO: 30987 - protein, 16 aa, BK virus
KCTFRRVYRKNYCPRR

SEQ ID NO: 30988 - protein, 16 aa, BK virus
CTFRRVYRKNYCPRRC

SEQ ID NO: 30989 - protein, 16 aa, BK virus
SKNCSSMDVAFTSRPV

SEQ ID NO: 30990 - protein, 16 aa, BK virus
KNCSSMDVAFTSRPVR

SEQ ID NO: 30991 - protein, 16 aa, BK virus
NCSSMDVAFTSRPVRD

SEQ ID NO: 30992 - protein, 16 aa, BK virus
CSSMDVAFTSRPVRDC

SEQ ID NO: 30993 - protein, 16 aa, BK virus
SSMDVAFTSRPVRDCN

SEQ ID NO: 30994 - protein, 16 aa, BK virus
SMDVAFTSRPVRDCNT

SEQ ID NO: 30995 - protein, 16 aa, BK virus
MDVAFTSRPVRDCNTC

SEQ ID NO: 30996 - protein, 16 aa, BK virus
DVAFTSRPVRDCNTCS

SEQ ID NO: 30997 - protein, 16 aa, BK virus
RWPQPKEKESVQGQLP

SEQ ID NO: 30998 - protein, 16 aa, BK virus
WPQPKEKESVQGQLPK

SEQ ID NO: 30999 - protein, 16 aa, BK virus
PQPKEKESVQGQLPKS

SEQ ID NO: 31000 - protein, 16 aa, BK virus
QPKEKESVQGQLPKSQ

SEQ ID NO: 31001 - protein, 16 aa, BK virus
PKEKESVQGQLPKSQR

SEQ ID NO: 31002 - protein, 16 aa, BK virus
KEKESVQGQLPKSQRN

SEQ ID NO: 31003 - protein, 16 aa, BK virus
EKESVQGQLPKSQRNP

SEQ ID NO: 31004 - protein, 16 aa, BK virus
KESVQGQLPKSQRNPC

SEQ ID NO: 31005 - protein, 16 aa, BK virus
ESVQGQLPKSQRNPCK

SEQ ID NO: 31006 - protein, 16 aa, BK virus
SVQGQLPKSQRNPCKC

SEQ ID NO: 31007 - protein, 16 aa, BK virus
VQGQLPKSQRNPCKCQ

SEQ ID NO: 31008 - protein, 16 aa, BK virus
QGQLPKSQRNPCKCQN

SEQ ID NO: 31009 - protein, 16 aa, BK virus
GQLPKSQRNPCKCQNY

SEQ ID NO: 31010 - protein, 16 aa, BK virus
VLKMTLAVIAQREKCF

SEQ ID NO: 31011 - protein, 16 aa, BK virus
LKMTLAVIAQREKCFP

SEQ ID NO: 31012 - protein, 16 aa, BK virus
KMTLAVIAQREKCFPV

SEQ ID NO: 31013 - protein, 16 aa, BK virus
MTLAVIAQREKCFPVT

SEQ ID NO: 31014 - protein, 16 aa, BK virus
TLAVIAQREKCFPVTA

SEQ ID NO: 31015 - protein, 16 aa, BK virus
LAVIAQREKCFPVTAQ

SEQ ID NO: 31016 - protein, 16 aa, BK virus
AVIAQREKCFPVTAQQ

SEQ ID NO: 31017 - protein, 16 aa, BK virus
VIAQREKCFPVTAQQE

SEQ ID NO: 31018 - protein, 16 aa, BK virus
IAQREKCFPVTAQQEF

SEQ ID NO: 31019 - protein, 16 aa, BK virus
AQREKCFPVTAQQEFP

SEQ ID NO: 31020 - protein, 16 aa, BK virus
QREKCFPVTAQQEFPS

SEQ ID NO: 31021 - protein, 16 aa, BK virus
REKCFPVTAQQEFPSP

SEQ ID NO: 31022 - protein, 16 aa, BK virus
EKCFPVTAQQEFPSPI

SEQ ID NO: 31023 - protein, 16 aa, BK virus
LACLTFMQGHKKCMSM

SEQ ID NO: 31024 - protein, 16 aa, BK virus
ACLTFMQGHKKCMSMV

SEQ ID NO: 31025 - protein, 16 aa, BK virus
CLTFMQGHKKCMSMVE

SEQ ID NO: 31026 - protein, 16 aa, BK virus
LTFMQGHKKCMSMVEE

SEQ ID NO: 31027 - protein, 16 aa, BK virus
TFMQGHKKCMSMVEEN

SEQ ID NO: 31028 - protein, 16 aa, BK virus
FMQGHKKCMSMVEENL

SEQ ID NO: 31029 - protein, 16 aa, BK virus
MQGHKKCMSMVEENLF

SEQ ID NO: 31030 - protein, 16 aa, BK virus
QGHKKCMSMVEENLFK

SEQ ID NO: 31031 - protein, 16 aa, BK virus
GHKKCMSMVEENLFKA

SEQ ID NO: 31032 - protein, 16 aa, BK virus
HKKCMSMVEENLFKAV

SEQ ID NO: 31033 - protein, 16 aa, BK virus
KKCMSMVEENLFKAVI

SEQ ID NO: 31034 - protein, 16 aa, BK virus
KCMSMVEENLFKAVIS

SEQ ID NO: 31035 - protein, 16 aa, BK virus
CMSMVEENLFKAVIST

SEQ ID NO: 31036 - protein, 16 aa, BK virus
MSMVEENLFKAVISTS

SEQ ID NO: 31037 - protein, 16 aa, BK virus
SMVEENLFKAVISTSL

SEQ ID NO: 31038 - protein, 16 aa, BK virus
MVEENLFKAVISTSLL

SEQ ID NO: 31039 - protein, 16 aa, BK virus
ILTIRPIWTKTMLIQL

SEQ ID NO: 31040 - protein, 16 aa, BK virus
LTIRPIWTKTMLIQLS

SEQ ID NO: 31041 - protein, 16 aa, BK virus
TIRPIWTKTMLIQLSA

SEQ ID NO: 31042 - protein, 16 aa, BK virus
IRPIWTKTMLIQLSAG

SEQ ID NO: 31043 - protein, 16 aa, BK virus
RPIWTKTMLIQLSAGY

SEQ ID NO: 31044 - protein, 16 aa, BK virus
PIWTKTMLIQLSAGYL

SEQ ID NO: 31045 - protein, 16 aa, BK virus
IWTKTMLIQLSAGYLI

SEQ ID NO: 31046 - protein, 16 aa, BK virus
WTKTMLIQLSAGYLIP

SEQ ID NO: 31047 - protein, 16 aa, BK virus
TKTMLIQLSAGYLIPV

SEQ ID NO: 31048 - protein, 16 aa, BK virus
KTMLIQLSAGYLIPVE

SEQ ID NO: 31049 - protein, 16 aa, BK virus
TMLIQLSAGYLIPVEM

SEQ ID NO: 31050 - protein, 16 aa, BK virus
MLIQLSAGYLIPVEMK

SEQ ID NO: 31051 - protein, 16 aa, BK virus
LIQLSAGYLIPVEMKM

SEQ ID NO: 31052 - protein, 16 aa, BK virus
IQLSAGYLIPVEMKML

SEQ ID NO: 31053 - protein, 16 aa, BK virus
QLSAGYLIPVEMKMLG

SEQ ID NO: 31054 - protein, 16 aa, BK virus
LSAGYLIPVEMKMLGI

SEQ ID NO: 31055 - protein, 16 aa, BK virus
SAGYLIPVEMKMLGIL

SEQ ID NO: 31056 - protein, 16 aa, BK virus
AGYLIPVEMKMLGILG

SEQ ID NO: 31057 - protein, 16 aa, BK virus
GYLIPVEMKMLGILGL

SEQ ID NO: 31058 - protein, 16 aa, BK virus
YLIPVEMKMLGILGLS

SEQ ID NO: 31059 - protein, 16 aa, BK virus
LIPVEMKMLGILGLSQ

SEQ ID NO: 31060 - protein, 16 aa, BK virus
IPVEMKMLGILGLSQE

SEQ ID NO: 31061 - protein, 16 aa, BK virus
PVEMKMLGILGLSQEG

SEQ ID NO: 31062 - protein, 16 aa, BK virus
VEMKMLGILGLSQEGK

SEQ ID NO: 31063 - protein, 16 aa, BK virus
EMKMLGILGLSQEGKM

SEQ ID NO: 31064 - protein, 16 aa, BK virus
MKMLGILGLSQEGKMF

SEQ ID NO: 31065 - protein, 16 aa, BK virus
KMLGILGLSQEGKMFP

SEQ ID NO: 31066 - protein, 16 aa, BK virus
MLGILGLSQEGKMFPQ

SEQ ID NO: 31067 - protein, 16 aa, BK virus
LGILGLSQEGKMFPQY

SEQ ID NO: 31068 - protein, 16 aa, BK virus
GILGLSQEGKMFPQYF

SEQ ID NO: 31069 - protein, 16 aa, BK virus
ILGLSQEGKMFPQYFM

SEQ ID NO: 31070 - protein, 16 aa, BK virus
MNRVWGLFVKLIACMF

SEQ ID NO: 31071 - protein, 16 aa, BK virus
NRVWGLFVKLIACMFQ

SEQ ID NO: 31072 - protein, 16 aa, BK virus
RVWGLFVKLIACMFQL

SEQ ID NO: 31073 - protein, 16 aa, BK virus
VWGLFVKLIACMFQLL

SEQ ID NO: 31074 - protein, 16 aa, BK virus
WGLFVKLIACMFQLLI

SEQ ID NO: 31075 - protein, 16 aa, BK virus
GLFVKLIACMFQLLIF

SEQ ID NO: 31076 - protein, 16 aa, BK virus
LFVKLIACMFQLLIFV

SEQ ID NO: 31077 - protein, 16 aa, BK virus
FVKLIACMFQLLIFVA

SEQ ID NO: 31078 - protein, 16 aa, BK virus
VKLIACMFQLLIFVAC

SEQ ID NO: 31079 - protein, 16 aa, BK virus
KLIACMFQLLIFVACL

SEQ ID NO: 31080 - protein, 16 aa, BK virus
LIACMFQLLIFVACLL

SEQ ID NO: 31081 - protein, 16 aa, BK virus
IACMFQLLIFVACLLT

SEQ ID NO: 31082 - protein, 16 aa, BK virus
ACMFQLLIFVACLLTA

SEQ ID NO: 31083 - protein, 16 aa, BK virus
CMFQLLIFVACLLTAL

SEQ ID NO: 31084 - protein, 16 aa, BK virus
MFQLLIFVACLLTALE

SEQ ID NO: 31085 - protein, 16 aa, BK virus
FQLLIFVACLLTALEH

SEQ ID NO: 31086 - protein, 16 aa, BK virus
QLLIFVACLLTALEHN

SEQ ID NO: 31087 - protein, 16 aa, BK virus
LLIFVACLLTALEHNS

SEQ ID NO: 31088 - protein, 16 aa, BK virus
LIFVACLLTALEHNSG

SEQ ID NO: 31089 - protein, 16 aa, BK virus
IFVACLLTALEHNSGE

SEQ ID NO: 31090 - protein, 16 aa, BK virus
FVACLLTALEHNSGEA

SEQ ID NO: 31091 - protein, 16 aa, BK virus
VACLLTALEHNSGEAL

SEQ ID NO: 31092 - protein, 16 aa, BK virus
ACLLTALEHNSGEALQ

SEQ ID NO: 31093 - protein, 16 aa, BK virus
CLLTALEHNSGEALQD

SEQ ID NO: 31094 - protein, 16 aa, BK virus
LLTALEHNSGEALQDI

SEQ ID NO: 31095 - protein, 16 aa, BK virus
LTALEHNSGEALQDIL

SEQ ID NO: 31096 - protein, 16 aa, BK virus
TALEHNSGEALQDILR

SEQ ID NO: 31097 - protein, 16 aa, BK virus
ALEHNSGEALQDILRS

SEQ ID NO: 31098 - protein, 16 aa, BK virus
LEHNSGEALQDILRSA

SEQ ID NO: 31099 - protein, 16 aa, BK virus
TGEPREWMGSLCMVWN

SEQ ID NO: 31100 - protein, 16 aa, BK virus
GEPREWMGSLCMVWNP

SEQ ID NO: 31101 - protein, 16 aa, BK virus
EPREWMGSLCMVWNPR

SEQ ID NO: 31102 - protein, 16 aa, BK virus
KRLGCLMAQKDFQGTQ

SEQ ID NO: 31103 - protein, 16 aa, BK virus
RLGCLMAQKDFQGTQI

SEQ ID NO: 31104 - protein, 16 aa, BK virus
DILTNRDNCKPKCFKQ

SEQ ID NO: 31105 - protein, 16 aa, BK virus
ILTNRDNCKPKCFKQV

SEQ ID NO: 31106 - protein, 16 aa, BK virus
LTNRDNCKPKCFKQVL

SEQ ID NO: 31107 - protein, 16 aa, BK virus
TNRDNCKPKCFKQVLL

SEQ ID NO: 31108 - protein, 16 aa, BK virus
NRDNCKPKCFKQVLLL

SEQ ID NO: 31109 - protein, 16 aa, BK virus
RDNCKPKCFKQVLLLY

SEQ ID NO: 31110 - protein, 16 aa, BK virus
DNCKPKCFKQVLLLYI

SEQ ID NO: 31111 - protein, 16 aa, BK virus
NCKPKCFKQVLLLYIY

SEQ ID NO: 31112 - protein, 16 aa, BK virus
CKPKCFKQVLLLYIYI

SEQ ID NO: 31113 - protein, 16 aa, BK virus
MLLLYKPLLSLCYFGG

SEQ ID NO: 31114 - protein, 16 aa, BK virus
LLLYKPLLSLCYFGGG

SEQ ID NO: 31115 - protein, 16 aa, BK virus
LLYKPLLSLCYFGGGV

SEQ ID NO: 31116 - protein, 16 aa, BK virus
LYKPLLSLCYFGGGVL

SEQ ID NO: 31117 - protein, 16 aa, BK virus
YKPLLSLCYFGGGVLG

SEQ ID NO: 31118 - protein, 16 aa, BK virus
KPLLSLCYFGGGVLGL

SEQ ID NO: 31119 - protein, 16 aa, BK virus
PLLSLCYFGGGVLGLL

SEQ ID NO: 31120 - protein, 16 aa, BK virus
LLSLCYFGGGVLGLLK

SEQ ID NO: 31121 - protein, 16 aa, BK virus
LSLCYFGGGVLGLLKH

SEQ ID NO: 31122 - protein, 16 aa, BK virus
LWGSDLWESSAGAEVS

SEQ ID NO: 31123 - protein, 16 aa, BK virus
WGSDLWESSAGAEVSE

SEQ ID NO: 31124 - protein, 16 aa, BK virus
GSDLWESSAGAEVSET

SEQ ID NO: 31125 - protein, 16 aa, BK virus
SDLWESSAGAEVSETW

SEQ ID NO: 31126 - protein, 16 aa, BK virus
DLWESSAGAEVSETWE

SEQ ID NO: 31127 - protein, 16 aa, BK virus
LWESSAGAEVSETWEE

SEQ ID NO: 31128 - protein, 16 aa, BK virus
WESSAGAEVSETWEEH

SEQ ID NO: 31129 - protein, 16 aa, BK virus
ESSAGAEVSETWEEHC

SEQ ID NO: 31130 - protein, 16 aa, BK virus
SSAGAEVSETWEEHCD

SEQ ID NO: 31131 - protein, 16 aa, BK virus
SAGAEVSETWEEHCDW

SEQ ID NO: 31132 - protein, 16 aa, BK virus
AGAEVSETWEEHCDWD

SEQ ID NO: 31133 - protein, 16 aa, BK virus
GAEVSETWEEHCDWDS

SEQ ID NO: 31134 - protein, 16 aa, BK virus
AEVSETWEEHCDWDSV

SEQ ID NO: 31135 - protein, 16 aa, BK virus
EVSETWEEHCDWDSVL

SEQ ID NO: 31136 - protein, 16 aa, BK virus
VSETWEEHCDWDSVLD

SEQ ID NO: 31137 - protein, 16 aa, BK virus
SETWEEHCDWDSVLDP

SEQ ID NO: 31138 - protein, 16 aa, BK virus
ETWEEHCDWDSVLDPC

SEQ ID NO: 31139 - protein, 16 aa, BK virus
TWEEHCDWDSVLDPCP

SEQ ID NO: 31140 - protein, 16 aa, BK virus
WEEHCDWDSVLDPCPE

SEQ ID NO: 31141 - protein, 16 aa, BK virus
EEHCDWDSVLDPCPES

SEQ ID NO: 31142 - protein, 16 aa, BK virus
EHCDWDSVLDPCPESS

SEQ ID NO: 31143 - protein, 16 aa, BK virus
HCDWDSVLDPCPESSV

SEQ ID NO: 31144 - protein, 16 aa, BK virus
CDWDSVLDPCPESSVS

SEQ ID NO: 31145 - protein, 16 aa, BK virus
DWDSVLDPCPESSVSE

SEQ ID NO: 31146 - protein, 16 aa, BK virus
WDSVLDPCPESSVSES

SEQ ID NO: 31147 - protein, 16 aa, BK virus
DSVLDPCPESSVSESS

SEQ ID NO: 31148 - protein, 16 aa, BK virus
SVLDPCPESSVSESSS

SEQ ID NO: 31149 - protein, 16 aa, BK virus
VLDPCPESSVSESSSL

SEQ ID NO: 31150 - protein, 16 aa, BK virus
LDPCPESSVSESSSLV

SEQ ID NO: 31151 - protein, 16 aa, BK virus
DPCPESSVSESSSLVI

SEQ ID NO: 31152 - protein, 16 aa, BK virus
PCPESSVSESSSLVIS

SEQ ID NO: 31153 - protein, 16 aa, BK virus
CPESSVSESSSLVISR

SEQ ID NO: 31154 - protein, 16 aa, BK virus
PESSVSESSSLVISRI

SEQ ID NO: 31155 - protein, 16 aa, BK virus
ESSVSESSSLVISRIH

SEQ ID NO: 31156 - protein, 16 aa, BK virus
SSVSESSSLVISRIHF

SEQ ID NO: 31157 - protein, 16 aa, BK virus
SVSESSSLVISRIHFP

SEQ ID NO: 31158 - protein, 16 aa, BK virus
VSESSSLVISRIHFPM

SEQ ID NO: 31159 - protein, 16 aa, BK virus
SESSSLVISRIHFPMH

SEQ ID NO: 31160 - protein, 16 aa, BK virus
ESSSLVISRIHFPMHI

SEQ ID NO: 31161 - protein, 16 aa, BK virus
SSSLVISRIHFPMHIL

SEQ ID NO: 31162 - protein, 16 aa, BK virus
SSLVISRIHFPMHILY

SEQ ID NO: 31163 - protein, 16 aa, BK virus
SLVISRIHFPMHILYF

SEQ ID NO: 31164 - protein, 16 aa, BK virus
LVISRIHFPMHILYFI

SEQ ID NO: 31165 - protein, 16 aa, BK virus
VISRIHFPMHILYFIL

SEQ ID NO: 31166 - protein, 16 aa, BK virus
ISRIHFPMHILYFILE

SEQ ID NO: 31167 - protein, 16 aa, BK virus
SRIHFPMHILYFILEK

SEQ ID NO: 31168 - protein, 16 aa, BK virus
RIHFPMHILYFILEKV

SEQ ID NO: 31169 - protein, 16 aa, BK virus
IHFPMHILYFILEKVY

SEQ ID NO: 31170 - protein, 16 aa, BK virus
HFPMHILYFILEKVYI

SEQ ID NO: 31171 - protein, 16 aa, BK virus
FPMHILYFILEKVYIL

SEQ ID NO: 31172 - protein, 16 aa, BK virus
PMHILYFILEKVYILI

SEQ ID NO: 31173 - protein, 16 aa, BK virus
MHILYFILEKVYILIS

SEQ ID NO: 31174 - protein, 16 aa, BK virus
HILYFILEKVYILISE

SEQ ID NO: 31175 - protein, 16 aa, BK virus
ILYFILEKVYILISES

SEQ ID NO: 31176 - protein, 16 aa, BK virus
LYFILEKVYILISESS

SEQ ID NO: 31177 - protein, 16 aa, BK virus
YFILEKVYILISESSL

SEQ ID NO: 31178 - protein, 16 aa, BK virus
FILEKVYILISESSLS

SEQ ID NO: 31179 - protein, 16 aa, BK virus
ILEKVYILISESSLSF

SEQ ID NO: 31180 - protein, 16 aa, BK virus
LEKVYILISESSLSFH

SEQ ID NO: 31181 - protein, 16 aa, BK virus
EKVYILISESSLSFHS

SEQ ID NO: 31182 - protein, 16 aa, BK virus
KVYILISESSLSFHST

SEQ ID NO: 31183 - protein, 16 aa, BK virus
VYILISESSLSFHSTI

SEQ ID NO: 31184 - protein, 16 aa, BK virus
YILISESSLSFHSTIL

SEQ ID NO: 31185 - protein, 16 aa, BK virus
ILISESSLSFHSTILD

SEQ ID NO: 31186 - protein, 16 aa, BK virus
LISESSLSFHSTILDC

SEQ ID NO: 31187 - protein, 16 aa, BK virus
ISESSLSFHSTILDCI

SEQ ID NO: 31188 - protein, 16 aa, BK virus
SESSLSFHSTILDCIS

SEQ ID NO: 31189 - protein, 16 aa, BK virus
ESSLSFHSTILDCISV

SEQ ID NO: 31190 - protein, 16 aa, BK virus
SSLSFHSTILDCISVA

SEQ ID NO: 31191 - protein, 16 aa, BK virus
SLSFHSTILDCISVAK

SEQ ID NO: 31192 - protein, 16 aa, BK virus
LSFHSTILDCISVAKS

SEQ ID NO: 31193 - protein, 16 aa, BK virus
SFHSTILDCISVAKSA

SEQ ID NO: 31194 - protein, 16 aa, BK virus
FHSTILDCISVAKSAT

SEQ ID NO: 31195 - protein, 16 aa, BK virus
HSTILDCISVAKSATG

SEQ ID NO: 31196 - protein, 16 aa, BK virus
STILDCISVAKSATGL

SEQ ID NO: 31197 - protein, 16 aa, BK virus
TILDCISVAKSATGLN

SEQ ID NO: 31198 - protein, 16 aa, BK virus
ILDCISVAKSATGLNQ

SEQ ID NO: 31199 - protein, 16 aa, BK virus
LDCISVAKSATGLNQI

SEQ ID NO: 31200 - protein, 16 aa, BK virus
DCISVAKSATGLNQIS

SEQ ID NO: 31201 - protein, 16 aa, BK virus
CISVAKSATGLNQISS

SEQ ID NO: 31202 - protein, 16 aa, BK virus
ISVAKSATGLNQISSS

SEQ ID NO: 31203 - protein, 16 aa, BK virus
SVAKSATGLNQISSSN

SEQ ID NO: 31204 - protein, 16 aa, BK virus
VAKSATGLNQISSSNK

SEQ ID NO: 31205 - protein, 16 aa, BK virus
AKSATGLNQISSSNKV

SEQ ID NO: 31206 - protein, 16 aa, BK virus
KSATGLNQISSSNKVI

SEQ ID NO: 31207 - protein, 16 aa, BK virus
SATGLNQISSSNKVIP

SEQ ID NO: 31208 - protein, 16 aa, BK virus
ATGLNQISSSNKVIPL

SEQ ID NO: 31209 - protein, 16 aa, BK virus
TGLNQISSSNKVIPLC

SEQ ID NO: 31210 - protein, 16 aa, BK virus
GLNQISSSNKVIPLCK

SEQ ID NO: 31211 - protein, 16 aa, BK virus
LNQISSSNKVIPLCKI

SEQ ID NO: 31212 - protein, 16 aa, BK virus
NQISSSNKVIPLCKIL

SEQ ID NO: 31213 - protein, 16 aa, BK virus
QISSSNKVIPLCKILF

SEQ ID NO: 31214 - protein, 16 aa, BK virus
ISSSNKVIPLCKILFS

SEQ ID NO: 31215 - protein, 16 aa, BK virus
SSSNKVIPLCKILFSS

SEQ ID NO: 31216 - protein, 16 aa, BK virus
SSNKVIPLCKILFSSK

SEQ ID NO: 31217 - protein, 16 aa, BK virus
SNKVIPLCKILFSSKN

SEQ ID NO: 31218 - protein, 16 aa, BK virus
NKVIPLCKILFSSKNS

SEQ ID NO: 31219 - protein, 16 aa, BK virus
KVIPLCKILFSSKNSE

SEQ ID NO: 31220 - protein, 16 aa, BK virus
VIPLCKILFSSKNSEF

SEQ ID NO: 31221 - protein, 16 aa, BK virus
IPLCKILFSSKNSEFC

SEQ ID NO: 31222 - protein, 16 aa, BK virus
PLCKILFSSKNSEFCK

SEQ ID NO: 31223 - protein, 16 aa, BK virus
LCKILFSSKNSEFCKD

SEQ ID NO: 31224 - protein, 16 aa, BK virus
CKILFSSKNSEFCKDF

SEQ ID NO: 31225 - protein, 16 aa, BK virus
KILFSSKNSEFCKDFL

SEQ ID NO: 31226 - protein, 16 aa, BK virus
ILFSSKNSEFCKDFLK

SEQ ID NO: 31227 - protein, 16 aa, BK virus
LFSSKNSEFCKDFLKY

SEQ ID NO: 31228 - protein, 16 aa, BK virus
FSSKNSEFCKDFLKYI

SEQ ID NO: 31229 - protein, 16 aa, BK virus
SSKNSEFCKDFLKYIL

SEQ ID NO: 31230 - protein, 16 aa, BK virus
SKNSEFCKDFLKYILG

SEQ ID NO: 31231 - protein, 16 aa, BK virus
KNSEFCKDFLKYILGL

SEQ ID NO: 31232 - protein, 16 aa, BK virus
NSEFCKDFLKYILGLK

SEQ ID NO: 31233 - protein, 16 aa, BK virus
SEFCKDFLKYILGLKS

SEQ ID NO: 31234 - protein, 16 aa, BK virus
EFCKDFLKYILGLKSI

SEQ ID NO: 31235 - protein, 16 aa, BK virus
FCKDFLKYILGLKSIC

SEQ ID NO: 31236 - protein, 16 aa, BK virus
CKDFLKYILGLKSICL

SEQ ID NO: 31237 - protein, 16 aa, BK virus
KDFLKYILGLKSICLT

SEQ ID NO: 31238 - protein, 16 aa, BK virus
DFLKYILGLKSICLTN

SEQ ID NO: 31239 - protein, 16 aa, BK virus
FLKYILGLKSICLTNL

SEQ ID NO: 31240 - protein, 16 aa, BK virus
LKYILGLKSICLTNLA

SEQ ID NO: 31241 - protein, 16 aa, BK virus
KYILGLKSICLTNLAC

SEQ ID NO: 31242 - protein, 16 aa, BK virus
YILGLKSICLTNLACR

SEQ ID NO: 31243 - protein, 16 aa, BK virus
ILGLKSICLTNLACRV

SEQ ID NO: 31244 - protein, 16 aa, BK virus
LGLKSICLTNLACRVL

SEQ ID NO: 31245 - protein, 16 aa, BK virus
GLKSICLTNLACRVLG

SEQ ID NO: 31246 - protein, 16 aa, BK virus
LKSICLTNLACRVLGT

SEQ ID NO: 31247 - protein, 16 aa, BK virus
KSICLTNLACRVLGTG

SEQ ID NO: 31248 - protein, 16 aa, BK virus
SICLTNLACRVLGTGY

SEQ ID NO: 31249 - protein, 16 aa, BK virus
ICLTNLACRVLGTGYS

SEQ ID NO: 31250 - protein, 16 aa, BK virus
CLTNLACRVLGTGYSF

SEQ ID NO: 31251 - protein, 16 aa, BK virus
LTNLACRVLGTGYSFI

SEQ ID NO: 31252 - protein, 16 aa, BK virus
TNLACRVLGTGYSFIV

SEQ ID NO: 31253 - protein, 16 aa, BK virus
NLACRVLGTGYSFIVT

SEQ ID NO: 31254 - protein, 16 aa, BK virus
LACRVLGTGYSFIVTK

SEQ ID NO: 31255 - protein, 16 aa, BK virus
ACRVLGTGYSFIVTKP

SEQ ID NO: 31256 - protein, 16 aa, BK virus
CRVLGTGYSFIVTKPG

SEQ ID NO: 31257 - protein, 16 aa, BK virus
RVLGTGYSFIVTKPGG

SEQ ID NO: 31258 - protein, 16 aa, BK virus
VLGTGYSFIVTKPGGN

SEQ ID NO: 31259 - protein, 16 aa, BK virus
LGTGYSFIVTKPGGNI

SEQ ID NO: 31260 - protein, 16 aa, BK virus
GTGYSFIVTKPGGNIW

SEQ ID NO: 31261 - protein, 16 aa, BK virus
TGYSFIVTKPGGNIWV

SEQ ID NO: 31262 - protein, 16 aa, BK virus
GYSFIVTKPGGNIWVL

SEQ ID NO: 31263 - protein, 16 aa, BK virus
YSFIVTKPGGNIWVLL

SEQ ID NO: 31264 - protein, 16 aa, BK virus
SFIVTKPGGNIWVLLF

SEQ ID NO: 31265 - protein, 16 aa, BK virus
FIVTKPGGNIWVLLFK

SEQ ID NO: 31266 - protein, 16 aa, BK virus
IVTKPGGNIWVLLFKC

SEQ ID NO: 31267 - protein, 16 aa, BK virus
VTKPGGNIWVLLFKCF

SEQ ID NO: 31268 - protein, 16 aa, BK virus
TKPGGNIWVLLFKCFF

SEQ ID NO: 31269 - protein, 16 aa, BK virus
KPGGNIWVLLFKCFFS

SEQ ID NO: 31270 - protein, 16 aa, BK virus
PGGNIWVLLFKCFFSK

SEQ ID NO: 31271 - protein, 16 aa, BK virus
GGNIWVLLFKCFFSKF

SEQ ID NO: 31272 - protein, 16 aa, BK virus
GNIWVLLFKCFFSKFT

SEQ ID NO: 31273 - protein, 16 aa, BK virus
NIWVLLFKCFFSKFTL

SEQ ID NO: 31274 - protein, 16 aa, BK virus
IWVLLFKCFFSKFTLT

SEQ ID NO: 31275 - protein, 16 aa, BK virus
WVLLFKCFFSKFTLTL

SEQ ID NO: 31276 - protein, 16 aa, BK virus
VLLFKCFFSKFTLTLP

SEQ ID NO: 31277 - protein, 16 aa, BK virus
LLFKCFFSKFTLTLPS

SEQ ID NO: 31278 - protein, 16 aa, BK virus
LFKCFFSKFTLTLPSK

SEQ ID NO: 31279 - protein, 16 aa, BK virus
SLKLSKLFIPCPEGKS

SEQ ID NO: 31280 - protein, 16 aa, BK virus
LKLSKLFIPCPEGKSF

SEQ ID NO: 31281 - protein, 16 aa, BK virus
KLSKLFIPCPEGKSFD

SEQ ID NO: 31282 - protein, 16 aa, BK virus
LSKLFIPCPEGKSFDS

SEQ ID NO: 31283 - protein, 16 aa, BK virus
SKLFIPCPEGKSFDSA

SEQ ID NO: 31284 - protein, 16 aa, BK virus
KLFIPCPEGKSFDSAP

SEQ ID NO: 31285 - protein, 16 aa, BK virus
LFIPCPEGKSFDSAPV

SEQ ID NO: 31286 - protein, 16 aa, BK virus
FIPCPEGKSFDSAPVP

SEQ ID NO: 31287 - protein, 16 aa, BK virus
IPCPEGKSFDSAPVPF

SEQ ID NO: 31288 - protein, 16 aa, BK virus
PCPEGKSFDSAPVPFT

SEQ ID NO: 31289 - protein, 16 aa, BK virus
CPEGKSFDSAPVPFTS

SEQ ID NO: 31290 - protein, 16 aa, BK virus
PEGKSFDSAPVPFTSS

SEQ ID NO: 31291 - protein, 16 aa, BK virus
EGKSFDSAPVPFTSSK

SEQ ID NO: 31292 - protein, 16 aa, BK virus
GKSFDSAPVPFTSSKT

SEQ ID NO: 31293 - protein, 16 aa, BK virus
KSFDSAPVPFTSSKTT

SEQ ID NO: 31294 - protein, 16 aa, BK virus
SFDSAPVPFTSSKTTM

SEQ ID NO: 31295 - protein, 16 aa, BK virus
FDSAPVPFTSSKTTMY

SEQ ID NO: 31296 - protein, 16 aa, BK virus
SIATPSSKVSLSMGRF

SEQ ID NO: 31297 - protein, 16 aa, BK virus
IATPSSKVSLSMGRFT

SEQ ID NO: 31298 - protein, 16 aa, BK virus
ATPSSKVSLSMGRFTF

SEQ ID NO: 31299 - protein, 16 aa, BK virus
TPSSKVSLSMGRFTFK

SEQ ID NO: 31300 - protein, 16 aa, BK virus
PSSKVSLSMGRFTFKA

SEQ ID NO: 31301 - protein, 16 aa, BK virus
SSKVSLSMGRFTFKAL

SEQ ID NO: 31302 - protein, 16 aa, BK virus
SKVSLSMGRFTFKALP

SEQ ID NO: 31303 - protein, 16 aa, BK virus
KVSLSMGRFTFKALPP

SEQ ID NO: 31304 - protein, 16 aa, BK virus
VSLSMGRFTFKALPPH

SEQ ID NO: 31305 - protein, 16 aa, BK virus
SLSMGRFTFKALPPHK

SEQ ID NO: 31306 - protein, 16 aa, BK virus
LSMGRFTFKALPPHKS

SEQ ID NO: 31307 - protein, 16 aa, BK virus
SMGRFTFKALPPHKSN

SEQ ID NO: 31308 - protein, 16 aa, BK virus
MGRFTFKALPPHKSNN

SEQ ID NO: 31309 - protein, 16 aa, BK virus
GRFTFKALPPHKSNNP

SEQ ID NO: 31310 - protein, 16 aa, BK virus
RFTFKALPPHKSNNPA

SEQ ID NO: 31311 - protein, 16 aa, BK virus
FTFKALPPHKSNNPAA

SEQ ID NO: 31312 - protein, 16 aa, BK virus
TFKALPPHKSNNPAAS

SEQ ID NO: 31313 - protein, 16 aa, BK virus
FKALPPHKSNNPAASV

SEQ ID NO: 31314 - protein, 16 aa, BK virus
KALPPHKSNNPAASVV

SEQ ID NO: 31315 - protein, 16 aa, BK virus
ALPPHKSNNPAASVVF

SEQ ID NO: 31316 - protein, 16 aa, BK virus
LPPHKSNNPAASVVFP

SEQ ID NO: 31317 - protein, 16 aa, BK virus
PPHKSNNPAASVVFPL

SEQ ID NO: 31318 - protein, 16 aa, BK virus
PHKSNNPAASVVFPLS

SEQ ID NO: 31319 - protein, 16 aa, BK virus
HKSNNPAASVVFPLSM

SEQ ID NO: 31320 - protein, 16 aa, BK virus
KSNNPAASVVFPLSMG

SEQ ID NO: 31321 - protein, 16 aa, BK virus
SNNPAASVVFPLSMGP

SEQ ID NO: 31322 - protein, 16 aa, BK virus
NNPAASVVFPLSMGPL

SEQ ID NO: 31323 - protein, 16 aa, BK virus
NPAASVVFPLSMGPLN

SEQ ID NO: 31324 - protein, 16 aa, BK virus
PAASVVFPLSMGPLNN

SEQ ID NO: 31325 - protein, 16 aa, BK virus
AASVVFPLSMGPLNNQ

SEQ ID NO: 31326 - protein, 16 aa, BK virus
ASVVFPLSMGPLNNQY

SEQ ID NO: 31327 - protein, 16 aa, BK virus
SVVFPLSMGPLNNQYL

SEQ ID NO: 31328 - protein, 16 aa, BK virus
VVFPLSMGPLNNQYLL

SEQ ID NO: 31329 - protein, 16 aa, BK virus
VFPLSMGPLNNQYLLL

SEQ ID NO: 31330 - protein, 16 aa, BK virus
FPLSMGPLNNQYLLLG

SEQ ID NO: 31331 - protein, 16 aa, BK virus
PLSMGPLNNQYLLLGT

SEQ ID NO: 31332 - protein, 16 aa, BK virus
LSMGPLNNQYLLLGTL

SEQ ID NO: 31333 - protein, 16 aa, BK virus
SMGPLNNQYLLLGTLK

SEQ ID NO: 31334 - protein, 16 aa, BK virus
MGPLNNQYLLLGTLKT

SEQ ID NO: 31335 - protein, 16 aa, BK virus
GPLNNQYLLLGTLKTI

SEQ ID NO: 31336 - protein, 16 aa, BK virus
PLNNQYLLLGTLKTIQ

SEQ ID NO: 31337 - protein, 16 aa, BK virus
LNNQYLLLGTLKTIQC

SEQ ID NO: 31338 - protein, 16 aa, BK virus
NNQYLLLGTLKTIQCK

SEQ ID NO: 31339 - protein, 16 aa, BK virus
NQYLLLGTLKTIQCKK

SEQ ID NO: 31340 - protein, 16 aa, BK virus
QYLLLGTLKTIQCKKS

SEQ ID NO: 31341 - protein, 16 aa, BK virus
YLLLGTLKTIQCKKSN

SEQ ID NO: 31342 - protein, 16 aa, BK virus
LLLGTLKTIQCKKSNI

SEQ ID NO: 31343 - protein, 16 aa, BK virus
LLGTLKTIQCKKSNIT

SEQ ID NO: 31344 - protein, 16 aa, BK virus
LGTLKTIQCKKSNITE

SEQ ID NO: 31345 - protein, 16 aa, BK virus
GTLKTIQCKKSNITES

SEQ ID NO: 31346 - protein, 16 aa, BK virus
TLKTIQCKKSNITESI

SEQ ID NO: 31347 - protein, 16 aa, BK virus
LKTIQCKKSNITESIL

SEQ ID NO: 31348 - protein, 16 aa, BK virus
KTIQCKKSNITESILG

SEQ ID NO: 31349 - protein, 16 aa, BK virus
TIQCKKSNITESILGS

SEQ ID NO: 31350 - protein, 16 aa, BK virus
IQCKKSNITESILGSK

SEQ ID NO: 31351 - protein, 16 aa, BK virus
QCKKSNITESILGSKQ

SEQ ID NO: 31352 - protein, 16 aa, BK virus
CKKSNITESILGSKQC

SEQ ID NO: 31353 - protein, 16 aa, BK virus
KKSNITESILGSKQCS

SEQ ID NO: 31354 - protein, 16 aa, BK virus
KSNITESILGSKQCSQ

SEQ ID NO: 31355 - protein, 16 aa, BK virus
SNITESILGSKQCSQA

SEQ ID NO: 31356 - protein, 16 aa, BK virus
NITESILGSKQCSQAT

SEQ ID NO: 31357 - protein, 16 aa, BK virus
ITESILGSKQCSQATP

SEQ ID NO: 31358 - protein, 16 aa, BK virus
TESILGSKQCSQATPA

SEQ ID NO: 31359 - protein, 16 aa, BK virus
ESILGSKQCSQATPAI

SEQ ID NO: 31360 - protein, 16 aa, BK virus
SILGSKQCSQATPAIY

SEQ ID NO: 31361 - protein, 16 aa, BK virus
ILGSKQCSQATPAIYC

SEQ ID NO: 31362 - protein, 16 aa, BK virus
LGSKQCSQATPAIYCS

SEQ ID NO: 31363 - protein, 16 aa, BK virus
GSKQCSQATPAIYCSS

SEQ ID NO: 31364 - protein, 16 aa, BK virus
SKQCSQATPAIYCSST

SEQ ID NO: 31365 - protein, 16 aa, BK virus
KQCSQATPAIYCSSTA

SEQ ID NO: 31366 - protein, 16 aa, BK virus
QCSQATPAIYCSSTAF

SEQ ID NO: 31367 - protein, 16 aa, BK virus
CSQATPAIYCSSTAFP

SEQ ID NO: 31368 - protein, 16 aa, BK virus
NSKYIPNNKNTSSHFV

SEQ ID NO: 31369 - protein, 16 aa, BK virus
SKYIPNNKNTSSHFVS

SEQ ID NO: 31370 - protein, 16 aa, BK virus
KYIPNNKNTSSHFVST

SEQ ID NO: 31371 - protein, 16 aa, BK virus
YIPNNKNTSSHFVSTA

SEQ ID NO: 31372 - protein, 16 aa, BK virus
IPNNKNTSSHFVSTAY

SEQ ID NO: 31373 - protein, 16 aa, BK virus
PNNKNTSSHFVSTAYS

SEQ ID NO: 31374 - protein, 16 aa, BK virus
NNKNTSSHFVSTAYSV

SEQ ID NO: 31375 - protein, 16 aa, BK virus
NKNTSSHFVSTAYSVI

SEQ ID NO: 31376 - protein, 16 aa, BK virus
KNTSSHFVSTAYSVIN

SEQ ID NO: 31377 - protein, 16 aa, BK virus
NTSSHFVSTAYSVINF

SEQ ID NO: 31378 - protein, 16 aa, BK virus
TSSHFVSTAYSVINFQ

SEQ ID NO: 31379 - protein, 16 aa, BK virus
SSHFVSTAYSVINFQD

SEQ ID NO: 31380 - protein, 16 aa, BK virus
SHFVSTAYSVINFQDT

SEQ ID NO: 31381 - protein, 16 aa, BK virus
HFVSTAYSVINFQDTC

SEQ ID NO: 31382 - protein, 16 aa, BK virus
FVSTAYSVINFQDTCF

SEQ ID NO: 31383 - protein, 16 aa, BK virus
VSTAYSVINFQDTCFV

SEQ ID NO: 31384 - protein, 16 aa, BK virus
STAYSVINFQDTCFVS

SEQ ID NO: 31385 - protein, 16 aa, BK virus
TAYSVINFQDTCFVSS

SEQ ID NO: 31386 - protein, 16 aa, BK virus
AYSVINFQDTCFVSSG

SEQ ID NO: 31387 - protein, 16 aa, BK virus
YSVINFQDTCFVSSGS

SEQ ID NO: 31388 - protein, 16 aa, BK virus
SVINFQDTCFVSSGSS

SEQ ID NO: 31389 - protein, 16 aa, BK virus
VINFQDTCFVSSGSSG

SEQ ID NO: 31390 - protein, 16 aa, BK virus
INFQDTCFVSSGSSGL

SEQ ID NO: 31391 - protein, 16 aa, BK virus
NFQDTCFVSSGSSGLK

SEQ ID NO: 31392 - protein, 16 aa, BK virus
FQDTCFVSSGSSGLKS

SEQ ID NO: 31393 - protein, 16 aa, BK virus
QDTCFVSSGSSGLKSC

SEQ ID NO: 31394 - protein, 16 aa, BK virus
DTCFVSSGSSGLKSCS

SEQ ID NO: 31395 - protein, 16 aa, BK virus
TCFVSSGSSGLKSCSF

SEQ ID NO: 31396 - protein, 16 aa, BK virus
CFVSSGSSGLKSCSFK

SEQ ID NO: 31397 - protein, 16 aa, BK virus
FVSSGSSGLKSCSFKP

SEQ ID NO: 31398 - protein, 16 aa, BK virus
VSSGSSGLKSCSFKPP

SEQ ID NO: 31399 - protein, 16 aa, BK virus
MLSSIVWYGSLVKALY

SEQ ID NO: 31400 - protein, 16 aa, BK virus
LSSIVWYGSLVKALYS

SEQ ID NO: 31401 - protein, 16 aa, BK virus
SSIVWYGSLVKALYSK

SEQ ID NO: 31402 - protein, 16 aa, BK virus
SIVWYGSLVKALYSKY

SEQ ID NO: 31403 - protein, 16 aa, BK virus
IVWYGSLVKALYSKYS

SEQ ID NO: 31404 - protein, 16 aa, BK virus
VWYGSLVKALYSKYSL

SEQ ID NO: 31405 - protein, 16 aa, BK virus
WYGSLVKALYSKYSLL

SEQ ID NO: 31406 - protein, 16 aa, BK virus
YGSLVKALYSKYSLLT

SEQ ID NO: 31407 - protein, 16 aa, BK virus
GSLVKALYSKYSLLTP

SEQ ID NO: 31408 - protein, 16 aa, BK virus
SLVKALYSKYSLLTPL

SEQ ID NO: 31409 - protein, 16 aa, BK virus
LVKALYSKYSLLTPLQ

SEQ ID NO: 31410 - protein, 16 aa, BK virus
VKALYSKYSLLTPLQI

SEQ ID NO: 31411 - protein, 16 aa, BK virus
KALYSKYSLLTPLQIK

SEQ ID NO: 31412 - protein, 16 aa, BK virus
ALYSKYSLLTPLQIKK

SEQ ID NO: 31413 - protein, 16 aa, BK virus
LYSKYSLLTPLQIKKL

SEQ ID NO: 31414 - protein, 16 aa, BK virus
YSKYSLLTPLQIKKLK

SEQ ID NO: 31415 - protein, 16 aa, BK virus
SKYSLLTPLQIKKLKV

SEQ ID NO: 31416 - protein, 16 aa, BK virus
KYSLLTPLQIKKLKVH

SEQ ID NO: 31417 - protein, 16 aa, BK virus
YSLLTPLQIKKLKVHS

SEQ ID NO: 31418 - protein, 16 aa, BK virus
SLLTPLQIKKLKVHSF

SEQ ID NO: 31419 - protein, 16 aa, BK virus
QKLLIAETLCLCGVKK

SEQ ID NO: 31420 - protein, 16 aa, BK virus
KLLIAETLCLCGVKKN

SEQ ID NO: 31421 - protein, 16 aa, BK virus
LLIAETLCLCGVKKNI

SEQ ID NO: 31422 - protein, 16 aa, BK virus
LIAETLCLCGVKKNII

SEQ ID NO: 31423 - protein, 16 aa, BK virus
IAETLCLCGVKKNIIL

SEQ ID NO: 31424 - protein, 16 aa, BK virus
AETLCLCGVKKNIILC

SEQ ID NO: 31425 - protein, 16 aa, BK virus
ETLCLCGVKKNIILCP

SEQ ID NO: 31426 - protein, 16 aa, BK virus
TLCLCGVKKNIILCPA

SEQ ID NO: 31427 - protein, 16 aa, BK virus
LCLCGVKKNIILCPAH

SEQ ID NO: 31428 - protein, 16 aa, BK virus
CLCGVKKNIILCPAHM

SEQ ID NO: 31429 - protein, 16 aa, BK virus
LCGVKKNIILCPAHMC

SEQ ID NO: 31430 - protein, 16 aa, BK virus
CGVKKNIILCPAHMCL

SEQ ID NO: 31431 - protein, 16 aa, BK virus
GVKKNIILCPAHMCLL

SEQ ID NO: 31432 - protein, 16 aa, BK virus
VKKNIILCPAHMCLLI

SEQ ID NO: 31433 - protein, 16 aa, BK virus
KKNIILCPAHMCLLIK

SEQ ID NO: 31434 - protein, 16 aa, BK virus
KNIILCPAHMCLLIKV

SEQ ID NO: 31435 - protein, 16 aa, BK virus
NIILCPAHMCLLIKVT

SEQ ID NO: 31436 - protein, 16 aa, BK virus
IILCPAHMCLLIKVTE

SEQ ID NO: 31437 - protein, 16 aa, BK virus
ILCPAHMCLLIKVTEY

SEQ ID NO: 31438 - protein, 16 aa, BK virus
LCPAHMCLLIKVTEYF

SEQ ID NO: 31439 - protein, 16 aa, BK virus
CPAHMCLLIKVTEYFS

SEQ ID NO: 31440 - protein, 16 aa, BK virus
PAHMCLLIKVTEYFSI

SEQ ID NO: 31441 - protein, 16 aa, BK virus
AHMCLLIKVTEYFSIS

SEQ ID NO: 31442 - protein, 16 aa, BK virus
HMCLLIKVTEYFSISF

SEQ ID NO: 31443 - protein, 16 aa, BK virus
MCLLIKVTEYFSISFL

SEQ ID NO: 31444 - protein, 16 aa, BK virus
CLLIKVTEYFSISFLY

SEQ ID NO: 31445 - protein, 16 aa, BK virus
LLIKVTEYFSISFLYR

SEQ ID NO: 31446 - protein, 16 aa, BK virus
LIKVTEYFSISFLYRI

SEQ ID NO: 31447 - protein, 16 aa, BK virus
AFSLVVYTAKQARVLL

SEQ ID NO: 31448 - protein, 16 aa, BK virus
FSLVVYTAKQARVLLL

SEQ ID NO: 31449 - protein, 16 aa, BK virus
SLVVYTAKQARVLLLN

SEQ ID NO: 31450 - protein, 16 aa, BK virus
LVVYTAKQARVLLLNT

SEQ ID NO: 31451 - protein, 16 aa, BK virus
VVYTAKQARVLLLNTA

SEQ ID NO: 31452 - protein, 16 aa, BK virus
LRNWCRSEGKSLGSST

SEQ ID NO: 31453 - protein, 16 aa, BK virus
RNWCRSEGKSLGSSTF

SEQ ID NO: 31454 - protein, 16 aa, BK virus
NWCRSEGKSLGSSTFL

SEQ ID NO: 31455 - protein, 16 aa, BK virus
WCRSEGKSLGSSTFLF

SEQ ID NO: 31456 - protein, 16 aa, BK virus
CRSEGKSLGSSTFLFF

SEQ ID NO: 31457 - protein, 16 aa, BK virus
RSEGKSLGSSTFLFFL

SEQ ID NO: 31458 - protein, 16 aa, BK virus
SEGKSLGSSTFLFFLG

SEQ ID NO: 31459 - protein, 16 aa, BK virus
EGKSLGSSTFLFFLGG

SEQ ID NO: 31460 - protein, 16 aa, BK virus
GKSLGSSTFLFFLGGV

SEQ ID NO: 31461 - protein, 16 aa, BK virus
KSLGSSTFLFFLGGVE

SEQ ID NO: 31462 - protein, 16 aa, BK virus
SLGSSTFLFFLGGVEC

SEQ ID NO: 31463 - protein, 16 aa, BK virus
ESAVASSSLANISSWQ

SEQ ID NO: 31464 - protein, 16 aa, BK virus
SAVASSSLANISSWQN

SEQ ID NO: 31465 - protein, 16 aa, BK virus
AVASSSLANISSWQNK

SEQ ID NO: 31466 - protein, 16 aa, BK virus
VASSSLANISSWQNKS

SEQ ID NO: 31467 - protein, 16 aa, BK virus
ASSSLANISSWQNKSS

SEQ ID NO: 31468 - protein, 16 aa, BK virus
SSSLANISSWQNKSSS

SEQ ID NO: 31469 - protein, 16 aa, BK virus
SSLANISSWQNKSSSH

SEQ ID NO: 31470 - protein, 16 aa, BK virus
SLANISSWQNKSSSHF

SEQ ID NO: 31471 - protein, 16 aa, BK virus
LANISSWQNKSSSHFS

SEQ ID NO: 31472 - protein, 16 aa, BK virus
ANISSWQNKSSSHFSL

SEQ ID NO: 31473 - protein, 16 aa, BK virus
NISSWQNKSSSHFSLK

SEQ ID NO: 31474 - protein, 16 aa, BK virus
ISSWQNKSSSHFSLKE

SEQ ID NO: 31475 - protein, 16 aa, BK virus
SSWQNKSSSHFSLKEL

SEQ ID NO: 31476 - protein, 16 aa, BK virus
SWQNKSSSHFSLKELH

SEQ ID NO: 31477 - protein, 16 aa, BK virus
WQNKSSSHFSLKELHQ

SEQ ID NO: 31478 - protein, 16 aa, BK virus
QNKSSSHFSLKELHQD

SEQ ID NO: 31479 - protein, 16 aa, BK virus
NKSSSHFSLKELHQDS

SEQ ID NO: 31480 - protein, 16 aa, BK virus
KSSSHFSLKELHQDSH

SEQ ID NO: 31481 - protein, 16 aa, BK virus
SSSHFSLKELHQDSHS

SEQ ID NO: 31482 - protein, 16 aa, BK virus
SSHFSLKELHQDSHSS

SEQ ID NO: 31483 - protein, 16 aa, BK virus
SHFSLKELHQDSHSSV

SEQ ID NO: 31484 - protein, 16 aa, BK virus
HFSLKELHQDSHSSVP

SEQ ID NO: 31485 - protein, 16 aa, BK virus
VGTYKKNNYLGPFNIL

SEQ ID NO: 31486 - protein, 16 aa, BK virus
GTYKKNNYLGPFNILL

SEQ ID NO: 31487 - protein, 16 aa, BK virus
TYKKNNYLGPFNILLF

SEQ ID NO: 31488 - protein, 16 aa, BK virus
YKKNNYLGPFNILLFI

SEQ ID NO: 31489 - protein, 16 aa, BK virus
REFLQLFGPTIAEFLQ

SEQ ID NO: 31490 - protein, 16 aa, BK virus
EFLQLFGPTIAEFLQL

SEQ ID NO: 31491 - protein, 16 aa, BK virus
FLQLFGPTIAEFLQLG

SEQ ID NO: 31492 - protein, 16 aa, BK virus
LQLFGPTIAEFLQLGL

SEQ ID NO: 31493 - protein, 16 aa, BK virus
QLFGPTIAEFLQLGLS

SEQ ID NO: 31494 - protein, 16 aa, BK virus
LFGPTIAEFLQLGLSQ

SEQ ID NO: 31495 - protein, 16 aa, BK virus
FGPTIAEFLQLGLSQT

SEQ ID NO: 31496 - protein, 16 aa, BK virus
GPTIAEFLQLGLSQTT

SEQ ID NO: 31497 - protein, 16 aa, BK virus
PTIAEFLQLGLSQTTV

SEQ ID NO: 31498 - protein, 16 aa, BK virus
SSQCSSNLSKPRALFL

SEQ ID NO: 31499 - protein, 16 aa, BK virus
SQCSSNLSKPRALFLK

SEQ ID NO: 31500 - protein, 16 aa, BK virus
QCSSNLSKPRALFLKI

SEQ ID NO: 31501 - protein, 16 aa, BK virus
CSSNLSKPRALFLKIF

SEQ ID NO: 31502 - protein, 16 aa, BK virus
SSNLSKPRALFLKIFY

SEQ ID NO: 31503 - protein, 16 aa, BK virus
SNLSKPRALFLKIFYL

SEQ ID NO: 31504 - protein, 16 aa, BK virus
NLSKPRALFLKIFYLN

SEQ ID NO: 31505 - protein, 16 aa, BK virus
LSKPRALFLKIFYLNA

SEQ ID NO: 31506 - protein, 16 aa, BK virus
SKPRALFLKIFYLNAL

SEQ ID NO: 31507 - protein, 16 aa, BK virus
KPRALFLKIFYLNALI

SEQ ID NO: 31508 - protein, 16 aa, BK virus
ADIACKGSAQKAFWNK

SEQ ID NO: 31509 - protein, 16 aa, BK virus
AIPCSTGYLGKEENQH

SEQ ID NO: 31510 - protein, 16 aa, BK virus
IPCSTGYLGKEENQHK

SEQ ID NO: 31511 - protein, 16 aa, BK virus
PCSTGYLGKEENQHKP

SEQ ID NO: 31512 - protein, 16 aa, BK virus
CSTGYLGKEENQHKPL

SEQ ID NO: 31513 - protein, 16 aa, BK virus
STGYLGKEENQHKPLS

SEQ ID NO: 31514 - protein, 16 aa, BK virus
TGYLGKEENQHKPLSY

SEQ ID NO: 31515 - protein, 16 aa, BK virus
GYLGKEENQHKPLSYS

SEQ ID NO: 31516 - protein, 16 aa, BK virus
YLGKEENQHKPLSYSR

SEQ ID NO: 31517 - protein, 16 aa, BK virus
LGKEENQHKPLSYSRF

SEQ ID NO: 31518 - protein, 16 aa, BK virus
GKEENQHKPLSYSRFQ

SEQ ID NO: 31519 - protein, 16 aa, BK virus
KEENQHKPLSYSRFQN

SEQ ID NO: 31520 - protein, 16 aa, BK virus
EENQHKPLSYSRFQNQ

SEQ ID NO: 31521 - protein, 16 aa, BK virus
ENQHKPLSYSRFQNQA

SEQ ID NO: 31522 - protein, 16 aa, BK virus
NQHKPLSYSRFQNQAD

SEQ ID NO: 31523 - protein, 16 aa, BK virus
QHKPLSYSRFQNQADE

SEQ ID NO: 31524 - protein, 16 aa, BK virus
HKPLSYSRFQNQADEL

SEQ ID NO: 31525 - protein, 16 aa, BK virus
KPLSYSRFQNQADELP

SEQ ID NO: 31526 - protein, 16 aa, BK virus
PLSYSRFQNQADELPL

SEQ ID NO: 31527 - protein, 16 aa, BK virus
LSYSRFQNQADELPLH

SEQ ID NO: 31528 - protein, 16 aa, BK virus
SYSRFQNQADELPLHP

SEQ ID NO: 31529 - protein, 16 aa, BK virus
YSRFQNQADELPLHPA

SEQ ID NO: 31530 - protein, 16 aa, BK virus
SRFQNQADELPLHPAP

SEQ ID NO: 31531 - protein, 16 aa, BK virus
RFQNQADELPLHPAPF

SEQ ID NO: 31532 - protein, 16 aa, BK virus
FQNQADELPLHPAPFF

SEQ ID NO: 31533 - protein, 16 aa, BK virus
QNQADELPLHPAPFFY

SEQ ID NO: 31534 - protein, 16 aa, BK virus
NQADELPLHPAPFFYT

SEQ ID NO: 31535 - protein, 16 aa, BK virus
QADELPLHPAPFFYTK

SEQ ID NO: 31536 - protein, 16 aa, BK virus
ADELPLHPAPFFYTKY

SEQ ID NO: 31537 - protein, 16 aa, BK virus
DELPLHPAPFFYTKYS

SEQ ID NO: 31538 - protein, 16 aa, BK virus
ELPLHPAPFFYTKYSF

SEQ ID NO: 31539 - protein, 16 aa, BK virus
LPLHPAPFFYTKYSFS

SEQ ID NO: 31540 - protein, 16 aa, BK virus
PLHPAPFFYTKYSFSS

SEQ ID NO: 31541 - protein, 16 aa, BK virus
LHPAPFFYTKYSFSSF

SEQ ID NO: 31542 - protein, 16 aa, BK virus
HPAPFFYTKYSFSSFY

SEQ ID NO: 31543 - protein, 16 aa, BK virus
PAPFFYTKYSFSSFYP

SEQ ID NO: 31544 - protein, 16 aa, BK virus
APFFYTKYSFSSFYPR

SEQ ID NO: 31545 - protein, 16 aa, BK virus
PFFYTKYSFSSFYPRR

SEQ ID NO: 31546 - protein, 16 aa, BK virus
FFYTKYSFSSFYPRRP

SEQ ID NO: 31547 - protein, 16 aa, BK virus
FYTKYSFSSFYPRRPL

SEQ ID NO: 31548 - protein, 16 aa, BK virus
YTKYSFSSFYPRRPLC

SEQ ID NO: 31549 - protein, 16 aa, BK virus
TKYSFSSFYPRRPLCQ

SEQ ID NO: 31550 - protein, 16 aa, BK virus
KYSFSSFYPRRPLCQG

SEQ ID NO: 31551 - protein, 16 aa, BK virus
YSFSSFYPRRPLCQGE

SEQ ID NO: 31552 - protein, 16 aa, BK virus
SFSSFYPRRPLCQGEI

SEQ ID NO: 31553 - protein, 16 aa, BK virus
FSSFYPRRPLCQGEIP

SEQ ID NO: 31554 - protein, 16 aa, BK virus
SSFYPRRPLCQGEIPY

SEQ ID NO: 31555 - protein, 16 aa, BK virus
SFYPRRPLCQGEIPYT

SEQ ID NO: 31556 - protein, 16 aa, BK virus
FYPRRPLCQGEIPYTS

SEQ ID NO: 31557 - protein, 16 aa, BK virus
YPRRPLCQGEIPYTSL

SEQ ID NO: 31558 - protein, 16 aa, BK virus
PRRPLCQGEIPYTSLN

SEQ ID NO: 31559 - protein, 16 aa, BK virus
RRPLCQGEIPYTSLNK

SEQ ID NO: 31560 - protein, 16 aa, BK virus
RPLCQGEIPYTSLNKL

SEQ ID NO: 31561 - protein, 16 aa, BK virus
PLCQGEIPYTSLNKLF

SEQ ID NO: 31562 - protein, 16 aa, BK virus
LCQGEIPYTSLNKLFS

SEQ ID NO: 31563 - protein, 16 aa, BK virus
CQGEIPYTSLNKLFSL

SEQ ID NO: 31564 - protein, 16 aa, BK virus
QGEIPYTSLNKLFSLR

SEQ ID NO: 31565 - protein, 16 aa, BK virus
GEIPYTSLNKLFSLRE

SEQ ID NO: 31566 - protein, 16 aa, BK virus
EIPYTSLNKLFSLRED

SEQ ID NO: 31567 - protein, 16 aa, BK virus
IPYTSLNKLFSLREDF

SEQ ID NO: 31568 - protein, 16 aa, BK virus
PYTSLNKLFSLREDFP

SEQ ID NO: 31569 - protein, 16 aa, BK virus
YTSLNKLFSLREDFPR

SEQ ID NO: 31570 - protein, 16 aa, BK virus
TSLNKLFSLREDFPRQ

SEQ ID NO: 31571 - protein, 16 aa, BK virus
SLNKLFSLREDFPRQL

SEQ ID NO: 31572 - protein, 16 aa, BK virus
LNKLFSLREDFPRQLF

SEQ ID NO: 31573 - protein, 16 aa, BK virus
NKLFSLREDFPRQLFQ

SEQ ID NO: 31574 - protein, 16 aa, BK virus
KLFSLREDFPRQLFQG

SEQ ID NO: 31575 - protein, 16 aa, BK virus
LFSLREDFPRQLFQGL

SEQ ID NO: 31576 - protein, 16 aa, BK virus
FSLREDFPRQLFQGLK

SEQ ID NO: 31577 - protein, 16 aa, BK virus
SLREDFPRQLFQGLKG

SEQ ID NO: 31578 - protein, 16 aa, BK virus
LREDFPRQLFQGLKGP

SEQ ID NO: 31579 - protein, 13 aa, BK virus
ASEKASTPLLLER

SEQ ID NO: 31580 - protein, 13 aa, BK virus
SEKASTPLLLERK

SEQ ID NO: 31581 - protein, 13 aa, BK virus
EKASTPLLLERKG

SEQ ID NO: 31582 - protein, 13 aa, BK virus
KASTPLLLERKGG

SEQ ID NO: 31583 - protein, 13 aa, BK virus
ASTPLLLERKGGG

SEQ ID NO: 31584 - protein, 13 aa, BK virus
STPLLLERKGGGR

SEQ ID NO: 31585 - protein, 13 aa, BK virus
TPLLLERKGGGRG

SEQ ID NO: 31586 - protein, 13 aa, BK virus
PLLLERKGGGRGG

SEQ ID NO: 31587 - protein, 13 aa, BK virus
LLLERKGGGRGGL

SEQ ID NO: 31588 - protein, 13 aa, BK virus
LLERKGGGRGGLG

SEQ ID NO: 31589 - protein, 13 aa, BK virus
LERKGGGRGGLGL

SEQ ID NO: 31590 - protein, 13 aa, BK virus
ERKGGGRGGLGLL

SEQ ID NO: 31591 - protein, 13 aa, BK virus
RKGGGRGGLGLLY

SEQ ID NO: 31592 - protein, 13 aa, BK virus
KGGGRGGLGLLYI

SEQ ID NO: 31593 - protein, 13 aa, BK virus
GGGRGGLGLLYII

SEQ ID NO: 31594 - protein, 13 aa, BK virus
GGRGGLGLLYIIK

SEQ ID NO: 31595 - protein, 13 aa, BK virus
GRGGLGLLYIIKK

SEQ ID NO: 31596 - protein, 13 aa, BK virus
RGGLGLLYIIKKK

SEQ ID NO: 31597 - protein, 13 aa, BK virus
GGLGLLYIIKKKA

SEQ ID NO: 31598 - protein, 13 aa, BK virus
GLGLLYIIKKKAT

SEQ ID NO: 31599 - protein, 13 aa, BK virus
LGLLYIIKKKATG

SEQ ID NO: 31600 - protein, 13 aa, BK virus
GLLYIIKKKATGR

SEQ ID NO: 31601 - protein, 13 aa, BK virus
LLYIIKKKATGRS

SEQ ID NO: 31602 - protein, 13 aa, BK virus
LYIIKKKATGRSC

SEQ ID NO: 31603 - protein, 13 aa, BK virus
YIIKKKATGRSCL

SEQ ID NO: 31604 - protein, 13 aa, BK virus
IIKKKATGRSCLP

SEQ ID NO: 31605 - protein, 13 aa, BK virus
IKKKATGRSCLPM

SEQ ID NO: 31606 - protein, 13 aa, BK virus
KKKATGRSCLPME

SEQ ID NO: 31607 - protein, 13 aa, BK virus
KKATGRSCLPMEC

SEQ ID NO: 31608 - protein, 13 aa, BK virus
KATGRSCLPMECS

SEQ ID NO: 31609 - protein, 13 aa, BK virus
ATGRSCLPMECSQ

SEQ ID NO: 31610 - protein, 13 aa, BK virus
TGRSCLPMECSQT

SEQ ID NO: 31611 - protein, 13 aa, BK virus
GRSCLPMECSQTM

SEQ ID NO: 31612 - protein, 13 aa, BK virus
RSCLPMECSQTMT

SEQ ID NO: 31613 - protein, 13 aa, BK virus
SCLPMECSQTMTS

SEQ ID NO: 31614 - protein, 13 aa, BK virus
CLPMECSQTMTSG

SEQ ID NO: 31615 - protein, 13 aa, BK virus
LPMECSQTMTSGR

SEQ ID NO: 31616 - protein, 13 aa, BK virus
PMECSQTMTSGRK

SEQ ID NO: 31617 - protein, 13 aa, BK virus
MECSQTMTSGRKV

SEQ ID NO: 31618 - protein, 13 aa, BK virus
ECSQTMTSGRKVH

SEQ ID NO: 31619 - protein, 13 aa, BK virus
CSQTMTSGRKVHD

SEQ ID NO: 31620 - protein, 13 aa, BK virus
SQTMTSGRKVHDS

SEQ ID NO: 31621 - protein, 13 aa, BK virus
QTMTSGRKVHDSQ

SEQ ID NO: 31622 - protein, 13 aa, BK virus
TMTSGRKVHDSQG

SEQ ID NO: 31623 - protein, 13 aa, BK virus
MTSGRKVHDSQGN

SEQ ID NO: 31624 - protein, 13 aa, BK virus
TSGRKVHDSQGNA

SEQ ID NO: 31625 - protein, 13 aa, BK virus
SGRKVHDSQGNAA

SEQ ID NO: 31626 - protein, 13 aa, BK virus
GRKVHDSQGNAAK

SEQ ID NO: 31627 - protein, 13 aa, BK virus
RKVHDSQGNAAKP

SEQ ID NO: 31628 - protein, 13 aa, BK virus
PQEGKCMTHREEL

SEQ ID NO: 31629 - protein, 13 aa, BK virus
QEGKCMTHREELL

SEQ ID NO: 31630 - protein, 13 aa, BK virus
EGKCMTHREELLT

SEQ ID NO: 31631 - protein, 13 aa, BK virus
GKCMTHREELLTH

SEQ ID NO: 31632 - protein, 13 aa, BK virus
KCMTHREELLTHG

SEQ ID NO: 31633 - protein, 13 aa, BK virus
CMTHREELLTHGM

SEQ ID NO: 31634 - protein, 13 aa, BK virus
MTHREELLTHGMQ

SEQ ID NO: 31635 - protein, 13 aa, BK virus
THREELLTHGMQP

SEQ ID NO: 31636 - protein, 13 aa, BK virus
HREELLTHGMQPN

SEQ ID NO: 31637 - protein, 13 aa, BK virus
REELLTHGMQPNH

SEQ ID NO: 31638 - protein, 13 aa, BK virus
EELLTHGMQPNHD

SEQ ID NO: 31639 - protein, 13 aa, BK virus
ELLTHGMQPNHDL

SEQ ID NO: 31640 - protein, 13 aa, BK virus
LLTHGMQPNHDLR

SEQ ID NO: 31641 - protein, 13 aa, BK virus
LTHGMQPNHDLRK

SEQ ID NO: 31642 - protein, 13 aa, BK virus
THGMQPNHDLRKE

SEQ ID NO: 31643 - protein, 13 aa, BK virus
HGMQPNHDLRKES

SEQ ID NO: 31644 - protein, 13 aa, BK virus
GMQPNHDLRKESA

SEQ ID NO: 31645 - protein, 13 aa, BK virus
QTCFASLGILALS

SEQ ID NO: 31646 - protein, 13 aa, BK virus
TCFASLGILALSP

SEQ ID NO: 31647 - protein, 13 aa, BK virus
CFASLGILALSPV

SEQ ID NO: 31648 - protein, 13 aa, BK virus
FASLGILALSPVK

SEQ ID NO: 31649 - protein, 13 aa, BK virus
ASLGILALSPVKL

SEQ ID NO: 31650 - protein, 13 aa, BK virus
SLGILALSPVKLD

SEQ ID NO: 31651 - protein, 13 aa, BK virus
LGILALSPVKLDK

SEQ ID NO: 31652 - protein, 13 aa, BK virus
GILALSPVKLDKG

SEQ ID NO: 31653 - protein, 13 aa, BK virus
ILALSPVKLDKGH

SEQ ID NO: 31654 - protein, 13 aa, BK virus
LALSPVKLDKGHG

SEQ ID NO: 31655 - protein, 13 aa, BK virus
ALSPVKLDKGHGS

SEQ ID NO: 31656 - protein, 13 aa, BK virus
LSPVKLDKGHGSA

SEQ ID NO: 31657 - protein, 13 aa, BK virus
SPVKLDKGHGSAP

SEQ ID NO: 31658 - protein, 13 aa, BK virus
PVKLDKGHGSAPA

SEQ ID NO: 31659 - protein, 13 aa, BK virus
VKLDKGHGSAPAV

SEQ ID NO: 31660 - protein, 13 aa, BK virus
KLDKGHGSAPAVT

SEQ ID NO: 31661 - protein, 13 aa, BK virus
LDKGHGSAPAVTT

SEQ ID NO: 31662 - protein, 13 aa, BK virus
DKGHGSAPAVTTS

SEQ ID NO: 31663 - protein, 13 aa, BK virus
KGHGSAPAVTTSF

SEQ ID NO: 31664 - protein, 13 aa, BK virus
GHGSAPAVTTSFS

SEQ ID NO: 31665 - protein, 13 aa, BK virus
HGSAPAVTTSFSE

SEQ ID NO: 31666 - protein, 13 aa, BK virus
GSAPAVTTSFSES

SEQ ID NO: 31667 - protein, 13 aa, BK virus
SAPAVTTSFSESW

SEQ ID NO: 31668 - protein, 13 aa, BK virus
NLDWNKKKSSEDF

SEQ ID NO: 31669 - protein, 13 aa, BK virus
LDWNKKKSSEDFY

SEQ ID NO: 31670 - protein, 13 aa, BK virus
DWNKKKSSEDFYF

SEQ ID NO: 31671 - protein, 13 aa, BK virus
WNKKKSSEDFYFY

SEQ ID NO: 31672 - protein, 13 aa, BK virus
NKKKSSEDFYFYF

SEQ ID NO: 31673 - protein, 13 aa, BK virus
KKKSSEDFYFYFR

SEQ ID NO: 31674 - protein, 13 aa, BK virus
KKSSEDFYFYFRA

SEQ ID NO: 31675 - protein, 13 aa, BK virus
KSSEDFYFYFRAF

SEQ ID NO: 31676 - protein, 13 aa, BK virus
SSEDFYFYFRAFA

SEQ ID NO: 31677 - protein, 13 aa, BK virus
SEDFYFYFRAFAG

SEQ ID NO: 31678 - protein, 13 aa, BK virus
EDFYFYFRAFAGI

SEQ ID NO: 31679 - protein, 13 aa, BK virus
DFYFYFRAFAGIL

SEQ ID NO: 31680 - protein, 13 aa, BK virus
RQCRREKQKYHCF

SEQ ID NO: 31681 - protein, 13 aa, BK virus
QCRREKQKYHCFT

SEQ ID NO: 31682 - protein, 13 aa, BK virus
CRREKQKYHCFTC

SEQ ID NO: 31683 - protein, 13 aa, BK virus
RREKQKYHCFTCC

SEQ ID NO: 31684 - protein, 13 aa, BK virus
REKQKYHCFTCCK

SEQ ID NO: 31685 - protein, 13 aa, BK virus
EKQKYHCFTCCKR

SEQ ID NO: 31686 - protein, 13 aa, BK virus
KQKYHCFTCCKRL

SEQ ID NO: 31687 - protein, 13 aa, BK virus
QKYHCFTCCKRLC

SEQ ID NO: 31688 - protein, 13 aa, BK virus
KYHCFTCCKRLCK

SEQ ID NO: 31689 - protein, 13 aa, BK virus
YHCFTCCKRLCKR

SEQ ID NO: 31690 - protein, 13 aa, BK virus
HCFTCCKRLCKRL

SEQ ID NO: 31691 - protein, 13 aa, BK virus
CFTCCKRLCKRLL

SEQ ID NO: 31692 - protein, 13 aa, BK virus
FTCCKRLCKRLLG

SEQ ID NO: 31693 - protein, 13 aa, BK virus
TCCKRLCKRLLGK

SEQ ID NO: 31694 - protein, 13 aa, BK virus
SLFFCISRFMGAA

SEQ ID NO: 31695 - protein, 13 aa, BK virus
LFFCISRFMGAAL

SEQ ID NO: 31696 - protein, 13 aa, BK virus
FFCISRFMGAALA

SEQ ID NO: 31697 - protein, 13 aa, BK virus
FCISRFMGAALAL

SEQ ID NO: 31698 - protein, 13 aa, BK virus
CISRFMGAALALL

SEQ ID NO: 31699 - protein, 13 aa, BK virus
ISRFMGAALALLG

SEQ ID NO: 31700 - protein, 13 aa, BK virus
SRFMGAALALLGD

SEQ ID NO: 31701 - protein, 13 aa, BK virus
RFMGAALALLGDL

SEQ ID NO: 31702 - protein, 13 aa, BK virus
FMGAALALLGDLV

SEQ ID NO: 31703 - protein, 13 aa, BK virus
MGAALALLGDLVA

SEQ ID NO: 31704 - protein, 13 aa, BK virus
GAALALLGDLVAS

SEQ ID NO: 31705 - protein, 13 aa, BK virus
AALALLGDLVASV

SEQ ID NO: 31706 - protein, 13 aa, BK virus
ALALLGDLVASVS

SEQ ID NO: 31707 - protein, 13 aa, BK virus
LALLGDLVASVSE

SEQ ID NO: 31708 - protein, 13 aa, BK virus
ALLGDLVASVSEA

SEQ ID NO: 31709 - protein, 13 aa, BK virus
LLGDLVASVSEAA

SEQ ID NO: 31710 - protein, 13 aa, BK virus
LGDLVASVSEAAA

SEQ ID NO: 31711 - protein, 13 aa, BK virus
GDLVASVSEAAAA

SEQ ID NO: 31712 - protein, 13 aa, BK virus
DLVASVSEAAAAT

SEQ ID NO: 31713 - protein, 13 aa, BK virus
LVASVSEAAAATG

SEQ ID NO: 31714 - protein, 13 aa, BK virus
VASVSEAAAATGF

SEQ ID NO: 31715 - protein, 13 aa, BK virus
ASVSEAAAATGFS

SEQ ID NO: 31716 - protein, 13 aa, BK virus
SVSEAAAATGFSV

SEQ ID NO: 31717 - protein, 13 aa, BK virus
VSEAAAATGFSVA

SEQ ID NO: 31718 - protein, 13 aa, BK virus
SEAAAATGFSVAE

SEQ ID NO: 31719 - protein, 13 aa, BK virus
EAAAATGFSVAEI

SEQ ID NO: 31720 - protein, 13 aa, BK virus
AAAATGFSVAEIA

SEQ ID NO: 31721 - protein, 13 aa, BK virus
AAATGFSVAEIAA

SEQ ID NO: 31722 - protein, 13 aa, BK virus
AATGFSVAEIAAG

SEQ ID NO: 31723 - protein, 13 aa, BK virus
ATGFSVAEIAAGE

SEQ ID NO: 31724 - protein, 13 aa, BK virus
TGFSVAEIAAGEA

SEQ ID NO: 31725 - protein, 13 aa, BK virus
GFSVAEIAAGEAA

SEQ ID NO: 31726 - protein, 13 aa, BK virus
FSVAEIAAGEAAA

SEQ ID NO: 31727 - protein, 13 aa, BK virus
SVAEIAAGEAAAA

SEQ ID NO: 31728 - protein, 13 aa, BK virus
VAEIAAGEAAAAI

SEQ ID NO: 31729 - protein, 13 aa, BK virus
AEIAAGEAAAAIE

SEQ ID NO: 31730 - protein, 13 aa, BK virus
EIAAGEAAAAIEV

SEQ ID NO: 31731 - protein, 13 aa, BK virus
IAAGEAAAAIEVQ

SEQ ID NO: 31732 - protein, 13 aa, BK virus
AAGEAAAAIEVQI

SEQ ID NO: 31733 - protein, 13 aa, BK virus
AGEAAAAIEVQIA

SEQ ID NO: 31734 - protein, 13 aa, BK virus
GEAAAAIEVQIAS

SEQ ID NO: 31735 - protein, 13 aa, BK virus
EAAAAIEVQIASL

SEQ ID NO: 31736 - protein, 13 aa, BK virus
AAAAIEVQIASLA

SEQ ID NO: 31737 - protein, 13 aa, BK virus
AAAIEVQIASLAT

SEQ ID NO: 31738 - protein, 13 aa, BK virus
AAIEVQIASLATV

SEQ ID NO: 31739 - protein, 13 aa, BK virus
AIEVQIASLATVE

SEQ ID NO: 31740 - protein, 13 aa, BK virus
IEVQIASLATVEG

SEQ ID NO: 31741 - protein, 13 aa, BK virus
EVQIASLATVEGI

SEQ ID NO: 31742 - protein, 13 aa, BK virus
VQIASLATVEGIT

SEQ ID NO: 31743 - protein, 13 aa, BK virus
QIASLATVEGITS

SEQ ID NO: 31744 - protein, 13 aa, BK virus
IASLATVEGITST

SEQ ID NO: 31745 - protein, 13 aa, BK virus
ASLATVEGITSTS

SEQ ID NO: 31746 - protein, 13 aa, BK virus
SLATVEGITSTSE

SEQ ID NO: 31747 - protein, 13 aa, BK virus
LATVEGITSTSEA

SEQ ID NO: 31748 - protein, 13 aa, BK virus
ATVEGITSTSEAI

SEQ ID NO: 31749 - protein, 13 aa, BK virus
TVEGITSTSEAIA

SEQ ID NO: 31750 - protein, 13 aa, BK virus
VEGITSTSEAIAA

SEQ ID NO: 31751 - protein, 13 aa, BK virus
EGITSTSEAIAAI

SEQ ID NO: 31752 - protein, 13 aa, BK virus
GITSTSEAIAAIG

SEQ ID NO: 31753 - protein, 13 aa, BK virus
ITSTSEAIAAIGL

SEQ ID NO: 31754 - protein, 13 aa, BK virus
TSTSEAIAAIGLT

SEQ ID NO: 31755 - protein, 13 aa, BK virus
STSEAIAAIGLTP

SEQ ID NO: 31756 - protein, 13 aa, BK virus
TSEAIAAIGLTPQ

SEQ ID NO: 31757 - protein, 13 aa, BK virus
SEAIAAIGLTPQT

SEQ ID NO: 31758 - protein, 13 aa, BK virus
EAIAAIGLTPQTY

SEQ ID NO: 31759 - protein, 13 aa, BK virus
AIAAIGLTPQTYA

SEQ ID NO: 31760 - protein, 13 aa, BK virus
IAAIGLTPQTYAV

SEQ ID NO: 31761 - protein, 13 aa, BK virus
AAIGLTPQTYAVI

SEQ ID NO: 31762 - protein, 13 aa, BK virus
AIGLTPQTYAVIA

SEQ ID NO: 31763 - protein, 13 aa, BK virus
IGLTPQTYAVIAG

SEQ ID NO: 31764 - protein, 13 aa, BK virus
GLTPQTYAVIAGA

SEQ ID NO: 31765 - protein, 13 aa, BK virus
LTPQTYAVIAGAP

SEQ ID NO: 31766 - protein, 13 aa, BK virus
TPQTYAVIAGAPG

SEQ ID NO: 31767 - protein, 13 aa, BK virus
PQTYAVIAGAPGA

SEQ ID NO: 31768 - protein, 13 aa, BK virus
QTYAVIAGAPGAI

SEQ ID NO: 31769 - protein, 13 aa, BK virus
TYAVIAGAPGAIA

SEQ ID NO: 31770 - protein, 13 aa, BK virus
YAVIAGAPGAIAG

SEQ ID NO: 31771 - protein, 13 aa, BK virus
AVIAGAPGAIAGF

SEQ ID NO: 31772 - protein, 13 aa, BK virus
VIAGAPGAIAGFA

SEQ ID NO: 31773 - protein, 13 aa, BK virus
IAGAPGAIAGFAA

SEQ ID NO: 31774 - protein, 13 aa, BK virus
AGAPGAIAGFAAL

SEQ ID NO: 31775 - protein, 13 aa, BK virus
GAPGAIAGFAALI

SEQ ID NO: 31776 - protein, 13 aa, BK virus
APGAIAGFAALIQ

SEQ ID NO: 31777 - protein, 13 aa, BK virus
PGAIAGFAALIQT

SEQ ID NO: 31778 - protein, 13 aa, BK virus
GAIAGFAALIQTV

SEQ ID NO: 31779 - protein, 13 aa, BK virus
AIAGFAALIQTVS

SEQ ID NO: 31780 - protein, 13 aa, BK virus
IAGFAALIQTVSG

SEQ ID NO: 31781 - protein, 13 aa, BK virus
AGFAALIQTVSGI

SEQ ID NO: 31782 - protein, 13 aa, BK virus
GFAALIQTVSGIS

SEQ ID NO: 31783 - protein, 13 aa, BK virus
FAALIQTVSGISS

SEQ ID NO: 31784 - protein, 13 aa, BK virus
AALIQTVSGISSL

SEQ ID NO: 31785 - protein, 13 aa, BK virus
ALIQTVSGISSLA

SEQ ID NO: 31786 - protein, 13 aa, BK virus
LIQTVSGISSLAQ

SEQ ID NO: 31787 - protein, 13 aa, BK virus
IQTVSGISSLAQV

SEQ ID NO: 31788 - protein, 13 aa, BK virus
QTVSGISSLAQVG

SEQ ID NO: 31789 - protein, 13 aa, BK virus
TVSGISSLAQVGY

SEQ ID NO: 31790 - protein, 13 aa, BK virus
VSGISSLAQVGYK

SEQ ID NO: 31791 - protein, 13 aa, BK virus
SGISSLAQVGYKF

SEQ ID NO: 31792 - protein, 13 aa, BK virus
GISSLAQVGYKFF

SEQ ID NO: 31793 - protein, 13 aa, BK virus
ISSLAQVGYKFFD

SEQ ID NO: 31794 - protein, 13 aa, BK virus
SSLAQVGYKFFDD

SEQ ID NO: 31795 - protein, 13 aa, BK virus
SLAQVGYKFFDDW

SEQ ID NO: 31796 - protein, 13 aa, BK virus
LAQVGYKFFDDWD

SEQ ID NO: 31797 - protein, 13 aa, BK virus
AQVGYKFFDDWDH

SEQ ID NO: 31798 - protein, 13 aa, BK virus
QVGYKFFDDWDHK

SEQ ID NO: 31799 - protein, 13 aa, BK virus
VGYKFFDDWDHKV

SEQ ID NO: 31800 - protein, 13 aa, BK virus
GYKFFDDWDHKVS

SEQ ID NO: 31801 - protein, 13 aa, BK virus
YKFFDDWDHKVST

SEQ ID NO: 31802 - protein, 13 aa, BK virus
KFFDDWDHKVSTV

SEQ ID NO: 31803 - protein, 13 aa, BK virus
FFDDWDHKVSTVG

SEQ ID NO: 31804 - protein, 13 aa, BK virus
FDDWDHKVSTVGL

SEQ ID NO: 31805 - protein, 13 aa, BK virus
DDWDHKVSTVGLY

SEQ ID NO: 31806 - protein, 13 aa, BK virus
DWDHKVSTVGLYQ

SEQ ID NO: 31807 - protein, 13 aa, BK virus
WDHKVSTVGLYQQ

SEQ ID NO: 31808 - protein, 13 aa, BK virus
DHKVSTVGLYQQS

SEQ ID NO: 31809 - protein, 13 aa, BK virus
HKVSTVGLYQQSG

SEQ ID NO: 31810 - protein, 13 aa, BK virus
KVSTVGLYQQSGM

SEQ ID NO: 31811 - protein, 13 aa, BK virus
VSTVGLYQQSGMA

SEQ ID NO: 31812 - protein, 13 aa, BK virus
STVGLYQQSGMAL

SEQ ID NO: 31813 - protein, 13 aa, BK virus
TVGLYQQSGMALE

SEQ ID NO: 31814 - protein, 13 aa, BK virus
VGLYQQSGMALEL

SEQ ID NO: 31815 - protein, 13 aa, BK virus
GLYQQSGMALELF

SEQ ID NO: 31816 - protein, 13 aa, BK virus
LYQQSGMALELFN

SEQ ID NO: 31817 - protein, 13 aa, BK virus
YQQSGMALELFNP

SEQ ID NO: 31818 - protein, 13 aa, BK virus
QQSGMALELFNPD

SEQ ID NO: 31819 - protein, 13 aa, BK virus
QSGMALELFNPDE

SEQ ID NO: 31820 - protein, 13 aa, BK virus
SGMALELFNPDEY

SEQ ID NO: 31821 - protein, 13 aa, BK virus
GMALELFNPDEYY

SEQ ID NO: 31822 - protein, 13 aa, BK virus
MALELFNPDEYYD

SEQ ID NO: 31823 - protein, 13 aa, BK virus
ALELFNPDEYYDI

SEQ ID NO: 31824 - protein, 13 aa, BK virus
LELFNPDEYYDIL

SEQ ID NO: 31825 - protein, 13 aa, BK virus
ELFNPDEYYDILF

SEQ ID NO: 31826 - protein, 13 aa, BK virus
LFNPDEYYDILFP

SEQ ID NO: 31827 - protein, 13 aa, BK virus
FNPDEYYDILFPG

SEQ ID NO: 31828 - protein, 13 aa, BK virus
NPDEYYDILFPGV

SEQ ID NO: 31829 - protein, 13 aa, BK virus
PDEYYDILFPGVN

SEQ ID NO: 31830 - protein, 13 aa, BK virus
DEYYDILFPGVNT

SEQ ID NO: 31831 - protein, 13 aa, BK virus
EYYDILFPGVNTF

SEQ ID NO: 31832 - protein, 13 aa, BK virus
YYDILFPGVNTFV

SEQ ID NO: 31833 - protein, 13 aa, BK virus
YDILFPGVNTFVN

SEQ ID NO: 31834 - protein, 13 aa, BK virus
DILFPGVNTFVNN

SEQ ID NO: 31835 - protein, 13 aa, BK virus
ILFPGVNTFVNNI

SEQ ID NO: 31836 - protein, 13 aa, BK virus
LFPGVNTFVNNIQ

SEQ ID NO: 31837 - protein, 13 aa, BK virus
FPGVNTFVNNIQY

SEQ ID NO: 31838 - protein, 13 aa, BK virus
PGVNTFVNNIQYL

SEQ ID NO: 31839 - protein, 13 aa, BK virus
GVNTFVNNIQYLD

SEQ ID NO: 31840 - protein, 13 aa, BK virus
VNTFVNNIQYLDP

SEQ ID NO: 31841 - protein, 13 aa, BK virus
NTFVNNIQYLDPR

SEQ ID NO: 31842 - protein, 13 aa, BK virus
TFVNNIQYLDPRH

SEQ ID NO: 31843 - protein, 13 aa, BK virus
FVNNIQYLDPRHW

SEQ ID NO: 31844 - protein, 13 aa, BK virus
VNNIQYLDPRHWG

SEQ ID NO: 31845 - protein, 13 aa, BK virus
NNIQYLDPRHWGP

SEQ ID NO: 31846 - protein, 13 aa, BK virus
NIQYLDPRHWGPS

SEQ ID NO: 31847 - protein, 13 aa, BK virus
IQYLDPRHWGPSL

SEQ ID NO: 31848 - protein, 13 aa, BK virus
QYLDPRHWGPSLF

SEQ ID NO: 31849 - protein, 13 aa, BK virus
YLDPRHWGPSLFA

SEQ ID NO: 31850 - protein, 13 aa, BK virus
LDPRHWGPSLFAT

SEQ ID NO: 31851 - protein, 13 aa, BK virus
DPRHWGPSLFATI

SEQ ID NO: 31852 - protein, 13 aa, BK virus
PRHWGPSLFATIS

SEQ ID NO: 31853 - protein, 13 aa, BK virus
RHWGPSLFATISQ

SEQ ID NO: 31854 - protein, 13 aa, BK virus
HWGPSLFATISQA

SEQ ID NO: 31855 - protein, 13 aa, BK virus
WGPSLFATISQAL

SEQ ID NO: 31856 - protein, 13 aa, BK virus
GPSLFATISQALW

SEQ ID NO: 31857 - protein, 13 aa, BK virus
PSLFATISQALWH

SEQ ID NO: 31858 - protein, 13 aa, BK virus
SLFATISQALWHV

SEQ ID NO: 31859 - protein, 13 aa, BK virus
LFATISQALWHVI

SEQ ID NO: 31860 - protein, 13 aa, BK virus
FATISQALWHVIR

SEQ ID NO: 31861 - protein, 13 aa, BK virus
ATISQALWHVIRD

SEQ ID NO: 31862 - protein, 13 aa, BK virus
TISQALWHVIRDD

SEQ ID NO: 31863 - protein, 13 aa, BK virus
ISQALWHVIRDDI

SEQ ID NO: 31864 - protein, 13 aa, BK virus
SQALWHVIRDDIP

SEQ ID NO: 31865 - protein, 13 aa, BK virus
QALWHVIRDDIPS

SEQ ID NO: 31866 - protein, 13 aa, BK virus
ALWHVIRDDIPSI

SEQ ID NO: 31867 - protein, 13 aa, BK virus
LWHVIRDDIPSIT

SEQ ID NO: 31868 - protein, 13 aa, BK virus
WHVIRDDIPSITS

SEQ ID NO: 31869 - protein, 13 aa, BK virus
HVIRDDIPSITSQ

SEQ ID NO: 31870 - protein, 13 aa, BK virus
VIRDDIPSITSQE

SEQ ID NO: 31871 - protein, 13 aa, BK virus
IRDDIPSITSQEL

SEQ ID NO: 31872 - protein, 13 aa, BK virus
RDDIPSITSQELQ

SEQ ID NO: 31873 - protein, 13 aa, BK virus
DDIPSITSQELQR

SEQ ID NO: 31874 - protein, 13 aa, BK virus
DIPSITSQELQRR

SEQ ID NO: 31875 - protein, 13 aa, BK virus
IPSITSQELQRRT

SEQ ID NO: 31876 - protein, 13 aa, BK virus
PSITSQELQRRTE

SEQ ID NO: 31877 - protein, 13 aa, BK virus
SITSQELQRRTER

SEQ ID NO: 31878 - protein, 13 aa, BK virus
ITSQELQRRTERF

SEQ ID NO: 31879 - protein, 13 aa, BK virus
TSQELQRRTERFF

SEQ ID NO: 31880 - protein, 13 aa, BK virus
SQELQRRTERFFR

SEQ ID NO: 31881 - protein, 13 aa, BK virus
QELQRRTERFFRD

SEQ ID NO: 31882 - protein, 13 aa, BK virus
ELQRRTERFFRDS

SEQ ID NO: 31883 - protein, 13 aa, BK virus
LQRRTERFFRDSL

SEQ ID NO: 31884 - protein, 13 aa, BK virus
QRRTERFFRDSLA

SEQ ID NO: 31885 - protein, 13 aa, BK virus
RRTERFFRDSLAR

SEQ ID NO: 31886 - protein, 13 aa, BK virus
RTERFFRDSLARF

SEQ ID NO: 31887 - protein, 13 aa, BK virus
TERFFRDSLARFL

SEQ ID NO: 31888 - protein, 13 aa, BK virus
ERFFRDSLARFLE

SEQ ID NO: 31889 - protein, 13 aa, BK virus
RFFRDSLARFLEE

SEQ ID NO: 31890 - protein, 13 aa, BK virus
FFRDSLARFLEET

SEQ ID NO: 31891 - protein, 13 aa, BK virus
FRDSLARFLEETT

SEQ ID NO: 31892 - protein, 13 aa, BK virus
RDSLARFLEETTW

SEQ ID NO: 31893 - protein, 13 aa, BK virus
DSLARFLEETTWT

SEQ ID NO: 31894 - protein, 13 aa, BK virus
SLARFLEETTWTI

SEQ ID NO: 31895 - protein, 13 aa, BK virus
LARFLEETTWTIV

SEQ ID NO: 31896 - protein, 13 aa, BK virus
ARFLEETTWTIVN

SEQ ID NO: 31897 - protein, 13 aa, BK virus
RFLEETTWTIVNA

SEQ ID NO: 31898 - protein, 13 aa, BK virus
FLEETTWTIVNAP

SEQ ID NO: 31899 - protein, 13 aa, BK virus
LEETTWTIVNAPI

SEQ ID NO: 31900 - protein, 13 aa, BK virus
EETTWTIVNAPIN

SEQ ID NO: 31901 - protein, 13 aa, BK virus
ETTWTIVNAPINF

SEQ ID NO: 31902 - protein, 13 aa, BK virus
TTWTIVNAPINFY

SEQ ID NO: 31903 - protein, 13 aa, BK virus
TWTIVNAPINFYN

SEQ ID NO: 31904 - protein, 13 aa, BK virus
WTIVNAPINFYNY

SEQ ID NO: 31905 - protein, 13 aa, BK virus
TIVNAPINFYNYI

SEQ ID NO: 31906 - protein, 13 aa, BK virus
IVNAPINFYNYIQ

SEQ ID NO: 31907 - protein, 13 aa, BK virus
VNAPINFYNYIQQ

SEQ ID NO: 31908 - protein, 13 aa, BK virus
NAPINFYNYIQQY

SEQ ID NO: 31909 - protein, 13 aa, BK virus
APINFYNYIQQYY

SEQ ID NO: 31910 - protein, 13 aa, BK virus
PINFYNYIQQYYS

SEQ ID NO: 31911 - protein, 13 aa, BK virus
INFYNYIQQYYSD

SEQ ID NO: 31912 - protein, 13 aa, BK virus
NFYNYIQQYYSDL

SEQ ID NO: 31913 - protein, 13 aa, BK virus
FYNYIQQYYSDLS

SEQ ID NO: 31914 - protein, 13 aa, BK virus
YNYIQQYYSDLSP

SEQ ID NO: 31915 - protein, 13 aa, BK virus
NYIQQYYSDLSPI

SEQ ID NO: 31916 - protein, 13 aa, BK virus
YIQQYYSDLSPIR

SEQ ID NO: 31917 - protein, 13 aa, BK virus
IQQYYSDLSPIRP

SEQ ID NO: 31918 - protein, 13 aa, BK virus
QQYYSDLSPIRPS

SEQ ID NO: 31919 - protein, 13 aa, BK virus
QYYSDLSPIRPSM

SEQ ID NO: 31920 - protein, 13 aa, BK virus
YYSDLSPIRPSMV

SEQ ID NO: 31921 - protein, 13 aa, BK virus
YSDLSPIRPSMVR

SEQ ID NO: 31922 - protein, 13 aa, BK virus
SDLSPIRPSMVRQ

SEQ ID NO: 31923 - protein, 13 aa, BK virus
DLSPIRPSMVRQV

SEQ ID NO: 31924 - protein, 13 aa, BK virus
LSPIRPSMVRQVA

SEQ ID NO: 31925 - protein, 13 aa, BK virus
SPIRPSMVRQVAE

SEQ ID NO: 31926 - protein, 13 aa, BK virus
PIRPSMVRQVAER

SEQ ID NO: 31927 - protein, 13 aa, BK virus
IRPSMVRQVAERE

SEQ ID NO: 31928 - protein, 13 aa, BK virus
RPSMVRQVAEREG

SEQ ID NO: 31929 - protein, 13 aa, BK virus
PSMVRQVAEREGT

SEQ ID NO: 31930 - protein, 13 aa, BK virus
SMVRQVAEREGTR

SEQ ID NO: 31931 - protein, 13 aa, BK virus
MVRQVAEREGTRV

SEQ ID NO: 31932 - protein, 13 aa, BK virus
VRQVAEREGTRVH

SEQ ID NO: 31933 - protein, 13 aa, BK virus
RQVAEREGTRVHF

SEQ ID NO: 31934 - protein, 13 aa, BK virus
QVAEREGTRVHFG

SEQ ID NO: 31935 - protein, 13 aa, BK virus
VAEREGTRVHFGH

SEQ ID NO: 31936 - protein, 13 aa, BK virus
AEREGTRVHFGHT

SEQ ID NO: 31937 - protein, 13 aa, BK virus
EREGTRVHFGHTY

SEQ ID NO: 31938 - protein, 13 aa, BK virus
REGTRVHFGHTYS

SEQ ID NO: 31939 - protein, 13 aa, BK virus
EGTRVHFGHTYSI

SEQ ID NO: 31940 - protein, 13 aa, BK virus
GTRVHFGHTYSID

SEQ ID NO: 31941 - protein, 13 aa, BK virus
TRVHFGHTYSIDD

SEQ ID NO: 31942 - protein, 13 aa, BK virus
RVHFGHTYSIDDA

SEQ ID NO: 31943 - protein, 13 aa, BK virus
VHFGHTYSIDDAD

SEQ ID NO: 31944 - protein, 13 aa, BK virus
HFGHTYSIDDADS

SEQ ID NO: 31945 - protein, 13 aa, BK virus
FGHTYSIDDADSI

SEQ ID NO: 31946 - protein, 13 aa, BK virus
GHTYSIDDADSIE

SEQ ID NO: 31947 - protein, 13 aa, BK virus
HTYSIDDADSIEE

SEQ ID NO: 31948 - protein, 13 aa, BK virus
TYSIDDADSIEEV

SEQ ID NO: 31949 - protein, 13 aa, BK virus
YSIDDADSIEEVT

SEQ ID NO: 31950 - protein, 13 aa, BK virus
SIDDADSIEEVTQ

SEQ ID NO: 31951 - protein, 13 aa, BK virus
IDDADSIEEVTQR

SEQ ID NO: 31952 - protein, 13 aa, BK virus
DDADSIEEVTQRM

SEQ ID NO: 31953 - protein, 13 aa, BK virus
DADSIEEVTQRMD

SEQ ID NO: 31954 - protein, 13 aa, BK virus
ADSIEEVTQRMDL

SEQ ID NO: 31955 - protein, 13 aa, BK virus
DSIEEVTQRMDLR

SEQ ID NO: 31956 - protein, 13 aa, BK virus
SIEEVTQRMDLRN

SEQ ID NO: 31957 - protein, 13 aa, BK virus
IEEVTQRMDLRNQ

SEQ ID NO: 31958 - protein, 13 aa, BK virus
EEVTQRMDLRNQQ

SEQ ID NO: 31959 - protein, 13 aa, BK virus
EVTQRMDLRNQQS

SEQ ID NO: 31960 - protein, 13 aa, BK virus
VTQRMDLRNQQSV

SEQ ID NO: 31961 - protein, 13 aa, BK virus
TQRMDLRNQQSVH

SEQ ID NO: 31962 - protein, 13 aa, BK virus
QRMDLRNQQSVHS

SEQ ID NO: 31963 - protein, 13 aa, BK virus
RMDLRNQQSVHSG

SEQ ID NO: 31964 - protein, 13 aa, BK virus
MDLRNQQSVHSGE

SEQ ID NO: 31965 - protein, 13 aa, BK virus
DLRNQQSVHSGEF

SEQ ID NO: 31966 - protein, 13 aa, BK virus
LRNQQSVHSGEFI

SEQ ID NO: 31967 - protein, 13 aa, BK virus
RNQQSVHSGEFIE

SEQ ID NO: 31968 - protein, 13 aa, BK virus
NQQSVHSGEFIEK

SEQ ID NO: 31969 - protein, 13 aa, BK virus
QQSVHSGEFIEKT

SEQ ID NO: 31970 - protein, 13 aa, BK virus
QSVHSGEFIEKTI

SEQ ID NO: 31971 - protein, 13 aa, BK virus
SVHSGEFIEKTIA

SEQ ID NO: 31972 - protein, 13 aa, BK virus
VHSGEFIEKTIAP

SEQ ID NO: 31973 - protein, 13 aa, BK virus
HSGEFIEKTIAPG

SEQ ID NO: 31974 - protein, 13 aa, BK virus
SGEFIEKTIAPGG

SEQ ID NO: 31975 - protein, 13 aa, BK virus
GEFIEKTIAPGGA

SEQ ID NO: 31976 - protein, 13 aa, BK virus
EFIEKTIAPGGAN

SEQ ID NO: 31977 - protein, 13 aa, BK virus
FIEKTIAPGGANQ

SEQ ID NO: 31978 - protein, 13 aa, BK virus
IEKTIAPGGANQR

SEQ ID NO: 31979 - protein, 13 aa, BK virus
EKTIAPGGANQRT

SEQ ID NO: 31980 - protein, 13 aa, BK virus
KTIAPGGANQRTA

SEQ ID NO: 31981 - protein, 13 aa, BK virus
TIAPGGANQRTAP

SEQ ID NO: 31982 - protein, 13 aa, BK virus
IAPGGANQRTAPQ

SEQ ID NO: 31983 - protein, 13 aa, BK virus
APGGANQRTAPQW

SEQ ID NO: 31984 - protein, 13 aa, BK virus
PGGANQRTAPQWM

SEQ ID NO: 31985 - protein, 13 aa, BK virus
GGANQRTAPQWML

SEQ ID NO: 31986 - protein, 13 aa, BK virus
GANQRTAPQWMLP

SEQ ID NO: 31987 - protein, 13 aa, BK virus
ANQRTAPQWMLPL

SEQ ID NO: 31988 - protein, 13 aa, BK virus
NQRTAPQWMLPLL

SEQ ID NO: 31989 - protein, 13 aa, BK virus
QRTAPQWMLPLLL

SEQ ID NO: 31990 - protein, 13 aa, BK virus
RTAPQWMLPLLLG

SEQ ID NO: 31991 - protein, 13 aa, BK virus
TAPQWMLPLLLGL

SEQ ID NO: 31992 - protein, 13 aa, BK virus
APQWMLPLLLGLY

SEQ ID NO: 31993 - protein, 13 aa, BK virus
PQWMLPLLLGLYG

SEQ ID NO: 31994 - protein, 13 aa, BK virus
QWMLPLLLGLYGT

SEQ ID NO: 31995 - protein, 13 aa, BK virus
WMLPLLLGLYGTV

SEQ ID NO: 31996 - protein, 13 aa, BK virus
MLPLLLGLYGTVT

SEQ ID NO: 31997 - protein, 13 aa, BK virus
LPLLLGLYGTVTP

SEQ ID NO: 31998 - protein, 13 aa, BK virus
PLLLGLYGTVTPA

SEQ ID NO: 31999 - protein, 13 aa, BK virus
LLLGLYGTVTPAL

SEQ ID NO: 32000 - protein, 13 aa, BK virus
LLGLYGTVTPALE

SEQ ID NO: 32001 - protein, 13 aa, BK virus
LGLYGTVTPALEA

SEQ ID NO: 32002 - protein, 13 aa, BK virus
GLYGTVTPALEAY

SEQ ID NO: 32003 - protein, 13 aa, BK virus
LYGTVTPALEAYE

SEQ ID NO: 32004 - protein, 13 aa, BK virus
YGTVTPALEAYED

SEQ ID NO: 32005 - protein, 13 aa, BK virus
GTVTPALEAYEDG

SEQ ID NO: 32006 - protein, 13 aa, BK virus
TVTPALEAYEDGP

SEQ ID NO: 32007 - protein, 13 aa, BK virus
VTPALEAYEDGPN

SEQ ID NO: 32008 - protein, 13 aa, BK virus
TPALEAYEDGPNQ

SEQ ID NO: 32009 - protein, 13 aa, BK virus
PALEAYEDGPNQK

SEQ ID NO: 32010 - protein, 13 aa, BK virus
ALEAYEDGPNQKK

SEQ ID NO: 32011 - protein, 13 aa, BK virus
LEAYEDGPNQKKR

SEQ ID NO: 32012 - protein, 13 aa, BK virus
EAYEDGPNQKKRR

SEQ ID NO: 32013 - protein, 13 aa, BK virus
AYEDGPNQKKRRV

SEQ ID NO: 32014 - protein, 13 aa, BK virus
YEDGPNQKKRRVS

SEQ ID NO: 32015 - protein, 13 aa, BK virus
EDGPNQKKRRVSR

SEQ ID NO: 32016 - protein, 13 aa, BK virus
DGPNQKKRRVSRG

SEQ ID NO: 32017 - protein, 13 aa, BK virus
GPNQKKRRVSRGS

SEQ ID NO: 32018 - protein, 13 aa, BK virus
PNQKKRRVSRGSS

SEQ ID NO: 32019 - protein, 13 aa, BK virus
NQKKRRVSRGSSQ

SEQ ID NO: 32020 - protein, 13 aa, BK virus
QKKRRVSRGSSQK

SEQ ID NO: 32021 - protein, 13 aa, BK virus
KKRRVSRGSSQKA

SEQ ID NO: 32022 - protein, 13 aa, BK virus
KRRVSRGSSQKAK

SEQ ID NO: 32023 - protein, 13 aa, BK virus
RRVSRGSSQKAKG

SEQ ID NO: 32024 - protein, 13 aa, BK virus
RVSRGSSQKAKGT

SEQ ID NO: 32025 - protein, 13 aa, BK virus
VSRGSSQKAKGTR

SEQ ID NO: 32026 - protein, 13 aa, BK virus
SRGSSQKAKGTRA

SEQ ID NO: 32027 - protein, 13 aa, BK virus
RGSSQKAKGTRAS

SEQ ID NO: 32028 - protein, 13 aa, BK virus
GSSQKAKGTRASA

SEQ ID NO: 32029 - protein, 13 aa, BK virus
SSQKAKGTRASAK

SEQ ID NO: 32030 - protein, 13 aa, BK virus
SQKAKGTRASAKT

SEQ ID NO: 32031 - protein, 13 aa, BK virus
QKAKGTRASAKTT

SEQ ID NO: 32032 - protein, 13 aa, BK virus
KAKGTRASAKTTN

SEQ ID NO: 32033 - protein, 13 aa, BK virus
AKGTRASAKTTNK

SEQ ID NO: 32034 - protein, 13 aa, BK virus
KGTRASAKTTNKR

SEQ ID NO: 32035 - protein, 13 aa, BK virus
GTRASAKTTNKRR

SEQ ID NO: 32036 - protein, 13 aa, BK virus
TRASAKTTNKRRS

SEQ ID NO: 32037 - protein, 13 aa, BK virus
RASAKTTNKRRSR

SEQ ID NO: 32038 - protein, 13 aa, BK virus
ASAKTTNKRRSRS

SEQ ID NO: 32039 - protein, 13 aa, BK virus
SAKTTNKRRSRSS

SEQ ID NO: 32040 - protein, 13 aa, BK virus
AKTTNKRRSRSSR

SEQ ID NO: 32041 - protein, 13 aa, BK virus
KTTNKRRSRSSRS

SEQ ID NO: 32042 - protein, 13 aa, BK virus
NWGRCYYRGRMLP

SEQ ID NO: 32043 - protein, 13 aa, BK virus
WGRCYYRGRMLPK

SEQ ID NO: 32044 - protein, 13 aa, BK virus
GRCYYRGRMLPKP

SEQ ID NO: 32045 - protein, 13 aa, BK virus
RCYYRGRMLPKPR

SEQ ID NO: 32046 - protein, 13 aa, BK virus
CYYRGRMLPKPRN

SEQ ID NO: 32047 - protein, 13 aa, BK virus
YYRGRMLPKPRNG

SEQ ID NO: 32048 - protein, 13 aa, BK virus
YRGRMLPKPRNGG

SEQ ID NO: 32049 - protein, 13 aa, BK virus
RGRMLPKPRNGGS

SEQ ID NO: 32050 - protein, 13 aa, BK virus
GRMLPKPRNGGSR

SEQ ID NO: 32051 - protein, 13 aa, BK virus
PREKNASLLQHSK

SEQ ID NO: 32052 - protein, 13 aa, BK virus
REKNASLLQHSKN

SEQ ID NO: 32053 - protein, 13 aa, BK virus
EKNASLLQHSKNS

SEQ ID NO: 32054 - protein, 13 aa, BK virus
KNASLLQHSKNSP

SEQ ID NO: 32055 - protein, 13 aa, BK virus
NASLLQHSKNSPP

SEQ ID NO: 32056 - protein, 13 aa, BK virus
ASLLQHSKNSPPQ

SEQ ID NO: 32057 - protein, 13 aa, BK virus
SLLQHSKNSPPQF

SEQ ID NO: 32058 - protein, 13 aa, BK virus
LLQHSKNSPPQFK

SEQ ID NO: 32059 - protein, 13 aa, BK virus
GPNLWKSTDVGGC

SEQ ID NO: 32060 - protein, 13 aa, BK virus
PNLWKSTDVGGCN

SEQ ID NO: 32061 - protein, 13 aa, BK virus
NLWKSTDVGGCNC

SEQ ID NO: 32062 - protein, 13 aa, BK virus
LWKSTDVGGCNCT

SEQ ID NO: 32063 - protein, 13 aa, BK virus
WKSTDVGGCNCTN

SEQ ID NO: 32064 - protein, 13 aa, BK virus
KSTDVGGCNCTNR

SEQ ID NO: 32065 - protein, 13 aa, BK virus
STDVGGCNCTNRG

SEQ ID NO: 32066 - protein, 13 aa, BK virus
TDVGGCNCTNRGY

SEQ ID NO: 32067 - protein, 13 aa, BK virus
DVGGCNCTNRGYW

SEQ ID NO: 32068 - protein, 13 aa, BK virus
VGGCNCTNRGYWN

SEQ ID NO: 32069 - protein, 13 aa, BK virus
GGCNCTNRGYWNN

SEQ ID NO: 32070 - protein, 13 aa, BK virus
FPLLCCRWRTLGN

SEQ ID NO: 32071 - protein, 13 aa, BK virus
PLLCCRWRTLGNA

SEQ ID NO: 32072 - protein, 13 aa, BK virus
LLCCRWRTLGNAG

SEQ ID NO: 32073 - protein, 13 aa, BK virus
LCCRWRTLGNAGS

SEQ ID NO: 32074 - protein, 13 aa, BK virus
CCRWRTLGNAGSA

SEQ ID NO: 32075 - protein, 13 aa, BK virus
CRWRTLGNAGSAN

SEQ ID NO: 32076 - protein, 13 aa, BK virus
RWRTLGNAGSANE

SEQ ID NO: 32077 - protein, 13 aa, BK virus
WRTLGNAGSANEL

SEQ ID NO: 32078 - protein, 13 aa, BK virus
RTLGNAGSANELQ

SEQ ID NO: 32079 - protein, 13 aa, BK virus
TLGNAGSANELQV

SEQ ID NO: 32080 - protein, 13 aa, BK virus
LGNAGSANELQVK

SEQ ID NO: 32081 - protein, 13 aa, BK virus
GNAGSANELQVKV

SEQ ID NO: 32082 - protein, 13 aa, BK virus
NAGSANELQVKVP

SEQ ID NO: 32083 - protein, 13 aa, BK virus
VFWDFHRRGKCSP

SEQ ID NO: 32084 - protein, 13 aa, BK virus
FWDFHRRGKCSPS

SEQ ID NO: 32085 - protein, 13 aa, BK virus
WDFHRRGKCSPST

SEQ ID NO: 32086 - protein, 13 aa, BK virus
DFHRRGKCSPSTS

SEQ ID NO: 32087 - protein, 13 aa, BK virus
FHRRGKCSPSTSC

SEQ ID NO: 32088 - protein, 13 aa, BK virus
HRRGKCSPSTSCD

SEQ ID NO: 32089 - protein, 13 aa, BK virus
RRGKCSPSTSCDQ

SEQ ID NO: 32090 - protein, 13 aa, BK virus
RGKCSPSTSCDQH

SEQ ID NO: 32091 - protein, 13 aa, BK virus
GKCSPSTSCDQHS

SEQ ID NO: 32092 - protein, 13 aa, BK virus
KCSPSTSCDQHSY

SEQ ID NO: 32093 - protein, 13 aa, BK virus
CSPSTSCDQHSYH

SEQ ID NO: 32094 - protein, 13 aa, BK virus
SPSTSCDQHSYHS

SEQ ID NO: 32095 - protein, 13 aa, BK virus
PSTSCDQHSYHSV

SEQ ID NO: 32096 - protein, 13 aa, BK virus
STSCDQHSYHSVA

SEQ ID NO: 32097 - protein, 13 aa, BK virus
TSCDQHSYHSVAR

SEQ ID NO: 32098 - protein, 13 aa, BK virus
QLWNTTVERPCKI

SEQ ID NO: 32099 - protein, 13 aa, BK virus
LWNTTVERPCKIF

SEQ ID NO: 32100 - protein, 13 aa, BK virus
DPPEKKICKESLP

SEQ ID NO: 32101 - protein, 13 aa, BK virus
PPEKKICKESLPN

SEQ ID NO: 32102 - protein, 13 aa, BK virus
PEKKICKESLPNF

SEQ ID NO: 32103 - protein, 13 aa, BK virus
EKKICKESLPNFL

SEQ ID NO: 32104 - protein, 13 aa, BK virus
KKICKESLPNFLF

SEQ ID NO: 32105 - protein, 13 aa, BK virus
KICKESLPNFLFA

SEQ ID NO: 32106 - protein, 13 aa, BK virus
ICKESLPNFLFAK

SEQ ID NO: 32107 - protein, 13 aa, BK virus
PYKQENPESGWAA

SEQ ID NO: 32108 - protein, 13 aa, BK virus
YKQENPESGWAAY

SEQ ID NO: 32109 - protein, 13 aa, BK virus
KQENPESGWAAYV

SEQ ID NO: 32110 - protein, 13 aa, BK virus
QENPESGWAAYVW

SEQ ID NO: 32111 - protein, 13 aa, BK virus
ENPESGWAAYVWY

SEQ ID NO: 32112 - protein, 13 aa, BK virus
NPESGWAAYVWYG

SEQ ID NO: 32113 - protein, 13 aa, BK virus
PESGWAAYVWYGI

SEQ ID NO: 32114 - protein, 13 aa, BK virus
ESGWAAYVWYGIP

SEQ ID NO: 32115 - protein, 13 aa, BK virus
SGWAAYVWYGIPG

SEQ ID NO: 32116 - protein, 13 aa, BK virus
GWAAYVWYGIPGR

SEQ ID NO: 32117 - protein, 13 aa, BK virus
WAAYVWYGIPGRR

SEQ ID NO: 32118 - protein, 13 aa, BK virus
AAYVWYGIPGRRG

SEQ ID NO: 32119 - protein, 13 aa, BK virus
WHRKTSRGPRYDK

SEQ ID NO: 32120 - protein, 13 aa, BK virus
HRKTSRGPRYDKI

SEQ ID NO: 32121 - protein, 13 aa, BK virus
RKTSRGPRYDKIY

SEQ ID NO: 32122 - protein, 13 aa, BK virus
QTGTIANQNALNR

SEQ ID NO: 32123 - protein, 13 aa, BK virus
TGTIANQNALNRC

SEQ ID NO: 32124 - protein, 13 aa, BK virus
GTIANQNALNRCF

SEQ ID NO: 32125 - protein, 13 aa, BK virus
TIANQNALNRCFY

SEQ ID NO: 32126 - protein, 13 aa, BK virus
IANQNALNRCFYC

SEQ ID NO: 32127 - protein, 13 aa, BK virus
ANQNALNRCFYCT

SEQ ID NO: 32128 - protein, 13 aa, BK virus
NQNALNRCFYCTY

SEQ ID NO: 32129 - protein, 13 aa, BK virus
QNALNRCFYCTYT

SEQ ID NO: 32130 - protein, 13 aa, BK virus
NALNRCFYCTYTF

SEQ ID NO: 32131 - protein, 13 aa, BK virus
ALNRCFYCTYTFN

SEQ ID NO: 32132 - protein, 13 aa, BK virus
LNRCFYCTYTFNK

SEQ ID NO: 32133 - protein, 13 aa, BK virus
NRCFYCTYTFNKC

SEQ ID NO: 32134 - protein, 13 aa, BK virus
RCFYCTYTFNKCC

SEQ ID NO: 32135 - protein, 13 aa, BK virus
CFYCTYTFNKCCF

SEQ ID NO: 32136 - protein, 13 aa, BK virus
FYCTYTFNKCCFC

SEQ ID NO: 32137 - protein, 13 aa, BK virus
YCTYTFNKCCFCI

SEQ ID NO: 32138 - protein, 13 aa, BK virus
CTYTFNKCCFCIS

SEQ ID NO: 32139 - protein, 13 aa, BK virus
TYTFNKCCFCISH

SEQ ID NO: 32140 - protein, 13 aa, BK virus
YTFNKCCFCISHF

SEQ ID NO: 32141 - protein, 13 aa, BK virus
NTESLYTNATLDY

SEQ ID NO: 32142 - protein, 13 aa, BK virus
TESLYTNATLDYG

SEQ ID NO: 32143 - protein, 13 aa, BK virus
ESLYTNATLDYGG

SEQ ID NO: 32144 - protein, 13 aa, BK virus
SLYTNATLDYGGL

SEQ ID NO: 32145 - protein, 13 aa, BK virus
LYTNATLDYGGLT

SEQ ID NO: 32146 - protein, 13 aa, BK virus
YTNATLDYGGLTF

SEQ ID NO: 32147 - protein, 13 aa, BK virus
TNATLDYGGLTFG

SEQ ID NO: 32148 - protein, 13 aa, BK virus
NATLDYGGLTFGN

SEQ ID NO: 32149 - protein, 13 aa, BK virus
ATLDYGGLTFGNL

SEQ ID NO: 32150 - protein, 13 aa, BK virus
TLDYGGLTFGNLQ

SEQ ID NO: 32151 - protein, 13 aa, BK virus
LDYGGLTFGNLQQ

SEQ ID NO: 32152 - protein, 13 aa, BK virus
DYGGLTFGNLQQG

SEQ ID NO: 32153 - protein, 13 aa, BK virus
YGGLTFGNLQQGL

SEQ ID NO: 32154 - protein, 13 aa, BK virus
GGLTFGNLQQGLK

SEQ ID NO: 32155 - protein, 13 aa, BK virus
GLTFGNLQQGLKY

SEQ ID NO: 32156 - protein, 13 aa, BK virus
LTFGNLQQGLKYL

SEQ ID NO: 32157 - protein, 13 aa, BK virus
TFGNLQQGLKYLR

SEQ ID NO: 32158 - protein, 13 aa, BK virus
FGNLQQGLKYLRL

SEQ ID NO: 32159 - protein, 13 aa, BK virus
GNLQQGLKYLRLG

SEQ ID NO: 32160 - protein, 13 aa, BK virus
NLQQGLKYLRLGK

SEQ ID NO: 32161 - protein, 13 aa, BK virus
LQQGLKYLRLGKS

SEQ ID NO: 32162 - protein, 13 aa, BK virus
QQGLKYLRLGKSI

SEQ ID NO: 32163 - protein, 13 aa, BK virus
QGLKYLRLGKSIV

SEQ ID NO: 32164 - protein, 13 aa, BK virus
GLKYLRLGKSIVI

SEQ ID NO: 32165 - protein, 13 aa, BK virus
LKYLRLGKSIVIG

SEQ ID NO: 32166 - protein, 13 aa, BK virus
KYLRLGKSIVIGI

SEQ ID NO: 32167 - protein, 13 aa, BK virus
YLRLGKSIVIGIQ

SEQ ID NO: 32168 - protein, 13 aa, BK virus
LRLGKSIVIGIQC

SEQ ID NO: 32169 - protein, 13 aa, BK virus
RLGKSIVIGIQCL

SEQ ID NO: 32170 - protein, 13 aa, BK virus
LGKSIVIGIQCLI

SEQ ID NO: 32171 - protein, 13 aa, BK virus
GKSIVIGIQCLIH

SEQ ID NO: 32172 - protein, 13 aa, BK virus
KSIVIGIQCLIHV

SEQ ID NO: 32173 - protein, 13 aa, BK virus
SIVIGIQCLIHVQ

SEQ ID NO: 32174 - protein, 13 aa, BK virus
IVIGIQCLIHVQS

SEQ ID NO: 32175 - protein, 13 aa, BK virus
VIGIQCLIHVQSL

SEQ ID NO: 32176 - protein, 13 aa, BK virus
IGIQCLIHVQSLQ

SEQ ID NO: 32177 - protein, 13 aa, BK virus
GIQCLIHVQSLQF

SEQ ID NO: 32178 - protein, 13 aa, BK virus
IQCLIHVQSLQFL

SEQ ID NO: 32179 - protein, 13 aa, BK virus
QCLIHVQSLQFLN

SEQ ID NO: 32180 - protein, 13 aa, BK virus
CLIHVQSLQFLNP

SEQ ID NO: 32181 - protein, 13 aa, BK virus
LIHVQSLQFLNPL

SEQ ID NO: 32182 - protein, 13 aa, BK virus
IHVQSLQFLNPLL

SEQ ID NO: 32183 - protein, 13 aa, BK virus
HVQSLQFLNPLLL

SEQ ID NO: 32184 - protein, 13 aa, BK virus
YQEYISPCIYYIS

SEQ ID NO: 32185 - protein, 13 aa, BK virus
QEYISPCIYYISS

SEQ ID NO: 32186 - protein, 13 aa, BK virus
EYISPCIYYISSL

SEQ ID NO: 32187 - protein, 13 aa, BK virus
YISPCIYYISSLK

SEQ ID NO: 32188 - protein, 13 aa, BK virus
ISPCIYYISSLKK

SEQ ID NO: 32189 - protein, 13 aa, BK virus
SPCIYYISSLKKY

SEQ ID NO: 32190 - protein, 13 aa, BK virus
PCIYYISSLKKYT

SEQ ID NO: 32191 - protein, 13 aa, BK virus
CIYYISSLKKYTY

SEQ ID NO: 32192 - protein, 13 aa, BK virus
IYYISSLKKYTYL

SEQ ID NO: 32193 - protein, 13 aa, BK virus
YYISSLKKYTYLS

SEQ ID NO: 32194 - protein, 13 aa, BK virus
YISSLKKYTYLSQ

SEQ ID NO: 32195 - protein, 13 aa, BK virus
ISSLKKYTYLSQN

SEQ ID NO: 32196 - protein, 13 aa, BK virus
SSLKKYTYLSQNP

SEQ ID NO: 32197 - protein, 13 aa, BK virus
SLKKYTYLSQNPA

SEQ ID NO: 32198 - protein, 13 aa, BK virus
LKKYTYLSQNPAF

SEQ ID NO: 32199 - protein, 13 aa, BK virus
KKYTYLSQNPAFP

SEQ ID NO: 32200 - protein, 13 aa, BK virus
KYTYLSQNPAFPS

SEQ ID NO: 32201 - protein, 13 aa, BK virus
YTYLSQNPAFPSI

SEQ ID NO: 32202 - protein, 13 aa, BK virus
TYLSQNPAFPSIQ

SEQ ID NO: 32203 - protein, 13 aa, BK virus
YLSQNPAFPSIQQ

SEQ ID NO: 32204 - protein, 13 aa, BK virus
LSQNPAFPSIQQF

SEQ ID NO: 32205 - protein, 13 aa, BK virus
TKLAVATRSFHFV

SEQ ID NO: 32206 - protein, 13 aa, BK virus
KLAVATRSFHFVK

SEQ ID NO: 32207 - protein, 13 aa, BK virus
LAVATRSFHFVKF

SEQ ID NO: 32208 - protein, 13 aa, BK virus
AVATRSFHFVKFF

SEQ ID NO: 32209 - protein, 13 aa, BK virus
VATRSFHFVKFFF

SEQ ID NO: 32210 - protein, 13 aa, BK virus
ATRSFHFVKFFFQ

SEQ ID NO: 32211 - protein, 13 aa, BK virus
TRSFHFVKFFFQV

SEQ ID NO: 32212 - protein, 13 aa, BK virus
RSFHFVKFFFQVR

SEQ ID NO: 32213 - protein, 13 aa, BK virus
SFHFVKFFFQVRT

SEQ ID NO: 32214 - protein, 13 aa, BK virus
FHFVKFFFQVRTL

SEQ ID NO: 32215 - protein, 13 aa, BK virus
HFVKFFFQVRTLS

SEQ ID NO: 32216 - protein, 13 aa, BK virus
FVKFFFQVRTLSF

SEQ ID NO: 32217 - protein, 13 aa, BK virus
VKFFFQVRTLSFV

SEQ ID NO: 32218 - protein, 13 aa, BK virus
KFFFQVRTLSFVR

SEQ ID NO: 32219 - protein, 13 aa, BK virus
FFFQVRTLSFVRI

SEQ ID NO: 32220 - protein, 13 aa, BK virus
FFQVRTLSFVRIF

SEQ ID NO: 32221 - protein, 13 aa, BK virus
FQVRTLSFVRIFL

SEQ ID NO: 32222 - protein, 13 aa, BK virus
QVRTLSFVRIFLN

SEQ ID NO: 32223 - protein, 13 aa, BK virus
VRTLSFVRIFLNI

SEQ ID NO: 32224 - protein, 13 aa, BK virus
RTLSFVRIFLNIF

SEQ ID NO: 32225 - protein, 13 aa, BK virus
TLSFVRIFLNIFW

SEQ ID NO: 32226 - protein, 13 aa, BK virus
LSFVRIFLNIFWA

SEQ ID NO: 32227 - protein, 13 aa, BK virus
PSLVEIFGFFCLN

SEQ ID NO: 32228 - protein, 13 aa, BK virus
SLVEIFGFFCLNV

SEQ ID NO: 32229 - protein, 13 aa, BK virus
LVEIFGFFCLNVS

SEQ ID NO: 32230 - protein, 13 aa, BK virus
VEIFGFFCLNVSF

SEQ ID NO: 32231 - protein, 13 aa, BK virus
EIFGFFCLNVSFL

SEQ ID NO: 32232 - protein, 13 aa, BK virus
IFGFFCLNVSFLN

SEQ ID NO: 32233 - protein, 13 aa, BK virus
FGFFCLNVSFLNL

SEQ ID NO: 32234 - protein, 13 aa, BK virus
GFFCLNVSFLNLP

SEQ ID NO: 32235 - protein, 13 aa, BK virus
HFHLNNLSNCLNC

SEQ ID NO: 32236 - protein, 13 aa, BK virus
FHLNNLSNCLNCL

SEQ ID NO: 32237 - protein, 13 aa, BK virus
HLNNLSNCLNCLF

SEQ ID NO: 32238 - protein, 13 aa, BK virus
LNNLSNCLNCLFH

SEQ ID NO: 32239 - protein, 13 aa, BK virus
NNLSNCLNCLFHV

SEQ ID NO: 32240 - protein, 13 aa, BK virus
NLSNCLNCLFHVL

SEQ ID NO: 32241 - protein, 13 aa, BK virus
LSNCLNCLFHVLK

SEQ ID NO: 32242 - protein, 13 aa, BK virus
SNCLNCLFHVLKA

SEQ ID NO: 32243 - protein, 13 aa, BK virus
NCLNCLFHVLKAN

SEQ ID NO: 32244 - protein, 13 aa, BK virus
CLNCLFHVLKANP

SEQ ID NO: 32245 - protein, 13 aa, BK virus
LNCLFHVLKANPL

SEQ ID NO: 32246 - protein, 13 aa, BK virus
NCLFHVLKANPLI

SEQ ID NO: 32247 - protein, 13 aa, BK virus
CLFHVLKANPLIQ

SEQ ID NO: 32248 - protein, 13 aa, BK virus
LFHVLKANPLIQL

SEQ ID NO: 32249 - protein, 13 aa, BK virus
FHVLKANPLIQLL

SEQ ID NO: 32250 - protein, 13 aa, BK virus
HVLKANPLIQLLS

SEQ ID NO: 32251 - protein, 13 aa, BK virus
VLKANPLIQLLSL

SEQ ID NO: 32252 - protein, 13 aa, BK virus
LKANPLIQLLSLL

SEQ ID NO: 32253 - protein, 13 aa, BK virus
KANPLIQLLSLLH

SEQ ID NO: 32254 - protein, 13 aa, BK virus
ANPLIQLLSLLHL

SEQ ID NO: 32255 - protein, 13 aa, BK virus
NPLIQLLSLLHLQ

SEQ ID NO: 32256 - protein, 13 aa, BK virus
PLIQLLSLLHLQK

SEQ ID NO: 32257 - protein, 13 aa, BK virus
LIQLLSLLHLQKQ

SEQ ID NO: 32258 - protein, 13 aa, BK virus
IQLLSLLHLQKQP

SEQ ID NO: 32259 - protein, 13 aa, BK virus
QLLSLLHLQKQPC

SEQ ID NO: 32260 - protein, 13 aa, BK virus
LLSLLHLQKQPCT

SEQ ID NO: 32261 - protein, 13 aa, BK virus
LSLLHLQKQPCTD

SEQ ID NO: 32262 - protein, 13 aa, BK virus
SLLHLQKQPCTDL

SEQ ID NO: 32263 - protein, 13 aa, BK virus
LHLAQRLAFPWVG

SEQ ID NO: 32264 - protein, 13 aa, BK virus
HLAQRLAFPWVGL

SEQ ID NO: 32265 - protein, 13 aa, BK virus
LAQRLAFPWVGLH

SEQ ID NO: 32266 - protein, 13 aa, BK virus
AQRLAFPWVGLHL

SEQ ID NO: 32267 - protein, 13 aa, BK virus
QRLAFPWVGLHLR

SEQ ID NO: 32268 - protein, 13 aa, BK virus
RLAFPWVGLHLRL

SEQ ID NO: 32269 - protein, 13 aa, BK virus
LAFPWVGLHLRLY

SEQ ID NO: 32270 - protein, 13 aa, BK virus
AFPWVGLHLRLYH

SEQ ID NO: 32271 - protein, 13 aa, BK virus
FPWVGLHLRLYHH

SEQ ID NO: 32272 - protein, 13 aa, BK virus
PWVGLHLRLYHHT

SEQ ID NO: 32273 - protein, 13 aa, BK virus
WVGLHLRLYHHTN

SEQ ID NO: 32274 - protein, 13 aa, BK virus
VGLHLRLYHHTNL

SEQ ID NO: 32275 - protein, 13 aa, BK virus
GLHLRLYHHTNLI

SEQ ID NO: 32276 - protein, 13 aa, BK virus
LHLRLYHHTNLIT

SEQ ID NO: 32277 - protein, 13 aa, BK virus
HLRLYHHTNLITL

SEQ ID NO: 32278 - protein, 13 aa, BK virus
LRLYHHTNLITLQ

SEQ ID NO: 32279 - protein, 13 aa, BK virus
RLYHHTNLITLQL

SEQ ID NO: 32280 - protein, 13 aa, BK virus
LYHHTNLITLQLV

SEQ ID NO: 32281 - protein, 13 aa, BK virus
YHHTNLITLQLVL

SEQ ID NO: 32282 - protein, 13 aa, BK virus
HHTNLITLQLVLF

SEQ ID NO: 32283 - protein, 13 aa, BK virus
HTNLITLQLVLFF

SEQ ID NO: 32284 - protein, 13 aa, BK virus
TNLITLQLVLFFH

SEQ ID NO: 32285 - protein, 13 aa, BK virus
NLITLQLVLFFHY

SEQ ID NO: 32286 - protein, 13 aa, BK virus
LITLQLVLFFHYQ

SEQ ID NO: 32287 - protein, 13 aa, BK virus
ITLQLVLFFHYQW

SEQ ID NO: 32288 - protein, 13 aa, BK virus
TLQLVLFFHYQWD

SEQ ID NO: 32289 - protein, 13 aa, BK virus
LQLVLFFHYQWDL

SEQ ID NO: 32290 - protein, 13 aa, BK virus
KQYSAKNQILQNP

SEQ ID NO: 32291 - protein, 13 aa, BK virus
QYSAKNQILQNPF

SEQ ID NO: 32292 - protein, 13 aa, BK virus
VANSAAKQHLPYI

SEQ ID NO: 32293 - protein, 13 aa, BK virus
ANSAAKQHLPYIV

SEQ ID NO: 32294 - protein, 13 aa, BK virus
NSAAKQHLPYIVL

SEQ ID NO: 32295 - protein, 13 aa, BK virus
SAAKQHLPYIVLV

SEQ ID NO: 32296 - protein, 13 aa, BK virus
AAKQHLPYIVLVQ

SEQ ID NO: 32297 - protein, 13 aa, BK virus
AKQHLPYIVLVQH

SEQ ID NO: 32298 - protein, 13 aa, BK virus
KQHLPYIVLVQHF

SEQ ID NO: 32299 - protein, 13 aa, BK virus
QHLPYIVLVQHFH

SEQ ID NO: 32300 - protein, 13 aa, BK virus
HLPYIVLVQHFHE

SEQ ID NO: 32301 - protein, 13 aa, BK virus
LPYIVLVQHFHEL

SEQ ID NO: 32302 - protein, 13 aa, BK virus
PYIVLVQHFHELQ

SEQ ID NO: 32303 - protein, 13 aa, BK virus
YIVLVQHFHELQI

SEQ ID NO: 32304 - protein, 13 aa, BK virus
IVLVQHFHELQIL

SEQ ID NO: 32305 - protein, 13 aa, BK virus
VLVQHFHELQILN

SEQ ID NO: 32306 - protein, 13 aa, BK virus
LVQHFHELQILNP

SEQ ID NO: 32307 - protein, 13 aa, BK virus
VQHFHELQILNPF

SEQ ID NO: 32308 - protein, 13 aa, BK virus
QHFHELQILNPFY

SEQ ID NO: 32309 - protein, 13 aa, BK virus
HFHELQILNPFYL

SEQ ID NO: 32310 - protein, 13 aa, BK virus
FHELQILNPFYLI

SEQ ID NO: 32311 - protein, 13 aa, BK virus
HELQILNPFYLIY

SEQ ID NO: 32312 - protein, 13 aa, BK virus
ELQILNPFYLIYD

SEQ ID NO: 32313 - protein, 13 aa, BK virus
IFLLAFLPWSYEG

SEQ ID NO: 32314 - protein, 13 aa, BK virus
FLLAFLPWSYEGY

SEQ ID NO: 32315 - protein, 13 aa, BK virus
LLAFLPWSYEGYL

SEQ ID NO: 32316 - protein, 13 aa, BK virus
LAFLPWSYEGYLL

SEQ ID NO: 32317 - protein, 13 aa, BK virus
AFLPWSYEGYLLF

SEQ ID NO: 32318 - protein, 13 aa, BK virus
FLPWSYEGYLLFF

SEQ ID NO: 32319 - protein, 13 aa, BK virus
LKLYLLLADKYFF

SEQ ID NO: 32320 - protein, 13 aa, BK virus
KLYLLLADKYFFD

SEQ ID NO: 32321 - protein, 13 aa, BK virus
LYLLLADKYFFDF

SEQ ID NO: 32322 - protein, 13 aa, BK virus
YLLLADKYFFDFY

SEQ ID NO: 32323 - protein, 13 aa, BK virus
LLLADKYFFDFYF

SEQ ID NO: 32324 - protein, 13 aa, BK virus
LLADKYFFDFYFL

SEQ ID NO: 32325 - protein, 13 aa, BK virus
LADKYFFDFYFLQ

SEQ ID NO: 32326 - protein, 13 aa, BK virus
ADKYFFDFYFLQK

SEQ ID NO: 32327 - protein, 13 aa, BK virus
SDKAGLFSDTFYT

SEQ ID NO: 32328 - protein, 13 aa, BK virus
DKAGLFSDTFYTP

SEQ ID NO: 32329 - protein, 13 aa, BK virus
KAGLFSDTFYTPL

SEQ ID NO: 32330 - protein, 13 aa, BK virus
AGLFSDTFYTPLH

SEQ ID NO: 32331 - protein, 13 aa, BK virus
GLFSDTFYTPLHC

SEQ ID NO: 32332 - protein, 13 aa, BK virus
LFSDTFYTPLHCI

SEQ ID NO: 32333 - protein, 13 aa, BK virus
FSDTFYTPLHCIE

SEQ ID NO: 32334 - protein, 13 aa, BK virus
SDTFYTPLHCIEI

SEQ ID NO: 32335 - protein, 13 aa, BK virus
DTFYTPLHCIEIL

SEQ ID NO: 32336 - protein, 13 aa, BK virus
TFYTPLHCIEILN

SEQ ID NO: 32337 - protein, 13 aa, BK virus
FYTPLHCIEILNT

SEQ ID NO: 32338 - protein, 13 aa, BK virus
YTPLHCIEILNTY

SEQ ID NO: 32339 - protein, 13 aa, BK virus
TPLHCIEILNTYL

SEQ ID NO: 32340 - protein, 13 aa, BK virus
PLHCIEILNTYLI

SEQ ID NO: 32341 - protein, 13 aa, BK virus
LHCIEILNTYLII

SEQ ID NO: 32342 - protein, 13 aa, BK virus
HCIEILNTYLIIK

SEQ ID NO: 32343 - protein, 13 aa, BK virus
CIEILNTYLIIKT

SEQ ID NO: 32344 - protein, 13 aa, BK virus
IEILNTYLIIKTH

SEQ ID NO: 32345 - protein, 13 aa, BK virus
EILNTYLIIKTHP

SEQ ID NO: 32346 - protein, 13 aa, BK virus
ILNTYLIIKTHPH

SEQ ID NO: 32347 - protein, 13 aa, BK virus
LNTYLIIKTHPHT

SEQ ID NO: 32348 - protein, 13 aa, BK virus
NTYLIIKTHPHTL

SEQ ID NO: 32349 - protein, 13 aa, BK virus
TYLIIKTHPHTLS

SEQ ID NO: 32350 - protein, 13 aa, BK virus
YLIIKTHPHTLSL

SEQ ID NO: 32351 - protein, 13 aa, BK virus
LIIKTHPHTLSLL

SEQ ID NO: 32352 - protein, 13 aa, BK virus
IIKTHPHTLSLLH

SEQ ID NO: 32353 - protein, 13 aa, BK virus
IKTHPHTLSLLHT

SEQ ID NO: 32354 - protein, 13 aa, BK virus
KTHPHTLSLLHTQ

SEQ ID NO: 32355 - protein, 13 aa, BK virus
LISKTPALFLQAL

SEQ ID NO: 32356 - protein, 13 aa, BK virus
ISKTPALFLQALL

SEQ ID NO: 32357 - protein, 13 aa, BK virus
SKTPALFLQALLG

SEQ ID NO: 32358 - protein, 13 aa, BK virus
NHAPLSPLECFLL

SEQ ID NO: 32359 - protein, 13 aa, BK virus
LQKLYVYVELKRI

SEQ ID NO: 32360 - protein, 13 aa, BK virus
GLLPFFFFWVVLS

SEQ ID NO: 32361 - protein, 13 aa, BK virus
LLPFFFFWVVLSV

SEQ ID NO: 32362 - protein, 13 aa, BK virus
LPFFFFWVVLSVE

SEQ ID NO: 32363 - protein, 13 aa, BK virus
PFFFFWVVLSVEN

SEQ ID NO: 32364 - protein, 13 aa, BK virus
FFFFWVVLSVENL

SEQ ID NO: 32365 - protein, 13 aa, BK virus
FFFWVVLSVENLL

SEQ ID NO: 32366 - protein, 13 aa, BK virus
FFWVVLSVENLLL

SEQ ID NO: 32367 - protein, 13 aa, BK virus
FWVVLSVENLLLL

SEQ ID NO: 32368 - protein, 13 aa, BK virus
WVVLSVENLLLLL

SEQ ID NO: 32369 - protein, 13 aa, BK virus
VVLSVENLLLLLH

SEQ ID NO: 32370 - protein, 13 aa, BK virus
VLSVENLLLLLHH

SEQ ID NO: 32371 - protein, 13 aa, BK virus
LSVENLLLLLHHW

SEQ ID NO: 32372 - protein, 13 aa, BK virus
SVENLLLLLHHWQ

SEQ ID NO: 32373 - protein, 13 aa, BK virus
VENLLLLLHHWQT

SEQ ID NO: 32374 - protein, 13 aa, BK virus
ENLLLLLHHWQTY

SEQ ID NO: 32375 - protein, 13 aa, BK virus
NLLLLLHHWQTYL

SEQ ID NO: 32376 - protein, 13 aa, BK virus
LLLLLHHWQTYLH

SEQ ID NO: 32377 - protein, 13 aa, BK virus
LLLLHHWQTYLHG

SEQ ID NO: 32378 - protein, 13 aa, BK virus
LLLHHWQTYLHGK

SEQ ID NO: 32379 - protein, 13 aa, BK virus
LLHHWQTYLHGKI

SEQ ID NO: 32380 - protein, 13 aa, BK virus
LHHWQTYLHGKIN

SEQ ID NO: 32381 - protein, 13 aa, BK virus
HHWQTYLHGKINL

SEQ ID NO: 32382 - protein, 13 aa, BK virus
HWQTYLHGKINLH

SEQ ID NO: 32383 - protein, 13 aa, BK virus
WQTYLHGKINLHP

SEQ ID NO: 32384 - protein, 13 aa, BK virus
QTYLHGKINLHPI

SEQ ID NO: 32385 - protein, 13 aa, BK virus
TYLHGKINLHPIF

SEQ ID NO: 32386 - protein, 13 aa, BK virus
YLHGKINLHPIFH

SEQ ID NO: 32387 - protein, 13 aa, BK virus
RNSTRTPTLLFHR

SEQ ID NO: 32388 - protein, 13 aa, BK virus
NSTRTPTLLFHRL

SEQ ID NO: 32389 - protein, 13 aa, BK virus
STRTPTLLFHRLA

SEQ ID NO: 32390 - protein, 13 aa, BK virus
TRTPTLLFHRLAP

SEQ ID NO: 32391 - protein, 13 aa, BK virus
RTPTLLFHRLAPI

SEQ ID NO: 32392 - protein, 13 aa, BK virus
TPTLLFHRLAPIK

SEQ ID NO: 32393 - protein, 13 aa, BK virus
PTLLFHRLAPIKK

SEQ ID NO: 32394 - protein, 13 aa, BK virus
TLLFHRLAPIKKI

SEQ ID NO: 32395 - protein, 13 aa, BK virus
LLFHRLAPIKKII

SEQ ID NO: 32396 - protein, 13 aa, BK virus
LFHRLAPIKKIIT

SEQ ID NO: 32397 - protein, 13 aa, BK virus
GLLIFYYLSKYKL

SEQ ID NO: 32398 - protein, 13 aa, BK virus
LLIFYYLSKYKLV

SEQ ID NO: 32399 - protein, 13 aa, BK virus
LIFYYLSKYKLVT

SEQ ID NO: 32400 - protein, 13 aa, BK virus
IFYYLSKYKLVTL

SEQ ID NO: 32401 - protein, 13 aa, BK virus
FYYLSKYKLVTLK

SEQ ID NO: 32402 - protein, 13 aa, BK virus
YYLSKYKLVTLKL

SEQ ID NO: 32403 - protein, 13 aa, BK virus
ISEGSFSNYLDPP

SEQ ID NO: 32404 - protein, 13 aa, BK virus
SEGSFSNYLDPPL

SEQ ID NO: 32405 - protein, 13 aa, BK virus
EGSFSNYLDPPLQ

SEQ ID NO: 32406 - protein, 13 aa, BK virus
GSFSNYLDPPLQS

SEQ ID NO: 32407 - protein, 13 aa, BK virus
SFSNYLDPPLQSF

SEQ ID NO: 32408 - protein, 13 aa, BK virus
FSNYLDPPLQSFF

SEQ ID NO: 32409 - protein, 13 aa, BK virus
SNYLDPPLQSFFS

SEQ ID NO: 32410 - protein, 13 aa, BK virus
AKPLCEAVNAVAI

SEQ ID NO: 32411 - protein, 13 aa, BK virus
KPLCEAVNAVAIY

SEQ ID NO: 32412 - protein, 13 aa, BK virus
PLCEAVNAVAIYP

SEQ ID NO: 32413 - protein, 13 aa, BK virus
LCEAVNAVAIYPN

SEQ ID NO: 32414 - protein, 13 aa, BK virus
CEAVNAVAIYPNQ

SEQ ID NO: 32415 - protein, 13 aa, BK virus
EAVNAVAIYPNQG

SEQ ID NO: 32416 - protein, 13 aa, BK virus
AVNAVAIYPNQGL

SEQ ID NO: 32417 - protein, 13 aa, BK virus
VNAVAIYPNQGLF

SEQ ID NO: 32418 - protein, 13 aa, BK virus
NAVAIYPNQGLFS

SEQ ID NO: 32419 - protein, 13 aa, BK virus
HARAVHRRLFGTN

SEQ ID NO: 32420 - protein, 13 aa, BK virus
ARAVHRRLFGTNR

SEQ ID NO: 32421 - protein, 13 aa, BK virus
RAVHRRLFGTNRP

SEQ ID NO: 32422 - protein, 13 aa, BK virus
AVHRRLFGTNRPF

SEQ ID NO: 32423 - protein, 13 aa, BK virus
VHRRLFGTNRPFL

SEQ ID NO: 32424 - protein, 13 aa, BK virus
HRRLFGTNRPFLA

SEQ ID NO: 32425 - protein, 13 aa, BK virus
RRLFGTNRPFLAV

SEQ ID NO: 32426 - protein, 13 aa, BK virus
RLFGTNRPFLAVQ

SEQ ID NO: 32427 - protein, 13 aa, BK virus
LFGTNRPFLAVQG

SEQ ID NO: 32428 - protein, 13 aa, BK virus
FGTNRPFLAVQGI

SEQ ID NO: 32429 - protein, 13 aa, BK virus
GTNRPFLAVQGIW

SEQ ID NO: 32430 - protein, 13 aa, BK virus
TNRPFLAVQGIWA

SEQ ID NO: 32431 - protein, 13 aa, BK virus
NRPFLAVQGIWAK

SEQ ID NO: 32432 - protein, 13 aa, BK virus
RPFLAVQGIWAKR

SEQ ID NO: 32433 - protein, 13 aa, BK virus
PFLAVQGIWAKRK

SEQ ID NO: 32434 - protein, 13 aa, BK virus
FLAVQGIWAKRKI

SEQ ID NO: 32435 - protein, 13 aa, BK virus
LAVQGIWAKRKIS

SEQ ID NO: 32436 - protein, 13 aa, BK virus
AVQGIWAKRKIST

SEQ ID NO: 32437 - protein, 13 aa, BK virus
VQGIWAKRKISTN

SEQ ID NO: 32438 - protein, 13 aa, BK virus
QGIWAKRKISTNL

SEQ ID NO: 32439 - protein, 13 aa, BK virus
ATPGSKIRLMSYL

SEQ ID NO: 32440 - protein, 13 aa, BK virus
TPGSKIRLMSYLY

SEQ ID NO: 32441 - protein, 13 aa, BK virus
PGSKIRLMSYLYI

SEQ ID NO: 32442 - protein, 13 aa, BK virus
GSKIRLMSYLYIL

SEQ ID NO: 32443 - protein, 13 aa, BK virus
SKIRLMSYLYILL

SEQ ID NO: 32444 - protein, 13 aa, BK virus
KIRLMSYLYILLH

SEQ ID NO: 32445 - protein, 13 aa, BK virus
IRLMSYLYILLHF

SEQ ID NO: 32446 - protein, 13 aa, BK virus
RLMSYLYILLHFF

SEQ ID NO: 32447 - protein, 13 aa, BK virus
LMSYLYILLHFFI

SEQ ID NO: 32448 - protein, 13 aa, BK virus
MSYLYILLHFFIQ

SEQ ID NO: 32449 - protein, 13 aa, BK virus
SYLYILLHFFIQS

SEQ ID NO: 32450 - protein, 13 aa, BK virus
YLYILLHFFIQSI

SEQ ID NO: 32451 - protein, 13 aa, BK virus
LYILLHFFIQSIH

SEQ ID NO: 32452 - protein, 13 aa, BK virus
YILLHFFIQSIHS

SEQ ID NO: 32453 - protein, 13 aa, BK virus
ILLHFFIQSIHSL

SEQ ID NO: 32454 - protein, 13 aa, BK virus
LLHFFIQSIHSLH

SEQ ID NO: 32455 - protein, 13 aa, BK virus
LHFFIQSIHSLHF

SEQ ID NO: 32456 - protein, 13 aa, BK virus
HFFIQSIHSLHFI

SEQ ID NO: 32457 - protein, 13 aa, BK virus
FFIQSIHSLHFIL

SEQ ID NO: 32458 - protein, 13 aa, BK virus
FIQSIHSLHFILV

SEQ ID NO: 32459 - protein, 13 aa, BK virus
IQSIHSLHFILVA

SEQ ID NO: 32460 - protein, 13 aa, BK virus
QSIHSLHFILVAP

SEQ ID NO: 32461 - protein, 13 aa, BK virus
SIHSLHFILVAPF

SEQ ID NO: 32462 - protein, 13 aa, BK virus
IHSLHFILVAPFV

SEQ ID NO: 32463 - protein, 13 aa, BK virus
HSLHFILVAPFVR

SEQ ID NO: 32464 - protein, 13 aa, BK virus
SLHFILVAPFVRV

SEQ ID NO: 32465 - protein, 13 aa, BK virus
LHFILVAPFVRVK

SEQ ID NO: 32466 - protein, 13 aa, BK virus
HFILVAPFVRVKF

SEQ ID NO: 32467 - protein, 13 aa, BK virus
FILVAPFVRVKFL

SEQ ID NO: 32468 - protein, 13 aa, BK virus
ILVAPFVRVKFLT

SEQ ID NO: 32469 - protein, 14 aa, BK virus
ASEKASTPLLLERK

SEQ ID NO: 32470 - protein, 14 aa, BK virus
SEKASTPLLLERKG

SEQ ID NO: 32471 - protein, 14 aa, BK virus
EKASTPLLLERKGG

SEQ ID NO: 32472 - protein, 14 aa, BK virus
KASTPLLLERKGGG

SEQ ID NO: 32473 - protein, 14 aa, BK virus
ASTPLLLERKGGGR

SEQ ID NO: 32474 - protein, 14 aa, BK virus
STPLLLERKGGGRG

SEQ ID NO: 32475 - protein, 14 aa, BK virus
TPLLLERKGGGRGG

SEQ ID NO: 32476 - protein, 14 aa, BK virus
PLLLERKGGGRGGL

SEQ ID NO: 32477 - protein, 14 aa, BK virus
LLLERKGGGRGGLG

SEQ ID NO: 32478 - protein, 14 aa, BK virus
LLERKGGGRGGLGL

SEQ ID NO: 32479 - protein, 14 aa, BK virus
LERKGGGRGGLGLL

SEQ ID NO: 32480 - protein, 14 aa, BK virus
ERKGGGRGGLGLLY

SEQ ID NO: 32481 - protein, 14 aa, BK virus
RKGGGRGGLGLLYI

SEQ ID NO: 32482 - protein, 14 aa, BK virus
KGGGRGGLGLLYII

SEQ ID NO: 32483 - protein, 14 aa, BK virus
GGGRGGLGLLYIIK

SEQ ID NO: 32484 - protein, 14 aa, BK virus
GGRGGLGLLYIIKK

SEQ ID NO: 32485 - protein, 14 aa, BK virus
GRGGLGLLYIIKKK

SEQ ID NO: 32486 - protein, 14 aa, BK virus
RGGLGLLYIIKKKA

SEQ ID NO: 32487 - protein, 14 aa, BK virus
GGLGLLYIIKKKAT

SEQ ID NO: 32488 - protein, 14 aa, BK virus
GLGLLYIIKKKATG

SEQ ID NO: 32489 - protein, 14 aa, BK virus
LGLLYIIKKKATGR

SEQ ID NO: 32490 - protein, 14 aa, BK virus
GLLYIIKKKATGRS

SEQ ID NO: 32491 - protein, 14 aa, BK virus
LLYIIKKKATGRSC

SEQ ID NO: 32492 - protein, 14 aa, BK virus
LYIIKKKATGRSCL

SEQ ID NO: 32493 - protein, 14 aa, BK virus
YIIKKKATGRSCLP

SEQ ID NO: 32494 - protein, 14 aa, BK virus
IIKKKATGRSCLPM

SEQ ID NO: 32495 - protein, 14 aa, BK virus
IKKKATGRSCLPME

SEQ ID NO: 32496 - protein, 14 aa, BK virus
KKKATGRSCLPMEC

SEQ ID NO: 32497 - protein, 14 aa, BK virus
KKATGRSCLPMECS

SEQ ID NO: 32498 - protein, 14 aa, BK virus
KATGRSCLPMECSQ

SEQ ID NO: 32499 - protein, 14 aa, BK virus
ATGRSCLPMECSQT

SEQ ID NO: 32500 - protein, 14 aa, BK virus
TGRSCLPMECSQTM

SEQ ID NO: 32501 - protein, 14 aa, BK virus
GRSCLPMECSQTMT

SEQ ID NO: 32502 - protein, 14 aa, BK virus
RSCLPMECSQTMTS

SEQ ID NO: 32503 - protein, 14 aa, BK virus
SCLPMECSQTMTSG

SEQ ID NO: 32504 - protein, 14 aa, BK virus
CLPMECSQTMTSGR

SEQ ID NO: 32505 - protein, 14 aa, BK virus
LPMECSQTMTSGRK

SEQ ID NO: 32506 - protein, 14 aa, BK virus
PMECSQTMTSGRKV

SEQ ID NO: 32507 - protein, 14 aa, BK virus
MECSQTMTSGRKVH

SEQ ID NO: 32508 - protein, 14 aa, BK virus
ECSQTMTSGRKVHD

SEQ ID NO: 32509 - protein, 14 aa, BK virus
CSQTMTSGRKVHDS

SEQ ID NO: 32510 - protein, 14 aa, BK virus
SQTMTSGRKVHDSQ

SEQ ID NO: 32511 - protein, 14 aa, BK virus
QTMTSGRKVHDSQG

SEQ ID NO: 32512 - protein, 14 aa, BK virus
TMTSGRKVHDSQGN

SEQ ID NO: 32513 - protein, 14 aa, BK virus
MTSGRKVHDSQGNA

SEQ ID NO: 32514 - protein, 14 aa, BK virus
TSGRKVHDSQGNAA

SEQ ID NO: 32515 - protein, 14 aa, BK virus
SGRKVHDSQGNAAK

SEQ ID NO: 32516 - protein, 14 aa, BK virus
GRKVHDSQGNAAKP

SEQ ID NO: 32517 - protein, 14 aa, BK virus
PQEGKCMTHREELL

SEQ ID NO: 32518 - protein, 14 aa, BK virus
QEGKCMTHREELLT

SEQ ID NO: 32519 - protein, 14 aa, BK virus
EGKCMTHREELLTH

SEQ ID NO: 32520 - protein, 14 aa, BK virus
GKCMTHREELLTHG

SEQ ID NO: 32521 - protein, 14 aa, BK virus
KCMTHREELLTHGM

SEQ ID NO: 32522 - protein, 14 aa, BK virus
CMTHREELLTHGMQ

SEQ ID NO: 32523 - protein, 14 aa, BK virus
MTHREELLTHGMQP

SEQ ID NO: 32524 - protein, 14 aa, BK virus
THREELLTHGMQPN

SEQ ID NO: 32525 - protein, 14 aa, BK virus
HREELLTHGMQPNH

SEQ ID NO: 32526 - protein, 14 aa, BK virus
REELLTHGMQPNHD

SEQ ID NO: 32527 - protein, 14 aa, BK virus
EELLTHGMQPNHDL

SEQ ID NO: 32528 - protein, 14 aa, BK virus
ELLTHGMQPNHDLR

SEQ ID NO: 32529 - protein, 14 aa, BK virus
LLTHGMQPNHDLRK

SEQ ID NO: 32530 - protein, 14 aa, BK virus
LTHGMQPNHDLRKE

SEQ ID NO: 32531 - protein, 14 aa, BK virus
THGMQPNHDLRKES

SEQ ID NO: 32532 - protein, 14 aa, BK virus
HGMQPNHDLRKESA

SEQ ID NO: 32533 - protein, 14 aa, BK virus
QTCFASLGILALSP

SEQ ID NO: 32534 - protein, 14 aa, BK virus
TCFASLGILALSPV

SEQ ID NO: 32535 - protein, 14 aa, BK virus
CFASLGILALSPVK

SEQ ID NO: 32536 - protein, 14 aa, BK virus
FASLGILALSPVKL

SEQ ID NO: 32537 - protein, 14 aa, BK virus
ASLGILALSPVKLD

SEQ ID NO: 32538 - protein, 14 aa, BK virus
SLGILALSPVKLDK

SEQ ID NO: 32539 - protein, 14 aa, BK virus
LGILALSPVKLDKG

SEQ ID NO: 32540 - protein, 14 aa, BK virus
GILALSPVKLDKGH

SEQ ID NO: 32541 - protein, 14 aa, BK virus
ILALSPVKLDKGHG

SEQ ID NO: 32542 - protein, 14 aa, BK virus
LALSPVKLDKGHGS

SEQ ID NO: 32543 - protein, 14 aa, BK virus
ALSPVKLDKGHGSA

SEQ ID NO: 32544 - protein, 14 aa, BK virus
LSPVKLDKGHGSAP

SEQ ID NO: 32545 - protein, 14 aa, BK virus
SPVKLDKGHGSAPA

SEQ ID NO: 32546 - protein, 14 aa, BK virus
PVKLDKGHGSAPAV

SEQ ID NO: 32547 - protein, 14 aa, BK virus
VKLDKGHGSAPAVT

SEQ ID NO: 32548 - protein, 14 aa, BK virus
KLDKGHGSAPAVTT

SEQ ID NO: 32549 - protein, 14 aa, BK virus
LDKGHGSAPAVTTS

SEQ ID NO: 32550 - protein, 14 aa, BK virus
DKGHGSAPAVTTSF

SEQ ID NO: 32551 - protein, 14 aa, BK virus
KGHGSAPAVTTSFS

SEQ ID NO: 32552 - protein, 14 aa, BK virus
GHGSAPAVTTSFSE

SEQ ID NO: 32553 - protein, 14 aa, BK virus
HGSAPAVTTSFSES

SEQ ID NO: 32554 - protein, 14 aa, BK virus
GSAPAVTTSFSESW

SEQ ID NO: 32555 - protein, 14 aa, BK virus
NLDWNKKKSSEDFY

SEQ ID NO: 32556 - protein, 14 aa, BK virus
LDWNKKKSSEDFYF

SEQ ID NO: 32557 - protein, 14 aa, BK virus
DWNKKKSSEDFYFY

SEQ ID NO: 32558 - protein, 14 aa, BK virus
WNKKKSSEDFYFYF

SEQ ID NO: 32559 - protein, 14 aa, BK virus
NKKKSSEDFYFYFR

SEQ ID NO: 32560 - protein, 14 aa, BK virus
KKKSSEDFYFYFRA

SEQ ID NO: 32561 - protein, 14 aa, BK virus
KKSSEDFYFYFRAF

SEQ ID NO: 32562 - protein, 14 aa, BK virus
KSSEDFYFYFRAFA

SEQ ID NO: 32563 - protein, 14 aa, BK virus
SSEDFYFYFRAFAG

SEQ ID NO: 32564 - protein, 14 aa, BK virus
SEDFYFYFRAFAGI

SEQ ID NO: 32565 - protein, 14 aa, BK virus
EDFYFYFRAFAGIL

SEQ ID NO: 32566 - protein, 14 aa, BK virus
RQCRREKQKYHCFT

SEQ ID NO: 32567 - protein, 14 aa, BK virus
QCRREKQKYHCFTC

SEQ ID NO: 32568 - protein, 14 aa, BK virus
CRREKQKYHCFTCC

SEQ ID NO: 32569 - protein, 14 aa, BK virus
RREKQKYHCFTCCK

SEQ ID NO: 32570 - protein, 14 aa, BK virus
REKQKYHCFTCCKR

SEQ ID NO: 32571 - protein, 14 aa, BK virus
EKQKYHCFTCCKRL

SEQ ID NO: 32572 - protein, 14 aa, BK virus
KQKYHCFTCCKRLC

SEQ ID NO: 32573 - protein, 14 aa, BK virus
QKYHCFTCCKRLCK

SEQ ID NO: 32574 - protein, 14 aa, BK virus
KYHCFTCCKRLCKR

SEQ ID NO: 32575 - protein, 14 aa, BK virus
YHCFTCCKRLCKRL

SEQ ID NO: 32576 - protein, 14 aa, BK virus
HCFTCCKRLCKRLL

SEQ ID NO: 32577 - protein, 14 aa, BK virus
CFTCCKRLCKRLLG

SEQ ID NO: 32578 - protein, 14 aa, BK virus
FTCCKRLCKRLLGK

SEQ ID NO: 32579 - protein, 14 aa, BK virus
SLFFCISRFMGAAL

SEQ ID NO: 32580 - protein, 14 aa, BK virus
LFFCISRFMGAALA

SEQ ID NO: 32581 - protein, 14 aa, BK virus
FFCISRFMGAALAL

SEQ ID NO: 32582 - protein, 14 aa, BK virus
FCISRFMGAALALL

SEQ ID NO: 32583 - protein, 14 aa, BK virus
CISRFMGAALALLG

SEQ ID NO: 32584 - protein, 14 aa, BK virus
ISRFMGAALALLGD

SEQ ID NO: 32585 - protein, 14 aa, BK virus
SRFMGAALALLGDL

SEQ ID NO: 32586 - protein, 14 aa, BK virus
RFMGAALALLGDLV

SEQ ID NO: 32587 - protein, 14 aa, BK virus
FMGAALALLGDLVA

SEQ ID NO: 32588 - protein, 14 aa, BK virus
MGAALALLGDLVAS

SEQ ID NO: 32589 - protein, 14 aa, BK virus
GAALALLGDLVASV

SEQ ID NO: 32590 - protein, 14 aa, BK virus
AALALLGDLVASVS

SEQ ID NO: 32591 - protein, 14 aa, BK virus
ALALLGDLVASVSE

SEQ ID NO: 32592 - protein, 14 aa, BK virus
LALLGDLVASVSEA

SEQ ID NO: 32593 - protein, 14 aa, BK virus
ALLGDLVASVSEAA

SEQ ID NO: 32594 - protein, 14 aa, BK virus
LLGDLVASVSEAAA

SEQ ID NO: 32595 - protein, 14 aa, BK virus
LGDLVASVSEAAAA

SEQ ID NO: 32596 - protein, 14 aa, BK virus
GDLVASVSEAAAAT

SEQ ID NO: 32597 - protein, 14 aa, BK virus
DLVASVSEAAAATG

SEQ ID NO: 32598 - protein, 14 aa, BK virus
LVASVSEAAAATGF

SEQ ID NO: 32599 - protein, 14 aa, BK virus
VASVSEAAAATGFS

SEQ ID NO: 32600 - protein, 14 aa, BK virus
ASVSEAAAATGFSV

SEQ ID NO: 32601 - protein, 14 aa, BK virus
SVSEAAAATGFSVA

SEQ ID NO: 32602 - protein, 14 aa, BK virus
VSEAAAATGFSVAE

SEQ ID NO: 32603 - protein, 14 aa, BK virus
SEAAAATGFSVAEI

SEQ ID NO: 32604 - protein, 14 aa, BK virus
EAAAATGFSVAEIA

SEQ ID NO: 32605 - protein, 14 aa, BK virus
AAAATGFSVAEIAA

SEQ ID NO: 32606 - protein, 14 aa, BK virus
AAATGFSVAEIAAG

SEQ ID NO: 32607 - protein, 14 aa, BK virus
AATGFSVAEIAAGE

SEQ ID NO: 32608 - protein, 14 aa, BK virus
ATGFSVAEIAAGEA

SEQ ID NO: 32609 - protein, 14 aa, BK virus
TGFSVAEIAAGEAA

SEQ ID NO: 32610 - protein, 14 aa, BK virus
GFSVAEIAAGEAAA

SEQ ID NO: 32611 - protein, 14 aa, BK virus
FSVAEIAAGEAAAA

SEQ ID NO: 32612 - protein, 14 aa, BK virus
SVAEIAAGEAAAAI

SEQ ID NO: 32613 - protein, 14 aa, BK virus
VAEIAAGEAAAAIE

SEQ ID NO: 32614 - protein, 14 aa, BK virus
AEIAAGEAAAAIEV

SEQ ID NO: 32615 - protein, 14 aa, BK virus
EIAAGEAAAAIEVQ

SEQ ID NO: 32616 - protein, 14 aa, BK virus
IAAGEAAAAIEVQI

SEQ ID NO: 32617 - protein, 14 aa, BK virus
AAGEAAAAIEVQIA

SEQ ID NO: 32618 - protein, 14 aa, BK virus
AGEAAAAIEVQIAS

SEQ ID NO: 32619 - protein, 14 aa, BK virus
GEAAAAIEVQIASL

SEQ ID NO: 32620 - protein, 14 aa, BK virus
EAAAAIEVQIASLA

SEQ ID NO: 32621 - protein, 14 aa, BK virus
AAAAIEVQIASLAT

SEQ ID NO: 32622 - protein, 14 aa, BK virus
AAAIEVQIASLATV

SEQ ID NO: 32623 - protein, 14 aa, BK virus
AAIEVQIASLATVE

SEQ ID NO: 32624 - protein, 14 aa, BK virus
AIEVQIASLATVEG

SEQ ID NO: 32625 - protein, 14 aa, BK virus
IEVQIASLATVEGI

SEQ ID NO: 32626 - protein, 14 aa, BK virus
EVQIASLATVEGIT

SEQ ID NO: 32627 - protein, 14 aa, BK virus
VQIASLATVEGITS

SEQ ID NO: 32628 - protein, 14 aa, BK virus
QIASLATVEGITST

SEQ ID NO: 32629 - protein, 14 aa, BK virus
IASLATVEGITSTS

SEQ ID NO: 32630 - protein, 14 aa, BK virus
ASLATVEGITSTSE

SEQ ID NO: 32631 - protein, 14 aa, BK virus
SLATVEGITSTSEA

SEQ ID NO: 32632 - protein, 14 aa, BK virus
LATVEGITSTSEAI

SEQ ID NO: 32633 - protein, 14 aa, BK virus
ATVEGITSTSEAIA

SEQ ID NO: 32634 - protein, 14 aa, BK virus
TVEGITSTSEAIAA

SEQ ID NO: 32635 - protein, 14 aa, BK virus
VEGITSTSEAIAAI

SEQ ID NO: 32636 - protein, 14 aa, BK virus
EGITSTSEAIAAIG

SEQ ID NO: 32637 - protein, 14 aa, BK virus
GITSTSEAIAAIGL

SEQ ID NO: 32638 - protein, 14 aa, BK virus
ITSTSEAIAAIGLT

SEQ ID NO: 32639 - protein, 14 aa, BK virus
TSTSEAIAAIGLTP

SEQ ID NO: 32640 - protein, 14 aa, BK virus
STSEAIAAIGLTPQ

SEQ ID NO: 32641 - protein, 14 aa, BK virus
TSEAIAAIGLTPQT

SEQ ID NO: 32642 - protein, 14 aa, BK virus
SEAIAAIGLTPQTY

SEQ ID NO: 32643 - protein, 14 aa, BK virus
EAIAAIGLTPQTYA

SEQ ID NO: 32644 - protein, 14 aa, BK virus
AIAAIGLTPQTYAV

SEQ ID NO: 32645 - protein, 14 aa, BK virus
IAAIGLTPQTYAVI

SEQ ID NO: 32646 - protein, 14 aa, BK virus
AAIGLTPQTYAVIA

SEQ ID NO: 32647 - protein, 14 aa, BK virus
AIGLTPQTYAVIAG

SEQ ID NO: 32648 - protein, 14 aa, BK virus
IGLTPQTYAVIAGA

SEQ ID NO: 32649 - protein, 14 aa, BK virus
GLTPQTYAVIAGAP

SEQ ID NO: 32650 - protein, 14 aa, BK virus
LTPQTYAVIAGAPG

SEQ ID NO: 32651 - protein, 14 aa, BK virus
TPQTYAVIAGAPGA

SEQ ID NO: 32652 - protein, 14 aa, BK virus
PQTYAVIAGAPGAI

SEQ ID NO: 32653 - protein, 14 aa, BK virus
QTYAVIAGAPGAIA

SEQ ID NO: 32654 - protein, 14 aa, BK virus
TYAVIAGAPGAIAG

SEQ ID NO: 32655 - protein, 14 aa, BK virus
YAVIAGAPGAIAGF

SEQ ID NO: 32656 - protein, 14 aa, BK virus
AVIAGAPGAIAGFA

SEQ ID NO: 32657 - protein, 14 aa, BK virus
VIAGAPGAIAGFAA

SEQ ID NO: 32658 - protein, 14 aa, BK virus
IAGAPGAIAGFAAL

SEQ ID NO: 32659 - protein, 14 aa, BK virus
AGAPGAIAGFAALI

SEQ ID NO: 32660 - protein, 14 aa, BK virus
GAPGAIAGFAALIQ

SEQ ID NO: 32661 - protein, 14 aa, BK virus
APGAIAGFAALIQT

SEQ ID NO: 32662 - protein, 14 aa, BK virus
PGAIAGFAALIQTV

SEQ ID NO: 32663 - protein, 14 aa, BK virus
GAIAGFAALIQTVS

SEQ ID NO: 32664 - protein, 14 aa, BK virus
AIAGFAALIQTVSG

SEQ ID NO: 32665 - protein, 14 aa, BK virus
IAGFAALIQTVSGI

SEQ ID NO: 32666 - protein, 14 aa, BK virus
AGFAALIQTVSGIS

SEQ ID NO: 32667 - protein, 14 aa, BK virus
GFAALIQTVSGISS

SEQ ID NO: 32668 - protein, 14 aa, BK virus
FAALIQTVSGISSL

SEQ ID NO: 32669 - protein, 14 aa, BK virus
AALIQTVSGISSLA

SEQ ID NO: 32670 - protein, 14 aa, BK virus
ALIQTVSGISSLAQ

SEQ ID NO: 32671 - protein, 14 aa, BK virus
LIQTVSGISSLAQV

SEQ ID NO: 32672 - protein, 14 aa, BK virus
IQTVSGISSLAQVG

SEQ ID NO: 32673 - protein, 14 aa, BK virus
QTVSGISSLAQVGY

SEQ ID NO: 32674 - protein, 14 aa, BK virus
TVSGISSLAQVGYK

SEQ ID NO: 32675 - protein, 14 aa, BK virus
VSGISSLAQVGYKF

SEQ ID NO: 32676 - protein, 14 aa, BK virus
SGISSLAQVGYKFF

SEQ ID NO: 32677 - protein, 14 aa, BK virus
GISSLAQVGYKFFD

SEQ ID NO: 32678 - protein, 14 aa, BK virus
ISSLAQVGYKFFDD

SEQ ID NO: 32679 - protein, 14 aa, BK virus
SSLAQVGYKFFDDW

SEQ ID NO: 32680 - protein, 14 aa, BK virus
SLAQVGYKFFDDWD

SEQ ID NO: 32681 - protein, 14 aa, BK virus
LAQVGYKFFDDWDH

SEQ ID NO: 32682 - protein, 14 aa, BK virus
AQVGYKFFDDWDHK

SEQ ID NO: 32683 - protein, 14 aa, BK virus
QVGYKFFDDWDHKV

SEQ ID NO: 32684 - protein, 14 aa, BK virus
VGYKFFDDWDHKVS

SEQ ID NO: 32685 - protein, 14 aa, BK virus
GYKFFDDWDHKVST

SEQ ID NO: 32686 - protein, 14 aa, BK virus
YKFFDDWDHKVSTV

SEQ ID NO: 32687 - protein, 14 aa, BK virus
KFFDDWDHKVSTVG

SEQ ID NO: 32688 - protein, 14 aa, BK virus
FFDDWDHKVSTVGL

SEQ ID NO: 32689 - protein, 14 aa, BK virus
FDDWDHKVSTVGLY

SEQ ID NO: 32690 - protein, 14 aa, BK virus
DDWDHKVSTVGLYQ

SEQ ID NO: 32691 - protein, 14 aa, BK virus
DWDHKVSTVGLYQQ

SEQ ID NO: 32692 - protein, 14 aa, BK virus
WDHKVSTVGLYQQS

SEQ ID NO: 32693 - protein, 14 aa, BK virus
DHKVSTVGLYQQSG

SEQ ID NO: 32694 - protein, 14 aa, BK virus
HKVSTVGLYQQSGM

SEQ ID NO: 32695 - protein, 14 aa, BK virus
KVSTVGLYQQSGMA

SEQ ID NO: 32696 - protein, 14 aa, BK virus
VSTVGLYQQSGMAL

SEQ ID NO: 32697 - protein, 14 aa, BK virus
STVGLYQQSGMALE

SEQ ID NO: 32698 - protein, 14 aa, BK virus
TVGLYQQSGMALEL

SEQ ID NO: 32699 - protein, 14 aa, BK virus
VGLYQQSGMALELF

SEQ ID NO: 32700 - protein, 14 aa, BK virus
GLYQQSGMALELFN

SEQ ID NO: 32701 - protein, 14 aa, BK virus
LYQQSGMALELFNP

SEQ ID NO: 32702 - protein, 14 aa, BK virus
YQQSGMALELFNPD

SEQ ID NO: 32703 - protein, 14 aa, BK virus
QQSGMALELFNPDE

SEQ ID NO: 32704 - protein, 14 aa, BK virus
QSGMALELFNPDEY

SEQ ID NO: 32705 - protein, 14 aa, BK virus
SGMALELFNPDEYY

SEQ ID NO: 32706 - protein, 14 aa, BK virus
GMALELFNPDEYYD

SEQ ID NO: 32707 - protein, 14 aa, BK virus
MALELFNPDEYYDI

SEQ ID NO: 32708 - protein, 14 aa, BK virus
ALELFNPDEYYDIL

SEQ ID NO: 32709 - protein, 14 aa, BK virus
LELFNPDEYYDILF

SEQ ID NO: 32710 - protein, 14 aa, BK virus
ELFNPDEYYDILFP

SEQ ID NO: 32711 - protein, 14 aa, BK virus
LFNPDEYYDILFPG

SEQ ID NO: 32712 - protein, 14 aa, BK virus
FNPDEYYDILFPGV

SEQ ID NO: 32713 - protein, 14 aa, BK virus
NPDEYYDILFPGVN

SEQ ID NO: 32714 - protein, 14 aa, BK virus
PDEYYDILFPGVNT

SEQ ID NO: 32715 - protein, 14 aa, BK virus
DEYYDILFPGVNTF

SEQ ID NO: 32716 - protein, 14 aa, BK virus
EYYDILFPGVNTFV

SEQ ID NO: 32717 - protein, 14 aa, BK virus
YYDILFPGVNTFVN

SEQ ID NO: 32718 - protein, 14 aa, BK virus
YDILFPGVNTFVNN

SEQ ID NO: 32719 - protein, 14 aa, BK virus
DILFPGVNTFVNNI

SEQ ID NO: 32720 - protein, 14 aa, BK virus
ILFPGVNTFVNNIQ

SEQ ID NO: 32721 - protein, 14 aa, BK virus
LFPGVNTFVNNIQY

SEQ ID NO: 32722 - protein, 14 aa, BK virus
FPGVNTFVNNIQYL

SEQ ID NO: 32723 - protein, 14 aa, BK virus
PGVNTFVNNIQYLD

SEQ ID NO: 32724 - protein, 14 aa, BK virus
GVNTFVNNIQYLDP

SEQ ID NO: 32725 - protein, 14 aa, BK virus
VNTFVNNIQYLDPR

SEQ ID NO: 32726 - protein, 14 aa, BK virus
NTFVNNIQYLDPRH

SEQ ID NO: 32727 - protein, 14 aa, BK virus
TFVNNIQYLDPRHW

SEQ ID NO: 32728 - protein, 14 aa, BK virus
FVNNIQYLDPRHWG

SEQ ID NO: 32729 - protein, 14 aa, BK virus
VNNIQYLDPRHWGP

SEQ ID NO: 32730 - protein, 14 aa, BK virus
NNIQYLDPRHWGPS

SEQ ID NO: 32731 - protein, 14 aa, BK virus
NIQYLDPRHWGPSL

SEQ ID NO: 32732 - protein, 14 aa, BK virus
IQYLDPRHWGPSLF

SEQ ID NO: 32733 - protein, 14 aa, BK virus
QYLDPRHWGPSLFA

SEQ ID NO: 32734 - protein, 14 aa, BK virus
YLDPRHWGPSLFAT

SEQ ID NO: 32735 - protein, 14 aa, BK virus
LDPRHWGPSLFATI

SEQ ID NO: 32736 - protein, 14 aa, BK virus
DPRHWGPSLFATIS

SEQ ID NO: 32737 - protein, 14 aa, BK virus
PRHWGPSLFATISQ

SEQ ID NO: 32738 - protein, 14 aa, BK virus
RHWGPSLFATISQA

SEQ ID NO: 32739 - protein, 14 aa, BK virus
HWGPSLFATISQAL

SEQ ID NO: 32740 - protein, 14 aa, BK virus
WGPSLFATISQALW

SEQ ID NO: 32741 - protein, 14 aa, BK virus
GPSLFATISQALWH

SEQ ID NO: 32742 - protein, 14 aa, BK virus
PSLFATISQALWHV

SEQ ID NO: 32743 - protein, 14 aa, BK virus
SLFATISQALWHVI

SEQ ID NO: 32744 - protein, 14 aa, BK virus
LFATISQALWHVIR

SEQ ID NO: 32745 - protein, 14 aa, BK virus
FATISQALWHVIRD

SEQ ID NO: 32746 - protein, 14 aa, BK virus
ATISQALWHVIRDD

SEQ ID NO: 32747 - protein, 14 aa, BK virus
TISQALWHVIRDDI

SEQ ID NO: 32748 - protein, 14 aa, BK virus
ISQALWHVIRDDIP

SEQ ID NO: 32749 - protein, 14 aa, BK virus
SQALWHVIRDDIPS

SEQ ID NO: 32750 - protein, 14 aa, BK virus
QALWHVIRDDIPSI

SEQ ID NO: 32751 - protein, 14 aa, BK virus
ALWHVIRDDIPSIT

SEQ ID NO: 32752 - protein, 14 aa, BK virus
LWHVIRDDIPSITS

SEQ ID NO: 32753 - protein, 14 aa, BK virus
WHVIRDDIPSITSQ

SEQ ID NO: 32754 - protein, 14 aa, BK virus
HVIRDDIPSITSQE

SEQ ID NO: 32755 - protein, 14 aa, BK virus
VIRDDIPSITSQEL

SEQ ID NO: 32756 - protein, 14 aa, BK virus
IRDDIPSITSQELQ

SEQ ID NO: 32757 - protein, 14 aa, BK virus
RDDIPSITSQELQR

SEQ ID NO: 32758 - protein, 14 aa, BK virus
DDIPSITSQELQRR

SEQ ID NO: 32759 - protein, 14 aa, BK virus
DIPSITSQELQRRT

SEQ ID NO: 32760 - protein, 14 aa, BK virus
IPSITSQELQRRTE

SEQ ID NO: 32761 - protein, 14 aa, BK virus
PSITSQELQRRTER

SEQ ID NO: 32762 - protein, 14 aa, BK virus
SITSQELQRRTERF

SEQ ID NO: 32763 - protein, 14 aa, BK virus
ITSQELQRRTERFF

SEQ ID NO: 32764 - protein, 14 aa, BK virus
TSQELQRRTERFFR

SEQ ID NO: 32765 - protein, 14 aa, BK virus
SQELQRRTERFFRD

SEQ ID NO: 32766 - protein, 14 aa, BK virus
QELQRRTERFFRDS

SEQ ID NO: 32767 - protein, 14 aa, BK virus
ELQRRTERFFRDSL

SEQ ID NO: 32768 - protein, 14 aa, BK virus
LQRRTERFFRDSLA

SEQ ID NO: 32769 - protein, 14 aa, BK virus
QRRTERFFRDSLAR

SEQ ID NO: 32770 - protein, 14 aa, BK virus
RRTERFFRDSLARF

SEQ ID NO: 32771 - protein, 14 aa, BK virus
RTERFFRDSLARFL

SEQ ID NO: 32772 - protein, 14 aa, BK virus
TERFFRDSLARFLE

SEQ ID NO: 32773 - protein, 14 aa, BK virus
ERFFRDSLARFLEE

SEQ ID NO: 32774 - protein, 14 aa, BK virus
RFFRDSLARFLEET

SEQ ID NO: 32775 - protein, 14 aa, BK virus
FFRDSLARFLEETT

SEQ ID NO: 32776 - protein, 14 aa, BK virus
FRDSLARFLEETTW

SEQ ID NO: 32777 - protein, 14 aa, BK virus
RDSLARFLEETTWT

SEQ ID NO: 32778 - protein, 14 aa, BK virus
DSLARFLEETTWTI

SEQ ID NO: 32779 - protein, 14 aa, BK virus
SLARFLEETTWTIV

SEQ ID NO: 32780 - protein, 14 aa, BK virus
LARFLEETTWTIVN

SEQ ID NO: 32781 - protein, 14 aa, BK virus
ARFLEETTWTIVNA

SEQ ID NO: 32782 - protein, 14 aa, BK virus
RFLEETTWTIVNAP

SEQ ID NO: 32783 - protein, 14 aa, BK virus
FLEETTWTIVNAPI

SEQ ID NO: 32784 - protein, 14 aa, BK virus
LEETTWTIVNAPIN

SEQ ID NO: 32785 - protein, 14 aa, BK virus
EETTWTIVNAPINF

SEQ ID NO: 32786 - protein, 14 aa, BK virus
ETTWTIVNAPINFY

SEQ ID NO: 32787 - protein, 14 aa, BK virus
TTWTIVNAPINFYN

SEQ ID NO: 32788 - protein, 14 aa, BK virus
TWTIVNAPINFYNY

SEQ ID NO: 32789 - protein, 14 aa, BK virus
WTIVNAPINFYNYI

SEQ ID NO: 32790 - protein, 14 aa, BK virus
TIVNAPINFYNYIQ

SEQ ID NO: 32791 - protein, 14 aa, BK virus
IVNAPINFYNYIQQ

SEQ ID NO: 32792 - protein, 14 aa, BK virus
VNAPINFYNYIQQY

SEQ ID NO: 32793 - protein, 14 aa, BK virus
NAPINFYNYIQQYY

SEQ ID NO: 32794 - protein, 14 aa, BK virus
APINFYNYIQQYYS

SEQ ID NO: 32795 - protein, 14 aa, BK virus
PINFYNYIQQYYSD

SEQ ID NO: 32796 - protein, 14 aa, BK virus
INFYNYIQQYYSDL

SEQ ID NO: 32797 - protein, 14 aa, BK virus
NFYNYIQQYYSDLS

SEQ ID NO: 32798 - protein, 14 aa, BK virus
FYNYIQQYYSDLSP

SEQ ID NO: 32799 - protein, 14 aa, BK virus
YNYIQQYYSDLSPI

SEQ ID NO: 32800 - protein, 14 aa, BK virus
NYIQQYYSDLSPIR

SEQ ID NO: 32801 - protein, 14 aa, BK virus
YIQQYYSDLSPIRP

SEQ ID NO: 32802 - protein, 14 aa, BK virus
IQQYYSDLSPIRPS

SEQ ID NO: 32803 - protein, 14 aa, BK virus
QQYYSDLSPIRPSM

SEQ ID NO: 32804 - protein, 14 aa, BK virus
QYYSDLSPIRPSMV

SEQ ID NO: 32805 - protein, 14 aa, BK virus
YYSDLSPIRPSMVR

SEQ ID NO: 32806 - protein, 14 aa, BK virus
YSDLSPIRPSMVRQ

SEQ ID NO: 32807 - protein, 14 aa, BK virus
SDLSPIRPSMVRQV

SEQ ID NO: 32808 - protein, 14 aa, BK virus
DLSPIRPSMVRQVA

SEQ ID NO: 32809 - protein, 14 aa, BK virus
LSPIRPSMVRQVAE

SEQ ID NO: 32810 - protein, 14 aa, BK virus
SPIRPSMVRQVAER

SEQ ID NO: 32811 - protein, 14 aa, BK virus
PIRPSMVRQVAERE

SEQ ID NO: 32812 - protein, 14 aa, BK virus
IRPSMVRQVAEREG

SEQ ID NO: 32813 - protein, 14 aa, BK virus
RPSMVRQVAEREGT

SEQ ID NO: 32814 - protein, 14 aa, BK virus
PSMVRQVAEREGTR

SEQ ID NO: 32815 - protein, 14 aa, BK virus
SMVRQVAEREGTRV

SEQ ID NO: 32816 - protein, 14 aa, BK virus
MVRQVAEREGTRVH

SEQ ID NO: 32817 - protein, 14 aa, BK virus
VRQVAEREGTRVHF

SEQ ID NO: 32818 - protein, 14 aa, BK virus
RQVAEREGTRVHFG

SEQ ID NO: 32819 - protein, 14 aa, BK virus
QVAEREGTRVHFGH

SEQ ID NO: 32820 - protein, 14 aa, BK virus
VAEREGTRVHFGHT

SEQ ID NO: 32821 - protein, 14 aa, BK virus
AEREGTRVHFGHTY

SEQ ID NO: 32822 - protein, 14 aa, BK virus
EREGTRVHFGHTYS

SEQ ID NO: 32823 - protein, 14 aa, BK virus
REGTRVHFGHTYSI

SEQ ID NO: 32824 - protein, 14 aa, BK virus
EGTRVHFGHTYSID

SEQ ID NO: 32825 - protein, 14 aa, BK virus
GTRVHFGHTYSIDD

SEQ ID NO: 32826 - protein, 14 aa, BK virus
TRVHFGHTYSIDDA

SEQ ID NO: 32827 - protein, 14 aa, BK virus
RVHFGHTYSIDDAD

SEQ ID NO: 32828 - protein, 14 aa, BK virus
VHFGHTYSIDDADS

SEQ ID NO: 32829 - protein, 14 aa, BK virus
HFGHTYSIDDADSI

SEQ ID NO: 32830 - protein, 14 aa, BK virus
FGHTYSIDDADSIE

SEQ ID NO: 32831 - protein, 14 aa, BK virus
GHTYSIDDADSIEE

SEQ ID NO: 32832 - protein, 14 aa, BK virus
HTYSIDDADSIEEV

SEQ ID NO: 32833 - protein, 14 aa, BK virus
TYSIDDADSIEEVT

SEQ ID NO: 32834 - protein, 14 aa, BK virus
YSIDDADSIEEVTQ

SEQ ID NO: 32835 - protein, 14 aa, BK virus
SIDDADSIEEVTQR

SEQ ID NO: 32836 - protein, 14 aa, BK virus
IDDADSIEEVTQRM

SEQ ID NO: 32837 - protein, 14 aa, BK virus
DDADSIEEVTQRMD

SEQ ID NO: 32838 - protein, 14 aa, BK virus
DADSIEEVTQRMDL

SEQ ID NO: 32839 - protein, 14 aa, BK virus
ADSIEEVTQRMDLR

SEQ ID NO: 32840 - protein, 14 aa, BK virus
DSIEEVTQRMDLRN

SEQ ID NO: 32841 - protein, 14 aa, BK virus
SIEEVTQRMDLRNQ

SEQ ID NO: 32842 - protein, 14 aa, BK virus
IEEVTQRMDLRNQQ

SEQ ID NO: 32843 - protein, 14 aa, BK virus
EEVTQRMDLRNQQS

SEQ ID NO: 32844 - protein, 14 aa, BK virus
EVTQRMDLRNQQSV

SEQ ID NO: 32845 - protein, 14 aa, BK virus
VTQRMDLRNQQSVH

SEQ ID NO: 32846 - protein, 14 aa, BK virus
TQRMDLRNQQSVHS

SEQ ID NO: 32847 - protein, 14 aa, BK virus
QRMDLRNQQSVHSG

SEQ ID NO: 32848 - protein, 14 aa, BK virus
RMDLRNQQSVHSGE

SEQ ID NO: 32849 - protein, 14 aa, BK virus
MDLRNQQSVHSGEF

SEQ ID NO: 32850 - protein, 14 aa, BK virus
DLRNQQSVHSGEFI

SEQ ID NO: 32851 - protein, 14 aa, BK virus
LRNQQSVHSGEFIE

SEQ ID NO: 32852 - protein, 14 aa, BK virus
RNQQSVHSGEFIEK

SEQ ID NO: 32853 - protein, 14 aa, BK virus
NQQSVHSGEFIEKT

SEQ ID NO: 32854 - protein, 14 aa, BK virus
QQSVHSGEFIEKTI

SEQ ID NO: 32855 - protein, 14 aa, BK virus
QSVHSGEFIEKTIA

SEQ ID NO: 32856 - protein, 14 aa, BK virus
SVHSGEFIEKTIAP

SEQ ID NO: 32857 - protein, 14 aa, BK virus
VHSGEFIEKTIAPG

SEQ ID NO: 32858 - protein, 14 aa, BK virus
HSGEFIEKTIAPGG

SEQ ID NO: 32859 - protein, 14 aa, BK virus
SGEFIEKTIAPGGA

SEQ ID NO: 32860 - protein, 14 aa, BK virus
GEFIEKTIAPGGAN

SEQ ID NO: 32861 - protein, 14 aa, BK virus
EFIEKTIAPGGANQ

SEQ ID NO: 32862 - protein, 14 aa, BK virus
FIEKTIAPGGANQR

SEQ ID NO: 32863 - protein, 14 aa, BK virus
IEKTIAPGGANQRT

SEQ ID NO: 32864 - protein, 14 aa, BK virus
EKTIAPGGANQRTA

SEQ ID NO: 32865 - protein, 14 aa, BK virus
KTIAPGGANQRTAP

SEQ ID NO: 32866 - protein, 14 aa, BK virus
TIAPGGANQRTAPQ

SEQ ID NO: 32867 - protein, 14 aa, BK virus
IAPGGANQRTAPQW

SEQ ID NO: 32868 - protein, 14 aa, BK virus
APGGANQRTAPQWM

SEQ ID NO: 32869 - protein, 14 aa, BK virus
PGGANQRTAPQWML

SEQ ID NO: 32870 - protein, 14 aa, BK virus
GGANQRTAPQWMLP

SEQ ID NO: 32871 - protein, 14 aa, BK virus
GANQRTAPQWMLPL

SEQ ID NO: 32872 - protein, 14 aa, BK virus
ANQRTAPQWMLPLL

SEQ ID NO: 32873 - protein, 14 aa, BK virus
NQRTAPQWMLPLLL

SEQ ID NO: 32874 - protein, 14 aa, BK virus
QRTAPQWMLPLLLG

SEQ ID NO: 32875 - protein, 14 aa, BK virus
RTAPQWMLPLLLGL

SEQ ID NO: 32876 - protein, 14 aa, BK virus
TAPQWMLPLLLGLY

SEQ ID NO: 32877 - protein, 14 aa, BK virus
APQWMLPLLLGLYG

SEQ ID NO: 32878 - protein, 14 aa, BK virus
PQWMLPLLLGLYGT

SEQ ID NO: 32879 - protein, 14 aa, BK virus
QWMLPLLLGLYGTV

SEQ ID NO: 32880 - protein, 14 aa, BK virus
WMLPLLLGLYGTVT

SEQ ID NO: 32881 - protein, 14 aa, BK virus
MLPLLLGLYGTVTP

SEQ ID NO: 32882 - protein, 14 aa, BK virus
LPLLLGLYGTVTPA

SEQ ID NO: 32883 - protein, 14 aa, BK virus
PLLLGLYGTVTPAL

SEQ ID NO: 32884 - protein, 14 aa, BK virus
LLLGLYGTVTPALE

SEQ ID NO: 32885 - protein, 14 aa, BK virus
LLGLYGTVTPALEA

SEQ ID NO: 32886 - protein, 14 aa, BK virus
LGLYGTVTPALEAY

SEQ ID NO: 32887 - protein, 14 aa, BK virus
GLYGTVTPALEAYE

SEQ ID NO: 32888 - protein, 14 aa, BK virus
LYGTVTPALEAYED

SEQ ID NO: 32889 - protein, 14 aa, BK virus
YGTVTPALEAYEDG

SEQ ID NO: 32890 - protein, 14 aa, BK virus
GTVTPALEAYEDGP

SEQ ID NO: 32891 - protein, 14 aa, BK virus
TVTPALEAYEDGPN

SEQ ID NO: 32892 - protein, 14 aa, BK virus
VTPALEAYEDGPNQ

SEQ ID NO: 32893 - protein, 14 aa, BK virus
TPALEAYEDGPNQK

SEQ ID NO: 32894 - protein, 14 aa, BK virus
PALEAYEDGPNQKK

SEQ ID NO: 32895 - protein, 14 aa, BK virus
ALEAYEDGPNQKKR

SEQ ID NO: 32896 - protein, 14 aa, BK virus
LEAYEDGPNQKKRR

SEQ ID NO: 32897 - protein, 14 aa, BK virus
EAYEDGPNQKKRRV

SEQ ID NO: 32898 - protein, 14 aa, BK virus
AYEDGPNQKKRRVS

SEQ ID NO: 32899 - protein, 14 aa, BK virus
YEDGPNQKKRRVSR

SEQ ID NO: 32900 - protein, 14 aa, BK virus
EDGPNQKKRRVSRG

SEQ ID NO: 32901 - protein, 14 aa, BK virus
DGPNQKKRRVSRGS

SEQ ID NO: 32902 - protein, 14 aa, BK virus
GPNQKKRRVSRGSS

SEQ ID NO: 32903 - protein, 14 aa, BK virus
PNQKKRRVSRGSSQ

SEQ ID NO: 32904 - protein, 14 aa, BK virus
NQKKRRVSRGSSQK

SEQ ID NO: 32905 - protein, 14 aa, BK virus
QKKRRVSRGSSQKA

SEQ ID NO: 32906 - protein, 14 aa, BK virus
KKRRVSRGSSQKAK

SEQ ID NO: 32907 - protein, 14 aa, BK virus
KRRVSRGSSQKAKG

SEQ ID NO: 32908 - protein, 14 aa, BK virus
RRVSRGSSQKAKGT

SEQ ID NO: 32909 - protein, 14 aa, BK virus
RVSRGSSQKAKGTR

SEQ ID NO: 32910 - protein, 14 aa, BK virus
VSRGSSQKAKGTRA

SEQ ID NO: 32911 - protein, 14 aa, BK virus
SRGSSQKAKGTRAS

SEQ ID NO: 32912 - protein, 14 aa, BK virus
RGSSQKAKGTRASA

SEQ ID NO: 32913 - protein, 14 aa, BK virus
GSSQKAKGTRASAK

SEQ ID NO: 32914 - protein, 14 aa, BK virus
SSQKAKGTRASAKT

SEQ ID NO: 32915 - protein, 14 aa, BK virus
SQKAKGTRASAKTT

SEQ ID NO: 32916 - protein, 14 aa, BK virus
QKAKGTRASAKTTN

SEQ ID NO: 32917 - protein, 14 aa, BK virus
KAKGTRASAKTTNK

SEQ ID NO: 32918 - protein, 14 aa, BK virus
AKGTRASAKTTNKR

SEQ ID NO: 32919 - protein, 14 aa, BK virus
KGTRASAKTTNKRR

SEQ ID NO: 32920 - protein, 14 aa, BK virus
GTRASAKTTNKRRS

SEQ ID NO: 32921 - protein, 14 aa, BK virus
TRASAKTTNKRRSR

SEQ ID NO: 32922 - protein, 14 aa, BK virus
RASAKTTNKRRSRS

SEQ ID NO: 32923 - protein, 14 aa, BK virus
ASAKTTNKRRSRSS

SEQ ID NO: 32924 - protein, 14 aa, BK virus
SAKTTNKRRSRSSR

SEQ ID NO: 32925 - protein, 14 aa, BK virus
AKTTNKRRSRSSRS

SEQ ID NO: 32926 - protein, 14 aa, BK virus
NWGRCYYRGRMLPK

SEQ ID NO: 32927 - protein, 14 aa, BK virus
WGRCYYRGRMLPKP

SEQ ID NO: 32928 - protein, 14 aa, BK virus
GRCYYRGRMLPKPR

SEQ ID NO: 32929 - protein, 14 aa, BK virus
RCYYRGRMLPKPRN

SEQ ID NO: 32930 - protein, 14 aa, BK virus
CYYRGRMLPKPRNG

SEQ ID NO: 32931 - protein, 14 aa, BK virus
YYRGRMLPKPRNGG

SEQ ID NO: 32932 - protein, 14 aa, BK virus
YRGRMLPKPRNGGS

SEQ ID NO: 32933 - protein, 14 aa, BK virus
RGRMLPKPRNGGSR

SEQ ID NO: 32934 - protein, 14 aa, BK virus
PREKNASLLQHSKN

SEQ ID NO: 32935 - protein, 14 aa, BK virus
REKNASLLQHSKNS

SEQ ID NO: 32936 - protein, 14 aa, BK virus
EKNASLLQHSKNSP

SEQ ID NO: 32937 - protein, 14 aa, BK virus
KNASLLQHSKNSPP

SEQ ID NO: 32938 - protein, 14 aa, BK virus
NASLLQHSKNSPPQ

SEQ ID NO: 32939 - protein, 14 aa, BK virus
ASLLQHSKNSPPQF

SEQ ID NO: 32940 - protein, 14 aa, BK virus
SLLQHSKNSPPQFK

SEQ ID NO: 32941 - protein, 14 aa, BK virus
GPNLWKSTDVGGCN

SEQ ID NO: 32942 - protein, 14 aa, BK virus
PNLWKSTDVGGCNC

SEQ ID NO: 32943 - protein, 14 aa, BK virus
NLWKSTDVGGCNCT

SEQ ID NO: 32944 - protein, 14 aa, BK virus
LWKSTDVGGCNCTN

SEQ ID NO: 32945 - protein, 14 aa, BK virus
WKSTDVGGCNCTNR

SEQ ID NO: 32946 - protein, 14 aa, BK virus
KSTDVGGCNCTNRG

SEQ ID NO: 32947 - protein, 14 aa, BK virus
STDVGGCNCTNRGY

SEQ ID NO: 32948 - protein, 14 aa, BK virus
TDVGGCNCTNRGYW

SEQ ID NO: 32949 - protein, 14 aa, BK virus
DVGGCNCTNRGYWN

SEQ ID NO: 32950 - protein, 14 aa, BK virus
VGGCNCTNRGYWNN

SEQ ID NO: 32951 - protein, 14 aa, BK virus
FPLLCCRWRTLGNA

SEQ ID NO: 32952 - protein, 14 aa, BK virus
PLLCCRWRTLGNAG

SEQ ID NO: 32953 - protein, 14 aa, BK virus
LLCCRWRTLGNAGS

SEQ ID NO: 32954 - protein, 14 aa, BK virus
LCCRWRTLGNAGSA

SEQ ID NO: 32955 - protein, 14 aa, BK virus
CCRWRTLGNAGSAN

SEQ ID NO: 32956 - protein, 14 aa, BK virus
CRWRTLGNAGSANE

SEQ ID NO: 32957 - protein, 14 aa, BK virus
RWRTLGNAGSANEL

SEQ ID NO: 32958 - protein, 14 aa, BK virus
WRTLGNAGSANELQ

SEQ ID NO: 32959 - protein, 14 aa, BK virus
RTLGNAGSANELQV

SEQ ID NO: 32960 - protein, 14 aa, BK virus
TLGNAGSANELQVK

SEQ ID NO: 32961 - protein, 14 aa, BK virus
LGNAGSANELQVKV

SEQ ID NO: 32962 - protein, 14 aa, BK virus
GNAGSANELQVKVP

SEQ ID NO: 32963 - protein, 14 aa, BK virus
VFWDFHRRGKCSPS

SEQ ID NO: 32964 - protein, 14 aa, BK virus
FWDFHRRGKCSPST

SEQ ID NO: 32965 - protein, 14 aa, BK virus
WDFHRRGKCSPSTS

SEQ ID NO: 32966 - protein, 14 aa, BK virus
DFHRRGKCSPSTSC

SEQ ID NO: 32967 - protein, 14 aa, BK virus
FHRRGKCSPSTSCD

SEQ ID NO: 32968 - protein, 14 aa, BK virus
HRRGKCSPSTSCDQ

SEQ ID NO: 32969 - protein, 14 aa, BK virus
RRGKCSPSTSCDQH

SEQ ID NO: 32970 - protein, 14 aa, BK virus
RGKCSPSTSCDQHS

SEQ ID NO: 32971 - protein, 14 aa, BK virus
GKCSPSTSCDQHSY

SEQ ID NO: 32972 - protein, 14 aa, BK virus
KCSPSTSCDQHSYH

SEQ ID NO: 32973 - protein, 14 aa, BK virus
CSPSTSCDQHSYHS

SEQ ID NO: 32974 - protein, 14 aa, BK virus
SPSTSCDQHSYHSV

SEQ ID NO: 32975 - protein, 14 aa, BK virus
PSTSCDQHSYHSVA

SEQ ID NO: 32976 - protein, 14 aa, BK virus
STSCDQHSYHSVAR

SEQ ID NO: 32977 - protein, 14 aa, BK virus
QLWNTTVERPCKIF

SEQ ID NO: 32978 - protein, 14 aa, BK virus
DPPEKKICKESLPN

SEQ ID NO: 32979 - protein, 14 aa, BK virus
PPEKKICKESLPNF

SEQ ID NO: 32980 - protein, 14 aa, BK virus
PEKKICKESLPNFL

SEQ ID NO: 32981 - protein, 14 aa, BK virus
EKKICKESLPNFLF

SEQ ID NO: 32982 - protein, 14 aa, BK virus
KKICKESLPNFLFA

SEQ ID NO: 32983 - protein, 14 aa, BK virus
KICKESLPNFLFAK

SEQ ID NO: 32984 - protein, 14 aa, BK virus
PYKQENPESGWAAY

SEQ ID NO: 32985 - protein, 14 aa, BK virus
YKQENPESGWAAYV

SEQ ID NO: 32986 - protein, 14 aa, BK virus
KQENPESGWAAYVW

SEQ ID NO: 32987 - protein, 14 aa, BK virus
QENPESGWAAYVWY

SEQ ID NO: 32988 - protein, 14 aa, BK virus
ENPESGWAAYVWYG

SEQ ID NO: 32989 - protein, 14 aa, BK virus
NPESGWAAYVWYGI

SEQ ID NO: 32990 - protein, 14 aa, BK virus
PESGWAAYVWYGIP

SEQ ID NO: 32991 - protein, 14 aa, BK virus
ESGWAAYVWYGIPG

SEQ ID NO: 32992 - protein, 14 aa, BK virus
SGWAAYVWYGIPGR

SEQ ID NO: 32993 - protein, 14 aa, BK virus
GWAAYVWYGIPGRR

SEQ ID NO: 32994 - protein, 14 aa, BK virus
WAAYVWYGIPGRRG

SEQ ID NO: 32995 - protein, 14 aa, BK virus
WHRKTSRGPRYDKI

SEQ ID NO: 32996 - protein, 14 aa, BK virus
HRKTSRGPRYDKIY

SEQ ID NO: 32997 - protein, 14 aa, BK virus
QTGTIANQNALNRC

SEQ ID NO: 32998 - protein, 14 aa, BK virus
TGTIANQNALNRCF

SEQ ID NO: 32999 - protein, 14 aa, BK virus
GTIANQNALNRCFY

SEQ ID NO: 33000 - protein, 14 aa, BK virus
TIANQNALNRCFYC

SEQ ID NO: 33001 - protein, 14 aa, BK virus
IANQNALNRCFYCT

SEQ ID NO: 33002 - protein, 14 aa, BK virus
ANQNALNRCFYCTY

SEQ ID NO: 33003 - protein, 14 aa, BK virus
NQNALNRCFYCTYT

SEQ ID NO: 33004 - protein, 14 aa, BK virus
QNALNRCFYCTYTF

SEQ ID NO: 33005 - protein, 14 aa, BK virus
NALNRCFYCTYTFN

SEQ ID NO: 33006 - protein, 14 aa, BK virus
ALNRCFYCTYTFNK

SEQ ID NO: 33007 - protein, 14 aa, BK virus
LNRCFYCTYTFNKC

SEQ ID NO: 33008 - protein, 14 aa, BK virus
NRCFYCTYTFNKCC

SEQ ID NO: 33009 - protein, 14 aa, BK virus
RCFYCTYTFNKCCF

SEQ ID NO: 33010 - protein, 14 aa, BK virus
CFYCTYTFNKCCFC

SEQ ID NO: 33011 - protein, 14 aa, BK virus
FYCTYTFNKCCFCI

SEQ ID NO: 33012 - protein, 14 aa, BK virus
YCTYTFNKCCFCIS

SEQ ID NO: 33013 - protein, 14 aa, BK virus
CTYTFNKCCFCISH

SEQ ID NO: 33014 - protein, 14 aa, BK virus
TYTFNKCCFCISHF

SEQ ID NO: 33015 - protein, 14 aa, BK virus
NTESLYTNATLDYG

SEQ ID NO: 33016 - protein, 14 aa, BK virus
TESLYTNATLDYGG

SEQ ID NO: 33017 - protein, 14 aa, BK virus
ESLYTNATLDYGGL

SEQ ID NO: 33018 - protein, 14 aa, BK virus
SLYTNATLDYGGLT

SEQ ID NO: 33019 - protein, 14 aa, BK virus
LYTNATLDYGGLTF

SEQ ID NO: 33020 - protein, 14 aa, BK virus
YTNATLDYGGLTFG

SEQ ID NO: 33021 - protein, 14 aa, BK virus
TNATLDYGGLTFGN

SEQ ID NO: 33022 - protein, 14 aa, BK virus
NATLDYGGLTFGNL

SEQ ID NO: 33023 - protein, 14 aa, BK virus
ATLDYGGLTFGNLQ

SEQ ID NO: 33024 - protein, 14 aa, BK virus
TLDYGGLTFGNLQQ

SEQ ID NO: 33025 - protein, 14 aa, BK virus
LDYGGLTFGNLQQG

SEQ ID NO: 33026 - protein, 14 aa, BK virus
DYGGLTFGNLQQGL

SEQ ID NO: 33027 - protein, 14 aa, BK virus
YGGLTFGNLQQGLK

SEQ ID NO: 33028 - protein, 14 aa, BK virus
GGLTFGNLQQGLKY

SEQ ID NO: 33029 - protein, 14 aa, BK virus
GLTFGNLQQGLKYL

SEQ ID NO: 33030 - protein, 14 aa, BK virus
LTFGNLQQGLKYLR

SEQ ID NO: 33031 - protein, 14 aa, BK virus
TFGNLQQGLKYLRL

SEQ ID NO: 33032 - protein, 14 aa, BK virus
FGNLQQGLKYLRLG

SEQ ID NO: 33033 - protein, 14 aa, BK virus
GNLQQGLKYLRLGK

SEQ ID NO: 33034 - protein, 14 aa, BK virus
NLQQGLKYLRLGKS

SEQ ID NO: 33035 - protein, 14 aa, BK virus
LQQGLKYLRLGKSI

SEQ ID NO: 33036 - protein, 14 aa, BK virus
QQGLKYLRLGKSIV

SEQ ID NO: 33037 - protein, 14 aa, BK virus
QGLKYLRLGKSIVI

SEQ ID NO: 33038 - protein, 14 aa, BK virus
GLKYLRLGKSIVIG

SEQ ID NO: 33039 - protein, 14 aa, BK virus
LKYLRLGKSIVIGI

SEQ ID NO: 33040 - protein, 14 aa, BK virus
KYLRLGKSIVIGIQ

SEQ ID NO: 33041 - protein, 14 aa, BK virus
YLRLGKSIVIGIQC

SEQ ID NO: 33042 - protein, 14 aa, BK virus
LRLGKSIVIGIQCL

SEQ ID NO: 33043 - protein, 14 aa, BK virus
RLGKSIVIGIQCLI

SEQ ID NO: 33044 - protein, 14 aa, BK virus
LGKSIVIGIQCLIH

SEQ ID NO: 33045 - protein, 14 aa, BK virus
GKSIVIGIQCLIHV

SEQ ID NO: 33046 - protein, 14 aa, BK virus
KSIVIGIQCLIHVQ

SEQ ID NO: 33047 - protein, 14 aa, BK virus
SIVIGIQCLIHVQS

SEQ ID NO: 33048 - protein, 14 aa, BK virus
IVIGIQCLIHVQSL

SEQ ID NO: 33049 - protein, 14 aa, BK virus
VIGIQCLIHVQSLQ

SEQ ID NO: 33050 - protein, 14 aa, BK virus
IGIQCLIHVQSLQF

SEQ ID NO: 33051 - protein, 14 aa, BK virus
GIQCLIHVQSLQFL

SEQ ID NO: 33052 - protein, 14 aa, BK virus
IQCLIHVQSLQFLN

SEQ ID NO: 33053 - protein, 14 aa, BK virus
QCLIHVQSLQFLNP

SEQ ID NO: 33054 - protein, 14 aa, BK virus
CLIHVQSLQFLNPL

SEQ ID NO: 33055 - protein, 14 aa, BK virus
LIHVQSLQFLNPLL

SEQ ID NO: 33056 - protein, 14 aa, BK virus
IHVQSLQFLNPLLL

SEQ ID NO: 33057 - protein, 14 aa, BK virus
YQEYISPCIYYISS

SEQ ID NO: 33058 - protein, 14 aa, BK virus
QEYISPCIYYISSL

SEQ ID NO: 33059 - protein, 14 aa, BK virus
EYISPCIYYISSLK

SEQ ID NO: 33060 - protein, 14 aa, BK virus
YISPCIYYISSLKK

SEQ ID NO: 33061 - protein, 14 aa, BK virus
ISPCIYYISSLKKY

SEQ ID NO: 33062 - protein, 14 aa, BK virus
SPCIYYISSLKKYT

SEQ ID NO: 33063 - protein, 14 aa, BK virus
PCIYYISSLKKYTY

SEQ ID NO: 33064 - protein, 14 aa, BK virus
CIYYISSLKKYTYL

SEQ ID NO: 33065 - protein, 14 aa, BK virus
IYYISSLKKYTYLS

SEQ ID NO: 33066 - protein, 14 aa, BK virus
YYISSLKKYTYLSQ

SEQ ID NO: 33067 - protein, 14 aa, BK virus
YISSLKKYTYLSQN

SEQ ID NO: 33068 - protein, 14 aa, BK virus
ISSLKKYTYLSQNP

SEQ ID NO: 33069 - protein, 14 aa, BK virus
SSLKKYTYLSQNPA

SEQ ID NO: 33070 - protein, 14 aa, BK virus
SLKKYTYLSQNPAF

SEQ ID NO: 33071 - protein, 14 aa, BK virus
LKKYTYLSQNPAFP

SEQ ID NO: 33072 - protein, 14 aa, BK virus
KKYTYLSQNPAFPS

SEQ ID NO: 33073 - protein, 14 aa, BK virus
KYTYLSQNPAFPSI

SEQ ID NO: 33074 - protein, 14 aa, BK virus
YTYLSQNPAFPSIQ

SEQ ID NO: 33075 - protein, 14 aa, BK virus
TYLSQNPAFPSIQQ

SEQ ID NO: 33076 - protein, 14 aa, BK virus
YLSQNPAFPSIQQF

SEQ ID NO: 33077 - protein, 14 aa, BK virus
TKLAVATRSFHFVK

SEQ ID NO: 33078 - protein, 14 aa, BK virus
KLAVATRSFHFVKF

SEQ ID NO: 33079 - protein, 14 aa, BK virus
LAVATRSFHFVKFF

SEQ ID NO: 33080 - protein, 14 aa, BK virus
AVATRSFHFVKFFF

SEQ ID NO: 33081 - protein, 14 aa, BK virus
VATRSFHFVKFFFQ

SEQ ID NO: 33082 - protein, 14 aa, BK virus
ATRSFHFVKFFFQV

SEQ ID NO: 33083 - protein, 14 aa, BK virus
TRSFHFVKFFFQVR

SEQ ID NO: 33084 - protein, 14 aa, BK virus
RSFHFVKFFFQVRT

SEQ ID NO: 33085 - protein, 14 aa, BK virus
SFHFVKFFFQVRTL

SEQ ID NO: 33086 - protein, 14 aa, BK virus
FHFVKFFFQVRTLS

SEQ ID NO: 33087 - protein, 14 aa, BK virus
HFVKFFFQVRTLSF

SEQ ID NO: 33088 - protein, 14 aa, BK virus
FVKFFFQVRTLSFV

SEQ ID NO: 33089 - protein, 14 aa, BK virus
VKFFFQVRTLSFVR

SEQ ID NO: 33090 - protein, 14 aa, BK virus
KFFFQVRTLSFVRI

SEQ ID NO: 33091 - protein, 14 aa, BK virus
FFFQVRTLSFVRIF

SEQ ID NO: 33092 - protein, 14 aa, BK virus
FFQVRTLSFVRIFL

SEQ ID NO: 33093 - protein, 14 aa, BK virus
FQVRTLSFVRIFLN

SEQ ID NO: 33094 - protein, 14 aa, BK virus
QVRTLSFVRIFLNI

SEQ ID NO: 33095 - protein, 14 aa, BK virus
VRTLSFVRIFLNIF

SEQ ID NO: 33096 - protein, 14 aa, BK virus
RTLSFVRIFLNIFW

SEQ ID NO: 33097 - protein, 14 aa, BK virus
TLSFVRIFLNIFWA

SEQ ID NO: 33098 - protein, 14 aa, BK virus
PSLVEIFGFFCLNV

SEQ ID NO: 33099 - protein, 14 aa, BK virus
SLVEIFGFFCLNVS

SEQ ID NO: 33100 - protein, 14 aa, BK virus
LVEIFGFFCLNVSF

SEQ ID NO: 33101 - protein, 14 aa, BK virus
VEIFGFFCLNVSFL

SEQ ID NO: 33102 - protein, 14 aa, BK virus
EIFGFFCLNVSFLN

SEQ ID NO: 33103 - protein, 14 aa, BK virus
IFGFFCLNVSFLNL

SEQ ID NO: 33104 - protein, 14 aa, BK virus
FGFFCLNVSFLNLP

SEQ ID NO: 33105 - protein, 14 aa, BK virus
HFHLNNLSNCLNCL

SEQ ID NO: 33106 - protein, 14 aa, BK virus
FHLNNLSNCLNCLF

SEQ ID NO: 33107 - protein, 14 aa, BK virus
HLNNLSNCLNCLFH

SEQ ID NO: 33108 - protein, 14 aa, BK virus
LNNLSNCLNCLFHV

SEQ ID NO: 33109 - protein, 14 aa, BK virus
NNLSNCLNCLFHVL

SEQ ID NO: 33110 - protein, 14 aa, BK virus
NLSNCLNCLFHVLK

SEQ ID NO: 33111 - protein, 14 aa, BK virus
LSNCLNCLFHVLKA

SEQ ID NO: 33112 - protein, 14 aa, BK virus
SNCLNCLFHVLKAN

SEQ ID NO: 33113 - protein, 14 aa, BK virus
NCLNCLFHVLKANP

SEQ ID NO: 33114 - protein, 14 aa, BK virus
CLNCLFHVLKANPL

SEQ ID NO: 33115 - protein, 14 aa, BK virus
LNCLFHVLKANPLI

SEQ ID NO: 33116 - protein, 14 aa, BK virus
NCLFHVLKANPLIQ

SEQ ID NO: 33117 - protein, 14 aa, BK virus
CLFHVLKANPLIQL

SEQ ID NO: 33118 - protein, 14 aa, BK virus
LFHVLKANPLIQLL

SEQ ID NO: 33119 - protein, 14 aa, BK virus
FHVLKANPLIQLLS

SEQ ID NO: 33120 - protein, 14 aa, BK virus
HVLKANPLIQLLSL

SEQ ID NO: 33121 - protein, 14 aa, BK virus
VLKANPLIQLLSLL

SEQ ID NO: 33122 - protein, 14 aa, BK virus
LKANPLIQLLSLLH

SEQ ID NO: 33123 - protein, 14 aa, BK virus
KANPLIQLLSLLHL

SEQ ID NO: 33124 - protein, 14 aa, BK virus
ANPLIQLLSLLHLQ

SEQ ID NO: 33125 - protein, 14 aa, BK virus
NPLIQLLSLLHLQK

SEQ ID NO: 33126 - protein, 14 aa, BK virus
PLIQLLSLLHLQKQ

SEQ ID NO: 33127 - protein, 14 aa, BK virus
LIQLLSLLHLQKQP

SEQ ID NO: 33128 - protein, 14 aa, BK virus
IQLLSLLHLQKQPC

SEQ ID NO: 33129 - protein, 14 aa, BK virus
QLLSLLHLQKQPCT

SEQ ID NO: 33130 - protein, 14 aa, BK virus
LLSLLHLQKQPCTD

SEQ ID NO: 33131 - protein, 14 aa, BK virus
LSLLHLQKQPCTDL

SEQ ID NO: 33132 - protein, 14 aa, BK virus
LHLAQRLAFPWVGL

SEQ ID NO: 33133 - protein, 14 aa, BK virus
HLAQRLAFPWVGLH

SEQ ID NO: 33134 - protein, 14 aa, BK virus
LAQRLAFPWVGLHL

SEQ ID NO: 33135 - protein, 14 aa, BK virus
AQRLAFPWVGLHLR

SEQ ID NO: 33136 - protein, 14 aa, BK virus
QRLAFPWVGLHLRL

SEQ ID NO: 33137 - protein, 14 aa, BK virus
RLAFPWVGLHLRLY

SEQ ID NO: 33138 - protein, 14 aa, BK virus
LAFPWVGLHLRLYH

SEQ ID NO: 33139 - protein, 14 aa, BK virus
AFPWVGLHLRLYHH

SEQ ID NO: 33140 - protein, 14 aa, BK virus
FPWVGLHLRLYHHT

SEQ ID NO: 33141 - protein, 14 aa, BK virus
PWVGLHLRLYHHTN

SEQ ID NO: 33142 - protein, 14 aa, BK virus
WVGLHLRLYHHTNL

SEQ ID NO: 33143 - protein, 14 aa, BK virus
VGLHLRLYHHTNLI

SEQ ID NO: 33144 - protein, 14 aa, BK virus
GLHLRLYHHTNLIT

SEQ ID NO: 33145 - protein, 14 aa, BK virus
LHLRLYHHTNLITL

SEQ ID NO: 33146 - protein, 14 aa, BK virus
HLRLYHHTNLITLQ

SEQ ID NO: 33147 - protein, 14 aa, BK virus
LRLYHHTNLITLQL

SEQ ID NO: 33148 - protein, 14 aa, BK virus
RLYHHTNLITLQLV

SEQ ID NO: 33149 - protein, 14 aa, BK virus
LYHHTNLITLQLVL

SEQ ID NO: 33150 - protein, 14 aa, BK virus
YHHTNLITLQLVLF

SEQ ID NO: 33151 - protein, 14 aa, BK virus
HHTNLITLQLVLFF

SEQ ID NO: 33152 - protein, 14 aa, BK virus
HTNLITLQLVLFFH

SEQ ID NO: 33153 - protein, 14 aa, BK virus
TNLITLQLVLFFHY

SEQ ID NO: 33154 - protein, 14 aa, BK virus
NLITLQLVLFFHYQ

SEQ ID NO: 33155 - protein, 14 aa, BK virus
LITLQLVLFFHYQW

SEQ ID NO: 33156 - protein, 14 aa, BK virus
ITLQLVLFFHYQWD

SEQ ID NO: 33157 - protein, 14 aa, BK virus
TLQLVLFFHYQWDL

SEQ ID NO: 33158 - protein, 14 aa, BK virus
KQYSAKNQILQNPF

SEQ ID NO: 33159 - protein, 14 aa, BK virus
VANSAAKQHLPYIV

SEQ ID NO: 33160 - protein, 14 aa, BK virus
ANSAAKQHLPYIVL

SEQ ID NO: 33161 - protein, 14 aa, BK virus
NSAAKQHLPYIVLV

SEQ ID NO: 33162 - protein, 14 aa, BK virus
SAAKQHLPYIVLVQ

SEQ ID NO: 33163 - protein, 14 aa, BK virus
AAKQHLPYIVLVQH

SEQ ID NO: 33164 - protein, 14 aa, BK virus
AKQHLPYIVLVQHF

SEQ ID NO: 33165 - protein, 14 aa, BK virus
KQHLPYIVLVQHFH

SEQ ID NO: 33166 - protein, 14 aa, BK virus
QHLPYIVLVQHFHE

SEQ ID NO: 33167 - protein, 14 aa, BK virus
HLPYIVLVQHFHEL

SEQ ID NO: 33168 - protein, 14 aa, BK virus
LPYIVLVQHFHELQ

SEQ ID NO: 33169 - protein, 14 aa, BK virus
PYIVLVQHFHELQI

SEQ ID NO: 33170 - protein, 14 aa, BK virus
YIVLVQHFHELQIL

SEQ ID NO: 33171 - protein, 14 aa, BK virus
IVLVQHFHELQILN

SEQ ID NO: 33172 - protein, 14 aa, BK virus
VLVQHFHELQILNP

SEQ ID NO: 33173 - protein, 14 aa, BK virus
LVQHFHELQILNPF

SEQ ID NO: 33174 - protein, 14 aa, BK virus
VQHFHELQILNPFY

SEQ ID NO: 33175 - protein, 14 aa, BK virus
QHFHELQILNPFYL

SEQ ID NO: 33176 - protein, 14 aa, BK virus
HFHELQILNPFYLI

SEQ ID NO: 33177 - protein, 14 aa, BK virus
FHELQILNPFYLIY

SEQ ID NO: 33178 - protein, 14 aa, BK virus
HELQILNPFYLIYD

SEQ ID NO: 33179 - protein, 14 aa, BK virus
IFLLAFLPWSYEGY

SEQ ID NO: 33180 - protein, 14 aa, BK virus
FLLAFLPWSYEGYL

SEQ ID NO: 33181 - protein, 14 aa, BK virus
LLAFLPWSYEGYLL

SEQ ID NO: 33182 - protein, 14 aa, BK virus
LAFLPWSYEGYLLF

SEQ ID NO: 33183 - protein, 14 aa, BK virus
AFLPWSYEGYLLFF

SEQ ID NO: 33184 - protein, 14 aa, BK virus
LKLYLLLADKYFFD

SEQ ID NO: 33185 - protein, 14 aa, BK virus
KLYLLLADKYFFDF

SEQ ID NO: 33186 - protein, 14 aa, BK virus
LYLLLADKYFFDFY

SEQ ID NO: 33187 - protein, 14 aa, BK virus
YLLLADKYFFDFYF

SEQ ID NO: 33188 - protein, 14 aa, BK virus
LLLADKYFFDFYFL

SEQ ID NO: 33189 - protein, 14 aa, BK virus
LLADKYFFDFYFLQ

SEQ ID NO: 33190 - protein, 14 aa, BK virus
LADKYFFDFYFLQK

SEQ ID NO: 33191 - protein, 14 aa, BK virus
SDKAGLFSDTFYTP

SEQ ID NO: 33192 - protein, 14 aa, BK virus
DKAGLFSDTFYTPL

SEQ ID NO: 33193 - protein, 14 aa, BK virus
KAGLFSDTFYTPLH

SEQ ID NO: 33194 - protein, 14 aa, BK virus
AGLFSDTFYTPLHC

SEQ ID NO: 33195 - protein, 14 aa, BK virus
GLFSDTFYTPLHCI

SEQ ID NO: 33196 - protein, 14 aa, BK virus
LFSDTFYTPLHCIE

SEQ ID NO: 33197 - protein, 14 aa, BK virus
FSDTFYTPLHCIEI

SEQ ID NO: 33198 - protein, 14 aa, BK virus
SDTFYTPLHCIEIL

SEQ ID NO: 33199 - protein, 14 aa, BK virus
DTFYTPLHCIEILN

SEQ ID NO: 33200 - protein, 14 aa, BK virus
TFYTPLHCIEILNT

SEQ ID NO: 33201 - protein, 14 aa, BK virus
FYTPLHCIEILNTY

SEQ ID NO: 33202 - protein, 14 aa, BK virus
YTPLHCIEILNTYL

SEQ ID NO: 33203 - protein, 14 aa, BK virus
TPLHCIEILNTYLI

SEQ ID NO: 33204 - protein, 14 aa, BK virus
PLHCIEILNTYLII

SEQ ID NO: 33205 - protein, 14 aa, BK virus
LHCIEILNTYLIIK

SEQ ID NO: 33206 - protein, 14 aa, BK virus
HCIEILNTYLIIKT

SEQ ID NO: 33207 - protein, 14 aa, BK virus
CIEILNTYLIIKTH

SEQ ID NO: 33208 - protein, 14 aa, BK virus
IEILNTYLIIKTHP

SEQ ID NO: 33209 - protein, 14 aa, BK virus
EILNTYLIIKTHPH

SEQ ID NO: 33210 - protein, 14 aa, BK virus
ILNTYLIIKTHPHT

SEQ ID NO: 33211 - protein, 14 aa, BK virus
LNTYLIIKTHPHTL

SEQ ID NO: 33212 - protein, 14 aa, BK virus
NTYLIIKTHPHTLS

SEQ ID NO: 33213 - protein, 14 aa, BK virus
TYLIIKTHPHTLSL

SEQ ID NO: 33214 - protein, 14 aa, BK virus
YLIIKTHPHTLSLL

SEQ ID NO: 33215 - protein, 14 aa, BK virus
LIIKTHPHTLSLLH

SEQ ID NO: 33216 - protein, 14 aa, BK virus
IIKTHPHTLSLLHT

SEQ ID NO: 33217 - protein, 14 aa, BK virus
IKTHPHTLSLLHTQ

SEQ ID NO: 33218 - protein, 14 aa, BK virus
LISKTPALFLQALL

SEQ ID NO: 33219 - protein, 14 aa, BK virus
ISKTPALFLQALLG

SEQ ID NO: 33220 - protein, 14 aa, BK virus
GLLPFFFFWVVLSV

SEQ ID NO: 33221 - protein, 14 aa, BK virus
LLPFFFFWVVLSVE

SEQ ID NO: 33222 - protein, 14 aa, BK virus
LPFFFFWVVLSVEN

SEQ ID NO: 33223 - protein, 14 aa, BK virus
PFFFFWVVLSVENL

SEQ ID NO: 33224 - protein, 14 aa, BK virus
FFFFWVVLSVENLL

SEQ ID NO: 33225 - protein, 14 aa, BK virus
FFFWVVLSVENLLL

SEQ ID NO: 33226 - protein, 14 aa, BK virus
FFWVVLSVENLLLL

SEQ ID NO: 33227 - protein, 14 aa, BK virus
FWVVLSVENLLLLL

SEQ ID NO: 33228 - protein, 14 aa, BK virus
WVVLSVENLLLLLH

SEQ ID NO: 33229 - protein, 14 aa, BK virus
VVLSVENLLLLLHH

SEQ ID NO: 33230 - protein, 14 aa, BK virus
VLSVENLLLLLHHW

SEQ ID NO: 33231 - protein, 14 aa, BK virus
LSVENLLLLLHHWQ

SEQ ID NO: 33232 - protein, 14 aa, BK virus
SVENLLLLLHHWQT

SEQ ID NO: 33233 - protein, 14 aa, BK virus
VENLLLLLHHWQTY

SEQ ID NO: 33234 - protein, 14 aa, BK virus
ENLLLLLHHWQTYL

SEQ ID NO: 33235 - protein, 14 aa, BK virus
NLLLLLHHWQTYLH

SEQ ID NO: 33236 - protein, 14 aa, BK virus
LLLLLHHWQTYLHG

SEQ ID NO: 33237 - protein, 14 aa, BK virus
LLLLHHWQTYLHGK

SEQ ID NO: 33238 - protein, 14 aa, BK virus
LLLHHWQTYLHGKI

SEQ ID NO: 33239 - protein, 14 aa, BK virus
LLHHWQTYLHGKIN

SEQ ID NO: 33240 - protein, 14 aa, BK virus
LHHWQTYLHGKINL

SEQ ID NO: 33241 - protein, 14 aa, BK virus
HHWQTYLHGKINLH

SEQ ID NO: 33242 - protein, 14 aa, BK virus
HWQTYLHGKINLHP

SEQ ID NO: 33243 - protein, 14 aa, BK virus
WQTYLHGKINLHPI

SEQ ID NO: 33244 - protein, 14 aa, BK virus
QTYLHGKINLHPIF

SEQ ID NO: 33245 - protein, 14 aa, BK virus
TYLHGKINLHPIFH

SEQ ID NO: 33246 - protein, 14 aa, BK virus
RNSTRTPTLLFHRL

SEQ ID NO: 33247 - protein, 14 aa, BK virus
NSTRTPTLLFHRLA

SEQ ID NO: 33248 - protein, 14 aa, BK virus
STRTPTLLFHRLAP

SEQ ID NO: 33249 - protein, 14 aa, BK virus
TRTPTLLFHRLAPI

SEQ ID NO: 33250 - protein, 14 aa, BK virus
RTPTLLFHRLAPIK

SEQ ID NO: 33251 - protein, 14 aa, BK virus
TPTLLFHRLAPIKK

SEQ ID NO: 33252 - protein, 14 aa, BK virus
PTLLFHRLAPIKKI

SEQ ID NO: 33253 - protein, 14 aa, BK virus
TLLFHRLAPIKKII

SEQ ID NO: 33254 - protein, 14 aa, BK virus
LLFHRLAPIKKIIT

SEQ ID NO: 33255 - protein, 14 aa, BK virus
GLLIFYYLSKYKLV

SEQ ID NO: 33256 - protein, 14 aa, BK virus
LLIFYYLSKYKLVT

SEQ ID NO: 33257 - protein, 14 aa, BK virus
LIFYYLSKYKLVTL

SEQ ID NO: 33258 - protein, 14 aa, BK virus
IFYYLSKYKLVTLK

SEQ ID NO: 33259 - protein, 14 aa, BK virus
FYYLSKYKLVTLKL

SEQ ID NO: 33260 - protein, 14 aa, BK virus
ISEGSFSNYLDPPL

SEQ ID NO: 33261 - protein, 14 aa, BK virus
SEGSFSNYLDPPLQ

SEQ ID NO: 33262 - protein, 14 aa, BK virus
EGSFSNYLDPPLQS

SEQ ID NO: 33263 - protein, 14 aa, BK virus
GSFSNYLDPPLQSF

SEQ ID NO: 33264 - protein, 14 aa, BK virus
SFSNYLDPPLQSFF

SEQ ID NO: 33265 - protein, 14 aa, BK virus
FSNYLDPPLQSFFS

SEQ ID NO: 33266 - protein, 14 aa, BK virus
AKPLCEAVNAVAIY

SEQ ID NO: 33267 - protein, 14 aa, BK virus
KPLCEAVNAVAIYP

SEQ ID NO: 33268 - protein, 14 aa, BK virus
PLCEAVNAVAIYPN

SEQ ID NO: 33269 - protein, 14 aa, BK virus
LCEAVNAVAIYPNQ

SEQ ID NO: 33270 - protein, 14 aa, BK virus
CEAVNAVAIYPNQG

SEQ ID NO: 33271 - protein, 14 aa, BK virus
EAVNAVAIYPNQGL

SEQ ID NO: 33272 - protein, 14 aa, BK virus
AVNAVAIYPNQGLF

SEQ ID NO: 33273 - protein, 14 aa, BK virus
VNAVAIYPNQGLFS

SEQ ID NO: 33274 - protein, 14 aa, BK virus
HARAVHRRLFGTNR

SEQ ID NO: 33275 - protein, 14 aa, BK virus
ARAVHRRLFGTNRP

SEQ ID NO: 33276 - protein, 14 aa, BK virus
RAVHRRLFGTNRPF

SEQ ID NO: 33277 - protein, 14 aa, BK virus
AVHRRLFGTNRPFL

SEQ ID NO: 33278 - protein, 14 aa, BK virus
VHRRLFGTNRPFLA

SEQ ID NO: 33279 - protein, 14 aa, BK virus
HRRLFGTNRPFLAV

SEQ ID NO: 33280 - protein, 14 aa, BK virus
RRLFGTNRPFLAVQ

SEQ ID NO: 33281 - protein, 14 aa, BK virus
RLFGTNRPFLAVQG

SEQ ID NO: 33282 - protein, 14 aa, BK virus
LFGTNRPFLAVQGI

SEQ ID NO: 33283 - protein, 14 aa, BK virus
FGTNRPFLAVQGIW

SEQ ID NO: 33284 - protein, 14 aa, BK virus
GTNRPFLAVQGIWA

SEQ ID NO: 33285 - protein, 14 aa, BK virus
TNRPFLAVQGIWAK

SEQ ID NO: 33286 - protein, 14 aa, BK virus
NRPFLAVQGIWAKR

SEQ ID NO: 33287 - protein, 14 aa, BK virus
RPFLAVQGIWAKRK

SEQ ID NO: 33288 - protein, 14 aa, BK virus
PFLAVQGIWAKRKI

SEQ ID NO: 33289 - protein, 14 aa, BK virus
FLAVQGIWAKRKIS

SEQ ID NO: 33290 - protein, 14 aa, BK virus
LAVQGIWAKRKIST

SEQ ID NO: 33291 - protein, 14 aa, BK virus
AVQGIWAKRKISTN

SEQ ID NO: 33292 - protein, 14 aa, BK virus
VQGIWAKRKISTNL

SEQ ID NO: 33293 - protein, 14 aa, BK virus
ATPGSKIRLMSYLY

SEQ ID NO: 33294 - protein, 14 aa, BK virus
TPGSKIRLMSYLYI

SEQ ID NO: 33295 - protein, 14 aa, BK virus
PGSKIRLMSYLYIL

SEQ ID NO: 33296 - protein, 14 aa, BK virus
GSKIRLMSYLYILL

SEQ ID NO: 33297 - protein, 14 aa, BK virus
SKIRLMSYLYILLH

SEQ ID NO: 33298 - protein, 14 aa, BK virus
KIRLMSYLYILLHF

SEQ ID NO: 33299 - protein, 14 aa, BK virus
IRLMSYLYILLHFF

SEQ ID NO: 33300 - protein, 14 aa, BK virus
RLMSYLYILLHFFI

SEQ ID NO: 33301 - protein, 14 aa, BK virus
LMSYLYILLHFFIQ

SEQ ID NO: 33302 - protein, 14 aa, BK virus
MSYLYILLHFFIQS

SEQ ID NO: 33303 - protein, 14 aa, BK virus
SYLYILLHFFIQSI

SEQ ID NO: 33304 - protein, 14 aa, BK virus
YLYILLHFFIQSIH

SEQ ID NO: 33305 - protein, 14 aa, BK virus
LYILLHFFIQSIHS

SEQ ID NO: 33306 - protein, 14 aa, BK virus
YILLHFFIQSIHSL

SEQ ID NO: 33307 - protein, 14 aa, BK virus
ILLHFFIQSIHSLH

SEQ ID NO: 33308 - protein, 14 aa, BK virus
LLHFFIQSIHSLHF

SEQ ID NO: 33309 - protein, 14 aa, BK virus
LHFFIQSIHSLHFI

SEQ ID NO: 33310 - protein, 14 aa, BK virus
HFFIQSIHSLHFIL

SEQ ID NO: 33311 - protein, 14 aa, BK virus
FFIQSIHSLHFILV

SEQ ID NO: 33312 - protein, 14 aa, BK virus
FIQSIHSLHFILVA

SEQ ID NO: 33313 - protein, 14 aa, BK virus
IQSIHSLHFILVAP

SEQ ID NO: 33314 - protein, 14 aa, BK virus
QSIHSLHFILVAPF

SEQ ID NO: 33315 - protein, 14 aa, BK virus
SIHSLHFILVAPFV

SEQ ID NO: 33316 - protein, 14 aa, BK virus
IHSLHFILVAPFVR

SEQ ID NO: 33317 - protein, 14 aa, BK virus
HSLHFILVAPFVRV

SEQ ID NO: 33318 - protein, 14 aa, BK virus
SLHFILVAPFVRVK

SEQ ID NO: 33319 - protein, 14 aa, BK virus
LHFILVAPFVRVKF

SEQ ID NO: 33320 - protein, 14 aa, BK virus
HFILVAPFVRVKFL

SEQ ID NO: 33321 - protein, 14 aa, BK virus
FILVAPFVRVKFLT

SEQ ID NO: 33322 - protein, 15 aa, BK virus
ASEKASTPLLLERKG

SEQ ID NO: 33323 - protein, 15 aa, BK virus
SEKASTPLLLERKGG

SEQ ID NO: 33324 - protein, 15 aa, BK virus
EKASTPLLLERKGGG

SEQ ID NO: 33325 - protein, 15 aa, BK virus
KASTPLLLERKGGGR

SEQ ID NO: 33326 - protein, 15 aa, BK virus
ASTPLLLERKGGGRG

SEQ ID NO: 33327 - protein, 15 aa, BK virus
STPLLLERKGGGRGG

SEQ ID NO: 33328 - protein, 15 aa, BK virus
TPLLLERKGGGRGGL

SEQ ID NO: 33329 - protein, 15 aa, BK virus
PLLLERKGGGRGGLG

SEQ ID NO: 33330 - protein, 15 aa, BK virus
LLLERKGGGRGGLGL

SEQ ID NO: 33331 - protein, 15 aa, BK virus
LLERKGGGRGGLGLL

SEQ ID NO: 33332 - protein, 15 aa, BK virus
LERKGGGRGGLGLLY

SEQ ID NO: 33333 - protein, 15 aa, BK virus
ERKGGGRGGLGLLYI

SEQ ID NO: 33334 - protein, 15 aa, BK virus
RKGGGRGGLGLLYII

SEQ ID NO: 33335 - protein, 15 aa, BK virus
KGGGRGGLGLLYIIK

SEQ ID NO: 33336 - protein, 15 aa, BK virus
GGGRGGLGLLYIIKK

SEQ ID NO: 33337 - protein, 15 aa, BK virus
GGRGGLGLLYIIKKK

SEQ ID NO: 33338 - protein, 15 aa, BK virus
GRGGLGLLYIIKKKA

SEQ ID NO: 33339 - protein, 15 aa, BK virus
RGGLGLLYIIKKKAT

SEQ ID NO: 33340 - protein, 15 aa, BK virus
GGLGLLYIIKKKATG

SEQ ID NO: 33341 - protein, 15 aa, BK virus
GLGLLYIIKKKATGR

SEQ ID NO: 33342 - protein, 15 aa, BK virus
LGLLYIIKKKATGRS

SEQ ID NO: 33343 - protein, 15 aa, BK virus
GLLYIIKKKATGRSC

SEQ ID NO: 33344 - protein, 15 aa, BK virus
LLYIIKKKATGRSCL

SEQ ID NO: 33345 - protein, 15 aa, BK virus
LYIIKKKATGRSCLP

SEQ ID NO: 33346 - protein, 15 aa, BK virus
YIIKKKATGRSCLPM

SEQ ID NO: 33347 - protein, 15 aa, BK virus
IIKKKATGRSCLPME

SEQ ID NO: 33348 - protein, 15 aa, BK virus
IKKKATGRSCLPMEC

SEQ ID NO: 33349 - protein, 15 aa, BK virus
KKKATGRSCLPMECS

SEQ ID NO: 33350 - protein, 15 aa, BK virus
KKATGRSCLPMECSQ

SEQ ID NO: 33351 - protein, 15 aa, BK virus
KATGRSCLPMECSQT

SEQ ID NO: 33352 - protein, 15 aa, BK virus
ATGRSCLPMECSQTM

SEQ ID NO: 33353 - protein, 15 aa, BK virus
TGRSCLPMECSQTMT

SEQ ID NO: 33354 - protein, 15 aa, BK virus
GRSCLPMECSQTMTS

SEQ ID NO: 33355 - protein, 15 aa, BK virus
RSCLPMECSQTMTSG

SEQ ID NO: 33356 - protein, 15 aa, BK virus
SCLPMECSQTMTSGR

SEQ ID NO: 33357 - protein, 15 aa, BK virus
CLPMECSQTMTSGRK

SEQ ID NO: 33358 - protein, 15 aa, BK virus
LPMECSQTMTSGRKV

SEQ ID NO: 33359 - protein, 15 aa, BK virus
PMECSQTMTSGRKVH

SEQ ID NO: 33360 - protein, 15 aa, BK virus
MECSQTMTSGRKVHD

SEQ ID NO: 33361 - protein, 15 aa, BK virus
ECSQTMTSGRKVHDS

SEQ ID NO: 33362 - protein, 15 aa, BK virus
CSQTMTSGRKVHDSQ

SEQ ID NO: 33363 - protein, 15 aa, BK virus
SQTMTSGRKVHDSQG

SEQ ID NO: 33364 - protein, 15 aa, BK virus
QTMTSGRKVHDSQGN

SEQ ID NO: 33365 - protein, 15 aa, BK virus
TMTSGRKVHDSQGNA

SEQ ID NO: 33366 - protein, 15 aa, BK virus
MTSGRKVHDSQGNAA

SEQ ID NO: 33367 - protein, 15 aa, BK virus
TSGRKVHDSQGNAAK

SEQ ID NO: 33368 - protein, 15 aa, BK virus
SGRKVHDSQGNAAKP

SEQ ID NO: 33369 - protein, 15 aa, BK virus
PQEGKCMTHREELLT

SEQ ID NO: 33370 - protein, 15 aa, BK virus
QEGKCMTHREELLTH

SEQ ID NO: 33371 - protein, 15 aa, BK virus
EGKCMTHREELLTHG

SEQ ID NO: 33372 - protein, 15 aa, BK virus
GKCMTHREELLTHGM

SEQ ID NO: 33373 - protein, 15 aa, BK virus
KCMTHREELLTHGMQ

SEQ ID NO: 33374 - protein, 15 aa, BK virus
CMTHREELLTHGMQP

SEQ ID NO: 33375 - protein, 15 aa, BK virus
MTHREELLTHGMQPN

SEQ ID NO: 33376 - protein, 15 aa, BK virus
THREELLTHGMQPNH

SEQ ID NO: 33377 - protein, 15 aa, BK virus
HREELLTHGMQPNHD

SEQ ID NO: 33378 - protein, 15 aa, BK virus
REELLTHGMQPNHDL

SEQ ID NO: 33379 - protein, 15 aa, BK virus
EELLTHGMQPNHDLR

SEQ ID NO: 33380 - protein, 15 aa, BK virus
ELLTHGMQPNHDLRK

SEQ ID NO: 33381 - protein, 15 aa, BK virus
LLTHGMQPNHDLRKE

SEQ ID NO: 33382 - protein, 15 aa, BK virus
LTHGMQPNHDLRKES

SEQ ID NO: 33383 - protein, 15 aa, BK virus
THGMQPNHDLRKESA

SEQ ID NO: 33384 - protein, 15 aa, BK virus
QTCFASLGILALSPV

SEQ ID NO: 33385 - protein, 15 aa, BK virus
TCFASLGILALSPVK

SEQ ID NO: 33386 - protein, 15 aa, BK virus
CFASLGILALSPVKL

SEQ ID NO: 33387 - protein, 15 aa, BK virus
FASLGILALSPVKLD

SEQ ID NO: 33388 - protein, 15 aa, BK virus
ASLGILALSPVKLDK

SEQ ID NO: 33389 - protein, 15 aa, BK virus
SLGILALSPVKLDKG

SEQ ID NO: 33390 - protein, 15 aa, BK virus
LGILALSPVKLDKGH

SEQ ID NO: 33391 - protein, 15 aa, BK virus
GILALSPVKLDKGHG

SEQ ID NO: 33392 - protein, 15 aa, BK virus
ILALSPVKLDKGHGS

SEQ ID NO: 33393 - protein, 15 aa, BK virus
LALSPVKLDKGHGSA

SEQ ID NO: 33394 - protein, 15 aa, BK virus
ALSPVKLDKGHGSAP

SEQ ID NO: 33395 - protein, 15 aa, BK virus
LSPVKLDKGHGSAPA

SEQ ID NO: 33396 - protein, 15 aa, BK virus
SPVKLDKGHGSAPAV

SEQ ID NO: 33397 - protein, 15 aa, BK virus
PVKLDKGHGSAPAVT

SEQ ID NO: 33398 - protein, 15 aa, BK virus
VKLDKGHGSAPAVTT

SEQ ID NO: 33399 - protein, 15 aa, BK virus
KLDKGHGSAPAVTTS

SEQ ID NO: 33400 - protein, 15 aa, BK virus
LDKGHGSAPAVTTSF

SEQ ID NO: 33401 - protein, 15 aa, BK virus
DKGHGSAPAVTTSFS

SEQ ID NO: 33402 - protein, 15 aa, BK virus
KGHGSAPAVTTSFSE

SEQ ID NO: 33403 - protein, 15 aa, BK virus
GHGSAPAVTTSFSES

SEQ ID NO: 33404 - protein, 15 aa, BK virus
HGSAPAVTTSFSESW

SEQ ID NO: 33405 - protein, 15 aa, BK virus
NLDWNKKKSSEDFYF

SEQ ID NO: 33406 - protein, 15 aa, BK virus
LDWNKKKSSEDFYFY

SEQ ID NO: 33407 - protein, 15 aa, BK virus
DWNKKKSSEDFYFYF

SEQ ID NO: 33408 - protein, 15 aa, BK virus
WNKKKSSEDFYFYFR

SEQ ID NO: 33409 - protein, 15 aa, BK virus
NKKKSSEDFYFYFRA

SEQ ID NO: 33410 - protein, 15 aa, BK virus
KKKSSEDFYFYFRAF

SEQ ID NO: 33411 - protein, 15 aa, BK virus
KKSSEDFYFYFRAFA

SEQ ID NO: 33412 - protein, 15 aa, BK virus
KSSEDFYFYFRAFAG

SEQ ID NO: 33413 - protein, 15 aa, BK virus
SSEDFYFYFRAFAGI

SEQ ID NO: 33414 - protein, 15 aa, BK virus
SEDFYFYFRAFAGIL

SEQ ID NO: 33415 - protein, 15 aa, BK virus
RQCRREKQKYHCFTC

SEQ ID NO: 33416 - protein, 15 aa, BK virus
QCRREKQKYHCFTCC

SEQ ID NO: 33417 - protein, 15 aa, BK virus
CRREKQKYHCFTCCK

SEQ ID NO: 33418 - protein, 15 aa, BK virus
RREKQKYHCFTCCKR

SEQ ID NO: 33419 - protein, 15 aa, BK virus
REKQKYHCFTCCKRL

SEQ ID NO: 33420 - protein, 15 aa, BK virus
EKQKYHCFTCCKRLC

SEQ ID NO: 33421 - protein, 15 aa, BK virus
KQKYHCFTCCKRLCK

SEQ ID NO: 33422 - protein, 15 aa, BK virus
QKYHCFTCCKRLCKR

SEQ ID NO: 33423 - protein, 15 aa, BK virus
KYHCFTCCKRLCKRL

SEQ ID NO: 33424 - protein, 15 aa, BK virus
YHCFTCCKRLCKRLL

SEQ ID NO: 33425 - protein, 15 aa, BK virus
HCFTCCKRLCKRLLG

SEQ ID NO: 33426 - protein, 15 aa, BK virus
CFTCCKRLCKRLLGK

SEQ ID NO: 33427 - protein, 15 aa, BK virus
SLFFCISRFMGAALA

SEQ ID NO: 33428 - protein, 15 aa, BK virus
LFFCISRFMGAALAL

SEQ ID NO: 33429 - protein, 15 aa, BK virus
FFCISRFMGAALALL

SEQ ID NO: 33430 - protein, 15 aa, BK virus
FCISRFMGAALALLG

SEQ ID NO: 33431 - protein, 15 aa, BK virus
CISRFMGAALALLGD

SEQ ID NO: 33432 - protein, 15 aa, BK virus
ISRFMGAALALLGDL

SEQ ID NO: 33433 - protein, 15 aa, BK virus
SRFMGAALALLGDLV

SEQ ID NO: 33434 - protein, 15 aa, BK virus
RFMGAALALLGDLVA

SEQ ID NO: 33435 - protein, 15 aa, BK virus
FMGAALALLGDLVAS

SEQ ID NO: 33436 - protein, 15 aa, BK virus
MGAALALLGDLVASV

SEQ ID NO: 33437 - protein, 15 aa, BK virus
GAALALLGDLVASVS

SEQ ID NO: 33438 - protein, 15 aa, BK virus
AALALLGDLVASVSE

SEQ ID NO: 33439 - protein, 15 aa, BK virus
ALALLGDLVASVSEA

SEQ ID NO: 33440 - protein, 15 aa, BK virus
LALLGDLVASVSEAA

SEQ ID NO: 33441 - protein, 15 aa, BK virus
ALLGDLVASVSEAAA

SEQ ID NO: 33442 - protein, 15 aa, BK virus
LLGDLVASVSEAAAA

SEQ ID NO: 33443 - protein, 15 aa, BK virus
LGDLVASVSEAAAAT

SEQ ID NO: 33444 - protein, 15 aa, BK virus
GDLVASVSEAAAATG

SEQ ID NO: 33445 - protein, 15 aa, BK virus
DLVASVSEAAAATGF

SEQ ID NO: 33446 - protein, 15 aa, BK virus
LVASVSEAAAATGFS

SEQ ID NO: 33447 - protein, 15 aa, BK virus
VASVSEAAAATGFSV

SEQ ID NO: 33448 - protein, 15 aa, BK virus
ASVSEAAAATGFSVA

SEQ ID NO: 33449 - protein, 15 aa, BK virus
SVSEAAAATGFSVAE

SEQ ID NO: 33450 - protein, 15 aa, BK virus
VSEAAAATGFSVAEI

SEQ ID NO: 33451 - protein, 15 aa, BK virus
SEAAAATGFSVAEIA

SEQ ID NO: 33452 - protein, 15 aa, BK virus
EAAAATGFSVAEIAA

SEQ ID NO: 33453 - protein, 15 aa, BK virus
AAAATGFSVAEIAAG

SEQ ID NO: 33454 - protein, 15 aa, BK virus
AAATGFSVAEIAAGE

SEQ ID NO: 33455 - protein, 15 aa, BK virus
AATGFSVAEIAAGEA

SEQ ID NO: 33456 - protein, 15 aa, BK virus
ATGFSVAEIAAGEAA

SEQ ID NO: 33457 - protein, 15 aa, BK virus
TGFSVAEIAAGEAAA

SEQ ID NO: 33458 - protein, 15 aa, BK virus
GFSVAEIAAGEAAAA

SEQ ID NO: 33459 - protein, 15 aa, BK virus
FSVAEIAAGEAAAAI

SEQ ID NO: 33460 - protein, 15 aa, BK virus
SVAEIAAGEAAAAIE

SEQ ID NO: 33461 - protein, 15 aa, BK virus
VAEIAAGEAAAAIEV

SEQ ID NO: 33462 - protein, 15 aa, BK virus
AEIAAGEAAAAIEVQ

SEQ ID NO: 33463 - protein, 15 aa, BK virus
EIAAGEAAAAIEVQI

SEQ ID NO: 33464 - protein, 15 aa, BK virus
IAAGEAAAAIEVQIA

SEQ ID NO: 33465 - protein, 15 aa, BK virus
AAGEAAAAIEVQIAS

SEQ ID NO: 33466 - protein, 15 aa, BK virus
AGEAAAAIEVQIASL

SEQ ID NO: 33467 - protein, 15 aa, BK virus
GEAAAAIEVQIASLA

SEQ ID NO: 33468 - protein, 15 aa, BK virus
EAAAAIEVQIASLAT

SEQ ID NO: 33469 - protein, 15 aa, BK virus
AAAAIEVQIASLATV

SEQ ID NO: 33470 - protein, 15 aa, BK virus
AAAIEVQIASLATVE

SEQ ID NO: 33471 - protein, 15 aa, BK virus
AAIEVQIASLATVEG

SEQ ID NO: 33472 - protein, 15 aa, BK virus
AIEVQIASLATVEGI

SEQ ID NO: 33473 - protein, 15 aa, BK virus
IEVQIASLATVEGIT

SEQ ID NO: 33474 - protein, 15 aa, BK virus
EVQIASLATVEGITS

SEQ ID NO: 33475 - protein, 15 aa, BK virus
VQIASLATVEGITST

SEQ ID NO: 33476 - protein, 15 aa, BK virus
QIASLATVEGITSTS

SEQ ID NO: 33477 - protein, 15 aa, BK virus
IASLATVEGITSTSE

SEQ ID NO: 33478 - protein, 15 aa, BK virus
ASLATVEGITSTSEA

SEQ ID NO: 33479 - protein, 15 aa, BK virus
SLATVEGITSTSEAI

SEQ ID NO: 33480 - protein, 15 aa, BK virus
LATVEGITSTSEAIA

SEQ ID NO: 33481 - protein, 15 aa, BK virus
ATVEGITSTSEAIAA

SEQ ID NO: 33482 - protein, 15 aa, BK virus
TVEGITSTSEAIAAI

SEQ ID NO: 33483 - protein, 15 aa, BK virus
VEGITSTSEAIAAIG

SEQ ID NO: 33484 - protein, 15 aa, BK virus
EGITSTSEAIAAIGL

SEQ ID NO: 33485 - protein, 15 aa, BK virus
GITSTSEAIAAIGLT

SEQ ID NO: 33486 - protein, 15 aa, BK virus
ITSTSEAIAAIGLTP

SEQ ID NO: 33487 - protein, 15 aa, BK virus
TSTSEAIAAIGLTPQ

SEQ ID NO: 33488 - protein, 15 aa, BK virus
STSEAIAAIGLTPQT

SEQ ID NO: 33489 - protein, 15 aa, BK virus
TSEAIAAIGLTPQTY

SEQ ID NO: 33490 - protein, 15 aa, BK virus
SEAIAAIGLTPQTYA

SEQ ID NO: 33491 - protein, 15 aa, BK virus
EAIAAIGLTPQTYAV

SEQ ID NO: 33492 - protein, 15 aa, BK virus
AIAAIGLTPQTYAVI

SEQ ID NO: 33493 - protein, 15 aa, BK virus
IAAIGLTPQTYAVIA

SEQ ID NO: 33494 - protein, 15 aa, BK virus
AAIGLTPQTYAVIAG

SEQ ID NO: 33495 - protein, 15 aa, BK virus
AIGLTPQTYAVIAGA

SEQ ID NO: 33496 - protein, 15 aa, BK virus
IGLTPQTYAVIAGAP

SEQ ID NO: 33497 - protein, 15 aa, BK virus
GLTPQTYAVIAGAPG

SEQ ID NO: 33498 - protein, 15 aa, BK virus
LTPQTYAVIAGAPGA

SEQ ID NO: 33499 - protein, 15 aa, BK virus
TPQTYAVIAGAPGAI

SEQ ID NO: 33500 - protein, 15 aa, BK virus
PQTYAVIAGAPGAIA

SEQ ID NO: 33501 - protein, 15 aa, BK virus
QTYAVIAGAPGAIAG

SEQ ID NO: 33502 - protein, 15 aa, BK virus
TYAVIAGAPGAIAGF

SEQ ID NO: 33503 - protein, 15 aa, BK virus
YAVIAGAPGAIAGFA

SEQ ID NO: 33504 - protein, 15 aa, BK virus
AVIAGAPGAIAGFAA

SEQ ID NO: 33505 - protein, 15 aa, BK virus
VIAGAPGAIAGFAAL

SEQ ID NO: 33506 - protein, 15 aa, BK virus
IAGAPGAIAGFAALI

SEQ ID NO: 33507 - protein, 15 aa, BK virus
AGAPGAIAGFAALIQ

SEQ ID NO: 33508 - protein, 15 aa, BK virus
GAPGAIAGFAALIQT

SEQ ID NO: 33509 - protein, 15 aa, BK virus
APGAIAGFAALIQTV

SEQ ID NO: 33510 - protein, 15 aa, BK virus
PGAIAGFAALIQTVS

SEQ ID NO: 33511 - protein, 15 aa, BK virus
GAIAGFAALIQTVSG

SEQ ID NO: 33512 - protein, 15 aa, BK virus
AIAGFAALIQTVSGI

SEQ ID NO: 33513 - protein, 15 aa, BK virus
IAGFAALIQTVSGIS

SEQ ID NO: 33514 - protein, 15 aa, BK virus
AGFAALIQTVSGISS

SEQ ID NO: 33515 - protein, 15 aa, BK virus
GFAALIQTVSGISSL

SEQ ID NO: 33516 - protein, 15 aa, BK virus
FAALIQTVSGISSLA

SEQ ID NO: 33517 - protein, 15 aa, BK virus
AALIQTVSGISSLAQ

SEQ ID NO: 33518 - protein, 15 aa, BK virus
ALIQTVSGISSLAQV

SEQ ID NO: 33519 - protein, 15 aa, BK virus
LIQTVSGISSLAQVG

SEQ ID NO: 33520 - protein, 15 aa, BK virus
IQTVSGISSLAQVGY

SEQ ID NO: 33521 - protein, 15 aa, BK virus
QTVSGISSLAQVGYK

SEQ ID NO: 33522 - protein, 15 aa, BK virus
TVSGISSLAQVGYKF

SEQ ID NO: 33523 - protein, 15 aa, BK virus
VSGISSLAQVGYKFF

SEQ ID NO: 33524 - protein, 15 aa, BK virus
SGISSLAQVGYKFFD

SEQ ID NO: 33525 - protein, 15 aa, BK virus
GISSLAQVGYKFFDD

SEQ ID NO: 33526 - protein, 15 aa, BK virus
ISSLAQVGYKFFDDW

SEQ ID NO: 33527 - protein, 15 aa, BK virus
SSLAQVGYKFFDDWD

SEQ ID NO: 33528 - protein, 15 aa, BK virus
SLAQVGYKFFDDWDH

SEQ ID NO: 33529 - protein, 15 aa, BK virus
LAQVGYKFFDDWDHK

SEQ ID NO: 33530 - protein, 15 aa, BK virus
AQVGYKFFDDWDHKV

SEQ ID NO: 33531 - protein, 15 aa, BK virus
QVGYKFFDDWDHKVS

SEQ ID NO: 33532 - protein, 15 aa, BK virus
VGYKFFDDWDHKVST

SEQ ID NO: 33533 - protein, 15 aa, BK virus
GYKFFDDWDHKVSTV

SEQ ID NO: 33534 - protein, 15 aa, BK virus
YKFFDDWDHKVSTVG

SEQ ID NO: 33535 - protein, 15 aa, BK virus
KFFDDWDHKVSTVGL

SEQ ID NO: 33536 - protein, 15 aa, BK virus
FFDDWDHKVSTVGLY

SEQ ID NO: 33537 - protein, 15 aa, BK virus
FDDWDHKVSTVGLYQ

SEQ ID NO: 33538 - protein, 15 aa, BK virus
DDWDHKVSTVGLYQQ

SEQ ID NO: 33539 - protein, 15 aa, BK virus
DWDHKVSTVGLYQQS

SEQ ID NO: 33540 - protein, 15 aa, BK virus
WDHKVSTVGLYQQSG

SEQ ID NO: 33541 - protein, 15 aa, BK virus
DHKVSTVGLYQQSGM

SEQ ID NO: 33542 - protein, 15 aa, BK virus
HKVSTVGLYQQSGMA

SEQ ID NO: 33543 - protein, 15 aa, BK virus
KVSTVGLYQQSGMAL

SEQ ID NO: 33544 - protein, 15 aa, BK virus
VSTVGLYQQSGMALE

SEQ ID NO: 33545 - protein, 15 aa, BK virus
STVGLYQQSGMALEL

SEQ ID NO: 33546 - protein, 15 aa, BK virus
TVGLYQQSGMALELF

SEQ ID NO: 33547 - protein, 15 aa, BK virus
VGLYQQSGMALELFN

SEQ ID NO: 33548 - protein, 15 aa, BK virus
GLYQQSGMALELFNP

SEQ ID NO: 33549 - protein, 15 aa, BK virus
LYQQSGMALELFNPD

SEQ ID NO: 33550 - protein, 15 aa, BK virus
YQQSGMALELFNPDE

SEQ ID NO: 33551 - protein, 15 aa, BK virus
QQSGMALELFNPDEY

SEQ ID NO: 33552 - protein, 15 aa, BK virus
QSGMALELFNPDEYY

SEQ ID NO: 33553 - protein, 15 aa, BK virus
SGMALELFNPDEYYD

SEQ ID NO: 33554 - protein, 15 aa, BK virus
GMALELFNPDEYYDI

SEQ ID NO: 33555 - protein, 15 aa, BK virus
MALELFNPDEYYDIL

SEQ ID NO: 33556 - protein, 15 aa, BK virus
ALELFNPDEYYDILF

SEQ ID NO: 33557 - protein, 15 aa, BK virus
LELFNPDEYYDILFP

SEQ ID NO: 33558 - protein, 15 aa, BK virus
ELFNPDEYYDILFPG

SEQ ID NO: 33559 - protein, 15 aa, BK virus
LFNPDEYYDILFPGV

SEQ ID NO: 33560 - protein, 15 aa, BK virus
FNPDEYYDILFPGVN

SEQ ID NO: 33561 - protein, 15 aa, BK virus
NPDEYYDILFPGVNT

SEQ ID NO: 33562 - protein, 15 aa, BK virus
PDEYYDILFPGVNTF

SEQ ID NO: 33563 - protein, 15 aa, BK virus
DEYYDILFPGVNTFV

SEQ ID NO: 33564 - protein, 15 aa, BK virus
EYYDILFPGVNTFVN

SEQ ID NO: 33565 - protein, 15 aa, BK virus
YYDILFPGVNTFVNN

SEQ ID NO: 33566 - protein, 15 aa, BK virus
YDILFPGVNTFVNNI

SEQ ID NO: 33567 - protein, 15 aa, BK virus
DILFPGVNTFVNNIQ

SEQ ID NO: 33568 - protein, 15 aa, BK virus
ILFPGVNTFVNNIQY

SEQ ID NO: 33569 - protein, 15 aa, BK virus
LFPGVNTFVNNIQYL

SEQ ID NO: 33570 - protein, 15 aa, BK virus
FPGVNTFVNNIQYLD

SEQ ID NO: 33571 - protein, 15 aa, BK virus
PGVNTFVNNIQYLDP

SEQ ID NO: 33572 - protein, 15 aa, BK virus
GVNTFVNNIQYLDPR

SEQ ID NO: 33573 - protein, 15 aa, BK virus
VNTFVNNIQYLDPRH

SEQ ID NO: 33574 - protein, 15 aa, BK virus
NTFVNNIQYLDPRHW

SEQ ID NO: 33575 - protein, 15 aa, BK virus
TFVNNIQYLDPRHWG

SEQ ID NO: 33576 - protein, 15 aa, BK virus
FVNNIQYLDPRHWGP

SEQ ID NO: 33577 - protein, 15 aa, BK virus
VNNIQYLDPRHWGPS

SEQ ID NO: 33578 - protein, 15 aa, BK virus
NNIQYLDPRHWGPSL

SEQ ID NO: 33579 - protein, 15 aa, BK virus
NIQYLDPRHWGPSLF

SEQ ID NO: 33580 - protein, 15 aa, BK virus
IQYLDPRHWGPSLFA

SEQ ID NO: 33581 - protein, 15 aa, BK virus
QYLDPRHWGPSLFAT

SEQ ID NO: 33582 - protein, 15 aa, BK virus
YLDPRHWGPSLFATI

SEQ ID NO: 33583 - protein, 15 aa, BK virus
LDPRHWGPSLFATIS

SEQ ID NO: 33584 - protein, 15 aa, BK virus
DPRHWGPSLFATISQ

SEQ ID NO: 33585 - protein, 15 aa, BK virus
PRHWGPSLFATISQA

SEQ ID NO: 33586 - protein, 15 aa, BK virus
RHWGPSLFATISQAL

SEQ ID NO: 33587 - protein, 15 aa, BK virus
HWGPSLFATISQALW

SEQ ID NO: 33588 - protein, 15 aa, BK virus
WGPSLFATISQALWH

SEQ ID NO: 33589 - protein, 15 aa, BK virus
GPSLFATISQALWHV

SEQ ID NO: 33590 - protein, 15 aa, BK virus
PSLFATISQALWHVI

SEQ ID NO: 33591 - protein, 15 aa, BK virus
SLFATISQALWHVIR

SEQ ID NO: 33592 - protein, 15 aa, BK virus
LFATISQALWHVIRD

SEQ ID NO: 33593 - protein, 15 aa, BK virus
FATISQALWHVIRDD

SEQ ID NO: 33594 - protein, 15 aa, BK virus
ATISQALWHVIRDDI

SEQ ID NO: 33595 - protein, 15 aa, BK virus
TISQALWHVIRDDIP

SEQ ID NO: 33596 - protein, 15 aa, BK virus
ISQALWHVIRDDIPS

SEQ ID NO: 33597 - protein, 15 aa, BK virus
SQALWHVIRDDIPSI

SEQ ID NO: 33598 - protein, 15 aa, BK virus
QALWHVIRDDIPSIT

SEQ ID NO: 33599 - protein, 15 aa, BK virus
ALWHVIRDDIPSITS

SEQ ID NO: 33600 - protein, 15 aa, BK virus
LWHVIRDDIPSITSQ

SEQ ID NO: 33601 - protein, 15 aa, BK virus
WHVIRDDIPSITSQE

SEQ ID NO: 33602 - protein, 15 aa, BK virus
HVIRDDIPSITSQEL

SEQ ID NO: 33603 - protein, 15 aa, BK virus
VIRDDIPSITSQELQ

SEQ ID NO: 33604 - protein, 15 aa, BK virus
IRDDIPSITSQELQR

SEQ ID NO: 33605 - protein, 15 aa, BK virus
RDDIPSITSQELQRR

SEQ ID NO: 33606 - protein, 15 aa, BK virus
DDIPSITSQELQRRT

SEQ ID NO: 33607 - protein, 15 aa, BK virus
DIPSITSQELQRRTE

SEQ ID NO: 33608 - protein, 15 aa, BK virus
IPSITSQELQRRTER

SEQ ID NO: 33609 - protein, 15 aa, BK virus
PSITSQELQRRTERF

SEQ ID NO: 33610 - protein, 15 aa, BK virus
SITSQELQRRTERFF

SEQ ID NO: 33611 - protein, 15 aa, BK virus
ITSQELQRRTERFFR

SEQ ID NO: 33612 - protein, 15 aa, BK virus
TSQELQRRTERFFRD

SEQ ID NO: 33613 - protein, 15 aa, BK virus
SQELQRRTERFFRDS

SEQ ID NO: 33614 - protein, 15 aa, BK virus
QELQRRTERFFRDSL

SEQ ID NO: 33615 - protein, 15 aa, BK virus
ELQRRTERFFRDSLA

SEQ ID NO: 33616 - protein, 15 aa, BK virus
LQRRTERFFRDSLAR

SEQ ID NO: 33617 - protein, 15 aa, BK virus
QRRTERFFRDSLARF

SEQ ID NO: 33618 - protein, 15 aa, BK virus
RRTERFFRDSLARFL

SEQ ID NO: 33619 - protein, 15 aa, BK virus
RTERFFRDSLARFLE

SEQ ID NO: 33620 - protein, 15 aa, BK virus
TERFFRDSLARFLEE

SEQ ID NO: 33621 - protein, 15 aa, BK virus
ERFFRDSLARFLEET

SEQ ID NO: 33622 - protein, 15 aa, BK virus
RFFRDSLARFLEETT

SEQ ID NO: 33623 - protein, 15 aa, BK virus
FFRDSLARFLEETTW

SEQ ID NO: 33624 - protein, 15 aa, BK virus
FRDSLARFLEETTWT

SEQ ID NO: 33625 - protein, 15 aa, BK virus
RDSLARFLEETTWTI

SEQ ID NO: 33626 - protein, 15 aa, BK virus
DSLARFLEETTWTIV

SEQ ID NO: 33627 - protein, 15 aa, BK virus
SLARFLEETTWTIVN

SEQ ID NO: 33628 - protein, 15 aa, BK virus
LARFLEETTWTIVNA

SEQ ID NO: 33629 - protein, 15 aa, BK virus
ARFLEETTWTIVNAP

SEQ ID NO: 33630 - protein, 15 aa, BK virus
RFLEETTWTIVNAPI

SEQ ID NO: 33631 - protein, 15 aa, BK virus
FLEETTWTIVNAPIN

SEQ ID NO: 33632 - protein, 15 aa, BK virus
LEETTWTIVNAPINF

SEQ ID NO: 33633 - protein, 15 aa, BK virus
EETTWTIVNAPINFY

SEQ ID NO: 33634 - protein, 15 aa, BK virus
ETTWTIVNAPINFYN

SEQ ID NO: 33635 - protein, 15 aa, BK virus
TTWTIVNAPINFYNY

SEQ ID NO: 33636 - protein, 15 aa, BK virus
TWTIVNAPINFYNYI

SEQ ID NO: 33637 - protein, 15 aa, BK virus
WTIVNAPINFYNYIQ

SEQ ID NO: 33638 - protein, 15 aa, BK virus
TIVNAPINFYNYIQQ

SEQ ID NO: 33639 - protein, 15 aa, BK virus
IVNAPINFYNYIQQY

SEQ ID NO: 33640 - protein, 15 aa, BK virus
VNAPINFYNYIQQYY

SEQ ID NO: 33641 - protein, 15 aa, BK virus
NAPINFYNYIQQYYS

SEQ ID NO: 33642 - protein, 15 aa, BK virus
APINFYNYIQQYYSD

SEQ ID NO: 33643 - protein, 15 aa, BK virus
PINFYNYIQQYYSDL

SEQ ID NO: 33644 - protein, 15 aa, BK virus
INFYNYIQQYYSDLS

SEQ ID NO: 33645 - protein, 15 aa, BK virus
NFYNYIQQYYSDLSP

SEQ ID NO: 33646 - protein, 15 aa, BK virus
FYNYIQQYYSDLSPI

SEQ ID NO: 33647 - protein, 15 aa, BK virus
YNYIQQYYSDLSPIR

SEQ ID NO: 33648 - protein, 15 aa, BK virus
NYIQQYYSDLSPIRP

SEQ ID NO: 33649 - protein, 15 aa, BK virus
YIQQYYSDLSPIRPS

SEQ ID NO: 33650 - protein, 15 aa, BK virus
IQQYYSDLSPIRPSM

SEQ ID NO: 33651 - protein, 15 aa, BK virus
QQYYSDLSPIRPSMV

SEQ ID NO: 33652 - protein, 15 aa, BK virus
QYYSDLSPIRPSMVR

SEQ ID NO: 33653 - protein, 15 aa, BK virus
YYSDLSPIRPSMVRQ

SEQ ID NO: 33654 - protein, 15 aa, BK virus
YSDLSPIRPSMVRQV

SEQ ID NO: 33655 - protein, 15 aa, BK virus
SDLSPIRPSMVRQVA

SEQ ID NO: 33656 - protein, 15 aa, BK virus
DLSPIRPSMVRQVAE

SEQ ID NO: 33657 - protein, 15 aa, BK virus
LSPIRPSMVRQVAER

SEQ ID NO: 33658 - protein, 15 aa, BK virus
SPIRPSMVRQVAERE

SEQ ID NO: 33659 - protein, 15 aa, BK virus
PIRPSMVRQVAEREG

SEQ ID NO: 33660 - protein, 15 aa, BK virus
IRPSMVRQVAEREGT

SEQ ID NO: 33661 - protein, 15 aa, BK virus
RPSMVRQVAEREGTR

SEQ ID NO: 33662 - protein, 15 aa, BK virus
PSMVRQVAEREGTRV

SEQ ID NO: 33663 - protein, 15 aa, BK virus
SMVRQVAEREGTRVH

SEQ ID NO: 33664 - protein, 15 aa, BK virus
MVRQVAEREGTRVHF

SEQ ID NO: 33665 - protein, 15 aa, BK virus
VRQVAEREGTRVHFG

SEQ ID NO: 33666 - protein, 15 aa, BK virus
RQVAEREGTRVHFGH

SEQ ID NO: 33667 - protein, 15 aa, BK virus
QVAEREGTRVHFGHT

SEQ ID NO: 33668 - protein, 15 aa, BK virus
VAEREGTRVHFGHTY

SEQ ID NO: 33669 - protein, 15 aa, BK virus
AEREGTRVHFGHTYS

SEQ ID NO: 33670 - protein, 15 aa, BK virus
EREGTRVHFGHTYSI

SEQ ID NO: 33671 - protein, 15 aa, BK virus
REGTRVHFGHTYSID

SEQ ID NO: 33672 - protein, 15 aa, BK virus
EGTRVHFGHTYSIDD

SEQ ID NO: 33673 - protein, 15 aa, BK virus
GTRVHFGHTYSIDDA

SEQ ID NO: 33674 - protein, 15 aa, BK virus
TRVHFGHTYSIDDAD

SEQ ID NO: 33675 - protein, 15 aa, BK virus
RVHFGHTYSIDDADS

SEQ ID NO: 33676 - protein, 15 aa, BK virus
VHFGHTYSIDDADSI

SEQ ID NO: 33677 - protein, 15 aa, BK virus
HFGHTYSIDDADSIE

SEQ ID NO: 33678 - protein, 15 aa, BK virus
FGHTYSIDDADSIEE

SEQ ID NO: 33679 - protein, 15 aa, BK virus
GHTYSIDDADSIEEV

SEQ ID NO: 33680 - protein, 15 aa, BK virus
HTYSIDDADSIEEVT

SEQ ID NO: 33681 - protein, 15 aa, BK virus
TYSIDDADSIEEVTQ

SEQ ID NO: 33682 - protein, 15 aa, BK virus
YSIDDADSIEEVTQR

SEQ ID NO: 33683 - protein, 15 aa, BK virus
SIDDADSIEEVTQRM

SEQ ID NO: 33684 - protein, 15 aa, BK virus
IDDADSIEEVTQRMD

SEQ ID NO: 33685 - protein, 15 aa, BK virus
DDADSIEEVTQRMDL

SEQ ID NO: 33686 - protein, 15 aa, BK virus
DADSIEEVTQRMDLR

SEQ ID NO: 33687 - protein, 15 aa, BK virus
ADSIEEVTQRMDLRN

SEQ ID NO: 33688 - protein, 15 aa, BK virus
DSIEEVTQRMDLRNQ

SEQ ID NO: 33689 - protein, 15 aa, BK virus
SIEEVTQRMDLRNQQ

SEQ ID NO: 33690 - protein, 15 aa, BK virus
IEEVTQRMDLRNQQS

SEQ ID NO: 33691 - protein, 15 aa, BK virus
EEVTQRMDLRNQQSV

SEQ ID NO: 33692 - protein, 15 aa, BK virus
EVTQRMDLRNQQSVH

SEQ ID NO: 33693 - protein, 15 aa, BK virus
VTQRMDLRNQQSVHS

SEQ ID NO: 33694 - protein, 15 aa, BK virus
TQRMDLRNQQSVHSG

SEQ ID NO: 33695 - protein, 15 aa, BK virus
QRMDLRNQQSVHSGE

SEQ ID NO: 33696 - protein, 15 aa, BK virus
RMDLRNQQSVHSGEF

SEQ ID NO: 33697 - protein, 15 aa, BK virus
MDLRNQQSVHSGEFI

SEQ ID NO: 33698 - protein, 15 aa, BK virus
DLRNQQSVHSGEFIE

SEQ ID NO: 33699 - protein, 15 aa, BK virus
LRNQQSVHSGEFIEK

SEQ ID NO: 33700 - protein, 15 aa, BK virus
RNQQSVHSGEFIEKT

SEQ ID NO: 33701 - protein, 15 aa, BK virus
NQQSVHSGEFIEKTI

SEQ ID NO: 33702 - protein, 15 aa, BK virus
QQSVHSGEFIEKTIA

SEQ ID NO: 33703 - protein, 15 aa, BK virus
QSVHSGEFIEKTIAP

SEQ ID NO: 33704 - protein, 15 aa, BK virus
SVHSGEFIEKTIAPG

SEQ ID NO: 33705 - protein, 15 aa, BK virus
VHSGEFIEKTIAPGG

SEQ ID NO: 33706 - protein, 15 aa, BK virus
HSGEFIEKTIAPGGA

SEQ ID NO: 33707 - protein, 15 aa, BK virus
SGEFIEKTIAPGGAN

SEQ ID NO: 33708 - protein, 15 aa, BK virus
GEFIEKTIAPGGANQ

SEQ ID NO: 33709 - protein, 15 aa, BK virus
EFIEKTIAPGGANQR

SEQ ID NO: 33710 - protein, 15 aa, BK virus
FIEKTIAPGGANQRT

SEQ ID NO: 33711 - protein, 15 aa, BK virus
IEKTIAPGGANQRTA

SEQ ID NO: 33712 - protein, 15 aa, BK virus
EKTIAPGGANQRTAP

SEQ ID NO: 33713 - protein, 15 aa, BK virus
KTIAPGGANQRTAPQ

SEQ ID NO: 33714 - protein, 15 aa, BK virus
TIAPGGANQRTAPQW

SEQ ID NO: 33715 - protein, 15 aa, BK virus
IAPGGANQRTAPQWM

SEQ ID NO: 33716 - protein, 15 aa, BK virus
APGGANQRTAPQWML

SEQ ID NO: 33717 - protein, 15 aa, BK virus
PGGANQRTAPQWMLP

SEQ ID NO: 33718 - protein, 15 aa, BK virus
GGANQRTAPQWMLPL

SEQ ID NO: 33719 - protein, 15 aa, BK virus
GANQRTAPQWMLPLL

SEQ ID NO: 33720 - protein, 15 aa, BK virus
ANQRTAPQWMLPLLL

SEQ ID NO: 33721 - protein, 15 aa, BK virus
NQRTAPQWMLPLLLG

SEQ ID NO: 33722 - protein, 15 aa, BK virus
QRTAPQWMLPLLLGL

SEQ ID NO: 33723 - protein, 15 aa, BK virus
RTAPQWMLPLLLGLY

SEQ ID NO: 33724 - protein, 15 aa, BK virus
TAPQWMLPLLLGLYG

SEQ ID NO: 33725 - protein, 15 aa, BK virus
APQWMLPLLLGLYGT

SEQ ID NO: 33726 - protein, 15 aa, BK virus
PQWMLPLLLGLYGTV

SEQ ID NO: 33727 - protein, 15 aa, BK virus
QWMLPLLLGLYGTVT

SEQ ID NO: 33728 - protein, 15 aa, BK virus
WMLPLLLGLYGTVTP

SEQ ID NO: 33729 - protein, 15 aa, BK virus
MLPLLLGLYGTVTPA

SEQ ID NO: 33730 - protein, 15 aa, BK virus
LPLLLGLYGTVTPAL

SEQ ID NO: 33731 - protein, 15 aa, BK virus
PLLLGLYGTVTPALE

SEQ ID NO: 33732 - protein, 15 aa, BK virus
LLLGLYGTVTPALEA

SEQ ID NO: 33733 - protein, 15 aa, BK virus
LLGLYGTVTPALEAY

SEQ ID NO: 33734 - protein, 15 aa, BK virus
LGLYGTVTPALEAYE

SEQ ID NO: 33735 - protein, 15 aa, BK virus
GLYGTVTPALEAYED

SEQ ID NO: 33736 - protein, 15 aa, BK virus
LYGTVTPALEAYEDG

SEQ ID NO: 33737 - protein, 15 aa, BK virus
YGTVTPALEAYEDGP

SEQ ID NO: 33738 - protein, 15 aa, BK virus
GTVTPALEAYEDGPN

SEQ ID NO: 33739 - protein, 15 aa, BK virus
TVTPALEAYEDGPNQ

SEQ ID NO: 33740 - protein, 15 aa, BK virus
VTPALEAYEDGPNQK

SEQ ID NO: 33741 - protein, 15 aa, BK virus
TPALEAYEDGPNQKK

SEQ ID NO: 33742 - protein, 15 aa, BK virus
PALEAYEDGPNQKKR

SEQ ID NO: 33743 - protein, 15 aa, BK virus
ALEAYEDGPNQKKRR

SEQ ID NO: 33744 - protein, 15 aa, BK virus
LEAYEDGPNQKKRRV

SEQ ID NO: 33745 - protein, 15 aa, BK virus
EAYEDGPNQKKRRVS

SEQ ID NO: 33746 - protein, 15 aa, BK virus
AYEDGPNQKKRRVSR

SEQ ID NO: 33747 - protein, 15 aa, BK virus
YEDGPNQKKRRVSRG

SEQ ID NO: 33748 - protein, 15 aa, BK virus
EDGPNQKKRRVSRGS

SEQ ID NO: 33749 - protein, 15 aa, BK virus
DGPNQKKRRVSRGSS

SEQ ID NO: 33750 - protein, 15 aa, BK virus
GPNQKKRRVSRGSSQ

SEQ ID NO: 33751 - protein, 15 aa, BK virus
PNQKKRRVSRGSSQK

SEQ ID NO: 33752 - protein, 15 aa, BK virus
NQKKRRVSRGSSQKA

SEQ ID NO: 33753 - protein, 15 aa, BK virus
QKKRRVSRGSSQKAK

SEQ ID NO: 33754 - protein, 15 aa, BK virus
KKRRVSRGSSQKAKG

SEQ ID NO: 33755 - protein, 15 aa, BK virus
KRRVSRGSSQKAKGT

SEQ ID NO: 33756 - protein, 15 aa, BK virus
RRVSRGSSQKAKGTR

SEQ ID NO: 33757 - protein, 15 aa, BK virus
RVSRGSSQKAKGTRA

SEQ ID NO: 33758 - protein, 15 aa, BK virus
VSRGSSQKAKGTRAS

SEQ ID NO: 33759 - protein, 15 aa, BK virus
SRGSSQKAKGTRASA

SEQ ID NO: 33760 - protein, 15 aa, BK virus
RGSSQKAKGTRASAK

SEQ ID NO: 33761 - protein, 15 aa, BK virus
GSSQKAKGTRASAKT

SEQ ID NO: 33762 - protein, 15 aa, BK virus
SSQKAKGTRASAKTT

SEQ ID NO: 33763 - protein, 15 aa, BK virus
SQKAKGTRASAKTTN

SEQ ID NO: 33764 - protein, 15 aa, BK virus
QKAKGTRASAKTTNK

SEQ ID NO: 33765 - protein, 15 aa, BK virus
KAKGTRASAKTTNKR

SEQ ID NO: 33766 - protein, 15 aa, BK virus
AKGTRASAKTTNKRR

SEQ ID NO: 33767 - protein, 15 aa, BK virus
KGTRASAKTTNKRRS

SEQ ID NO: 33768 - protein, 15 aa, BK virus
GTRASAKTTNKRRSR

SEQ ID NO: 33769 - protein, 15 aa, BK virus
TRASAKTTNKRRSRS

SEQ ID NO: 33770 - protein, 15 aa, BK virus
RASAKTTNKRRSRSS

SEQ ID NO: 33771 - protein, 15 aa, BK virus
ASAKTTNKRRSRSSR

SEQ ID NO: 33772 - protein, 15 aa, BK virus
SAKTTNKRRSRSSRS

SEQ ID NO: 33773 - protein, 15 aa, BK virus
NWGRCYYRGRMLPKP

SEQ ID NO: 33774 - protein, 15 aa, BK virus
WGRCYYRGRMLPKPR

SEQ ID NO: 33775 - protein, 15 aa, BK virus
GRCYYRGRMLPKPRN

SEQ ID NO: 33776 - protein, 15 aa, BK virus
RCYYRGRMLPKPRNG

SEQ ID NO: 33777 - protein, 15 aa, BK virus
CYYRGRMLPKPRNGG

SEQ ID NO: 33778 - protein, 15 aa, BK virus
YYRGRMLPKPRNGGS

SEQ ID NO: 33779 - protein, 15 aa, BK virus
YRGRMLPKPRNGGSR

SEQ ID NO: 33780 - protein, 15 aa, BK virus
PREKNASLLQHSKNS

SEQ ID NO: 33781 - protein, 15 aa, BK virus
REKNASLLQHSKNSP

SEQ ID NO: 33782 - protein, 15 aa, BK virus
EKNASLLQHSKNSPP

SEQ ID NO: 33783 - protein, 15 aa, BK virus
KNASLLQHSKNSPPQ

SEQ ID NO: 33784 - protein, 15 aa, BK virus
NASLLQHSKNSPPQF

SEQ ID NO: 33785 - protein, 15 aa, BK virus
ASLLQHSKNSPPQFK

SEQ ID NO: 33786 - protein, 15 aa, BK virus
GPNLWKSTDVGGCNC

SEQ ID NO: 33787 - protein, 15 aa, BK virus
PNLWKSTDVGGCNCT

SEQ ID NO: 33788 - protein, 15 aa, BK virus
NLWKSTDVGGCNCTN

SEQ ID NO: 33789 - protein, 15 aa, BK virus
LWKSTDVGGCNCTNR

SEQ ID NO: 33790 - protein, 15 aa, BK virus
WKSTDVGGCNCTNRG

SEQ ID NO: 33791 - protein, 15 aa, BK virus
KSTDVGGCNCTNRGY

SEQ ID NO: 33792 - protein, 15 aa, BK virus
STDVGGCNCTNRGYW

SEQ ID NO: 33793 - protein, 15 aa, BK virus
TDVGGCNCTNRGYWN

SEQ ID NO: 33794 - protein, 15 aa, BK virus
DVGGCNCTNRGYWNN

SEQ ID NO: 33795 - protein, 15 aa, BK virus
FPLLCCRWRTLGNAG

SEQ ID NO: 33796 - protein, 15 aa, BK virus
PLLCCRWRTLGNAGS

SEQ ID NO: 33797 - protein, 15 aa, BK virus
LLCCRWRTLGNAGSA

SEQ ID NO: 33798 - protein, 15 aa, BK virus
LCCRWRTLGNAGSAN

SEQ ID NO: 33799 - protein, 15 aa, BK virus
CCRWRTLGNAGSANE

SEQ ID NO: 33800 - protein, 15 aa, BK virus
CRWRTLGNAGSANEL

SEQ ID NO: 33801 - protein, 15 aa, BK virus
RWRTLGNAGSANELQ

SEQ ID NO: 33802 - protein, 15 aa, BK virus
WRTLGNAGSANELQV

SEQ ID NO: 33803 - protein, 15 aa, BK virus
RTLGNAGSANELQVK

SEQ ID NO: 33804 - protein, 15 aa, BK virus
TLGNAGSANELQVKV

SEQ ID NO: 33805 - protein, 15 aa, BK virus
LGNAGSANELQVKVP

SEQ ID NO: 33806 - protein, 15 aa, BK virus
VFWDFHRRGKCSPST

SEQ ID NO: 33807 - protein, 15 aa, BK virus
FWDFHRRGKCSPSTS

SEQ ID NO: 33808 - protein, 15 aa, BK virus
WDFHRRGKCSPSTSC

SEQ ID NO: 33809 - protein, 15 aa, BK virus
DFHRRGKCSPSTSCD

SEQ ID NO: 33810 - protein, 15 aa, BK virus
FHRRGKCSPSTSCDQ

SEQ ID NO: 33811 - protein, 15 aa, BK virus
HRRGKCSPSTSCDQH

SEQ ID NO: 33812 - protein, 15 aa, BK virus
RRGKCSPSTSCDQHS

SEQ ID NO: 33813 - protein, 15 aa, BK virus
RGKCSPSTSCDQHSY

SEQ ID NO: 33814 - protein, 15 aa, BK virus
GKCSPSTSCDQHSYH

SEQ ID NO: 33815 - protein, 15 aa, BK virus
KCSPSTSCDQHSYHS

SEQ ID NO: 33816 - protein, 15 aa, BK virus
CSPSTSCDQHSYHSV

SEQ ID NO: 33817 - protein, 15 aa, BK virus
SPSTSCDQHSYHSVA

SEQ ID NO: 33818 - protein, 15 aa, BK virus
PSTSCDQHSYHSVAR

SEQ ID NO: 33819 - protein, 15 aa, BK virus
DPPEKKICKESLPNF

SEQ ID NO: 33820 - protein, 15 aa, BK virus
PPEKKICKESLPNFL

SEQ ID NO: 33821 - protein, 15 aa, BK virus
PEKKICKESLPNFLF

SEQ ID NO: 33822 - protein, 15 aa, BK virus
EKKICKESLPNFLFA

SEQ ID NO: 33823 - protein, 15 aa, BK virus
KKICKESLPNFLFAK

SEQ ID NO: 33824 - protein, 15 aa, BK virus
PYKQENPESGWAAYV

SEQ ID NO: 33825 - protein, 15 aa, BK virus
YKQENPESGWAAYVW

SEQ ID NO: 33826 - protein, 15 aa, BK virus
KQENPESGWAAYVWY

SEQ ID NO: 33827 - protein, 15 aa, BK virus
QENPESGWAAYVWYG

SEQ ID NO: 33828 - protein, 15 aa, BK virus
ENPESGWAAYVWYGI

SEQ ID NO: 33829 - protein, 15 aa, BK virus
NPESGWAAYVWYGIP

SEQ ID NO: 33830 - protein, 15 aa, BK virus
PESGWAAYVWYGIPG

SEQ ID NO: 33831 - protein, 15 aa, BK virus
ESGWAAYVWYGIPGR

SEQ ID NO: 33832 - protein, 15 aa, BK virus
SGWAAYVWYGIPGRR

SEQ ID NO: 33833 - protein, 15 aa, BK virus
GWAAYVWYGIPGRRG

SEQ ID NO: 33834 - protein, 15 aa, BK virus
WHRKTSRGPRYDKIY

SEQ ID NO: 33835 - protein, 15 aa, BK virus
QTGTIANQNALNRCF

SEQ ID NO: 33836 - protein, 15 aa, BK virus
TGTIANQNALNRCFY

SEQ ID NO: 33837 - protein, 15 aa, BK virus
GTIANQNALNRCFYC

SEQ ID NO: 33838 - protein, 15 aa, BK virus
TIANQNALNRCFYCT

SEQ ID NO: 33839 - protein, 15 aa, BK virus
IANQNALNRCFYCTY

SEQ ID NO: 33840 - protein, 15 aa, BK virus
ANQNALNRCFYCTYT

SEQ ID NO: 33841 - protein, 15 aa, BK virus
NQNALNRCFYCTYTF

SEQ ID NO: 33842 - protein, 15 aa, BK virus
QNALNRCFYCTYTFN

SEQ ID NO: 33843 - protein, 15 aa, BK virus
NALNRCFYCTYTFNK

SEQ ID NO: 33844 - protein, 15 aa, BK virus
ALNRCFYCTYTFNKC

SEQ ID NO: 33845 - protein, 15 aa, BK virus
LNRCFYCTYTFNKCC

SEQ ID NO: 33846 - protein, 15 aa, BK virus
NRCFYCTYTFNKCCF

SEQ ID NO: 33847 - protein, 15 aa, BK virus
RCFYCTYTFNKCCFC

SEQ ID NO: 33848 - protein, 15 aa, BK virus
CFYCTYTFNKCCFCI

SEQ ID NO: 33849 - protein, 15 aa, BK virus
FYCTYTFNKCCFCIS

SEQ ID NO: 33850 - protein, 15 aa, BK virus
YCTYTFNKCCFCISH

SEQ ID NO: 33851 - protein, 15 aa, BK virus
CTYTFNKCCFCISHF

SEQ ID NO: 33852 - protein, 15 aa, BK virus
NTESLYTNATLDYGG

SEQ ID NO: 33853 - protein, 15 aa, BK virus
TESLYTNATLDYGGL

SEQ ID NO: 33854 - protein, 15 aa, BK virus
ESLYTNATLDYGGLT

SEQ ID NO: 33855 - protein, 15 aa, BK virus
SLYTNATLDYGGLTF

SEQ ID NO: 33856 - protein, 15 aa, BK virus
LYTNATLDYGGLTFG

SEQ ID NO: 33857 - protein, 15 aa, BK virus
YTNATLDYGGLTFGN

SEQ ID NO: 33858 - protein, 15 aa, BK virus
TNATLDYGGLTFGNL

SEQ ID NO: 33859 - protein, 15 aa, BK virus
NATLDYGGLTFGNLQ

SEQ ID NO: 33860 - protein, 15 aa, BK virus
ATLDYGGLTFGNLQQ

SEQ ID NO: 33861 - protein, 15 aa, BK virus
TLDYGGLTFGNLQQG

SEQ ID NO: 33862 - protein, 15 aa, BK virus
LDYGGLTFGNLQQGL

SEQ ID NO: 33863 - protein, 15 aa, BK virus
DYGGLTFGNLQQGLK

SEQ ID NO: 33864 - protein, 15 aa, BK virus
YGGLTFGNLQQGLKY

SEQ ID NO: 33865 - protein, 15 aa, BK virus
GGLTFGNLQQGLKYL

SEQ ID NO: 33866 - protein, 15 aa, BK virus
GLTFGNLQQGLKYLR

SEQ ID NO: 33867 - protein, 15 aa, BK virus
LTFGNLQQGLKYLRL

SEQ ID NO: 33868 - protein, 15 aa, BK virus
TFGNLQQGLKYLRLG

SEQ ID NO: 33869 - protein, 15 aa, BK virus
FGNLQQGLKYLRLGK

SEQ ID NO: 33870 - protein, 15 aa, BK virus
GNLQQGLKYLRLGKS

SEQ ID NO: 33871 - protein, 15 aa, BK virus
NLQQGLKYLRLGKSI

SEQ ID NO: 33872 - protein, 15 aa, BK virus
LQQGLKYLRLGKSIV

SEQ ID NO: 33873 - protein, 15 aa, BK virus
QQGLKYLRLGKSIVI

SEQ ID NO: 33874 - protein, 15 aa, BK virus
QGLKYLRLGKSIVIG

SEQ ID NO: 33875 - protein, 15 aa, BK virus
GLKYLRLGKSIVIGI

SEQ ID NO: 33876 - protein, 15 aa, BK virus
LKYLRLGKSIVIGIQ

SEQ ID NO: 33877 - protein, 15 aa, BK virus
KYLRLGKSIVIGIQC

SEQ ID NO: 33878 - protein, 15 aa, BK virus
YLRLGKSIVIGIQCL

SEQ ID NO: 33879 - protein, 15 aa, BK virus
LRLGKSIVIGIQCLI

SEQ ID NO: 33880 - protein, 15 aa, BK virus
RLGKSIVIGIQCLIH

SEQ ID NO: 33881 - protein, 15 aa, BK virus
LGKSIVIGIQCLIHV

SEQ ID NO: 33882 - protein, 15 aa, BK virus
GKSIVIGIQCLIHVQ

SEQ ID NO: 33883 - protein, 15 aa, BK virus
KSIVIGIQCLIHVQS

SEQ ID NO: 33884 - protein, 15 aa, BK virus
SIVIGIQCLIHVQSL

SEQ ID NO: 33885 - protein, 15 aa, BK virus
IVIGIQCLIHVQSLQ

SEQ ID NO: 33886 - protein, 15 aa, BK virus
VIGIQCLIHVQSLQF

SEQ ID NO: 33887 - protein, 15 aa, BK virus
IGIQCLIHVQSLQFL

SEQ ID NO: 33888 - protein, 15 aa, BK virus
GIQCLIHVQSLQFLN

SEQ ID NO: 33889 - protein, 15 aa, BK virus
IQCLIHVQSLQFLNP

SEQ ID NO: 33890 - protein, 15 aa, BK virus
QCLIHVQSLQFLNPL

SEQ ID NO: 33891 - protein, 15 aa, BK virus
CLIHVQSLQFLNPLL

SEQ ID NO: 33892 - protein, 15 aa, BK virus
LIHVQSLQFLNPLLL

SEQ ID NO: 33893 - protein, 15 aa, BK virus
YQEYISPCIYYISSL

SEQ ID NO: 33894 - protein, 15 aa, BK virus
QEYISPCIYYISSLK

SEQ ID NO: 33895 - protein, 15 aa, BK virus
EYISPCIYYISSLKK

SEQ ID NO: 33896 - protein, 15 aa, BK virus
YISPCIYYISSLKKY

SEQ ID NO: 33897 - protein, 15 aa, BK virus
ISPCIYYISSLKKYT

SEQ ID NO: 33898 - protein, 15 aa, BK virus
SPCIYYISSLKKYTY

SEQ ID NO: 33899 - protein, 15 aa, BK virus
PCIYYISSLKKYTYL

SEQ ID NO: 33900 - protein, 15 aa, BK virus
CIYYISSLKKYTYLS

SEQ ID NO: 33901 - protein, 15 aa, BK virus
IYYISSLKKYTYLSQ

SEQ ID NO: 33902 - protein, 15 aa, BK virus
YYISSLKKYTYLSQN

SEQ ID NO: 33903 - protein, 15 aa, BK virus
YISSLKKYTYLSQNP

SEQ ID NO: 33904 - protein, 15 aa, BK virus
ISSLKKYTYLSQNPA

SEQ ID NO: 33905 - protein, 15 aa, BK virus
SSLKKYTYLSQNPAF

SEQ ID NO: 33906 - protein, 15 aa, BK virus
SLKKYTYLSQNPAFP

SEQ ID NO: 33907 - protein, 15 aa, BK virus
LKKYTYLSQNPAFPS

SEQ ID NO: 33908 - protein, 15 aa, BK virus
KKYTYLSQNPAFPSI

SEQ ID NO: 33909 - protein, 15 aa, BK virus
KYTYLSQNPAFPSIQ

SEQ ID NO: 33910 - protein, 15 aa, BK virus
YTYLSQNPAFPSIQQ

SEQ ID NO: 33911 - protein, 15 aa, BK virus
TYLSQNPAFPSIQQF

SEQ ID NO: 33912 - protein, 15 aa, BK virus
TKLAVATRSFHFVKF

SEQ ID NO: 33913 - protein, 15 aa, BK virus
KLAVATRSFHFVKFF

SEQ ID NO: 33914 - protein, 15 aa, BK virus
LAVATRSFHFVKFFF

SEQ ID NO: 33915 - protein, 15 aa, BK virus
AVATRSFHFVKFFFQ

SEQ ID NO: 33916 - protein, 15 aa, BK virus
VATRSFHFVKFFFQV

SEQ ID NO: 33917 - protein, 15 aa, BK virus
ATRSFHFVKFFFQVR

SEQ ID NO: 33918 - protein, 15 aa, BK virus
TRSFHFVKFFFQVRT

SEQ ID NO: 33919 - protein, 15 aa, BK virus
RSFHFVKFFFQVRTL

SEQ ID NO: 33920 - protein, 15 aa, BK virus
SFHFVKFFFQVRTLS

SEQ ID NO: 33921 - protein, 15 aa, BK virus
FHFVKFFFQVRTLSF

SEQ ID NO: 33922 - protein, 15 aa, BK virus
HFVKFFFQVRTLSFV

SEQ ID NO: 33923 - protein, 15 aa, BK virus
FVKFFFQVRTLSFVR

SEQ ID NO: 33924 - protein, 15 aa, BK virus
VKFFFQVRTLSFVRI

SEQ ID NO: 33925 - protein, 15 aa, BK virus
KFFFQVRTLSFVRIF

SEQ ID NO: 33926 - protein, 15 aa, BK virus
FFFQVRTLSFVRIFL

SEQ ID NO: 33927 - protein, 15 aa, BK virus
FFQVRTLSFVRIFLN

SEQ ID NO: 33928 - protein, 15 aa, BK virus
FQVRTLSFVRIFLNI

SEQ ID NO: 33929 - protein, 15 aa, BK virus
QVRTLSFVRIFLNIF

SEQ ID NO: 33930 - protein, 15 aa, BK virus
VRTLSFVRIFLNIFW

SEQ ID NO: 33931 - protein, 15 aa, BK virus
RTLSFVRIFLNIFWA

SEQ ID NO: 33932 - protein, 15 aa, BK virus
PSLVEIFGFFCLNVS

SEQ ID NO: 33933 - protein, 15 aa, BK virus
SLVEIFGFFCLNVSF

SEQ ID NO: 33934 - protein, 15 aa, BK virus
LVEIFGFFCLNVSFL

SEQ ID NO: 33935 - protein, 15 aa, BK virus
VEIFGFFCLNVSFLN

SEQ ID NO: 33936 - protein, 15 aa, BK virus
EIFGFFCLNVSFLNL

SEQ ID NO: 33937 - protein, 15 aa, BK virus
IFGFFCLNVSFLNLP

SEQ ID NO: 33938 - protein, 15 aa, BK virus
HFHLNNLSNCLNCLF

SEQ ID NO: 33939 - protein, 15 aa, BK virus
FHLNNLSNCLNCLFH

SEQ ID NO: 33940 - protein, 15 aa, BK virus
HLNNLSNCLNCLFHV

SEQ ID NO: 33941 - protein, 15 aa, BK virus
LNNLSNCLNCLFHVL

SEQ ID NO: 33942 - protein, 15 aa, BK virus
NNLSNCLNCLFHVLK

SEQ ID NO: 33943 - protein, 15 aa, BK virus
NLSNCLNCLFHVLKA

SEQ ID NO: 33944 - protein, 15 aa, BK virus
LSNCLNCLFHVLKAN

SEQ ID NO: 33945 - protein, 15 aa, BK virus
SNCLNCLFHVLKANP

SEQ ID NO: 33946 - protein, 15 aa, BK virus
NCLNCLFHVLKANPL

SEQ ID NO: 33947 - protein, 15 aa, BK virus
CLNCLFHVLKANPLI

SEQ ID NO: 33948 - protein, 15 aa, BK virus
LNCLFHVLKANPLIQ

SEQ ID NO: 33949 - protein, 15 aa, BK virus
NCLFHVLKANPLIQL

SEQ ID NO: 33950 - protein, 15 aa, BK virus
CLFHVLKANPLIQLL

SEQ ID NO: 33951 - protein, 15 aa, BK virus
LFHVLKANPLIQLLS

SEQ ID NO: 33952 - protein, 15 aa, BK virus
FHVLKANPLIQLLSL

SEQ ID NO: 33953 - protein, 15 aa, BK virus
HVLKANPLIQLLSLL

SEQ ID NO: 33954 - protein, 15 aa, BK virus
VLKANPLIQLLSLLH

SEQ ID NO: 33955 - protein, 15 aa, BK virus
LKANPLIQLLSLLHL

SEQ ID NO: 33956 - protein, 15 aa, BK virus
KANPLIQLLSLLHLQ

SEQ ID NO: 33957 - protein, 15 aa, BK virus
ANPLIQLLSLLHLQK

SEQ ID NO: 33958 - protein, 15 aa, BK virus
NPLIQLLSLLHLQKQ

SEQ ID NO: 33959 - protein, 15 aa, BK virus
PLIQLLSLLHLQKQP

SEQ ID NO: 33960 - protein, 15 aa, BK virus
LIQLLSLLHLQKQPC

SEQ ID NO: 33961 - protein, 15 aa, BK virus
IQLLSLLHLQKQPCT

SEQ ID NO: 33962 - protein, 15 aa, BK virus
QLLSLLHLQKQPCTD

SEQ ID NO: 33963 - protein, 15 aa, BK virus
LLSLLHLQKQPCTDL

SEQ ID NO: 33964 - protein, 15 aa, BK virus
LHLAQRLAFPWVGLH

SEQ ID NO: 33965 - protein, 15 aa, BK virus
HLAQRLAFPWVGLHL

SEQ ID NO: 33966 - protein, 15 aa, BK virus
LAQRLAFPWVGLHLR

SEQ ID NO: 33967 - protein, 15 aa, BK virus
AQRLAFPWVGLHLRL

SEQ ID NO: 33968 - protein, 15 aa, BK virus
QRLAFPWVGLHLRLY

SEQ ID NO: 33969 - protein, 15 aa, BK virus
RLAFPWVGLHLRLYH

SEQ ID NO: 33970 - protein, 15 aa, BK virus
LAFPWVGLHLRLYHH

SEQ ID NO: 33971 - protein, 15 aa, BK virus
AFPWVGLHLRLYHHT

SEQ ID NO: 33972 - protein, 15 aa, BK virus
FPWVGLHLRLYHHTN

SEQ ID NO: 33973 - protein, 15 aa, BK virus
PWVGLHLRLYHHTNL

SEQ ID NO: 33974 - protein, 15 aa, BK virus
WVGLHLRLYHHTNLI

SEQ ID NO: 33975 - protein, 15 aa, BK virus
VGLHLRLYHHTNLIT

SEQ ID NO: 33976 - protein, 15 aa, BK virus
GLHLRLYHHTNLITL

SEQ ID NO: 33977 - protein, 15 aa, BK virus
LHLRLYHHTNLITLQ

SEQ ID NO: 33978 - protein, 15 aa, BK virus
HLRLYHHTNLITLQL

SEQ ID NO: 33979 - protein, 15 aa, BK virus
LRLYHHTNLITLQLV

SEQ ID NO: 33980 - protein, 15 aa, BK virus
RLYHHTNLITLQLVL

SEQ ID NO: 33981 - protein, 15 aa, BK virus
LYHHTNLITLQLVLF

SEQ ID NO: 33982 - protein, 15 aa, BK virus
YHHTNLITLQLVLFF

SEQ ID NO: 33983 - protein, 15 aa, BK virus
HHTNLITLQLVLFFH

SEQ ID NO: 33984 - protein, 15 aa, BK virus
HTNLITLQLVLFFHY

SEQ ID NO: 33985 - protein, 15 aa, BK virus
TNLITLQLVLFFHYQ

SEQ ID NO: 33986 - protein, 15 aa, BK virus
NLITLQLVLFFHYQW

SEQ ID NO: 33987 - protein, 15 aa, BK virus
LITLQLVLFFHYQWD

SEQ ID NO: 33988 - protein, 15 aa, BK virus
ITLQLVLFFHYQWDL

SEQ ID NO: 33989 - protein, 15 aa, BK virus
VANSAAKQHLPYIVL

SEQ ID NO: 33990 - protein, 15 aa, BK virus
ANSAAKQHLPYIVLV

SEQ ID NO: 33991 - protein, 15 aa, BK virus
NSAAKQHLPYIVLVQ

SEQ ID NO: 33992 - protein, 15 aa, BK virus
SAAKQHLPYIVLVQH

SEQ ID NO: 33993 - protein, 15 aa, BK virus
AAKQHLPYIVLVQHF

SEQ ID NO: 33994 - protein, 15 aa, BK virus
AKQHLPYIVLVQHFH

SEQ ID NO: 33995 - protein, 15 aa, BK virus
KQHLPYIVLVQHFHE

SEQ ID NO: 33996 - protein, 15 aa, BK virus
QHLPYIVLVQHFHEL

SEQ ID NO: 33997 - protein, 15 aa, BK virus
HLPYIVLVQHFHELQ

SEQ ID NO: 33998 - protein, 15 aa, BK virus
LPYIVLVQHFHELQI

SEQ ID NO: 33999 - protein, 15 aa, BK virus
PYIVLVQHFHELQIL

SEQ ID NO: 34000 - protein, 15 aa, BK virus
YIVLVQHFHELQILN

SEQ ID NO: 34001 - protein, 15 aa, BK virus
IVLVQHFHELQILNP

SEQ ID NO: 34002 - protein, 15 aa, BK virus
VLVQHFHELQILNPF

SEQ ID NO: 34003 - protein, 15 aa, BK virus
LVQHFHELQILNPFY

SEQ ID NO: 34004 - protein, 15 aa, BK virus
VQHFHELQILNPFYL

SEQ ID NO: 34005 - protein, 15 aa, BK virus
QHFHELQILNPFYLI

SEQ ID NO: 34006 - protein, 15 aa, BK virus
HFHELQILNPFYLIY

SEQ ID NO: 34007 - protein, 15 aa, BK virus
FHELQILNPFYLIYD

SEQ ID NO: 34008 - protein, 15 aa, BK virus
IFLLAFLPWSYEGYL

SEQ ID NO: 34009 - protein, 15 aa, BK virus
FLLAFLPWSYEGYLL

SEQ ID NO: 34010 - protein, 15 aa, BK virus
LLAFLPWSYEGYLLF

SEQ ID NO: 34011 - protein, 15 aa, BK virus
LAFLPWSYEGYLLFF

SEQ ID NO: 34012 - protein, 15 aa, BK virus
LKLYLLLADKYFFDF

SEQ ID NO: 34013 - protein, 15 aa, BK virus
KLYLLLADKYFFDFY

SEQ ID NO: 34014 - protein, 15 aa, BK virus
LYLLLADKYFFDFYF

SEQ ID NO: 34015 - protein, 15 aa, BK virus
YLLLADKYFFDFYFL

SEQ ID NO: 34016 - protein, 15 aa, BK virus
LLLADKYFFDFYFLQ

SEQ ID NO: 34017 - protein, 15 aa, BK virus
LLADKYFFDFYFLQK

SEQ ID NO: 34018 - protein, 15 aa, BK virus
SDKAGLFSDTFYTPL

SEQ ID NO: 34019 - protein, 15 aa, BK virus
DKAGLFSDTFYTPLH

SEQ ID NO: 34020 - protein, 15 aa, BK virus
KAGLFSDTFYTPLHC

SEQ ID NO: 34021 - protein, 15 aa, BK virus
AGLFSDTFYTPLHCI

SEQ ID NO: 34022 - protein, 15 aa, BK virus
GLFSDTFYTPLHCIE

SEQ ID NO: 34023 - protein, 15 aa, BK virus
LFSDTFYTPLHCIEI

SEQ ID NO: 34024 - protein, 15 aa, BK virus
FSDTFYTPLHCIEIL

SEQ ID NO: 34025 - protein, 15 aa, BK virus
SDTFYTPLHCIEILN

SEQ ID NO: 34026 - protein, 15 aa, BK virus
DTFYTPLHCIEILNT

SEQ ID NO: 34027 - protein, 15 aa, BK virus
TFYTPLHCIEILNTY

SEQ ID NO: 34028 - protein, 15 aa, BK virus
FYTPLHCIEILNTYL

SEQ ID NO: 34029 - protein, 15 aa, BK virus
YTPLHCIEILNTYLI

SEQ ID NO: 34030 - protein, 15 aa, BK virus
TPLHCIEILNTYLII

SEQ ID NO: 34031 - protein, 15 aa, BK virus
PLHCIEILNTYLIIK

SEQ ID NO: 34032 - protein, 15 aa, BK virus
LHCIEILNTYLIIKT

SEQ ID NO: 34033 - protein, 15 aa, BK virus
HCIEILNTYLIIKTH

SEQ ID NO: 34034 - protein, 15 aa, BK virus
CIEILNTYLIIKTHP

SEQ ID NO: 34035 - protein, 15 aa, BK virus
IEILNTYLIIKTHPH

SEQ ID NO: 34036 - protein, 15 aa, BK virus
EILNTYLIIKTHPHT

SEQ ID NO: 34037 - protein, 15 aa, BK virus
ILNTYLIIKTHPHTL

SEQ ID NO: 34038 - protein, 15 aa, BK virus
LNTYLIIKTHPHTLS

SEQ ID NO: 34039 - protein, 15 aa, BK virus
NTYLIIKTHPHTLSL

SEQ ID NO: 34040 - protein, 15 aa, BK virus
TYLIIKTHPHTLSLL

SEQ ID NO: 34041 - protein, 15 aa, BK virus
YLIIKTHPHTLSLLH

SEQ ID NO: 34042 - protein, 15 aa, BK virus
LIIKTHPHTLSLLHT

SEQ ID NO: 34043 - protein, 15 aa, BK virus
IIKTHPHTLSLLHTQ

SEQ ID NO: 34044 - protein, 15 aa, BK virus
LISKTPALFLQALLG

SEQ ID NO: 34045 - protein, 15 aa, BK virus
GLLPFFFFWVVLSVE

SEQ ID NO: 34046 - protein, 15 aa, BK virus
LLPFFFFWVVLSVEN

SEQ ID NO: 34047 - protein, 15 aa, BK virus
LPFFFFWVVLSVENL

SEQ ID NO: 34048 - protein, 15 aa, BK virus
PFFFFWVVLSVENLL

SEQ ID NO: 34049 - protein, 15 aa, BK virus
FFFFWVVLSVENLLL

SEQ ID NO: 34050 - protein, 15 aa, BK virus
FFFWVVLSVENLLLL

SEQ ID NO: 34051 - protein, 15 aa, BK virus
FFWVVLSVENLLLLL

SEQ ID NO: 34052 - protein, 15 aa, BK virus
FWVVLSVENLLLLLH

SEQ ID NO: 34053 - protein, 15 aa, BK virus
WVVLSVENLLLLLHH

SEQ ID NO: 34054 - protein, 15 aa, BK virus
VVLSVENLLLLLHHW

SEQ ID NO: 34055 - protein, 15 aa, BK virus
VLSVENLLLLLHHWQ

SEQ ID NO: 34056 - protein, 15 aa, BK virus
LSVENLLLLLHHWQT

SEQ ID NO: 34057 - protein, 15 aa, BK virus
SVENLLLLLHHWQTY

SEQ ID NO: 34058 - protein, 15 aa, BK virus
VENLLLLLHHWQTYL

SEQ ID NO: 34059 - protein, 15 aa, BK virus
ENLLLLLHHWQTYLH

SEQ ID NO: 34060 - protein, 15 aa, BK virus
NLLLLLHHWQTYLHG

SEQ ID NO: 34061 - protein, 15 aa, BK virus
LLLLLHHWQTYLHGK

SEQ ID NO: 34062 - protein, 15 aa, BK virus
LLLLHHWQTYLHGKI

SEQ ID NO: 34063 - protein, 15 aa, BK virus
LLLHHWQTYLHGKIN

SEQ ID NO: 34064 - protein, 15 aa, BK virus
LLHHWQTYLHGKINL

SEQ ID NO: 34065 - protein, 15 aa, BK virus
LHHWQTYLHGKINLH

SEQ ID NO: 34066 - protein, 15 aa, BK virus
HHWQTYLHGKINLHP

SEQ ID NO: 34067 - protein, 15 aa, BK virus
HWQTYLHGKINLHPI

SEQ ID NO: 34068 - protein, 15 aa, BK virus
WQTYLHGKINLHPIF

SEQ ID NO: 34069 - protein, 15 aa, BK virus
QTYLHGKINLHPIFH

SEQ ID NO: 34070 - protein, 15 aa, BK virus
RNSTRTPTLLFHRLA

SEQ ID NO: 34071 - protein, 15 aa, BK virus
NSTRTPTLLFHRLAP

SEQ ID NO: 34072 - protein, 15 aa, BK virus
STRTPTLLFHRLAPI

SEQ ID NO: 34073 - protein, 15 aa, BK virus
TRTPTLLFHRLAPIK

SEQ ID NO: 34074 - protein, 15 aa, BK virus
RTPTLLFHRLAPIKK

SEQ ID NO: 34075 - protein, 15 aa, BK virus
TPTLLFHRLAPIKKI

SEQ ID NO: 34076 - protein, 15 aa, BK virus
PTLLFHRLAPIKKII

SEQ ID NO: 34077 - protein, 15 aa, BK virus
TLLFHRLAPIKKIIT

SEQ ID NO: 34078 - protein, 15 aa, BK virus
GLLIFYYLSKYKLVT

SEQ ID NO: 34079 - protein, 15 aa, BK virus
LLIFYYLSKYKLVTL

SEQ ID NO: 34080 - protein, 15 aa, BK virus
LIFYYLSKYKLVTLK

SEQ ID NO: 34081 - protein, 15 aa, BK virus
IFYYLSKYKLVTLKL

SEQ ID NO: 34082 - protein, 15 aa, BK virus
ISEGSFSNYLDPPLQ

SEQ ID NO: 34083 - protein, 15 aa, BK virus
SEGSFSNYLDPPLQS

SEQ ID NO: 34084 - protein, 15 aa, BK virus
EGSFSNYLDPPLQSF

SEQ ID NO: 34085 - protein, 15 aa, BK virus
GSFSNYLDPPLQSFF

SEQ ID NO: 34086 - protein, 15 aa, BK virus
SFSNYLDPPLQSFFS

SEQ ID NO: 34087 - protein, 15 aa, BK virus
AKPLCEAVNAVAIYP

SEQ ID NO: 34088 - protein, 15 aa, BK virus
KPLCEAVNAVAIYPN

SEQ ID NO: 34089 - protein, 15 aa, BK virus
PLCEAVNAVAIYPNQ

SEQ ID NO: 34090 - protein, 15 aa, BK virus
LCEAVNAVAIYPNQG

SEQ ID NO: 34091 - protein, 15 aa, BK virus
CEAVNAVAIYPNQGL

SEQ ID NO: 34092 - protein, 15 aa, BK virus
EAVNAVAIYPNQGLF

SEQ ID NO: 34093 - protein, 15 aa, BK virus
AVNAVAIYPNQGLFS

SEQ ID NO: 34094 - protein, 15 aa, BK virus
HARAVHRRLFGTNRP

SEQ ID NO: 34095 - protein, 15 aa, BK virus
ARAVHRRLFGTNRPF

SEQ ID NO: 34096 - protein, 15 aa, BK virus
RAVHRRLFGTNRPFL

SEQ ID NO: 34097 - protein, 15 aa, BK virus
AVHRRLFGTNRPFLA

SEQ ID NO: 34098 - protein, 15 aa, BK virus
VHRRLFGTNRPFLAV

SEQ ID NO: 34099 - protein, 15 aa, BK virus
HRRLFGTNRPFLAVQ

SEQ ID NO: 34100 - protein, 15 aa, BK virus
RRLFGTNRPFLAVQG

SEQ ID NO: 34101 - protein, 15 aa, BK virus
RLFGTNRPFLAVQGI

SEQ ID NO: 34102 - protein, 15 aa, BK virus
LFGTNRPFLAVQGIW

SEQ ID NO: 34103 - protein, 15 aa, BK virus
FGTNRPFLAVQGIWA

SEQ ID NO: 34104 - protein, 15 aa, BK virus
GTNRPFLAVQGIWAK

SEQ ID NO: 34105 - protein, 15 aa, BK virus
TNRPFLAVQGIWAKR

SEQ ID NO: 34106 - protein, 15 aa, BK virus
NRPFLAVQGIWAKRK

SEQ ID NO: 34107 - protein, 15 aa, BK virus
RPFLAVQGIWAKRKI

SEQ ID NO: 34108 - protein, 15 aa, BK virus
PFLAVQGIWAKRKIS

SEQ ID NO: 34109 - protein, 15 aa, BK virus
FLAVQGIWAKRKIST

SEQ ID NO: 34110 - protein, 15 aa, BK virus
LAVQGIWAKRKISTN

SEQ ID NO: 34111 - protein, 15 aa, BK virus
AVQGIWAKRKISTNL

SEQ ID NO: 34112 - protein, 15 aa, BK virus
ATPGSKIRLMSYLYI

SEQ ID NO: 34113 - protein, 15 aa, BK virus
TPGSKIRLMSYLYIL

SEQ ID NO: 34114 - protein, 15 aa, BK virus
PGSKIRLMSYLYILL

SEQ ID NO: 34115 - protein, 15 aa, BK virus
GSKIRLMSYLYILLH

SEQ ID NO: 34116 - protein, 15 aa, BK virus
SKIRLMSYLYILLHF

SEQ ID NO: 34117 - protein, 15 aa, BK virus
KIRLMSYLYILLHFF

SEQ ID NO: 34118 - protein, 15 aa, BK virus
IRLMSYLYILLHFFI

SEQ ID NO: 34119 - protein, 15 aa, BK virus
RLMSYLYILLHFFIQ

SEQ ID NO: 34120 - protein, 15 aa, BK virus
LMSYLYILLHFFIQS

SEQ ID NO: 34121 - protein, 15 aa, BK virus
MSYLYILLHFFIQSI

SEQ ID NO: 34122 - protein, 15 aa, BK virus
SYLYILLHFFIQSIH

SEQ ID NO: 34123 - protein, 15 aa, BK virus
YLYILLHFFIQSIHS

SEQ ID NO: 34124 - protein, 15 aa, BK virus
LYILLHFFIQSIHSL

SEQ ID NO: 34125 - protein, 15 aa, BK virus
YILLHFFIQSIHSLH

SEQ ID NO: 34126 - protein, 15 aa, BK virus
ILLHFFIQSIHSLHF

SEQ ID NO: 34127 - protein, 15 aa, BK virus
LLHFFIQSIHSLHFI

SEQ ID NO: 34128 - protein, 15 aa, BK virus
LHFFIQSIHSLHFIL

SEQ ID NO: 34129 - protein, 15 aa, BK virus
HFFIQSIHSLHFILV

SEQ ID NO: 34130 - protein, 15 aa, BK virus
FFIQSIHSLHFILVA

SEQ ID NO: 34131 - protein, 15 aa, BK virus
FIQSIHSLHFILVAP

SEQ ID NO: 34132 - protein, 15 aa, BK virus
IQSIHSLHFILVAPF

SEQ ID NO: 34133 - protein, 15 aa, BK virus
QSIHSLHFILVAPFV

SEQ ID NO: 34134 - protein, 15 aa, BK virus
SIHSLHFILVAPFVR

SEQ ID NO: 34135 - protein, 15 aa, BK virus
IHSLHFILVAPFVRV

SEQ ID NO: 34136 - protein, 15 aa, BK virus
HSLHFILVAPFVRVK

SEQ ID NO: 34137 - protein, 15 aa, BK virus
SLHFILVAPFVRVKF

SEQ ID NO: 34138 - protein, 15 aa, BK virus
LHFILVAPFVRVKFL

SEQ ID NO: 34139 - protein, 15 aa, BK virus
HFILVAPFVRVKFLT

SEQ ID NO: 34140 - protein, 15 aa, BK virus
KVHELHGFFPVKNFI

SEQ ID NO: 34141 - protein, 15 aa, BK virus
VHELHGFFPVKNFIH

SEQ ID NO: 34142 - protein, 16 aa, BK virus
ASEKASTPLLLERKGG

SEQ ID NO: 34143 - protein, 16 aa, BK virus
SEKASTPLLLERKGGG

SEQ ID NO: 34144 - protein, 16 aa, BK virus
EKASTPLLLERKGGGR

SEQ ID NO: 34145 - protein, 16 aa, BK virus
KASTPLLLERKGGGRG

SEQ ID NO: 34146 - protein, 16 aa, BK virus
ASTPLLLERKGGGRGG

SEQ ID NO: 34147 - protein, 16 aa, BK virus
STPLLLERKGGGRGGL

SEQ ID NO: 34148 - protein, 16 aa, BK virus
TPLLLERKGGGRGGLG

SEQ ID NO: 34149 - protein, 16 aa, BK virus
PLLLERKGGGRGGLGL

SEQ ID NO: 34150 - protein, 16 aa, BK virus
LLLERKGGGRGGLGLL

SEQ ID NO: 34151 - protein, 16 aa, BK virus
LLERKGGGRGGLGLLY

SEQ ID NO: 34152 - protein, 16 aa, BK virus
LERKGGGRGGLGLLYI

SEQ ID NO: 34153 - protein, 16 aa, BK virus
ERKGGGRGGLGLLYII

SEQ ID NO: 34154 - protein, 16 aa, BK virus
RKGGGRGGLGLLYIIK

SEQ ID NO: 34155 - protein, 16 aa, BK virus
KGGGRGGLGLLYIIKK

SEQ ID NO: 34156 - protein, 16 aa, BK virus
GGGRGGLGLLYIIKKK

SEQ ID NO: 34157 - protein, 16 aa, BK virus
GGRGGLGLLYIIKKKA

SEQ ID NO: 34158 - protein, 16 aa, BK virus
GRGGLGLLYIIKKKAT

SEQ ID NO: 34159 - protein, 16 aa, BK virus
RGGLGLLYIIKKKATG

SEQ ID NO: 34160 - protein, 16 aa, BK virus
GGLGLLYIIKKKATGR

SEQ ID NO: 34161 - protein, 16 aa, BK virus
GLGLLYIIKKKATGRS

SEQ ID NO: 34162 - protein, 16 aa, BK virus
LGLLYIIKKKATGRSC

SEQ ID NO: 34163 - protein, 16 aa, BK virus
GLLYIIKKKATGRSCL

SEQ ID NO: 34164 - protein, 16 aa, BK virus
LLYIIKKKATGRSCLP

SEQ ID NO: 34165 - protein, 16 aa, BK virus
LYIIKKKATGRSCLPM

SEQ ID NO: 34166 - protein, 16 aa, BK virus
YIIKKKATGRSCLPME

SEQ ID NO: 34167 - protein, 16 aa, BK virus
IIKKKATGRSCLPMEC

SEQ ID NO: 34168 - protein, 16 aa, BK virus
IKKKATGRSCLPMECS

SEQ ID NO: 34169 - protein, 16 aa, BK virus
KKKATGRSCLPMECSQ

SEQ ID NO: 34170 - protein, 16 aa, BK virus
KKATGRSCLPMECSQT

SEQ ID NO: 34171 - protein, 16 aa, BK virus
KATGRSCLPMECSQTM

SEQ ID NO: 34172 - protein, 16 aa, BK virus
ATGRSCLPMECSQTMT

SEQ ID NO: 34173 - protein, 16 aa, BK virus
TGRSCLPMECSQTMTS

SEQ ID NO: 34174 - protein, 16 aa, BK virus
GRSCLPMECSQTMTSG

SEQ ID NO: 34175 - protein, 16 aa, BK virus
RSCLPMECSQTMTSGR

SEQ ID NO: 34176 - protein, 16 aa, BK virus
SCLPMECSQTMTSGRK

SEQ ID NO: 34177 - protein, 16 aa, BK virus
CLPMECSQTMTSGRKV

SEQ ID NO: 34178 - protein, 16 aa, BK virus
LPMECSQTMTSGRKVH

SEQ ID NO: 34179 - protein, 16 aa, BK virus
PMECSQTMTSGRKVHD

SEQ ID NO: 34180 - protein, 16 aa, BK virus
MECSQTMTSGRKVHDS

SEQ ID NO: 34181 - protein, 16 aa, BK virus
ECSQTMTSGRKVHDSQ

SEQ ID NO: 34182 - protein, 16 aa, BK virus
CSQTMTSGRKVHDSQG

SEQ ID NO: 34183 - protein, 16 aa, BK virus
SQTMTSGRKVHDSQGN

SEQ ID NO: 34184 - protein, 16 aa, BK virus
QTMTSGRKVHDSQGNA

SEQ ID NO: 34185 - protein, 16 aa, BK virus
TMTSGRKVHDSQGNAA

SEQ ID NO: 34186 - protein, 16 aa, BK virus
MTSGRKVHDSQGNAAK

SEQ ID NO: 34187 - protein, 16 aa, BK virus
TSGRKVHDSQGNAAKP

SEQ ID NO: 34188 - protein, 16 aa, BK virus
PQEGKCMTHREELLTH

SEQ ID NO: 34189 - protein, 16 aa, BK virus
QEGKCMTHREELLTHG

SEQ ID NO: 34190 - protein, 16 aa, BK virus
EGKCMTHREELLTHGM

SEQ ID NO: 34191 - protein, 16 aa, BK virus
GKCMTHREELLTHGMQ

SEQ ID NO: 34192 - protein, 16 aa, BK virus
KCMTHREELLTHGMQP

SEQ ID NO: 34193 - protein, 16 aa, BK virus
CMTHREELLTHGMQPN

SEQ ID NO: 34194 - protein, 16 aa, BK virus
MTHREELLTHGMQPNH

SEQ ID NO: 34195 - protein, 16 aa, BK virus
THREELLTHGMQPNHD

SEQ ID NO: 34196 - protein, 16 aa, BK virus
HREELLTHGMQPNHDL

SEQ ID NO: 34197 - protein, 16 aa, BK virus
REELLTHGMQPNHDLR

SEQ ID NO: 34198 - protein, 16 aa, BK virus
EELLTHGMQPNHDLRK

SEQ ID NO: 34199 - protein, 16 aa, BK virus
ELLTHGMQPNHDLRKE

SEQ ID NO: 34200 - protein, 16 aa, BK virus
LLTHGMQPNHDLRKES

SEQ ID NO: 34201 - protein, 16 aa, BK virus
LTHGMQPNHDLRKESA

SEQ ID NO: 34202 - protein, 16 aa, BK virus
QTCFASLGILALSPVK

SEQ ID NO: 34203 - protein, 16 aa, BK virus
TCFASLGILALSPVKL

SEQ ID NO: 34204 - protein, 16 aa, BK virus
CFASLGILALSPVKLD

SEQ ID NO: 34205 - protein, 16 aa, BK virus
FASLGILALSPVKLDK

SEQ ID NO: 34206 - protein, 16 aa, BK virus
ASLGILALSPVKLDKG

SEQ ID NO: 34207 - protein, 16 aa, BK virus
SLGILALSPVKLDKGH

SEQ ID NO: 34208 - protein, 16 aa, BK virus
LGILALSPVKLDKGHG

SEQ ID NO: 34209 - protein, 16 aa, BK virus
GILALSPVKLDKGHGS

SEQ ID NO: 34210 - protein, 16 aa, BK virus
ILALSPVKLDKGHGSA

SEQ ID NO: 34211 - protein, 16 aa, BK virus
LALSPVKLDKGHGSAP

SEQ ID NO: 34212 - protein, 16 aa, BK virus
ALSPVKLDKGHGSAPA

SEQ ID NO: 34213 - protein, 16 aa, BK virus
LSPVKLDKGHGSAPAV

SEQ ID NO: 34214 - protein, 16 aa, BK virus
SPVKLDKGHGSAPAVT

SEQ ID NO: 34215 - protein, 16 aa, BK virus
PVKLDKGHGSAPAVTT

SEQ ID NO: 34216 - protein, 16 aa, BK virus
VKLDKGHGSAPAVTTS

SEQ ID NO: 34217 - protein, 16 aa, BK virus
KLDKGHGSAPAVTTSF

SEQ ID NO: 34218 - protein, 16 aa, BK virus
LDKGHGSAPAVTTSFS

SEQ ID NO: 34219 - protein, 16 aa, BK virus
DKGHGSAPAVTTSFSE

SEQ ID NO: 34220 - protein, 16 aa, BK virus
KGHGSAPAVTTSFSES

SEQ ID NO: 34221 - protein, 16 aa, BK virus
GHGSAPAVTTSFSESW

SEQ ID NO: 34222 - protein, 16 aa, BK virus
NLDWNKKKSSEDFYFY

SEQ ID NO: 34223 - protein, 16 aa, BK virus
LDWNKKKSSEDFYFYF

SEQ ID NO: 34224 - protein, 16 aa, BK virus
DWNKKKSSEDFYFYFR

SEQ ID NO: 34225 - protein, 16 aa, BK virus
WNKKKSSEDFYFYFRA

SEQ ID NO: 34226 - protein, 16 aa, BK virus
NKKKSSEDFYFYFRAF

SEQ ID NO: 34227 - protein, 16 aa, BK virus
KKKSSEDFYFYFRAFA

SEQ ID NO: 34228 - protein, 16 aa, BK virus
KKSSEDFYFYFRAFAG

SEQ ID NO: 34229 - protein, 16 aa, BK virus
KSSEDFYFYFRAFAGI

SEQ ID NO: 34230 - protein, 16 aa, BK virus
SSEDFYFYFRAFAGIL

SEQ ID NO: 34231 - protein, 16 aa, BK virus
RQCRREKQKYHCFTCC

SEQ ID NO: 34232 - protein, 16 aa, BK virus
QCRREKQKYHCFTCCK

SEQ ID NO: 34233 - protein, 16 aa, BK virus
CRREKQKYHCFTCCKR

SEQ ID NO: 34234 - protein, 16 aa, BK virus
RREKQKYHCFTCCKRL

SEQ ID NO: 34235 - protein, 16 aa, BK virus
REKQKYHCFTCCKRLC

SEQ ID NO: 34236 - protein, 16 aa, BK virus
EKQKYHCFTCCKRLCK

SEQ ID NO: 34237 - protein, 16 aa, BK virus
KQKYHCFTCCKRLCKR

SEQ ID NO: 34238 - protein, 16 aa, BK virus
QKYHCFTCCKRLCKRL

SEQ ID NO: 34239 - protein, 16 aa, BK virus
KYHCFTCCKRLCKRLL

SEQ ID NO: 34240 - protein, 16 aa, BK virus
YHCFTCCKRLCKRLLG

SEQ ID NO: 34241 - protein, 16 aa, BK virus
HCFTCCKRLCKRLLGK

SEQ ID NO: 34242 - protein, 16 aa, BK virus
SLFFCISRFMGAALAL

SEQ ID NO: 34243 - protein, 16 aa, BK virus
LFFCISRFMGAALALL

SEQ ID NO: 34244 - protein, 16 aa, BK virus
FFCISRFMGAALALLG

SEQ ID NO: 34245 - protein, 16 aa, BK virus
FCISRFMGAALALLGD

SEQ ID NO: 34246 - protein, 16 aa, BK virus
CISRFMGAALALLGDL

SEQ ID NO: 34247 - protein, 16 aa, BK virus
ISRFMGAALALLGDLV

SEQ ID NO: 34248 - protein, 16 aa, BK virus
SRFMGAALALLGDLVA

SEQ ID NO: 34249 - protein, 16 aa, BK virus
RFMGAALALLGDLVAS

SEQ ID NO: 34250 - protein, 16 aa, BK virus
FMGAALALLGDLVASV

SEQ ID NO: 34251 - protein, 16 aa, BK virus
MGAALALLGDLVASVS

SEQ ID NO: 34252 - protein, 16 aa, BK virus
GAALALLGDLVASVSE

SEQ ID NO: 34253 - protein, 16 aa, BK virus
AALALLGDLVASVSEA

SEQ ID NO: 34254 - protein, 16 aa, BK virus
ALALLGDLVASVSEAA

SEQ ID NO: 34255 - protein, 16 aa, BK virus
LALLGDLVASVSEAAA

SEQ ID NO: 34256 - protein, 16 aa, BK virus
ALLGDLVASVSEAAAA

SEQ ID NO: 34257 - protein, 16 aa, BK virus
LLGDLVASVSEAAAAT

SEQ ID NO: 34258 - protein, 16 aa, BK virus
LGDLVASVSEAAAATG

SEQ ID NO: 34259 - protein, 16 aa, BK virus
GDLVASVSEAAAATGF

SEQ ID NO: 34260 - protein, 16 aa, BK virus
DLVASVSEAAAATGFS

SEQ ID NO: 34261 - protein, 16 aa, BK virus
LVASVSEAAAATGFSV

SEQ ID NO: 34262 - protein, 16 aa, BK virus
VASVSEAAAATGFSVA

SEQ ID NO: 34263 - protein, 16 aa, BK virus
ASVSEAAAATGFSVAE

SEQ ID NO: 34264 - protein, 16 aa, BK virus
SVSEAAAATGFSVAEI

SEQ ID NO: 34265 - protein, 16 aa, BK virus
VSEAAAATGFSVAEIA

SEQ ID NO: 34266 - protein, 16 aa, BK virus
SEAAAATGFSVAEIAA

SEQ ID NO: 34267 - protein, 16 aa, BK virus
EAAAATGFSVAEIAAG

SEQ ID NO: 34268 - protein, 16 aa, BK virus
AAAATGFSVAEIAAGE

SEQ ID NO: 34269 - protein, 16 aa, BK virus
AAATGFSVAEIAAGEA

SEQ ID NO: 34270 - protein, 16 aa, BK virus
AATGFSVAEIAAGEAA

SEQ ID NO: 34271 - protein, 16 aa, BK virus
ATGFSVAEIAAGEAAA

SEQ ID NO: 34272 - protein, 16 aa, BK virus
TGFSVAEIAAGEAAAA

SEQ ID NO: 34273 - protein, 16 aa, BK virus
GFSVAEIAAGEAAAAI

SEQ ID NO: 34274 - protein, 16 aa, BK virus
FSVAEIAAGEAAAAIE

SEQ ID NO: 34275 - protein, 16 aa, BK virus
SVAEIAAGEAAAAIEV

SEQ ID NO: 34276 - protein, 16 aa, BK virus
VAEIAAGEAAAAIEVQ

SEQ ID NO: 34277 - protein, 16 aa, BK virus
AEIAAGEAAAAIEVQI

SEQ ID NO: 34278 - protein, 16 aa, BK virus
EIAAGEAAAAIEVQIA

SEQ ID NO: 34279 - protein, 16 aa, BK virus
IAAGEAAAAIEVQIAS

SEQ ID NO: 34280 - protein, 16 aa, BK virus
AAGEAAAAIEVQIASL

SEQ ID NO: 34281 - protein, 16 aa, BK virus
AGEAAAAIEVQIASLA

SEQ ID NO: 34282 - protein, 16 aa, BK virus
GEAAAAIEVQIASLAT

SEQ ID NO: 34283 - protein, 16 aa, BK virus
EAAAAIEVQIASLATV

SEQ ID NO: 34284 - protein, 16 aa, BK virus
AAAAIEVQIASLATVE

SEQ ID NO: 34285 - protein, 16 aa, BK virus
AAAIEVQIASLATVEG

SEQ ID NO: 34286 - protein, 16 aa, BK virus
AAIEVQIASLATVEGI

SEQ ID NO: 34287 - protein, 16 aa, BK virus
AIEVQIASLATVEGIT

SEQ ID NO: 34288 - protein, 16 aa, BK virus
IEVQIASLATVEGITS

SEQ ID NO: 34289 - protein, 16 aa, BK virus
EVQIASLATVEGITST

SEQ ID NO: 34290 - protein, 16 aa, BK virus
VQIASLATVEGITSTS

SEQ ID NO: 34291 - protein, 16 aa, BK virus
QIASLATVEGITSTSE

SEQ ID NO: 34292 - protein, 16 aa, BK virus
IASLATVEGITSTSEA

SEQ ID NO: 34293 - protein, 16 aa, BK virus
ASLATVEGITSTSEAI

SEQ ID NO: 34294 - protein, 16 aa, BK virus
SLATVEGITSTSEAIA

SEQ ID NO: 34295 - protein, 16 aa, BK virus
LATVEGITSTSEAIAA

SEQ ID NO: 34296 - protein, 16 aa, BK virus
ATVEGITSTSEAIAAI

SEQ ID NO: 34297 - protein, 16 aa, BK virus
TVEGITSTSEAIAAIG

SEQ ID NO: 34298 - protein, 16 aa, BK virus
VEGITSTSEAIAAIGL

SEQ ID NO: 34299 - protein, 16 aa, BK virus
EGITSTSEAIAAIGLT

SEQ ID NO: 34300 - protein, 16 aa, BK virus
GITSTSEAIAAIGLTP

SEQ ID NO: 34301 - protein, 16 aa, BK virus
ITSTSEAIAAIGLTPQ

SEQ ID NO: 34302 - protein, 16 aa, BK virus
TSTSEAIAAIGLTPQT

SEQ ID NO: 34303 - protein, 16 aa, BK virus
STSEAIAAIGLTPQTY

SEQ ID NO: 34304 - protein, 16 aa, BK virus
TSEAIAAIGLTPQTYA

SEQ ID NO: 34305 - protein, 16 aa, BK virus
SEAIAAIGLTPQTYAV

SEQ ID NO: 34306 - protein, 16 aa, BK virus
EAIAAIGLTPQTYAVI

SEQ ID NO: 34307 - protein, 16 aa, BK virus
AIAAIGLTPQTYAVIA

SEQ ID NO: 34308 - protein, 16 aa, BK virus
IAAIGLTPQTYAVIAG

SEQ ID NO: 34309 - protein, 16 aa, BK virus
AAIGLTPQTYAVIAGA

SEQ ID NO: 34310 - protein, 16 aa, BK virus
AIGLTPQTYAVIAGAP

SEQ ID NO: 34311 - protein, 16 aa, BK virus
IGLTPQTYAVIAGAPG

SEQ ID NO: 34312 - protein, 16 aa, BK virus
GLTPQTYAVIAGAPGA

SEQ ID NO: 34313 - protein, 16 aa, BK virus
LTPQTYAVIAGAPGAI

SEQ ID NO: 34314 - protein, 16 aa, BK virus
TPQTYAVIAGAPGAIA

SEQ ID NO: 34315 - protein, 16 aa, BK virus
PQTYAVIAGAPGAIAG

SEQ ID NO: 34316 - protein, 16 aa, BK virus
QTYAVIAGAPGAIAGF

SEQ ID NO: 34317 - protein, 16 aa, BK virus
TYAVIAGAPGAIAGFA

SEQ ID NO: 34318 - protein, 16 aa, BK virus
YAVIAGAPGAIAGFAA

SEQ ID NO: 34319 - protein, 16 aa, BK virus
AVIAGAPGAIAGFAAL

SEQ ID NO: 34320 - protein, 16 aa, BK virus
VIAGAPGAIAGFAALI

SEQ ID NO: 34321 - protein, 16 aa, BK virus
IAGAPGAIAGFAALIQ

SEQ ID NO: 34322 - protein, 16 aa, BK virus
AGAPGAIAGFAALIQT

SEQ ID NO: 34323 - protein, 16 aa, BK virus
GAPGAIAGFAALIQTV

SEQ ID NO: 34324 - protein, 16 aa, BK virus
APGAIAGFAALIQTVS

SEQ ID NO: 34325 - protein, 16 aa, BK virus
PGAIAGFAALIQTVSG

SEQ ID NO: 34326 - protein, 16 aa, BK virus
GAIAGFAALIQTVSGI

SEQ ID NO: 34327 - protein, 16 aa, BK virus
AIAGFAALIQTVSGIS

SEQ ID NO: 34328 - protein, 16 aa, BK virus
IAGFAALIQTVSGISS

SEQ ID NO: 34329 - protein, 16 aa, BK virus
AGFAALIQTVSGISSL

SEQ ID NO: 34330 - protein, 16 aa, BK virus
GFAALIQTVSGISSLA

SEQ ID NO: 34331 - protein, 16 aa, BK virus
FAALIQTVSGISSLAQ

SEQ ID NO: 34332 - protein, 16 aa, BK virus
AALIQTVSGISSLAQV

SEQ ID NO: 34333 - protein, 16 aa, BK virus
ALIQTVSGISSLAQVG

SEQ ID NO: 34334 - protein, 16 aa, BK virus
LIQTVSGISSLAQVGY

SEQ ID NO: 34335 - protein, 16 aa, BK virus
IQTVSGISSLAQVGYK

SEQ ID NO: 34336 - protein, 16 aa, BK virus
QTVSGISSLAQVGYKF

SEQ ID NO: 34337 - protein, 16 aa, BK virus
TVSGISSLAQVGYKFF

SEQ ID NO: 34338 - protein, 16 aa, BK virus
VSGISSLAQVGYKFFD

SEQ ID NO: 34339 - protein, 16 aa, BK virus
SGISSLAQVGYKFFDD

SEQ ID NO: 34340 - protein, 16 aa, BK virus
GISSLAQVGYKFFDDW

SEQ ID NO: 34341 - protein, 16 aa, BK virus
ISSLAQVGYKFFDDWD

SEQ ID NO: 34342 - protein, 16 aa, BK virus
SSLAQVGYKFFDDWDH

SEQ ID NO: 34343 - protein, 16 aa, BK virus
SLAQVGYKFFDDWDHK

SEQ ID NO: 34344 - protein, 16 aa, BK virus
LAQVGYKFFDDWDHKV

SEQ ID NO: 34345 - protein, 16 aa, BK virus
AQVGYKFFDDWDHKVS

SEQ ID NO: 34346 - protein, 16 aa, BK virus
QVGYKFFDDWDHKVST

SEQ ID NO: 34347 - protein, 16 aa, BK virus
VGYKFFDDWDHKVSTV

SEQ ID NO: 34348 - protein, 16 aa, BK virus
GYKFFDDWDHKVSTVG

SEQ ID NO: 34349 - protein, 16 aa, BK virus
YKFFDDWDHKVSTVGL

SEQ ID NO: 34350 - protein, 16 aa, BK virus
KFFDDWDHKVSTVGLY

SEQ ID NO: 34351 - protein, 16 aa, BK virus
FFDDWDHKVSTVGLYQ

SEQ ID NO: 34352 - protein, 16 aa, BK virus
FDDWDHKVSTVGLYQQ

SEQ ID NO: 34353 - protein, 16 aa, BK virus
DDWDHKVSTVGLYQQS

SEQ ID NO: 34354 - protein, 16 aa, BK virus
DWDHKVSTVGLYQQSG

SEQ ID NO: 34355 - protein, 16 aa, BK virus
WDHKVSTVGLYQQSGM

SEQ ID NO: 34356 - protein, 16 aa, BK virus
DHKVSTVGLYQQSGMA

SEQ ID NO: 34357 - protein, 16 aa, BK virus
HKVSTVGLYQQSGMAL

SEQ ID NO: 34358 - protein, 16 aa, BK virus
KVSTVGLYQQSGMALE

SEQ ID NO: 34359 - protein, 16 aa, BK virus
VSTVGLYQQSGMALEL

SEQ ID NO: 34360 - protein, 16 aa, BK virus
STVGLYQQSGMALELF

SEQ ID NO: 34361 - protein, 16 aa, BK virus
TVGLYQQSGMALELFN

SEQ ID NO: 34362 - protein, 16 aa, BK virus
VGLYQQSGMALELFNP

SEQ ID NO: 34363 - protein, 16 aa, BK virus
GLYQQSGMALELFNPD

SEQ ID NO: 34364 - protein, 16 aa, BK virus
LYQQSGMALELFNPDE

SEQ ID NO: 34365 - protein, 16 aa, BK virus
YQQSGMALELFNPDEY

SEQ ID NO: 34366 - protein, 16 aa, BK virus
QQSGMALELFNPDEYY

SEQ ID NO: 34367 - protein, 16 aa, BK virus
QSGMALELFNPDEYYD

SEQ ID NO: 34368 - protein, 16 aa, BK virus
SGMALELFNPDEYYDI

SEQ ID NO: 34369 - protein, 16 aa, BK virus
GMALELFNPDEYYDIL

SEQ ID NO: 34370 - protein, 16 aa, BK virus
MALELFNPDEYYDILF

SEQ ID NO: 34371 - protein, 16 aa, BK virus
ALELFNPDEYYDILFP

SEQ ID NO: 34372 - protein, 16 aa, BK virus
LELFNPDEYYDILFPG

SEQ ID NO: 34373 - protein, 16 aa, BK virus
ELFNPDEYYDILFPGV

SEQ ID NO: 34374 - protein, 16 aa, BK virus
LFNPDEYYDILFPGVN

SEQ ID NO: 34375 - protein, 16 aa, BK virus
FNPDEYYDILFPGVNT

SEQ ID NO: 34376 - protein, 16 aa, BK virus
NPDEYYDILFPGVNTF

SEQ ID NO: 34377 - protein, 16 aa, BK virus
PDEYYDILFPGVNTFV

SEQ ID NO: 34378 - protein, 16 aa, BK virus
DEYYDILFPGVNTFVN

SEQ ID NO: 34379 - protein, 16 aa, BK virus
EYYDILFPGVNTFVNN

SEQ ID NO: 34380 - protein, 16 aa, BK virus
YYDILFPGVNTFVNNI

SEQ ID NO: 34381 - protein, 16 aa, BK virus
YDILFPGVNTFVNNIQ

SEQ ID NO: 34382 - protein, 16 aa, BK virus
DILFPGVNTFVNNIQY

SEQ ID NO: 34383 - protein, 16 aa, BK virus
ILFPGVNTFVNNIQYL

SEQ ID NO: 34384 - protein, 16 aa, BK virus
LFPGVNTFVNNIQYLD

SEQ ID NO: 34385 - protein, 16 aa, BK virus
FPGVNTFVNNIQYLDP

SEQ ID NO: 34386 - protein, 16 aa, BK virus
PGVNTFVNNIQYLDPR

SEQ ID NO: 34387 - protein, 16 aa, BK virus
GVNTFVNNIQYLDPRH

SEQ ID NO: 34388 - protein, 16 aa, BK virus
VNTFVNNIQYLDPRHW

SEQ ID NO: 34389 - protein, 16 aa, BK virus
NTFVNNIQYLDPRHWG

SEQ ID NO: 34390 - protein, 16 aa, BK virus
TFVNNIQYLDPRHWGP

SEQ ID NO: 34391 - protein, 16 aa, BK virus
FVNNIQYLDPRHWGPS

SEQ ID NO: 34392 - protein, 16 aa, BK virus
VNNIQYLDPRHWGPSL

SEQ ID NO: 34393 - protein, 16 aa, BK virus
NNIQYLDPRHWGPSLF

SEQ ID NO: 34394 - protein, 16 aa, BK virus
NIQYLDPRHWGPSLFA

SEQ ID NO: 34395 - protein, 16 aa, BK virus
IQYLDPRHWGPSLFAT

SEQ ID NO: 34396 - protein, 16 aa, BK virus
QYLDPRHWGPSLFATI

SEQ ID NO: 34397 - protein, 16 aa, BK virus
YLDPRHWGPSLFATIS

SEQ ID NO: 34398 - protein, 16 aa, BK virus
LDPRHWGPSLFATISQ

SEQ ID NO: 34399 - protein, 16 aa, BK virus
DPRHWGPSLFATISQA

SEQ ID NO: 34400 - protein, 16 aa, BK virus
PRHWGPSLFATISQAL

SEQ ID NO: 34401 - protein, 16 aa, BK virus
RHWGPSLFATISQALW

SEQ ID NO: 34402 - protein, 16 aa, BK virus
HWGPSLFATISQALWH

SEQ ID NO: 34403 - protein, 16 aa, BK virus
WGPSLFATISQALWHV

SEQ ID NO: 34404 - protein, 16 aa, BK virus
GPSLFATISQALWHVI

SEQ ID NO: 34405 - protein, 16 aa, BK virus
PSLFATISQALWHVIR

SEQ ID NO: 34406 - protein, 16 aa, BK virus
SLFATISQALWHVIRD

SEQ ID NO: 34407 - protein, 16 aa, BK virus
LFATISQALWHVIRDD

SEQ ID NO: 34408 - protein, 16 aa, BK virus
FATISQALWHVIRDDI

SEQ ID NO: 34409 - protein, 16 aa, BK virus
ATISQALWHVIRDDIP

SEQ ID NO: 34410 - protein, 16 aa, BK virus
TISQALWHVIRDDIPS

SEQ ID NO: 34411 - protein, 16 aa, BK virus
ISQALWHVIRDDIPSI

SEQ ID NO: 34412 - protein, 16 aa, BK virus
SQALWHVIRDDIPSIT

SEQ ID NO: 34413 - protein, 16 aa, BK virus
QALWHVIRDDIPSITS

SEQ ID NO: 34414 - protein, 16 aa, BK virus
ALWHVIRDDIPSITSQ

SEQ ID NO: 34415 - protein, 16 aa, BK virus
LWHVIRDDIPSITSQE

SEQ ID NO: 34416 - protein, 16 aa, BK virus
WHVIRDDIPSITSQEL

SEQ ID NO: 34417 - protein, 16 aa, BK virus
HVIRDDIPSITSQELQ

SEQ ID NO: 34418 - protein, 16 aa, BK virus
VIRDDIPSITSQELQR

SEQ ID NO: 34419 - protein, 16 aa, BK virus
IRDDIPSITSQELQRR

SEQ ID NO: 34420 - protein, 16 aa, BK virus
RDDIPSITSQELQRRT

SEQ ID NO: 34421 - protein, 16 aa, BK virus
DDIPSITSQELQRRTE

SEQ ID NO: 34422 - protein, 16 aa, BK virus
DIPSITSQELQRRTER

SEQ ID NO: 34423 - protein, 16 aa, BK virus
IPSITSQELQRRTERF

SEQ ID NO: 34424 - protein, 16 aa, BK virus
PSITSQELQRRTERFF

SEQ ID NO: 34425 - protein, 16 aa, BK virus
SITSQELQRRTERFFR

SEQ ID NO: 34426 - protein, 16 aa, BK virus
ITSQELQRRTERFFRD

SEQ ID NO: 34427 - protein, 16 aa, BK virus
TSQELQRRTERFFRDS

SEQ ID NO: 34428 - protein, 16 aa, BK virus
SQELQRRTERFFRDSL

SEQ ID NO: 34429 - protein, 16 aa, BK virus
QELQRRTERFFRDSLA

SEQ ID NO: 34430 - protein, 16 aa, BK virus
ELQRRTERFFRDSLAR

SEQ ID NO: 34431 - protein, 16 aa, BK virus
LQRRTERFFRDSLARF

SEQ ID NO: 34432 - protein, 16 aa, BK virus
QRRTERFFRDSLARFL

SEQ ID NO: 34433 - protein, 16 aa, BK virus
RRTERFFRDSLARFLE

SEQ ID NO: 34434 - protein, 16 aa, BK virus
RTERFFRDSLARFLEE

SEQ ID NO: 34435 - protein, 16 aa, BK virus
TERFFRDSLARFLEET

SEQ ID NO: 34436 - protein, 16 aa, BK virus
ERFFRDSLARFLEETT

SEQ ID NO: 34437 - protein, 16 aa, BK virus
RFFRDSLARFLEETTW

SEQ ID NO: 34438 - protein, 16 aa, BK virus
FFRDSLARFLEETTWT

SEQ ID NO: 34439 - protein, 16 aa, BK virus
FRDSLARFLEETTWTI

SEQ ID NO: 34440 - protein, 16 aa, BK virus
RDSLARFLEETTWTIV

SEQ ID NO: 34441 - protein, 16 aa, BK virus
DSLARFLEETTWTIVN

SEQ ID NO: 34442 - protein, 16 aa, BK virus
SLARFLEETTWTIVNA

SEQ ID NO: 34443 - protein, 16 aa, BK virus
LARFLEETTWTIVNAP

SEQ ID NO: 34444 - protein, 16 aa, BK virus
ARFLEETTWTIVNAPI

SEQ ID NO: 34445 - protein, 16 aa, BK virus
RFLEETTWTIVNAPIN

SEQ ID NO: 34446 - protein, 16 aa, BK virus
FLEETTWTIVNAPINF

SEQ ID NO: 34447 - protein, 16 aa, BK virus
LEETTWTIVNAPINFY

SEQ ID NO: 34448 - protein, 16 aa, BK virus
EETTWTIVNAPINFYN

SEQ ID NO: 34449 - protein, 16 aa, BK virus
ETTWTIVNAPINFYNY

SEQ ID NO: 34450 - protein, 16 aa, BK virus
TTWTIVNAPINFYNYI

SEQ ID NO: 34451 - protein, 16 aa, BK virus
TWTIVNAPINFYNYIQ

SEQ ID NO: 34452 - protein, 16 aa, BK virus
WTIVNAPINFYNYIQQ

SEQ ID NO: 34453 - protein, 16 aa, BK virus
TIVNAPINFYNYIQQY

SEQ ID NO: 34454 - protein, 16 aa, BK virus
IVNAPINFYNYIQQYY

SEQ ID NO: 34455 - protein, 16 aa, BK virus
VNAPINFYNYIQQYYS

SEQ ID NO: 34456 - protein, 16 aa, BK virus
NAPINFYNYIQQYYSD

SEQ ID NO: 34457 - protein, 16 aa, BK virus
APINFYNYIQQYYSDL

SEQ ID NO: 34458 - protein, 16 aa, BK virus
PINFYNYIQQYYSDLS

SEQ ID NO: 34459 - protein, 16 aa, BK virus
INFYNYIQQYYSDLSP

SEQ ID NO: 34460 - protein, 16 aa, BK virus
NFYNYIQQYYSDLSPI

SEQ ID NO: 34461 - protein, 16 aa, BK virus
FYNYIQQYYSDLSPIR

SEQ ID NO: 34462 - protein, 16 aa, BK virus
YNYIQQYYSDLSPIRP

SEQ ID NO: 34463 - protein, 16 aa, BK virus
NYIQQYYSDLSPIRPS

SEQ ID NO: 34464 - protein, 16 aa, BK virus
YIQQYYSDLSPIRPSM

SEQ ID NO: 34465 - protein, 16 aa, BK virus
IQQYYSDLSPIRPSMV

SEQ ID NO: 34466 - protein, 16 aa, BK virus
QQYYSDLSPIRPSMVR

SEQ ID NO: 34467 - protein, 16 aa, BK virus
QYYSDLSPIRPSMVRQ

SEQ ID NO: 34468 - protein, 16 aa, BK virus
YYSDLSPIRPSMVRQV

SEQ ID NO: 34469 - protein, 16 aa, BK virus
YSDLSPIRPSMVRQVA

SEQ ID NO: 34470 - protein, 16 aa, BK virus
SDLSPIRPSMVRQVAE

SEQ ID NO: 34471 - protein, 16 aa, BK virus
DLSPIRPSMVRQVAER

SEQ ID NO: 34472 - protein, 16 aa, BK virus
LSPIRPSMVRQVAERE

SEQ ID NO: 34473 - protein, 16 aa, BK virus
SPIRPSMVRQVAEREG

SEQ ID NO: 34474 - protein, 16 aa, BK virus
PIRPSMVRQVAEREGT

SEQ ID NO: 34475 - protein, 16 aa, BK virus
IRPSMVRQVAEREGTR

SEQ ID NO: 34476 - protein, 16 aa, BK virus
RPSMVRQVAEREGTRV

SEQ ID NO: 34477 - protein, 16 aa, BK virus
PSMVRQVAEREGTRVH

SEQ ID NO: 34478 - protein, 16 aa, BK virus
SMVRQVAEREGTRVHF

SEQ ID NO: 34479 - protein, 16 aa, BK virus
MVRQVAEREGTRVHFG

SEQ ID NO: 34480 - protein, 16 aa, BK virus
VRQVAEREGTRVHFGH

SEQ ID NO: 34481 - protein, 16 aa, BK virus
RQVAEREGTRVHFGHT

SEQ ID NO: 34482 - protein, 16 aa, BK virus
QVAEREGTRVHFGHTY

SEQ ID NO: 34483 - protein, 16 aa, BK virus
VAEREGTRVHFGHTYS

SEQ ID NO: 34484 - protein, 16 aa, BK virus
AEREGTRVHFGHTYSI

SEQ ID NO: 34485 - protein, 16 aa, BK virus
EREGTRVHFGHTYSID

SEQ ID NO: 34486 - protein, 16 aa, BK virus
REGTRVHFGHTYSIDD

SEQ ID NO: 34487 - protein, 16 aa, BK virus
EGTRVHFGHTYSIDDA

SEQ ID NO: 34488 - protein, 16 aa, BK virus
GTRVHFGHTYSIDDAD

SEQ ID NO: 34489 - protein, 16 aa, BK virus
TRVHFGHTYSIDDADS

SEQ ID NO: 34490 - protein, 16 aa, BK virus
RVHFGHTYSIDDADSI

SEQ ID NO: 34491 - protein, 16 aa, BK virus
VHFGHTYSIDDADSIE

SEQ ID NO: 34492 - protein, 16 aa, BK virus
HFGHTYSIDDADSIEE

SEQ ID NO: 34493 - protein, 16 aa, BK virus
FGHTYSIDDADSIEEV

SEQ ID NO: 34494 - protein, 16 aa, BK virus
GHTYSIDDADSIEEVT

SEQ ID NO: 34495 - protein, 16 aa, BK virus
HTYSIDDADSIEEVTQ

SEQ ID NO: 34496 - protein, 16 aa, BK virus
TYSIDDADSIEEVTQR

SEQ ID NO: 34497 - protein, 16 aa, BK virus
YSIDDADSIEEVTQRM

SEQ ID NO: 34498 - protein, 16 aa, BK virus
SIDDADSIEEVTQRMD

SEQ ID NO: 34499 - protein, 16 aa, BK virus
IDDADSIEEVTQRMDL

SEQ ID NO: 34500 - protein, 16 aa, BK virus
DDADSIEEVTQRMDLR

SEQ ID NO: 34501 - protein, 16 aa, BK virus
DADSIEEVTQRMDLRN

SEQ ID NO: 34502 - protein, 16 aa, BK virus
ADSIEEVTQRMDLRNQ

SEQ ID NO: 34503 - protein, 16 aa, BK virus
DSIEEVTQRMDLRNQQ

SEQ ID NO: 34504 - protein, 16 aa, BK virus
SIEEVTQRMDLRNQQS

SEQ ID NO: 34505 - protein, 16 aa, BK virus
IEEVTQRMDLRNQQSV

SEQ ID NO: 34506 - protein, 16 aa, BK virus
EEVTQRMDLRNQQSVH

SEQ ID NO: 34507 - protein, 16 aa, BK virus
EVTQRMDLRNQQSVHS

SEQ ID NO: 34508 - protein, 16 aa, BK virus
VTQRMDLRNQQSVHSG

SEQ ID NO: 34509 - protein, 16 aa, BK virus
TQRMDLRNQQSVHSGE

SEQ ID NO: 34510 - protein, 16 aa, BK virus
QRMDLRNQQSVHSGEF

SEQ ID NO: 34511 - protein, 16 aa, BK virus
RMDLRNQQSVHSGEFI

SEQ ID NO: 34512 - protein, 16 aa, BK virus
MDLRNQQSVHSGEFIE

SEQ ID NO: 34513 - protein, 16 aa, BK virus
DLRNQQSVHSGEFIEK

SEQ ID NO: 34514 - protein, 16 aa, BK virus
LRNQQSVHSGEFIEKT

SEQ ID NO: 34515 - protein, 16 aa, BK virus
RNQQSVHSGEFIEKTI

SEQ ID NO: 34516 - protein, 16 aa, BK virus
NQQSVHSGEFIEKTIA

SEQ ID NO: 34517 - protein, 16 aa, BK virus
QQSVHSGEFIEKTIAP

SEQ ID NO: 34518 - protein, 16 aa, BK virus
QSVHSGEFIEKTIAPG

SEQ ID NO: 34519 - protein, 16 aa, BK virus
SVHSGEFIEKTIAPGG

SEQ ID NO: 34520 - protein, 16 aa, BK virus
VHSGEFIEKTIAPGGA

SEQ ID NO: 34521 - protein, 16 aa, BK virus
HSGEFIEKTIAPGGAN

SEQ ID NO: 34522 - protein, 16 aa, BK virus
SGEFIEKTIAPGGANQ

SEQ ID NO: 34523 - protein, 16 aa, BK virus
GEFIEKTIAPGGANQR

SEQ ID NO: 34524 - protein, 16 aa, BK virus
EFIEKTIAPGGANQRT

SEQ ID NO: 34525 - protein, 16 aa, BK virus
FIEKTIAPGGANQRTA

SEQ ID NO: 34526 - protein, 16 aa, BK virus
IEKTIAPGGANQRTAP

SEQ ID NO: 34527 - protein, 16 aa, BK virus
EKTIAPGGANQRTAPQ

SEQ ID NO: 34528 - protein, 16 aa, BK virus
KTIAPGGANQRTAPQW

SEQ ID NO: 34529 - protein, 16 aa, BK virus
TIAPGGANQRTAPQWM

SEQ ID NO: 34530 - protein, 16 aa, BK virus
IAPGGANQRTAPQWML

SEQ ID NO: 34531 - protein, 16 aa, BK virus
APGGANQRTAPQWMLP

SEQ ID NO: 34532 - protein, 16 aa, BK virus
PGGANQRTAPQWMLPL

SEQ ID NO: 34533 - protein, 16 aa, BK virus
GGANQRTAPQWMLPLL

SEQ ID NO: 34534 - protein, 16 aa, BK virus
GANQRTAPQWMLPLLL

SEQ ID NO: 34535 - protein, 16 aa, BK virus
ANQRTAPQWMLPLLLG

SEQ ID NO: 34536 - protein, 16 aa, BK virus
NQRTAPQWMLPLLLGL

SEQ ID NO: 34537 - protein, 16 aa, BK virus
QRTAPQWMLPLLLGLY

SEQ ID NO: 34538 - protein, 16 aa, BK virus
RTAPQWMLPLLLGLYG

SEQ ID NO: 34539 - protein, 16 aa, BK virus
TAPQWMLPLLLGLYGT

SEQ ID NO: 34540 - protein, 16 aa, BK virus
APQWMLPLLLGLYGTV

SEQ ID NO: 34541 - protein, 16 aa, BK virus
PQWMLPLLLGLYGTVT

SEQ ID NO: 34542 - protein, 16 aa, BK virus
QWMLPLLLGLYGTVTP

SEQ ID NO: 34543 - protein, 16 aa, BK virus
WMLPLLLGLYGTVTPA

SEQ ID NO: 34544 - protein, 16 aa, BK virus
MLPLLLGLYGTVTPAL

SEQ ID NO: 34545 - protein, 16 aa, BK virus
LPLLLGLYGTVTPALE

SEQ ID NO: 34546 - protein, 16 aa, BK virus
PLLLGLYGTVTPALEA

SEQ ID NO: 34547 - protein, 16 aa, BK virus
LLLGLYGTVTPALEAY

SEQ ID NO: 34548 - protein, 16 aa, BK virus
LLGLYGTVTPALEAYE

SEQ ID NO: 34549 - protein, 16 aa, BK virus
LGLYGTVTPALEAYED

SEQ ID NO: 34550 - protein, 16 aa, BK virus
GLYGTVTPALEAYEDG

SEQ ID NO: 34551 - protein, 16 aa, BK virus
LYGTVTPALEAYEDGP

SEQ ID NO: 34552 - protein, 16 aa, BK virus
YGTVTPALEAYEDGPN

SEQ ID NO: 34553 - protein, 16 aa, BK virus
GTVTPALEAYEDGPNQ

SEQ ID NO: 34554 - protein, 16 aa, BK virus
TVTPALEAYEDGPNQK

SEQ ID NO: 34555 - protein, 16 aa, BK virus
VTPALEAYEDGPNQKK

SEQ ID NO: 34556 - protein, 16 aa, BK virus
TPALEAYEDGPNQKKR

SEQ ID NO: 34557 - protein, 16 aa, BK virus
PALEAYEDGPNQKKRR

SEQ ID NO: 34558 - protein, 16 aa, BK virus
ALEAYEDGPNQKKRRV

SEQ ID NO: 34559 - protein, 16 aa, BK virus
LEAYEDGPNQKKRRVS

SEQ ID NO: 34560 - protein, 16 aa, BK virus
EAYEDGPNQKKRRVSR

SEQ ID NO: 34561 - protein, 16 aa, BK virus
AYEDGPNQKKRRVSRG

SEQ ID NO: 34562 - protein, 16 aa, BK virus
YEDGPNQKKRRVSRGS

SEQ ID NO: 34563 - protein, 16 aa, BK virus
EDGPNQKKRRVSRGSS

SEQ ID NO: 34564 - protein, 16 aa, BK virus
DGPNQKKRRVSRGSSQ

SEQ ID NO: 34565 - protein, 16 aa, BK virus
GPNQKKRRVSRGSSQK

SEQ ID NO: 34566 - protein, 16 aa, BK virus
PNQKKRRVSRGSSQKA

SEQ ID NO: 34567 - protein, 16 aa, BK virus
NQKKRRVSRGSSQKAK

SEQ ID NO: 34568 - protein, 16 aa, BK virus
QKKRRVSRGSSQKAKG

SEQ ID NO: 34569 - protein, 16 aa, BK virus
KKRRVSRGSSQKAKGT

SEQ ID NO: 34570 - protein, 16 aa, BK virus
KRRVSRGSSQKAKGTR

SEQ ID NO: 34571 - protein, 16 aa, BK virus
RRVSRGSSQKAKGTRA

SEQ ID NO: 34572 - protein, 16 aa, BK virus
RVSRGSSQKAKGTRAS

SEQ ID NO: 34573 - protein, 16 aa, BK virus
VSRGSSQKAKGTRASA

SEQ ID NO: 34574 - protein, 16 aa, BK virus
SRGSSQKAKGTRASAK

SEQ ID NO: 34575 - protein, 16 aa, BK virus
RGSSQKAKGTRASAKT

SEQ ID NO: 34576 - protein, 16 aa, BK virus
GSSQKAKGTRASAKTT

SEQ ID NO: 34577 - protein, 16 aa, BK virus
SSQKAKGTRASAKTTN

SEQ ID NO: 34578 - protein, 16 aa, BK virus
SQKAKGTRASAKTTNK

SEQ ID NO: 34579 - protein, 16 aa, BK virus
QKAKGTRASAKTTNKR

SEQ ID NO: 34580 - protein, 16 aa, BK virus
KAKGTRASAKTTNKRR

SEQ ID NO: 34581 - protein, 16 aa, BK virus
AKGTRASAKTTNKRRS

SEQ ID NO: 34582 - protein, 16 aa, BK virus
KGTRASAKTTNKRRSR

SEQ ID NO: 34583 - protein, 16 aa, BK virus
GTRASAKTTNKRRSRS

SEQ ID NO: 34584 - protein, 16 aa, BK virus
TRASAKTTNKRRSRSS

SEQ ID NO: 34585 - protein, 16 aa, BK virus
RASAKTTNKRRSRSSR

SEQ ID NO: 34586 - protein, 16 aa, BK virus
ASAKTTNKRRSRSSRS

SEQ ID NO: 34587 - protein, 16 aa, BK virus
NWGRCYYRGRMLPKPR

SEQ ID NO: 34588 - protein, 16 aa, BK virus
WGRCYYRGRMLPKPRN

SEQ ID NO: 34589 - protein, 16 aa, BK virus
GRCYYRGRMLPKPRNG

SEQ ID NO: 34590 - protein, 16 aa, BK virus
RCYYRGRMLPKPRNGG

SEQ ID NO: 34591 - protein, 16 aa, BK virus
CYYRGRMLPKPRNGGS

SEQ ID NO: 34592 - protein, 16 aa, BK virus
YYRGRMLPKPRNGGSR

SEQ ID NO: 34593 - protein, 16 aa, BK virus
PREKNASLLQHSKNSP

SEQ ID NO: 34594 - protein, 16 aa, BK virus
REKNASLLQHSKNSPP

SEQ ID NO: 34595 - protein, 16 aa, BK virus
EKNASLLQHSKNSPPQ

SEQ ID NO: 34596 - protein, 16 aa, BK virus
KNASLLQHSKNSPPQF

SEQ ID NO: 34597 - protein, 16 aa, BK virus
NASLLQHSKNSPPQFK

SEQ ID NO: 34598 - protein, 16 aa, BK virus
GPNLWKSTDVGGCNCT

SEQ ID NO: 34599 - protein, 16 aa, BK virus
PNLWKSTDVGGCNCTN

SEQ ID NO: 34600 - protein, 16 aa, BK virus
NLWKSTDVGGCNCTNR

SEQ ID NO: 34601 - protein, 16 aa, BK virus
LWKSTDVGGCNCTNRG

SEQ ID NO: 34602 - protein, 16 aa, BK virus
WKSTDVGGCNCTNRGY

SEQ ID NO: 34603 - protein, 16 aa, BK virus
KSTDVGGCNCTNRGYW

SEQ ID NO: 34604 - protein, 16 aa, BK virus
STDVGGCNCTNRGYWN

SEQ ID NO: 34605 - protein, 16 aa, BK virus
TDVGGCNCTNRGYWNN

SEQ ID NO: 34606 - protein, 16 aa, BK virus
FPLLCCRWRTLGNAGS

SEQ ID NO: 34607 - protein, 16 aa, BK virus
PLLCCRWRTLGNAGSA

SEQ ID NO: 34608 - protein, 16 aa, BK virus
LLCCRWRTLGNAGSAN

SEQ ID NO: 34609 - protein, 16 aa, BK virus
LCCRWRTLGNAGSANE

SEQ ID NO: 34610 - protein, 16 aa, BK virus
CCRWRTLGNAGSANEL

SEQ ID NO: 34611 - protein, 16 aa, BK virus
CRWRTLGNAGSANELQ

SEQ ID NO: 34612 - protein, 16 aa, BK virus
RWRTLGNAGSANELQV

SEQ ID NO: 34613 - protein, 16 aa, BK virus
WRTLGNAGSANELQVK

SEQ ID NO: 34614 - protein, 16 aa, BK virus
RTLGNAGSANELQVKV

SEQ ID NO: 34615 - protein, 16 aa, BK virus
TLGNAGSANELQVKVP

SEQ ID NO: 34616 - protein, 16 aa, BK virus
VFWDFHRRGKCSPSTS

SEQ ID NO: 34617 - protein, 16 aa, BK virus
FWDFHRRGKCSPSTSC

SEQ ID NO: 34618 - protein, 16 aa, BK virus
WDFHRRGKCSPSTSCD

SEQ ID NO: 34619 - protein, 16 aa, BK virus
DFHRRGKCSPSTSCDQ

SEQ ID NO: 34620 - protein, 16 aa, BK virus
FHRRGKCSPSTSCDQH

SEQ ID NO: 34621 - protein, 16 aa, BK virus
HRRGKCSPSTSCDQHS

SEQ ID NO: 34622 - protein, 16 aa, BK virus
RRGKCSPSTSCDQHSY

SEQ ID NO: 34623 - protein, 16 aa, BK virus
RGKCSPSTSCDQHSYH

SEQ ID NO: 34624 - protein, 16 aa, BK virus
GKCSPSTSCDQHSYHS

SEQ ID NO: 34625 - protein, 16 aa, BK virus
KCSPSTSCDQHSYHSV

SEQ ID NO: 34626 - protein, 16 aa, BK virus
CSPSTSCDQHSYHSVA

SEQ ID NO: 34627 - protein, 16 aa, BK virus
SPSTSCDQHSYHSVAR

SEQ ID NO: 34628 - protein, 16 aa, BK virus
DPPEKKICKESLPNFL

SEQ ID NO: 34629 - protein, 16 aa, BK virus
PPEKKICKESLPNFLF

SEQ ID NO: 34630 - protein, 16 aa, BK virus
PEKKICKESLPNFLFA

SEQ ID NO: 34631 - protein, 16 aa, BK virus
EKKICKESLPNFLFAK

SEQ ID NO: 34632 - protein, 16 aa, BK virus
PYKQENPESGWAAYVW

SEQ ID NO: 34633 - protein, 16 aa, BK virus
YKQENPESGWAAYVWY

SEQ ID NO: 34634 - protein, 16 aa, BK virus
KQENPESGWAAYVWYG

SEQ ID NO: 34635 - protein, 16 aa, BK virus
QENPESGWAAYVWYGI

SEQ ID NO: 34636 - protein, 16 aa, BK virus
ENPESGWAAYVWYGIP

SEQ ID NO: 34637 - protein, 16 aa, BK virus
NPESGWAAYVWYGIPG

SEQ ID NO: 34638 - protein, 16 aa, BK virus
PESGWAAYVWYGIPGR

SEQ ID NO: 34639 - protein, 16 aa, BK virus
ESGWAAYVWYGIPGRR

SEQ ID NO: 34640 - protein, 16 aa, BK virus
SGWAAYVWYGIPGRRG

SEQ ID NO: 34641 - protein, 16 aa, BK virus
QTGTIANQNALNRCFY

SEQ ID NO: 34642 - protein, 16 aa, BK virus
TGTIANQNALNRCFYC

SEQ ID NO: 34643 - protein, 16 aa, BK virus
GTIANQNALNRCFYCT

SEQ ID NO: 34644 - protein, 16 aa, BK virus
TIANQNALNRCFYCTY

SEQ ID NO: 34645 - protein, 16 aa, BK virus
IANQNALNRCFYCTYT

SEQ ID NO: 34646 - protein, 16 aa, BK virus
ANQNALNRCFYCTYTF

SEQ ID NO: 34647 - protein, 16 aa, BK virus
NQNALNRCFYCTYTFN

SEQ ID NO: 34648 - protein, 16 aa, BK virus
QNALNRCFYCTYTFNK

SEQ ID NO: 34649 - protein, 16 aa, BK virus
NALNRCFYCTYTFNKC

SEQ ID NO: 34650 - protein, 16 aa, BK virus
ALNRCFYCTYTFNKCC

SEQ ID NO: 34651 - protein, 16 aa, BK virus
LNRCFYCTYTFNKCCF

SEQ ID NO: 34652 - protein, 16 aa, BK virus
NRCFYCTYTFNKCCFC

SEQ ID NO: 34653 - protein, 16 aa, BK virus
RCFYCTYTFNKCCFCI

SEQ ID NO: 34654 - protein, 16 aa, BK virus
CFYCTYTFNKCCFCIS

SEQ ID NO: 34655 - protein, 16 aa, BK virus
FYCTYTFNKCCFCISH

SEQ ID NO: 34656 - protein, 16 aa, BK virus
YCTYTFNKCCFCISHF

SEQ ID NO: 34657 - protein, 16 aa, BK virus
NTESLYTNATLDYGGL

SEQ ID NO: 34658 - protein, 16 aa, BK virus
TESLYTNATLDYGGLT

SEQ ID NO: 34659 - protein, 16 aa, BK virus
ESLYTNATLDYGGLTF

SEQ ID NO: 34660 - protein, 16 aa, BK virus
SLYTNATLDYGGLTFG

SEQ ID NO: 34661 - protein, 16 aa, BK virus
LYTNATLDYGGLTFGN

SEQ ID NO: 34662 - protein, 16 aa, BK virus
YTNATLDYGGLTFGNL

SEQ ID NO: 34663 - protein, 16 aa, BK virus
TNATLDYGGLTFGNLQ

SEQ ID NO: 34664 - protein, 16 aa, BK virus
NATLDYGGLTFGNLQQ

SEQ ID NO: 34665 - protein, 16 aa, BK virus
ATLDYGGLTFGNLQQG

SEQ ID NO: 34666 - protein, 16 aa, BK virus
TLDYGGLTFGNLQQGL

SEQ ID NO: 34667 - protein, 16 aa, BK virus
LDYGGLTFGNLQQGLK

SEQ ID NO: 34668 - protein, 16 aa, BK virus
DYGGLTFGNLQQGLKY

SEQ ID NO: 34669 - protein, 16 aa, BK virus
YGGLTFGNLQQGLKYL

SEQ ID NO: 34670 - protein, 16 aa, BK virus
GGLTFGNLQQGLKYLR

SEQ ID NO: 34671 - protein, 16 aa, BK virus
GLTFGNLQQGLKYLRL

SEQ ID NO: 34672 - protein, 16 aa, BK virus
LTFGNLQQGLKYLRLG

SEQ ID NO: 34673 - protein, 16 aa, BK virus
TFGNLQQGLKYLRLGK

SEQ ID NO: 34674 - protein, 16 aa, BK virus
FGNLQQGLKYLRLGKS

SEQ ID NO: 34675 - protein, 16 aa, BK virus
GNLQQGLKYLRLGKSI

SEQ ID NO: 34676 - protein, 16 aa, BK virus
NLQQGLKYLRLGKSIV

SEQ ID NO: 34677 - protein, 16 aa, BK virus
LQQGLKYLRLGKSIVI

SEQ ID NO: 34678 - protein, 16 aa, BK virus
QQGLKYLRLGKSIVIG

SEQ ID NO: 34679 - protein, 16 aa, BK virus
QGLKYLRLGKSIVIGI

SEQ ID NO: 34680 - protein, 16 aa, BK virus
GLKYLRLGKSIVIGIQ

SEQ ID NO: 34681 - protein, 16 aa, BK virus
LKYLRLGKSIVIGIQC

SEQ ID NO: 34682 - protein, 16 aa, BK virus
KYLRLGKSIVIGIQCL

SEQ ID NO: 34683 - protein, 16 aa, BK virus
YLRLGKSIVIGIQCLI

SEQ ID NO: 34684 - protein, 16 aa, BK virus
LRLGKSIVIGIQCLIH

SEQ ID NO: 34685 - protein, 16 aa, BK virus
RLGKSIVIGIQCLIHV

SEQ ID NO: 34686 - protein, 16 aa, BK virus
LGKSIVIGIQCLIHVQ

SEQ ID NO: 34687 - protein, 16 aa, BK virus
GKSIVIGIQCLIHVQS

SEQ ID NO: 34688 - protein, 16 aa, BK virus
KSIVIGIQCLIHVQSL

SEQ ID NO: 34689 - protein, 16 aa, BK virus
SIVIGIQCLIHVQSLQ

SEQ ID NO: 34690 - protein, 16 aa, BK virus
IVIGIQCLIHVQSLQF

SEQ ID NO: 34691 - protein, 16 aa, BK virus
VIGIQCLIHVQSLQFL

SEQ ID NO: 34692 - protein, 16 aa, BK virus
IGIQCLIHVQSLQFLN

SEQ ID NO: 34693 - protein, 16 aa, BK virus
GIQCLIHVQSLQFLNP

SEQ ID NO: 34694 - protein, 16 aa, BK virus
IQCLIHVQSLQFLNPL

SEQ ID NO: 34695 - protein, 16 aa, BK virus
QCLIHVQSLQFLNPLL

SEQ ID NO: 34696 - protein, 16 aa, BK virus
CLIHVQSLQFLNPLLL

SEQ ID NO: 34697 - protein, 16 aa, BK virus
YQEYISPCIYYISSLK

SEQ ID NO: 34698 - protein, 16 aa, BK virus
QEYISPCIYYISSLKK

SEQ ID NO: 34699 - protein, 16 aa, BK virus
EYISPCIYYISSLKKY

SEQ ID NO: 34700 - protein, 16 aa, BK virus
YISPCIYYISSLKKYT

SEQ ID NO: 34701 - protein, 16 aa, BK virus
ISPCIYYISSLKKYTY

SEQ ID NO: 34702 - protein, 16 aa, BK virus
SPCIYYISSLKKYTYL

SEQ ID NO: 34703 - protein, 16 aa, BK virus
PCIYYISSLKKYTYLS

SEQ ID NO: 34704 - protein, 16 aa, BK virus
CIYYISSLKKYTYLSQ

SEQ ID NO: 34705 - protein, 16 aa, BK virus
IYYISSLKKYTYLSQN

SEQ ID NO: 34706 - protein, 16 aa, BK virus
YYISSLKKYTYLSQNP

SEQ ID NO: 34707 - protein, 16 aa, BK virus
YISSLKKYTYLSQNPA

SEQ ID NO: 34708 - protein, 16 aa, BK virus
ISSLKKYTYLSQNPAF

SEQ ID NO: 34709 - protein, 16 aa, BK virus
SSLKKYTYLSQNPAFP

SEQ ID NO: 34710 - protein, 16 aa, BK virus
SLKKYTYLSQNPAFPS

SEQ ID NO: 34711 - protein, 16 aa, BK virus
LKKYTYLSQNPAFPSI

SEQ ID NO: 34712 - protein, 16 aa, BK virus
KKYTYLSQNPAFPSIQ

SEQ ID NO: 34713 - protein, 16 aa, BK virus
KYTYLSQNPAFPSIQQ

SEQ ID NO: 34714 - protein, 16 aa, BK virus
YTYLSQNPAFPSIQQF

SEQ ID NO: 34715 - protein, 16 aa, BK virus
TKLAVATRSFHFVKFF

SEQ ID NO: 34716 - protein, 16 aa, BK virus
KLAVATRSFHFVKFFF

SEQ ID NO: 34717 - protein, 16 aa, BK virus
LAVATRSFHFVKFFFQ

SEQ ID NO: 34718 - protein, 16 aa, BK virus
AVATRSFHFVKFFFQV

SEQ ID NO: 34719 - protein, 16 aa, BK virus
VATRSFHFVKFFFQVR

SEQ ID NO: 34720 - protein, 16 aa, BK virus
ATRSFHFVKFFFQVRT

SEQ ID NO: 34721 - protein, 16 aa, BK virus
TRSFHFVKFFFQVRTL

SEQ ID NO: 34722 - protein, 16 aa, BK virus
RSFHFVKFFFQVRTLS

SEQ ID NO: 34723 - protein, 16 aa, BK virus
SFHFVKFFFQVRTLSF

SEQ ID NO: 34724 - protein, 16 aa, BK virus
FHFVKFFFQVRTLSFV

SEQ ID NO: 34725 - protein, 16 aa, BK virus
HFVKFFFQVRTLSFVR

SEQ ID NO: 34726 - protein, 16 aa, BK virus
FVKFFFQVRTLSFVRI

SEQ ID NO: 34727 - protein, 16 aa, BK virus
VKFFFQVRTLSFVRIF

SEQ ID NO: 34728 - protein, 16 aa, BK virus
KFFFQVRTLSFVRIFL

SEQ ID NO: 34729 - protein, 16 aa, BK virus
FFFQVRTLSFVRIFLN

SEQ ID NO: 34730 - protein, 16 aa, BK virus
FFQVRTLSFVRIFLNI

SEQ ID NO: 34731 - protein, 16 aa, BK virus
FQVRTLSFVRIFLNIF

SEQ ID NO: 34732 - protein, 16 aa, BK virus
QVRTLSFVRIFLNIFW

SEQ ID NO: 34733 - protein, 16 aa, BK virus
VRTLSFVRIFLNIFWA

SEQ ID NO: 34734 - protein, 16 aa, BK virus
PSLVEIFGFFCLNVSF

SEQ ID NO: 34735 - protein, 16 aa, BK virus
SLVEIFGFFCLNVSFL

SEQ ID NO: 34736 - protein, 16 aa, BK virus
LVEIFGFFCLNVSFLN

SEQ ID NO: 34737 - protein, 16 aa, BK virus
VEIFGFFCLNVSFLNL

SEQ ID NO: 34738 - protein, 16 aa, BK virus
EIFGFFCLNVSFLNLP

SEQ ID NO: 34739 - protein, 16 aa, BK virus
HFHLNNLSNCLNCLFH

SEQ ID NO: 34740 - protein, 16 aa, BK virus
FHLNNLSNCLNCLFHV

SEQ ID NO: 34741 - protein, 16 aa, BK virus
HLNNLSNCLNCLFHVL

SEQ ID NO: 34742 - protein, 16 aa, BK virus
LNNLSNCLNCLFHVLK

SEQ ID NO: 34743 - protein, 16 aa, BK virus
NNLSNCLNCLFHVLKA

SEQ ID NO: 34744 - protein, 16 aa, BK virus
NLSNCLNCLFHVLKAN

SEQ ID NO: 34745 - protein, 16 aa, BK virus
LSNCLNCLFHVLKANP

SEQ ID NO: 34746 - protein, 16 aa, BK virus
SNCLNCLFHVLKANPL

SEQ ID NO: 34747 - protein, 16 aa, BK virus
NCLNCLFHVLKANPLI

SEQ ID NO: 34748 - protein, 16 aa, BK virus
CLNCLFHVLKANPLIQ

SEQ ID NO: 34749 - protein, 16 aa, BK virus
LNCLFHVLKANPLIQL

SEQ ID NO: 34750 - protein, 16 aa, BK virus
NCLFHVLKANPLIQLL

SEQ ID NO: 34751 - protein, 16 aa, BK virus
CLFHVLKANPLIQLLS

SEQ ID NO: 34752 - protein, 16 aa, BK virus
LFHVLKANPLIQLLSL

SEQ ID NO: 34753 - protein, 16 aa, BK virus
FHVLKANPLIQLLSLL

SEQ ID NO: 34754 - protein, 16 aa, BK virus
HVLKANPLIQLLSLLH

SEQ ID NO: 34755 - protein, 16 aa, BK virus
VLKANPLIQLLSLLHL

SEQ ID NO: 34756 - protein, 16 aa, BK virus
LKANPLIQLLSLLHLQ

SEQ ID NO: 34757 - protein, 16 aa, BK virus
KANPLIQLLSLLHLQK

SEQ ID NO: 34758 - protein, 16 aa, BK virus
ANPLIQLLSLLHLQKQ

SEQ ID NO: 34759 - protein, 16 aa, BK virus
NPLIQLLSLLHLQKQP

SEQ ID NO: 34760 - protein, 16 aa, BK virus
PLIQLLSLLHLQKQPC

SEQ ID NO: 34761 - protein, 16 aa, BK virus
LIQLLSLLHLQKQPCT

SEQ ID NO: 34762 - protein, 16 aa, BK virus
IQLLSLLHLQKQPCTD

SEQ ID NO: 34763 - protein, 16 aa, BK virus
QLLSLLHLQKQPCTDL

SEQ ID NO: 34764 - protein, 16 aa, BK virus
LHLAQRLAFPWVGLHL

SEQ ID NO: 34765 - protein, 16 aa, BK virus
HLAQRLAFPWVGLHLR

SEQ ID NO: 34766 - protein, 16 aa, BK virus
LAQRLAFPWVGLHLRL

SEQ ID NO: 34767 - protein, 16 aa, BK virus
AQRLAFPWVGLHLRLY

SEQ ID NO: 34768 - protein, 16 aa, BK virus
QRLAFPWVGLHLRLYH

SEQ ID NO: 34769 - protein, 16 aa, BK virus
RLAFPWVGLHLRLYHH

SEQ ID NO: 34770 - protein, 16 aa, BK virus
LAFPWVGLHLRLYHHT

SEQ ID NO: 34771 - protein, 16 aa, BK virus
AFPWVGLHLRLYHHTN

SEQ ID NO: 34772 - protein, 16 aa, BK virus
FPWVGLHLRLYHHTNL

SEQ ID NO: 34773 - protein, 16 aa, BK virus
PWVGLHLRLYHHTNLI

SEQ ID NO: 34774 - protein, 16 aa, BK virus
WVGLHLRLYHHTNLIT

SEQ ID NO: 34775 - protein, 16 aa, BK virus
VGLHLRLYHHTNLITL

SEQ ID NO: 34776 - protein, 16 aa, BK virus
GLHLRLYHHTNLITLQ

SEQ ID NO: 34777 - protein, 16 aa, BK virus
LHLRLYHHTNLITLQL

SEQ ID NO: 34778 - protein, 16 aa, BK virus
HLRLYHHTNLITLQLV

SEQ ID NO: 34779 - protein, 16 aa, BK virus
LRLYHHTNLITLQLVL

SEQ ID NO: 34780 - protein, 16 aa, BK virus
RLYHHTNLITLQLVLF

SEQ ID NO: 34781 - protein, 16 aa, BK virus
LYHHTNLITLQLVLFF

SEQ ID NO: 34782 - protein, 16 aa, BK virus
YHHTNLITLQLVLFFH

SEQ ID NO: 34783 - protein, 16 aa, BK virus
HHTNLITLQLVLFFHY

SEQ ID NO: 34784 - protein, 16 aa, BK virus
HTNLITLQLVLFFHYQ

SEQ ID NO: 34785 - protein, 16 aa, BK virus
TNLITLQLVLFFHYQW

SEQ ID NO: 34786 - protein, 16 aa, BK virus
NLITLQLVLFFHYQWD

SEQ ID NO: 34787 - protein, 16 aa, BK virus
LITLQLVLFFHYQWDL

SEQ ID NO: 34788 - protein, 16 aa, BK virus
VANSAAKQHLPYIVLV

SEQ ID NO: 34789 - protein, 16 aa, BK virus
ANSAAKQHLPYIVLVQ

SEQ ID NO: 34790 - protein, 16 aa, BK virus
NSAAKQHLPYIVLVQH

SEQ ID NO: 34791 - protein, 16 aa, BK virus
SAAKQHLPYIVLVQHF

SEQ ID NO: 34792 - protein, 16 aa, BK virus
AAKQHLPYIVLVQHFH

SEQ ID NO: 34793 - protein, 16 aa, BK virus
AKQHLPYIVLVQHFHE

SEQ ID NO: 34794 - protein, 16 aa, BK virus
KQHLPYIVLVQHFHEL

SEQ ID NO: 34795 - protein, 16 aa, BK virus
QHLPYIVLVQHFHELQ

SEQ ID NO: 34796 - protein, 16 aa, BK virus
HLPYIVLVQHFHELQI

SEQ ID NO: 34797 - protein, 16 aa, BK virus
LPYIVLVQHFHELQIL

SEQ ID NO: 34798 - protein, 16 aa, BK virus
PYIVLVQHFHELQILN

SEQ ID NO: 34799 - protein, 16 aa, BK virus
YIVLVQHFHELQILNP

SEQ ID NO: 34800 - protein, 16 aa, BK virus
IVLVQHFHELQILNPF

SEQ ID NO: 34801 - protein, 16 aa, BK virus
VLVQHFHELQILNPFY

SEQ ID NO: 34802 - protein, 16 aa, BK virus
LVQHFHELQILNPFYL

SEQ ID NO: 34803 - protein, 16 aa, BK virus
VQHFHELQILNPFYLI

SEQ ID NO: 34804 - protein, 16 aa, BK virus
QHFHELQILNPFYLIY

SEQ ID NO: 34805 - protein, 16 aa, BK virus
HFHELQILNPFYLIYD

SEQ ID NO: 34806 - protein, 16 aa, BK virus
IFLLAFLPWSYEGYLL

SEQ ID NO: 34807 - protein, 16 aa, BK virus
FLLAFLPWSYEGYLLF

SEQ ID NO: 34808 - protein, 16 aa, BK virus
LLAFLPWSYEGYLLFF

SEQ ID NO: 34809 - protein, 16 aa, BK virus
LKLYLLLADKYFFDFY

SEQ ID NO: 34810 - protein, 16 aa, BK virus
KLYLLLADKYFFDFYF

SEQ ID NO: 34811 - protein, 16 aa, BK virus
LYLLLADKYFFDFYFL

SEQ ID NO: 34812 - protein, 16 aa, BK virus
YLLLADKYFFDFYFLQ

SEQ ID NO: 34813 - protein, 16 aa, BK virus
LLLADKYFFDFYFLQK

SEQ ID NO: 34814 - protein, 16 aa, BK virus
SDKAGLFSDTFYTPLH

SEQ ID NO: 34815 - protein, 16 aa, BK virus
DKAGLFSDTFYTPLHC

SEQ ID NO: 34816 - protein, 16 aa, BK virus
KAGLFSDTFYTPLHCI

SEQ ID NO: 34817 - protein, 16 aa, BK virus
AGLFSDTFYTPLHCIE

SEQ ID NO: 34818 - protein, 16 aa, BK virus
GLFSDTFYTPLHCIEI

SEQ ID NO: 34819 - protein, 16 aa, BK virus
LFSDTFYTPLHCIEIL

SEQ ID NO: 34820 - protein, 16 aa, BK virus
FSDTFYTPLHCIEILN

SEQ ID NO: 34821 - protein, 16 aa, BK virus
SDTFYTPLHCIEILNT

SEQ ID NO: 34822 - protein, 16 aa, BK virus
DTFYTPLHCIEILNTY

SEQ ID NO: 34823 - protein, 16 aa, BK virus
TFYTPLHCIEILNTYL

SEQ ID NO: 34824 - protein, 16 aa, BK virus
FYTPLHCIEILNTYLI

SEQ ID NO: 34825 - protein, 16 aa, BK virus
YTPLHCIEILNTYLII

SEQ ID NO: 34826 - protein, 16 aa, BK virus
TPLHCIEILNTYLIIK

SEQ ID NO: 34827 - protein, 16 aa, BK virus
PLHCIEILNTYLIIKT

SEQ ID NO: 34828 - protein, 16 aa, BK virus
LHCIEILNTYLIIKTH

SEQ ID NO: 34829 - protein, 16 aa, BK virus
HCIEILNTYLIIKTHP

SEQ ID NO: 34830 - protein, 16 aa, BK virus
CIEILNTYLIIKTHPH

SEQ ID NO: 34831 - protein, 16 aa, BK virus
IEILNTYLIIKTHPHT

SEQ ID NO: 34832 - protein, 16 aa, BK virus
EILNTYLIIKTHPHTL

SEQ ID NO: 34833 - protein, 16 aa, BK virus
ILNTYLIIKTHPHTLS

SEQ ID NO: 34834 - protein, 16 aa, BK virus
LNTYLIIKTHPHTLSL

SEQ ID NO: 34835 - protein, 16 aa, BK virus
NTYLIIKTHPHTLSLL

SEQ ID NO: 34836 - protein, 16 aa, BK virus
TYLIIKTHPHTLSLLH

SEQ ID NO: 34837 - protein, 16 aa, BK virus
YLIIKTHPHTLSLLHT

SEQ ID NO: 34838 - protein, 16 aa, BK virus
LIIKTHPHTLSLLHTQ

SEQ ID NO: 34839 - protein, 16 aa, BK virus
GLLPFFFFWVVLSVEN

SEQ ID NO: 34840 - protein, 16 aa, BK virus
LLPFFFFWVVLSVENL

SEQ ID NO: 34841 - protein, 16 aa, BK virus
LPFFFFWVVLSVENLL

SEQ ID NO: 34842 - protein, 16 aa, BK virus
PFFFFWVVLSVENLLL

SEQ ID NO: 34843 - protein, 16 aa, BK virus
FFFFWVVLSVENLLLL

SEQ ID NO: 34844 - protein, 16 aa, BK virus
FFFWVVLSVENLLLLL

SEQ ID NO: 34845 - protein, 16 aa, BK virus
FFWVVLSVENLLLLLH

SEQ ID NO: 34846 - protein, 16 aa, BK virus
FWVVLSVENLLLLLHH

SEQ ID NO: 34847 - protein, 16 aa, BK virus
WVVLSVENLLLLLHHW

SEQ ID NO: 34848 - protein, 16 aa, BK virus
VVLSVENLLLLLHHWQ

SEQ ID NO: 34849 - protein, 16 aa, BK virus
VLSVENLLLLLHHWQT

SEQ ID NO: 34850 - protein, 16 aa, BK virus
LSVENLLLLLHHWQTY

SEQ ID NO: 34851 - protein, 16 aa, BK virus
SVENLLLLLHHWQTYL

SEQ ID NO: 34852 - protein, 16 aa, BK virus
VENLLLLLHHWQTYLH

SEQ ID NO: 34853 - protein, 16 aa, BK virus
ENLLLLLHHWQTYLHG

SEQ ID NO: 34854 - protein, 16 aa, BK virus
NLLLLLHHWQTYLHGK

SEQ ID NO: 34855 - protein, 16 aa, BK virus
LLLLLHHWQTYLHGKI

SEQ ID NO: 34856 - protein, 16 aa, BK virus
LLLLHHWQTYLHGKIN

SEQ ID NO: 34857 - protein, 16 aa, BK virus
LLLHHWQTYLHGKINL

SEQ ID NO: 34858 - protein, 16 aa, BK virus
LLHHWQTYLHGKINLH

SEQ ID NO: 34859 - protein, 16 aa, BK virus
LHHWQTYLHGKINLHP

SEQ ID NO: 34860 - protein, 16 aa, BK virus
HHWQTYLHGKINLHPI

SEQ ID NO: 34861 - protein, 16 aa, BK virus
HWQTYLHGKINLHPIF

SEQ ID NO: 34862 - protein, 16 aa, BK virus
WQTYLHGKINLHPIFH

SEQ ID NO: 34863 - protein, 16 aa, BK virus
RNSTRTPTLLFHRLAP

SEQ ID NO: 34864 - protein, 16 aa, BK virus
NSTRTPTLLFHRLAPI

SEQ ID NO: 34865 - protein, 16 aa, BK virus
STRTPTLLFHRLAPIK

SEQ ID NO: 34866 - protein, 16 aa, BK virus
TRTPTLLFHRLAPIKK

SEQ ID NO: 34867 - protein, 16 aa, BK virus
RTPTLLFHRLAPIKKI

SEQ ID NO: 34868 - protein, 16 aa, BK virus
TPTLLFHRLAPIKKII

SEQ ID NO: 34869 - protein, 16 aa, BK virus
PTLLFHRLAPIKKIIT

SEQ ID NO: 34870 - protein, 16 aa, BK virus
GLLIFYYLSKYKLVTL

SEQ ID NO: 34871 - protein, 16 aa, BK virus
LLIFYYLSKYKLVTLK

SEQ ID NO: 34872 - protein, 16 aa, BK virus
LIFYYLSKYKLVTLKL

SEQ ID NO: 34873 - protein, 16 aa, BK virus
ISEGSFSNYLDPPLQS

SEQ ID NO: 34874 - protein, 16 aa, BK virus
SEGSFSNYLDPPLQSF

SEQ ID NO: 34875 - protein, 16 aa, BK virus
EGSFSNYLDPPLQSFF

SEQ ID NO: 34876 - protein, 16 aa, BK virus
GSFSNYLDPPLQSFFS

SEQ ID NO: 34877 - protein, 16 aa, BK virus
AKPLCEAVNAVAIYPN

SEQ ID NO: 34878 - protein, 16 aa, BK virus
KPLCEAVNAVAIYPNQ

SEQ ID NO: 34879 - protein, 16 aa, BK virus
PLCEAVNAVAIYPNQG

SEQ ID NO: 34880 - protein, 16 aa, BK virus
LCEAVNAVAIYPNQGL

SEQ ID NO: 34881 - protein, 16 aa, BK virus
CEAVNAVAIYPNQGLF

SEQ ID NO: 34882 - protein, 16 aa, BK virus
EAVNAVAIYPNQGLFS

SEQ ID NO: 34883 - protein, 16 aa, BK virus
HARAVHRRLFGTNRPF

SEQ ID NO: 34884 - protein, 16 aa, BK virus
ARAVHRRLFGTNRPFL

SEQ ID NO: 34885 - protein, 16 aa, BK virus
RAVHRRLFGTNRPFLA

SEQ ID NO: 34886 - protein, 16 aa, BK virus
AVHRRLFGTNRPFLAV

SEQ ID NO: 34887 - protein, 16 aa, BK virus
VHRRLFGTNRPFLAVQ

SEQ ID NO: 34888 - protein, 16 aa, BK virus
HRRLFGTNRPFLAVQG

SEQ ID NO: 34889 - protein, 16 aa, BK virus
RRLFGTNRPFLAVQGI

SEQ ID NO: 34890 - protein, 16 aa, BK virus
RLFGTNRPFLAVQGIW

SEQ ID NO: 34891 - protein, 16 aa, BK virus
LFGTNRPFLAVQGIWA

SEQ ID NO: 34892 - protein, 16 aa, BK virus
FGTNRPFLAVQGIWAK

SEQ ID NO: 34893 - protein, 16 aa, BK virus
GTNRPFLAVQGIWAKR

SEQ ID NO: 34894 - protein, 16 aa, BK virus
TNRPFLAVQGIWAKRK

SEQ ID NO: 34895 - protein, 16 aa, BK virus
NRPFLAVQGIWAKRKI

SEQ ID NO: 34896 - protein, 16 aa, BK virus
RPFLAVQGIWAKRKIS

SEQ ID NO: 34897 - protein, 16 aa, BK virus
PFLAVQGIWAKRKIST

SEQ ID NO: 34898 - protein, 16 aa, BK virus
FLAVQGIWAKRKISTN

SEQ ID NO: 34899 - protein, 16 aa, BK virus
LAVQGIWAKRKISTNL

SEQ ID NO: 34900 - protein, 16 aa, BK virus
ATPGSKIRLMSYLYIL

SEQ ID NO: 34901 - protein, 16 aa, BK virus
TPGSKIRLMSYLYILL

SEQ ID NO: 34902 - protein, 16 aa, BK virus
PGSKIRLMSYLYILLH

SEQ ID NO: 34903 - protein, 16 aa, BK virus
GSKIRLMSYLYILLHF

SEQ ID NO: 34904 - protein, 16 aa, BK virus
SKIRLMSYLYILLHFF

SEQ ID NO: 34905 - protein, 16 aa, BK virus
KIRLMSYLYILLHFFI

SEQ ID NO: 34906 - protein, 16 aa, BK virus
IRLMSYLYILLHFFIQ

SEQ ID NO: 34907 - protein, 16 aa, BK virus
RLMSYLYILLHFFIQS

SEQ ID NO: 34908 - protein, 16 aa, BK virus
LMSYLYILLHFFIQSI

SEQ ID NO: 34909 - protein, 16 aa, BK virus
MSYLYILLHFFIQSIH

SEQ ID NO: 34910 - protein, 16 aa, BK virus
SYLYILLHFFIQSIHS

SEQ ID NO: 34911 - protein, 16 aa, BK virus
YLYILLHFFIQSIHSL

SEQ ID NO: 34912 - protein, 16 aa, BK virus
LYILLHFFIQSIHSLH

SEQ ID NO: 34913 - protein, 16 aa, BK virus
YILLHFFIQSIHSLHF

SEQ ID NO: 34914 - protein, 16 aa, BK virus
ILLHFFIQSIHSLHFI

SEQ ID NO: 34915 - protein, 16 aa, BK virus
LLHFFIQSIHSLHFIL

SEQ ID NO: 34916 - protein, 16 aa, BK virus
LHFFIQSIHSLHFILV

SEQ ID NO: 34917 - protein, 16 aa, BK virus
HFFIQSIHSLHFILVA

SEQ ID NO: 34918 - protein, 16 aa, BK virus
FFIQSIHSLHFILVAP

SEQ ID NO: 34919 - protein, 16 aa, BK virus
FIQSIHSLHFILVAPF

SEQ ID NO: 34920 - protein, 16 aa, BK virus
IQSIHSLHFILVAPFV

SEQ ID NO: 34921 - protein, 16 aa, BK virus
QSIHSLHFILVAPFVR

SEQ ID NO: 34922 - protein, 16 aa, BK virus
SIHSLHFILVAPFVRV

SEQ ID NO: 34923 - protein, 16 aa, BK virus
IHSLHFILVAPFVRVK

SEQ ID NO: 34924 - protein, 16 aa, BK virus
HSLHFILVAPFVRVKF

SEQ ID NO: 34925 - protein, 16 aa, BK virus
SLHFILVAPFVRVKFL

SEQ ID NO: 34926 - protein, 16 aa, BK virus
LHFILVAPFVRVKFLT

SEQ ID NO: 34927 - protein, 15 aa, BK virus
HFILVAPFVRVKFLT

SEQ ID NO: 34928 - protein, 13 aa, BK virus
MDKVLNREESMEL

SEQ ID NO: 34929 - protein, 13 aa, BK virus
DKVLNREESMELM

SEQ ID NO: 34930 - protein, 13 aa, BK virus
KVLNREESMELMD

SEQ ID NO: 34931 - protein, 13 aa, BK virus
VLNREESMELMDL

SEQ ID NO: 34932 - protein, 13 aa, BK virus
LNREESMELMDLL

SEQ ID NO: 34933 - protein, 13 aa, BK virus
NREESMELMDLLG

SEQ ID NO: 34934 - protein, 13 aa, BK virus
REESMELMDLLGL

SEQ ID NO: 34935 - protein, 13 aa, BK virus
EESMELMDLLGLE

SEQ ID NO: 34936 - protein, 13 aa, BK virus
ESMELMDLLGLER

SEQ ID NO: 34937 - protein, 13 aa, BK virus
SMELMDLLGLERA

SEQ ID NO: 34938 - protein, 13 aa, BK virus
MELMDLLGLERAA

SEQ ID NO: 34939 - protein, 13 aa, BK virus
ELMDLLGLERAAW

SEQ ID NO: 34940 - protein, 13 aa, BK virus
LMDLLGLERAAWG

SEQ ID NO: 34941 - protein, 13 aa, BK virus
MDLLGLERAAWGN

SEQ ID NO: 34942 - protein, 13 aa, BK virus
DLLGLERAAWGNL

SEQ ID NO: 34943 - protein, 13 aa, BK virus
LLGLERAAWGNLP

SEQ ID NO: 34944 - protein, 13 aa, BK virus
LGLERAAWGNLPL

SEQ ID NO: 34945 - protein, 13 aa, BK virus
GLERAAWGNLPLM

SEQ ID NO: 34946 - protein, 13 aa, BK virus
LERAAWGNLPLMR

SEQ ID NO: 34947 - protein, 13 aa, BK virus
ERAAWGNLPLMRK

SEQ ID NO: 34948 - protein, 13 aa, BK virus
RAAWGNLPLMRKA

SEQ ID NO: 34949 - protein, 13 aa, BK virus
AAWGNLPLMRKAY

SEQ ID NO: 34950 - protein, 13 aa, BK virus
AWGNLPLMRKAYL

SEQ ID NO: 34951 - protein, 13 aa, BK virus
WGNLPLMRKAYLR

SEQ ID NO: 34952 - protein, 13 aa, BK virus
GNLPLMRKAYLRK

SEQ ID NO: 34953 - protein, 13 aa, BK virus
NLPLMRKAYLRKC

SEQ ID NO: 34954 - protein, 13 aa, BK virus
LPLMRKAYLRKCK

SEQ ID NO: 34955 - protein, 13 aa, BK virus
PLMRKAYLRKCKE

SEQ ID NO: 34956 - protein, 13 aa, BK virus
LMRKAYLRKCKEF

SEQ ID NO: 34957 - protein, 13 aa, BK virus
MRKAYLRKCKEFH

SEQ ID NO: 34958 - protein, 13 aa, BK virus
RKAYLRKCKEFHP

SEQ ID NO: 34959 - protein, 13 aa, BK virus
KAYLRKCKEFHPD

SEQ ID NO: 34960 - protein, 13 aa, BK virus
AYLRKCKEFHPDK

SEQ ID NO: 34961 - protein, 13 aa, BK virus
YLRKCKEFHPDKG

SEQ ID NO: 34962 - protein, 13 aa, BK virus
LRKCKEFHPDKGG

SEQ ID NO: 34963 - protein, 13 aa, BK virus
RKCKEFHPDKGGD

SEQ ID NO: 34964 - protein, 13 aa, BK virus
KCKEFHPDKGGDE

SEQ ID NO: 34965 - protein, 13 aa, BK virus
CKEFHPDKGGDED

SEQ ID NO: 34966 - protein, 13 aa, BK virus
KEFHPDKGGDEDK

SEQ ID NO: 34967 - protein, 13 aa, BK virus
EFHPDKGGDEDKM

SEQ ID NO: 34968 - protein, 13 aa, BK virus
FHPDKGGDEDKMK

SEQ ID NO: 34969 - protein, 13 aa, BK virus
HPDKGGDEDKMKR

SEQ ID NO: 34970 - protein, 13 aa, BK virus
PDKGGDEDKMKRM

SEQ ID NO: 34971 - protein, 13 aa, BK virus
DKGGDEDKMKRMN

SEQ ID NO: 34972 - protein, 13 aa, BK virus
KGGDEDKMKRMNT

SEQ ID NO: 34973 - protein, 13 aa, BK virus
GGDEDKMKRMNTL

SEQ ID NO: 34974 - protein, 13 aa, BK virus
GDEDKMKRMNTLY

SEQ ID NO: 34975 - protein, 13 aa, BK virus
DEDKMKRMNTLYK

SEQ ID NO: 34976 - protein, 13 aa, BK virus
EDKMKRMNTLYKK

SEQ ID NO: 34977 - protein, 13 aa, BK virus
DKMKRMNTLYKKM

SEQ ID NO: 34978 - protein, 13 aa, BK virus
KMKRMNTLYKKME

SEQ ID NO: 34979 - protein, 13 aa, BK virus
MKRMNTLYKKMEQ

SEQ ID NO: 34980 - protein, 13 aa, BK virus
KRMNTLYKKMEQD

SEQ ID NO: 34981 - protein, 13 aa, BK virus
RMNTLYKKMEQDV

SEQ ID NO: 34982 - protein, 13 aa, BK virus
MNTLYKKMEQDVK

SEQ ID NO: 34983 - protein, 13 aa, BK virus
NTLYKKMEQDVKV

SEQ ID NO: 34984 - protein, 13 aa, BK virus
TLYKKMEQDVKVA

SEQ ID NO: 34985 - protein, 13 aa, BK virus
LYKKMEQDVKVAH

SEQ ID NO: 34986 - protein, 13 aa, BK virus
YKKMEQDVKVAHQ

SEQ ID NO: 34987 - protein, 13 aa, BK virus
KKMEQDVKVAHQP

SEQ ID NO: 34988 - protein, 13 aa, BK virus
KMEQDVKVAHQPD

SEQ ID NO: 34989 - protein, 13 aa, BK virus
MEQDVKVAHQPDF

SEQ ID NO: 34990 - protein, 13 aa, BK virus
EQDVKVAHQPDFG

SEQ ID NO: 34991 - protein, 13 aa, BK virus
QDVKVAHQPDFGT

SEQ ID NO: 34992 - protein, 13 aa, BK virus
DVKVAHQPDFGTW

SEQ ID NO: 34993 - protein, 13 aa, BK virus
VKVAHQPDFGTWS

SEQ ID NO: 34994 - protein, 13 aa, BK virus
KVAHQPDFGTWSS

SEQ ID NO: 34995 - protein, 13 aa, BK virus
VAHQPDFGTWSSS

SEQ ID NO: 34996 - protein, 13 aa, BK virus
AHQPDFGTWSSSE

SEQ ID NO: 34997 - protein, 13 aa, BK virus
HQPDFGTWSSSEV

SEQ ID NO: 34998 - protein, 13 aa, BK virus
QPDFGTWSSSEVC

SEQ ID NO: 34999 - protein, 13 aa, BK virus
PDFGTWSSSEVCA

SEQ ID NO: 35000 - protein, 13 aa, BK virus
DFGTWSSSEVCAD

SEQ ID NO: 35001 - protein, 13 aa, BK virus
FGTWSSSEVCADF

SEQ ID NO: 35002 - protein, 13 aa, BK virus
GTWSSSEVCADFP

SEQ ID NO: 35003 - protein, 13 aa, BK virus
TWSSSEVCADFPL

SEQ ID NO: 35004 - protein, 13 aa, BK virus
WSSSEVCADFPLC

SEQ ID NO: 35005 - protein, 13 aa, BK virus
SSSEVCADFPLCP

SEQ ID NO: 35006 - protein, 13 aa, BK virus
SSEVCADFPLCPD

SEQ ID NO: 35007 - protein, 13 aa, BK virus
SEVCADFPLCPDT

SEQ ID NO: 35008 - protein, 13 aa, BK virus
EVCADFPLCPDTL

SEQ ID NO: 35009 - protein, 13 aa, BK virus
VCADFPLCPDTLY

SEQ ID NO: 35010 - protein, 13 aa, BK virus
CADFPLCPDTLYC

SEQ ID NO: 35011 - protein, 13 aa, BK virus
ADFPLCPDTLYCK

SEQ ID NO: 35012 - protein, 13 aa, BK virus
DFPLCPDTLYCKE

SEQ ID NO: 35013 - protein, 13 aa, BK virus
FPLCPDTLYCKEW

SEQ ID NO: 35014 - protein, 13 aa, BK virus
PLCPDTLYCKEWP

SEQ ID NO: 35015 - protein, 13 aa, BK virus
LCPDTLYCKEWPI

SEQ ID NO: 35016 - protein, 13 aa, BK virus
CPDTLYCKEWPIC

SEQ ID NO: 35017 - protein, 13 aa, BK virus
PDTLYCKEWPICS

SEQ ID NO: 35018 - protein, 13 aa, BK virus
DTLYCKEWPICSK

SEQ ID NO: 35019 - protein, 13 aa, BK virus
TLYCKEWPICSKK

SEQ ID NO: 35020 - protein, 13 aa, BK virus
LYCKEWPICSKKP

SEQ ID NO: 35021 - protein, 13 aa, BK virus
YCKEWPICSKKPS

SEQ ID NO: 35022 - protein, 13 aa, BK virus
CKEWPICSKKPSV

SEQ ID NO: 35023 - protein, 13 aa, BK virus
KEWPICSKKPSVH

SEQ ID NO: 35024 - protein, 13 aa, BK virus
EWPICSKKPSVHC

SEQ ID NO: 35025 - protein, 13 aa, BK virus
WPICSKKPSVHCP

SEQ ID NO: 35026 - protein, 13 aa, BK virus
PICSKKPSVHCPC

SEQ ID NO: 35027 - protein, 13 aa, BK virus
ICSKKPSVHCPCM

SEQ ID NO: 35028 - protein, 13 aa, BK virus
CSKKPSVHCPCML

SEQ ID NO: 35029 - protein, 13 aa, BK virus
SKKPSVHCPCMLC

SEQ ID NO: 35030 - protein, 13 aa, BK virus
KKPSVHCPCMLCQ

SEQ ID NO: 35031 - protein, 13 aa, BK virus
KPSVHCPCMLCQL

SEQ ID NO: 35032 - protein, 13 aa, BK virus
PSVHCPCMLCQLR

SEQ ID NO: 35033 - protein, 13 aa, BK virus
SVHCPCMLCQLRL

SEQ ID NO: 35034 - protein, 13 aa, BK virus
VHCPCMLCQLRLR

SEQ ID NO: 35035 - protein, 13 aa, BK virus
HCPCMLCQLRLRH

SEQ ID NO: 35036 - protein, 13 aa, BK virus
CPCMLCQLRLRHL

SEQ ID NO: 35037 - protein, 13 aa, BK virus
PCMLCQLRLRHLN

SEQ ID NO: 35038 - protein, 13 aa, BK virus
CMLCQLRLRHLNR

SEQ ID NO: 35039 - protein, 13 aa, BK virus
MLCQLRLRHLNRK

SEQ ID NO: 35040 - protein, 13 aa, BK virus
LCQLRLRHLNRKF

SEQ ID NO: 35041 - protein, 13 aa, BK virus
CQLRLRHLNRKFL

SEQ ID NO: 35042 - protein, 13 aa, BK virus
QLRLRHLNRKFLR

SEQ ID NO: 35043 - protein, 13 aa, BK virus
LRLRHLNRKFLRK

SEQ ID NO: 35044 - protein, 13 aa, BK virus
RLRHLNRKFLRKE

SEQ ID NO: 35045 - protein, 13 aa, BK virus
LRHLNRKFLRKEP

SEQ ID NO: 35046 - protein, 13 aa, BK virus
RHLNRKFLRKEPL

SEQ ID NO: 35047 - protein, 13 aa, BK virus
HLNRKFLRKEPLV

SEQ ID NO: 35048 - protein, 13 aa, BK virus
LNRKFLRKEPLVW

SEQ ID NO: 35049 - protein, 13 aa, BK virus
NRKFLRKEPLVWI

SEQ ID NO: 35050 - protein, 13 aa, BK virus
RKFLRKEPLVWID

SEQ ID NO: 35051 - protein, 13 aa, BK virus
KFLRKEPLVWIDC

SEQ ID NO: 35052 - protein, 13 aa, BK virus
FLRKEPLVWIDCY

SEQ ID NO: 35053 - protein, 13 aa, BK virus
LRKEPLVWIDCYC

SEQ ID NO: 35054 - protein, 13 aa, BK virus
RKEPLVWIDCYCI

SEQ ID NO: 35055 - protein, 13 aa, BK virus
KEPLVWIDCYCID

SEQ ID NO: 35056 - protein, 13 aa, BK virus
EPLVWIDCYCIDC

SEQ ID NO: 35057 - protein, 13 aa, BK virus
PLVWIDCYCIDCF

SEQ ID NO: 35058 - protein, 13 aa, BK virus
LVWIDCYCIDCFT

SEQ ID NO: 35059 - protein, 13 aa, BK virus
VWIDCYCIDCFTQ

SEQ ID NO: 35060 - protein, 13 aa, BK virus
WIDCYCIDCFTQW

SEQ ID NO: 35061 - protein, 13 aa, BK virus
IDCYCIDCFTQWF

SEQ ID NO: 35062 - protein, 13 aa, BK virus
DCYCIDCFTQWFG

SEQ ID NO: 35063 - protein, 13 aa, BK virus
CYCIDCFTQWFGL

SEQ ID NO: 35064 - protein, 13 aa, BK virus
YCIDCFTQWFGLD

SEQ ID NO: 35065 - protein, 13 aa, BK virus
CIDCFTQWFGLDL

SEQ ID NO: 35066 - protein, 13 aa, BK virus
IDCFTQWFGLDLT

SEQ ID NO: 35067 - protein, 13 aa, BK virus
DCFTQWFGLDLTE

SEQ ID NO: 35068 - protein, 13 aa, BK virus
CFTQWFGLDLTEE

SEQ ID NO: 35069 - protein, 13 aa, BK virus
FTQWFGLDLTEET

SEQ ID NO: 35070 - protein, 13 aa, BK virus
TQWFGLDLTEETL

SEQ ID NO: 35071 - protein, 13 aa, BK virus
QWFGLDLTEETLQ

SEQ ID NO: 35072 - protein, 13 aa, BK virus
WFGLDLTEETLQW

SEQ ID NO: 35073 - protein, 13 aa, BK virus
FGLDLTEETLQWW

SEQ ID NO: 35074 - protein, 13 aa, BK virus
GLDLTEETLQWWV

SEQ ID NO: 35075 - protein, 13 aa, BK virus
LDLTEETLQWWVQ

SEQ ID NO: 35076 - protein, 13 aa, BK virus
DLTEETLQWWVQI

SEQ ID NO: 35077 - protein, 13 aa, BK virus
LTEETLQWWVQII

SEQ ID NO: 35078 - protein, 13 aa, BK virus
TEETLQWWVQIIG

SEQ ID NO: 35079 - protein, 13 aa, BK virus
EETLQWWVQIIGE

SEQ ID NO: 35080 - protein, 13 aa, BK virus
ETLQWWVQIIGET

SEQ ID NO: 35081 - protein, 13 aa, BK virus
TLQWWVQIIGETP

SEQ ID NO: 35082 - protein, 13 aa, BK virus
LQWWVQIIGETPF

SEQ ID NO: 35083 - protein, 13 aa, BK virus
QWWVQIIGETPFR

SEQ ID NO: 35084 - protein, 13 aa, BK virus
WWVQIIGETPFRD

SEQ ID NO: 35085 - protein, 13 aa, BK virus
WVQIIGETPFRDL

SEQ ID NO: 35086 - protein, 13 aa, BK virus
VQIIGETPFRDLK

SEQ ID NO: 35087 - protein, 13 aa, BK virus
QIIGETPFRDLKL

SEQ ID NO: 35088 - protein, 13 aa, BK virus
KALSNYFFYRCQP

SEQ ID NO: 35089 - protein, 13 aa, BK virus
ALSNYFFYRCQPM

SEQ ID NO: 35090 - protein, 13 aa, BK virus
LSNYFFYRCQPME

SEQ ID NO: 35091 - protein, 13 aa, BK virus
SNYFFYRCQPMEQ

SEQ ID NO: 35092 - protein, 13 aa, BK virus
NYFFYRCQPMEQK

SEQ ID NO: 35093 - protein, 13 aa, BK virus
YFFYRCQPMEQKS

SEQ ID NO: 35094 - protein, 13 aa, BK virus
FFYRCQPMEQKSG

SEQ ID NO: 35095 - protein, 13 aa, BK virus
FYRCQPMEQKSGS

SEQ ID NO: 35096 - protein, 13 aa, BK virus
YRCQPMEQKSGSP

SEQ ID NO: 35097 - protein, 13 aa, BK virus
RCQPMEQKSGSPG

SEQ ID NO: 35098 - protein, 13 aa, BK virus
CQPMEQKSGSPGG

SEQ ID NO: 35099 - protein, 13 aa, BK virus
QPMEQKSGSPGGV

SEQ ID NO: 35100 - protein, 13 aa, BK virus
PMEQKSGSPGGVP

SEQ ID NO: 35101 - protein, 13 aa, BK virus
MEQKSGSPGGVPL

SEQ ID NO: 35102 - protein, 13 aa, BK virus
EQKSGSPGGVPLM

SEQ ID NO: 35103 - protein, 13 aa, BK virus
QKSGSPGGVPLMK

SEQ ID NO: 35104 - protein, 13 aa, BK virus
KSGSPGGVPLMKN

SEQ ID NO: 35105 - protein, 13 aa, BK virus
SGSPGGVPLMKNG

SEQ ID NO: 35106 - protein, 13 aa, BK virus
GSPGGVPLMKNGM

SEQ ID NO: 35107 - protein, 13 aa, BK virus
SPGGVPLMKNGMK

SEQ ID NO: 35108 - protein, 13 aa, BK virus
PGGVPLMKNGMKI

SEQ ID NO: 35109 - protein, 13 aa, BK virus
GGVPLMKNGMKIY

SEQ ID NO: 35110 - protein, 13 aa, BK virus
GVPLMKNGMKIYF

SEQ ID NO: 35111 - protein, 13 aa, BK virus
VPLMKNGMKIYFA

SEQ ID NO: 35112 - protein, 13 aa, BK virus
PLMKNGMKIYFAM

SEQ ID NO: 35113 - protein, 13 aa, BK virus
LMKNGMKIYFAMK

SEQ ID NO: 35114 - protein, 13 aa, BK virus
MKNGMKIYFAMKI

SEQ ID NO: 35115 - protein, 13 aa, BK virus
KNGMKIYFAMKIC

SEQ ID NO: 35116 - protein, 13 aa, BK virus
NGMKIYFAMKICL

SEQ ID NO: 35117 - protein, 13 aa, BK virus
GMKIYFAMKICLP

SEQ ID NO: 35118 - protein, 13 aa, BK virus
MKIYFAMKICLPV

SEQ ID NO: 35119 - protein, 13 aa, BK virus
KIYFAMKICLPVM

SEQ ID NO: 35120 - protein, 13 aa, BK virus
IYFAMKICLPVMK

SEQ ID NO: 35121 - protein, 13 aa, BK virus
YFAMKICLPVMKK

SEQ ID NO: 35122 - protein, 13 aa, BK virus
FAMKICLPVMKKQ

SEQ ID NO: 35123 - protein, 13 aa, BK virus
AMKICLPVMKKQQ

SEQ ID NO: 35124 - protein, 13 aa, BK virus
MKICLPVMKKQQQ

SEQ ID NO: 35125 - protein, 13 aa, BK virus
KICLPVMKKQQQI

SEQ ID NO: 35126 - protein, 13 aa, BK virus
ICLPVMKKQQQIL

SEQ ID NO: 35127 - protein, 13 aa, BK virus
CLPVMKKQQQILN

SEQ ID NO: 35128 - protein, 13 aa, BK virus
LPVMKKQQQILNT

SEQ ID NO: 35129 - protein, 13 aa, BK virus
PVMKKQQQILNTQ

SEQ ID NO: 35130 - protein, 13 aa, BK virus
VMKKQQQILNTQH

SEQ ID NO: 35131 - protein, 13 aa, BK virus
MKKQQQILNTQHH

SEQ ID NO: 35132 - protein, 13 aa, BK virus
KKQQQILNTQHHP

SEQ ID NO: 35133 - protein, 13 aa, BK virus
KQQQILNTQHHPK

SEQ ID NO: 35134 - protein, 13 aa, BK virus
QQQILNTQHHPKK

SEQ ID NO: 35135 - protein, 13 aa, BK virus
QQILNTQHHPKKK

SEQ ID NO: 35136 - protein, 13 aa, BK virus
QILNTQHHPKKKE

SEQ ID NO: 35137 - protein, 13 aa, BK virus
ILNTQHHPKKKER

SEQ ID NO: 35138 - protein, 13 aa, BK virus
KTLKTFPLIYTSF

SEQ ID NO: 35139 - protein, 13 aa, BK virus
TLKTFPLIYTSFL

SEQ ID NO: 35140 - protein, 13 aa, BK virus
LKTFPLIYTSFLV

SEQ ID NO: 35141 - protein, 13 aa, BK virus
KTFPLIYTSFLVK

SEQ ID NO: 35142 - protein, 13 aa, BK virus
TFPLIYTSFLVKL

SEQ ID NO: 35143 - protein, 13 aa, BK virus
FPLIYTSFLVKLY

SEQ ID NO: 35144 - protein, 13 aa, BK virus
PLIYTSFLVKLYL

SEQ ID NO: 35145 - protein, 13 aa, BK virus
LIYTSFLVKLYLV

SEQ ID NO: 35146 - protein, 13 aa, BK virus
IYTSFLVKLYLVI

SEQ ID NO: 35147 - protein, 13 aa, BK virus
YTSFLVKLYLVIE

SEQ ID NO: 35148 - protein, 13 aa, BK virus
TSFLVKLYLVIEP

SEQ ID NO: 35149 - protein, 13 aa, BK virus
SFLVKLYLVIEPL

SEQ ID NO: 35150 - protein, 13 aa, BK virus
FLVKLYLVIEPLP

SEQ ID NO: 35151 - protein, 13 aa, BK virus
LVKLYLVIEPLPA

SEQ ID NO: 35152 - protein, 13 aa, BK virus
VKLYLVIEPLPAL

SEQ ID NO: 35153 - protein, 13 aa, BK virus
KLYLVIEPLPALL

SEQ ID NO: 35154 - protein, 13 aa, BK virus
LYLVIEPLPALLC

SEQ ID NO: 35155 - protein, 13 aa, BK virus
YLVIEPLPALLCI

SEQ ID NO: 35156 - protein, 13 aa, BK virus
LVIEPLPALLCIL

SEQ ID NO: 35157 - protein, 13 aa, BK virus
VIEPLPALLCILL

SEQ ID NO: 35158 - protein, 13 aa, BK virus
IEPLPALLCILLK

SEQ ID NO: 35159 - protein, 13 aa, BK virus
EPLPALLCILLKK

SEQ ID NO: 35160 - protein, 13 aa, BK virus
PLPALLCILLKKK

SEQ ID NO: 35161 - protein, 13 aa, BK virus
LPALLCILLKKKL

SEQ ID NO: 35162 - protein, 13 aa, BK virus
PALLCILLKKKLK

SEQ ID NO: 35163 - protein, 13 aa, BK virus
ALLCILLKKKLKF

SEQ ID NO: 35164 - protein, 13 aa, BK virus
LLCILLKKKLKFC

SEQ ID NO: 35165 - protein, 13 aa, BK virus
LCILLKKKLKFCI

SEQ ID NO: 35166 - protein, 13 aa, BK virus
CILLKKKLKFCIK

SEQ ID NO: 35167 - protein, 13 aa, BK virus
ILLKKKLKFCIKN

SEQ ID NO: 35168 - protein, 13 aa, BK virus
LLKKKLKFCIKNL

SEQ ID NO: 35169 - protein, 13 aa, BK virus
LKKKLKFCIKNLW

SEQ ID NO: 35170 - protein, 13 aa, BK virus
KKKLKFCIKNLWK

SEQ ID NO: 35171 - protein, 13 aa, BK virus
KKLKFCIKNLWKN

SEQ ID NO: 35172 - protein, 13 aa, BK virus
KLKFCIKNLWKNI

SEQ ID NO: 35173 - protein, 13 aa, BK virus
LKFCIKNLWKNIL

SEQ ID NO: 35174 - protein, 13 aa, BK virus
LLLVDTCVLGIIL

SEQ ID NO: 35175 - protein, 13 aa, BK virus
LLVDTCVLGIILY

SEQ ID NO: 35176 - protein, 13 aa, BK virus
LVDTCVLGIILYS

SEQ ID NO: 35177 - protein, 13 aa, BK virus
VDTCVLGIILYSF

SEQ ID NO: 35178 - protein, 13 aa, BK virus
LHIDIEFLQLIIS

SEQ ID NO: 35179 - protein, 13 aa, BK virus
HIDIEFLQLIISV

SEQ ID NO: 35180 - protein, 13 aa, BK virus
IDIEFLQLIISVK

SEQ ID NO: 35181 - protein, 13 aa, BK virus
DIEFLQLIISVKS

SEQ ID NO: 35182 - protein, 13 aa, BK virus
IEFLQLIISVKSC

SEQ ID NO: 35183 - protein, 13 aa, BK virus
EFLQLIISVKSCV

SEQ ID NO: 35184 - protein, 13 aa, BK virus
FLQLIISVKSCVP

SEQ ID NO: 35185 - protein, 13 aa, BK virus
LQLIISVKSCVPL

SEQ ID NO: 35186 - protein, 13 aa, BK virus
QLIISVKSCVPLV

SEQ ID NO: 35187 - protein, 13 aa, BK virus
LIISVKSCVPLVF

SEQ ID NO: 35188 - protein, 13 aa, BK virus
FVRVLIRNTYYIV

SEQ ID NO: 35189 - protein, 13 aa, BK virus
VRVLIRNTYYIVP

SEQ ID NO: 35190 - protein, 13 aa, BK virus
RSMILAQKSLKKQ

SEQ ID NO: 35191 - protein, 13 aa, BK virus
SMILAQKSLKKQS

SEQ ID NO: 35192 - protein, 13 aa, BK virus
MILAQKSLKKQSR

SEQ ID NO: 35193 - protein, 13 aa, BK virus
ILAQKSLKKQSRC

SEQ ID NO: 35194 - protein, 13 aa, BK virus
LAQKSLKKQSRCL

SEQ ID NO: 35195 - protein, 13 aa, BK virus
AQKSLKKQSRCLG

SEQ ID NO: 35196 - protein, 13 aa, BK virus
QKSLKKQSRCLGN

SEQ ID NO: 35197 - protein, 13 aa, BK virus
RSVKSVRKKTSLI

SEQ ID NO: 35198 - protein, 13 aa, BK virus
SVKSVRKKTSLIT

SEQ ID NO: 35199 - protein, 13 aa, BK virus
VKSVRKKTSLITL

SEQ ID NO: 35200 - protein, 13 aa, BK virus
KSVRKKTSLITLS

SEQ ID NO: 35201 - protein, 13 aa, BK virus
SVRKKTSLITLSI

SEQ ID NO: 35202 - protein, 13 aa, BK virus
VRKKTSLITLSIM

SEQ ID NO: 35203 - protein, 13 aa, BK virus
RKKTSLITLSIMK

SEQ ID NO: 35204 - protein, 13 aa, BK virus
KKTSLITLSIMKS

SEQ ID NO: 35205 - protein, 13 aa, BK virus
KTSLITLSIMKST

SEQ ID NO: 35206 - protein, 13 aa, BK virus
TSLITLSIMKSTL

SEQ ID NO: 35207 - protein, 13 aa, BK virus
SLITLSIMKSTLQ

SEQ ID NO: 35208 - protein, 13 aa, BK virus
LITLSIMKSTLQM

SEQ ID NO: 35209 - protein, 13 aa, BK virus
ITLSIMKSTLQML

SEQ ID NO: 35210 - protein, 13 aa, BK virus
TLSIMKSTLQMLL

SEQ ID NO: 35211 - protein, 13 aa, BK virus
LSIMKSTLQMLLF

SEQ ID NO: 35212 - protein, 13 aa, BK virus
SIMKSTLQMLLFL

SEQ ID NO: 35213 - protein, 13 aa, BK virus
IMKSTLQMLLFLQ

SEQ ID NO: 35214 - protein, 13 aa, BK virus
MKSTLQMLLFLQK

SEQ ID NO: 35215 - protein, 13 aa, BK virus
KSTLQMLLFLQKV

SEQ ID NO: 35216 - protein, 13 aa, BK virus
STLQMLLFLQKVK

SEQ ID NO: 35217 - protein, 13 aa, BK virus
TLQMLLFLQKVKI

SEQ ID NO: 35218 - protein, 13 aa, BK virus
LQMLLFLQKVKIK

SEQ ID NO: 35219 - protein, 13 aa, BK virus
QMLLFLQKVKIKK

SEQ ID NO: 35220 - protein, 13 aa, BK virus
MLLFLQKVKIKKV

SEQ ID NO: 35221 - protein, 13 aa, BK virus
LLFLQKVKIKKVF

SEQ ID NO: 35222 - protein, 13 aa, BK virus
LFLQKVKIKKVFV

SEQ ID NO: 35223 - protein, 13 aa, BK virus
FLQKVKIKKVFVS

SEQ ID NO: 35224 - protein, 13 aa, BK virus
LQKVKIKKVFVSK

SEQ ID NO: 35225 - protein, 13 aa, BK virus
QKVKIKKVFVSKQ

SEQ ID NO: 35226 - protein, 13 aa, BK virus
NNIWQVLLGCTVC

SEQ ID NO: 35227 - protein, 13 aa, BK virus
NIWQVLLGCTVCY

SEQ ID NO: 35228 - protein, 13 aa, BK virus
IWQVLLGCTVCYL

SEQ ID NO: 35229 - protein, 13 aa, BK virus
WQVLLGCTVCYLK

SEQ ID NO: 35230 - protein, 13 aa, BK virus
QVLLGCTVCYLKW

SEQ ID NO: 35231 - protein, 13 aa, BK virus
VLLGCTVCYLKWI

SEQ ID NO: 35232 - protein, 13 aa, BK virus
LLGCTVCYLKWIL

SEQ ID NO: 35233 - protein, 13 aa, BK virus
YLIFCTVLFSMYL

SEQ ID NO: 35234 - protein, 13 aa, BK virus
LIFCTVLFSMYLK

SEQ ID NO: 35235 - protein, 13 aa, BK virus
IFCTVLFSMYLKE

SEQ ID NO: 35236 - protein, 13 aa, BK virus
FCTVLFSMYLKED

SEQ ID NO: 35237 - protein, 13 aa, BK virus
CTVLFSMYLKEDT

SEQ ID NO: 35238 - protein, 13 aa, BK virus
TVLFSMYLKEDTG

SEQ ID NO: 35239 - protein, 13 aa, BK virus
VLFSMYLKEDTGY

SEQ ID NO: 35240 - protein, 13 aa, BK virus
LFSMYLKEDTGYL

SEQ ID NO: 35241 - protein, 13 aa, BK virus
FSMYLKEDTGYLK

SEQ ID NO: 35242 - protein, 13 aa, BK virus
SMYLKEDTGYLKV

SEQ ID NO: 35243 - protein, 13 aa, BK virus
MYLKEDTGYLKVP

SEQ ID NO: 35244 - protein, 13 aa, BK virus
YLKEDTGYLKVPL

SEQ ID NO: 35245 - protein, 13 aa, BK virus
LKEDTGYLKVPLI

SEQ ID NO: 35246 - protein, 13 aa, BK virus
KEDTGYLKVPLIV

SEQ ID NO: 35247 - protein, 13 aa, BK virus
EDTGYLKVPLIVE

SEQ ID NO: 35248 - protein, 13 aa, BK virus
DTGYLKVPLIVEK

SEQ ID NO: 35249 - protein, 13 aa, BK virus
TGYLKVPLIVEKQ

SEQ ID NO: 35250 - protein, 13 aa, BK virus
GYLKVPLIVEKQH

SEQ ID NO: 35251 - protein, 13 aa, BK virus
KGQELNQRICLQD

SEQ ID NO: 35252 - protein, 13 aa, BK virus
GQELNQRICLQDM

SEQ ID NO: 35253 - protein, 13 aa, BK virus
QELNQRICLQDME

SEQ ID NO: 35254 - protein, 13 aa, BK virus
TKEPKYFHQAWLQ

SEQ ID NO: 35255 - protein, 13 aa, BK virus
MSILSLKPCKLDL

SEQ ID NO: 35256 - protein, 13 aa, BK virus
ENPYKTQSSYLKK

SEQ ID NO: 35257 - protein, 13 aa, BK virus
NPYKTQSSYLKKE

SEQ ID NO: 35258 - protein, 13 aa, BK virus
PYKTQSSYLKKEF

SEQ ID NO: 35259 - protein, 13 aa, BK virus
YKTQSSYLKKEFY

SEQ ID NO: 35260 - protein, 13 aa, BK virus
KTQSSYLKKEFYK

SEQ ID NO: 35261 - protein, 13 aa, BK virus
TQSSYLKKEFYKV

SEQ ID NO: 35262 - protein, 13 aa, BK virus
QSSYLKKEFYKVE

SEQ ID NO: 35263 - protein, 13 aa, BK virus
LILQLIYNLELLN

SEQ ID NO: 35264 - protein, 13 aa, BK virus
ILQLIYNLELLNG

SEQ ID NO: 35265 - protein, 13 aa, BK virus
LQLIYNLELLNGR

SEQ ID NO: 35266 - protein, 13 aa, BK virus
QLIYNLELLNGRK

SEQ ID NO: 35267 - protein, 13 aa, BK virus
LIYNLELLNGRKG

SEQ ID NO: 35268 - protein, 13 aa, BK virus
IYNLELLNGRKGW

SEQ ID NO: 35269 - protein, 13 aa, BK virus
YNLELLNGRKGWI

SEQ ID NO: 35270 - protein, 13 aa, BK virus
NLELLNGRKGWIL

SEQ ID NO: 35271 - protein, 13 aa, BK virus
LELLNGRKGWILR

SEQ ID NO: 35272 - protein, 13 aa, BK virus
NIIYAWGNVFLIL

SEQ ID NO: 35273 - protein, 13 aa, BK virus
IIYAWGNVFLILQ

SEQ ID NO: 35274 - protein, 13 aa, BK virus
IYAWGNVFLILQE

SEQ ID NO: 35275 - protein, 13 aa, BK virus
YAWGNVFLILQEK

SEQ ID NO: 35276 - protein, 13 aa, BK virus
AWGNVFLILQEKR

SEQ ID NO: 35277 - protein, 13 aa, BK virus
WGNVFLILQEKRI

SEQ ID NO: 35278 - protein, 13 aa, BK virus
GNVFLILQEKRIQ

SEQ ID NO: 35279 - protein, 13 aa, BK virus
NVFLILQEKRIQK

SEQ ID NO: 35280 - protein, 13 aa, BK virus
VFLILQEKRIQKL

SEQ ID NO: 35281 - protein, 13 aa, BK virus
FLILQEKRIQKLK

SEQ ID NO: 35282 - protein, 13 aa, BK virus
LILQEKRIQKLKT

SEQ ID NO: 35283 - protein, 13 aa, BK virus
ILQEKRIQKLKTL

SEQ ID NO: 35284 - protein, 13 aa, BK virus
LQEKRIQKLKTLD

SEQ ID NO: 35285 - protein, 13 aa, BK virus
QEKRIQKLKTLDM

SEQ ID NO: 35286 - protein, 13 aa, BK virus
EKRIQKLKTLDMD

SEQ ID NO: 35287 - protein, 13 aa, BK virus
KRIQKLKTLDMDQ

SEQ ID NO: 35288 - protein, 13 aa, BK virus
RIQKLKTLDMDQA

SEQ ID NO: 35289 - protein, 13 aa, BK virus
IQKLKTLDMDQAL

SEQ ID NO: 35290 - protein, 13 aa, BK virus
QKLKTLDMDQALN

SEQ ID NO: 35291 - protein, 13 aa, BK virus
KLKTLDMDQALNP

SEQ ID NO: 35292 - protein, 13 aa, BK virus
LKTLDMDQALNPN

SEQ ID NO: 35293 - protein, 13 aa, BK virus
KTLDMDQALNPNH

SEQ ID NO: 35294 - protein, 13 aa, BK virus
TLDMDQALNPNHN

SEQ ID NO: 35295 - protein, 13 aa, BK virus
LDMDQALNPNHNA

SEQ ID NO: 35296 - protein, 13 aa, BK virus
DMDQALNPNHNAL

SEQ ID NO: 35297 - protein, 13 aa, BK virus
MDQALNPNHNALP

SEQ ID NO: 35298 - protein, 13 aa, BK virus
DQALNPNHNALPK

SEQ ID NO: 35299 - protein, 13 aa, BK virus
QALNPNHNALPKS

SEQ ID NO: 35300 - protein, 13 aa, BK virus
ALNPNHNALPKSQ

SEQ ID NO: 35301 - protein, 13 aa, BK virus
LNPNHNALPKSQI

SEQ ID NO: 35302 - protein, 13 aa, BK virus
NPNHNALPKSQIL

SEQ ID NO: 35303 - protein, 13 aa, BK virus
PNHNALPKSQILQ

SEQ ID NO: 35304 - protein, 13 aa, BK virus
NHNALPKSQILQP

SEQ ID NO: 35305 - protein, 13 aa, BK virus
HNALPKSQILQPL

SEQ ID NO: 35306 - protein, 13 aa, BK virus
NALPKSQILQPLL

SEQ ID NO: 35307 - protein, 13 aa, BK virus
ALPKSQILQPLLK

SEQ ID NO: 35308 - protein, 13 aa, BK virus
LPKSQILQPLLKI

SEQ ID NO: 35309 - protein, 13 aa, BK virus
PKSQILQPLLKIP

SEQ ID NO: 35310 - protein, 13 aa, BK virus
KSQILQPLLKIPK

SEQ ID NO: 35311 - protein, 13 aa, BK virus
SQILQPLLKIPKG

SEQ ID NO: 35312 - protein, 13 aa, BK virus
QILQPLLKIPKGQ

SEQ ID NO: 35313 - protein, 13 aa, BK virus
ILQPLLKIPKGQT

SEQ ID NO: 35314 - protein, 13 aa, BK virus
LQPLLKIPKGQTP

SEQ ID NO: 35315 - protein, 13 aa, BK virus
QPLLKIPKGQTPI

SEQ ID NO: 35316 - protein, 13 aa, BK virus
PLLKIPKGQTPIV

SEQ ID NO: 35317 - protein, 13 aa, BK virus
LLKIPKGQTPIVK

SEQ ID NO: 35318 - protein, 13 aa, BK virus
LKIPKGQTPIVKS

SEQ ID NO: 35319 - protein, 13 aa, BK virus
KIPKGQTPIVKSC

SEQ ID NO: 35320 - protein, 13 aa, BK virus
IPKGQTPIVKSCI

SEQ ID NO: 35321 - protein, 13 aa, BK virus
PKGQTPIVKSCIC

SEQ ID NO: 35322 - protein, 13 aa, BK virus
KGQTPIVKSCICV

SEQ ID NO: 35323 - protein, 13 aa, BK virus
GQTPIVKSCICVK

SEQ ID NO: 35324 - protein, 13 aa, BK virus
QTPIVKSCICVKA

SEQ ID NO: 35325 - protein, 13 aa, BK virus
TPIVKSCICVKAF

SEQ ID NO: 35326 - protein, 13 aa, BK virus
PIVKSCICVKAFS

SEQ ID NO: 35327 - protein, 13 aa, BK virus
IVKSCICVKAFSV

SEQ ID NO: 35328 - protein, 13 aa, BK virus
VKSCICVKAFSVL

SEQ ID NO: 35329 - protein, 13 aa, BK virus
KSCICVKAFSVLK

SEQ ID NO: 35330 - protein, 13 aa, BK virus
SCICVKAFSVLKG

SEQ ID NO: 35331 - protein, 13 aa, BK virus
CICVKAFSVLKGL

SEQ ID NO: 35332 - protein, 13 aa, BK virus
ICVKAFSVLKGLK

SEQ ID NO: 35333 - protein, 13 aa, BK virus
CVKAFSVLKGLKH

SEQ ID NO: 35334 - protein, 13 aa, BK virus
VKAFSVLKGLKHH

SEQ ID NO: 35335 - protein, 13 aa, BK virus
KAFSVLKGLKHHP

SEQ ID NO: 35336 - protein, 13 aa, BK virus
AFSVLKGLKHHPQ

SEQ ID NO: 35337 - protein, 13 aa, BK virus
FSVLKGLKHHPQN

SEQ ID NO: 35338 - protein, 13 aa, BK virus
SVLKGLKHHPQNN

SEQ ID NO: 35339 - protein, 13 aa, BK virus
VLKGLKHHPQNNT

SEQ ID NO: 35340 - protein, 13 aa, BK virus
LKGLKHHPQNNTS

SEQ ID NO: 35341 - protein, 13 aa, BK virus
KGLKHHPQNNTSL

SEQ ID NO: 35342 - protein, 13 aa, BK virus
GLKHHPQNNTSLK

SEQ ID NO: 35343 - protein, 13 aa, BK virus
LKHHPQNNTSLKV

SEQ ID NO: 35344 - protein, 13 aa, BK virus
KHHPQNNTSLKVA

SEQ ID NO: 35345 - protein, 13 aa, BK virus
HHPQNNTSLKVAY

SEQ ID NO: 35346 - protein, 13 aa, BK virus
HPQNNTSLKVAYT

SEQ ID NO: 35347 - protein, 13 aa, BK virus
PQNNTSLKVAYTK

SEQ ID NO: 35348 - protein, 13 aa, BK virus
QNNTSLKVAYTKA

SEQ ID NO: 35349 - protein, 13 aa, BK virus
NNTSLKVAYTKAA

SEQ ID NO: 35350 - protein, 13 aa, BK virus
NTSLKVAYTKAAF

SEQ ID NO: 35351 - protein, 13 aa, BK virus
TSLKVAYTKAAFI

SEQ ID NO: 35352 - protein, 13 aa, BK virus
SLKVAYTKAAFIK

SEQ ID NO: 35353 - protein, 13 aa, BK virus
LKVAYTKAAFIKC

SEQ ID NO: 35354 - protein, 13 aa, BK virus
KVAYTKAAFIKCI

SEQ ID NO: 35355 - protein, 13 aa, BK virus
VAYTKAAFIKCIC

SEQ ID NO: 35356 - protein, 13 aa, BK virus
AYTKAAFIKCICT

SEQ ID NO: 35357 - protein, 13 aa, BK virus
YTKAAFIKCICTI

SEQ ID NO: 35358 - protein, 13 aa, BK virus
TKAAFIKCICTIK

SEQ ID NO: 35359 - protein, 13 aa, BK virus
KAAFIKCICTIKA

SEQ ID NO: 35360 - protein, 13 aa, BK virus
AAFIKCICTIKAP

SEQ ID NO: 35361 - protein, 13 aa, BK virus
AFIKCICTIKAPV

SEQ ID NO: 35362 - protein, 13 aa, BK virus
SILVCNCPCLSIY

SEQ ID NO: 35363 - protein, 13 aa, BK virus
ILVCNCPCLSIYL

SEQ ID NO: 35364 - protein, 13 aa, BK virus
LVCNCPCLSIYLI

SEQ ID NO: 35365 - protein, 13 aa, BK virus
VCNCPCLSIYLII

SEQ ID NO: 35366 - protein, 13 aa, BK virus
CNCPCLSIYLIIS

SEQ ID NO: 35367 - protein, 13 aa, BK virus
NCPCLSIYLIISG

SEQ ID NO: 35368 - protein, 13 aa, BK virus
CPCLSIYLIISGS

SEQ ID NO: 35369 - protein, 13 aa, BK virus
PCLSIYLIISGSP

SEQ ID NO: 35370 - protein, 13 aa, BK virus
CLSIYLIISGSPG

SEQ ID NO: 35371 - protein, 13 aa, BK virus
LSIYLIISGSPGS

SEQ ID NO: 35372 - protein, 13 aa, BK virus
SIYLIISGSPGSL

SEQ ID NO: 35373 - protein, 13 aa, BK virus
IYLIISGSPGSLS

SEQ ID NO: 35374 - protein, 13 aa, BK virus
YLIISGSPGSLSV

SEQ ID NO: 35375 - protein, 13 aa, BK virus
LIISGSPGSLSVP

SEQ ID NO: 35376 - protein, 13 aa, BK virus
IISGSPGSLSVPS

SEQ ID NO: 35377 - protein, 13 aa, BK virus
ISGSPGSLSVPSN

SEQ ID NO: 35378 - protein, 13 aa, BK virus
SGSPGSLSVPSNT

SEQ ID NO: 35379 - protein, 13 aa, BK virus
GSPGSLSVPSNTL

SEQ ID NO: 35380 - protein, 13 aa, BK virus
SPGSLSVPSNTLT

SEQ ID NO: 35381 - protein, 13 aa, BK virus
PGSLSVPSNTLTS

SEQ ID NO: 35382 - protein, 13 aa, BK virus
GSLSVPSNTLTSS

SEQ ID NO: 35383 - protein, 13 aa, BK virus
SLSVPSNTLTSST

SEQ ID NO: 35384 - protein, 13 aa, BK virus
LSVPSNTLTSSTW

SEQ ID NO: 35385 - protein, 13 aa, BK virus
SVPSNTLTSSTWD

SEQ ID NO: 35386 - protein, 13 aa, BK virus
VPSNTLTSSTWDS

SEQ ID NO: 35387 - protein, 13 aa, BK virus
PSNTLTSSTWDSI

SEQ ID NO: 35388 - protein, 13 aa, BK virus
SNTLTSSTWDSIP

SEQ ID NO: 35389 - protein, 13 aa, BK virus
NTLTSSTWDSIPY

SEQ ID NO: 35390 - protein, 13 aa, BK virus
TLTSSTWDSIPYI

SEQ ID NO: 35391 - protein, 13 aa, BK virus
LTSSTWDSIPYIG

SEQ ID NO: 35392 - protein, 13 aa, BK virus
TSSTWDSIPYIGC

SEQ ID NO: 35393 - protein, 13 aa, BK virus
SSTWDSIPYIGCP

SEQ ID NO: 35394 - protein, 13 aa, BK virus
STWDSIPYIGCPS

SEQ ID NO: 35395 - protein, 13 aa, BK virus
TWDSIPYIGCPST

SEQ ID NO: 35396 - protein, 13 aa, BK virus
WDSIPYIGCPSTL

SEQ ID NO: 35397 - protein, 13 aa, BK virus
DSIPYIGCPSTLW

SEQ ID NO: 35398 - protein, 13 aa, BK virus
SIPYIGCPSTLWV

SEQ ID NO: 35399 - protein, 13 aa, BK virus
IPYIGCPSTLWVL

SEQ ID NO: 35400 - protein, 13 aa, BK virus
PYIGCPSTLWVLL

SEQ ID NO: 35401 - protein, 13 aa, BK virus
YIGCPSTLWVLLF

SEQ ID NO: 35402 - protein, 13 aa, BK virus
IGCPSTLWVLLFI

SEQ ID NO: 35403 - protein, 13 aa, BK virus
GCPSTLWVLLFIR

SEQ ID NO: 35404 - protein, 13 aa, BK virus
CPSTLWVLLFIRS

SEQ ID NO: 35405 - protein, 13 aa, BK virus
PSTLWVLLFIRSL

SEQ ID NO: 35406 - protein, 13 aa, BK virus
STLWVLLFIRSLS

SEQ ID NO: 35407 - protein, 13 aa, BK virus
TLWVLLFIRSLSK

SEQ ID NO: 35408 - protein, 13 aa, BK virus
LWVLLFIRSLSKK

SEQ ID NO: 35409 - protein, 13 aa, BK virus
WVLLFIRSLSKKE

SEQ ID NO: 35410 - protein, 13 aa, BK virus
VLLFIRSLSKKEI

SEQ ID NO: 35411 - protein, 13 aa, BK virus
LLFIRSLSKKEIG

SEQ ID NO: 35412 - protein, 13 aa, BK virus
GFFTDLFLRRILK

SEQ ID NO: 35413 - protein, 13 aa, BK virus
FFTDLFLRRILKY

SEQ ID NO: 35414 - protein, 13 aa, BK virus
FTDLFLRRILKYL

SEQ ID NO: 35415 - protein, 13 aa, BK virus
TDLFLRRILKYLA

SEQ ID NO: 35416 - protein, 13 aa, BK virus
DLFLRRILKYLAR

SEQ ID NO: 35417 - protein, 13 aa, BK virus
LFLRRILKYLARP

SEQ ID NO: 35418 - protein, 13 aa, BK virus
FLRRILKYLARPL

SEQ ID NO: 35419 - protein, 13 aa, BK virus
LRRILKYLARPLH

SEQ ID NO: 35420 - protein, 13 aa, BK virus
RRILKYLARPLHC

SEQ ID NO: 35421 - protein, 13 aa, BK virus
RILKYLARPLHCC

SEQ ID NO: 35422 - protein, 13 aa, BK virus
ILKYLARPLHCCV

SEQ ID NO: 35423 - protein, 13 aa, BK virus
LKYLARPLHCCVP

SEQ ID NO: 35424 - protein, 13 aa, BK virus
KYLARPLHCCVPE

SEQ ID NO: 35425 - protein, 13 aa, BK virus
YLARPLHCCVPEL

SEQ ID NO: 35426 - protein, 13 aa, BK virus
LARPLHCCVPELL

SEQ ID NO: 35427 - protein, 13 aa, BK virus
ARPLHCCVPELLV

SEQ ID NO: 35428 - protein, 13 aa, BK virus
RPLHCCVPELLVN

SEQ ID NO: 35429 - protein, 13 aa, BK virus
PLHCCVPELLVNR

SEQ ID NO: 35430 - protein, 13 aa, BK virus
LHCCVPELLVNRP

SEQ ID NO: 35431 - protein, 13 aa, BK virus
HCCVPELLVNRPQ

SEQ ID NO: 35432 - protein, 13 aa, BK virus
CCVPELLVNRPQI

SEQ ID NO: 35433 - protein, 13 aa, BK virus
CVPELLVNRPQIS

SEQ ID NO: 35434 - protein, 13 aa, BK virus
VPELLVNRPQISA

SEQ ID NO: 35435 - protein, 13 aa, BK virus
PELLVNRPQISAA

SEQ ID NO: 35436 - protein, 13 aa, BK virus
ELLVNRPQISAAE

SEQ ID NO: 35437 - protein, 13 aa, BK virus
LLVNRPQISAAET

SEQ ID NO: 35438 - protein, 13 aa, BK virus
LVNRPQISAAETY

SEQ ID NO: 35439 - protein, 13 aa, BK virus
VNRPQISAAETYR

SEQ ID NO: 35440 - protein, 13 aa, BK virus
NRPQISAAETYRL

SEQ ID NO: 35441 - protein, 13 aa, BK virus
RPQISAAETYRLS

SEQ ID NO: 35442 - protein, 13 aa, BK virus
PQISAAETYRLSA

SEQ ID NO: 35443 - protein, 13 aa, BK virus
QISAAETYRLSAL

SEQ ID NO: 35444 - protein, 13 aa, BK virus
ISAAETYRLSALQ

SEQ ID NO: 35445 - protein, 13 aa, BK virus
SAAETYRLSALQR

SEQ ID NO: 35446 - protein, 13 aa, BK virus
AAETYRLSALQRG

SEQ ID NO: 35447 - protein, 13 aa, BK virus
AETYRLSALQRGP

SEQ ID NO: 35448 - protein, 13 aa, BK virus
ETYRLSALQRGPT

SEQ ID NO: 35449 - protein, 13 aa, BK virus
TYRLSALQRGPTP

SEQ ID NO: 35450 - protein, 13 aa, BK virus
YRLSALQRGPTPC

SEQ ID NO: 35451 - protein, 13 aa, BK virus
RLSALQRGPTPCS

SEQ ID NO: 35452 - protein, 13 aa, BK virus
LSALQRGPTPCSS

SEQ ID NO: 35453 - protein, 13 aa, BK virus
SALQRGPTPCSSS

SEQ ID NO: 35454 - protein, 13 aa, BK virus
ALQRGPTPCSSSN

SEQ ID NO: 35455 - protein, 13 aa, BK virus
LQRGPTPCSSSNT

SEQ ID NO: 35456 - protein, 13 aa, BK virus
QRGPTPCSSSNTV

SEQ ID NO: 35457 - protein, 13 aa, BK virus
RGPTPCSSSNTVV

SEQ ID NO: 35458 - protein, 13 aa, BK virus
GPTPCSSSNTVVA

SEQ ID NO: 35459 - protein, 13 aa, BK virus
PTPCSSSNTVVAV

SEQ ID NO: 35460 - protein, 13 aa, BK virus
TPCSSSNTVVAVL

SEQ ID NO: 35461 - protein, 13 aa, BK virus
PCSSSNTVVAVLV

SEQ ID NO: 35462 - protein, 13 aa, BK virus
CSSSNTVVAVLVT

SEQ ID NO: 35463 - protein, 13 aa, BK virus
STGGTFSPPVKVP

SEQ ID NO: 35464 - protein, 13 aa, BK virus
TGGTFSPPVKVPK

SEQ ID NO: 35465 - protein, 13 aa, BK virus
GGTFSPPVKVPKY

SEQ ID NO: 35466 - protein, 13 aa, BK virus
GTFSPPVKVPKYL

SEQ ID NO: 35467 - protein, 13 aa, BK virus
TFSPPVKVPKYLA

SEQ ID NO: 35468 - protein, 13 aa, BK virus
FSPPVKVPKYLAF

SEQ ID NO: 35469 - protein, 13 aa, BK virus
SPPVKVPKYLAFS

SEQ ID NO: 35470 - protein, 13 aa, BK virus
PPVKVPKYLAFSF

SEQ ID NO: 35471 - protein, 13 aa, BK virus
PVKVPKYLAFSFL

SEQ ID NO: 35472 - protein, 13 aa, BK virus
VKVPKYLAFSFLL

SEQ ID NO: 35473 - protein, 13 aa, BK virus
KVPKYLAFSFLLG

SEQ ID NO: 35474 - protein, 13 aa, BK virus
VPKYLAFSFLLGS

SEQ ID NO: 35475 - protein, 13 aa, BK virus
PKYLAFSFLLGSG

SEQ ID NO: 35476 - protein, 13 aa, BK virus
KYLAFSFLLGSGT

SEQ ID NO: 35477 - protein, 13 aa, BK virus
YLAFSFLLGSGTQ

SEQ ID NO: 35478 - protein, 13 aa, BK virus
LAFSFLLGSGTQH

SEQ ID NO: 35479 - protein, 13 aa, BK virus
AFSFLLGSGTQHS

SEQ ID NO: 35480 - protein, 13 aa, BK virus
FSFLLGSGTQHST

SEQ ID NO: 35481 - protein, 13 aa, BK virus
SFLLGSGTQHSTG

SEQ ID NO: 35482 - protein, 13 aa, BK virus
ALWSVFITWDWAV

SEQ ID NO: 35483 - protein, 13 aa, BK virus
LWSVFITWDWAVG

SEQ ID NO: 35484 - protein, 13 aa, BK virus
WSVFITWDWAVGF

SEQ ID NO: 35485 - protein, 13 aa, BK virus
SVFITWDWAVGFL

SEQ ID NO: 35486 - protein, 13 aa, BK virus
VFITWDWAVGFLG

SEQ ID NO: 35487 - protein, 13 aa, BK virus
FITWDWAVGFLGV

SEQ ID NO: 35488 - protein, 13 aa, BK virus
ITWDWAVGFLGVI

SEQ ID NO: 35489 - protein, 13 aa, BK virus
TWDWAVGFLGVIV

SEQ ID NO: 35490 - protein, 13 aa, BK virus
WDWAVGFLGVIVP

SEQ ID NO: 35491 - protein, 13 aa, BK virus
DWAVGFLGVIVPS

SEQ ID NO: 35492 - protein, 13 aa, BK virus
WAVGFLGVIVPSG

SEQ ID NO: 35493 - protein, 13 aa, BK virus
AVGFLGVIVPSGY

SEQ ID NO: 35494 - protein, 13 aa, BK virus
VGFLGVIVPSGYF

SEQ ID NO: 35495 - protein, 13 aa, BK virus
GFLGVIVPSGYFD

SEQ ID NO: 35496 - protein, 13 aa, BK virus
FLGVIVPSGYFDL

SEQ ID NO: 35497 - protein, 13 aa, BK virus
FISTPCISKGSPP

SEQ ID NO: 35498 - protein, 13 aa, BK virus
ISTPCISKGSPPT

SEQ ID NO: 35499 - protein, 13 aa, BK virus
STPCISKGSPPTA

SEQ ID NO: 35500 - protein, 13 aa, BK virus
TPCISKGSPPTAK

SEQ ID NO: 35501 - protein, 13 aa, BK virus
PCISKGSPPTAKK

SEQ ID NO: 35502 - protein, 13 aa, BK virus
CISKGSPPTAKKW

SEQ ID NO: 35503 - protein, 13 aa, BK virus
ISKGSPPTAKKWK

SEQ ID NO: 35504 - protein, 13 aa, BK virus
SKGSPPTAKKWKL

SEQ ID NO: 35505 - protein, 13 aa, BK virus
KGSPPTAKKWKLL

SEQ ID NO: 35506 - protein, 13 aa, BK virus
GSPPTAKKWKLLP

SEQ ID NO: 35507 - protein, 13 aa, BK virus
IGFPPPCSCTFCD

SEQ ID NO: 35508 - protein, 13 aa, BK virus
GFPPPCSCTFCDP

SEQ ID NO: 35509 - protein, 13 aa, BK virus
FPPPCSCTFCDPA

SEQ ID NO: 35510 - protein, 13 aa, BK virus
RLSMLVIPITSVC

SEQ ID NO: 35511 - protein, 13 aa, BK virus
LSMLVIPITSVCT

SEQ ID NO: 35512 - protein, 13 aa, BK virus
SMLVIPITSVCTV

SEQ ID NO: 35513 - protein, 13 aa, BK virus
MLVIPITSVCTVT

SEQ ID NO: 35514 - protein, 13 aa, BK virus
LVIPITSVCTVTA

SEQ ID NO: 35515 - protein, 13 aa, BK virus
VIPITSVCTVTAS

SEQ ID NO: 35516 - protein, 13 aa, BK virus
IPITSVCTVTASH

SEQ ID NO: 35517 - protein, 13 aa, BK virus
PITSVCTVTASHI

SEQ ID NO: 35518 - protein, 13 aa, BK virus
ITSVCTVTASHIS

SEQ ID NO: 35519 - protein, 13 aa, BK virus
TSVCTVTASHISR

SEQ ID NO: 35520 - protein, 13 aa, BK virus
SVCTVTASHISRF

SEQ ID NO: 35521 - protein, 13 aa, BK virus
VCTVTASHISRFP

SEQ ID NO: 35522 - protein, 13 aa, BK virus
CTVTASHISRFPQ

SEQ ID NO: 35523 - protein, 13 aa, BK virus
TVTASHISRFPQV

SEQ ID NO: 35524 - protein, 13 aa, BK virus
VTASHISRFPQVR

SEQ ID NO: 35525 - protein, 13 aa, BK virus
TASHISRFPQVRS

SEQ ID NO: 35526 - protein, 13 aa, BK virus
ASHISRFPQVRSS

SEQ ID NO: 35527 - protein, 13 aa, BK virus
SHISRFPQVRSSF

SEQ ID NO: 35528 - protein, 13 aa, BK virus
HISRFPQVRSSFK

SEQ ID NO: 35529 - protein, 13 aa, BK virus
ISRFPQVRSSFKL

SEQ ID NO: 35530 - protein, 13 aa, BK virus
SRFPQVRSSFKLG

SEQ ID NO: 35531 - protein, 13 aa, BK virus
RFPQVRSSFKLGR

SEQ ID NO: 35532 - protein, 13 aa, BK virus
FPQVRSSFKLGRG

SEQ ID NO: 35533 - protein, 13 aa, BK virus
PQVRSSFKLGRGI

SEQ ID NO: 35534 - protein, 13 aa, BK virus
QVRSSFKLGRGIL

SEQ ID NO: 35535 - protein, 13 aa, BK virus
VRSSFKLGRGILA

SEQ ID NO: 35536 - protein, 13 aa, BK virus
RSSFKLGRGILAV

SEQ ID NO: 35537 - protein, 13 aa, BK virus
SSFKLGRGILAVL

SEQ ID NO: 35538 - protein, 13 aa, BK virus
QGSIFLSGLSLLK

SEQ ID NO: 35539 - protein, 13 aa, BK virus
GSIFLSGLSLLKS

SEQ ID NO: 35540 - protein, 13 aa, BK virus
SIFLSGLSLLKSF

SEQ ID NO: 35541 - protein, 13 aa, BK virus
IFLSGLSLLKSFS

SEQ ID NO: 35542 - protein, 13 aa, BK virus
FLSGLSLLKSFSA

SEQ ID NO: 35543 - protein, 13 aa, BK virus
LSGLSLLKSFSAL

SEQ ID NO: 35544 - protein, 13 aa, BK virus
SGLSLLKSFSALS

SEQ ID NO: 35545 - protein, 13 aa, BK virus
GLSLLKSFSALSF

SEQ ID NO: 35546 - protein, 13 aa, BK virus
LSLLKSFSALSFR

SEQ ID NO: 35547 - protein, 13 aa, BK virus
SLLKSFSALSFRL

SEQ ID NO: 35548 - protein, 13 aa, BK virus
LLKSFSALSFRLK

SEQ ID NO: 35549 - protein, 13 aa, BK virus
LKSFSALSFRLKP

SEQ ID NO: 35550 - protein, 13 aa, BK virus
KSFSALSFRLKPL

SEQ ID NO: 35551 - protein, 13 aa, BK virus
SFSALSFRLKPLR

SEQ ID NO: 35552 - protein, 13 aa, BK virus
FSALSFRLKPLRF

SEQ ID NO: 35553 - protein, 13 aa, BK virus
SALSFRLKPLRFS

SEQ ID NO: 35554 - protein, 13 aa, BK virus
ALSFRLKPLRFSS

SEQ ID NO: 35555 - protein, 13 aa, BK virus
LSFRLKPLRFSSG

SEQ ID NO: 35556 - protein, 13 aa, BK virus
SFRLKPLRFSSGS

SEQ ID NO: 35557 - protein, 13 aa, BK virus
FRLKPLRFSSGSP

SEQ ID NO: 35558 - protein, 13 aa, BK virus
RLKPLRFSSGSPI

SEQ ID NO: 35559 - protein, 13 aa, BK virus
LKPLRFSSGSPIS

SEQ ID NO: 35560 - protein, 13 aa, BK virus
KPLRFSSGSPISG

SEQ ID NO: 35561 - protein, 13 aa, BK virus
PLRFSSGSPISGF

SEQ ID NO: 35562 - protein, 13 aa, BK virus
LRFSSGSPISGFR

SEQ ID NO: 35563 - protein, 13 aa, BK virus
RFSSGSPISGFRK

SEQ ID NO: 35564 - protein, 13 aa, BK virus
FSSGSPISGFRKH

SEQ ID NO: 35565 - protein, 13 aa, BK virus
SSGSPISGFRKHS

SEQ ID NO: 35566 - protein, 13 aa, BK virus
SGSPISGFRKHST

SEQ ID NO: 35567 - protein, 13 aa, BK virus
GSPISGFRKHSTS

SEQ ID NO: 35568 - protein, 13 aa, BK virus
SPISGFRKHSTSV

SEQ ID NO: 35569 - protein, 13 aa, BK virus
PISGFRKHSTSVI

SEQ ID NO: 35570 - protein, 13 aa, BK virus
ISGFRKHSTSVIA

SEQ ID NO: 35571 - protein, 13 aa, BK virus
SGFRKHSTSVIAS

SEQ ID NO: 35572 - protein, 13 aa, BK virus
GFRKHSTSVIAST

SEQ ID NO: 35573 - protein, 13 aa, BK virus
FRKHSTSVIASTP

SEQ ID NO: 35574 - protein, 13 aa, BK virus
RKHSTSVIASTPV

SEQ ID NO: 35575 - protein, 13 aa, BK virus
KHSTSVIASTPVL

SEQ ID NO: 35576 - protein, 13 aa, BK virus
HSTSVIASTPVLT

SEQ ID NO: 35577 - protein, 13 aa, BK virus
STSVIASTPVLTS

SEQ ID NO: 35578 - protein, 13 aa, BK virus
TSVIASTPVLTSR

SEQ ID NO: 35579 - protein, 13 aa, BK virus
SVIASTPVLTSRT

SEQ ID NO: 35580 - protein, 13 aa, BK virus
VIASTPVLTSRTS

SEQ ID NO: 35581 - protein, 13 aa, BK virus
IASTPVLTSRTST

SEQ ID NO: 35582 - protein, 13 aa, BK virus
ASTPVLTSRTSTP

SEQ ID NO: 35583 - protein, 13 aa, BK virus
STPVLTSRTSTPP

SEQ ID NO: 35584 - protein, 13 aa, BK virus
TPVLTSRTSTPPF

SEQ ID NO: 35585 - protein, 13 aa, BK virus
PVLTSRTSTPPFI

SEQ ID NO: 35586 - protein, 13 aa, BK virus
VLTSRTSTPPFIS

SEQ ID NO: 35587 - protein, 13 aa, BK virus
LTSRTSTPPFISS

SEQ ID NO: 35588 - protein, 13 aa, BK virus
TSRTSTPPFISSF

SEQ ID NO: 35589 - protein, 13 aa, BK virus
SRTSTPPFISSFG

SEQ ID NO: 35590 - protein, 13 aa, BK virus
RTSTPPFISSFGT

SEQ ID NO: 35591 - protein, 13 aa, BK virus
TSTPPFISSFGTC

SEQ ID NO: 35592 - protein, 13 aa, BK virus
STPPFISSFGTCT

SEQ ID NO: 35593 - protein, 13 aa, BK virus
TPPFISSFGTCTG

SEQ ID NO: 35594 - protein, 13 aa, BK virus
PPFISSFGTCTGS

SEQ ID NO: 35595 - protein, 13 aa, BK virus
PFISSFGTCTGSF

SEQ ID NO: 35596 - protein, 13 aa, BK virus
FISSFGTCTGSFG

SEQ ID NO: 35597 - protein, 13 aa, BK virus
ISSFGTCTGSFGF

SEQ ID NO: 35598 - protein, 13 aa, BK virus
SSFGTCTGSFGFL

SEQ ID NO: 35599 - protein, 13 aa, BK virus
SFGTCTGSFGFLG

SEQ ID NO: 35600 - protein, 13 aa, BK virus
FGTCTGSFGFLGA

SEQ ID NO: 35601 - protein, 13 aa, BK virus
GTCTGSFGFLGAA

SEQ ID NO: 35602 - protein, 13 aa, BK virus
TCTGSFGFLGAAP

SEQ ID NO: 35603 - protein, 13 aa, BK virus
CTGSFGFLGAAPG

SEQ ID NO: 35604 - protein, 13 aa, BK virus
TGSFGFLGAAPGH

SEQ ID NO: 35605 - protein, 13 aa, BK virus
GSFGFLGAAPGHS

SEQ ID NO: 35606 - protein, 13 aa, BK virus
SFGFLGAAPGHSP

SEQ ID NO: 35607 - protein, 13 aa, BK virus
FGFLGAAPGHSPF

SEQ ID NO: 35608 - protein, 13 aa, BK virus
GFLGAAPGHSPFL

SEQ ID NO: 35609 - protein, 13 aa, BK virus
FLGAAPGHSPFLL

SEQ ID NO: 35610 - protein, 13 aa, BK virus
LGAAPGHSPFLLV

SEQ ID NO: 35611 - protein, 13 aa, BK virus
GAAPGHSPFLLVG

SEQ ID NO: 35612 - protein, 13 aa, BK virus
AAPGHSPFLLVGA

SEQ ID NO: 35613 - protein, 13 aa, BK virus
APGHSPFLLVGAI

SEQ ID NO: 35614 - protein, 13 aa, BK virus
PGHSPFLLVGAIF

SEQ ID NO: 35615 - protein, 13 aa, BK virus
GHSPFLLVGAIFI

SEQ ID NO: 35616 - protein, 13 aa, BK virus
HSPFLLVGAIFIC

SEQ ID NO: 35617 - protein, 13 aa, BK virus
SPFLLVGAIFICF

SEQ ID NO: 35618 - protein, 13 aa, BK virus
PFLLVGAIFICFK

SEQ ID NO: 35619 - protein, 13 aa, BK virus
FLLVGAIFICFKS

SEQ ID NO: 35620 - protein, 13 aa, BK virus
LLVGAIFICFKSR

SEQ ID NO: 35621 - protein, 13 aa, BK virus
LVGAIFICFKSRC

SEQ ID NO: 35622 - protein, 13 aa, BK virus
VGAIFICFKSRCY

SEQ ID NO: 35623 - protein, 13 aa, BK virus
GAIFICFKSRCYS

SEQ ID NO: 35624 - protein, 13 aa, BK virus
AIFICFKSRCYSP

SEQ ID NO: 35625 - protein, 13 aa, BK virus
IFICFKSRCYSPV

SEQ ID NO: 35626 - protein, 13 aa, BK virus
FICFKSRCYSPVQ

SEQ ID NO: 35627 - protein, 13 aa, BK virus
ICFKSRCYSPVQA

SEQ ID NO: 35628 - protein, 13 aa, BK virus
RQHPLRSSSLIST

SEQ ID NO: 35629 - protein, 13 aa, BK virus
QHPLRSSSLISTS

SEQ ID NO: 35630 - protein, 13 aa, BK virus
HPLRSSSLISTSW

SEQ ID NO: 35631 - protein, 13 aa, BK virus
PLRSSSLISTSWG

SEQ ID NO: 35632 - protein, 13 aa, BK virus
LRSSSLISTSWGN

SEQ ID NO: 35633 - protein, 13 aa, BK virus
RSSSLISTSWGNS

SEQ ID NO: 35634 - protein, 13 aa, BK virus
SSSLISTSWGNSF

SEQ ID NO: 35635 - protein, 13 aa, BK virus
SSLISTSWGNSFF

SEQ ID NO: 35636 - protein, 13 aa, BK virus
SLISTSWGNSFFY

SEQ ID NO: 35637 - protein, 13 aa, BK virus
LISTSWGNSFFYK

SEQ ID NO: 35638 - protein, 13 aa, BK virus
ISTSWGNSFFYKL

SEQ ID NO: 35639 - protein, 13 aa, BK virus
STSWGNSFFYKLS

SEQ ID NO: 35640 - protein, 13 aa, BK virus
VHSLCNFFYTVSI

SEQ ID NO: 35641 - protein, 13 aa, BK virus
HSLCNFFYTVSII

SEQ ID NO: 35642 - protein, 13 aa, BK virus
SLCNFFYTVSIIY

SEQ ID NO: 35643 - protein, 13 aa, BK virus
LCNFFYTVSIIYT

SEQ ID NO: 35644 - protein, 13 aa, BK virus
CNFFYTVSIIYTI

SEQ ID NO: 35645 - protein, 13 aa, BK virus
NFFYTVSIIYTIS

SEQ ID NO: 35646 - protein, 13 aa, BK virus
FFYTVSIIYTISM

SEQ ID NO: 35647 - protein, 13 aa, BK virus
FYTVSIIYTISMA

SEQ ID NO: 35648 - protein, 13 aa, BK virus
YTVSIIYTISMAK

SEQ ID NO: 35649 - protein, 13 aa, BK virus
TVSIIYTISMAKM

SEQ ID NO: 35650 - protein, 13 aa, BK virus
VSIIYTISMAKMY

SEQ ID NO: 35651 - protein, 13 aa, BK virus
SIIYTISMAKMYT

SEQ ID NO: 35652 - protein, 13 aa, BK virus
IIYTISMAKMYTG

SEQ ID NO: 35653 - protein, 13 aa, BK virus
IYTISMAKMYTGT

SEQ ID NO: 35654 - protein, 13 aa, BK virus
YTISMAKMYTGTF

SEQ ID NO: 35655 - protein, 13 aa, BK virus
TISMAKMYTGTFP

SEQ ID NO: 35656 - protein, 13 aa, BK virus
ISMAKMYTGTFPF

SEQ ID NO: 35657 - protein, 13 aa, BK virus
SMAKMYTGTFPFS

SEQ ID NO: 35658 - protein, 13 aa, BK virus
MAKMYTGTFPFSY

SEQ ID NO: 35659 - protein, 13 aa, BK virus
AKMYTGTFPFSYL

SEQ ID NO: 35660 - protein, 13 aa, BK virus
KMYTGTFPFSYLS

SEQ ID NO: 35661 - protein, 13 aa, BK virus
MYTGTFPFSYLSN

SEQ ID NO: 35662 - protein, 13 aa, BK virus
YTGTFPFSYLSNH

SEQ ID NO: 35663 - protein, 13 aa, BK virus
GPNRGKIRIILLN

SEQ ID NO: 35664 - protein, 13 aa, BK virus
PNRGKIRIILLNI

SEQ ID NO: 35665 - protein, 13 aa, BK virus
NRGKIRIILLNII

SEQ ID NO: 35666 - protein, 13 aa, BK virus
RGKIRIILLNIII

SEQ ID NO: 35667 - protein, 13 aa, BK virus
GKIRIILLNIIIK

SEQ ID NO: 35668 - protein, 13 aa, BK virus
KIRIILLNIIIKV

SEQ ID NO: 35669 - protein, 13 aa, BK virus
IRIILLNIIIKVY

SEQ ID NO: 35670 - protein, 13 aa, BK virus
RIILLNIIIKVYR

SEQ ID NO: 35671 - protein, 13 aa, BK virus
IILLNIIIKVYRG

SEQ ID NO: 35672 - protein, 13 aa, BK virus
ILLNIIIKVYRGI

SEQ ID NO: 35673 - protein, 13 aa, BK virus
LLNIIIKVYRGIY

SEQ ID NO: 35674 - protein, 13 aa, BK virus
LNIIIKVYRGIYN

SEQ ID NO: 35675 - protein, 13 aa, BK virus
NIIIKVYRGIYNC

SEQ ID NO: 35676 - protein, 13 aa, BK virus
IIIKVYRGIYNCP

SEQ ID NO: 35677 - protein, 13 aa, BK virus
IIKVYRGIYNCPG

SEQ ID NO: 35678 - protein, 13 aa, BK virus
IKVYRGIYNCPGS

SEQ ID NO: 35679 - protein, 13 aa, BK virus
KVYRGIYNCPGSF

SEQ ID NO: 35680 - protein, 13 aa, BK virus
VYRGIYNCPGSFL

SEQ ID NO: 35681 - protein, 13 aa, BK virus
YRGIYNCPGSFLQ

SEQ ID NO: 35682 - protein, 13 aa, BK virus
RGIYNCPGSFLQK

SEQ ID NO: 35683 - protein, 13 aa, BK virus
GIYNCPGSFLQKS

SEQ ID NO: 35684 - protein, 13 aa, BK virus
IYNCPGSFLQKSS

SEQ ID NO: 35685 - protein, 13 aa, BK virus
YNCPGSFLQKSSQ

SEQ ID NO: 35686 - protein, 13 aa, BK virus
NCPGSFLQKSSQG

SEQ ID NO: 35687 - protein, 13 aa, BK virus
CPGSFLQKSSQGV

SEQ ID NO: 35688 - protein, 13 aa, BK virus
PGSFLQKSSQGVS

SEQ ID NO: 35689 - protein, 13 aa, BK virus
GSFLQKSSQGVSK

SEQ ID NO: 35690 - protein, 13 aa, BK virus
SFLQKSSQGVSKK

SEQ ID NO: 35691 - protein, 13 aa, BK virus
FLQKSSQGVSKKS

SEQ ID NO: 35692 - protein, 13 aa, BK virus
LQKSSQGVSKKSF

SEQ ID NO: 35693 - protein, 13 aa, BK virus
QKSSQGVSKKSFC

SEQ ID NO: 35694 - protein, 13 aa, BK virus
KSSQGVSKKSFCS

SEQ ID NO: 35695 - protein, 13 aa, BK virus
SSQGVSKKSFCSS

SEQ ID NO: 35696 - protein, 13 aa, BK virus
SQGVSKKSFCSSL

SEQ ID NO: 35697 - protein, 13 aa, BK virus
QGVSKKSFCSSLQ

SEQ ID NO: 35698 - protein, 13 aa, BK virus
GVSKKSFCSSLQF

SEQ ID NO: 35699 - protein, 13 aa, BK virus
VSKKSFCSSLQFL

SEQ ID NO: 35700 - protein, 13 aa, BK virus
GYRRYIIPNNMPQ

SEQ ID NO: 35701 - protein, 13 aa, BK virus
YRRYIIPNNMPQS

SEQ ID NO: 35702 - protein, 13 aa, BK virus
RRYIIPNNMPQSL

SEQ ID NO: 35703 - protein, 13 aa, BK virus
RYIIPNNMPQSLG

SEQ ID NO: 35704 - protein, 13 aa, BK virus
YIIPNNMPQSLGN

SEQ ID NO: 35705 - protein, 13 aa, BK virus
IIPNNMPQSLGNS

SEQ ID NO: 35706 - protein, 13 aa, BK virus
IPNNMPQSLGNSS

SEQ ID NO: 35707 - protein, 13 aa, BK virus
PNNMPQSLGNSSK

SEQ ID NO: 35708 - protein, 13 aa, BK virus
NNMPQSLGNSSKQ

SEQ ID NO: 35709 - protein, 13 aa, BK virus
NMPQSLGNSSKQR

SEQ ID NO: 35710 - protein, 13 aa, BK virus
MPQSLGNSSKQRR

SEQ ID NO: 35711 - protein, 13 aa, BK virus
PQSLGNSSKQRRT

SEQ ID NO: 35712 - protein, 13 aa, BK virus
QSLGNSSKQRRTP

SEQ ID NO: 35713 - protein, 13 aa, BK virus
SLGNSSKQRRTPM

SEQ ID NO: 35714 - protein, 13 aa, BK virus
LGNSSKQRRTPMP

SEQ ID NO: 35715 - protein, 13 aa, BK virus
GNSSKQRRTPMPR

SEQ ID NO: 35716 - protein, 13 aa, BK virus
NSSKQRRTPMPRI

SEQ ID NO: 35717 - protein, 13 aa, BK virus
SSKQRRTPMPRIK

SEQ ID NO: 35718 - protein, 13 aa, BK virus
SKQRRTPMPRIKV

SEQ ID NO: 35719 - protein, 13 aa, BK virus
KQRRTPMPRIKVL

SEQ ID NO: 35720 - protein, 13 aa, BK virus
QRRTPMPRIKVLN

SEQ ID NO: 35721 - protein, 13 aa, BK virus
RRTPMPRIKVLNI

SEQ ID NO: 35722 - protein, 13 aa, BK virus
RTPMPRIKVLNII

SEQ ID NO: 35723 - protein, 13 aa, BK virus
TPMPRIKVLNIIN

SEQ ID NO: 35724 - protein, 13 aa, BK virus
PMPRIKVLNIINK

SEQ ID NO: 35725 - protein, 13 aa, BK virus
MPRIKVLNIINKS

SEQ ID NO: 35726 - protein, 13 aa, BK virus
PRIKVLNIINKSI

SEQ ID NO: 35727 - protein, 13 aa, BK virus
RIKVLNIINKSIY

SEQ ID NO: 35728 - protein, 13 aa, BK virus
IKVLNIINKSIYT

SEQ ID NO: 35729 - protein, 13 aa, BK virus
KVLNIINKSIYTR

SEQ ID NO: 35730 - protein, 13 aa, BK virus
VLNIINKSIYTRK

SEQ ID NO: 35731 - protein, 13 aa, BK virus
LNIINKSIYTRKQ

SEQ ID NO: 35732 - protein, 13 aa, BK virus
NIINKSIYTRKQN

SEQ ID NO: 35733 - protein, 13 aa, BK virus
IINKSIYTRKQNI

SEQ ID NO: 35734 - protein, 13 aa, BK virus
INKSIYTRKQNII

SEQ ID NO: 35735 - protein, 13 aa, BK virus
NKSIYTRKQNIIV

SEQ ID NO: 35736 - protein, 13 aa, BK virus
KSIYTRKQNIIVL

SEQ ID NO: 35737 - protein, 13 aa, BK virus
SIYTRKQNIIVLI

SEQ ID NO: 35738 - protein, 13 aa, BK virus
IYTRKQNIIVLIW

SEQ ID NO: 35739 - protein, 13 aa, BK virus
YTRKQNIIVLIWV

SEQ ID NO: 35740 - protein, 13 aa, BK virus
TRKQNIIVLIWVK

SEQ ID NO: 35741 - protein, 13 aa, BK virus
RKQNIIVLIWVKQ

SEQ ID NO: 35742 - protein, 13 aa, BK virus
KQNIIVLIWVKQF

SEQ ID NO: 35743 - protein, 13 aa, BK virus
QNIIVLIWVKQFQ

SEQ ID NO: 35744 - protein, 13 aa, BK virus
NIIVLIWVKQFQS

SEQ ID NO: 35745 - protein, 13 aa, BK virus
IIVLIWVKQFQSH

SEQ ID NO: 35746 - protein, 13 aa, BK virus
IVLIWVKQFQSHA

SEQ ID NO: 35747 - protein, 13 aa, BK virus
LLIEAYSGNFVIP

SEQ ID NO: 35748 - protein, 13 aa, BK virus
LIEAYSGNFVIPI

SEQ ID NO: 35749 - protein, 13 aa, BK virus
IEAYSGNFVIPII

SEQ ID NO: 35750 - protein, 13 aa, BK virus
EAYSGNFVIPIIK

SEQ ID NO: 35751 - protein, 13 aa, BK virus
AYSGNFVIPIIKE

SEQ ID NO: 35752 - protein, 13 aa, BK virus
YSGNFVIPIIKEL

SEQ ID NO: 35753 - protein, 13 aa, BK virus
SGNFVIPIIKELI

SEQ ID NO: 35754 - protein, 13 aa, BK virus
GNFVIPIIKELIP

SEQ ID NO: 35755 - protein, 13 aa, BK virus
NFVIPIIKELIPY

SEQ ID NO: 35756 - protein, 13 aa, BK virus
FVIPIIKELIPYL

SEQ ID NO: 35757 - protein, 13 aa, BK virus
VIPIIKELIPYLS

SEQ ID NO: 35758 - protein, 13 aa, BK virus
SSKPSNSPRSTSN

SEQ ID NO: 35759 - protein, 13 aa, BK virus
SKPSNSPRSTSNY

SEQ ID NO: 35760 - protein, 13 aa, BK virus
KPSNSPRSTSNYS

SEQ ID NO: 35761 - protein, 13 aa, BK virus
PSNSPRSTSNYSI

SEQ ID NO: 35762 - protein, 13 aa, BK virus
SNSPRSTSNYSIC

SEQ ID NO: 35763 - protein, 13 aa, BK virus
NSPRSTSNYSICL

SEQ ID NO: 35764 - protein, 13 aa, BK virus
SPRSTSNYSICLR

SEQ ID NO: 35765 - protein, 13 aa, BK virus
PRSTSNYSICLRS

SEQ ID NO: 35766 - protein, 13 aa, BK virus
GTCYALYSSKGCN

SEQ ID NO: 35767 - protein, 13 aa, BK virus
TCYALYSSKGCNL

SEQ ID NO: 35768 - protein, 13 aa, BK virus
CYALYSSKGCNLN

SEQ ID NO: 35769 - protein, 13 aa, BK virus
YALYSSKGCNLNF

SEQ ID NO: 35770 - protein, 13 aa, BK virus
ALYSSKGCNLNFY

SEQ ID NO: 35771 - protein, 13 aa, BK virus
LYSSKGCNLNFYS

SEQ ID NO: 35772 - protein, 13 aa, BK virus
YSSKGCNLNFYSS

SEQ ID NO: 35773 - protein, 13 aa, BK virus
SSKGCNLNFYSSS

SEQ ID NO: 35774 - protein, 13 aa, BK virus
SKGCNLNFYSSSS

SEQ ID NO: 35775 - protein, 13 aa, BK virus
KGCNLNFYSSSSL

SEQ ID NO: 35776 - protein, 13 aa, BK virus
GCNLNFYSSSSLP

SEQ ID NO: 35777 - protein, 13 aa, BK virus
CNLNFYSSSSLPS

SEQ ID NO: 35778 - protein, 13 aa, BK virus
NLNFYSSSSLPSS

SEQ ID NO: 35779 - protein, 13 aa, BK virus
LNFYSSSSLPSSN

SEQ ID NO: 35780 - protein, 13 aa, BK virus
NFYSSSSLPSSNF

SEQ ID NO: 35781 - protein, 13 aa, BK virus
FYSSSSLPSSNFS

SEQ ID NO: 35782 - protein, 13 aa, BK virus
YSSSSLPSSNFSH

SEQ ID NO: 35783 - protein, 13 aa, BK virus
KSCGSSSLRYTGN

SEQ ID NO: 35784 - protein, 13 aa, BK virus
SSTHEPGNTKKKG

SEQ ID NO: 35785 - protein, 13 aa, BK virus
STHEPGNTKKKGL

SEQ ID NO: 35786 - protein, 13 aa, BK virus
THEPGNTKKKGLL

SEQ ID NO: 35787 - protein, 13 aa, BK virus
HEPGNTKKKGLLT

SEQ ID NO: 35788 - protein, 13 aa, BK virus
ESFTESFTAGKAV

SEQ ID NO: 35789 - protein, 13 aa, BK virus
SFTESFTAGKAVV

SEQ ID NO: 35790 - protein, 13 aa, BK virus
FTESFTAGKAVVL

SEQ ID NO: 35791 - protein, 13 aa, BK virus
TESFTAGKAVVLL

SEQ ID NO: 35792 - protein, 13 aa, BK virus
ESFTAGKAVVLLF

SEQ ID NO: 35793 - protein, 13 aa, BK virus
SFTAGKAVVLLFF

SEQ ID NO: 35794 - protein, 13 aa, BK virus
FTAGKAVVLLFFP

SEQ ID NO: 35795 - protein, 13 aa, BK virus
TAGKAVVLLFFPS

SEQ ID NO: 35796 - protein, 13 aa, BK virus
AGKAVVLLFFPST

SEQ ID NO: 35797 - protein, 13 aa, BK virus
GKAVVLLFFPSTL

SEQ ID NO: 35798 - protein, 13 aa, BK virus
KAVVLLFFPSTLS

SEQ ID NO: 35799 - protein, 13 aa, BK virus
AVVLLFFPSTLSS

SEQ ID NO: 35800 - protein, 13 aa, BK virus
VVLLFFPSTLSSP

SEQ ID NO: 35801 - protein, 13 aa, BK virus
VLLFFPSTLSSPL

SEQ ID NO: 35802 - protein, 13 aa, BK virus
LLFFPSTLSSPLQ

SEQ ID NO: 35803 - protein, 13 aa, BK virus
LFFPSTLSSPLQN

SEQ ID NO: 35804 - protein, 13 aa, BK virus
FFPSTLSSPLQNS

SEQ ID NO: 35805 - protein, 13 aa, BK virus
FPSTLSSPLQNSS

SEQ ID NO: 35806 - protein, 13 aa, BK virus
PSTLSSPLQNSSK

SEQ ID NO: 35807 - protein, 13 aa, BK virus
STLSSPLQNSSKS

SEQ ID NO: 35808 - protein, 13 aa, BK virus
TLSSPLQNSSKSS

SEQ ID NO: 35809 - protein, 13 aa, BK virus
LSSPLQNSSKSSK

SEQ ID NO: 35810 - protein, 13 aa, BK virus
SSPLQNSSKSSKI

SEQ ID NO: 35811 - protein, 13 aa, BK virus
SPLQNSSKSSKIK

SEQ ID NO: 35812 - protein, 13 aa, BK virus
PLQNSSKSSKIKI

SEQ ID NO: 35813 - protein, 13 aa, BK virus
LQNSSKSSKIKIK

SEQ ID NO: 35814 - protein, 13 aa, BK virus
QNSSKSSKIKIKI

SEQ ID NO: 35815 - protein, 13 aa, BK virus
NSSKSSKIKIKIL

SEQ ID NO: 35816 - protein, 13 aa, BK virus
ALFFVPVQVLPTF

SEQ ID NO: 35817 - protein, 13 aa, BK virus
LFFVPVQVLPTFT

SEQ ID NO: 35818 - protein, 13 aa, BK virus
FFVPVQVLPTFTE

SEQ ID NO: 35819 - protein, 13 aa, BK virus
FVPVQVLPTFTEA

SEQ ID NO: 35820 - protein, 13 aa, BK virus
VPVQVLPTFTEAC

SEQ ID NO: 35821 - protein, 13 aa, BK virus
PVQVLPTFTEACR

SEQ ID NO: 35822 - protein, 13 aa, BK virus
VQVLPTFTEACRD

SEQ ID NO: 35823 - protein, 13 aa, BK virus
QVLPTFTEACRDS

SEQ ID NO: 35824 - protein, 13 aa, BK virus
VLPTFTEACRDSW

SEQ ID NO: 35825 - protein, 13 aa, BK virus
LPTFTEACRDSWR

SEQ ID NO: 35826 - protein, 13 aa, BK virus
PTFTEACRDSWRR

SEQ ID NO: 35827 - protein, 13 aa, BK virus
TFTEACRDSWRRT

SEQ ID NO: 35828 - protein, 13 aa, BK virus
FTEACRDSWRRTM

SEQ ID NO: 35829 - protein, 13 aa, BK virus
TEACRDSWRRTMA

SEQ ID NO: 35830 - protein, 13 aa, BK virus
EACRDSWRRTMAF

SEQ ID NO: 35831 - protein, 13 aa, BK virus
ACRDSWRRTMAFV

SEQ ID NO: 35832 - protein, 13 aa, BK virus
CRDSWRRTMAFVQ

SEQ ID NO: 35833 - protein, 13 aa, BK virus
RDSWRRTMAFVQF

SEQ ID NO: 35834 - protein, 13 aa, BK virus
DSWRRTMAFVQFN

SEQ ID NO: 35835 - protein, 13 aa, BK virus
SWRRTMAFVQFNW

SEQ ID NO: 35836 - protein, 13 aa, BK virus
WRRTMAFVQFNWG

SEQ ID NO: 35837 - protein, 13 aa, BK virus
RRTMAFVQFNWGQ

SEQ ID NO: 35838 - protein, 13 aa, BK virus
RTMAFVQFNWGQG

SEQ ID NO: 35839 - protein, 13 aa, BK virus
TMAFVQFNWGQGQ

SEQ ID NO: 35840 - protein, 13 aa, BK virus
MAFVQFNWGQGQD

SEQ ID NO: 35841 - protein, 13 aa, BK virus
AFVQFNWGQGQDS

SEQ ID NO: 35842 - protein, 13 aa, BK virus
ARKTCLSCTFLPE

SEQ ID NO: 35843 - protein, 13 aa, BK virus
RKTCLSCTFLPEV

SEQ ID NO: 35844 - protein, 13 aa, BK virus
KTCLSCTFLPEVM

SEQ ID NO: 35845 - protein, 13 aa, BK virus
TCLSCTFLPEVMV

SEQ ID NO: 35846 - protein, 13 aa, BK virus
CLSCTFLPEVMVW

SEQ ID NO: 35847 - protein, 13 aa, BK virus
LSCTFLPEVMVWL

SEQ ID NO: 35848 - protein, 13 aa, BK virus
SCTFLPEVMVWLH

SEQ ID NO: 35849 - protein, 13 aa, BK virus
CTFLPEVMVWLHS

SEQ ID NO: 35850 - protein, 13 aa, BK virus
TFLPEVMVWLHSM

SEQ ID NO: 35851 - protein, 13 aa, BK virus
FLPEVMVWLHSMG

SEQ ID NO: 35852 - protein, 13 aa, BK virus
LPEVMVWLHSMGK

SEQ ID NO: 35853 - protein, 13 aa, BK virus
PEVMVWLHSMGKQ

SEQ ID NO: 35854 - protein, 13 aa, BK virus
EVMVWLHSMGKQL

SEQ ID NO: 35855 - protein, 13 aa, BK virus
VMVWLHSMGKQLL

SEQ ID NO: 35856 - protein, 13 aa, BK virus
MVWLHSMGKQLLP

SEQ ID NO: 35857 - protein, 13 aa, BK virus
VWLHSMGKQLLPV

SEQ ID NO: 35858 - protein, 13 aa, BK virus
WLHSMGKQLLPVS

SEQ ID NO: 35859 - protein, 13 aa, BK virus
LHSMGKQLLPVSH

SEQ ID NO: 35860 - protein, 13 aa, BK virus
HSMGKQLLPVSHA

SEQ ID NO: 35861 - protein, 13 aa, BK virus
SMGKQLLPVSHAL

SEQ ID NO: 35862 - protein, 13 aa, BK virus
MGKQLLPVSHALS

SEQ ID NO: 35863 - protein, 13 aa, BK virus
GKQLLPVSHALSF

SEQ ID NO: 35864 - protein, 13 aa, BK virus
KQLLPVSHALSFL

SEQ ID NO: 35865 - protein, 13 aa, BK virus
QLLPVSHALSFLR

SEQ ID NO: 35866 - protein, 13 aa, BK virus
LLPVSHALSFLRS

SEQ ID NO: 35867 - protein, 13 aa, BK virus
LPVSHALSFLRSW

SEQ ID NO: 35868 - protein, 13 aa, BK virus
PVSHALSFLRSWF

SEQ ID NO: 35869 - protein, 13 aa, BK virus
VSHALSFLRSWFG

SEQ ID NO: 35870 - protein, 13 aa, BK virus
SHALSFLRSWFGC

SEQ ID NO: 35871 - protein, 13 aa, BK virus
HALSFLRSWFGCI

SEQ ID NO: 35872 - protein, 13 aa, BK virus
ALSFLRSWFGCIP

SEQ ID NO: 35873 - protein, 13 aa, BK virus
LSFLRSWFGCIPL

SEQ ID NO: 35874 - protein, 13 aa, BK virus
EAEAASASTLSLK

SEQ ID NO: 35875 - protein, 13 aa, BK virus
GLAKLFGEIPILL

SEQ ID NO: 35876 - protein, 13 aa, BK virus
LAKLFGEIPILLQ

SEQ ID NO: 35877 - protein, 13 aa, BK virus
AKLFGEIPILLQF

SEQ ID NO: 35878 - protein, 13 aa, BK virus
KLFGEIPILLQFL

SEQ ID NO: 35879 - protein, 13 aa, BK virus
LFGEIPILLQFLQ

SEQ ID NO: 35880 - protein, 14 aa, BK virus
MDKVLNREESMELM

SEQ ID NO: 35881 - protein, 14 aa, BK virus
DKVLNREESMELMD

SEQ ID NO: 35882 - protein, 14 aa, BK virus
KVLNREESMELMDL

SEQ ID NO: 35883 - protein, 14 aa, BK virus
VLNREESMELMDLL

SEQ ID NO: 35884 - protein, 14 aa, BK virus
LNREESMELMDLLG

SEQ ID NO: 35885 - protein, 14 aa, BK virus
NREESMELMDLLGL

SEQ ID NO: 35886 - protein, 14 aa, BK virus
REESMELMDLLGLE

SEQ ID NO: 35887 - protein, 14 aa, BK virus
EESMELMDLLGLER

SEQ ID NO: 35888 - protein, 14 aa, BK virus
ESMELMDLLGLERA

SEQ ID NO: 35889 - protein, 14 aa, BK virus
SMELMDLLGLERAA

SEQ ID NO: 35890 - protein, 14 aa, BK virus
MELMDLLGLERAAW

SEQ ID NO: 35891 - protein, 14 aa, BK virus
ELMDLLGLERAAWG

SEQ ID NO: 35892 - protein, 14 aa, BK virus
LMDLLGLERAAWGN

SEQ ID NO: 35893 - protein, 14 aa, BK virus
MDLLGLERAAWGNL

SEQ ID NO: 35894 - protein, 14 aa, BK virus
DLLGLERAAWGNLP

SEQ ID NO: 35895 - protein, 14 aa, BK virus
LLGLERAAWGNLPL

SEQ ID NO: 35896 - protein, 14 aa, BK virus
LGLERAAWGNLPLM

SEQ ID NO: 35897 - protein, 14 aa, BK virus
GLERAAWGNLPLMR

SEQ ID NO: 35898 - protein, 14 aa, BK virus
LERAAWGNLPLMRK

SEQ ID NO: 35899 - protein, 14 aa, BK virus
ERAAWGNLPLMRKA

SEQ ID NO: 35900 - protein, 14 aa, BK virus
RAAWGNLPLMRKAY

SEQ ID NO: 35901 - protein, 14 aa, BK virus
AAWGNLPLMRKAYL

SEQ ID NO: 35902 - protein, 14 aa, BK virus
AWGNLPLMRKAYLR

SEQ ID NO: 35903 - protein, 14 aa, BK virus
WGNLPLMRKAYLRK

SEQ ID NO: 35904 - protein, 14 aa, BK virus
GNLPLMRKAYLRKC

SEQ ID NO: 35905 - protein, 14 aa, BK virus
NLPLMRKAYLRKCK

SEQ ID NO: 35906 - protein, 14 aa, BK virus
LPLMRKAYLRKCKE

SEQ ID NO: 35907 - protein, 14 aa, BK virus
PLMRKAYLRKCKEF

SEQ ID NO: 35908 - protein, 14 aa, BK virus
LMRKAYLRKCKEFH

SEQ ID NO: 35909 - protein, 14 aa, BK virus
MRKAYLRKCKEFHP

SEQ ID NO: 35910 - protein, 14 aa, BK virus
RKAYLRKCKEFHPD

SEQ ID NO: 35911 - protein, 14 aa, BK virus
KAYLRKCKEFHPDK

SEQ ID NO: 35912 - protein, 14 aa, BK virus
AYLRKCKEFHPDKG

SEQ ID NO: 35913 - protein, 14 aa, BK virus
YLRKCKEFHPDKGG

SEQ ID NO: 35914 - protein, 14 aa, BK virus
LRKCKEFHPDKGGD

SEQ ID NO: 35915 - protein, 14 aa, BK virus
RKCKEFHPDKGGDE

SEQ ID NO: 35916 - protein, 14 aa, BK virus
KCKEFHPDKGGDED

SEQ ID NO: 35917 - protein, 14 aa, BK virus
CKEFHPDKGGDEDK

SEQ ID NO: 35918 - protein, 14 aa, BK virus
KEFHPDKGGDEDKM

SEQ ID NO: 35919 - protein, 14 aa, BK virus
EFHPDKGGDEDKMK

SEQ ID NO: 35920 - protein, 14 aa, BK virus
FHPDKGGDEDKMKR

SEQ ID NO: 35921 - protein, 14 aa, BK virus
HPDKGGDEDKMKRM

SEQ ID NO: 35922 - protein, 14 aa, BK virus
PDKGGDEDKMKRMN

SEQ ID NO: 35923 - protein, 14 aa, BK virus
DKGGDEDKMKRMNT

SEQ ID NO: 35924 - protein, 14 aa, BK virus
KGGDEDKMKRMNTL

SEQ ID NO: 35925 - protein, 14 aa, BK virus
GGDEDKMKRMNTLY

SEQ ID NO: 35926 - protein, 14 aa, BK virus
GDEDKMKRMNTLYK

SEQ ID NO: 35927 - protein, 14 aa, BK virus
DEDKMKRMNTLYKK

SEQ ID NO: 35928 - protein, 14 aa, BK virus
EDKMKRMNTLYKKM

SEQ ID NO: 35929 - protein, 14 aa, BK virus
DKMKRMNTLYKKME

SEQ ID NO: 35930 - protein, 14 aa, BK virus
KMKRMNTLYKKMEQ

SEQ ID NO: 35931 - protein, 14 aa, BK virus
MKRMNTLYKKMEQD

SEQ ID NO: 35932 - protein, 14 aa, BK virus
KRMNTLYKKMEQDV

SEQ ID NO: 35933 - protein, 14 aa, BK virus
RMNTLYKKMEQDVK

SEQ ID NO: 35934 - protein, 14 aa, BK virus
MNTLYKKMEQDVKV

SEQ ID NO: 35935 - protein, 14 aa, BK virus
NTLYKKMEQDVKVA

SEQ ID NO: 35936 - protein, 14 aa, BK virus
TLYKKMEQDVKVAH

SEQ ID NO: 35937 - protein, 14 aa, BK virus
LYKKMEQDVKVAHQ

SEQ ID NO: 35938 - protein, 14 aa, BK virus
YKKMEQDVKVAHQP

SEQ ID NO: 35939 - protein, 14 aa, BK virus
KKMEQDVKVAHQPD

SEQ ID NO: 35940 - protein, 14 aa, BK virus
KMEQDVKVAHQPDF

SEQ ID NO: 35941 - protein, 14 aa, BK virus
MEQDVKVAHQPDFG

SEQ ID NO: 35942 - protein, 14 aa, BK virus
EQDVKVAHQPDFGT

SEQ ID NO: 35943 - protein, 14 aa, BK virus
QDVKVAHQPDFGTW

SEQ ID NO: 35944 - protein, 14 aa, BK virus
DVKVAHQPDFGTWS

SEQ ID NO: 35945 - protein, 14 aa, BK virus
VKVAHQPDFGTWSS

SEQ ID NO: 35946 - protein, 14 aa, BK virus
KVAHQPDFGTWSSS

SEQ ID NO: 35947 - protein, 14 aa, BK virus
VAHQPDFGTWSSSE

SEQ ID NO: 35948 - protein, 14 aa, BK virus
AHQPDFGTWSSSEV

SEQ ID NO: 35949 - protein, 14 aa, BK virus
HQPDFGTWSSSEVC

SEQ ID NO: 35950 - protein, 14 aa, BK virus
QPDFGTWSSSEVCA

SEQ ID NO: 35951 - protein, 14 aa, BK virus
PDFGTWSSSEVCAD

SEQ ID NO: 35952 - protein, 14 aa, BK virus
DFGTWSSSEVCADF

SEQ ID NO: 35953 - protein, 14 aa, BK virus
FGTWSSSEVCADFP

SEQ ID NO: 35954 - protein, 14 aa, BK virus
GTWSSSEVCADFPL

SEQ ID NO: 35955 - protein, 14 aa, BK virus
TWSSSEVCADFPLC

SEQ ID NO: 35956 - protein, 14 aa, BK virus
WSSSEVCADFPLCP

SEQ ID NO: 35957 - protein, 14 aa, BK virus
SSSEVCADFPLCPD

SEQ ID NO: 35958 - protein, 14 aa, BK virus
SSEVCADFPLCPDT

SEQ ID NO: 35959 - protein, 14 aa, BK virus
SEVCADFPLCPDTL

SEQ ID NO: 35960 - protein, 14 aa, BK virus
EVCADFPLCPDTLY

SEQ ID NO: 35961 - protein, 14 aa, BK virus
VCADFPLCPDTLYC

SEQ ID NO: 35962 - protein, 14 aa, BK virus
CADFPLCPDTLYCK

SEQ ID NO: 35963 - protein, 14 aa, BK virus
ADFPLCPDTLYCKE

SEQ ID NO: 35964 - protein, 14 aa, BK virus
DFPLCPDTLYCKEW

SEQ ID NO: 35965 - protein, 14 aa, BK virus
FPLCPDTLYCKEWP

SEQ ID NO: 35966 - protein, 14 aa, BK virus
PLCPDTLYCKEWPI

SEQ ID NO: 35967 - protein, 14 aa, BK virus
LCPDTLYCKEWPIC

SEQ ID NO: 35968 - protein, 14 aa, BK virus
CPDTLYCKEWPICS

SEQ ID NO: 35969 - protein, 14 aa, BK virus
PDTLYCKEWPICSK

SEQ ID NO: 35970 - protein, 14 aa, BK virus
DTLYCKEWPICSKK

SEQ ID NO: 35971 - protein, 14 aa, BK virus
TLYCKEWPICSKKP

SEQ ID NO: 35972 - protein, 14 aa, BK virus
LYCKEWPICSKKPS

SEQ ID NO: 35973 - protein, 14 aa, BK virus
YCKEWPICSKKPSV

SEQ ID NO: 35974 - protein, 14 aa, BK virus
CKEWPICSKKPSVH

SEQ ID NO: 35975 - protein, 14 aa, BK virus
KEWPICSKKPSVHC

SEQ ID NO: 35976 - protein, 14 aa, BK virus
EWPICSKKPSVHCP

SEQ ID NO: 35977 - protein, 14 aa, BK virus
WPICSKKPSVHCPC

SEQ ID NO: 35978 - protein, 14 aa, BK virus
PICSKKPSVHCPCM

SEQ ID NO: 35979 - protein, 14 aa, BK virus
ICSKKPSVHCPCML

SEQ ID NO: 35980 - protein, 14 aa, BK virus
CSKKPSVHCPCMLC

SEQ ID NO: 35981 - protein, 14 aa, BK virus
SKKPSVHCPCMLCQ

SEQ ID NO: 35982 - protein, 14 aa, BK virus
KKPSVHCPCMLCQL

SEQ ID NO: 35983 - protein, 14 aa, BK virus
KPSVHCPCMLCQLR

SEQ ID NO: 35984 - protein, 14 aa, BK virus
PSVHCPCMLCQLRL

SEQ ID NO: 35985 - protein, 14 aa, BK virus
SVHCPCMLCQLRLR

SEQ ID NO: 35986 - protein, 14 aa, BK virus
VHCPCMLCQLRLRH

SEQ ID NO: 35987 - protein, 14 aa, BK virus
HCPCMLCQLRLRHL

SEQ ID NO: 35988 - protein, 14 aa, BK virus
CPCMLCQLRLRHLN

SEQ ID NO: 35989 - protein, 14 aa, BK virus
PCMLCQLRLRHLNR

SEQ ID NO: 35990 - protein, 14 aa, BK virus
CMLCQLRLRHLNRK

SEQ ID NO: 35991 - protein, 14 aa, BK virus
MLCQLRLRHLNRKF

SEQ ID NO: 35992 - protein, 14 aa, BK virus
LCQLRLRHLNRKFL

SEQ ID NO: 35993 - protein, 14 aa, BK virus
CQLRLRHLNRKFLR

SEQ ID NO: 35994 - protein, 14 aa, BK virus
QLRLRHLNRKFLRK

SEQ ID NO: 35995 - protein, 14 aa, BK virus
LRLRHLNRKFLRKE

SEQ ID NO: 35996 - protein, 14 aa, BK virus
RLRHLNRKFLRKEP

SEQ ID NO: 35997 - protein, 14 aa, BK virus
LRHLNRKFLRKEPL

SEQ ID NO: 35998 - protein, 14 aa, BK virus
RHLNRKFLRKEPLV

SEQ ID NO: 35999 - protein, 14 aa, BK virus
HLNRKFLRKEPLVW

SEQ ID NO: 36000 - protein, 14 aa, BK virus
LNRKFLRKEPLVWI

SEQ ID NO: 36001 - protein, 14 aa, BK virus
NRKFLRKEPLVWID

SEQ ID NO: 36002 - protein, 14 aa, BK virus
RKFLRKEPLVWIDC

SEQ ID NO: 36003 - protein, 14 aa, BK virus
KFLRKEPLVWIDCY

SEQ ID NO: 36004 - protein, 14 aa, BK virus
FLRKEPLVWIDCYC

SEQ ID NO: 36005 - protein, 14 aa, BK virus
LRKEPLVWIDCYCI

SEQ ID NO: 36006 - protein, 14 aa, BK virus
RKEPLVWIDCYCID

SEQ ID NO: 36007 - protein, 14 aa, BK virus
KEPLVWIDCYCIDC

SEQ ID NO: 36008 - protein, 14 aa, BK virus
EPLVWIDCYCIDCF

SEQ ID NO: 36009 - protein, 14 aa, BK virus
PLVWIDCYCIDCFT

SEQ ID NO: 36010 - protein, 14 aa, BK virus
LVWIDCYCIDCFTQ

SEQ ID NO: 36011 - protein, 14 aa, BK virus
VWIDCYCIDCFTQW

SEQ ID NO: 36012 - protein, 14 aa, BK virus
WIDCYCIDCFTQWF

SEQ ID NO: 36013 - protein, 14 aa, BK virus
IDCYCIDCFTQWFG

SEQ ID NO: 36014 - protein, 14 aa, BK virus
DCYCIDCFTQWFGL

SEQ ID NO: 36015 - protein, 14 aa, BK virus
CYCIDCFTQWFGLD

SEQ ID NO: 36016 - protein, 14 aa, BK virus
YCIDCFTQWFGLDL

SEQ ID NO: 36017 - protein, 14 aa, BK virus
CIDCFTQWFGLDLT

SEQ ID NO: 36018 - protein, 14 aa, BK virus
IDCFTQWFGLDLTE

SEQ ID NO: 36019 - protein, 14 aa, BK virus
DCFTQWFGLDLTEE

SEQ ID NO: 36020 - protein, 14 aa, BK virus
CFTQWFGLDLTEET

SEQ ID NO: 36021 - protein, 14 aa, BK virus
FTQWFGLDLTEETL

SEQ ID NO: 36022 - protein, 14 aa, BK virus
TQWFGLDLTEETLQ

SEQ ID NO: 36023 - protein, 14 aa, BK virus
QWFGLDLTEETLQW

SEQ ID NO: 36024 - protein, 14 aa, BK virus
WFGLDLTEETLQWW

SEQ ID NO: 36025 - protein, 14 aa, BK virus
FGLDLTEETLQWWV

SEQ ID NO: 36026 - protein, 14 aa, BK virus
GLDLTEETLQWWVQ

SEQ ID NO: 36027 - protein, 14 aa, BK virus
LDLTEETLQWWVQI

SEQ ID NO: 36028 - protein, 14 aa, BK virus
DLTEETLQWWVQII

SEQ ID NO: 36029 - protein, 14 aa, BK virus
LTEETLQWWVQIIG

SEQ ID NO: 36030 - protein, 14 aa, BK virus
TEETLQWWVQIIGE

SEQ ID NO: 36031 - protein, 14 aa, BK virus
EETLQWWVQIIGET

SEQ ID NO: 36032 - protein, 14 aa, BK virus
ETLQWWVQIIGETP

SEQ ID NO: 36033 - protein, 14 aa, BK virus
TLQWWVQIIGETPF

SEQ ID NO: 36034 - protein, 14 aa, BK virus
LQWWVQIIGETPFR

SEQ ID NO: 36035 - protein, 14 aa, BK virus
QWWVQIIGETPFRD

SEQ ID NO: 36036 - protein, 14 aa, BK virus
WWVQIIGETPFRDL

SEQ ID NO: 36037 - protein, 14 aa, BK virus
WVQIIGETPFRDLK

SEQ ID NO: 36038 - protein, 14 aa, BK virus
VQIIGETPFRDLKL

SEQ ID NO: 36039 - protein, 14 aa, BK virus
KALSNYFFYRCQPM

SEQ ID NO: 36040 - protein, 14 aa, BK virus
ALSNYFFYRCQPME

SEQ ID NO: 36041 - protein, 14 aa, BK virus
LSNYFFYRCQPMEQ

SEQ ID NO: 36042 - protein, 14 aa, BK virus
SNYFFYRCQPMEQK

SEQ ID NO: 36043 - protein, 14 aa, BK virus
NYFFYRCQPMEQKS

SEQ ID NO: 36044 - protein, 14 aa, BK virus
YFFYRCQPMEQKSG

SEQ ID NO: 36045 - protein, 14 aa, BK virus
FFYRCQPMEQKSGS

SEQ ID NO: 36046 - protein, 14 aa, BK virus
FYRCQPMEQKSGSP

SEQ ID NO: 36047 - protein, 14 aa, BK virus
YRCQPMEQKSGSPG

SEQ ID NO: 36048 - protein, 14 aa, BK virus
RCQPMEQKSGSPGG

SEQ ID NO: 36049 - protein, 14 aa, BK virus
CQPMEQKSGSPGGV

SEQ ID NO: 36050 - protein, 14 aa, BK virus
QPMEQKSGSPGGVP

SEQ ID NO: 36051 - protein, 14 aa, BK virus
PMEQKSGSPGGVPL

SEQ ID NO: 36052 - protein, 14 aa, BK virus
MEQKSGSPGGVPLM

SEQ ID NO: 36053 - protein, 14 aa, BK virus
EQKSGSPGGVPLMK

SEQ ID NO: 36054 - protein, 14 aa, BK virus
QKSGSPGGVPLMKN

SEQ ID NO: 36055 - protein, 14 aa, BK virus
KSGSPGGVPLMKNG

SEQ ID NO: 36056 - protein, 14 aa, BK virus
SGSPGGVPLMKNGM

SEQ ID NO: 36057 - protein, 14 aa, BK virus
GSPGGVPLMKNGMK

SEQ ID NO: 36058 - protein, 14 aa, BK virus
SPGGVPLMKNGMKI

SEQ ID NO: 36059 - protein, 14 aa, BK virus
PGGVPLMKNGMKIY

SEQ ID NO: 36060 - protein, 14 aa, BK virus
GGVPLMKNGMKIYF

SEQ ID NO: 36061 - protein, 14 aa, BK virus
GVPLMKNGMKIYFA

SEQ ID NO: 36062 - protein, 14 aa, BK virus
VPLMKNGMKIYFAM

SEQ ID NO: 36063 - protein, 14 aa, BK virus
PLMKNGMKIYFAMK

SEQ ID NO: 36064 - protein, 14 aa, BK virus
LMKNGMKIYFAMKI

SEQ ID NO: 36065 - protein, 14 aa, BK virus
MKNGMKIYFAMKIC

SEQ ID NO: 36066 - protein, 14 aa, BK virus
KNGMKIYFAMKICL

SEQ ID NO: 36067 - protein, 14 aa, BK virus
NGMKIYFAMKICLP

SEQ ID NO: 36068 - protein, 14 aa, BK virus
GMKIYFAMKICLPV

SEQ ID NO: 36069 - protein, 14 aa, BK virus
MKIYFAMKICLPVM

SEQ ID NO: 36070 - protein, 14 aa, BK virus
KIYFAMKICLPVMK

SEQ ID NO: 36071 - protein, 14 aa, BK virus
IYFAMKICLPVMKK

SEQ ID NO: 36072 - protein, 14 aa, BK virus
YFAMKICLPVMKKQ

SEQ ID NO: 36073 - protein, 14 aa, BK virus
FAMKICLPVMKKQQ

SEQ ID NO: 36074 - protein, 14 aa, BK virus
AMKICLPVMKKQQQ

SEQ ID NO: 36075 - protein, 14 aa, BK virus
MKICLPVMKKQQQI

SEQ ID NO: 36076 - protein, 14 aa, BK virus
KICLPVMKKQQQIL

SEQ ID NO: 36077 - protein, 14 aa, BK virus
ICLPVMKKQQQILN

SEQ ID NO: 36078 - protein, 14 aa, BK virus
CLPVMKKQQQILNT

SEQ ID NO: 36079 - protein, 14 aa, BK virus
LPVMKKQQQILNTQ

SEQ ID NO: 36080 - protein, 14 aa, BK virus
PVMKKQQQILNTQH

SEQ ID NO: 36081 - protein, 14 aa, BK virus
VMKKQQQILNTQHH

SEQ ID NO: 36082 - protein, 14 aa, BK virus
MKKQQQILNTQHHP

SEQ ID NO: 36083 - protein, 14 aa, BK virus
KKQQQILNTQHHPK

SEQ ID NO: 36084 - protein, 14 aa, BK virus
KQQQILNTQHHPKK

SEQ ID NO: 36085 - protein, 14 aa, BK virus
QQQILNTQHHPKKK

SEQ ID NO: 36086 - protein, 14 aa, BK virus
QQILNTQHHPKKKE

SEQ ID NO: 36087 - protein, 14 aa, BK virus
QILNTQHHPKKKER

SEQ ID NO: 36088 - protein, 14 aa, BK virus
KTLKTFPLIYTSFL

SEQ ID NO: 36089 - protein, 14 aa, BK virus
TLKTFPLIYTSFLV

SEQ ID NO: 36090 - protein, 14 aa, BK virus
LKTFPLIYTSFLVK

SEQ ID NO: 36091 - protein, 14 aa, BK virus
KTFPLIYTSFLVKL

SEQ ID NO: 36092 - protein, 14 aa, BK virus
TFPLIYTSFLVKLY

SEQ ID NO: 36093 - protein, 14 aa, BK virus
FPLIYTSFLVKLYL

SEQ ID NO: 36094 - protein, 14 aa, BK virus
PLIYTSFLVKLYLV

SEQ ID NO: 36095 - protein, 14 aa, BK virus
LIYTSFLVKLYLVI

SEQ ID NO: 36096 - protein, 14 aa, BK virus
IYTSFLVKLYLVIE

SEQ ID NO: 36097 - protein, 14 aa, BK virus
YTSFLVKLYLVIEP

SEQ ID NO: 36098 - protein, 14 aa, BK virus
TSFLVKLYLVIEPL

SEQ ID NO: 36099 - protein, 14 aa, BK virus
SFLVKLYLVIEPLP

SEQ ID NO: 36100 - protein, 14 aa, BK virus
FLVKLYLVIEPLPA

SEQ ID NO: 36101 - protein, 14 aa, BK virus
LVKLYLVIEPLPAL

SEQ ID NO: 36102 - protein, 14 aa, BK virus
VKLYLVIEPLPALL

SEQ ID NO: 36103 - protein, 14 aa, BK virus
KLYLVIEPLPALLC

SEQ ID NO: 36104 - protein, 14 aa, BK virus
LYLVIEPLPALLCI

SEQ ID NO: 36105 - protein, 14 aa, BK virus
YLVIEPLPALLCIL

SEQ ID NO: 36106 - protein, 14 aa, BK virus
LVIEPLPALLCILL

SEQ ID NO: 36107 - protein, 14 aa, BK virus
VIEPLPALLCILLK

SEQ ID NO: 36108 - protein, 14 aa, BK virus
IEPLPALLCILLKK

SEQ ID NO: 36109 - protein, 14 aa, BK virus
EPLPALLCILLKKK

SEQ ID NO: 36110 - protein, 14 aa, BK virus
PLPALLCILLKKKL

SEQ ID NO: 36111 - protein, 14 aa, BK virus
LPALLCILLKKKLK

SEQ ID NO: 36112 - protein, 14 aa, BK virus
PALLCILLKKKLKF

SEQ ID NO: 36113 - protein, 14 aa, BK virus
ALLCILLKKKLKFC

SEQ ID NO: 36114 - protein, 14 aa, BK virus
LLCILLKKKLKFCI

SEQ ID NO: 36115 - protein, 14 aa, BK virus
LCILLKKKLKFCIK

SEQ ID NO: 36116 - protein, 14 aa, BK virus
CILLKKKLKFCIKN

SEQ ID NO: 36117 - protein, 14 aa, BK virus
ILLKKKLKFCIKNL

SEQ ID NO: 36118 - protein, 14 aa, BK virus
LLKKKLKFCIKNLW

SEQ ID NO: 36119 - protein, 14 aa, BK virus
LKKKLKFCIKNLWK

SEQ ID NO: 36120 - protein, 14 aa, BK virus
KKKLKFCIKNLWKN

SEQ ID NO: 36121 - protein, 14 aa, BK virus
KKLKFCIKNLWKNI

SEQ ID NO: 36122 - protein, 14 aa, BK virus
KLKFCIKNLWKNIL

SEQ ID NO: 36123 - protein, 14 aa, BK virus
LLLVDTCVLGIILY

SEQ ID NO: 36124 - protein, 14 aa, BK virus
LLVDTCVLGIILYS

SEQ ID NO: 36125 - protein, 14 aa, BK virus
LVDTCVLGIILYSF

SEQ ID NO: 36126 - protein, 14 aa, BK virus
LHIDIEFLQLIISV

SEQ ID NO: 36127 - protein, 14 aa, BK virus
HIDIEFLQLIISVK

SEQ ID NO: 36128 - protein, 14 aa, BK virus
IDIEFLQLIISVKS

SEQ ID NO: 36129 - protein, 14 aa, BK virus
DIEFLQLIISVKSC

SEQ ID NO: 36130 - protein, 14 aa, BK virus
IEFLQLIISVKSCV

SEQ ID NO: 36131 - protein, 14 aa, BK virus
EFLQLIISVKSCVP

SEQ ID NO: 36132 - protein, 14 aa, BK virus
FLQLIISVKSCVPL

SEQ ID NO: 36133 - protein, 14 aa, BK virus
LQLIISVKSCVPLV

SEQ ID NO: 36134 - protein, 14 aa, BK virus
QLIISVKSCVPLVF

SEQ ID NO: 36135 - protein, 14 aa, BK virus
FVRVLIRNTYYIVP

SEQ ID NO: 36136 - protein, 14 aa, BK virus
RSMILAQKSLKKQS

SEQ ID NO: 36137 - protein, 14 aa, BK virus
SMILAQKSLKKQSR

SEQ ID NO: 36138 - protein, 14 aa, BK virus
MILAQKSLKKQSRC

SEQ ID NO: 36139 - protein, 14 aa, BK virus
ILAQKSLKKQSRCL

SEQ ID NO: 36140 - protein, 14 aa, BK virus
LAQKSLKKQSRCLG

SEQ ID NO: 36141 - protein, 14 aa, BK virus
AQKSLKKQSRCLGN

SEQ ID NO: 36142 - protein, 14 aa, BK virus
RSVKSVRKKTSLIT

SEQ ID NO: 36143 - protein, 14 aa, BK virus
SVKSVRKKTSLITL

SEQ ID NO: 36144 - protein, 14 aa, BK virus
VKSVRKKTSLITLS

SEQ ID NO: 36145 - protein, 14 aa, BK virus
KSVRKKTSLITLSI

SEQ ID NO: 36146 - protein, 14 aa, BK virus
SVRKKTSLITLSIM

SEQ ID NO: 36147 - protein, 14 aa, BK virus
VRKKTSLITLSIMK

SEQ ID NO: 36148 - protein, 14 aa, BK virus
RKKTSLITLSIMKS

SEQ ID NO: 36149 - protein, 14 aa, BK virus
KKTSLITLSIMKST

SEQ ID NO: 36150 - protein, 14 aa, BK virus
KTSLITLSIMKSTL

SEQ ID NO: 36151 - protein, 14 aa, BK virus
TSLITLSIMKSTLQ

SEQ ID NO: 36152 - protein, 14 aa, BK virus
SLITLSIMKSTLQM

SEQ ID NO: 36153 - protein, 14 aa, BK virus
LITLSIMKSTLQML

SEQ ID NO: 36154 - protein, 14 aa, BK virus
ITLSIMKSTLQMLL

SEQ ID NO: 36155 - protein, 14 aa, BK virus
TLSIMKSTLQMLLF

SEQ ID NO: 36156 - protein, 14 aa, BK virus
LSIMKSTLQMLLFL

SEQ ID NO: 36157 - protein, 14 aa, BK virus
SIMKSTLQMLLFLQ

SEQ ID NO: 36158 - protein, 14 aa, BK virus
IMKSTLQMLLFLQK

SEQ ID NO: 36159 - protein, 14 aa, BK virus
MKSTLQMLLFLQKV

SEQ ID NO: 36160 - protein, 14 aa, BK virus
KSTLQMLLFLQKVK

SEQ ID NO: 36161 - protein, 14 aa, BK virus
STLQMLLFLQKVKI

SEQ ID NO: 36162 - protein, 14 aa, BK virus
TLQMLLFLQKVKIK

SEQ ID NO: 36163 - protein, 14 aa, BK virus
LQMLLFLQKVKIKK

SEQ ID NO: 36164 - protein, 14 aa, BK virus
QMLLFLQKVKIKKV

SEQ ID NO: 36165 - protein, 14 aa, BK virus
MLLFLQKVKIKKVF

SEQ ID NO: 36166 - protein, 14 aa, BK virus
LLFLQKVKIKKVFV

SEQ ID NO: 36167 - protein, 14 aa, BK virus
LFLQKVKIKKVFVS

SEQ ID NO: 36168 - protein, 14 aa, BK virus
FLQKVKIKKVFVSK

SEQ ID NO: 36169 - protein, 14 aa, BK virus
LQKVKIKKVFVSKQ

SEQ ID NO: 36170 - protein, 14 aa, BK virus
NNIWQVLLGCTVCY

SEQ ID NO: 36171 - protein, 14 aa, BK virus
NIWQVLLGCTVCYL

SEQ ID NO: 36172 - protein, 14 aa, BK virus
IWQVLLGCTVCYLK

SEQ ID NO: 36173 - protein, 14 aa, BK virus
WQVLLGCTVCYLKW

SEQ ID NO: 36174 - protein, 14 aa, BK virus
QVLLGCTVCYLKWI

SEQ ID NO: 36175 - protein, 14 aa, BK virus
VLLGCTVCYLKWIL

SEQ ID NO: 36176 - protein, 14 aa, BK virus
YLIFCTVLFSMYLK

SEQ ID NO: 36177 - protein, 14 aa, BK virus
LIFCTVLFSMYLKE

SEQ ID NO: 36178 - protein, 14 aa, BK virus
IFCTVLFSMYLKED

SEQ ID NO: 36179 - protein, 14 aa, BK virus
FCTVLFSMYLKEDT

SEQ ID NO: 36180 - protein, 14 aa, BK virus
CTVLFSMYLKEDTG

SEQ ID NO: 36181 - protein, 14 aa, BK virus
TVLFSMYLKEDTGY

SEQ ID NO: 36182 - protein, 14 aa, BK virus
VLFSMYLKEDTGYL

SEQ ID NO: 36183 - protein, 14 aa, BK virus
LFSMYLKEDTGYLK

SEQ ID NO: 36184 - protein, 14 aa, BK virus
FSMYLKEDTGYLKV

SEQ ID NO: 36185 - protein, 14 aa, BK virus
SMYLKEDTGYLKVP

SEQ ID NO: 36186 - protein, 14 aa, BK virus
MYLKEDTGYLKVPL

SEQ ID NO: 36187 - protein, 14 aa, BK virus
YLKEDTGYLKVPLI

SEQ ID NO: 36188 - protein, 14 aa, BK virus
LKEDTGYLKVPLIV

SEQ ID NO: 36189 - protein, 14 aa, BK virus
KEDTGYLKVPLIVE

SEQ ID NO: 36190 - protein, 14 aa, BK virus
EDTGYLKVPLIVEK

SEQ ID NO: 36191 - protein, 14 aa, BK virus
DTGYLKVPLIVEKQ

SEQ ID NO: 36192 - protein, 14 aa, BK virus
TGYLKVPLIVEKQH

SEQ ID NO: 36193 - protein, 14 aa, BK virus
KGQELNQRICLQDM

SEQ ID NO: 36194 - protein, 14 aa, BK virus
GQELNQRICLQDME

SEQ ID NO: 36195 - protein, 14 aa, BK virus
ENPYKTQSSYLKKE

SEQ ID NO: 36196 - protein, 14 aa, BK virus
NPYKTQSSYLKKEF

SEQ ID NO: 36197 - protein, 14 aa, BK virus
PYKTQSSYLKKEFY

SEQ ID NO: 36198 - protein, 14 aa, BK virus
YKTQSSYLKKEFYK

SEQ ID NO: 36199 - protein, 14 aa, BK virus
KTQSSYLKKEFYKV

SEQ ID NO: 36200 - protein, 14 aa, BK virus
TQSSYLKKEFYKVE

SEQ ID NO: 36201 - protein, 14 aa, BK virus
LILQLIYNLELLNG

SEQ ID NO: 36202 - protein, 14 aa, BK virus
ILQLIYNLELLNGR

SEQ ID NO: 36203 - protein, 14 aa, BK virus
LQLIYNLELLNGRK

SEQ ID NO: 36204 - protein, 14 aa, BK virus
QLIYNLELLNGRKG

SEQ ID NO: 36205 - protein, 14 aa, BK virus
LIYNLELLNGRKGW

SEQ ID NO: 36206 - protein, 14 aa, BK virus
IYNLELLNGRKGWI

SEQ ID NO: 36207 - protein, 14 aa, BK virus
YNLELLNGRKGWIL

SEQ ID NO: 36208 - protein, 14 aa, BK virus
NLELLNGRKGWILR

SEQ ID NO: 36209 - protein, 14 aa, BK virus
NIIYAWGNVFLILQ

SEQ ID NO: 36210 - protein, 14 aa, BK virus
IIYAWGNVFLILQE

SEQ ID NO: 36211 - protein, 14 aa, BK virus
IYAWGNVFLILQEK

SEQ ID NO: 36212 - protein, 14 aa, BK virus
YAWGNVFLILQEKR

SEQ ID NO: 36213 - protein, 14 aa, BK virus
AWGNVFLILQEKRI

SEQ ID NO: 36214 - protein, 14 aa, BK virus
WGNVFLILQEKRIQ

SEQ ID NO: 36215 - protein, 14 aa, BK virus
GNVFLILQEKRIQK

SEQ ID NO: 36216 - protein, 14 aa, BK virus
NVFLILQEKRIQKL

SEQ ID NO: 36217 - protein, 14 aa, BK virus
VFLILQEKRIQKLK

SEQ ID NO: 36218 - protein, 14 aa, BK virus
FLILQEKRIQKLKT

SEQ ID NO: 36219 - protein, 14 aa, BK virus
LILQEKRIQKLKTL

SEQ ID NO: 36220 - protein, 14 aa, BK virus
ILQEKRIQKLKTLD

SEQ ID NO: 36221 - protein, 14 aa, BK virus
LQEKRIQKLKTLDM

SEQ ID NO: 36222 - protein, 14 aa, BK virus
QEKRIQKLKTLDMD

SEQ ID NO: 36223 - protein, 14 aa, BK virus
EKRIQKLKTLDMDQ

SEQ ID NO: 36224 - protein, 14 aa, BK virus
KRIQKLKTLDMDQA

SEQ ID NO: 36225 - protein, 14 aa, BK virus
RIQKLKTLDMDQAL

SEQ ID NO: 36226 - protein, 14 aa, BK virus
IQKLKTLDMDQALN

SEQ ID NO: 36227 - protein, 14 aa, BK virus
QKLKTLDMDQALNP

SEQ ID NO: 36228 - protein, 14 aa, BK virus
KLKTLDMDQALNPN

SEQ ID NO: 36229 - protein, 14 aa, BK virus
LKTLDMDQALNPNH

SEQ ID NO: 36230 - protein, 14 aa, BK virus
KTLDMDQALNPNHN

SEQ ID NO: 36231 - protein, 14 aa, BK virus
TLDMDQALNPNHNA

SEQ ID NO: 36232 - protein, 14 aa, BK virus
LDMDQALNPNHNAL

SEQ ID NO: 36233 - protein, 14 aa, BK virus
DMDQALNPNHNALP

SEQ ID NO: 36234 - protein, 14 aa, BK virus
MDQALNPNHNALPK

SEQ ID NO: 36235 - protein, 14 aa, BK virus
DQALNPNHNALPKS

SEQ ID NO: 36236 - protein, 14 aa, BK virus
QALNPNHNALPKSQ

SEQ ID NO: 36237 - protein, 14 aa, BK virus
ALNPNHNALPKSQI

SEQ ID NO: 36238 - protein, 14 aa, BK virus
LNPNHNALPKSQIL

SEQ ID NO: 36239 - protein, 14 aa, BK virus
NPNHNALPKSQILQ

SEQ ID NO: 36240 - protein, 14 aa, BK virus
PNHNALPKSQILQP

SEQ ID NO: 36241 - protein, 14 aa, BK virus
NHNALPKSQILQPL

SEQ ID NO: 36242 - protein, 14 aa, BK virus
HNALPKSQILQPLL

SEQ ID NO: 36243 - protein, 14 aa, BK virus
NALPKSQILQPLLK

SEQ ID NO: 36244 - protein, 14 aa, BK virus
ALPKSQILQPLLKI

SEQ ID NO: 36245 - protein, 14 aa, BK virus
LPKSQILQPLLKIP

SEQ ID NO: 36246 - protein, 14 aa, BK virus
PKSQILQPLLKIPK

SEQ ID NO: 36247 - protein, 14 aa, BK virus
KSQILQPLLKIPKG

SEQ ID NO: 36248 - protein, 14 aa, BK virus
SQILQPLLKIPKGQ

SEQ ID NO: 36249 - protein, 14 aa, BK virus
QILQPLLKIPKGQT

SEQ ID NO: 36250 - protein, 14 aa, BK virus
ILQPLLKIPKGQTP

SEQ ID NO: 36251 - protein, 14 aa, BK virus
LQPLLKIPKGQTPI

SEQ ID NO: 36252 - protein, 14 aa, BK virus
QPLLKIPKGQTPIV

SEQ ID NO: 36253 - protein, 14 aa, BK virus
PLLKIPKGQTPIVK

SEQ ID NO: 36254 - protein, 14 aa, BK virus
LLKIPKGQTPIVKS

SEQ ID NO: 36255 - protein, 14 aa, BK virus
LKIPKGQTPIVKSC

SEQ ID NO: 36256 - protein, 14 aa, BK virus
KIPKGQTPIVKSCI

SEQ ID NO: 36257 - protein, 14 aa, BK virus
IPKGQTPIVKSCIC

SEQ ID NO: 36258 - protein, 14 aa, BK virus
PKGQTPIVKSCICV

SEQ ID NO: 36259 - protein, 14 aa, BK virus
KGQTPIVKSCICVK

SEQ ID NO: 36260 - protein, 14 aa, BK virus
GQTPIVKSCICVKA

SEQ ID NO: 36261 - protein, 14 aa, BK virus
QTPIVKSCICVKAF

SEQ ID NO: 36262 - protein, 14 aa, BK virus
TPIVKSCICVKAFS

SEQ ID NO: 36263 - protein, 14 aa, BK virus
PIVKSCICVKAFSV

SEQ ID NO: 36264 - protein, 14 aa, BK virus
IVKSCICVKAFSVL

SEQ ID NO: 36265 - protein, 14 aa, BK virus
VKSCICVKAFSVLK

SEQ ID NO: 36266 - protein, 14 aa, BK virus
KSCICVKAFSVLKG

SEQ ID NO: 36267 - protein, 14 aa, BK virus
SCICVKAFSVLKGL

SEQ ID NO: 36268 - protein, 14 aa, BK virus
CICVKAFSVLKGLK

SEQ ID NO: 36269 - protein, 14 aa, BK virus
ICVKAFSVLKGLKH

SEQ ID NO: 36270 - protein, 14 aa, BK virus
CVKAFSVLKGLKHH

SEQ ID NO: 36271 - protein, 14 aa, BK virus
VKAFSVLKGLKHHP

SEQ ID NO: 36272 - protein, 14 aa, BK virus
KAFSVLKGLKHHPQ

SEQ ID NO: 36273 - protein, 14 aa, BK virus
AFSVLKGLKHHPQN

SEQ ID NO: 36274 - protein, 14 aa, BK virus
FSVLKGLKHHPQNN

SEQ ID NO: 36275 - protein, 14 aa, BK virus
SVLKGLKHHPQNNT

SEQ ID NO: 36276 - protein, 14 aa, BK virus
VLKGLKHHPQNNTS

SEQ ID NO: 36277 - protein, 14 aa, BK virus
LKGLKHHPQNNTSL

SEQ ID NO: 36278 - protein, 14 aa, BK virus
KGLKHHPQNNTSLK

SEQ ID NO: 36279 - protein, 14 aa, BK virus
GLKHHPQNNTSLKV

SEQ ID NO: 36280 - protein, 14 aa, BK virus
LKHHPQNNTSLKVA

SEQ ID NO: 36281 - protein, 14 aa, BK virus
KHHPQNNTSLKVAY

SEQ ID NO: 36282 - protein, 14 aa, BK virus
HHPQNNTSLKVAYT

SEQ ID NO: 36283 - protein, 14 aa, BK virus
HPQNNTSLKVAYTK

SEQ ID NO: 36284 - protein, 14 aa, BK virus
PQNNTSLKVAYTKA

SEQ ID NO: 36285 - protein, 14 aa, BK virus
QNNTSLKVAYTKAA

SEQ ID NO: 36286 - protein, 14 aa, BK virus
NNTSLKVAYTKAAF

SEQ ID NO: 36287 - protein, 14 aa, BK virus
NTSLKVAYTKAAFI

SEQ ID NO: 36288 - protein, 14 aa, BK virus
TSLKVAYTKAAFIK

SEQ ID NO: 36289 - protein, 14 aa, BK virus
SLKVAYTKAAFIKC

SEQ ID NO: 36290 - protein, 14 aa, BK virus
LKVAYTKAAFIKCI

SEQ ID NO: 36291 - protein, 14 aa, BK virus
KVAYTKAAFIKCIC

SEQ ID NO: 36292 - protein, 14 aa, BK virus
VAYTKAAFIKCICT

SEQ ID NO: 36293 - protein, 14 aa, BK virus
AYTKAAFIKCICTI

SEQ ID NO: 36294 - protein, 14 aa, BK virus
YTKAAFIKCICTIK

SEQ ID NO: 36295 - protein, 14 aa, BK virus
TKAAFIKCICTIKA

SEQ ID NO: 36296 - protein, 14 aa, BK virus
KAAFIKCICTIKAP

SEQ ID NO: 36297 - protein, 14 aa, BK virus
AAFIKCICTIKAPV

SEQ ID NO: 36298 - protein, 14 aa, BK virus
SILVCNCPCLSIYL

SEQ ID NO: 36299 - protein, 14 aa, BK virus
ILVCNCPCLSIYLI

SEQ ID NO: 36300 - protein, 14 aa, BK virus
LVCNCPCLSIYLII

SEQ ID NO: 36301 - protein, 14 aa, BK virus
VCNCPCLSIYLIIS

SEQ ID NO: 36302 - protein, 14 aa, BK virus
CNCPCLSIYLIISG

SEQ ID NO: 36303 - protein, 14 aa, BK virus
NCPCLSIYLIISGS

SEQ ID NO: 36304 - protein, 14 aa, BK virus
CPCLSIYLIISGSP

SEQ ID NO: 36305 - protein, 14 aa, BK virus
PCLSIYLIISGSPG

SEQ ID NO: 36306 - protein, 14 aa, BK virus
CLSIYLIISGSPGS

SEQ ID NO: 36307 - protein, 14 aa, BK virus
LSIYLIISGSPGSL

SEQ ID NO: 36308 - protein, 14 aa, BK virus
SIYLIISGSPGSLS

SEQ ID NO: 36309 - protein, 14 aa, BK virus
IYLIISGSPGSLSV

SEQ ID NO: 36310 - protein, 14 aa, BK virus
YLIISGSPGSLSVP

SEQ ID NO: 36311 - protein, 14 aa, BK virus
LIISGSPGSLSVPS

SEQ ID NO: 36312 - protein, 14 aa, BK virus
IISGSPGSLSVPSN

SEQ ID NO: 36313 - protein, 14 aa, BK virus
ISGSPGSLSVPSNT

SEQ ID NO: 36314 - protein, 14 aa, BK virus
SGSPGSLSVPSNTL

SEQ ID NO: 36315 - protein, 14 aa, BK virus
GSPGSLSVPSNTLT

SEQ ID NO: 36316 - protein, 14 aa, BK virus
SPGSLSVPSNTLTS

SEQ ID NO: 36317 - protein, 14 aa, BK virus
PGSLSVPSNTLTSS

SEQ ID NO: 36318 - protein, 14 aa, BK virus
GSLSVPSNTLTSST

SEQ ID NO: 36319 - protein, 14 aa, BK virus
SLSVPSNTLTSSTW

SEQ ID NO: 36320 - protein, 14 aa, BK virus
LSVPSNTLTSSTWD

SEQ ID NO: 36321 - protein, 14 aa, BK virus
SVPSNTLTSSTWDS

SEQ ID NO: 36322 - protein, 14 aa, BK virus
VPSNTLTSSTWDSI

SEQ ID NO: 36323 - protein, 14 aa, BK virus
PSNTLTSSTWDSIP

SEQ ID NO: 36324 - protein, 14 aa, BK virus
SNTLTSSTWDSIPY

SEQ ID NO: 36325 - protein, 14 aa, BK virus
NTLTSSTWDSIPYI

SEQ ID NO: 36326 - protein, 14 aa, BK virus
TLTSSTWDSIPYIG

SEQ ID NO: 36327 - protein, 14 aa, BK virus
LTSSTWDSIPYIGC

SEQ ID NO: 36328 - protein, 14 aa, BK virus
TSSTWDSIPYIGCP

SEQ ID NO: 36329 - protein, 14 aa, BK virus
SSTWDSIPYIGCPS

SEQ ID NO: 36330 - protein, 14 aa, BK virus
STWDSIPYIGCPST

SEQ ID NO: 36331 - protein, 14 aa, BK virus
TWDSIPYIGCPSTL

SEQ ID NO: 36332 - protein, 14 aa, BK virus
WDSIPYIGCPSTLW

SEQ ID NO: 36333 - protein, 14 aa, BK virus
DSIPYIGCPSTLWV

SEQ ID NO: 36334 - protein, 14 aa, BK virus
SIPYIGCPSTLWVL

SEQ ID NO: 36335 - protein, 14 aa, BK virus
IPYIGCPSTLWVLL

SEQ ID NO: 36336 - protein, 14 aa, BK virus
PYIGCPSTLWVLLF

SEQ ID NO: 36337 - protein, 14 aa, BK virus
YIGCPSTLWVLLFI

SEQ ID NO: 36338 - protein, 14 aa, BK virus
IGCPSTLWVLLFIR

SEQ ID NO: 36339 - protein, 14 aa, BK virus
GCPSTLWVLLFIRS

SEQ ID NO: 36340 - protein, 14 aa, BK virus
CPSTLWVLLFIRSL

SEQ ID NO: 36341 - protein, 14 aa, BK virus
PSTLWVLLFIRSLS

SEQ ID NO: 36342 - protein, 14 aa, BK virus
STLWVLLFIRSLSK

SEQ ID NO: 36343 - protein, 14 aa, BK virus
TLWVLLFIRSLSKK

SEQ ID NO: 36344 - protein, 14 aa, BK virus
LWVLLFIRSLSKKE

SEQ ID NO: 36345 - protein, 14 aa, BK virus
WVLLFIRSLSKKEI

SEQ ID NO: 36346 - protein, 14 aa, BK virus
VLLFIRSLSKKEIG

SEQ ID NO: 36347 - protein, 14 aa, BK virus
GFFTDLFLRRILKY

SEQ ID NO: 36348 - protein, 14 aa, BK virus
FFTDLFLRRILKYL

SEQ ID NO: 36349 - protein, 14 aa, BK virus
FTDLFLRRILKYLA

SEQ ID NO: 36350 - protein, 14 aa, BK virus
TDLFLRRILKYLAR

SEQ ID NO: 36351 - protein, 14 aa, BK virus
DLFLRRILKYLARP

SEQ ID NO: 36352 - protein, 14 aa, BK virus
LFLRRILKYLARPL

SEQ ID NO: 36353 - protein, 14 aa, BK virus
FLRRILKYLARPLH

SEQ ID NO: 36354 - protein, 14 aa, BK virus
LRRILKYLARPLHC

SEQ ID NO: 36355 - protein, 14 aa, BK virus
RRILKYLARPLHCC

SEQ ID NO: 36356 - protein, 14 aa, BK virus
RILKYLARPLHCCV

SEQ ID NO: 36357 - protein, 14 aa, BK virus
ILKYLARPLHCCVP

SEQ ID NO: 36358 - protein, 14 aa, BK virus
LKYLARPLHCCVPE

SEQ ID NO: 36359 - protein, 14 aa, BK virus
KYLARPLHCCVPEL

SEQ ID NO: 36360 - protein, 14 aa, BK virus
YLARPLHCCVPELL

SEQ ID NO: 36361 - protein, 14 aa, BK virus
LARPLHCCVPELLV

SEQ ID NO: 36362 - protein, 14 aa, BK virus
ARPLHCCVPELLVN

SEQ ID NO: 36363 - protein, 14 aa, BK virus
RPLHCCVPELLVNR

SEQ ID NO: 36364 - protein, 14 aa, BK virus
PLHCCVPELLVNRP

SEQ ID NO: 36365 - protein, 14 aa, BK virus
LHCCVPELLVNRPQ

SEQ ID NO: 36366 - protein, 14 aa, BK virus
HCCVPELLVNRPQI

SEQ ID NO: 36367 - protein, 14 aa, BK virus
CCVPELLVNRPQIS

SEQ ID NO: 36368 - protein, 14 aa, BK virus
CVPELLVNRPQISA

SEQ ID NO: 36369 - protein, 14 aa, BK virus
VPELLVNRPQISAA

SEQ ID NO: 36370 - protein, 14 aa, BK virus
PELLVNRPQISAAE

SEQ ID NO: 36371 - protein, 14 aa, BK virus
ELLVNRPQISAAET

SEQ ID NO: 36372 - protein, 14 aa, BK virus
LLVNRPQISAAETY

SEQ ID NO: 36373 - protein, 14 aa, BK virus
LVNRPQISAAETYR

SEQ ID NO: 36374 - protein, 14 aa, BK virus
VNRPQISAAETYRL

SEQ ID NO: 36375 - protein, 14 aa, BK virus
NRPQISAAETYRLS

SEQ ID NO: 36376 - protein, 14 aa, BK virus
RPQISAAETYRLSA

SEQ ID NO: 36377 - protein, 14 aa, BK virus
PQISAAETYRLSAL

SEQ ID NO: 36378 - protein, 14 aa, BK virus
QISAAETYRLSALQ

SEQ ID NO: 36379 - protein, 14 aa, BK virus
ISAAETYRLSALQR

SEQ ID NO: 36380 - protein, 14 aa, BK virus
SAAETYRLSALQRG

SEQ ID NO: 36381 - protein, 14 aa, BK virus
AAETYRLSALQRGP

SEQ ID NO: 36382 - protein, 14 aa, BK virus
AETYRLSALQRGPT

SEQ ID NO: 36383 - protein, 14 aa, BK virus
ETYRLSALQRGPTP

SEQ ID NO: 36384 - protein, 14 aa, BK virus
TYRLSALQRGPTPC

SEQ ID NO: 36385 - protein, 14 aa, BK virus
YRLSALQRGPTPCS

SEQ ID NO: 36386 - protein, 14 aa, BK virus
RLSALQRGPTPCSS

SEQ ID NO: 36387 - protein, 14 aa, BK virus
LSALQRGPTPCSSS

SEQ ID NO: 36388 - protein, 14 aa, BK virus
SALQRGPTPCSSSN

SEQ ID NO: 36389 - protein, 14 aa, BK virus
ALQRGPTPCSSSNT

SEQ ID NO: 36390 - protein, 14 aa, BK virus
LQRGPTPCSSSNTV

SEQ ID NO: 36391 - protein, 14 aa, BK virus
QRGPTPCSSSNTVV

SEQ ID NO: 36392 - protein, 14 aa, BK virus
RGPTPCSSSNTVVA

SEQ ID NO: 36393 - protein, 14 aa, BK virus
GPTPCSSSNTVVAV

SEQ ID NO: 36394 - protein, 14 aa, BK virus
PTPCSSSNTVVAVL

SEQ ID NO: 36395 - protein, 14 aa, BK virus
TPCSSSNTVVAVLV

SEQ ID NO: 36396 - protein, 14 aa, BK virus
PCSSSNTVVAVLVT

SEQ ID NO: 36397 - protein, 14 aa, BK virus
STGGTFSPPVKVPK

SEQ ID NO: 36398 - protein, 14 aa, BK virus
TGGTFSPPVKVPKY

SEQ ID NO: 36399 - protein, 14 aa, BK virus
GGTFSPPVKVPKYL

SEQ ID NO: 36400 - protein, 14 aa, BK virus
GTFSPPVKVPKYLA

SEQ ID NO: 36401 - protein, 14 aa, BK virus
TFSPPVKVPKYLAF

SEQ ID NO: 36402 - protein, 14 aa, BK virus
FSPPVKVPKYLAFS

SEQ ID NO: 36403 - protein, 14 aa, BK virus
SPPVKVPKYLAFSF

SEQ ID NO: 36404 - protein, 14 aa, BK virus
PPVKVPKYLAFSFL

SEQ ID NO: 36405 - protein, 14 aa, BK virus
PVKVPKYLAFSFLL

SEQ ID NO: 36406 - protein, 14 aa, BK virus
VKVPKYLAFSFLLG

SEQ ID NO: 36407 - protein, 14 aa, BK virus
KVPKYLAFSFLLGS

SEQ ID NO: 36408 - protein, 14 aa, BK virus
VPKYLAFSFLLGSG

SEQ ID NO: 36409 - protein, 14 aa, BK virus
PKYLAFSFLLGSGT

SEQ ID NO: 36410 - protein, 14 aa, BK virus
KYLAFSFLLGSGTQ

SEQ ID NO: 36411 - protein, 14 aa, BK virus
YLAFSFLLGSGTQH

SEQ ID NO: 36412 - protein, 14 aa, BK virus
LAFSFLLGSGTQHS

SEQ ID NO: 36413 - protein, 14 aa, BK virus
AFSFLLGSGTQHST

SEQ ID NO: 36414 - protein, 14 aa, BK virus
FSFLLGSGTQHSTG

SEQ ID NO: 36415 - protein, 14 aa, BK virus
ALWSVFITWDWAVG

SEQ ID NO: 36416 - protein, 14 aa, BK virus
LWSVFITWDWAVGF

SEQ ID NO: 36417 - protein, 14 aa, BK virus
WSVFITWDWAVGFL

SEQ ID NO: 36418 - protein, 14 aa, BK virus
SVFITWDWAVGFLG

SEQ ID NO: 36419 - protein, 14 aa, BK virus
VFITWDWAVGFLGV

SEQ ID NO: 36420 - protein, 14 aa, BK virus
FITWDWAVGFLGVI

SEQ ID NO: 36421 - protein, 14 aa, BK virus
ITWDWAVGFLGVIV

SEQ ID NO: 36422 - protein, 14 aa, BK virus
TWDWAVGFLGVIVP

SEQ ID NO: 36423 - protein, 14 aa, BK virus
WDWAVGFLGVIVPS

SEQ ID NO: 36424 - protein, 14 aa, BK virus
DWAVGFLGVIVPSG

SEQ ID NO: 36425 - protein, 14 aa, BK virus
WAVGFLGVIVPSGY

SEQ ID NO: 36426 - protein, 14 aa, BK virus
AVGFLGVIVPSGYF

SEQ ID NO: 36427 - protein, 14 aa, BK virus
VGFLGVIVPSGYFD

SEQ ID NO: 36428 - protein, 14 aa, BK virus
GFLGVIVPSGYFDL

SEQ ID NO: 36429 - protein, 14 aa, BK virus
FISTPCISKGSPPT

SEQ ID NO: 36430 - protein, 14 aa, BK virus
ISTPCISKGSPPTA

SEQ ID NO: 36431 - protein, 14 aa, BK virus
STPCISKGSPPTAK

SEQ ID NO: 36432 - protein, 14 aa, BK virus
TPCISKGSPPTAKK

SEQ ID NO: 36433 - protein, 14 aa, BK virus
PCISKGSPPTAKKW

SEQ ID NO: 36434 - protein, 14 aa, BK virus
CISKGSPPTAKKWK

SEQ ID NO: 36435 - protein, 14 aa, BK virus
ISKGSPPTAKKWKL

SEQ ID NO: 36436 - protein, 14 aa, BK virus
SKGSPPTAKKWKLL

SEQ ID NO: 36437 - protein, 14 aa, BK virus
KGSPPTAKKWKLLP

SEQ ID NO: 36438 - protein, 14 aa, BK virus
IGFPPPCSCTFCDP

SEQ ID NO: 36439 - protein, 14 aa, BK virus
GFPPPCSCTFCDPA

SEQ ID NO: 36440 - protein, 14 aa, BK virus
RLSMLVIPITSVCT

SEQ ID NO: 36441 - protein, 14 aa, BK virus
LSMLVIPITSVCTV

SEQ ID NO: 36442 - protein, 14 aa, BK virus
SMLVIPITSVCTVT

SEQ ID NO: 36443 - protein, 14 aa, BK virus
MLVIPITSVCTVTA

SEQ ID NO: 36444 - protein, 14 aa, BK virus
LVIPITSVCTVTAS

SEQ ID NO: 36445 - protein, 14 aa, BK virus
VIPITSVCTVTASH

SEQ ID NO: 36446 - protein, 14 aa, BK virus
IPITSVCTVTASHI

SEQ ID NO: 36447 - protein, 14 aa, BK virus
PITSVCTVTASHIS

SEQ ID NO: 36448 - protein, 14 aa, BK virus
ITSVCTVTASHISR

SEQ ID NO: 36449 - protein, 14 aa, BK virus
TSVCTVTASHISRF

SEQ ID NO: 36450 - protein, 14 aa, BK virus
SVCTVTASHISRFP

SEQ ID NO: 36451 - protein, 14 aa, BK virus
VCTVTASHISRFPQ

SEQ ID NO: 36452 - protein, 14 aa, BK virus
CTVTASHISRFPQV

SEQ ID NO: 36453 - protein, 14 aa, BK virus
TVTASHISRFPQVR

SEQ ID NO: 36454 - protein, 14 aa, BK virus
VTASHISRFPQVRS

SEQ ID NO: 36455 - protein, 14 aa, BK virus
TASHISRFPQVRSS

SEQ ID NO: 36456 - protein, 14 aa, BK virus
ASHISRFPQVRSSF

SEQ ID NO: 36457 - protein, 14 aa, BK virus
SHISRFPQVRSSFK

SEQ ID NO: 36458 - protein, 14 aa, BK virus
HISRFPQVRSSFKL

SEQ ID NO: 36459 - protein, 14 aa, BK virus
ISRFPQVRSSFKLG

SEQ ID NO: 36460 - protein, 14 aa, BK virus
SRFPQVRSSFKLGR

SEQ ID NO: 36461 - protein, 14 aa, BK virus
RFPQVRSSFKLGRG

SEQ ID NO: 36462 - protein, 14 aa, BK virus
FPQVRSSFKLGRGI

SEQ ID NO: 36463 - protein, 14 aa, BK virus
PQVRSSFKLGRGIL

SEQ ID NO: 36464 - protein, 14 aa, BK virus
QVRSSFKLGRGILA

SEQ ID NO: 36465 - protein, 14 aa, BK virus
VRSSFKLGRGILAV

SEQ ID NO: 36466 - protein, 14 aa, BK virus
RSSFKLGRGILAVL

SEQ ID NO: 36467 - protein, 14 aa, BK virus
QGSIFLSGLSLLKS

SEQ ID NO: 36468 - protein, 14 aa, BK virus
GSIFLSGLSLLKSF

SEQ ID NO: 36469 - protein, 14 aa, BK virus
SIFLSGLSLLKSFS

SEQ ID NO: 36470 - protein, 14 aa, BK virus
IFLSGLSLLKSFSA

SEQ ID NO: 36471 - protein, 14 aa, BK virus
FLSGLSLLKSFSAL

SEQ ID NO: 36472 - protein, 14 aa, BK virus
LSGLSLLKSFSALS

SEQ ID NO: 36473 - protein, 14 aa, BK virus
SGLSLLKSFSALSF

SEQ ID NO: 36474 - protein, 14 aa, BK virus
GLSLLKSFSALSFR

SEQ ID NO: 36475 - protein, 14 aa, BK virus
LSLLKSFSALSFRL

SEQ ID NO: 36476 - protein, 14 aa, BK virus
SLLKSFSALSFRLK

SEQ ID NO: 36477 - protein, 14 aa, BK virus
LLKSFSALSFRLKP

SEQ ID NO: 36478 - protein, 14 aa, BK virus
LKSFSALSFRLKPL

SEQ ID NO: 36479 - protein, 14 aa, BK virus
KSFSALSFRLKPLR

SEQ ID NO: 36480 - protein, 14 aa, BK virus
SFSALSFRLKPLRF

SEQ ID NO: 36481 - protein, 14 aa, BK virus
FSALSFRLKPLRFS

SEQ ID NO: 36482 - protein, 14 aa, BK virus
SALSFRLKPLRFSS

SEQ ID NO: 36483 - protein, 14 aa, BK virus
ALSFRLKPLRFSSG

SEQ ID NO: 36484 - protein, 14 aa, BK virus
LSFRLKPLRFSSGS

SEQ ID NO: 36485 - protein, 14 aa, BK virus
SFRLKPLRFSSGSP

SEQ ID NO: 36486 - protein, 14 aa, BK virus
FRLKPLRFSSGSPI

SEQ ID NO: 36487 - protein, 14 aa, BK virus
RLKPLRFSSGSPIS

SEQ ID NO: 36488 - protein, 14 aa, BK virus
LKPLRFSSGSPISG

SEQ ID NO: 36489 - protein, 14 aa, BK virus
KPLRFSSGSPISGF

SEQ ID NO: 36490 - protein, 14 aa, BK virus
PLRFSSGSPISGFR

SEQ ID NO: 36491 - protein, 14 aa, BK virus
LRFSSGSPISGFRK

SEQ ID NO: 36492 - protein, 14 aa, BK virus
RFSSGSPISGFRKH

SEQ ID NO: 36493 - protein, 14 aa, BK virus
FSSGSPISGFRKHS

SEQ ID NO: 36494 - protein, 14 aa, BK virus
SSGSPISGFRKHST

SEQ ID NO: 36495 - protein, 14 aa, BK virus
SGSPISGFRKHSTS

SEQ ID NO: 36496 - protein, 14 aa, BK virus
GSPISGFRKHSTSV

SEQ ID NO: 36497 - protein, 14 aa, BK virus
SPISGFRKHSTSVI

SEQ ID NO: 36498 - protein, 14 aa, BK virus
PISGFRKHSTSVIA

SEQ ID NO: 36499 - protein, 14 aa, BK virus
ISGFRKHSTSVIAS

SEQ ID NO: 36500 - protein, 14 aa, BK virus
SGFRKHSTSVIAST

SEQ ID NO: 36501 - protein, 14 aa, BK virus
GFRKHSTSVIASTP

SEQ ID NO: 36502 - protein, 14 aa, BK virus
FRKHSTSVIASTPV

SEQ ID NO: 36503 - protein, 14 aa, BK virus
RKHSTSVIASTPVL

SEQ ID NO: 36504 - protein, 14 aa, BK virus
KHSTSVIASTPVLT

SEQ ID NO: 36505 - protein, 14 aa, BK virus
HSTSVIASTPVLTS

SEQ ID NO: 36506 - protein, 14 aa, BK virus
STSVIASTPVLTSR

SEQ ID NO: 36507 - protein, 14 aa, BK virus
TSVIASTPVLTSRT

SEQ ID NO: 36508 - protein, 14 aa, BK virus
SVIASTPVLTSRTS

SEQ ID NO: 36509 - protein, 14 aa, BK virus
VIASTPVLTSRTST

SEQ ID NO: 36510 - protein, 14 aa, BK virus
IASTPVLTSRTSTP

SEQ ID NO: 36511 - protein, 14 aa, BK virus
ASTPVLTSRTSTPP

SEQ ID NO: 36512 - protein, 14 aa, BK virus
STPVLTSRTSTPPF

SEQ ID NO: 36513 - protein, 14 aa, BK virus
TPVLTSRTSTPPFI

SEQ ID NO: 36514 - protein, 14 aa, BK virus
PVLTSRTSTPPFIS

SEQ ID NO: 36515 - protein, 14 aa, BK virus
VLTSRTSTPPFISS

SEQ ID NO: 36516 - protein, 14 aa, BK virus
LTSRTSTPPFISSF

SEQ ID NO: 36517 - protein, 14 aa, BK virus
TSRTSTPPFISSFG

SEQ ID NO: 36518 - protein, 14 aa, BK virus
SRTSTPPFISSFGT

SEQ ID NO: 36519 - protein, 14 aa, BK virus
RTSTPPFISSFGTC

SEQ ID NO: 36520 - protein, 14 aa, BK virus
TSTPPFISSFGTCT

SEQ ID NO: 36521 - protein, 14 aa, BK virus
STPPFISSFGTCTG

SEQ ID NO: 36522 - protein, 14 aa, BK virus
TPPFISSFGTCTGS

SEQ ID NO: 36523 - protein, 14 aa, BK virus
PPFISSFGTCTGSF

SEQ ID NO: 36524 - protein, 14 aa, BK virus
PFISSFGTCTGSFG

SEQ ID NO: 36525 - protein, 14 aa, BK virus
FISSFGTCTGSFGF

SEQ ID NO: 36526 - protein, 14 aa, BK virus
ISSFGTCTGSFGFL

SEQ ID NO: 36527 - protein, 14 aa, BK virus
SSFGTCTGSFGFLG

SEQ ID NO: 36528 - protein, 14 aa, BK virus
SFGTCTGSFGFLGA

SEQ ID NO: 36529 - protein, 14 aa, BK virus
FGTCTGSFGFLGAA

SEQ ID NO: 36530 - protein, 14 aa, BK virus
GTCTGSFGFLGAAP

SEQ ID NO: 36531 - protein, 14 aa, BK virus
TCTGSFGFLGAAPG

SEQ ID NO: 36532 - protein, 14 aa, BK virus
CTGSFGFLGAAPGH

SEQ ID NO: 36533 - protein, 14 aa, BK virus
TGSFGFLGAAPGHS

SEQ ID NO: 36534 - protein, 14 aa, BK virus
GSFGFLGAAPGHSP

SEQ ID NO: 36535 - protein, 14 aa, BK virus
SFGFLGAAPGHSPF

SEQ ID NO: 36536 - protein, 14 aa, BK virus
FGFLGAAPGHSPFL

SEQ ID NO: 36537 - protein, 14 aa, BK virus
GFLGAAPGHSPFLL

SEQ ID NO: 36538 - protein, 14 aa, BK virus
FLGAAPGHSPFLLV

SEQ ID NO: 36539 - protein, 14 aa, BK virus
LGAAPGHSPFLLVG

SEQ ID NO: 36540 - protein, 14 aa, BK virus
GAAPGHSPFLLVGA

SEQ ID NO: 36541 - protein, 14 aa, BK virus
AAPGHSPFLLVGAI

SEQ ID NO: 36542 - protein, 14 aa, BK virus
APGHSPFLLVGAIF

SEQ ID NO: 36543 - protein, 14 aa, BK virus
PGHSPFLLVGAIFI

SEQ ID NO: 36544 - protein, 14 aa, BK virus
GHSPFLLVGAIFIC

SEQ ID NO: 36545 - protein, 14 aa, BK virus
HSPFLLVGAIFICF

SEQ ID NO: 36546 - protein, 14 aa, BK virus
SPFLLVGAIFICFK

SEQ ID NO: 36547 - protein, 14 aa, BK virus
PFLLVGAIFICFKS

SEQ ID NO: 36548 - protein, 14 aa, BK virus
FLLVGAIFICFKSR

SEQ ID NO: 36549 - protein, 14 aa, BK virus
LLVGAIFICFKSRC

SEQ ID NO: 36550 - protein, 14 aa, BK virus
LVGAIFICFKSRCY

SEQ ID NO: 36551 - protein, 14 aa, BK virus
VGAIFICFKSRCYS

SEQ ID NO: 36552 - protein, 14 aa, BK virus
GAIFICFKSRCYSP

SEQ ID NO: 36553 - protein, 14 aa, BK virus
AIFICFKSRCYSPV

SEQ ID NO: 36554 - protein, 14 aa, BK virus
IFICFKSRCYSPVQ

SEQ ID NO: 36555 - protein, 14 aa, BK virus
FICFKSRCYSPVQA

SEQ ID NO: 36556 - protein, 14 aa, BK virus
RQHPLRSSSLISTS

SEQ ID NO: 36557 - protein, 14 aa, BK virus
QHPLRSSSLISTSW

SEQ ID NO: 36558 - protein, 14 aa, BK virus
HPLRSSSLISTSWG

SEQ ID NO: 36559 - protein, 14 aa, BK virus
PLRSSSLISTSWGN

SEQ ID NO: 36560 - protein, 14 aa, BK virus
LRSSSLISTSWGNS

SEQ ID NO: 36561 - protein, 14 aa, BK virus
RSSSLISTSWGNSF

SEQ ID NO: 36562 - protein, 14 aa, BK virus
SSSLISTSWGNSFF

SEQ ID NO: 36563 - protein, 14 aa, BK virus
SSLISTSWGNSFFY

SEQ ID NO: 36564 - protein, 14 aa, BK virus
SLISTSWGNSFFYK

SEQ ID NO: 36565 - protein, 14 aa, BK virus
LISTSWGNSFFYKL

SEQ ID NO: 36566 - protein, 14 aa, BK virus
ISTSWGNSFFYKLS

SEQ ID NO: 36567 - protein, 14 aa, BK virus
VHSLCNFFYTVSII

SEQ ID NO: 36568 - protein, 14 aa, BK virus
HSLCNFFYTVSIIY

SEQ ID NO: 36569 - protein, 14 aa, BK virus
SLCNFFYTVSIIYT

SEQ ID NO: 36570 - protein, 14 aa, BK virus
LCNFFYTVSIIYTI

SEQ ID NO: 36571 - protein, 14 aa, BK virus
CNFFYTVSIIYTIS

SEQ ID NO: 36572 - protein, 14 aa, BK virus
NFFYTVSIIYTISM

SEQ ID NO: 36573 - protein, 14 aa, BK virus
FFYTVSIIYTISMA

SEQ ID NO: 36574 - protein, 14 aa, BK virus
FYTVSIIYTISMAK

SEQ ID NO: 36575 - protein, 14 aa, BK virus
YTVSIIYTISMAKM

SEQ ID NO: 36576 - protein, 14 aa, BK virus
TVSIIYTISMAKMY

SEQ ID NO: 36577 - protein, 14 aa, BK virus
VSIIYTISMAKMYT

SEQ ID NO: 36578 - protein, 14 aa, BK virus
SIIYTISMAKMYTG

SEQ ID NO: 36579 - protein, 14 aa, BK virus
IIYTISMAKMYTGT

SEQ ID NO: 36580 - protein, 14 aa, BK virus
IYTISMAKMYTGTF

SEQ ID NO: 36581 - protein, 14 aa, BK virus
YTISMAKMYTGTFP

SEQ ID NO: 36582 - protein, 14 aa, BK virus
TISMAKMYTGTFPF

SEQ ID NO: 36583 - protein, 14 aa, BK virus
ISMAKMYTGTFPFS

SEQ ID NO: 36584 - protein, 14 aa, BK virus
SMAKMYTGTFPFSY

SEQ ID NO: 36585 - protein, 14 aa, BK virus
MAKMYTGTFPFSYL

SEQ ID NO: 36586 - protein, 14 aa, BK virus
AKMYTGTFPFSYLS

SEQ ID NO: 36587 - protein, 14 aa, BK virus
KMYTGTFPFSYLSN

SEQ ID NO: 36588 - protein, 14 aa, BK virus
MYTGTFPFSYLSNH

SEQ ID NO: 36589 - protein, 14 aa, BK virus
GPNRGKIRIILLNI

SEQ ID NO: 36590 - protein, 14 aa, BK virus
PNRGKIRIILLNII

SEQ ID NO: 36591 - protein, 14 aa, BK virus
NRGKIRIILLNIII

SEQ ID NO: 36592 - protein, 14 aa, BK virus
RGKIRIILLNIIIK

SEQ ID NO: 36593 - protein, 14 aa, BK virus
GKIRIILLNIIIKV

SEQ ID NO: 36594 - protein, 14 aa, BK virus
KIRIILLNIIIKVY

SEQ ID NO: 36595 - protein, 14 aa, BK virus
IRIILLNIIIKVYR

SEQ ID NO: 36596 - protein, 14 aa, BK virus
RIILLNIIIKVYRG

SEQ ID NO: 36597 - protein, 14 aa, BK virus
IILLNIIIKVYRGI

SEQ ID NO: 36598 - protein, 14 aa, BK virus
ILLNIIIKVYRGIY

SEQ ID NO: 36599 - protein, 14 aa, BK virus
LLNIIIKVYRGIYN

SEQ ID NO: 36600 - protein, 14 aa, BK virus
LNIIIKVYRGIYNC

SEQ ID NO: 36601 - protein, 14 aa, BK virus
NIIIKVYRGIYNCP

SEQ ID NO: 36602 - protein, 14 aa, BK virus
IIIKVYRGIYNCPG

SEQ ID NO: 36603 - protein, 14 aa, BK virus
IIKVYRGIYNCPGS

SEQ ID NO: 36604 - protein, 14 aa, BK virus
IKVYRGIYNCPGSF

SEQ ID NO: 36605 - protein, 14 aa, BK virus
KVYRGIYNCPGSFL

SEQ ID NO: 36606 - protein, 14 aa, BK virus
VYRGIYNCPGSFLQ

SEQ ID NO: 36607 - protein, 14 aa, BK virus
YRGIYNCPGSFLQK

SEQ ID NO: 36608 - protein, 14 aa, BK virus
RGIYNCPGSFLQKS

SEQ ID NO: 36609 - protein, 14 aa, BK virus
GIYNCPGSFLQKSS

SEQ ID NO: 36610 - protein, 14 aa, BK virus
IYNCPGSFLQKSSQ

SEQ ID NO: 36611 - protein, 14 aa, BK virus
YNCPGSFLQKSSQG

SEQ ID NO: 36612 - protein, 14 aa, BK virus
NCPGSFLQKSSQGV

SEQ ID NO: 36613 - protein, 14 aa, BK virus
CPGSFLQKSSQGVS

SEQ ID NO: 36614 - protein, 14 aa, BK virus
PGSFLQKSSQGVSK

SEQ ID NO: 36615 - protein, 14 aa, BK virus
GSFLQKSSQGVSKK

SEQ ID NO: 36616 - protein, 14 aa, BK virus
SFLQKSSQGVSKKS

SEQ ID NO: 36617 - protein, 14 aa, BK virus
FLQKSSQGVSKKSF

SEQ ID NO: 36618 - protein, 14 aa, BK virus
LQKSSQGVSKKSFC

SEQ ID NO: 36619 - protein, 14 aa, BK virus
QKSSQGVSKKSFCS

SEQ ID NO: 36620 - protein, 14 aa, BK virus
KSSQGVSKKSFCSS

SEQ ID NO: 36621 - protein, 14 aa, BK virus
SSQGVSKKSFCSSL

SEQ ID NO: 36622 - protein, 14 aa, BK virus
SQGVSKKSFCSSLQ

SEQ ID NO: 36623 - protein, 14 aa, BK virus
QGVSKKSFCSSLQF

SEQ ID NO: 36624 - protein, 14 aa, BK virus
GVSKKSFCSSLQFL

SEQ ID NO: 36625 - protein, 14 aa, BK virus
GYRRYIIPNNMPQS

SEQ ID NO: 36626 - protein, 14 aa, BK virus
YRRYIIPNNMPQSL

SEQ ID NO: 36627 - protein, 14 aa, BK virus
RRYIIPNNMPQSLG

SEQ ID NO: 36628 - protein, 14 aa, BK virus
RYIIPNNMPQSLGN

SEQ ID NO: 36629 - protein, 14 aa, BK virus
YIIPNNMPQSLGNS

SEQ ID NO: 36630 - protein, 14 aa, BK virus
IIPNNMPQSLGNSS

SEQ ID NO: 36631 - protein, 14 aa, BK virus
IPNNMPQSLGNSSK

SEQ ID NO: 36632 - protein, 14 aa, BK virus
PNNMPQSLGNSSKQ

SEQ ID NO: 36633 - protein, 14 aa, BK virus
NNMPQSLGNSSKQR

SEQ ID NO: 36634 - protein, 14 aa, BK virus
NMPQSLGNSSKQRR

SEQ ID NO: 36635 - protein, 14 aa, BK virus
MPQSLGNSSKQRRT

SEQ ID NO: 36636 - protein, 14 aa, BK virus
PQSLGNSSKQRRTP

SEQ ID NO: 36637 - protein, 14 aa, BK virus
QSLGNSSKQRRTPM

SEQ ID NO: 36638 - protein, 14 aa, BK virus
SLGNSSKQRRTPMP

SEQ ID NO: 36639 - protein, 14 aa, BK virus
LGNSSKQRRTPMPR

SEQ ID NO: 36640 - protein, 14 aa, BK virus
GNSSKQRRTPMPRI

SEQ ID NO: 36641 - protein, 14 aa, BK virus
NSSKQRRTPMPRIK

SEQ ID NO: 36642 - protein, 14 aa, BK virus
SSKQRRTPMPRIKV

SEQ ID NO: 36643 - protein, 14 aa, BK virus
SKQRRTPMPRIKVL

SEQ ID NO: 36644 - protein, 14 aa, BK virus
KQRRTPMPRIKVLN

SEQ ID NO: 36645 - protein, 14 aa, BK virus
QRRTPMPRIKVLNI

SEQ ID NO: 36646 - protein, 14 aa, BK virus
RRTPMPRIKVLNII

SEQ ID NO: 36647 - protein, 14 aa, BK virus
RTPMPRIKVLNIIN

SEQ ID NO: 36648 - protein, 14 aa, BK virus
TPMPRIKVLNIINK

SEQ ID NO: 36649 - protein, 14 aa, BK virus
PMPRIKVLNIINKS

SEQ ID NO: 36650 - protein, 14 aa, BK virus
MPRIKVLNIINKSI

SEQ ID NO: 36651 - protein, 14 aa, BK virus
PRIKVLNIINKSIY

SEQ ID NO: 36652 - protein, 14 aa, BK virus
RIKVLNIINKSIYT

SEQ ID NO: 36653 - protein, 14 aa, BK virus
IKVLNIINKSIYTR

SEQ ID NO: 36654 - protein, 14 aa, BK virus
KVLNIINKSIYTRK

SEQ ID NO: 36655 - protein, 14 aa, BK virus
VLNIINKSIYTRKQ

SEQ ID NO: 36656 - protein, 14 aa, BK virus
LNIINKSIYTRKQN

SEQ ID NO: 36657 - protein, 14 aa, BK virus
NIINKSIYTRKQNI

SEQ ID NO: 36658 - protein, 14 aa, BK virus
IINKSIYTRKQNII

SEQ ID NO: 36659 - protein, 14 aa, BK virus
INKSIYTRKQNIIV

SEQ ID NO: 36660 - protein, 14 aa, BK virus
NKSIYTRKQNIIVL

SEQ ID NO: 36661 - protein, 14 aa, BK virus
KSIYTRKQNIIVLI

SEQ ID NO: 36662 - protein, 14 aa, BK virus
SIYTRKQNIIVLIW

SEQ ID NO: 36663 - protein, 14 aa, BK virus
IYTRKQNIIVLIWV

SEQ ID NO: 36664 - protein, 14 aa, BK virus
YTRKQNIIVLIWVK

SEQ ID NO: 36665 - protein, 14 aa, BK virus
TRKQNIIVLIWVKQ

SEQ ID NO: 36666 - protein, 14 aa, BK virus
RKQNIIVLIWVKQF

SEQ ID NO: 36667 - protein, 14 aa, BK virus
KQNIIVLIWVKQFQ

SEQ ID NO: 36668 - protein, 14 aa, BK virus
QNIIVLIWVKQFQS

SEQ ID NO: 36669 - protein, 14 aa, BK virus
NIIVLIWVKQFQSH

SEQ ID NO: 36670 - protein, 14 aa, BK virus
IIVLIWVKQFQSHA

SEQ ID NO: 36671 - protein, 14 aa, BK virus
LLIEAYSGNFVIPI

SEQ ID NO: 36672 - protein, 14 aa, BK virus
LIEAYSGNFVIPII

SEQ ID NO: 36673 - protein, 14 aa, BK virus
IEAYSGNFVIPIIK

SEQ ID NO: 36674 - protein, 14 aa, BK virus
EAYSGNFVIPIIKE

SEQ ID NO: 36675 - protein, 14 aa, BK virus
AYSGNFVIPIIKEL

SEQ ID NO: 36676 - protein, 14 aa, BK virus
YSGNFVIPIIKELI

SEQ ID NO: 36677 - protein, 14 aa, BK virus
SGNFVIPIIKELIP

SEQ ID NO: 36678 - protein, 14 aa, BK virus
GNFVIPIIKELIPY

SEQ ID NO: 36679 - protein, 14 aa, BK virus
NFVIPIIKELIPYL

SEQ ID NO: 36680 - protein, 14 aa, BK virus
FVIPIIKELIPYLS

SEQ ID NO: 36681 - protein, 14 aa, BK virus
SSKPSNSPRSTSNY

SEQ ID NO: 36682 - protein, 14 aa, BK virus
SKPSNSPRSTSNYS

SEQ ID NO: 36683 - protein, 14 aa, BK virus
KPSNSPRSTSNYSI

SEQ ID NO: 36684 - protein, 14 aa, BK virus
PSNSPRSTSNYSIC

SEQ ID NO: 36685 - protein, 14 aa, BK virus
SNSPRSTSNYSICL

SEQ ID NO: 36686 - protein, 14 aa, BK virus
NSPRSTSNYSICLR

SEQ ID NO: 36687 - protein, 14 aa, BK virus
SPRSTSNYSICLRS

SEQ ID NO: 36688 - protein, 14 aa, BK virus
GTCYALYSSKGCNL

SEQ ID NO: 36689 - protein, 14 aa, BK virus
TCYALYSSKGCNLN

SEQ ID NO: 36690 - protein, 14 aa, BK virus
CYALYSSKGCNLNF

SEQ ID NO: 36691 - protein, 14 aa, BK virus
YALYSSKGCNLNFY

SEQ ID NO: 36692 - protein, 14 aa, BK virus
ALYSSKGCNLNFYS

SEQ ID NO: 36693 - protein, 14 aa, BK virus
LYSSKGCNLNFYSS

SEQ ID NO: 36694 - protein, 14 aa, BK virus
YSSKGCNLNFYSSS

SEQ ID NO: 36695 - protein, 14 aa, BK virus
SSKGCNLNFYSSSS

SEQ ID NO: 36696 - protein, 14 aa, BK virus
SKGCNLNFYSSSSL

SEQ ID NO: 36697 - protein, 14 aa, BK virus
KGCNLNFYSSSSLP

SEQ ID NO: 36698 - protein, 14 aa, BK virus
GCNLNFYSSSSLPS

SEQ ID NO: 36699 - protein, 14 aa, BK virus
CNLNFYSSSSLPSS

SEQ ID NO: 36700 - protein, 14 aa, BK virus
NLNFYSSSSLPSSN

SEQ ID NO: 36701 - protein, 14 aa, BK virus
LNFYSSSSLPSSNF

SEQ ID NO: 36702 - protein, 14 aa, BK virus
NFYSSSSLPSSNFS

SEQ ID NO: 36703 - protein, 14 aa, BK virus
FYSSSSLPSSNFSH

SEQ ID NO: 36704 - protein, 14 aa, BK virus
SSTHEPGNTKKKGL

SEQ ID NO: 36705 - protein, 14 aa, BK virus
STHEPGNTKKKGLL

SEQ ID NO: 36706 - protein, 14 aa, BK virus
THEPGNTKKKGLLT

SEQ ID NO: 36707 - protein, 14 aa, BK virus
ESFTESFTAGKAVV

SEQ ID NO: 36708 - protein, 14 aa, BK virus
SFTESFTAGKAVVL

SEQ ID NO: 36709 - protein, 14 aa, BK virus
FTESFTAGKAVVLL

SEQ ID NO: 36710 - protein, 14 aa, BK virus
TESFTAGKAVVLLF

SEQ ID NO: 36711 - protein, 14 aa, BK virus
ESFTAGKAVVLLFF

SEQ ID NO: 36712 - protein, 14 aa, BK virus
SFTAGKAVVLLFFP

SEQ ID NO: 36713 - protein, 14 aa, BK virus
FTAGKAVVLLFFPS

SEQ ID NO: 36714 - protein, 14 aa, BK virus
TAGKAVVLLFFPST

SEQ ID NO: 36715 - protein, 14 aa, BK virus
AGKAVVLLFFPSTL

SEQ ID NO: 36716 - protein, 14 aa, BK virus
GKAVVLLFFPSTLS

SEQ ID NO: 36717 - protein, 14 aa, BK virus
KAVVLLFFPSTLSS

SEQ ID NO: 36718 - protein, 14 aa, BK virus
AVVLLFFPSTLSSP

SEQ ID NO: 36719 - protein, 14 aa, BK virus
VVLLFFPSTLSSPL

SEQ ID NO: 36720 - protein, 14 aa, BK virus
VLLFFPSTLSSPLQ

SEQ ID NO: 36721 - protein, 14 aa, BK virus
LLFFPSTLSSPLQN

SEQ ID NO: 36722 - protein, 14 aa, BK virus
LFFPSTLSSPLQNS

SEQ ID NO: 36723 - protein, 14 aa, BK virus
FFPSTLSSPLQNSS

SEQ ID NO: 36724 - protein, 14 aa, BK virus
FPSTLSSPLQNSSK

SEQ ID NO: 36725 - protein, 14 aa, BK virus
PSTLSSPLQNSSKS

SEQ ID NO: 36726 - protein, 14 aa, BK virus
STLSSPLQNSSKSS

SEQ ID NO: 36727 - protein, 14 aa, BK virus
TLSSPLQNSSKSSK

SEQ ID NO: 36728 - protein, 14 aa, BK virus
LSSPLQNSSKSSKI

SEQ ID NO: 36729 - protein, 14 aa, BK virus
SSPLQNSSKSSKIK

SEQ ID NO: 36730 - protein, 14 aa, BK virus
SPLQNSSKSSKIKI

SEQ ID NO: 36731 - protein, 14 aa, BK virus
PLQNSSKSSKIKIK

SEQ ID NO: 36732 - protein, 14 aa, BK virus
LQNSSKSSKIKIKI

SEQ ID NO: 36733 - protein, 14 aa, BK virus
QNSSKSSKIKIKIL

SEQ ID NO: 36734 - protein, 14 aa, BK virus
ALFFVPVQVLPTFT

SEQ ID NO: 36735 - protein, 14 aa, BK virus
LFFVPVQVLPTFTE

SEQ ID NO: 36736 - protein, 14 aa, BK virus
FFVPVQVLPTFTEA

SEQ ID NO: 36737 - protein, 14 aa, BK virus
FVPVQVLPTFTEAC

SEQ ID NO: 36738 - protein, 14 aa, BK virus
VPVQVLPTFTEACR

SEQ ID NO: 36739 - protein, 14 aa, BK virus
PVQVLPTFTEACRD

SEQ ID NO: 36740 - protein, 14 aa, BK virus
VQVLPTFTEACRDS

SEQ ID NO: 36741 - protein, 14 aa, BK virus
QVLPTFTEACRDSW

SEQ ID NO: 36742 - protein, 14 aa, BK virus
VLPTFTEACRDSWR

SEQ ID NO: 36743 - protein, 14 aa, BK virus
LPTFTEACRDSWRR

SEQ ID NO: 36744 - protein, 14 aa, BK virus
PTFTEACRDSWRRT

SEQ ID NO: 36745 - protein, 14 aa, BK virus
TFTEACRDSWRRTM

SEQ ID NO: 36746 - protein, 14 aa, BK virus
FTEACRDSWRRTMA

SEQ ID NO: 36747 - protein, 14 aa, BK virus
TEACRDSWRRTMAF

SEQ ID NO: 36748 - protein, 14 aa, BK virus
EACRDSWRRTMAFV

SEQ ID NO: 36749 - protein, 14 aa, BK virus
ACRDSWRRTMAFVQ

SEQ ID NO: 36750 - protein, 14 aa, BK virus
CRDSWRRTMAFVQF

SEQ ID NO: 36751 - protein, 14 aa, BK virus
RDSWRRTMAFVQFN

SEQ ID NO: 36752 - protein, 14 aa, BK virus
DSWRRTMAFVQFNW

SEQ ID NO: 36753 - protein, 14 aa, BK virus
SWRRTMAFVQFNWG

SEQ ID NO: 36754 - protein, 14 aa, BK virus
WRRTMAFVQFNWGQ

SEQ ID NO: 36755 - protein, 14 aa, BK virus
RRTMAFVQFNWGQG

SEQ ID NO: 36756 - protein, 14 aa, BK virus
RTMAFVQFNWGQGQ

SEQ ID NO: 36757 - protein, 14 aa, BK virus
TMAFVQFNWGQGQD

SEQ ID NO: 36758 - protein, 14 aa, BK virus
MAFVQFNWGQGQDS

SEQ ID NO: 36759 - protein, 14 aa, BK virus
ARKTCLSCTFLPEV

SEQ ID NO: 36760 - protein, 14 aa, BK virus
RKTCLSCTFLPEVM

SEQ ID NO: 36761 - protein, 14 aa, BK virus
KTCLSCTFLPEVMV

SEQ ID NO: 36762 - protein, 14 aa, BK virus
TCLSCTFLPEVMVW

SEQ ID NO: 36763 - protein, 14 aa, BK virus
CLSCTFLPEVMVWL

SEQ ID NO: 36764 - protein, 14 aa, BK virus
LSCTFLPEVMVWLH

SEQ ID NO: 36765 - protein, 14 aa, BK virus
SCTFLPEVMVWLHS

SEQ ID NO: 36766 - protein, 14 aa, BK virus
CTFLPEVMVWLHSM

SEQ ID NO: 36767 - protein, 14 aa, BK virus
TFLPEVMVWLHSMG

SEQ ID NO: 36768 - protein, 14 aa, BK virus
FLPEVMVWLHSMGK

SEQ ID NO: 36769 - protein, 14 aa, BK virus
LPEVMVWLHSMGKQ

SEQ ID NO: 36770 - protein, 14 aa, BK virus
PEVMVWLHSMGKQL

SEQ ID NO: 36771 - protein, 14 aa, BK virus
EVMVWLHSMGKQLL

SEQ ID NO: 36772 - protein, 14 aa, BK virus
VMVWLHSMGKQLLP

SEQ ID NO: 36773 - protein, 14 aa, BK virus
MVWLHSMGKQLLPV

SEQ ID NO: 36774 - protein, 14 aa, BK virus
VWLHSMGKQLLPVS

SEQ ID NO: 36775 - protein, 14 aa, BK virus
WLHSMGKQLLPVSH

SEQ ID NO: 36776 - protein, 14 aa, BK virus
LHSMGKQLLPVSHA

SEQ ID NO: 36777 - protein, 14 aa, BK virus
HSMGKQLLPVSHAL

SEQ ID NO: 36778 - protein, 14 aa, BK virus
SMGKQLLPVSHALS

SEQ ID NO: 36779 - protein, 14 aa, BK virus
MGKQLLPVSHALSF

SEQ ID NO: 36780 - protein, 14 aa, BK virus
GKQLLPVSHALSFL

SEQ ID NO: 36781 - protein, 14 aa, BK virus
KQLLPVSHALSFLR

SEQ ID NO: 36782 - protein, 14 aa, BK virus
QLLPVSHALSFLRS

SEQ ID NO: 36783 - protein, 14 aa, BK virus
LLPVSHALSFLRSW

SEQ ID NO: 36784 - protein, 14 aa, BK virus
LPVSHALSFLRSWF

SEQ ID NO: 36785 - protein, 14 aa, BK virus
PVSHALSFLRSWFG

SEQ ID NO: 36786 - protein, 14 aa, BK virus
VSHALSFLRSWFGC

SEQ ID NO: 36787 - protein, 14 aa, BK virus
SHALSFLRSWFGCI

SEQ ID NO: 36788 - protein, 14 aa, BK virus
HALSFLRSWFGCIP

SEQ ID NO: 36789 - protein, 14 aa, BK virus
ALSFLRSWFGCIPL

SEQ ID NO: 36790 - protein, 14 aa, BK virus
GLAKLFGEIPILLQ

SEQ ID NO: 36791 - protein, 14 aa, BK virus
LAKLFGEIPILLQF

SEQ ID NO: 36792 - protein, 14 aa, BK virus
AKLFGEIPILLQFL

SEQ ID NO: 36793 - protein, 14 aa, BK virus
KLFGEIPILLQFLQ

SEQ ID NO: 36794 - protein, 15 aa, BK virus
MDKVLNREESMELMD

SEQ ID NO: 36795 - protein, 15 aa, BK virus
DKVLNREESMELMDL

SEQ ID NO: 36796 - protein, 15 aa, BK virus
KVLNREESMELMDLL

SEQ ID NO: 36797 - protein, 15 aa, BK virus
VLNREESMELMDLLG

SEQ ID NO: 36798 - protein, 15 aa, BK virus
LNREESMELMDLLGL

SEQ ID NO: 36799 - protein, 15 aa, BK virus
NREESMELMDLLGLE

SEQ ID NO: 36800 - protein, 15 aa, BK virus
REESMELMDLLGLER

SEQ ID NO: 36801 - protein, 15 aa, BK virus
EESMELMDLLGLERA

SEQ ID NO: 36802 - protein, 15 aa, BK virus
ESMELMDLLGLERAA

SEQ ID NO: 36803 - protein, 15 aa, BK virus
SMELMDLLGLERAAW

SEQ ID NO: 36804 - protein, 15 aa, BK virus
MELMDLLGLERAAWG

SEQ ID NO: 36805 - protein, 15 aa, BK virus
ELMDLLGLERAAWGN

SEQ ID NO: 36806 - protein, 15 aa, BK virus
LMDLLGLERAAWGNL

SEQ ID NO: 36807 - protein, 15 aa, BK virus
MDLLGLERAAWGNLP

SEQ ID NO: 36808 - protein, 15 aa, BK virus
DLLGLERAAWGNLPL

SEQ ID NO: 36809 - protein, 15 aa, BK virus
LLGLERAAWGNLPLM

SEQ ID NO: 36810 - protein, 15 aa, BK virus
LGLERAAWGNLPLMR

SEQ ID NO: 36811 - protein, 15 aa, BK virus
GLERAAWGNLPLMRK

SEQ ID NO: 36812 - protein, 15 aa, BK virus
LERAAWGNLPLMRKA

SEQ ID NO: 36813 - protein, 15 aa, BK virus
ERAAWGNLPLMRKAY

SEQ ID NO: 36814 - protein, 15 aa, BK virus
RAAWGNLPLMRKAYL

SEQ ID NO: 36815 - protein, 15 aa, BK virus
AAWGNLPLMRKAYLR

SEQ ID NO: 36816 - protein, 15 aa, BK virus
AWGNLPLMRKAYLRK

SEQ ID NO: 36817 - protein, 15 aa, BK virus
WGNLPLMRKAYLRKC

SEQ ID NO: 36818 - protein, 15 aa, BK virus
GNLPLMRKAYLRKCK

SEQ ID NO: 36819 - protein, 15 aa, BK virus
NLPLMRKAYLRKCKE

SEQ ID NO: 36820 - protein, 15 aa, BK virus
LPLMRKAYLRKCKEF

SEQ ID NO: 36821 - protein, 15 aa, BK virus
PLMRKAYLRKCKEFH

SEQ ID NO: 36822 - protein, 15 aa, BK virus
LMRKAYLRKCKEFHP

SEQ ID NO: 36823 - protein, 15 aa, BK virus
MRKAYLRKCKEFHPD

SEQ ID NO: 36824 - protein, 15 aa, BK virus
RKAYLRKCKEFHPDK

SEQ ID NO: 36825 - protein, 15 aa, BK virus
KAYLRKCKEFHPDKG

SEQ ID NO: 36826 - protein, 15 aa, BK virus
AYLRKCKEFHPDKGG

SEQ ID NO: 36827 - protein, 15 aa, BK virus
YLRKCKEFHPDKGGD

SEQ ID NO: 36828 - protein, 15 aa, BK virus
LRKCKEFHPDKGGDE

SEQ ID NO: 36829 - protein, 15 aa, BK virus
RKCKEFHPDKGGDED

SEQ ID NO: 36830 - protein, 15 aa, BK virus
KCKEFHPDKGGDEDK

SEQ ID NO: 36831 - protein, 15 aa, BK virus
CKEFHPDKGGDEDKM

SEQ ID NO: 36832 - protein, 15 aa, BK virus
KEFHPDKGGDEDKMK

SEQ ID NO: 36833 - protein, 15 aa, BK virus
EFHPDKGGDEDKMKR

SEQ ID NO: 36834 - protein, 15 aa, BK virus
FHPDKGGDEDKMKRM

SEQ ID NO: 36835 - protein, 15 aa, BK virus
HPDKGGDEDKMKRMN

SEQ ID NO: 36836 - protein, 15 aa, BK virus
PDKGGDEDKMKRMNT

SEQ ID NO: 36837 - protein, 15 aa, BK virus
DKGGDEDKMKRMNTL

SEQ ID NO: 36838 - protein, 15 aa, BK virus
KGGDEDKMKRMNTLY

SEQ ID NO: 36839 - protein, 15 aa, BK virus
GGDEDKMKRMNTLYK

SEQ ID NO: 36840 - protein, 15 aa, BK virus
GDEDKMKRMNTLYKK

SEQ ID NO: 36841 - protein, 15 aa, BK virus
DEDKMKRMNTLYKKM

SEQ ID NO: 36842 - protein, 15 aa, BK virus
EDKMKRMNTLYKKME

SEQ ID NO: 36843 - protein, 15 aa, BK virus
DKMKRMNTLYKKMEQ

SEQ ID NO: 36844 - protein, 15 aa, BK virus
KMKRMNTLYKKMEQD

SEQ ID NO: 36845 - protein, 15 aa, BK virus
MKRMNTLYKKMEQDV

SEQ ID NO: 36846 - protein, 15 aa, BK virus
KRMNTLYKKMEQDVK

SEQ ID NO: 36847 - protein, 15 aa, BK virus
RMNTLYKKMEQDVKV

SEQ ID NO: 36848 - protein, 15 aa, BK virus
MNTLYKKMEQDVKVA

SEQ ID NO: 36849 - protein, 15 aa, BK virus
NTLYKKMEQDVKVAH

SEQ ID NO: 36850 - protein, 15 aa, BK virus
TLYKKMEQDVKVAHQ

SEQ ID NO: 36851 - protein, 15 aa, BK virus
LYKKMEQDVKVAHQP

SEQ ID NO: 36852 - protein, 15 aa, BK virus
YKKMEQDVKVAHQPD

SEQ ID NO: 36853 - protein, 15 aa, BK virus
KKMEQDVKVAHQPDF

SEQ ID NO: 36854 - protein, 15 aa, BK virus
KMEQDVKVAHQPDFG

SEQ ID NO: 36855 - protein, 15 aa, BK virus
MEQDVKVAHQPDFGT

SEQ ID NO: 36856 - protein, 15 aa, BK virus
EQDVKVAHQPDFGTW

SEQ ID NO: 36857 - protein, 15 aa, BK virus
QDVKVAHQPDFGTWS

SEQ ID NO: 36858 - protein, 15 aa, BK virus
DVKVAHQPDFGTWSS

SEQ ID NO: 36859 - protein, 15 aa, BK virus
VKVAHQPDFGTWSSS

SEQ ID NO: 36860 - protein, 15 aa, BK virus
KVAHQPDFGTWSSSE

SEQ ID NO: 36861 - protein, 15 aa, BK virus
VAHQPDFGTWSSSEV

SEQ ID NO: 36862 - protein, 15 aa, BK virus
AHQPDFGTWSSSEVC

SEQ ID NO: 36863 - protein, 15 aa, BK virus
HQPDFGTWSSSEVCA

SEQ ID NO: 36864 - protein, 15 aa, BK virus
QPDFGTWSSSEVCAD

SEQ ID NO: 36865 - protein, 15 aa, BK virus
PDFGTWSSSEVCADF

SEQ ID NO: 36866 - protein, 15 aa, BK virus
DFGTWSSSEVCADFP

SEQ ID NO: 36867 - protein, 15 aa, BK virus
FGTWSSSEVCADFPL

SEQ ID NO: 36868 - protein, 15 aa, BK virus
GTWSSSEVCADFPLC

SEQ ID NO: 36869 - protein, 15 aa, BK virus
TWSSSEVCADFPLCP

SEQ ID NO: 36870 - protein, 15 aa, BK virus
WSSSEVCADFPLCPD

SEQ ID NO: 36871 - protein, 15 aa, BK virus
SSSEVCADFPLCPDT

SEQ ID NO: 36872 - protein, 15 aa, BK virus
SSEVCADFPLCPDTL

SEQ ID NO: 36873 - protein, 15 aa, BK virus
SEVCADFPLCPDTLY

SEQ ID NO: 36874 - protein, 15 aa, BK virus
EVCADFPLCPDTLYC

SEQ ID NO: 36875 - protein, 15 aa, BK virus
VCADFPLCPDTLYCK

SEQ ID NO: 36876 - protein, 15 aa, BK virus
CADFPLCPDTLYCKE

SEQ ID NO: 36877 - protein, 15 aa, BK virus
ADFPLCPDTLYCKEW

SEQ ID NO: 36878 - protein, 15 aa, BK virus
DFPLCPDTLYCKEWP

SEQ ID NO: 36879 - protein, 15 aa, BK virus
FPLCPDTLYCKEWPI

SEQ ID NO: 36880 - protein, 15 aa, BK virus
PLCPDTLYCKEWPIC

SEQ ID NO: 36881 - protein, 15 aa, BK virus
LCPDTLYCKEWPICS

SEQ ID NO: 36882 - protein, 15 aa, BK virus
CPDTLYCKEWPICSK

SEQ ID NO: 36883 - protein, 15 aa, BK virus
PDTLYCKEWPICSKK

SEQ ID NO: 36884 - protein, 15 aa, BK virus
DTLYCKEWPICSKKP

SEQ ID NO: 36885 - protein, 15 aa, BK virus
TLYCKEWPICSKKPS

SEQ ID NO: 36886 - protein, 15 aa, BK virus
LYCKEWPICSKKPSV

SEQ ID NO: 36887 - protein, 15 aa, BK virus
YCKEWPICSKKPSVH

SEQ ID NO: 36888 - protein, 15 aa, BK virus
CKEWPICSKKPSVHC

SEQ ID NO: 36889 - protein, 15 aa, BK virus
KEWPICSKKPSVHCP

SEQ ID NO: 36890 - protein, 15 aa, BK virus
EWPICSKKPSVHCPC

SEQ ID NO: 36891 - protein, 15 aa, BK virus
WPICSKKPSVHCPCM

SEQ ID NO: 36892 - protein, 15 aa, BK virus
PICSKKPSVHCPCML

SEQ ID NO: 36893 - protein, 15 aa, BK virus
ICSKKPSVHCPCMLC

SEQ ID NO: 36894 - protein, 15 aa, BK virus
CSKKPSVHCPCMLCQ

SEQ ID NO: 36895 - protein, 15 aa, BK virus
SKKPSVHCPCMLCQL

SEQ ID NO: 36896 - protein, 15 aa, BK virus
KKPSVHCPCMLCQLR

SEQ ID NO: 36897 - protein, 15 aa, BK virus
KPSVHCPCMLCQLRL

SEQ ID NO: 36898 - protein, 15 aa, BK virus
PSVHCPCMLCQLRLR

SEQ ID NO: 36899 - protein, 15 aa, BK virus
SVHCPCMLCQLRLRH

SEQ ID NO: 36900 - protein, 15 aa, BK virus
VHCPCMLCQLRLRHL

SEQ ID NO: 36901 - protein, 15 aa, BK virus
HCPCMLCQLRLRHLN

SEQ ID NO: 36902 - protein, 15 aa, BK virus
CPCMLCQLRLRHLNR

SEQ ID NO: 36903 - protein, 15 aa, BK virus
PCMLCQLRLRHLNRK

SEQ ID NO: 36904 - protein, 15 aa, BK virus
CMLCQLRLRHLNRKF

SEQ ID NO: 36905 - protein, 15 aa, BK virus
MLCQLRLRHLNRKFL

SEQ ID NO: 36906 - protein, 15 aa, BK virus
LCQLRLRHLNRKFLR

SEQ ID NO: 36907 - protein, 15 aa, BK virus
CQLRLRHLNRKFLRK

SEQ ID NO: 36908 - protein, 15 aa, BK virus
QLRLRHLNRKFLRKE

SEQ ID NO: 36909 - protein, 15 aa, BK virus
LRLRHLNRKFLRKEP

SEQ ID NO: 36910 - protein, 15 aa, BK virus
RLRHLNRKFLRKEPL

SEQ ID NO: 36911 - protein, 15 aa, BK virus
LRHLNRKFLRKEPLV

SEQ ID NO: 36912 - protein, 15 aa, BK virus
RHLNRKFLRKEPLVW

SEQ ID NO: 36913 - protein, 15 aa, BK virus
HLNRKFLRKEPLVWI

SEQ ID NO: 36914 - protein, 15 aa, BK virus
LNRKFLRKEPLVWID

SEQ ID NO: 36915 - protein, 15 aa, BK virus
NRKFLRKEPLVWIDC

SEQ ID NO: 36916 - protein, 15 aa, BK virus
RKFLRKEPLVWIDCY

SEQ ID NO: 36917 - protein, 15 aa, BK virus
KFLRKEPLVWIDCYC

SEQ ID NO: 36918 - protein, 15 aa, BK virus
FLRKEPLVWIDCYCI

SEQ ID NO: 36919 - protein, 15 aa, BK virus
LRKEPLVWIDCYCID

SEQ ID NO: 36920 - protein, 15 aa, BK virus
RKEPLVWIDCYCIDC

SEQ ID NO: 36921 - protein, 15 aa, BK virus
KEPLVWIDCYCIDCF

SEQ ID NO: 36922 - protein, 15 aa, BK virus
EPLVWIDCYCIDCFT

SEQ ID NO: 36923 - protein, 15 aa, BK virus
PLVWIDCYCIDCFTQ

SEQ ID NO: 36924 - protein, 15 aa, BK virus
LVWIDCYCIDCFTQW

SEQ ID NO: 36925 - protein, 15 aa, BK virus
VWIDCYCIDCFTQWF

SEQ ID NO: 36926 - protein, 15 aa, BK virus
WIDCYCIDCFTQWFG

SEQ ID NO: 36927 - protein, 15 aa, BK virus
IDCYCIDCFTQWFGL

SEQ ID NO: 36928 - protein, 15 aa, BK virus
DCYCIDCFTQWFGLD

SEQ ID NO: 36929 - protein, 15 aa, BK virus
CYCIDCFTQWFGLDL

SEQ ID NO: 36930 - protein, 15 aa, BK virus
YCIDCFTQWFGLDLT

SEQ ID NO: 36931 - protein, 15 aa, BK virus
CIDCFTQWFGLDLTE

SEQ ID NO: 36932 - protein, 15 aa, BK virus
IDCFTQWFGLDLTEE

SEQ ID NO: 36933 - protein, 15 aa, BK virus
DCFTQWFGLDLTEET

SEQ ID NO: 36934 - protein, 15 aa, BK virus
CFTQWFGLDLTEETL

SEQ ID NO: 36935 - protein, 15 aa, BK virus
FTQWFGLDLTEETLQ

SEQ ID NO: 36936 - protein, 15 aa, BK virus
TQWFGLDLTEETLQW

SEQ ID NO: 36937 - protein, 15 aa, BK virus
QWFGLDLTEETLQWW

SEQ ID NO: 36938 - protein, 15 aa, BK virus
WFGLDLTEETLQWWV

SEQ ID NO: 36939 - protein, 15 aa, BK virus
FGLDLTEETLQWWVQ

SEQ ID NO: 36940 - protein, 15 aa, BK virus
GLDLTEETLQWWVQI

SEQ ID NO: 36941 - protein, 15 aa, BK virus
LDLTEETLQWWVQII

SEQ ID NO: 36942 - protein, 15 aa, BK virus
DLTEETLQWWVQIIG

SEQ ID NO: 36943 - protein, 15 aa, BK virus
LTEETLQWWVQIIGE

SEQ ID NO: 36944 - protein, 15 aa, BK virus
TEETLQWWVQIIGET

SEQ ID NO: 36945 - protein, 15 aa, BK virus
EETLQWWVQIIGETP

SEQ ID NO: 36946 - protein, 15 aa, BK virus
ETLQWWVQIIGETPF

SEQ ID NO: 36947 - protein, 15 aa, BK virus
TLQWWVQIIGETPFR

SEQ ID NO: 36948 - protein, 15 aa, BK virus
LQWWVQIIGETPFRD

SEQ ID NO: 36949 - protein, 15 aa, BK virus
QWWVQIIGETPFRDL

SEQ ID NO: 36950 - protein, 15 aa, BK virus
WWVQIIGETPFRDLK

SEQ ID NO: 36951 - protein, 15 aa, BK virus
WVQIIGETPFRDLKL

SEQ ID NO: 36952 - protein, 15 aa, BK virus
KALSNYFFYRCQPME

SEQ ID NO: 36953 - protein, 15 aa, BK virus
ALSNYFFYRCQPMEQ

SEQ ID NO: 36954 - protein, 15 aa, BK virus
LSNYFFYRCQPMEQK

SEQ ID NO: 36955 - protein, 15 aa, BK virus
SNYFFYRCQPMEQKS

SEQ ID NO: 36956 - protein, 15 aa, BK virus
NYFFYRCQPMEQKSG

SEQ ID NO: 36957 - protein, 15 aa, BK virus
YFFYRCQPMEQKSGS

SEQ ID NO: 36958 - protein, 15 aa, BK virus
FFYRCQPMEQKSGSP

SEQ ID NO: 36959 - protein, 15 aa, BK virus
FYRCQPMEQKSGSPG

SEQ ID NO: 36960 - protein, 15 aa, BK virus
YRCQPMEQKSGSPGG

SEQ ID NO: 36961 - protein, 15 aa, BK virus
RCQPMEQKSGSPGGV

SEQ ID NO: 36962 - protein, 15 aa, BK virus
CQPMEQKSGSPGGVP

SEQ ID NO: 36963 - protein, 15 aa, BK virus
QPMEQKSGSPGGVPL

SEQ ID NO: 36964 - protein, 15 aa, BK virus
PMEQKSGSPGGVPLM

SEQ ID NO: 36965 - protein, 15 aa, BK virus
MEQKSGSPGGVPLMK

SEQ ID NO: 36966 - protein, 15 aa, BK virus
EQKSGSPGGVPLMKN

SEQ ID NO: 36967 - protein, 15 aa, BK virus
QKSGSPGGVPLMKNG

SEQ ID NO: 36968 - protein, 15 aa, BK virus
KSGSPGGVPLMKNGM

SEQ ID NO: 36969 - protein, 15 aa, BK virus
SGSPGGVPLMKNGMK

SEQ ID NO: 36970 - protein, 15 aa, BK virus
GSPGGVPLMKNGMKI

SEQ ID NO: 36971 - protein, 15 aa, BK virus
SPGGVPLMKNGMKIY

SEQ ID NO: 36972 - protein, 15 aa, BK virus
PGGVPLMKNGMKIYF

SEQ ID NO: 36973 - protein, 15 aa, BK virus
GGVPLMKNGMKIYFA

SEQ ID NO: 36974 - protein, 15 aa, BK virus
GVPLMKNGMKIYFAM

SEQ ID NO: 36975 - protein, 15 aa, BK virus
VPLMKNGMKIYFAMK

SEQ ID NO: 36976 - protein, 15 aa, BK virus
PLMKNGMKIYFAMKI

SEQ ID NO: 36977 - protein, 15 aa, BK virus
LMKNGMKIYFAMKIC

SEQ ID NO: 36978 - protein, 15 aa, BK virus
MKNGMKIYFAMKICL

SEQ ID NO: 36979 - protein, 15 aa, BK virus
KNGMKIYFAMKICLP

SEQ ID NO: 36980 - protein, 15 aa, BK virus
NGMKIYFAMKICLPV

SEQ ID NO: 36981 - protein, 15 aa, BK virus
GMKIYFAMKICLPVM

SEQ ID NO: 36982 - protein, 15 aa, BK virus
MKIYFAMKICLPVMK

SEQ ID NO: 36983 - protein, 15 aa, BK virus
KIYFAMKICLPVMKK

SEQ ID NO: 36984 - protein, 15 aa, BK virus
IYFAMKICLPVMKKQ

SEQ ID NO: 36985 - protein, 15 aa, BK virus
YFAMKICLPVMKKQQ

SEQ ID NO: 36986 - protein, 15 aa, BK virus
FAMKICLPVMKKQQQ

SEQ ID NO: 36987 - protein, 15 aa, BK virus
AMKICLPVMKKQQQI

SEQ ID NO: 36988 - protein, 15 aa, BK virus
MKICLPVMKKQQQIL

SEQ ID NO: 36989 - protein, 15 aa, BK virus
KICLPVMKKQQQILN

SEQ ID NO: 36990 - protein, 15 aa, BK virus
ICLPVMKKQQQILNT

SEQ ID NO: 36991 - protein, 15 aa, BK virus
CLPVMKKQQQILNTQ

SEQ ID NO: 36992 - protein, 15 aa, BK virus
LPVMKKQQQILNTQH

SEQ ID NO: 36993 - protein, 15 aa, BK virus
PVMKKQQQILNTQHH

SEQ ID NO: 36994 - protein, 15 aa, BK virus
VMKKQQQILNTQHHP

SEQ ID NO: 36995 - protein, 15 aa, BK virus
MKKQQQILNTQHHPK

SEQ ID NO: 36996 - protein, 15 aa, BK virus
KKQQQILNTQHHPKK

SEQ ID NO: 36997 - protein, 15 aa, BK virus
KQQQILNTQHHPKKK

SEQ ID NO: 36998 - protein, 15 aa, BK virus
QQQILNTQHHPKKKE

SEQ ID NO: 36999 - protein, 15 aa, BK virus
QQILNTQHHPKKKER

SEQ ID NO: 37000 - protein, 15 aa, BK virus
KTLKTFPLIYTSFLV

SEQ ID NO: 37001 - protein, 15 aa, BK virus
TLKTFPLIYTSFLVK

SEQ ID NO: 37002 - protein, 15 aa, BK virus
LKTFPLIYTSFLVKL

SEQ ID NO: 37003 - protein, 15 aa, BK virus
KTFPLIYTSFLVKLY

SEQ ID NO: 37004 - protein, 15 aa, BK virus
TFPLIYTSFLVKLYL

SEQ ID NO: 37005 - protein, 15 aa, BK virus
FPLIYTSFLVKLYLV

SEQ ID NO: 37006 - protein, 15 aa, BK virus
PLIYTSFLVKLYLVI

SEQ ID NO: 37007 - protein, 15 aa, BK virus
LIYTSFLVKLYLVIE

SEQ ID NO: 37008 - protein, 15 aa, BK virus
IYTSFLVKLYLVIEP

SEQ ID NO: 37009 - protein, 15 aa, BK virus
YTSFLVKLYLVIEPL

SEQ ID NO: 37010 - protein, 15 aa, BK virus
TSFLVKLYLVIEPLP

SEQ ID NO: 37011 - protein, 15 aa, BK virus
SFLVKLYLVIEPLPA

SEQ ID NO: 37012 - protein, 15 aa, BK virus
FLVKLYLVIEPLPAL

SEQ ID NO: 37013 - protein, 15 aa, BK virus
LVKLYLVIEPLPALL

SEQ ID NO: 37014 - protein, 15 aa, BK virus
VKLYLVIEPLPALLC

SEQ ID NO: 37015 - protein, 15 aa, BK virus
KLYLVIEPLPALLCI

SEQ ID NO: 37016 - protein, 15 aa, BK virus
LYLVIEPLPALLCIL

SEQ ID NO: 37017 - protein, 15 aa, BK virus
YLVIEPLPALLCILL

SEQ ID NO: 37018 - protein, 15 aa, BK virus
LVIEPLPALLCILLK

SEQ ID NO: 37019 - protein, 15 aa, BK virus
VIEPLPALLCILLKK

SEQ ID NO: 37020 - protein, 15 aa, BK virus
IEPLPALLCILLKKK

SEQ ID NO: 37021 - protein, 15 aa, BK virus
EPLPALLCILLKKKL

SEQ ID NO: 37022 - protein, 15 aa, BK virus
PLPALLCILLKKKLK

SEQ ID NO: 37023 - protein, 15 aa, BK virus
LPALLCILLKKKLKF

SEQ ID NO: 37024 - protein, 15 aa, BK virus
PALLCILLKKKLKFC

SEQ ID NO: 37025 - protein, 15 aa, BK virus
ALLCILLKKKLKFCI

SEQ ID NO: 37026 - protein, 15 aa, BK virus
LLCILLKKKLKFCIK

SEQ ID NO: 37027 - protein, 15 aa, BK virus
LCILLKKKLKFCIKN

SEQ ID NO: 37028 - protein, 15 aa, BK virus
CILLKKKLKFCIKNL

SEQ ID NO: 37029 - protein, 15 aa, BK virus
ILLKKKLKFCIKNLW

SEQ ID NO: 37030 - protein, 15 aa, BK virus
LLKKKLKFCIKNLWK

SEQ ID NO: 37031 - protein, 15 aa, BK virus
LKKKLKFCIKNLWKN

SEQ ID NO: 37032 - protein, 15 aa, BK virus
KKKLKFCIKNLWKNI

SEQ ID NO: 37033 - protein, 15 aa, BK virus
KKLKFCIKNLWKNIL

SEQ ID NO: 37034 - protein, 15 aa, BK virus
LLLVDTCVLGIILYS

SEQ ID NO: 37035 - protein, 15 aa, BK virus
LLVDTCVLGIILYSF

SEQ ID NO: 37036 - protein, 15 aa, BK virus
LHIDIEFLQLIISVK

SEQ ID NO: 37037 - protein, 15 aa, BK virus
HIDIEFLQLIISVKS

SEQ ID NO: 37038 - protein, 15 aa, BK virus
IDIEFLQLIISVKSC

SEQ ID NO: 37039 - protein, 15 aa, BK virus
DIEFLQLIISVKSCV

SEQ ID NO: 37040 - protein, 15 aa, BK virus
IEFLQLIISVKSCVP

SEQ ID NO: 37041 - protein, 15 aa, BK virus
EFLQLIISVKSCVPL

SEQ ID NO: 37042 - protein, 15 aa, BK virus
FLQLIISVKSCVPLV

SEQ ID NO: 37043 - protein, 15 aa, BK virus
LQLIISVKSCVPLVF

SEQ ID NO: 37044 - protein, 15 aa, BK virus
RSMILAQKSLKKQSR

SEQ ID NO: 37045 - protein, 15 aa, BK virus
SMILAQKSLKKQSRC

SEQ ID NO: 37046 - protein, 15 aa, BK virus
MILAQKSLKKQSRCL

SEQ ID NO: 37047 - protein, 15 aa, BK virus
ILAQKSLKKQSRCLG

SEQ ID NO: 37048 - protein, 15 aa, BK virus
LAQKSLKKQSRCLGN

SEQ ID NO: 37049 - protein, 15 aa, BK virus
RSVKSVRKKTSLITL

SEQ ID NO: 37050 - protein, 15 aa, BK virus
SVKSVRKKTSLITLS

SEQ ID NO: 37051 - protein, 15 aa, BK virus
VKSVRKKTSLITLSI

SEQ ID NO: 37052 - protein, 15 aa, BK virus
KSVRKKTSLITLSIM

SEQ ID NO: 37053 - protein, 15 aa, BK virus
SVRKKTSLITLSIMK

SEQ ID NO: 37054 - protein, 15 aa, BK virus
VRKKTSLITLSIMKS

SEQ ID NO: 37055 - protein, 15 aa, BK virus
RKKTSLITLSIMKST

SEQ ID NO: 37056 - protein, 15 aa, BK virus
KKTSLITLSIMKSTL

SEQ ID NO: 37057 - protein, 15 aa, BK virus
KTSLITLSIMKSTLQ

SEQ ID NO: 37058 - protein, 15 aa, BK virus
TSLITLSIMKSTLQM

SEQ ID NO: 37059 - protein, 15 aa, BK virus
SLITLSIMKSTLQML

SEQ ID NO: 37060 - protein, 15 aa, BK virus
LITLSIMKSTLQMLL

SEQ ID NO: 37061 - protein, 15 aa, BK virus
ITLSIMKSTLQMLLF

SEQ ID NO: 37062 - protein, 15 aa, BK virus
TLSIMKSTLQMLLFL

SEQ ID NO: 37063 - protein, 15 aa, BK virus
LSIMKSTLQMLLFLQ

SEQ ID NO: 37064 - protein, 15 aa, BK virus
SIMKSTLQMLLFLQK

SEQ ID NO: 37065 - protein, 15 aa, BK virus
IMKSTLQMLLFLQKV

SEQ ID NO: 37066 - protein, 15 aa, BK virus
MKSTLQMLLFLQKVK

SEQ ID NO: 37067 - protein, 15 aa, BK virus
KSTLQMLLFLQKVKI

SEQ ID NO: 37068 - protein, 15 aa, BK virus
STLQMLLFLQKVKIK

SEQ ID NO: 37069 - protein, 15 aa, BK virus
TLQMLLFLQKVKIKK

SEQ ID NO: 37070 - protein, 15 aa, BK virus
LQMLLFLQKVKIKKV

SEQ ID NO: 37071 - protein, 15 aa, BK virus
QMLLFLQKVKIKKVF

SEQ ID NO: 37072 - protein, 15 aa, BK virus
MLLFLQKVKIKKVFV

SEQ ID NO: 37073 - protein, 15 aa, BK virus
LLFLQKVKIKKVFVS

SEQ ID NO: 37074 - protein, 15 aa, BK virus
LFLQKVKIKKVFVSK

SEQ ID NO: 37075 - protein, 15 aa, BK virus
FLQKVKIKKVFVSKQ

SEQ ID NO: 37076 - protein, 15 aa, BK virus
NNIWQVLLGCTVCYL

SEQ ID NO: 37077 - protein, 15 aa, BK virus
NIWQVLLGCTVCYLK

SEQ ID NO: 37078 - protein, 15 aa, BK virus
IWQVLLGCTVCYLKW

SEQ ID NO: 37079 - protein, 15 aa, BK virus
WQVLLGCTVCYLKWI

SEQ ID NO: 37080 - protein, 15 aa, BK virus
QVLLGCTVCYLKWIL

SEQ ID NO: 37081 - protein, 15 aa, BK virus
YLIFCTVLFSMYLKE

SEQ ID NO: 37082 - protein, 15 aa, BK virus
LIFCTVLFSMYLKED

SEQ ID NO: 37083 - protein, 15 aa, BK virus
IFCTVLFSMYLKEDT

SEQ ID NO: 37084 - protein, 15 aa, BK virus
FCTVLFSMYLKEDTG

SEQ ID NO: 37085 - protein, 15 aa, BK virus
CTVLFSMYLKEDTGY

SEQ ID NO: 37086 - protein, 15 aa, BK virus
TVLFSMYLKEDTGYL

SEQ ID NO: 37087 - protein, 15 aa, BK virus
VLFSMYLKEDTGYLK

SEQ ID NO: 37088 - protein, 15 aa, BK virus
LFSMYLKEDTGYLKV

SEQ ID NO: 37089 - protein, 15 aa, BK virus
FSMYLKEDTGYLKVP

SEQ ID NO: 37090 - protein, 15 aa, BK virus
SMYLKEDTGYLKVPL

SEQ ID NO: 37091 - protein, 15 aa, BK virus
MYLKEDTGYLKVPLI

SEQ ID NO: 37092 - protein, 15 aa, BK virus
YLKEDTGYLKVPLIV

SEQ ID NO: 37093 - protein, 15 aa, BK virus
LKEDTGYLKVPLIVE

SEQ ID NO: 37094 - protein, 15 aa, BK virus
KEDTGYLKVPLIVEK

SEQ ID NO: 37095 - protein, 15 aa, BK virus
EDTGYLKVPLIVEKQ

SEQ ID NO: 37096 - protein, 15 aa, BK virus
DTGYLKVPLIVEKQH

SEQ ID NO: 37097 - protein, 15 aa, BK virus
KGQELNQRICLQDME

SEQ ID NO: 37098 - protein, 15 aa, BK virus
ENPYKTQSSYLKKEF

SEQ ID NO: 37099 - protein, 15 aa, BK virus
NPYKTQSSYLKKEFY

SEQ ID NO: 37100 - protein, 15 aa, BK virus
PYKTQSSYLKKEFYK

SEQ ID NO: 37101 - protein, 15 aa, BK virus
YKTQSSYLKKEFYKV

SEQ ID NO: 37102 - protein, 15 aa, BK virus
KTQSSYLKKEFYKVE

SEQ ID NO: 37103 - protein, 15 aa, BK virus
LILQLIYNLELLNGR

SEQ ID NO: 37104 - protein, 15 aa, BK virus
ILQLIYNLELLNGRK

SEQ ID NO: 37105 - protein, 15 aa, BK virus
LQLIYNLELLNGRKG

SEQ ID NO: 37106 - protein, 15 aa, BK virus
QLIYNLELLNGRKGW

SEQ ID NO: 37107 - protein, 15 aa, BK virus
LIYNLELLNGRKGWI

SEQ ID NO: 37108 - protein, 15 aa, BK virus
IYNLELLNGRKGWIL

SEQ ID NO: 37109 - protein, 15 aa, BK virus
YNLELLNGRKGWILR

SEQ ID NO: 37110 - protein, 15 aa, BK virus
NIIYAWGNVFLILQE

SEQ ID NO: 37111 - protein, 15 aa, BK virus
IIYAWGNVFLILQEK

SEQ ID NO: 37112 - protein, 15 aa, BK virus
IYAWGNVFLILQEKR

SEQ ID NO: 37113 - protein, 15 aa, BK virus
YAWGNVFLILQEKRI

SEQ ID NO: 37114 - protein, 15 aa, BK virus
AWGNVFLILQEKRIQ

SEQ ID NO: 37115 - protein, 15 aa, BK virus
WGNVFLILQEKRIQK

SEQ ID NO: 37116 - protein, 15 aa, BK virus
GNVFLILQEKRIQKL

SEQ ID NO: 37117 - protein, 15 aa, BK virus
NVFLILQEKRIQKLK

SEQ ID NO: 37118 - protein, 15 aa, BK virus
VFLILQEKRIQKLKT

SEQ ID NO: 37119 - protein, 15 aa, BK virus
FLILQEKRIQKLKTL

SEQ ID NO: 37120 - protein, 15 aa, BK virus
LILQEKRIQKLKTLD

SEQ ID NO: 37121 - protein, 15 aa, BK virus
ILQEKRIQKLKTLDM

SEQ ID NO: 37122 - protein, 15 aa, BK virus
LQEKRIQKLKTLDMD

SEQ ID NO: 37123 - protein, 15 aa, BK virus
QEKRIQKLKTLDMDQ

SEQ ID NO: 37124 - protein, 15 aa, BK virus
EKRIQKLKTLDMDQA

SEQ ID NO: 37125 - protein, 15 aa, BK virus
KRIQKLKTLDMDQAL

SEQ ID NO: 37126 - protein, 15 aa, BK virus
RIQKLKTLDMDQALN

SEQ ID NO: 37127 - protein, 15 aa, BK virus
IQKLKTLDMDQALNP

SEQ ID NO: 37128 - protein, 15 aa, BK virus
QKLKTLDMDQALNPN

SEQ ID NO: 37129 - protein, 15 aa, BK virus
KLKTLDMDQALNPNH

SEQ ID NO: 37130 - protein, 15 aa, BK virus
LKTLDMDQALNPNHN

SEQ ID NO: 37131 - protein, 15 aa, BK virus
KTLDMDQALNPNHNA

SEQ ID NO: 37132 - protein, 15 aa, BK virus
TLDMDQALNPNHNAL

SEQ ID NO: 37133 - protein, 15 aa, BK virus
LDMDQALNPNHNALP

SEQ ID NO: 37134 - protein, 15 aa, BK virus
DMDQALNPNHNALPK

SEQ ID NO: 37135 - protein, 15 aa, BK virus
MDQALNPNHNALPKS

SEQ ID NO: 37136 - protein, 15 aa, BK virus
DQALNPNHNALPKSQ

SEQ ID NO: 37137 - protein, 15 aa, BK virus
QALNPNHNALPKSQI

SEQ ID NO: 37138 - protein, 15 aa, BK virus
ALNPNHNALPKSQIL

SEQ ID NO: 37139 - protein, 15 aa, BK virus
LNPNHNALPKSQILQ

SEQ ID NO: 37140 - protein, 15 aa, BK virus
NPNHNALPKSQILQP

SEQ ID NO: 37141 - protein, 15 aa, BK virus
PNHNALPKSQILQPL

SEQ ID NO: 37142 - protein, 15 aa, BK virus
NHNALPKSQILQPLL

SEQ ID NO: 37143 - protein, 15 aa, BK virus
HNALPKSQILQPLLK

SEQ ID NO: 37144 - protein, 15 aa, BK virus
NALPKSQILQPLLKI

SEQ ID NO: 37145 - protein, 15 aa, BK virus
ALPKSQILQPLLKIP

SEQ ID NO: 37146 - protein, 15 aa, BK virus
LPKSQILQPLLKIPK

SEQ ID NO: 37147 - protein, 15 aa, BK virus
PKSQILQPLLKIPKG

SEQ ID NO: 37148 - protein, 15 aa, BK virus
KSQILQPLLKIPKGQ

SEQ ID NO: 37149 - protein, 15 aa, BK virus
SQILQPLLKIPKGQT

SEQ ID NO: 37150 - protein, 15 aa, BK virus
QILQPLLKIPKGQTP

SEQ ID NO: 37151 - protein, 15 aa, BK virus
ILQPLLKIPKGQTPI

SEQ ID NO: 37152 - protein, 15 aa, BK virus
LQPLLKIPKGQTPIV

SEQ ID NO: 37153 - protein, 15 aa, BK virus
QPLLKIPKGQTPIVK

SEQ ID NO: 37154 - protein, 15 aa, BK virus
PLLKIPKGQTPIVKS

SEQ ID NO: 37155 - protein, 15 aa, BK virus
LLKIPKGQTPIVKSC

SEQ ID NO: 37156 - protein, 15 aa, BK virus
LKIPKGQTPIVKSCI

SEQ ID NO: 37157 - protein, 15 aa, BK virus
KIPKGQTPIVKSCIC

SEQ ID NO: 37158 - protein, 15 aa, BK virus
IPKGQTPIVKSCICV

SEQ ID NO: 37159 - protein, 15 aa, BK virus
PKGQTPIVKSCICVK

SEQ ID NO: 37160 - protein, 15 aa, BK virus
KGQTPIVKSCICVKA

SEQ ID NO: 37161 - protein, 15 aa, BK virus
GQTPIVKSCICVKAF

SEQ ID NO: 37162 - protein, 15 aa, BK virus
QTPIVKSCICVKAFS

SEQ ID NO: 37163 - protein, 15 aa, BK virus
TPIVKSCICVKAFSV

SEQ ID NO: 37164 - protein, 15 aa, BK virus
PIVKSCICVKAFSVL

SEQ ID NO: 37165 - protein, 15 aa, BK virus
IVKSCICVKAFSVLK

SEQ ID NO: 37166 - protein, 15 aa, BK virus
VKSCICVKAFSVLKG

SEQ ID NO: 37167 - protein, 15 aa, BK virus
KSCICVKAFSVLKGL

SEQ ID NO: 37168 - protein, 15 aa, BK virus
SCICVKAFSVLKGLK

SEQ ID NO: 37169 - protein, 15 aa, BK virus
CICVKAFSVLKGLKH

SEQ ID NO: 37170 - protein, 15 aa, BK virus
ICVKAFSVLKGLKHH

SEQ ID NO: 37171 - protein, 15 aa, BK virus
CVKAFSVLKGLKHHP

SEQ ID NO: 37172 - protein, 15 aa, BK virus
VKAFSVLKGLKHHPQ

SEQ ID NO: 37173 - protein, 15 aa, BK virus
KAFSVLKGLKHHPQN

SEQ ID NO: 37174 - protein, 15 aa, BK virus
AFSVLKGLKHHPQNN

SEQ ID NO: 37175 - protein, 15 aa, BK virus
FSVLKGLKHHPQNNT

SEQ ID NO: 37176 - protein, 15 aa, BK virus
SVLKGLKHHPQNNTS

SEQ ID NO: 37177 - protein, 15 aa, BK virus
VLKGLKHHPQNNTSL

SEQ ID NO: 37178 - protein, 15 aa, BK virus
LKGLKHHPQNNTSLK

SEQ ID NO: 37179 - protein, 15 aa, BK virus
KGLKHHPQNNTSLKV

SEQ ID NO: 37180 - protein, 15 aa, BK virus
GLKHHPQNNTSLKVA

SEQ ID NO: 37181 - protein, 15 aa, BK virus
LKHHPQNNTSLKVAY

SEQ ID NO: 37182 - protein, 15 aa, BK virus
KHHPQNNTSLKVAYT

SEQ ID NO: 37183 - protein, 15 aa, BK virus
HHPQNNTSLKVAYTK

SEQ ID NO: 37184 - protein, 15 aa, BK virus
HPQNNTSLKVAYTKA

SEQ ID NO: 37185 - protein, 15 aa, BK virus
PQNNTSLKVAYTKAA

SEQ ID NO: 37186 - protein, 15 aa, BK virus
QNNTSLKVAYTKAAF

SEQ ID NO: 37187 - protein, 15 aa, BK virus
NNTSLKVAYTKAAFI

SEQ ID NO: 37188 - protein, 15 aa, BK virus
NTSLKVAYTKAAFIK

SEQ ID NO: 37189 - protein, 15 aa, BK virus
TSLKVAYTKAAFIKC

SEQ ID NO: 37190 - protein, 15 aa, BK virus
SLKVAYTKAAFIKCI

SEQ ID NO: 37191 - protein, 15 aa, BK virus
LKVAYTKAAFIKCIC

SEQ ID NO: 37192 - protein, 15 aa, BK virus
KVAYTKAAFIKCICT

SEQ ID NO: 37193 - protein, 15 aa, BK virus
VAYTKAAFIKCICTI

SEQ ID NO: 37194 - protein, 15 aa, BK virus
AYTKAAFIKCICTIK

SEQ ID NO: 37195 - protein, 15 aa, BK virus
YTKAAFIKCICTIKA

SEQ ID NO: 37196 - protein, 15 aa, BK virus
TKAAFIKCICTIKAP

SEQ ID NO: 37197 - protein, 15 aa, BK virus
KAAFIKCICTIKAPV

SEQ ID NO: 37198 - protein, 15 aa, BK virus
SILVCNCPCLSIYLI

SEQ ID NO: 37199 - protein, 15 aa, BK virus
ILVCNCPCLSIYLII

SEQ ID NO: 37200 - protein, 15 aa, BK virus
LVCNCPCLSIYLIIS

SEQ ID NO: 37201 - protein, 15 aa, BK virus
VCNCPCLSIYLIISG

SEQ ID NO: 37202 - protein, 15 aa, BK virus
CNCPCLSIYLIISGS

SEQ ID NO: 37203 - protein, 15 aa, BK virus
NCPCLSIYLIISGSP

SEQ ID NO: 37204 - protein, 15 aa, BK virus
CPCLSIYLIISGSPG

SEQ ID NO: 37205 - protein, 15 aa, BK virus
PCLSIYLIISGSPGS

SEQ ID NO: 37206 - protein, 15 aa, BK virus
CLSIYLIISGSPGSL

SEQ ID NO: 37207 - protein, 15 aa, BK virus
LSIYLIISGSPGSLS

SEQ ID NO: 37208 - protein, 15 aa, BK virus
SIYLIISGSPGSLSV

SEQ ID NO: 37209 - protein, 15 aa, BK virus
IYLIISGSPGSLSVP

SEQ ID NO: 37210 - protein, 15 aa, BK virus
YLIISGSPGSLSVPS

SEQ ID NO: 37211 - protein, 15 aa, BK virus
LIISGSPGSLSVPSN

SEQ ID NO: 37212 - protein, 15 aa, BK virus
IISGSPGSLSVPSNT

SEQ ID NO: 37213 - protein, 15 aa, BK virus
ISGSPGSLSVPSNTL

SEQ ID NO: 37214 - protein, 15 aa, BK virus
SGSPGSLSVPSNTLT

SEQ ID NO: 37215 - protein, 15 aa, BK virus
GSPGSLSVPSNTLTS

SEQ ID NO: 37216 - protein, 15 aa, BK virus
SPGSLSVPSNTLTSS

SEQ ID NO: 37217 - protein, 15 aa, BK virus
PGSLSVPSNTLTSST

SEQ ID NO: 37218 - protein, 15 aa, BK virus
GSLSVPSNTLTSSTW

SEQ ID NO: 37219 - protein, 15 aa, BK virus
SLSVPSNTLTSSTWD

SEQ ID NO: 37220 - protein, 15 aa, BK virus
LSVPSNTLTSSTWDS

SEQ ID NO: 37221 - protein, 15 aa, BK virus
SVPSNTLTSSTWDSI

SEQ ID NO: 37222 - protein, 15 aa, BK virus
VPSNTLTSSTWDSIP

SEQ ID NO: 37223 - protein, 15 aa, BK virus
PSNTLTSSTWDSIPY

SEQ ID NO: 37224 - protein, 15 aa, BK virus
SNTLTSSTWDSIPYI

SEQ ID NO: 37225 - protein, 15 aa, BK virus
NTLTSSTWDSIPYIG

SEQ ID NO: 37226 - protein, 15 aa, BK virus
TLTSSTWDSIPYIGC

SEQ ID NO: 37227 - protein, 15 aa, BK virus
LTSSTWDSIPYIGCP

SEQ ID NO: 37228 - protein, 15 aa, BK virus
TSSTWDSIPYIGCPS

SEQ ID NO: 37229 - protein, 15 aa, BK virus
SSTWDSIPYIGCPST

SEQ ID NO: 37230 - protein, 15 aa, BK virus
STWDSIPYIGCPSTL

SEQ ID NO: 37231 - protein, 15 aa, BK virus
TWDSIPYIGCPSTLW

SEQ ID NO: 37232 - protein, 15 aa, BK virus
WDSIPYIGCPSTLWV

SEQ ID NO: 37233 - protein, 15 aa, BK virus
DSIPYIGCPSTLWVL

SEQ ID NO: 37234 - protein, 15 aa, BK virus
SIPYIGCPSTLWVLL

SEQ ID NO: 37235 - protein, 15 aa, BK virus
IPYIGCPSTLWVLLF

SEQ ID NO: 37236 - protein, 15 aa, BK virus
PYIGCPSTLWVLLFI

SEQ ID NO: 37237 - protein, 15 aa, BK virus
YIGCPSTLWVLLFIR

SEQ ID NO: 37238 - protein, 15 aa, BK virus
IGCPSTLWVLLFIRS

SEQ ID NO: 37239 - protein, 15 aa, BK virus
GCPSTLWVLLFIRSL

SEQ ID NO: 37240 - protein, 15 aa, BK virus
CPSTLWVLLFIRSLS

SEQ ID NO: 37241 - protein, 15 aa, BK virus
PSTLWVLLFIRSLSK

SEQ ID NO: 37242 - protein, 15 aa, BK virus
STLWVLLFIRSLSKK

SEQ ID NO: 37243 - protein, 15 aa, BK virus
TLWVLLFIRSLSKKE

SEQ ID NO: 37244 - protein, 15 aa, BK virus
LWVLLFIRSLSKKEI

SEQ ID NO: 37245 - protein, 15 aa, BK virus
WVLLFIRSLSKKEIG

SEQ ID NO: 37246 - protein, 15 aa, BK virus
GFFTDLFLRRILKYL

SEQ ID NO: 37247 - protein, 15 aa, BK virus
FFTDLFLRRILKYLA

SEQ ID NO: 37248 - protein, 15 aa, BK virus
FTDLFLRRILKYLAR

SEQ ID NO: 37249 - protein, 15 aa, BK virus
TDLFLRRILKYLARP

SEQ ID NO: 37250 - protein, 15 aa, BK virus
DLFLRRILKYLARPL

SEQ ID NO: 37251 - protein, 15 aa, BK virus
LFLRRILKYLARPLH

SEQ ID NO: 37252 - protein, 15 aa, BK virus
FLRRILKYLARPLHC

SEQ ID NO: 37253 - protein, 15 aa, BK virus
LRRILKYLARPLHCC

SEQ ID NO: 37254 - protein, 15 aa, BK virus
RRILKYLARPLHCCV

SEQ ID NO: 37255 - protein, 15 aa, BK virus
RILKYLARPLHCCVP

SEQ ID NO: 37256 - protein, 15 aa, BK virus
ILKYLARPLHCCVPE

SEQ ID NO: 37257 - protein, 15 aa, BK virus
LKYLARPLHCCVPEL

SEQ ID NO: 37258 - protein, 15 aa, BK virus
KYLARPLHCCVPELL

SEQ ID NO: 37259 - protein, 15 aa, BK virus
YLARPLHCCVPELLV

SEQ ID NO: 37260 - protein, 15 aa, BK virus
LARPLHCCVPELLVN

SEQ ID NO: 37261 - protein, 15 aa, BK virus
ARPLHCCVPELLVNR

SEQ ID NO: 37262 - protein, 15 aa, BK virus
RPLHCCVPELLVNRP

SEQ ID NO: 37263 - protein, 15 aa, BK virus
PLHCCVPELLVNRPQ

SEQ ID NO: 37264 - protein, 15 aa, BK virus
LHCCVPELLVNRPQI

SEQ ID NO: 37265 - protein, 15 aa, BK virus
HCCVPELLVNRPQIS

SEQ ID NO: 37266 - protein, 15 aa, BK virus
CCVPELLVNRPQISA

SEQ ID NO: 37267 - protein, 15 aa, BK virus
CVPELLVNRPQISAA

SEQ ID NO: 37268 - protein, 15 aa, BK virus
VPELLVNRPQISAAE

SEQ ID NO: 37269 - protein, 15 aa, BK virus
PELLVNRPQISAAET

SEQ ID NO: 37270 - protein, 15 aa, BK virus
ELLVNRPQISAAETY

SEQ ID NO: 37271 - protein, 15 aa, BK virus
LLVNRPQISAAETYR

SEQ ID NO: 37272 - protein, 15 aa, BK virus
LVNRPQISAAETYRL

SEQ ID NO: 37273 - protein, 15 aa, BK virus
VNRPQISAAETYRLS

SEQ ID NO: 37274 - protein, 15 aa, BK virus
NRPQISAAETYRLSA

SEQ ID NO: 37275 - protein, 15 aa, BK virus
RPQISAAETYRLSAL

SEQ ID NO: 37276 - protein, 15 aa, BK virus
PQISAAETYRLSALQ

SEQ ID NO: 37277 - protein, 15 aa, BK virus
QISAAETYRLSALQR

SEQ ID NO: 37278 - protein, 15 aa, BK virus
ISAAETYRLSALQRG

SEQ ID NO: 37279 - protein, 15 aa, BK virus
SAAETYRLSALQRGP

SEQ ID NO: 37280 - protein, 15 aa, BK virus
AAETYRLSALQRGPT

SEQ ID NO: 37281 - protein, 15 aa, BK virus
AETYRLSALQRGPTP

SEQ ID NO: 37282 - protein, 15 aa, BK virus
ETYRLSALQRGPTPC

SEQ ID NO: 37283 - protein, 15 aa, BK virus
TYRLSALQRGPTPCS

SEQ ID NO: 37284 - protein, 15 aa, BK virus
YRLSALQRGPTPCSS

SEQ ID NO: 37285 - protein, 15 aa, BK virus
RLSALQRGPTPCSSS

SEQ ID NO: 37286 - protein, 15 aa, BK virus
LSALQRGPTPCSSSN

SEQ ID NO: 37287 - protein, 15 aa, BK virus
SALQRGPTPCSSSNT

SEQ ID NO: 37288 - protein, 15 aa, BK virus
ALQRGPTPCSSSNTV

SEQ ID NO: 37289 - protein, 15 aa, BK virus
LQRGPTPCSSSNTVV

SEQ ID NO: 37290 - protein, 15 aa, BK virus
QRGPTPCSSSNTVVA

SEQ ID NO: 37291 - protein, 15 aa, BK virus
RGPTPCSSSNTVVAV

SEQ ID NO: 37292 - protein, 15 aa, BK virus
GPTPCSSSNTVVAVL

SEQ ID NO: 37293 - protein, 15 aa, BK virus
PTPCSSSNTVVAVLV

SEQ ID NO: 37294 - protein, 15 aa, BK virus
TPCSSSNTVVAVLVT

SEQ ID NO: 37295 - protein, 15 aa, BK virus
STGGTFSPPVKVPKY

SEQ ID NO: 37296 - protein, 15 aa, BK virus
TGGTFSPPVKVPKYL

SEQ ID NO: 37297 - protein, 15 aa, BK virus
GGTFSPPVKVPKYLA

SEQ ID NO: 37298 - protein, 15 aa, BK virus
GTFSPPVKVPKYLAF

SEQ ID NO: 37299 - protein, 15 aa, BK virus
TFSPPVKVPKYLAFS

SEQ ID NO: 37300 - protein, 15 aa, BK virus
FSPPVKVPKYLAFSF

SEQ ID NO: 37301 - protein, 15 aa, BK virus
SPPVKVPKYLAFSFL

SEQ ID NO: 37302 - protein, 15 aa, BK virus
PPVKVPKYLAFSFLL

SEQ ID NO: 37303 - protein, 15 aa, BK virus
PVKVPKYLAFSFLLG

SEQ ID NO: 37304 - protein, 15 aa, BK virus
VKVPKYLAFSFLLGS

SEQ ID NO: 37305 - protein, 15 aa, BK virus
KVPKYLAFSFLLGSG

SEQ ID NO: 37306 - protein, 15 aa, BK virus
VPKYLAFSFLLGSGT

SEQ ID NO: 37307 - protein, 15 aa, BK virus
PKYLAFSFLLGSGTQ

SEQ ID NO: 37308 - protein, 15 aa, BK virus
KYLAFSFLLGSGTQH

SEQ ID NO: 37309 - protein, 15 aa, BK virus
YLAFSFLLGSGTQHS

SEQ ID NO: 37310 - protein, 15 aa, BK virus
LAFSFLLGSGTQHST

SEQ ID NO: 37311 - protein, 15 aa, BK virus
AFSFLLGSGTQHSTG

SEQ ID NO: 37312 - protein, 15 aa, BK virus
ALWSVFITWDWAVGF

SEQ ID NO: 37313 - protein, 15 aa, BK virus
LWSVFITWDWAVGFL

SEQ ID NO: 37314 - protein, 15 aa, BK virus
WSVFITWDWAVGFLG

SEQ ID NO: 37315 - protein, 15 aa, BK virus
SVFITWDWAVGFLGV

SEQ ID NO: 37316 - protein, 15 aa, BK virus
VFITWDWAVGFLGVI

SEQ ID NO: 37317 - protein, 15 aa, BK virus
FITWDWAVGFLGVIV

SEQ ID NO: 37318 - protein, 15 aa, BK virus
ITWDWAVGFLGVIVP

SEQ ID NO: 37319 - protein, 15 aa, BK virus
TWDWAVGFLGVIVPS

SEQ ID NO: 37320 - protein, 15 aa, BK virus
WDWAVGFLGVIVPSG

SEQ ID NO: 37321 - protein, 15 aa, BK virus
DWAVGFLGVIVPSGY

SEQ ID NO: 37322 - protein, 15 aa, BK virus
WAVGFLGVIVPSGYF

SEQ ID NO: 37323 - protein, 15 aa, BK virus
AVGFLGVIVPSGYFD

SEQ ID NO: 37324 - protein, 15 aa, BK virus
VGFLGVIVPSGYFDL

SEQ ID NO: 37325 - protein, 15 aa, BK virus
FISTPCISKGSPPTA

SEQ ID NO: 37326 - protein, 15 aa, BK virus
ISTPCISKGSPPTAK

SEQ ID NO: 37327 - protein, 15 aa, BK virus
STPCISKGSPPTAKK

SEQ ID NO: 37328 - protein, 15 aa, BK virus
TPCISKGSPPTAKKW

SEQ ID NO: 37329 - protein, 15 aa, BK virus
PCISKGSPPTAKKWK

SEQ ID NO: 37330 - protein, 15 aa, BK virus
CISKGSPPTAKKWKL

SEQ ID NO: 37331 - protein, 15 aa, BK virus
ISKGSPPTAKKWKLL

SEQ ID NO: 37332 - protein, 15 aa, BK virus
SKGSPPTAKKWKLLP

SEQ ID NO: 37333 - protein, 15 aa, BK virus
IGFPPPCSCTFCDPA

SEQ ID NO: 37334 - protein, 15 aa, BK virus
RLSMLVIPITSVCTV

SEQ ID NO: 37335 - protein, 15 aa, BK virus
LSMLVIPITSVCTVT

SEQ ID NO: 37336 - protein, 15 aa, BK virus
SMLVIPITSVCTVTA

SEQ ID NO: 37337 - protein, 15 aa, BK virus
MLVIPITSVCTVTAS

SEQ ID NO: 37338 - protein, 15 aa, BK virus
LVIPITSVCTVTASH

SEQ ID NO: 37339 - protein, 15 aa, BK virus
VIPITSVCTVTASHI

SEQ ID NO: 37340 - protein, 15 aa, BK virus
IPITSVCTVTASHIS

SEQ ID NO: 37341 - protein, 15 aa, BK virus
PITSVCTVTASHISR

SEQ ID NO: 37342 - protein, 15 aa, BK virus
ITSVCTVTASHISRF

SEQ ID NO: 37343 - protein, 15 aa, BK virus
TSVCTVTASHISRFP

SEQ ID NO: 37344 - protein, 15 aa, BK virus
SVCTVTASHISRFPQ

SEQ ID NO: 37345 - protein, 15 aa, BK virus
VCTVTASHISRFPQV

SEQ ID NO: 37346 - protein, 15 aa, BK virus
CTVTASHISRFPQVR

SEQ ID NO: 37347 - protein, 15 aa, BK virus
TVTASHISRFPQVRS

SEQ ID NO: 37348 - protein, 15 aa, BK virus
VTASHISRFPQVRSS

SEQ ID NO: 37349 - protein, 15 aa, BK virus
TASHISRFPQVRSSF

SEQ ID NO: 37350 - protein, 15 aa, BK virus
ASHISRFPQVRSSFK

SEQ ID NO: 37351 - protein, 15 aa, BK virus
SHISRFPQVRSSFKL

SEQ ID NO: 37352 - protein, 15 aa, BK virus
HISRFPQVRSSFKLG

SEQ ID NO: 37353 - protein, 15 aa, BK virus
ISRFPQVRSSFKLGR

SEQ ID NO: 37354 - protein, 15 aa, BK virus
SRFPQVRSSFKLGRG

SEQ ID NO: 37355 - protein, 15 aa, BK virus
RFPQVRSSFKLGRGI

SEQ ID NO: 37356 - protein, 15 aa, BK virus
FPQVRSSFKLGRGIL

SEQ ID NO: 37357 - protein, 15 aa, BK virus
PQVRSSFKLGRGILA

SEQ ID NO: 37358 - protein, 15 aa, BK virus
QVRSSFKLGRGILAV

SEQ ID NO: 37359 - protein, 15 aa, BK virus
VRSSFKLGRGILAVL

SEQ ID NO: 37360 - protein, 15 aa, BK virus
QGSIFLSGLSLLKSF

SEQ ID NO: 37361 - protein, 15 aa, BK virus
GSIFLSGLSLLKSFS

SEQ ID NO: 37362 - protein, 15 aa, BK virus
SIFLSGLSLLKSFSA

SEQ ID NO: 37363 - protein, 15 aa, BK virus
IFLSGLSLLKSFSAL

SEQ ID NO: 37364 - protein, 15 aa, BK virus
FLSGLSLLKSFSALS

SEQ ID NO: 37365 - protein, 15 aa, BK virus
LSGLSLLKSFSALSF

SEQ ID NO: 37366 - protein, 15 aa, BK virus
SGLSLLKSFSALSFR

SEQ ID NO: 37367 - protein, 15 aa, BK virus
GLSLLKSFSALSFRL

SEQ ID NO: 37368 - protein, 15 aa, BK virus
LSLLKSFSALSFRLK

SEQ ID NO: 37369 - protein, 15 aa, BK virus
SLLKSFSALSFRLKP

SEQ ID NO: 37370 - protein, 15 aa, BK virus
LLKSFSALSFRLKPL

SEQ ID NO: 37371 - protein, 15 aa, BK virus
LKSFSALSFRLKPLR

SEQ ID NO: 37372 - protein, 15 aa, BK virus
KSFSALSFRLKPLRF

SEQ ID NO: 37373 - protein, 15 aa, BK virus
SFSALSFRLKPLRFS

SEQ ID NO: 37374 - protein, 15 aa, BK virus
FSALSFRLKPLRFSS

SEQ ID NO: 37375 - protein, 15 aa, BK virus
SALSFRLKPLRFSSG

SEQ ID NO: 37376 - protein, 15 aa, BK virus
ALSFRLKPLRFSSGS

SEQ ID NO: 37377 - protein, 15 aa, BK virus
LSFRLKPLRFSSGSP

SEQ ID NO: 37378 - protein, 15 aa, BK virus
SFRLKPLRFSSGSPI

SEQ ID NO: 37379 - protein, 15 aa, BK virus
FRLKPLRFSSGSPIS

SEQ ID NO: 37380 - protein, 15 aa, BK virus
RLKPLRFSSGSPISG

SEQ ID NO: 37381 - protein, 15 aa, BK virus
LKPLRFSSGSPISGF

SEQ ID NO: 37382 - protein, 15 aa, BK virus
KPLRFSSGSPISGFR

SEQ ID NO: 37383 - protein, 15 aa, BK virus
PLRFSSGSPISGFRK

SEQ ID NO: 37384 - protein, 15 aa, BK virus
LRFSSGSPISGFRKH

SEQ ID NO: 37385 - protein, 15 aa, BK virus
RFSSGSPISGFRKHS

SEQ ID NO: 37386 - protein, 15 aa, BK virus
FSSGSPISGFRKHST

SEQ ID NO: 37387 - protein, 15 aa, BK virus
SSGSPISGFRKHSTS

SEQ ID NO: 37388 - protein, 15 aa, BK virus
SGSPISGFRKHSTSV

SEQ ID NO: 37389 - protein, 15 aa, BK virus
GSPISGFRKHSTSVI

SEQ ID NO: 37390 - protein, 15 aa, BK virus
SPISGFRKHSTSVIA

SEQ ID NO: 37391 - protein, 15 aa, BK virus
PISGFRKHSTSVIAS

SEQ ID NO: 37392 - protein, 15 aa, BK virus
ISGFRKHSTSVIAST

SEQ ID NO: 37393 - protein, 15 aa, BK virus
SGFRKHSTSVIASTP

SEQ ID NO: 37394 - protein, 15 aa, BK virus
GFRKHSTSVIASTPV

SEQ ID NO: 37395 - protein, 15 aa, BK virus
FRKHSTSVIASTPVL

SEQ ID NO: 37396 - protein, 15 aa, BK virus
RKHSTSVIASTPVLT

SEQ ID NO: 37397 - protein, 15 aa, BK virus
KHSTSVIASTPVLTS

SEQ ID NO: 37398 - protein, 15 aa, BK virus
HSTSVIASTPVLTSR

SEQ ID NO: 37399 - protein, 15 aa, BK virus
STSVIASTPVLTSRT

SEQ ID NO: 37400 - protein, 15 aa, BK virus
TSVIASTPVLTSRTS

SEQ ID NO: 37401 - protein, 15 aa, BK virus
SVIASTPVLTSRTST

SEQ ID NO: 37402 - protein, 15 aa, BK virus
VIASTPVLTSRTSTP

SEQ ID NO: 37403 - protein, 15 aa, BK virus
IASTPVLTSRTSTPP

SEQ ID NO: 37404 - protein, 15 aa, BK virus
ASTPVLTSRTSTPPF

SEQ ID NO: 37405 - protein, 15 aa, BK virus
STPVLTSRTSTPPFI

SEQ ID NO: 37406 - protein, 15 aa, BK virus
TPVLTSRTSTPPFIS

SEQ ID NO: 37407 - protein, 15 aa, BK virus
PVLTSRTSTPPFISS

SEQ ID NO: 37408 - protein, 15 aa, BK virus
VLTSRTSTPPFISSF

SEQ ID NO: 37409 - protein, 15 aa, BK virus
LTSRTSTPPFISSFG

SEQ ID NO: 37410 - protein, 15 aa, BK virus
TSRTSTPPFISSFGT

SEQ ID NO: 37411 - protein, 15 aa, BK virus
SRTSTPPFISSFGTC

SEQ ID NO: 37412 - protein, 15 aa, BK virus
RTSTPPFISSFGTCT

SEQ ID NO: 37413 - protein, 15 aa, BK virus
TSTPPFISSFGTCTG

SEQ ID NO: 37414 - protein, 15 aa, BK virus
STPPFISSFGTCTGS

SEQ ID NO: 37415 - protein, 15 aa, BK virus
TPPFISSFGTCTGSF

SEQ ID NO: 37416 - protein, 15 aa, BK virus
PPFISSFGTCTGSFG

SEQ ID NO: 37417 - protein, 15 aa, BK virus
PFISSFGTCTGSFGF

SEQ ID NO: 37418 - protein, 15 aa, BK virus
FISSFGTCTGSFGFL

SEQ ID NO: 37419 - protein, 15 aa, BK virus
ISSFGTCTGSFGFLG

SEQ ID NO: 37420 - protein, 15 aa, BK virus
SSFGTCTGSFGFLGA

SEQ ID NO: 37421 - protein, 15 aa, BK virus
SFGTCTGSFGFLGAA

SEQ ID NO: 37422 - protein, 15 aa, BK virus
FGTCTGSFGFLGAAP

SEQ ID NO: 37423 - protein, 15 aa, BK virus
GTCTGSFGFLGAAPG

SEQ ID NO: 37424 - protein, 15 aa, BK virus
TCTGSFGFLGAAPGH

SEQ ID NO: 37425 - protein, 15 aa, BK virus
CTGSFGFLGAAPGHS

SEQ ID NO: 37426 - protein, 15 aa, BK virus
TGSFGFLGAAPGHSP

SEQ ID NO: 37427 - protein, 15 aa, BK virus
GSFGFLGAAPGHSPF

SEQ ID NO: 37428 - protein, 15 aa, BK virus
SFGFLGAAPGHSPFL

SEQ ID NO: 37429 - protein, 15 aa, BK virus
FGFLGAAPGHSPFLL

SEQ ID NO: 37430 - protein, 15 aa, BK virus
GFLGAAPGHSPFLLV

SEQ ID NO: 37431 - protein, 15 aa, BK virus
FLGAAPGHSPFLLVG

SEQ ID NO: 37432 - protein, 15 aa, BK virus
LGAAPGHSPFLLVGA

SEQ ID NO: 37433 - protein, 15 aa, BK virus
GAAPGHSPFLLVGAI

SEQ ID NO: 37434 - protein, 15 aa, BK virus
AAPGHSPFLLVGAIF

SEQ ID NO: 37435 - protein, 15 aa, BK virus
APGHSPFLLVGAIFI

SEQ ID NO: 37436 - protein, 15 aa, BK virus
PGHSPFLLVGAIFIC

SEQ ID NO: 37437 - protein, 15 aa, BK virus
GHSPFLLVGAIFICF

SEQ ID NO: 37438 - protein, 15 aa, BK virus
HSPFLLVGAIFICFK

SEQ ID NO: 37439 - protein, 15 aa, BK virus
SPFLLVGAIFICFKS

SEQ ID NO: 37440 - protein, 15 aa, BK virus
PFLLVGAIFICFKSR

SEQ ID NO: 37441 - protein, 15 aa, BK virus
FLLVGAIFICFKSRC

SEQ ID NO: 37442 - protein, 15 aa, BK virus
LLVGAIFICFKSRCY

SEQ ID NO: 37443 - protein, 15 aa, BK virus
LVGAIFICFKSRCYS

SEQ ID NO: 37444 - protein, 15 aa, BK virus
VGAIFICFKSRCYSP

SEQ ID NO: 37445 - protein, 15 aa, BK virus
GAIFICFKSRCYSPV

SEQ ID NO: 37446 - protein, 15 aa, BK virus
AIFICFKSRCYSPVQ

SEQ ID NO: 37447 - protein, 15 aa, BK virus
IFICFKSRCYSPVQA

SEQ ID NO: 37448 - protein, 15 aa, BK virus
RQHPLRSSSLISTSW

SEQ ID NO: 37449 - protein, 15 aa, BK virus
QHPLRSSSLISTSWG

SEQ ID NO: 37450 - protein, 15 aa, BK virus
HPLRSSSLISTSWGN

SEQ ID NO: 37451 - protein, 15 aa, BK virus
PLRSSSLISTSWGNS

SEQ ID NO: 37452 - protein, 15 aa, BK virus
LRSSSLISTSWGNSF

SEQ ID NO: 37453 - protein, 15 aa, BK virus
RSSSLISTSWGNSFF

SEQ ID NO: 37454 - protein, 15 aa, BK virus
SSSLISTSWGNSFFY

SEQ ID NO: 37455 - protein, 15 aa, BK virus
SSLISTSWGNSFFYK

SEQ ID NO: 37456 - protein, 15 aa, BK virus
SLISTSWGNSFFYKL

SEQ ID NO: 37457 - protein, 15 aa, BK virus
LISTSWGNSFFYKLS

SEQ ID NO: 37458 - protein, 15 aa, BK virus
VHSLCNFFYTVSIIY

SEQ ID NO: 37459 - protein, 15 aa, BK virus
HSLCNFFYTVSIIYT

SEQ ID NO: 37460 - protein, 15 aa, BK virus
SLCNFFYTVSIIYTI

SEQ ID NO: 37461 - protein, 15 aa, BK virus
LCNFFYTVSIIYTIS

SEQ ID NO: 37462 - protein, 15 aa, BK virus
CNFFYTVSIIYTISM

SEQ ID NO: 37463 - protein, 15 aa, BK virus
NFFYTVSIIYTISMA

SEQ ID NO: 37464 - protein, 15 aa, BK virus
FFYTVSIIYTISMAK

SEQ ID NO: 37465 - protein, 15 aa, BK virus
FYTVSIIYTISMAKM

SEQ ID NO: 37466 - protein, 15 aa, BK virus
YTVSIIYTISMAKMY

SEQ ID NO: 37467 - protein, 15 aa, BK virus
TVSIIYTISMAKMYT

SEQ ID NO: 37468 - protein, 15 aa, BK virus
VSIIYTISMAKMYTG

SEQ ID NO: 37469 - protein, 15 aa, BK virus
SIIYTISMAKMYTGT

SEQ ID NO: 37470 - protein, 15 aa, BK virus
IIYTISMAKMYTGTF

SEQ ID NO: 37471 - protein, 15 aa, BK virus
IYTISMAKMYTGTFP

SEQ ID NO: 37472 - protein, 15 aa, BK virus
YTISMAKMYTGTFPF

SEQ ID NO: 37473 - protein, 15 aa, BK virus
TISMAKMYTGTFPFS

SEQ ID NO: 37474 - protein, 15 aa, BK virus
ISMAKMYTGTFPFSY

SEQ ID NO: 37475 - protein, 15 aa, BK virus
SMAKMYTGTFPFSYL

SEQ ID NO: 37476 - protein, 15 aa, BK virus
MAKMYTGTFPFSYLS

SEQ ID NO: 37477 - protein, 15 aa, BK virus
AKMYTGTFPFSYLSN

SEQ ID NO: 37478 - protein, 15 aa, BK virus
KMYTGTFPFSYLSNH

SEQ ID NO: 37479 - protein, 15 aa, BK virus
GPNRGKIRIILLNII

SEQ ID NO: 37480 - protein, 15 aa, BK virus
PNRGKIRIILLNIII

SEQ ID NO: 37481 - protein, 15 aa, BK virus
NRGKIRIILLNIIIK

SEQ ID NO: 37482 - protein, 15 aa, BK virus
RGKIRIILLNIIIKV

SEQ ID NO: 37483 - protein, 15 aa, BK virus
GKIRIILLNIIIKVY

SEQ ID NO: 37484 - protein, 15 aa, BK virus
KIRIILLNIIIKVYR

SEQ ID NO: 37485 - protein, 15 aa, BK virus
IRIILLNIIIKVYRG

SEQ ID NO: 37486 - protein, 15 aa, BK virus
RIILLNIIIKVYRGI

SEQ ID NO: 37487 - protein, 15 aa, BK virus
IILLNIIIKVYRGIY

SEQ ID NO: 37488 - protein, 15 aa, BK virus
ILLNIIIKVYRGIYN

SEQ ID NO: 37489 - protein, 15 aa, BK virus
LLNIIIKVYRGIYNC

SEQ ID NO: 37490 - protein, 15 aa, BK virus
LNIIIKVYRGIYNCP

SEQ ID NO: 37491 - protein, 15 aa, BK virus
NIIIKVYRGIYNCPG

SEQ ID NO: 37492 - protein, 15 aa, BK virus
IIIKVYRGIYNCPGS

SEQ ID NO: 37493 - protein, 15 aa, BK virus
IIKVYRGIYNCPGSF

SEQ ID NO: 37494 - protein, 15 aa, BK virus
IKVYRGIYNCPGSFL

SEQ ID NO: 37495 - protein, 15 aa, BK virus
KVYRGIYNCPGSFLQ

SEQ ID NO: 37496 - protein, 15 aa, BK virus
VYRGIYNCPGSFLQK

SEQ ID NO: 37497 - protein, 15 aa, BK virus
YRGIYNCPGSFLQKS

SEQ ID NO: 37498 - protein, 15 aa, BK virus
RGIYNCPGSFLQKSS

SEQ ID NO: 37499 - protein, 15 aa, BK virus
GIYNCPGSFLQKSSQ

SEQ ID NO: 37500 - protein, 15 aa, BK virus
IYNCPGSFLQKSSQG

SEQ ID NO: 37501 - protein, 15 aa, BK virus
YNCPGSFLQKSSQGV

SEQ ID NO: 37502 - protein, 15 aa, BK virus
NCPGSFLQKSSQGVS

SEQ ID NO: 37503 - protein, 15 aa, BK virus
CPGSFLQKSSQGVSK

SEQ ID NO: 37504 - protein, 15 aa, BK virus
PGSFLQKSSQGVSKK

SEQ ID NO: 37505 - protein, 15 aa, BK virus
GSFLQKSSQGVSKKS

SEQ ID NO: 37506 - protein, 15 aa, BK virus
SFLQKSSQGVSKKSF

SEQ ID NO: 37507 - protein, 15 aa, BK virus
FLQKSSQGVSKKSFC

SEQ ID NO: 37508 - protein, 15 aa, BK virus
LQKSSQGVSKKSFCS

SEQ ID NO: 37509 - protein, 15 aa, BK virus
QKSSQGVSKKSFCSS

SEQ ID NO: 37510 - protein, 15 aa, BK virus
KSSQGVSKKSFCSSL

SEQ ID NO: 37511 - protein, 15 aa, BK virus
SSQGVSKKSFCSSLQ

SEQ ID NO: 37512 - protein, 15 aa, BK virus
SQGVSKKSFCSSLQF

SEQ ID NO: 37513 - protein, 15 aa, BK virus
QGVSKKSFCSSLQFL

SEQ ID NO: 37514 - protein, 15 aa, BK virus
GYRRYIIPNNMPQSL

SEQ ID NO: 37515 - protein, 15 aa, BK virus
YRRYIIPNNMPQSLG

SEQ ID NO: 37516 - protein, 15 aa, BK virus
RRYIIPNNMPQSLGN

SEQ ID NO: 37517 - protein, 15 aa, BK virus
RYIIPNNMPQSLGNS

SEQ ID NO: 37518 - protein, 15 aa, BK virus
YIIPNNMPQSLGNSS

SEQ ID NO: 37519 - protein, 15 aa, BK virus
IIPNNMPQSLGNSSK

SEQ ID NO: 37520 - protein, 15 aa, BK virus
IPNNMPQSLGNSSKQ

SEQ ID NO: 37521 - protein, 15 aa, BK virus
PNNMPQSLGNSSKQR

SEQ ID NO: 37522 - protein, 15 aa, BK virus
NNMPQSLGNSSKQRR

SEQ ID NO: 37523 - protein, 15 aa, BK virus
NMPQSLGNSSKQRRT

SEQ ID NO: 37524 - protein, 15 aa, BK virus
MPQSLGNSSKQRRTP

SEQ ID NO: 37525 - protein, 15 aa, BK virus
PQSLGNSSKQRRTPM

SEQ ID NO: 37526 - protein, 15 aa, BK virus
QSLGNSSKQRRTPMP

SEQ ID NO: 37527 - protein, 15 aa, BK virus
SLGNSSKQRRTPMPR

SEQ ID NO: 37528 - protein, 15 aa, BK virus
LGNSSKQRRTPMPRI

SEQ ID NO: 37529 - protein, 15 aa, BK virus
GNSSKQRRTPMPRIK

SEQ ID NO: 37530 - protein, 15 aa, BK virus
NSSKQRRTPMPRIKV

SEQ ID NO: 37531 - protein, 15 aa, BK virus
SSKQRRTPMPRIKVL

SEQ ID NO: 37532 - protein, 15 aa, BK virus
SKQRRTPMPRIKVLN

SEQ ID NO: 37533 - protein, 15 aa, BK virus
KQRRTPMPRIKVLNI

SEQ ID NO: 37534 - protein, 15 aa, BK virus
QRRTPMPRIKVLNII

SEQ ID NO: 37535 - protein, 15 aa, BK virus
RRTPMPRIKVLNIIN

SEQ ID NO: 37536 - protein, 15 aa, BK virus
RTPMPRIKVLNIINK

SEQ ID NO: 37537 - protein, 15 aa, BK virus
TPMPRIKVLNIINKS

SEQ ID NO: 37538 - protein, 15 aa, BK virus
PMPRIKVLNIINKSI

SEQ ID NO: 37539 - protein, 15 aa, BK virus
MPRIKVLNIINKSIY

SEQ ID NO: 37540 - protein, 15 aa, BK virus
PRIKVLNIINKSIYT

SEQ ID NO: 37541 - protein, 15 aa, BK virus
RIKVLNIINKSIYTR

SEQ ID NO: 37542 - protein, 15 aa, BK virus
IKVLNIINKSIYTRK

SEQ ID NO: 37543 - protein, 15 aa, BK virus
KVLNIINKSIYTRKQ

SEQ ID NO: 37544 - protein, 15 aa, BK virus
VLNIINKSIYTRKQN

SEQ ID NO: 37545 - protein, 15 aa, BK virus
LNIINKSIYTRKQNI

SEQ ID NO: 37546 - protein, 15 aa, BK virus
NIINKSIYTRKQNII

SEQ ID NO: 37547 - protein, 15 aa, BK virus
IINKSIYTRKQNIIV

SEQ ID NO: 37548 - protein, 15 aa, BK virus
INKSIYTRKQNIIVL

SEQ ID NO: 37549 - protein, 15 aa, BK virus
NKSIYTRKQNIIVLI

SEQ ID NO: 37550 - protein, 15 aa, BK virus
KSIYTRKQNIIVLIW

SEQ ID NO: 37551 - protein, 15 aa, BK virus
SIYTRKQNIIVLIWV

SEQ ID NO: 37552 - protein, 15 aa, BK virus
IYTRKQNIIVLIWVK

SEQ ID NO: 37553 - protein, 15 aa, BK virus
YTRKQNIIVLIWVKQ

SEQ ID NO: 37554 - protein, 15 aa, BK virus
TRKQNIIVLIWVKQF

SEQ ID NO: 37555 - protein, 15 aa, BK virus
RKQNIIVLIWVKQFQ

SEQ ID NO: 37556 - protein, 15 aa, BK virus
KQNIIVLIWVKQFQS

SEQ ID NO: 37557 - protein, 15 aa, BK virus
QNIIVLIWVKQFQSH

SEQ ID NO: 37558 - protein, 15 aa, BK virus
NIIVLIWVKQFQSHA

SEQ ID NO: 37559 - protein, 15 aa, BK virus
LLIEAYSGNFVIPII

SEQ ID NO: 37560 - protein, 15 aa, BK virus
LIEAYSGNFVIPIIK

SEQ ID NO: 37561 - protein, 15 aa, BK virus
IEAYSGNFVIPIIKE

SEQ ID NO: 37562 - protein, 15 aa, BK virus
EAYSGNFVIPIIKEL

SEQ ID NO: 37563 - protein, 15 aa, BK virus
AYSGNFVIPIIKELI

SEQ ID NO: 37564 - protein, 15 aa, BK virus
YSGNFVIPIIKELIP

SEQ ID NO: 37565 - protein, 15 aa, BK virus
SGNFVIPIIKELIPY

SEQ ID NO: 37566 - protein, 15 aa, BK virus
GNFVIPIIKELIPYL

SEQ ID NO: 37567 - protein, 15 aa, BK virus
NFVIPIIKELIPYLS

SEQ ID NO: 37568 - protein, 15 aa, BK virus
SSKPSNSPRSTSNYS

SEQ ID NO: 37569 - protein, 15 aa, BK virus
SKPSNSPRSTSNYSI

SEQ ID NO: 37570 - protein, 15 aa, BK virus
KPSNSPRSTSNYSIC

SEQ ID NO: 37571 - protein, 15 aa, BK virus
PSNSPRSTSNYSICL

SEQ ID NO: 37572 - protein, 15 aa, BK virus
SNSPRSTSNYSICLR

SEQ ID NO: 37573 - protein, 15 aa, BK virus
NSPRSTSNYSICLRS

SEQ ID NO: 37574 - protein, 15 aa, BK virus
GTCYALYSSKGCNLN

SEQ ID NO: 37575 - protein, 15 aa, BK virus
TCYALYSSKGCNLNF

SEQ ID NO: 37576 - protein, 15 aa, BK virus
CYALYSSKGCNLNFY

SEQ ID NO: 37577 - protein, 15 aa, BK virus
YALYSSKGCNLNFYS

SEQ ID NO: 37578 - protein, 15 aa, BK virus
ALYSSKGCNLNFYSS

SEQ ID NO: 37579 - protein, 15 aa, BK virus
LYSSKGCNLNFYSSS

SEQ ID NO: 37580 - protein, 15 aa, BK virus
YSSKGCNLNFYSSSS

SEQ ID NO: 37581 - protein, 15 aa, BK virus
SSKGCNLNFYSSSSL

SEQ ID NO: 37582 - protein, 15 aa, BK virus
SKGCNLNFYSSSSLP

SEQ ID NO: 37583 - protein, 15 aa, BK virus
KGCNLNFYSSSSLPS

SEQ ID NO: 37584 - protein, 15 aa, BK virus
GCNLNFYSSSSLPSS

SEQ ID NO: 37585 - protein, 15 aa, BK virus
CNLNFYSSSSLPSSN

SEQ ID NO: 37586 - protein, 15 aa, BK virus
NLNFYSSSSLPSSNF

SEQ ID NO: 37587 - protein, 15 aa, BK virus
LNFYSSSSLPSSNFS

SEQ ID NO: 37588 - protein, 15 aa, BK virus
NFYSSSSLPSSNFSH

SEQ ID NO: 37589 - protein, 15 aa, BK virus
SSTHEPGNTKKKGLL

SEQ ID NO: 37590 - protein, 15 aa, BK virus
STHEPGNTKKKGLLT

SEQ ID NO: 37591 - protein, 15 aa, BK virus
ESFTESFTAGKAVVL

SEQ ID NO: 37592 - protein, 15 aa, BK virus
SFTESFTAGKAVVLL

SEQ ID NO: 37593 - protein, 15 aa, BK virus
FTESFTAGKAVVLLF

SEQ ID NO: 37594 - protein, 15 aa, BK virus
TESFTAGKAVVLLFF

SEQ ID NO: 37595 - protein, 15 aa, BK virus
ESFTAGKAVVLLFFP

SEQ ID NO: 37596 - protein, 15 aa, BK virus
SFTAGKAVVLLFFPS

SEQ ID NO: 37597 - protein, 15 aa, BK virus
FTAGKAVVLLFFPST

SEQ ID NO: 37598 - protein, 15 aa, BK virus
TAGKAVVLLFFPSTL

SEQ ID NO: 37599 - protein, 15 aa, BK virus
AGKAVVLLFFPSTLS

SEQ ID NO: 37600 - protein, 15 aa, BK virus
GKAVVLLFFPSTLSS

SEQ ID NO: 37601 - protein, 15 aa, BK virus
KAVVLLFFPSTLSSP

SEQ ID NO: 37602 - protein, 15 aa, BK virus
AVVLLFFPSTLSSPL

SEQ ID NO: 37603 - protein, 15 aa, BK virus
VVLLFFPSTLSSPLQ

SEQ ID NO: 37604 - protein, 15 aa, BK virus
VLLFFPSTLSSPLQN

SEQ ID NO: 37605 - protein, 15 aa, BK virus
LLFFPSTLSSPLQNS

SEQ ID NO: 37606 - protein, 15 aa, BK virus
LFFPSTLSSPLQNSS

SEQ ID NO: 37607 - protein, 15 aa, BK virus
FFPSTLSSPLQNSSK

SEQ ID NO: 37608 - protein, 15 aa, BK virus
FPSTLSSPLQNSSKS

SEQ ID NO: 37609 - protein, 15 aa, BK virus
PSTLSSPLQNSSKSS

SEQ ID NO: 37610 - protein, 15 aa, BK virus
STLSSPLQNSSKSSK

SEQ ID NO: 37611 - protein, 15 aa, BK virus
TLSSPLQNSSKSSKI

SEQ ID NO: 37612 - protein, 15 aa, BK virus
LSSPLQNSSKSSKIK

SEQ ID NO: 37613 - protein, 15 aa, BK virus
SSPLQNSSKSSKIKI

SEQ ID NO: 37614 - protein, 15 aa, BK virus
SPLQNSSKSSKIKIK

SEQ ID NO: 37615 - protein, 15 aa, BK virus
PLQNSSKSSKIKIKI

SEQ ID NO: 37616 - protein, 15 aa, BK virus
LQNSSKSSKIKIKIL

SEQ ID NO: 37617 - protein, 15 aa, BK virus
ALFFVPVQVLPTFTE

SEQ ID NO: 37618 - protein, 15 aa, BK virus
LFFVPVQVLPTFTEA

SEQ ID NO: 37619 - protein, 15 aa, BK virus
FFVPVQVLPTFTEAC

SEQ ID NO: 37620 - protein, 15 aa, BK virus
FVPVQVLPTFTEACR

SEQ ID NO: 37621 - protein, 15 aa, BK virus
VPVQVLPTFTEACRD

SEQ ID NO: 37622 - protein, 15 aa, BK virus
PVQVLPTFTEACRDS

SEQ ID NO: 37623 - protein, 15 aa, BK virus
VQVLPTFTEACRDSW

SEQ ID NO: 37624 - protein, 15 aa, BK virus
QVLPTFTEACRDSWR

SEQ ID NO: 37625 - protein, 15 aa, BK virus
VLPTFTEACRDSWRR

SEQ ID NO: 37626 - protein, 15 aa, BK virus
LPTFTEACRDSWRRT

SEQ ID NO: 37627 - protein, 15 aa, BK virus
PTFTEACRDSWRRTM

SEQ ID NO: 37628 - protein, 15 aa, BK virus
TFTEACRDSWRRTMA

SEQ ID NO: 37629 - protein, 15 aa, BK virus
FTEACRDSWRRTMAF

SEQ ID NO: 37630 - protein, 15 aa, BK virus
TEACRDSWRRTMAFV

SEQ ID NO: 37631 - protein, 15 aa, BK virus
EACRDSWRRTMAFVQ

SEQ ID NO: 37632 - protein, 15 aa, BK virus
ACRDSWRRTMAFVQF

SEQ ID NO: 37633 - protein, 15 aa, BK virus
CRDSWRRTMAFVQFN

SEQ ID NO: 37634 - protein, 15 aa, BK virus
RDSWRRTMAFVQFNW

SEQ ID NO: 37635 - protein, 15 aa, BK virus
DSWRRTMAFVQFNWG

SEQ ID NO: 37636 - protein, 15 aa, BK virus
SWRRTMAFVQFNWGQ

SEQ ID NO: 37637 - protein, 15 aa, BK virus
WRRTMAFVQFNWGQG

SEQ ID NO: 37638 - protein, 15 aa, BK virus
RRTMAFVQFNWGQGQ

SEQ ID NO: 37639 - protein, 15 aa, BK virus
RTMAFVQFNWGQGQD

SEQ ID NO: 37640 - protein, 15 aa, BK virus
TMAFVQFNWGQGQDS

SEQ ID NO: 37641 - protein, 15 aa, BK virus
ARKTCLSCTFLPEVM

SEQ ID NO: 37642 - protein, 15 aa, BK virus
RKTCLSCTFLPEVMV

SEQ ID NO: 37643 - protein, 15 aa, BK virus
KTCLSCTFLPEVMVW

SEQ ID NO: 37644 - protein, 15 aa, BK virus
TCLSCTFLPEVMVWL

SEQ ID NO: 37645 - protein, 15 aa, BK virus
CLSCTFLPEVMVWLH

SEQ ID NO: 37646 - protein, 15 aa, BK virus
LSCTFLPEVMVWLHS

SEQ ID NO: 37647 - protein, 15 aa, BK virus
SCTFLPEVMVWLHSM

SEQ ID NO: 37648 - protein, 15 aa, BK virus
CTFLPEVMVWLHSMG

SEQ ID NO: 37649 - protein, 15 aa, BK virus
TFLPEVMVWLHSMGK

SEQ ID NO: 37650 - protein, 15 aa, BK virus
FLPEVMVWLHSMGKQ

SEQ ID NO: 37651 - protein, 15 aa, BK virus
LPEVMVWLHSMGKQL

SEQ ID NO: 37652 - protein, 15 aa, BK virus
PEVMVWLHSMGKQLL

SEQ ID NO: 37653 - protein, 15 aa, BK virus
EVMVWLHSMGKQLLP

SEQ ID NO: 37654 - protein, 15 aa, BK virus
VMVWLHSMGKQLLPV

SEQ ID NO: 37655 - protein, 15 aa, BK virus
MVWLHSMGKQLLPVS

SEQ ID NO: 37656 - protein, 15 aa, BK virus
VWLHSMGKQLLPVSH

SEQ ID NO: 37657 - protein, 15 aa, BK virus
WLHSMGKQLLPVSHA

SEQ ID NO: 37658 - protein, 15 aa, BK virus
LHSMGKQLLPVSHAL

SEQ ID NO: 37659 - protein, 15 aa, BK virus
HSMGKQLLPVSHALS

SEQ ID NO: 37660 - protein, 15 aa, BK virus
SMGKQLLPVSHALSF

SEQ ID NO: 37661 - protein, 15 aa, BK virus
MGKQLLPVSHALSFL

SEQ ID NO: 37662 - protein, 15 aa, BK virus
GKQLLPVSHALSFLR

SEQ ID NO: 37663 - protein, 15 aa, BK virus
KQLLPVSHALSFLRS

SEQ ID NO: 37664 - protein, 15 aa, BK virus
QLLPVSHALSFLRSW

SEQ ID NO: 37665 - protein, 15 aa, BK virus
LLPVSHALSFLRSWF

SEQ ID NO: 37666 - protein, 15 aa, BK virus
LPVSHALSFLRSWFG

SEQ ID NO: 37667 - protein, 15 aa, BK virus
PVSHALSFLRSWFGC

SEQ ID NO: 37668 - protein, 15 aa, BK virus
VSHALSFLRSWFGCI

SEQ ID NO: 37669 - protein, 15 aa, BK virus
SHALSFLRSWFGCIP

SEQ ID NO: 37670 - protein, 15 aa, BK virus
HALSFLRSWFGCIPL

SEQ ID NO: 37671 - protein, 15 aa, BK virus
GLAKLFGEIPILLQF

SEQ ID NO: 37672 - protein, 15 aa, BK virus
LAKLFGEIPILLQFL

SEQ ID NO: 37673 - protein, 15 aa, BK virus
AKLFGEIPILLQFLQ

SEQ ID NO: 37674 - protein, 16 aa, BK virus
MDKVLNREESMELMDL

SEQ ID NO: 37675 - protein, 16 aa, BK virus
DKVLNREESMELMDLL

SEQ ID NO: 37676 - protein, 16 aa, BK virus
KVLNREESMELMDLLG

SEQ ID NO: 37677 - protein, 16 aa, BK virus
VLNREESMELMDLLGL

SEQ ID NO: 37678 - protein, 16 aa, BK virus
LNREESMELMDLLGLE

SEQ ID NO: 37679 - protein, 16 aa, BK virus
NREESMELMDLLGLER

SEQ ID NO: 37680 - protein, 16 aa, BK virus
REESMELMDLLGLERA

SEQ ID NO: 37681 - protein, 16 aa, BK virus
EESMELMDLLGLERAA

SEQ ID NO: 37682 - protein, 16 aa, BK virus
ESMELMDLLGLERAAW

SEQ ID NO: 37683 - protein, 16 aa, BK virus
SMELMDLLGLERAAWG

SEQ ID NO: 37684 - protein, 16 aa, BK virus
MELMDLLGLERAAWGN

SEQ ID NO: 37685 - protein, 16 aa, BK virus
ELMDLLGLERAAWGNL

SEQ ID NO: 37686 - protein, 16 aa, BK virus
LMDLLGLERAAWGNLP

SEQ ID NO: 37687 - protein, 16 aa, BK virus
MDLLGLERAAWGNLPL

SEQ ID NO: 37688 - protein, 16 aa, BK virus
DLLGLERAAWGNLPLM

SEQ ID NO: 37689 - protein, 16 aa, BK virus
LLGLERAAWGNLPLMR

SEQ ID NO: 37690 - protein, 16 aa, BK virus
LGLERAAWGNLPLMRK

SEQ ID NO: 37691 - protein, 16 aa, BK virus
GLERAAWGNLPLMRKA

SEQ ID NO: 37692 - protein, 16 aa, BK virus
LERAAWGNLPLMRKAY

SEQ ID NO: 37693 - protein, 16 aa, BK virus
ERAAWGNLPLMRKAYL

SEQ ID NO: 37694 - protein, 16 aa, BK virus
RAAWGNLPLMRKAYLR

SEQ ID NO: 37695 - protein, 16 aa, BK virus
AAWGNLPLMRKAYLRK

SEQ ID NO: 37696 - protein, 16 aa, BK virus
AWGNLPLMRKAYLRKC

SEQ ID NO: 37697 - protein, 16 aa, BK virus
WGNLPLMRKAYLRKCK

SEQ ID NO: 37698 - protein, 16 aa, BK virus
GNLPLMRKAYLRKCKE

SEQ ID NO: 37699 - protein, 16 aa, BK virus
NLPLMRKAYLRKCKEF

SEQ ID NO: 37700 - protein, 16 aa, BK virus
LPLMRKAYLRKCKEFH

SEQ ID NO: 37701 - protein, 16 aa, BK virus
PLMRKAYLRKCKEFHP

SEQ ID NO: 37702 - protein, 16 aa, BK virus
LMRKAYLRKCKEFHPD

SEQ ID NO: 37703 - protein, 16 aa, BK virus
MRKAYLRKCKEFHPDK

SEQ ID NO: 37704 - protein, 16 aa, BK virus
RKAYLRKCKEFHPDKG

SEQ ID NO: 37705 - protein, 16 aa, BK virus
KAYLRKCKEFHPDKGG

SEQ ID NO: 37706 - protein, 16 aa, BK virus
AYLRKCKEFHPDKGGD

SEQ ID NO: 37707 - protein, 16 aa, BK virus
YLRKCKEFHPDKGGDE

SEQ ID NO: 37708 - protein, 16 aa, BK virus
LRKCKEFHPDKGGDED

SEQ ID NO: 37709 - protein, 16 aa, BK virus
RKCKEFHPDKGGDEDK

SEQ ID NO: 37710 - protein, 16 aa, BK virus
KCKEFHPDKGGDEDKM

SEQ ID NO: 37711 - protein, 16 aa, BK virus
CKEFHPDKGGDEDKMK

SEQ ID NO: 37712 - protein, 16 aa, BK virus
KEFHPDKGGDEDKMKR

SEQ ID NO: 37713 - protein, 16 aa, BK virus
EFHPDKGGDEDKMKRM

SEQ ID NO: 37714 - protein, 16 aa, BK virus
FHPDKGGDEDKMKRMN

SEQ ID NO: 37715 - protein, 16 aa, BK virus
HPDKGGDEDKMKRMNT

SEQ ID NO: 37716 - protein, 16 aa, BK virus
PDKGGDEDKMKRMNTL

SEQ ID NO: 37717 - protein, 16 aa, BK virus
DKGGDEDKMKRMNTLY

SEQ ID NO: 37718 - protein, 16 aa, BK virus
KGGDEDKMKRMNTLYK

SEQ ID NO: 37719 - protein, 16 aa, BK virus
GGDEDKMKRMNTLYKK

SEQ ID NO: 37720 - protein, 16 aa, BK virus
GDEDKMKRMNTLYKKM

SEQ ID NO: 37721 - protein, 16 aa, BK virus
DEDKMKRMNTLYKKME

SEQ ID NO: 37722 - protein, 16 aa, BK virus
EDKMKRMNTLYKKMEQ

SEQ ID NO: 37723 - protein, 16 aa, BK virus
DKMKRMNTLYKKMEQD

SEQ ID NO: 37724 - protein, 16 aa, BK virus
KMKRMNTLYKKMEQDV

SEQ ID NO: 37725 - protein, 16 aa, BK virus
MKRMNTLYKKMEQDVK

SEQ ID NO: 37726 - protein, 16 aa, BK virus
KRMNTLYKKMEQDVKV

SEQ ID NO: 37727 - protein, 16 aa, BK virus
RMNTLYKKMEQDVKVA

SEQ ID NO: 37728 - protein, 16 aa, BK virus
MNTLYKKMEQDVKVAH

SEQ ID NO: 37729 - protein, 16 aa, BK virus
NTLYKKMEQDVKVAHQ

SEQ ID NO: 37730 - protein, 16 aa, BK virus
TLYKKMEQDVKVAHQP

SEQ ID NO: 37731 - protein, 16 aa, BK virus
LYKKMEQDVKVAHQPD

SEQ ID NO: 37732 - protein, 16 aa, BK virus
YKKMEQDVKVAHQPDF

SEQ ID NO: 37733 - protein, 16 aa, BK virus
KKMEQDVKVAHQPDFG

SEQ ID NO: 37734 - protein, 16 aa, BK virus
KMEQDVKVAHQPDFGT

SEQ ID NO: 37735 - protein, 16 aa, BK virus
MEQDVKVAHQPDFGTW

SEQ ID NO: 37736 - protein, 16 aa, BK virus
EQDVKVAHQPDFGTWS

SEQ ID NO: 37737 - protein, 16 aa, BK virus
QDVKVAHQPDFGTWSS

SEQ ID NO: 37738 - protein, 16 aa, BK virus
DVKVAHQPDFGTWSSS

SEQ ID NO: 37739 - protein, 16 aa, BK virus
VKVAHQPDFGTWSSSE

SEQ ID NO: 37740 - protein, 16 aa, BK virus
KVAHQPDFGTWSSSEV

SEQ ID NO: 37741 - protein, 16 aa, BK virus
VAHQPDFGTWSSSEVC

SEQ ID NO: 37742 - protein, 16 aa, BK virus
AHQPDFGTWSSSEVCA

SEQ ID NO: 37743 - protein, 16 aa, BK virus
HQPDFGTWSSSEVCAD

SEQ ID NO: 37744 - protein, 16 aa, BK virus
QPDFGTWSSSEVCADF

SEQ ID NO: 37745 - protein, 16 aa, BK virus
PDFGTWSSSEVCADFP

SEQ ID NO: 37746 - protein, 16 aa, BK virus
DFGTWSSSEVCADFPL

SEQ ID NO: 37747 - protein, 16 aa, BK virus
FGTWSSSEVCADFPLC

SEQ ID NO: 37748 - protein, 16 aa, BK virus
GTWSSSEVCADFPLCP

SEQ ID NO: 37749 - protein, 16 aa, BK virus
TWSSSEVCADFPLCPD

SEQ ID NO: 37750 - protein, 16 aa, BK virus
WSSSEVCADFPLCPDT

SEQ ID NO: 37751 - protein, 16 aa, BK virus
SSSEVCADFPLCPDTL

SEQ ID NO: 37752 - protein, 16 aa, BK virus
SSEVCADFPLCPDTLY

SEQ ID NO: 37753 - protein, 16 aa, BK virus
SEVCADFPLCPDTLYC

SEQ ID NO: 37754 - protein, 16 aa, BK virus
EVCADFPLCPDTLYCK

SEQ ID NO: 37755 - protein, 16 aa, BK virus
VCADFPLCPDTLYCKE

SEQ ID NO: 37756 - protein, 16 aa, BK virus
CADFPLCPDTLYCKEW

SEQ ID NO: 37757 - protein, 16 aa, BK virus
ADFPLCPDTLYCKEWP

SEQ ID NO: 37758 - protein, 16 aa, BK virus
DFPLCPDTLYCKEWPI

SEQ ID NO: 37759 - protein, 16 aa, BK virus
FPLCPDTLYCKEWPIC

SEQ ID NO: 37760 - protein, 16 aa, BK virus
PLCPDTLYCKEWPICS

SEQ ID NO: 37761 - protein, 16 aa, BK virus
LCPDTLYCKEWPICSK

SEQ ID NO: 37762 - protein, 16 aa, BK virus
CPDTLYCKEWPICSKK

SEQ ID NO: 37763 - protein, 16 aa, BK virus
PDTLYCKEWPICSKKP

SEQ ID NO: 37764 - protein, 16 aa, BK virus
DTLYCKEWPICSKKPS

SEQ ID NO: 37765 - protein, 16 aa, BK virus
TLYCKEWPICSKKPSV

SEQ ID NO: 37766 - protein, 16 aa, BK virus
LYCKEWPICSKKPSVH

SEQ ID NO: 37767 - protein, 16 aa, BK virus
YCKEWPICSKKPSVHC

SEQ ID NO: 37768 - protein, 16 aa, BK virus
CKEWPICSKKPSVHCP

SEQ ID NO: 37769 - protein, 16 aa, BK virus
KEWPICSKKPSVHCPC

SEQ ID NO: 37770 - protein, 16 aa, BK virus
EWPICSKKPSVHCPCM

SEQ ID NO: 37771 - protein, 16 aa, BK virus
WPICSKKPSVHCPCML

SEQ ID NO: 37772 - protein, 16 aa, BK virus
PICSKKPSVHCPCMLC

SEQ ID NO: 37773 - protein, 16 aa, BK virus
ICSKKPSVHCPCMLCQ

SEQ ID NO: 37774 - protein, 16 aa, BK virus
CSKKPSVHCPCMLCQL

SEQ ID NO: 37775 - protein, 16 aa, BK virus
SKKPSVHCPCMLCQLR

SEQ ID NO: 37776 - protein, 16 aa, BK virus
KKPSVHCPCMLCQLRL

SEQ ID NO: 37777 - protein, 16 aa, BK virus
KPSVHCPCMLCQLRLR

SEQ ID NO: 37778 - protein, 16 aa, BK virus
PSVHCPCMLCQLRLRH

SEQ ID NO: 37779 - protein, 16 aa, BK virus
SVHCPCMLCQLRLRHL

SEQ ID NO: 37780 - protein, 16 aa, BK virus
VHCPCMLCQLRLRHLN

SEQ ID NO: 37781 - protein, 16 aa, BK virus
HCPCMLCQLRLRHLNR

SEQ ID NO: 37782 - protein, 16 aa, BK virus
CPCMLCQLRLRHLNRK

SEQ ID NO: 37783 - protein, 16 aa, BK virus
PCMLCQLRLRHLNRKF

SEQ ID NO: 37784 - protein, 16 aa, BK virus
CMLCQLRLRHLNRKFL

SEQ ID NO: 37785 - protein, 16 aa, BK virus
MLCQLRLRHLNRKFLR

SEQ ID NO: 37786 - protein, 16 aa, BK virus
LCQLRLRHLNRKFLRK

SEQ ID NO: 37787 - protein, 16 aa, BK virus
CQLRLRHLNRKFLRKE

SEQ ID NO: 37788 - protein, 16 aa, BK virus
QLRLRHLNRKFLRKEP

SEQ ID NO: 37789 - protein, 16 aa, BK virus
LRLRHLNRKFLRKEPL

SEQ ID NO: 37790 - protein, 16 aa, BK virus
RLRHLNRKFLRKEPLV

SEQ ID NO: 37791 - protein, 16 aa, BK virus
LRHLNRKFLRKEPLVW

SEQ ID NO: 37792 - protein, 16 aa, BK virus
RHLNRKFLRKEPLVWI

SEQ ID NO: 37793 - protein, 16 aa, BK virus
HLNRKFLRKEPLVWID

SEQ ID NO: 37794 - protein, 16 aa, BK virus
LNRKFLRKEPLVWIDC

SEQ ID NO: 37795 - protein, 16 aa, BK virus
NRKFLRKEPLVWIDCY

SEQ ID NO: 37796 - protein, 16 aa, BK virus
RKFLRKEPLVWIDCYC

SEQ ID NO: 37797 - protein, 16 aa, BK virus
KFLRKEPLVWIDCYCI

SEQ ID NO: 37798 - protein, 16 aa, BK virus
FLRKEPLVWIDCYCID

SEQ ID NO: 37799 - protein, 16 aa, BK virus
LRKEPLVWIDCYCIDC

SEQ ID NO: 37800 - protein, 16 aa, BK virus
RKEPLVWIDCYCIDCF

SEQ ID NO: 37801 - protein, 16 aa, BK virus
KEPLVWIDCYCIDCFT

SEQ ID NO: 37802 - protein, 16 aa, BK virus
EPLVWIDCYCIDCFTQ

SEQ ID NO: 37803 - protein, 16 aa, BK virus
PLVWIDCYCIDCFTQW

SEQ ID NO: 37804 - protein, 16 aa, BK virus
LVWIDCYCIDCFTQWF

SEQ ID NO: 37805 - protein, 16 aa, BK virus
VWIDCYCIDCFTQWFG

SEQ ID NO: 37806 - protein, 16 aa, BK virus
WIDCYCIDCFTQWFGL

SEQ ID NO: 37807 - protein, 16 aa, BK virus
IDCYCIDCFTQWFGLD

SEQ ID NO: 37808 - protein, 16 aa, BK virus
DCYCIDCFTQWFGLDL

SEQ ID NO: 37809 - protein, 16 aa, BK virus
CYCIDCFTQWFGLDLT

SEQ ID NO: 37810 - protein, 16 aa, BK virus
YCIDCFTQWFGLDLTE

SEQ ID NO: 37811 - protein, 16 aa, BK virus
CIDCFTQWFGLDLTEE

SEQ ID NO: 37812 - protein, 16 aa, BK virus
IDCFTQWFGLDLTEET

SEQ ID NO: 37813 - protein, 16 aa, BK virus
DCFTQWFGLDLTEETL

SEQ ID NO: 37814 - protein, 16 aa, BK virus
CFTQWFGLDLTEETLQ

SEQ ID NO: 37815 - protein, 16 aa, BK virus
FTQWFGLDLTEETLQW

SEQ ID NO: 37816 - protein, 16 aa, BK virus
TQWFGLDLTEETLQWW

SEQ ID NO: 37817 - protein, 16 aa, BK virus
QWFGLDLTEETLQWWV

SEQ ID NO: 37818 - protein, 16 aa, BK virus
WFGLDLTEETLQWWVQ

SEQ ID NO: 37819 - protein, 16 aa, BK virus
FGLDLTEETLQWWVQI

SEQ ID NO: 37820 - protein, 16 aa, BK virus
GLDLTEETLQWWVQII

SEQ ID NO: 37821 - protein, 16 aa, BK virus
LDLTEETLQWWVQIIG

SEQ ID NO: 37822 - protein, 16 aa, BK virus
DLTEETLQWWVQIIGE

SEQ ID NO: 37823 - protein, 16 aa, BK virus
LTEETLQWWVQIIGET

SEQ ID NO: 37824 - protein, 16 aa, BK virus
TEETLQWWVQIIGETP

SEQ ID NO: 37825 - protein, 16 aa, BK virus
EETLQWWVQIIGETPF

SEQ ID NO: 37826 - protein, 16 aa, BK virus
ETLQWWVQIIGETPFR

SEQ ID NO: 37827 - protein, 16 aa, BK virus
TLQWWVQIIGETPFRD

SEQ ID NO: 37828 - protein, 16 aa, BK virus
LQWWVQIIGETPFRDL

SEQ ID NO: 37829 - protein, 16 aa, BK virus
QWWVQIIGETPFRDLK

SEQ ID NO: 37830 - protein, 16 aa, BK virus
WWVQIIGETPFRDLKL

SEQ ID NO: 37831 - protein, 16 aa, BK virus
KALSNYFFYRCQPMEQ

SEQ ID NO: 37832 - protein, 16 aa, BK virus
ALSNYFFYRCQPMEQK

SEQ ID NO: 37833 - protein, 16 aa, BK virus
LSNYFFYRCQPMEQKS

SEQ ID NO: 37834 - protein, 16 aa, BK virus
SNYFFYRCQPMEQKSG

SEQ ID NO: 37835 - protein, 16 aa, BK virus
NYFFYRCQPMEQKSGS

SEQ ID NO: 37836 - protein, 16 aa, BK virus
YFFYRCQPMEQKSGSP

SEQ ID NO: 37837 - protein, 16 aa, BK virus
FFYRCQPMEQKSGSPG

SEQ ID NO: 37838 - protein, 16 aa, BK virus
FYRCQPMEQKSGSPGG

SEQ ID NO: 37839 - protein, 16 aa, BK virus
YRCQPMEQKSGSPGGV

SEQ ID NO: 37840 - protein, 16 aa, BK virus
RCQPMEQKSGSPGGVP

SEQ ID NO: 37841 - protein, 16 aa, BK virus
CQPMEQKSGSPGGVPL

SEQ ID NO: 37842 - protein, 16 aa, BK virus
QPMEQKSGSPGGVPLM

SEQ ID NO: 37843 - protein, 16 aa, BK virus
PMEQKSGSPGGVPLMK

SEQ ID NO: 37844 - protein, 16 aa, BK virus
MEQKSGSPGGVPLMKN

SEQ ID NO: 37845 - protein, 16 aa, BK virus
EQKSGSPGGVPLMKNG

SEQ ID NO: 37846 - protein, 16 aa, BK virus
QKSGSPGGVPLMKNGM

SEQ ID NO: 37847 - protein, 16 aa, BK virus
KSGSPGGVPLMKNGMK

SEQ ID NO: 37848 - protein, 16 aa, BK virus
SGSPGGVPLMKNGMKI

SEQ ID NO: 37849 - protein, 16 aa, BK virus
GSPGGVPLMKNGMKIY

SEQ ID NO: 37850 - protein, 16 aa, BK virus
SPGGVPLMKNGMKIYF

SEQ ID NO: 37851 - protein, 16 aa, BK virus
PGGVPLMKNGMKIYFA

SEQ ID NO: 37852 - protein, 16 aa, BK virus
GGVPLMKNGMKIYFAM

SEQ ID NO: 37853 - protein, 16 aa, BK virus
GVPLMKNGMKIYFAMK

SEQ ID NO: 37854 - protein, 16 aa, BK virus
VPLMKNGMKIYFAMKI

SEQ ID NO: 37855 - protein, 16 aa, BK virus
PLMKNGMKIYFAMKIC

SEQ ID NO: 37856 - protein, 16 aa, BK virus
LMKNGMKIYFAMKICL

SEQ ID NO: 37857 - protein, 16 aa, BK virus
MKNGMKIYFAMKICLP

SEQ ID NO: 37858 - protein, 16 aa, BK virus
KNGMKIYFAMKICLPV

SEQ ID NO: 37859 - protein, 16 aa, BK virus
NGMKIYFAMKICLPVM

SEQ ID NO: 37860 - protein, 16 aa, BK virus
GMKIYFAMKICLPVMK

SEQ ID NO: 37861 - protein, 16 aa, BK virus
MKIYFAMKICLPVMKK

SEQ ID NO: 37862 - protein, 16 aa, BK virus
KIYFAMKICLPVMKKQ

SEQ ID NO: 37863 - protein, 16 aa, BK virus
IYFAMKICLPVMKKQQ

SEQ ID NO: 37864 - protein, 16 aa, BK virus
YFAMKICLPVMKKQQQ

SEQ ID NO: 37865 - protein, 16 aa, BK virus
FAMKICLPVMKKQQQI

SEQ ID NO: 37866 - protein, 16 aa, BK virus
AMKICLPVMKKQQQIL

SEQ ID NO: 37867 - protein, 16 aa, BK virus
MKICLPVMKKQQQILN

SEQ ID NO: 37868 - protein, 16 aa, BK virus
KICLPVMKKQQQILNT

SEQ ID NO: 37869 - protein, 16 aa, BK virus
ICLPVMKKQQQILNTQ

SEQ ID NO: 37870 - protein, 16 aa, BK virus
CLPVMKKQQQILNTQH

SEQ ID NO: 37871 - protein, 16 aa, BK virus
LPVMKKQQQILNTQHH

SEQ ID NO: 37872 - protein, 16 aa, BK virus
PVMKKQQQILNTQHHP

SEQ ID NO: 37873 - protein, 16 aa, BK virus
VMKKQQQILNTQHHPK

SEQ ID NO: 37874 - protein, 16 aa, BK virus
MKKQQQILNTQHHPKK

SEQ ID NO: 37875 - protein, 16 aa, BK virus
KKQQQILNTQHHPKKK

SEQ ID NO: 37876 - protein, 16 aa, BK virus
KQQQILNTQHHPKKKE

SEQ ID NO: 37877 - protein, 16 aa, BK virus
QQQILNTQHHPKKKER

SEQ ID NO: 37878 - protein, 16 aa, BK virus
KTLKTFPLIYTSFLVK

SEQ ID NO: 37879 - protein, 16 aa, BK virus
TLKTFPLIYTSFLVKL

SEQ ID NO: 37880 - protein, 16 aa, BK virus
LKTFPLIYTSFLVKLY

SEQ ID NO: 37881 - protein, 16 aa, BK virus
KTFPLIYTSFLVKLYL

SEQ ID NO: 37882 - protein, 16 aa, BK virus
TFPLIYTSFLVKLYLV

SEQ ID NO: 37883 - protein, 16 aa, BK virus
FPLIYTSFLVKLYLVI

SEQ ID NO: 37884 - protein, 16 aa, BK virus
PLIYTSFLVKLYLVIE

SEQ ID NO: 37885 - protein, 16 aa, BK virus
LIYTSFLVKLYLVIEP

SEQ ID NO: 37886 - protein, 16 aa, BK virus
IYTSFLVKLYLVIEPL

SEQ ID NO: 37887 - protein, 16 aa, BK virus
YTSFLVKLYLVIEPLP

SEQ ID NO: 37888 - protein, 16 aa, BK virus
TSFLVKLYLVIEPLPA

SEQ ID NO: 37889 - protein, 16 aa, BK virus
SFLVKLYLVIEPLPAL

SEQ ID NO: 37890 - protein, 16 aa, BK virus
FLVKLYLVIEPLPALL

SEQ ID NO: 37891 - protein, 16 aa, BK virus
LVKLYLVIEPLPALLC

SEQ ID NO: 37892 - protein, 16 aa, BK virus
VKLYLVIEPLPALLCI

SEQ ID NO: 37893 - protein, 16 aa, BK virus
KLYLVIEPLPALLCIL

SEQ ID NO: 37894 - protein, 16 aa, BK virus
LYLVIEPLPALLCILL

SEQ ID NO: 37895 - protein, 16 aa, BK virus
YLVIEPLPALLCILLK

SEQ ID NO: 37896 - protein, 16 aa, BK virus
LVIEPLPALLCILLKK

SEQ ID NO: 37897 - protein, 16 aa, BK virus
VIEPLPALLCILLKKK

SEQ ID NO: 37898 - protein, 16 aa, BK virus
IEPLPALLCILLKKKL

SEQ ID NO: 37899 - protein, 16 aa, BK virus
EPLPALLCILLKKKLK

SEQ ID NO: 37900 - protein, 16 aa, BK virus
PLPALLCILLKKKLKF

SEQ ID NO: 37901 - protein, 16 aa, BK virus
LPALLCILLKKKLKFC

SEQ ID NO: 37902 - protein, 16 aa, BK virus
PALLCILLKKKLKFCI

SEQ ID NO: 37903 - protein, 16 aa, BK virus
ALLCILLKKKLKFCIK

SEQ ID NO: 37904 - protein, 16 aa, BK virus
LLCILLKKKLKFCIKN

SEQ ID NO: 37905 - protein, 16 aa, BK virus
LCILLKKKLKFCIKNL

SEQ ID NO: 37906 - protein, 16 aa, BK virus
CILLKKKLKFCIKNLW

SEQ ID NO: 37907 - protein, 16 aa, BK virus
ILLKKKLKFCIKNLWK

SEQ ID NO: 37908 - protein, 16 aa, BK virus
LLKKKLKFCIKNLWKN

SEQ ID NO: 37909 - protein, 16 aa, BK virus
LKKKLKFCIKNLWKNI

SEQ ID NO: 37910 - protein, 16 aa, BK virus
KKKLKFCIKNLWKNIL

SEQ ID NO: 37911 - protein, 16 aa, BK virus
LLLVDTCVLGIILYSF

SEQ ID NO: 37912 - protein, 16 aa, BK virus
LHIDIEFLQLIISVKS

SEQ ID NO: 37913 - protein, 16 aa, BK virus
HIDIEFLQLIISVKSC

SEQ ID NO: 37914 - protein, 16 aa, BK virus
IDIEFLQLIISVKSCV

SEQ ID NO: 37915 - protein, 16 aa, BK virus
DIEFLQLIISVKSCVP

SEQ ID NO: 37916 - protein, 16 aa, BK virus
IEFLQLIISVKSCVPL

SEQ ID NO: 37917 - protein, 16 aa, BK virus
EFLQLIISVKSCVPLV

SEQ ID NO: 37918 - protein, 16 aa, BK virus
FLQLIISVKSCVPLVF

SEQ ID NO: 37919 - protein, 16 aa, BK virus
RSMILAQKSLKKQSRC

SEQ ID NO: 37920 - protein, 16 aa, BK virus
SMILAQKSLKKQSRCL

SEQ ID NO: 37921 - protein, 16 aa, BK virus
MILAQKSLKKQSRCLG

SEQ ID NO: 37922 - protein, 16 aa, BK virus
ILAQKSLKKQSRCLGN

SEQ ID NO: 37923 - protein, 16 aa, BK virus
RSVKSVRKKTSLITLS

SEQ ID NO: 37924 - protein, 16 aa, BK virus
SVKSVRKKTSLITLSI

SEQ ID NO: 37925 - protein, 16 aa, BK virus
VKSVRKKTSLITLSIM

SEQ ID NO: 37926 - protein, 16 aa, BK virus
KSVRKKTSLITLSIMK

SEQ ID NO: 37927 - protein, 16 aa, BK virus
SVRKKTSLITLSIMKS

SEQ ID NO: 37928 - protein, 16 aa, BK virus
VRKKTSLITLSIMKST

SEQ ID NO: 37929 - protein, 16 aa, BK virus
RKKTSLITLSIMKSTL

SEQ ID NO: 37930 - protein, 16 aa, BK virus
KKTSLITLSIMKSTLQ

SEQ ID NO: 37931 - protein, 16 aa, BK virus
KTSLITLSIMKSTLQM

SEQ ID NO: 37932 - protein, 16 aa, BK virus
TSLITLSIMKSTLQML

SEQ ID NO: 37933 - protein, 16 aa, BK virus
SLITLSIMKSTLQMLL

SEQ ID NO: 37934 - protein, 16 aa, BK virus
LITLSIMKSTLQMLLF

SEQ ID NO: 37935 - protein, 16 aa, BK virus
ITLSIMKSTLQMLLFL

SEQ ID NO: 37936 - protein, 16 aa, BK virus
TLSIMKSTLQMLLFLQ

SEQ ID NO: 37937 - protein, 16 aa, BK virus
LSIMKSTLQMLLFLQK

SEQ ID NO: 37938 - protein, 16 aa, BK virus
SIMKSTLQMLLFLQKV

SEQ ID NO: 37939 - protein, 16 aa, BK virus
IMKSTLQMLLFLQKVK

SEQ ID NO: 37940 - protein, 16 aa, BK virus
MKSTLQMLLFLQKVKI

SEQ ID NO: 37941 - protein, 16 aa, BK virus
KSTLQMLLFLQKVKIK

SEQ ID NO: 37942 - protein, 16 aa, BK virus
STLQMLLFLQKVKIKK

SEQ ID NO: 37943 - protein, 16 aa, BK virus
TLQMLLFLQKVKIKKV

SEQ ID NO: 37944 - protein, 16 aa, BK virus
LQMLLFLQKVKIKKVF

SEQ ID NO: 37945 - protein, 16 aa, BK virus
QMLLFLQKVKIKKVFV

SEQ ID NO: 37946 - protein, 16 aa, BK virus
MLLFLQKVKIKKVFVS

SEQ ID NO: 37947 - protein, 16 aa, BK virus
LLFLQKVKIKKVFVSK

SEQ ID NO: 37948 - protein, 16 aa, BK virus
LFLQKVKIKKVFVSKQ

SEQ ID NO: 37949 - protein, 16 aa, BK virus
NNIWQVLLGCTVCYLK

SEQ ID NO: 37950 - protein, 16 aa, BK virus
NIWQVLLGCTVCYLKW

SEQ ID NO: 37951 - protein, 16 aa, BK virus
IWQVLLGCTVCYLKWI

SEQ ID NO: 37952 - protein, 16 aa, BK virus
WQVLLGCTVCYLKWIL

SEQ ID NO: 37953 - protein, 16 aa, BK virus
YLIFCTVLFSMYLKED

SEQ ID NO: 37954 - protein, 16 aa, BK virus
LIFCTVLFSMYLKEDT

SEQ ID NO: 37955 - protein, 16 aa, BK virus
IFCTVLFSMYLKEDTG

SEQ ID NO: 37956 - protein, 16 aa, BK virus
FCTVLFSMYLKEDTGY

SEQ ID NO: 37957 - protein, 16 aa, BK virus
CTVLFSMYLKEDTGYL

SEQ ID NO: 37958 - protein, 16 aa, BK virus
TVLFSMYLKEDTGYLK

SEQ ID NO: 37959 - protein, 16 aa, BK virus
VLFSMYLKEDTGYLKV

SEQ ID NO: 37960 - protein, 16 aa, BK virus
LFSMYLKEDTGYLKVP

SEQ ID NO: 37961 - protein, 16 aa, BK virus
FSMYLKEDTGYLKVPL

SEQ ID NO: 37962 - protein, 16 aa, BK virus
SMYLKEDTGYLKVPLI

SEQ ID NO: 37963 - protein, 16 aa, BK virus
MYLKEDTGYLKVPLIV

SEQ ID NO: 37964 - protein, 16 aa, BK virus
YLKEDTGYLKVPLIVE

SEQ ID NO: 37965 - protein, 16 aa, BK virus
LKEDTGYLKVPLIVEK

SEQ ID NO: 37966 - protein, 16 aa, BK virus
KEDTGYLKVPLIVEKQ

SEQ ID NO: 37967 - protein, 16 aa, BK virus
EDTGYLKVPLIVEKQH

SEQ ID NO: 37968 - protein, 16 aa, BK virus
ENPYKTQSSYLKKEFY

SEQ ID NO: 37969 - protein, 16 aa, BK virus
NPYKTQSSYLKKEFYK

SEQ ID NO: 37970 - protein, 16 aa, BK virus
PYKTQSSYLKKEFYKV

SEQ ID NO: 37971 - protein, 16 aa, BK virus
YKTQSSYLKKEFYKVE

SEQ ID NO: 37972 - protein, 16 aa, BK virus
LILQLIYNLELLNGRK

SEQ ID NO: 37973 - protein, 16 aa, BK virus
ILQLIYNLELLNGRKG

SEQ ID NO: 37974 - protein, 16 aa, BK virus
LQLIYNLELLNGRKGW

SEQ ID NO: 37975 - protein, 16 aa, BK virus
QLIYNLELLNGRKGWI

SEQ ID NO: 37976 - protein, 16 aa, BK virus
LIYNLELLNGRKGWIL

SEQ ID NO: 37977 - protein, 16 aa, BK virus
IYNLELLNGRKGWILR

SEQ ID NO: 37978 - protein, 16 aa, BK virus
NIIYAWGNVFLILQEK

SEQ ID NO: 37979 - protein, 16 aa, BK virus
IIYAWGNVFLILQEKR

SEQ ID NO: 37980 - protein, 16 aa, BK virus
IYAWGNVFLILQEKRI

SEQ ID NO: 37981 - protein, 16 aa, BK virus
YAWGNVFLILQEKRIQ

SEQ ID NO: 37982 - protein, 16 aa, BK virus
AWGNVFLILQEKRIQK

SEQ ID NO: 37983 - protein, 16 aa, BK virus
WGNVFLILQEKRIQKL

SEQ ID NO: 37984 - protein, 16 aa, BK virus
GNVFLILQEKRIQKLK

SEQ ID NO: 37985 - protein, 16 aa, BK virus
NVFLILQEKRIQKLKT

SEQ ID NO: 37986 - protein, 16 aa, BK virus
VFLILQEKRIQKLKTL

SEQ ID NO: 37987 - protein, 16 aa, BK virus
FLILQEKRIQKLKTLD

SEQ ID NO: 37988 - protein, 16 aa, BK virus
LILQEKRIQKLKTLDM

SEQ ID NO: 37989 - protein, 16 aa, BK virus
ILQEKRIQKLKTLDMD

SEQ ID NO: 37990 - protein, 16 aa, BK virus
LQEKRIQKLKTLDMDQ

SEQ ID NO: 37991 - protein, 16 aa, BK virus
QEKRIQKLKTLDMDQA

SEQ ID NO: 37992 - protein, 16 aa, BK virus
EKRIQKLKTLDMDQAL

SEQ ID NO: 37993 - protein, 16 aa, BK virus
KRIQKLKTLDMDQALN

SEQ ID NO: 37994 - protein, 16 aa, BK virus
RIQKLKTLDMDQALNP

SEQ ID NO: 37995 - protein, 16 aa, BK virus
IQKLKTLDMDQALNPN

SEQ ID NO: 37996 - protein, 16 aa, BK virus
QKLKTLDMDQALNPNH

SEQ ID NO: 37997 - protein, 16 aa, BK virus
KLKTLDMDQALNPNHN

SEQ ID NO: 37998 - protein, 16 aa, BK virus
LKTLDMDQALNPNHNA

SEQ ID NO: 37999 - protein, 16 aa, BK virus
KTLDMDQALNPNHNAL

SEQ ID NO: 38000 - protein, 16 aa, BK virus
TLDMDQALNPNHNALP

SEQ ID NO: 38001 - protein, 16 aa, BK virus
LDMDQALNPNHNALPK

SEQ ID NO: 38002 - protein, 16 aa, BK virus
DMDQALNPNHNALPKS

SEQ ID NO: 38003 - protein, 16 aa, BK virus
MDQALNPNHNALPKSQ

SEQ ID NO: 38004 - protein, 16 aa, BK virus
DQALNPNHNALPKSQI

SEQ ID NO: 38005 - protein, 16 aa, BK virus
QALNPNHNALPKSQIL

SEQ ID NO: 38006 - protein, 16 aa, BK virus
ALNPNHNALPKSQILQ

SEQ ID NO: 38007 - protein, 16 aa, BK virus
LNPNHNALPKSQILQP

SEQ ID NO: 38008 - protein, 16 aa, BK virus
NPNHNALPKSQILQPL

SEQ ID NO: 38009 - protein, 16 aa, BK virus
PNHNALPKSQILQPLL

SEQ ID NO: 38010 - protein, 16 aa, BK virus
NHNALPKSQILQPLLK

SEQ ID NO: 38011 - protein, 16 aa, BK virus
HNALPKSQILQPLLKI

SEQ ID NO: 38012 - protein, 16 aa, BK virus
NALPKSQILQPLLKIP

SEQ ID NO: 38013 - protein, 16 aa, BK virus
ALPKSQILQPLLKIPK

SEQ ID NO: 38014 - protein, 16 aa, BK virus
LPKSQILQPLLKIPKG

SEQ ID NO: 38015 - protein, 16 aa, BK virus
PKSQILQPLLKIPKGQ

SEQ ID NO: 38016 - protein, 16 aa, BK virus
KSQILQPLLKIPKGQT

SEQ ID NO: 38017 - protein, 16 aa, BK virus
SQILQPLLKIPKGQTP

SEQ ID NO: 38018 - protein, 16 aa, BK virus
QILQPLLKIPKGQTPI

SEQ ID NO: 38019 - protein, 16 aa, BK virus
ILQPLLKIPKGQTPIV

SEQ ID NO: 38020 - protein, 16 aa, BK virus
LQPLLKIPKGQTPIVK

SEQ ID NO: 38021 - protein, 16 aa, BK virus
QPLLKIPKGQTPIVKS

SEQ ID NO: 38022 - protein, 16 aa, BK virus
PLLKIPKGQTPIVKSC

SEQ ID NO: 38023 - protein, 16 aa, BK virus
LLKIPKGQTPIVKSCI

SEQ ID NO: 38024 - protein, 16 aa, BK virus
LKIPKGQTPIVKSCIC

SEQ ID NO: 38025 - protein, 16 aa, BK virus
KIPKGQTPIVKSCICV

SEQ ID NO: 38026 - protein, 16 aa, BK virus
IPKGQTPIVKSCICVK

SEQ ID NO: 38027 - protein, 16 aa, BK virus
PKGQTPIVKSCICVKA

SEQ ID NO: 38028 - protein, 16 aa, BK virus
KGQTPIVKSCICVKAF

SEQ ID NO: 38029 - protein, 16 aa, BK virus
GQTPIVKSCICVKAFS

SEQ ID NO: 38030 - protein, 16 aa, BK virus
QTPIVKSCICVKAFSV

SEQ ID NO: 38031 - protein, 16 aa, BK virus
TPIVKSCICVKAFSVL

SEQ ID NO: 38032 - protein, 16 aa, BK virus
PIVKSCICVKAFSVLK

SEQ ID NO: 38033 - protein, 16 aa, BK virus
IVKSCICVKAFSVLKG

SEQ ID NO: 38034 - protein, 16 aa, BK virus
VKSCICVKAFSVLKGL

SEQ ID NO: 38035 - protein, 16 aa, BK virus
KSCICVKAFSVLKGLK

SEQ ID NO: 38036 - protein, 16 aa, BK virus
SCICVKAFSVLKGLKH

SEQ ID NO: 38037 - protein, 16 aa, BK virus
CICVKAFSVLKGLKHH

SEQ ID NO: 38038 - protein, 16 aa, BK virus
ICVKAFSVLKGLKHHP

SEQ ID NO: 38039 - protein, 16 aa, BK virus
CVKAFSVLKGLKHHPQ

SEQ ID NO: 38040 - protein, 16 aa, BK virus
VKAFSVLKGLKHHPQN

SEQ ID NO: 38041 - protein, 16 aa, BK virus
KAFSVLKGLKHHPQNN

SEQ ID NO: 38042 - protein, 16 aa, BK virus
AFSVLKGLKHHPQNNT

SEQ ID NO: 38043 - protein, 16 aa, BK virus
FSVLKGLKHHPQNNTS

SEQ ID NO: 38044 - protein, 16 aa, BK virus
SVLKGLKHHPQNNTSL

SEQ ID NO: 38045 - protein, 16 aa, BK virus
VLKGLKHHPQNNTSLK

SEQ ID NO: 38046 - protein, 16 aa, BK virus
LKGLKHHPQNNTSLKV

SEQ ID NO: 38047 - protein, 16 aa, BK virus
KGLKHHPQNNTSLKVA

SEQ ID NO: 38048 - protein, 16 aa, BK virus
GLKHHPQNNTSLKVAY

SEQ ID NO: 38049 - protein, 16 aa, BK virus
LKHHPQNNTSLKVAYT

SEQ ID NO: 38050 - protein, 16 aa, BK virus
KHHPQNNTSLKVAYTK

SEQ ID NO: 38051 - protein, 16 aa, BK virus
HHPQNNTSLKVAYTKA

SEQ ID NO: 38052 - protein, 16 aa, BK virus
HPQNNTSLKVAYTKAA

SEQ ID NO: 38053 - protein, 16 aa, BK virus
PQNNTSLKVAYTKAAF

SEQ ID NO: 38054 - protein, 16 aa, BK virus
QNNTSLKVAYTKAAFI

SEQ ID NO: 38055 - protein, 16 aa, BK virus
NNTSLKVAYTKAAFIK

SEQ ID NO: 38056 - protein, 16 aa, BK virus
NTSLKVAYTKAAFIKC

SEQ ID NO: 38057 - protein, 16 aa, BK virus
TSLKVAYTKAAFIKCI

SEQ ID NO: 38058 - protein, 16 aa, BK virus
SLKVAYTKAAFIKCIC

SEQ ID NO: 38059 - protein, 16 aa, BK virus
LKVAYTKAAFIKCICT

SEQ ID NO: 38060 - protein, 16 aa, BK virus
KVAYTKAAFIKCICTI

SEQ ID NO: 38061 - protein, 16 aa, BK virus
VAYTKAAFIKCICTIK

SEQ ID NO: 38062 - protein, 16 aa, BK virus
AYTKAAFIKCICTIKA

SEQ ID NO: 38063 - protein, 16 aa, BK virus
YTKAAFIKCICTIKAP

SEQ ID NO: 38064 - protein, 16 aa, BK virus
TKAAFIKCICTIKAPV

SEQ ID NO: 38065 - protein, 16 aa, BK virus
SILVCNCPCLSIYLII

SEQ ID NO: 38066 - protein, 16 aa, BK virus
ILVCNCPCLSIYLIIS

SEQ ID NO: 38067 - protein, 16 aa, BK virus
LVCNCPCLSIYLIISG

SEQ ID NO: 38068 - protein, 16 aa, BK virus
VCNCPCLSIYLIISGS

SEQ ID NO: 38069 - protein, 16 aa, BK virus
CNCPCLSIYLIISGSP

SEQ ID NO: 38070 - protein, 16 aa, BK virus
NCPCLSIYLIISGSPG

SEQ ID NO: 38071 - protein, 16 aa, BK virus
CPCLSIYLIISGSPGS

SEQ ID NO: 38072 - protein, 16 aa, BK virus
PCLSIYLIISGSPGSL

SEQ ID NO: 38073 - protein, 16 aa, BK virus
CLSIYLIISGSPGSLS

SEQ ID NO: 38074 - protein, 16 aa, BK virus
LSIYLIISGSPGSLSV

SEQ ID NO: 38075 - protein, 16 aa, BK virus
SIYLIISGSPGSLSVP

SEQ ID NO: 38076 - protein, 16 aa, BK virus
IYLIISGSPGSLSVPS

SEQ ID NO: 38077 - protein, 16 aa, BK virus
YLIISGSPGSLSVPSN

SEQ ID NO: 38078 - protein, 16 aa, BK virus
LIISGSPGSLSVPSNT

SEQ ID NO: 38079 - protein, 16 aa, BK virus
IISGSPGSLSVPSNTL

SEQ ID NO: 38080 - protein, 16 aa, BK virus
ISGSPGSLSVPSNTLT

SEQ ID NO: 38081 - protein, 16 aa, BK virus
SGSPGSLSVPSNTLTS

SEQ ID NO: 38082 - protein, 16 aa, BK virus
GSPGSLSVPSNTLTSS

SEQ ID NO: 38083 - protein, 16 aa, BK virus
SPGSLSVPSNTLTSST

SEQ ID NO: 38084 - protein, 16 aa, BK virus
PGSLSVPSNTLTSSTW

SEQ ID NO: 38085 - protein, 16 aa, BK virus
GSLSVPSNTLTSSTWD

SEQ ID NO: 38086 - protein, 16 aa, BK virus
SLSVPSNTLTSSTWDS

SEQ ID NO: 38087 - protein, 16 aa, BK virus
LSVPSNTLTSSTWDSI

SEQ ID NO: 38088 - protein, 16 aa, BK virus
SVPSNTLTSSTWDSIP

SEQ ID NO: 38089 - protein, 16 aa, BK virus
VPSNTLTSSTWDSIPY

SEQ ID NO: 38090 - protein, 16 aa, BK virus
PSNTLTSSTWDSIPYI

SEQ ID NO: 38091 - protein, 16 aa, BK virus
SNTLTSSTWDSIPYIG

SEQ ID NO: 38092 - protein, 16 aa, BK virus
NTLTSSTWDSIPYIGC

SEQ ID NO: 38093 - protein, 16 aa, BK virus
TLTSSTWDSIPYIGCP

SEQ ID NO: 38094 - protein, 16 aa, BK virus
LTSSTWDSIPYIGCPS

SEQ ID NO: 38095 - protein, 16 aa, BK virus
TSSTWDSIPYIGCPST

SEQ ID NO: 38096 - protein, 16 aa, BK virus
SSTWDSIPYIGCPSTL

SEQ ID NO: 38097 - protein, 16 aa, BK virus
STWDSIPYIGCPSTLW

SEQ ID NO: 38098 - protein, 16 aa, BK virus
TWDSIPYIGCPSTLWV

SEQ ID NO: 38099 - protein, 16 aa, BK virus
WDSIPYIGCPSTLWVL

SEQ ID NO: 38100 - protein, 16 aa, BK virus
DSIPYIGCPSTLWVLL

SEQ ID NO: 38101 - protein, 16 aa, BK virus
SIPYIGCPSTLWVLLF

SEQ ID NO: 38102 - protein, 16 aa, BK virus
IPYIGCPSTLWVLLFI

SEQ ID NO: 38103 - protein, 16 aa, BK virus
PYIGCPSTLWVLLFIR

SEQ ID NO: 38104 - protein, 16 aa, BK virus
YIGCPSTLWVLLFIRS

SEQ ID NO: 38105 - protein, 16 aa, BK virus
IGCPSTLWVLLFIRSL

SEQ ID NO: 38106 - protein, 16 aa, BK virus
GCPSTLWVLLFIRSLS

SEQ ID NO: 38107 - protein, 16 aa, BK virus
CPSTLWVLLFIRSLSK

SEQ ID NO: 38108 - protein, 16 aa, BK virus
PSTLWVLLFIRSLSKK

SEQ ID NO: 38109 - protein, 16 aa, BK virus
STLWVLLFIRSLSKKE

SEQ ID NO: 38110 - protein, 16 aa, BK virus
TLWVLLFIRSLSKKEI

SEQ ID NO: 38111 - protein, 16 aa, BK virus
LWVLLFIRSLSKKEIG

SEQ ID NO: 38112 - protein, 16 aa, BK virus
GFFTDLFLRRILKYLA

SEQ ID NO: 38113 - protein, 16 aa, BK virus
FFTDLFLRRILKYLAR

SEQ ID NO: 38114 - protein, 16 aa, BK virus
FTDLFLRRILKYLARP

SEQ ID NO: 38115 - protein, 16 aa, BK virus
TDLFLRRILKYLARPL

SEQ ID NO: 38116 - protein, 16 aa, BK virus
DLFLRRILKYLARPLH

SEQ ID NO: 38117 - protein, 16 aa, BK virus
LFLRRILKYLARPLHC

SEQ ID NO: 38118 - protein, 16 aa, BK virus
FLRRILKYLARPLHCC

SEQ ID NO: 38119 - protein, 16 aa, BK virus
LRRILKYLARPLHCCV

SEQ ID NO: 38120 - protein, 16 aa, BK virus
RRILKYLARPLHCCVP

SEQ ID NO: 38121 - protein, 16 aa, BK virus
RILKYLARPLHCCVPE

SEQ ID NO: 38122 - protein, 16 aa, BK virus
ILKYLARPLHCCVPEL

SEQ ID NO: 38123 - protein, 16 aa, BK virus
LKYLARPLHCCVPELL

SEQ ID NO: 38124 - protein, 16 aa, BK virus
KYLARPLHCCVPELLV

SEQ ID NO: 38125 - protein, 16 aa, BK virus
YLARPLHCCVPELLVN

SEQ ID NO: 38126 - protein, 16 aa, BK virus
LARPLHCCVPELLVNR

SEQ ID NO: 38127 - protein, 16 aa, BK virus
ARPLHCCVPELLVNRP

SEQ ID NO: 38128 - protein, 16 aa, BK virus
RPLHCCVPELLVNRPQ

SEQ ID NO: 38129 - protein, 16 aa, BK virus
PLHCCVPELLVNRPQI

SEQ ID NO: 38130 - protein, 16 aa, BK virus
LHCCVPELLVNRPQIS

SEQ ID NO: 38131 - protein, 16 aa, BK virus
HCCVPELLVNRPQISA

SEQ ID NO: 38132 - protein, 16 aa, BK virus
CCVPELLVNRPQISAA

SEQ ID NO: 38133 - protein, 16 aa, BK virus
CVPELLVNRPQISAAE

SEQ ID NO: 38134 - protein, 16 aa, BK virus
VPELLVNRPQISAAET

SEQ ID NO: 38135 - protein, 16 aa, BK virus
PELLVNRPQISAAETY

SEQ ID NO: 38136 - protein, 16 aa, BK virus
ELLVNRPQISAAETYR

SEQ ID NO: 38137 - protein, 16 aa, BK virus
LLVNRPQISAAETYRL

SEQ ID NO: 38138 - protein, 16 aa, BK virus
LVNRPQISAAETYRLS

SEQ ID NO: 38139 - protein, 16 aa, BK virus
VNRPQISAAETYRLSA

SEQ ID NO: 38140 - protein, 16 aa, BK virus
NRPQISAAETYRLSAL

SEQ ID NO: 38141 - protein, 16 aa, BK virus
RPQISAAETYRLSALQ

SEQ ID NO: 38142 - protein, 16 aa, BK virus
PQISAAETYRLSALQR

SEQ ID NO: 38143 - protein, 16 aa, BK virus
QISAAETYRLSALQRG

SEQ ID NO: 38144 - protein, 16 aa, BK virus
ISAAETYRLSALQRGP

SEQ ID NO: 38145 - protein, 16 aa, BK virus
SAAETYRLSALQRGPT

SEQ ID NO: 38146 - protein, 16 aa, BK virus
AAETYRLSALQRGPTP

SEQ ID NO: 38147 - protein, 16 aa, BK virus
AETYRLSALQRGPTPC

SEQ ID NO: 38148 - protein, 16 aa, BK virus
ETYRLSALQRGPTPCS

SEQ ID NO: 38149 - protein, 16 aa, BK virus
TYRLSALQRGPTPCSS

SEQ ID NO: 38150 - protein, 16 aa, BK virus
YRLSALQRGPTPCSSS

SEQ ID NO: 38151 - protein, 16 aa, BK virus
RLSALQRGPTPCSSSN

SEQ ID NO: 38152 - protein, 16 aa, BK virus
LSALQRGPTPCSSSNT

SEQ ID NO: 38153 - protein, 16 aa, BK virus
SALQRGPTPCSSSNTV

SEQ ID NO: 38154 - protein, 16 aa, BK virus
ALQRGPTPCSSSNTVV

SEQ ID NO: 38155 - protein, 16 aa, BK virus
LQRGPTPCSSSNTVVA

SEQ ID NO: 38156 - protein, 16 aa, BK virus
QRGPTPCSSSNTVVAV

SEQ ID NO: 38157 - protein, 16 aa, BK virus
RGPTPCSSSNTVVAVL

SEQ ID NO: 38158 - protein, 16 aa, BK virus
GPTPCSSSNTVVAVLV

SEQ ID NO: 38159 - protein, 16 aa, BK virus
PTPCSSSNTVVAVLVT

SEQ ID NO: 38160 - protein, 16 aa, BK virus
STGGTFSPPVKVPKYL

SEQ ID NO: 38161 - protein, 16 aa, BK virus
TGGTFSPPVKVPKYLA

SEQ ID NO: 38162 - protein, 16 aa, BK virus
GGTFSPPVKVPKYLAF

SEQ ID NO: 38163 - protein, 16 aa, BK virus
GTFSPPVKVPKYLAFS

SEQ ID NO: 38164 - protein, 16 aa, BK virus
TFSPPVKVPKYLAFSF

SEQ ID NO: 38165 - protein, 16 aa, BK virus
FSPPVKVPKYLAFSFL

SEQ ID NO: 38166 - protein, 16 aa, BK virus
SPPVKVPKYLAFSFLL

SEQ ID NO: 38167 - protein, 16 aa, BK virus
PPVKVPKYLAFSFLLG

SEQ ID NO: 38168 - protein, 16 aa, BK virus
PVKVPKYLAFSFLLGS

SEQ ID NO: 38169 - protein, 16 aa, BK virus
VKVPKYLAFSFLLGSG

SEQ ID NO: 38170 - protein, 16 aa, BK virus
KVPKYLAFSFLLGSGT

SEQ ID NO: 38171 - protein, 16 aa, BK virus
VPKYLAFSFLLGSGTQ

SEQ ID NO: 38172 - protein, 16 aa, BK virus
PKYLAFSFLLGSGTQH

SEQ ID NO: 38173 - protein, 16 aa, BK virus
KYLAFSFLLGSGTQHS

SEQ ID NO: 38174 - protein, 16 aa, BK virus
YLAFSFLLGSGTQHST

SEQ ID NO: 38175 - protein, 16 aa, BK virus
LAFSFLLGSGTQHSTG

SEQ ID NO: 38176 - protein, 16 aa, BK virus
ALWSVFITWDWAVGFL

SEQ ID NO: 38177 - protein, 16 aa, BK virus
LWSVFITWDWAVGFLG

SEQ ID NO: 38178 - protein, 16 aa, BK virus
WSVFITWDWAVGFLGV

SEQ ID NO: 38179 - protein, 16 aa, BK virus
SVFITWDWAVGFLGVI

SEQ ID NO: 38180 - protein, 16 aa, BK virus
VFITWDWAVGFLGVIV

SEQ ID NO: 38181 - protein, 16 aa, BK virus
FITWDWAVGFLGVIVP

SEQ ID NO: 38182 - protein, 16 aa, BK virus
ITWDWAVGFLGVIVPS

SEQ ID NO: 38183 - protein, 16 aa, BK virus
TWDWAVGFLGVIVPSG

SEQ ID NO: 38184 - protein, 16 aa, BK virus
WDWAVGFLGVIVPSGY

SEQ ID NO: 38185 - protein, 16 aa, BK virus
DWAVGFLGVIVPSGYF

SEQ ID NO: 38186 - protein, 16 aa, BK virus
WAVGFLGVIVPSGYFD

SEQ ID NO: 38187 - protein, 16 aa, BK virus
AVGFLGVIVPSGYFDL

SEQ ID NO: 38188 - protein, 16 aa, BK virus
FISTPCISKGSPPTAK

SEQ ID NO: 38189 - protein, 16 aa, BK virus
ISTPCISKGSPPTAKK

SEQ ID NO: 38190 - protein, 16 aa, BK virus
STPCISKGSPPTAKKW

SEQ ID NO: 38191 - protein, 16 aa, BK virus
TPCISKGSPPTAKKWK

SEQ ID NO: 38192 - protein, 16 aa, BK virus
PCISKGSPPTAKKWKL

SEQ ID NO: 38193 - protein, 16 aa, BK virus
CISKGSPPTAKKWKLL

SEQ ID NO: 38194 - protein, 16 aa, BK virus
ISKGSPPTAKKWKLLP

SEQ ID NO: 38195 - protein, 16 aa, BK virus
RLSMLVIPITSVCTVT

SEQ ID NO: 38196 - protein, 16 aa, BK virus
LSMLVIPITSVCTVTA

SEQ ID NO: 38197 - protein, 16 aa, BK virus
SMLVIPITSVCTVTAS

SEQ ID NO: 38198 - protein, 16 aa, BK virus
MLVIPITSVCTVTASH

SEQ ID NO: 38199 - protein, 16 aa, BK virus
LVIPITSVCTVTASHI

SEQ ID NO: 38200 - protein, 16 aa, BK virus
VIPITSVCTVTASHIS

SEQ ID NO: 38201 - protein, 16 aa, BK virus
IPITSVCTVTASHISR

SEQ ID NO: 38202 - protein, 16 aa, BK virus
PITSVCTVTASHISRF

SEQ ID NO: 38203 - protein, 16 aa, BK virus
ITSVCTVTASHISRFP

SEQ ID NO: 38204 - protein, 16 aa, BK virus
TSVCTVTASHISRFPQ

SEQ ID NO: 38205 - protein, 16 aa, BK virus
SVCTVTASHISRFPQV

SEQ ID NO: 38206 - protein, 16 aa, BK virus
VCTVTASHISRFPQVR

SEQ ID NO: 38207 - protein, 16 aa, BK virus
CTVTASHISRFPQVRS

SEQ ID NO: 38208 - protein, 16 aa, BK virus
TVTASHISRFPQVRSS

SEQ ID NO: 38209 - protein, 16 aa, BK virus
VTASHISRFPQVRSSF

SEQ ID NO: 38210 - protein, 16 aa, BK virus
TASHISRFPQVRSSFK

SEQ ID NO: 38211 - protein, 16 aa, BK virus
ASHISRFPQVRSSFKL

SEQ ID NO: 38212 - protein, 16 aa, BK virus
SHISRFPQVRSSFKLG

SEQ ID NO: 38213 - protein, 16 aa, BK virus
HISRFPQVRSSFKLGR

SEQ ID NO: 38214 - protein, 16 aa, BK virus
ISRFPQVRSSFKLGRG

SEQ ID NO: 38215 - protein, 16 aa, BK virus
SRFPQVRSSFKLGRGI

SEQ ID NO: 38216 - protein, 16 aa, BK virus
RFPQVRSSFKLGRGIL

SEQ ID NO: 38217 - protein, 16 aa, BK virus
FPQVRSSFKLGRGILA

SEQ ID NO: 38218 - protein, 16 aa, BK virus
PQVRSSFKLGRGILAV

SEQ ID NO: 38219 - protein, 16 aa, BK virus
QVRSSFKLGRGILAVL

SEQ ID NO: 38220 - protein, 16 aa, BK virus
QGSIFLSGLSLLKSFS

SEQ ID NO: 38221 - protein, 16 aa, BK virus
GSIFLSGLSLLKSFSA

SEQ ID NO: 38222 - protein, 16 aa, BK virus
SIFLSGLSLLKSFSAL

SEQ ID NO: 38223 - protein, 16 aa, BK virus
IFLSGLSLLKSFSALS

SEQ ID NO: 38224 - protein, 16 aa, BK virus
FLSGLSLLKSFSALSF

SEQ ID NO: 38225 - protein, 16 aa, BK virus
LSGLSLLKSFSALSFR

SEQ ID NO: 38226 - protein, 16 aa, BK virus
SGLSLLKSFSALSFRL

SEQ ID NO: 38227 - protein, 16 aa, BK virus
GLSLLKSFSALSFRLK

SEQ ID NO: 38228 - protein, 16 aa, BK virus
LSLLKSFSALSFRLKP

SEQ ID NO: 38229 - protein, 16 aa, BK virus
SLLKSFSALSFRLKPL

SEQ ID NO: 38230 - protein, 16 aa, BK virus
LLKSFSALSFRLKPLR

SEQ ID NO: 38231 - protein, 16 aa, BK virus
LKSFSALSFRLKPLRF

SEQ ID NO: 38232 - protein, 16 aa, BK virus
KSFSALSFRLKPLRFS

SEQ ID NO: 38233 - protein, 16 aa, BK virus
SFSALSFRLKPLRFSS

SEQ ID NO: 38234 - protein, 16 aa, BK virus
FSALSFRLKPLRFSSG

SEQ ID NO: 38235 - protein, 16 aa, BK virus
SALSFRLKPLRFSSGS

SEQ ID NO: 38236 - protein, 16 aa, BK virus
ALSFRLKPLRFSSGSP

SEQ ID NO: 38237 - protein, 16 aa, BK virus
LSFRLKPLRFSSGSPI

SEQ ID NO: 38238 - protein, 16 aa, BK virus
SFRLKPLRFSSGSPIS

SEQ ID NO: 38239 - protein, 16 aa, BK virus
FRLKPLRFSSGSPISG

SEQ ID NO: 38240 - protein, 16 aa, BK virus
RLKPLRFSSGSPISGF

SEQ ID NO: 38241 - protein, 16 aa, BK virus
LKPLRFSSGSPISGFR

SEQ ID NO: 38242 - protein, 16 aa, BK virus
KPLRFSSGSPISGFRK

SEQ ID NO: 38243 - protein, 16 aa, BK virus
PLRFSSGSPISGFRKH

SEQ ID NO: 38244 - protein, 16 aa, BK virus
LRFSSGSPISGFRKHS

SEQ ID NO: 38245 - protein, 16 aa, BK virus
RFSSGSPISGFRKHST

SEQ ID NO: 38246 - protein, 16 aa, BK virus
FSSGSPISGFRKHSTS

SEQ ID NO: 38247 - protein, 16 aa, BK virus
SSGSPISGFRKHSTSV

SEQ ID NO: 38248 - protein, 16 aa, BK virus
SGSPISGFRKHSTSVI

SEQ ID NO: 38249 - protein, 16 aa, BK virus
GSPISGFRKHSTSVIA

SEQ ID NO: 38250 - protein, 16 aa, BK virus
SPISGFRKHSTSVIAS

SEQ ID NO: 38251 - protein, 16 aa, BK virus
PISGFRKHSTSVIAST

SEQ ID NO: 38252 - protein, 16 aa, BK virus
ISGFRKHSTSVIASTP

SEQ ID NO: 38253 - protein, 16 aa, BK virus
SGFRKHSTSVIASTPV

SEQ ID NO: 38254 - protein, 16 aa, BK virus
GFRKHSTSVIASTPVL

SEQ ID NO: 38255 - protein, 16 aa, BK virus
FRKHSTSVIASTPVLT

SEQ ID NO: 38256 - protein, 16 aa, BK virus
RKHSTSVIASTPVLTS

SEQ ID NO: 38257 - protein, 16 aa, BK virus
KHSTSVIASTPVLTSR

SEQ ID NO: 38258 - protein, 16 aa, BK virus
HSTSVIASTPVLTSRT

SEQ ID NO: 38259 - protein, 16 aa, BK virus
STSVIASTPVLTSRTS

SEQ ID NO: 38260 - protein, 16 aa, BK virus
TSVIASTPVLTSRTST

SEQ ID NO: 38261 - protein, 16 aa, BK virus
SVIASTPVLTSRTSTP

SEQ ID NO: 38262 - protein, 16 aa, BK virus
VIASTPVLTSRTSTPP

SEQ ID NO: 38263 - protein, 16 aa, BK virus
IASTPVLTSRTSTPPF

SEQ ID NO: 38264 - protein, 16 aa, BK virus
ASTPVLTSRTSTPPFI

SEQ ID NO: 38265 - protein, 16 aa, BK virus
STPVLTSRTSTPPFIS

SEQ ID NO: 38266 - protein, 16 aa, BK virus
TPVLTSRTSTPPFISS

SEQ ID NO: 38267 - protein, 16 aa, BK virus
PVLTSRTSTPPFISSF

SEQ ID NO: 38268 - protein, 16 aa, BK virus
VLTSRTSTPPFISSFG

SEQ ID NO: 38269 - protein, 16 aa, BK virus
LTSRTSTPPFISSFGT

SEQ ID NO: 38270 - protein, 16 aa, BK virus
TSRTSTPPFISSFGTC

SEQ ID NO: 38271 - protein, 16 aa, BK virus
SRTSTPPFISSFGTCT

SEQ ID NO: 38272 - protein, 16 aa, BK virus
RTSTPPFISSFGTCTG

SEQ ID NO: 38273 - protein, 16 aa, BK virus
TSTPPFISSFGTCTGS

SEQ ID NO: 38274 - protein, 16 aa, BK virus
STPPFISSFGTCTGSF

SEQ ID NO: 38275 - protein, 16 aa, BK virus
TPPFISSFGTCTGSFG

SEQ ID NO: 38276 - protein, 16 aa, BK virus
PPFISSFGTCTGSFGF

SEQ ID NO: 38277 - protein, 16 aa, BK virus
PFISSFGTCTGSFGFL

SEQ ID NO: 38278 - protein, 16 aa, BK virus
FISSFGTCTGSFGFLG

SEQ ID NO: 38279 - protein, 16 aa, BK virus
ISSFGTCTGSFGFLGA

SEQ ID NO: 38280 - protein, 16 aa, BK virus
SSFGTCTGSFGFLGAA

SEQ ID NO: 38281 - protein, 16 aa, BK virus
SFGTCTGSFGFLGAAP

SEQ ID NO: 38282 - protein, 16 aa, BK virus
FGTCTGSFGFLGAAPG

SEQ ID NO: 38283 - protein, 16 aa, BK virus
GTCTGSFGFLGAAPGH

SEQ ID NO: 38284 - protein, 16 aa, BK virus
TCTGSFGFLGAAPGHS

SEQ ID NO: 38285 - protein, 16 aa, BK virus
CTGSFGFLGAAPGHSP

SEQ ID NO: 38286 - protein, 16 aa, BK virus
TGSFGFLGAAPGHSPF

SEQ ID NO: 38287 - protein, 16 aa, BK virus
GSFGFLGAAPGHSPFL

SEQ ID NO: 38288 - protein, 16 aa, BK virus
SFGFLGAAPGHSPFLL

SEQ ID NO: 38289 - protein, 16 aa, BK virus
FGFLGAAPGHSPFLLV

SEQ ID NO: 38290 - protein, 16 aa, BK virus
GFLGAAPGHSPFLLVG

SEQ ID NO: 38291 - protein, 16 aa, BK virus
FLGAAPGHSPFLLVGA

SEQ ID NO: 38292 - protein, 16 aa, BK virus
LGAAPGHSPFLLVGAI

SEQ ID NO: 38293 - protein, 16 aa, BK virus
GAAPGHSPFLLVGAIF

SEQ ID NO: 38294 - protein, 16 aa, BK virus
AAPGHSPFLLVGAIFI

SEQ ID NO: 38295 - protein, 16 aa, BK virus
APGHSPFLLVGAIFIC

SEQ ID NO: 38296 - protein, 16 aa, BK virus
PGHSPFLLVGAIFICF

SEQ ID NO: 38297 - protein, 16 aa, BK virus
GHSPFLLVGAIFICFK

SEQ ID NO: 38298 - protein, 16 aa, BK virus
HSPFLLVGAIFICFKS

SEQ ID NO: 38299 - protein, 16 aa, BK virus
SPFLLVGAIFICFKSR

SEQ ID NO: 38300 - protein, 16 aa, BK virus
PFLLVGAIFICFKSRC

SEQ ID NO: 38301 - protein, 16 aa, BK virus
FLLVGAIFICFKSRCY

SEQ ID NO: 38302 - protein, 16 aa, BK virus
LLVGAIFICFKSRCYS

SEQ ID NO: 38303 - protein, 16 aa, BK virus
LVGAIFICFKSRCYSP

SEQ ID NO: 38304 - protein, 16 aa, BK virus
VGAIFICFKSRCYSPV

SEQ ID NO: 38305 - protein, 16 aa, BK virus
GAIFICFKSRCYSPVQ

SEQ ID NO: 38306 - protein, 16 aa, BK virus
AIFICFKSRCYSPVQA

SEQ ID NO: 38307 - protein, 16 aa, BK virus
RQHPLRSSSLISTSWG

SEQ ID NO: 38308 - protein, 16 aa, BK virus
QHPLRSSSLISTSWGN

SEQ ID NO: 38309 - protein, 16 aa, BK virus
HPLRSSSLISTSWGNS

SEQ ID NO: 38310 - protein, 16 aa, BK virus
PLRSSSLISTSWGNSF

SEQ ID NO: 38311 - protein, 16 aa, BK virus
LRSSSLISTSWGNSFF

SEQ ID NO: 38312 - protein, 16 aa, BK virus
RSSSLISTSWGNSFFY

SEQ ID NO: 38313 - protein, 16 aa, BK virus
SSSLISTSWGNSFFYK

SEQ ID NO: 38314 - protein, 16 aa, BK virus
SSLISTSWGNSFFYKL

SEQ ID NO: 38315 - protein, 16 aa, BK virus
SLISTSWGNSFFYKLS

SEQ ID NO: 38316 - protein, 16 aa, BK virus
VHSLCNFFYTVSIIYT

SEQ ID NO: 38317 - protein, 16 aa, BK virus
HSLCNFFYTVSIIYTI

SEQ ID NO: 38318 - protein, 16 aa, BK virus
SLCNFFYTVSIIYTIS

SEQ ID NO: 38319 - protein, 16 aa, BK virus
LCNFFYTVSIIYTISM

SEQ ID NO: 38320 - protein, 16 aa, BK virus
CNFFYTVSIIYTISMA

SEQ ID NO: 38321 - protein, 16 aa, BK virus
NFFYTVSIIYTISMAK

SEQ ID NO: 38322 - protein, 16 aa, BK virus
FFYTVSIIYTISMAKM

SEQ ID NO: 38323 - protein, 16 aa, BK virus
FYTVSIIYTISMAKMY

SEQ ID NO: 38324 - protein, 16 aa, BK virus
YTVSIIYTISMAKMYT

SEQ ID NO: 38325 - protein, 16 aa, BK virus
TVSIIYTISMAKMYTG

SEQ ID NO: 38326 - protein, 16 aa, BK virus
VSIIYTISMAKMYTGT

SEQ ID NO: 38327 - protein, 16 aa, BK virus
SIIYTISMAKMYTGTF

SEQ ID NO: 38328 - protein, 16 aa, BK virus
IIYTISMAKMYTGTFP

SEQ ID NO: 38329 - protein, 16 aa, BK virus
IYTISMAKMYTGTFPF

SEQ ID NO: 38330 - protein, 16 aa, BK virus
YTISMAKMYTGTFPFS

SEQ ID NO: 38331 - protein, 16 aa, BK virus
TISMAKMYTGTFPFSY

SEQ ID NO: 38332 - protein, 16 aa, BK virus
ISMAKMYTGTFPFSYL

SEQ ID NO: 38333 - protein, 16 aa, BK virus
SMAKMYTGTFPFSYLS

SEQ ID NO: 38334 - protein, 16 aa, BK virus
MAKMYTGTFPFSYLSN

SEQ ID NO: 38335 - protein, 16 aa, BK virus
AKMYTGTFPFSYLSNH

SEQ ID NO: 38336 - protein, 16 aa, BK virus
GPNRGKIRIILLNIII

SEQ ID NO: 38337 - protein, 16 aa, BK virus
PNRGKIRIILLNIIIK

SEQ ID NO: 38338 - protein, 16 aa, BK virus
NRGKIRIILLNIIIKV

SEQ ID NO: 38339 - protein, 16 aa, BK virus
RGKIRIILLNIIIKVY

SEQ ID NO: 38340 - protein, 16 aa, BK virus
GKIRIILLNIIIKVYR

SEQ ID NO: 38341 - protein, 16 aa, BK virus
KIRIILLNIIIKVYRG

SEQ ID NO: 38342 - protein, 16 aa, BK virus
IRIILLNIIIKVYRGI

SEQ ID NO: 38343 - protein, 16 aa, BK virus
RIILLNIIIKVYRGIY

SEQ ID NO: 38344 - protein, 16 aa, BK virus
IILLNIIIKVYRGIYN

SEQ ID NO: 38345 - protein, 16 aa, BK virus
ILLNIIIKVYRGIYNC

SEQ ID NO: 38346 - protein, 16 aa, BK virus
LLNIIIKVYRGIYNCP

SEQ ID NO: 38347 - protein, 16 aa, BK virus
LNIIIKVYRGIYNCPG

SEQ ID NO: 38348 - protein, 16 aa, BK virus
NIIIKVYRGIYNCPGS

SEQ ID NO: 38349 - protein, 16 aa, BK virus
IIIKVYRGIYNCPGSF

SEQ ID NO: 38350 - protein, 16 aa, BK virus
IIKVYRGIYNCPGSFL

SEQ ID NO: 38351 - protein, 16 aa, BK virus
IKVYRGIYNCPGSFLQ

SEQ ID NO: 38352 - protein, 16 aa, BK virus
KVYRGIYNCPGSFLQK

SEQ ID NO: 38353 - protein, 16 aa, BK virus
VYRGIYNCPGSFLQKS

SEQ ID NO: 38354 - protein, 16 aa, BK virus
YRGIYNCPGSFLQKSS

SEQ ID NO: 38355 - protein, 16 aa, BK virus
RGIYNCPGSFLQKSSQ

SEQ ID NO: 38356 - protein, 16 aa, BK virus
GIYNCPGSFLQKSSQG

SEQ ID NO: 38357 - protein, 16 aa, BK virus
IYNCPGSFLQKSSQGV

SEQ ID NO: 38358 - protein, 16 aa, BK virus
YNCPGSFLQKSSQGVS

SEQ ID NO: 38359 - protein, 16 aa, BK virus
NCPGSFLQKSSQGVSK

SEQ ID NO: 38360 - protein, 16 aa, BK virus
CPGSFLQKSSQGVSKK

SEQ ID NO: 38361 - protein, 16 aa, BK virus
PGSFLQKSSQGVSKKS

SEQ ID NO: 38362 - protein, 16 aa, BK virus
GSFLQKSSQGVSKKSF

SEQ ID NO: 38363 - protein, 16 aa, BK virus
SFLQKSSQGVSKKSFC

SEQ ID NO: 38364 - protein, 16 aa, BK virus
FLQKSSQGVSKKSFCS

SEQ ID NO: 38365 - protein, 16 aa, BK virus
LQKSSQGVSKKSFCSS

SEQ ID NO: 38366 - protein, 16 aa, BK virus
QKSSQGVSKKSFCSSL

SEQ ID NO: 38367 - protein, 16 aa, BK virus
KSSQGVSKKSFCSSLQ

SEQ ID NO: 38368 - protein, 16 aa, BK virus
SSQGVSKKSFCSSLQF

SEQ ID NO: 38369 - protein, 16 aa, BK virus
SQGVSKKSFCSSLQFL

SEQ ID NO: 38370 - protein, 16 aa, BK virus
GYRRYIIPNNMPQSLG

SEQ ID NO: 38371 - protein, 16 aa, BK virus
YRRYIIPNNMPQSLGN

SEQ ID NO: 38372 - protein, 16 aa, BK virus
RRYIIPNNMPQSLGNS

SEQ ID NO: 38373 - protein, 16 aa, BK virus
RYIIPNNMPQSLGNSS

SEQ ID NO: 38374 - protein, 16 aa, BK virus
YIIPNNMPQSLGNSSK

SEQ ID NO: 38375 - protein, 16 aa, BK virus
IIPNNMPQSLGNSSKQ

SEQ ID NO: 38376 - protein, 16 aa, BK virus
IPNNMPQSLGNSSKQR

SEQ ID NO: 38377 - protein, 16 aa, BK virus
PNNMPQSLGNSSKQRR

SEQ ID NO: 38378 - protein, 16 aa, BK virus
NNMPQSLGNSSKQRRT

SEQ ID NO: 38379 - protein, 16 aa, BK virus
NMPQSLGNSSKQRRTP

SEQ ID NO: 38380 - protein, 16 aa, BK virus
MPQSLGNSSKQRRTPM

SEQ ID NO: 38381 - protein, 16 aa, BK virus
PQSLGNSSKQRRTPMP

SEQ ID NO: 38382 - protein, 16 aa, BK virus
QSLGNSSKQRRTPMPR

SEQ ID NO: 38383 - protein, 16 aa, BK virus
SLGNSSKQRRTPMPRI

SEQ ID NO: 38384 - protein, 16 aa, BK virus
LGNSSKQRRTPMPRIK

SEQ ID NO: 38385 - protein, 16 aa, BK virus
GNSSKQRRTPMPRIKV

SEQ ID NO: 38386 - protein, 16 aa, BK virus
NSSKQRRTPMPRIKVL

SEQ ID NO: 38387 - protein, 16 aa, BK virus
SSKQRRTPMPRIKVLN

SEQ ID NO: 38388 - protein, 16 aa, BK virus
SKQRRTPMPRIKVLNI

SEQ ID NO: 38389 - protein, 16 aa, BK virus
KQRRTPMPRIKVLNII

SEQ ID NO: 38390 - protein, 16 aa, BK virus
QRRTPMPRIKVLNIIN

SEQ ID NO: 38391 - protein, 16 aa, BK virus
RRTPMPRIKVLNIINK

SEQ ID NO: 38392 - protein, 16 aa, BK virus
RTPMPRIKVLNIINKS

SEQ ID NO: 38393 - protein, 16 aa, BK virus
TPMPRIKVLNIINKSI

SEQ ID NO: 38394 - protein, 16 aa, BK virus
PMPRIKVLNIINKSIY

SEQ ID NO: 38395 - protein, 16 aa, BK virus
MPRIKVLNIINKSIYT

SEQ ID NO: 38396 - protein, 16 aa, BK virus
PRIKVLNIINKSIYTR

SEQ ID NO: 38397 - protein, 16 aa, BK virus
RIKVLNIINKSIYTRK

SEQ ID NO: 38398 - protein, 16 aa, BK virus
IKVLNIINKSIYTRKQ

SEQ ID NO: 38399 - protein, 16 aa, BK virus
KVLNIINKSIYTRKQN

SEQ ID NO: 38400 - protein, 16 aa, BK virus
VLNIINKSIYTRKQNI

SEQ ID NO: 38401 - protein, 16 aa, BK virus
LNIINKSIYTRKQNII

SEQ ID NO: 38402 - protein, 16 aa, BK virus
NIINKSIYTRKQNIIV

SEQ ID NO: 38403 - protein, 16 aa, BK virus
IINKSIYTRKQNIIVL

SEQ ID NO: 38404 - protein, 16 aa, BK virus
INKSIYTRKQNIIVLI

SEQ ID NO: 38405 - protein, 16 aa, BK virus
NKSIYTRKQNIIVLIW

SEQ ID NO: 38406 - protein, 16 aa, BK virus
KSIYTRKQNIIVLIWV

SEQ ID NO: 38407 - protein, 16 aa, BK virus
SIYTRKQNIIVLIWVK

SEQ ID NO: 38408 - protein, 16 aa, BK virus
IYTRKQNIIVLIWVKQ

SEQ ID NO: 38409 - protein, 16 aa, BK virus
YTRKQNIIVLIWVKQF

SEQ ID NO: 38410 - protein, 16 aa, BK virus
TRKQNIIVLIWVKQFQ

SEQ ID NO: 38411 - protein, 16 aa, BK virus
RKQNIIVLIWVKQFQS

SEQ ID NO: 38412 - protein, 16 aa, BK virus
KQNIIVLIWVKQFQSH

SEQ ID NO: 38413 - protein, 16 aa, BK virus
QNIIVLIWVKQFQSHA

SEQ ID NO: 38414 - protein, 16 aa, BK virus
LLIEAYSGNFVIPIIK

SEQ ID NO: 38415 - protein, 16 aa, BK virus
LIEAYSGNFVIPIIKE

SEQ ID NO: 38416 - protein, 16 aa, BK virus
IEAYSGNFVIPIIKEL

SEQ ID NO: 38417 - protein, 16 aa, BK virus
EAYSGNFVIPIIKELI

SEQ ID NO: 38418 - protein, 16 aa, BK virus
AYSGNFVIPIIKELIP

SEQ ID NO: 38419 - protein, 16 aa, BK virus
YSGNFVIPIIKELIPY

SEQ ID NO: 38420 - protein, 16 aa, BK virus
SGNFVIPIIKELIPYL

SEQ ID NO: 38421 - protein, 16 aa, BK virus
GNFVIPIIKELIPYLS

SEQ ID NO: 38422 - protein, 16 aa, BK virus
SSKPSNSPRSTSNYSI

SEQ ID NO: 38423 - protein, 16 aa, BK virus
SKPSNSPRSTSNYSIC

SEQ ID NO: 38424 - protein, 16 aa, BK virus
KPSNSPRSTSNYSICL

SEQ ID NO: 38425 - protein, 16 aa, BK virus
PSNSPRSTSNYSICLR

SEQ ID NO: 38426 - protein, 16 aa, BK virus
SNSPRSTSNYSICLRS

SEQ ID NO: 38427 - protein, 16 aa, BK virus
GTCYALYSSKGCNLNF

SEQ ID NO: 38428 - protein, 16 aa, BK virus
TCYALYSSKGCNLNFY

SEQ ID NO: 38429 - protein, 16 aa, BK virus
CYALYSSKGCNLNFYS

SEQ ID NO: 38430 - protein, 16 aa, BK virus
YALYSSKGCNLNFYSS

SEQ ID NO: 38431 - protein, 16 aa, BK virus
ALYSSKGCNLNFYSSS

SEQ ID NO: 38432 - protein, 16 aa, BK virus
LYSSKGCNLNFYSSSS

SEQ ID NO: 38433 - protein, 16 aa, BK virus
YSSKGCNLNFYSSSSL

SEQ ID NO: 38434 - protein, 16 aa, BK virus
SSKGCNLNFYSSSSLP

SEQ ID NO: 38435 - protein, 16 aa, BK virus
SKGCNLNFYSSSSLPS

SEQ ID NO: 38436 - protein, 16 aa, BK virus
KGCNLNFYSSSSLPSS

SEQ ID NO: 38437 - protein, 16 aa, BK virus
GCNLNFYSSSSLPSSN

SEQ ID NO: 38438 - protein, 16 aa, BK virus
CNLNFYSSSSLPSSNF

SEQ ID NO: 38439 - protein, 16 aa, BK virus
NLNFYSSSSLPSSNFS

SEQ ID NO: 38440 - protein, 16 aa, BK virus
LNFYSSSSLPSSNFSH

SEQ ID NO: 38441 - protein, 16 aa, BK virus
SSTHEPGNTKKKGLLT

SEQ ID NO: 38442 - protein, 16 aa, BK virus
ESFTESFTAGKAVVLL

SEQ ID NO: 38443 - protein, 16 aa, BK virus
SFTESFTAGKAVVLLF

SEQ ID NO: 38444 - protein, 16 aa, BK virus
FTESFTAGKAVVLLFF

SEQ ID NO: 38445 - protein, 16 aa, BK virus
TESFTAGKAVVLLFFP

SEQ ID NO: 38446 - protein, 16 aa, BK virus
ESFTAGKAVVLLFFPS

SEQ ID NO: 38447 - protein, 16 aa, BK virus
SFTAGKAVVLLFFPST

SEQ ID NO: 38448 - protein, 16 aa, BK virus
FTAGKAVVLLFFPSTL

SEQ ID NO: 38449 - protein, 16 aa, BK virus
TAGKAVVLLFFPSTLS

SEQ ID NO: 38450 - protein, 16 aa, BK virus
AGKAVVLLFFPSTLSS

SEQ ID NO: 38451 - protein, 16 aa, BK virus
GKAVVLLFFPSTLSSP

SEQ ID NO: 38452 - protein, 16 aa, BK virus
KAVVLLFFPSTLSSPL

SEQ ID NO: 38453 - protein, 16 aa, BK virus
AVVLLFFPSTLSSPLQ

SEQ ID NO: 38454 - protein, 16 aa, BK virus
VVLLFFPSTLSSPLQN

SEQ ID NO: 38455 - protein, 16 aa, BK virus
VLLFFPSTLSSPLQNS

SEQ ID NO: 38456 - protein, 16 aa, BK virus
LLFFPSTLSSPLQNSS

SEQ ID NO: 38457 - protein, 16 aa, BK virus
LFFPSTLSSPLQNSSK

SEQ ID NO: 38458 - protein, 16 aa, BK virus
FFPSTLSSPLQNSSKS

SEQ ID NO: 38459 - protein, 16 aa, BK virus
FPSTLSSPLQNSSKSS

SEQ ID NO: 38460 - protein, 16 aa, BK virus
PSTLSSPLQNSSKSSK

SEQ ID NO: 38461 - protein, 16 aa, BK virus
STLSSPLQNSSKSSKI

SEQ ID NO: 38462 - protein, 16 aa, BK virus
TLSSPLQNSSKSSKIK

SEQ ID NO: 38463 - protein, 16 aa, BK virus
LSSPLQNSSKSSKIKI

SEQ ID NO: 38464 - protein, 16 aa, BK virus
SSPLQNSSKSSKIKIK

SEQ ID NO: 38465 - protein, 16 aa, BK virus
SPLQNSSKSSKIKIKI

SEQ ID NO: 38466 - protein, 16 aa, BK virus
PLQNSSKSSKIKIKIL

SEQ ID NO: 38467 - protein, 16 aa, BK virus
ALFFVPVQVLPTFTEA

SEQ ID NO: 38468 - protein, 16 aa, BK virus
LFFVPVQVLPTFTEAC

SEQ ID NO: 38469 - protein, 16 aa, BK virus
FFVPVQVLPTFTEACR

SEQ ID NO: 38470 - protein, 16 aa, BK virus
FVPVQVLPTFTEACRD

SEQ ID NO: 38471 - protein, 16 aa, BK virus
VPVQVLPTFTEACRDS

SEQ ID NO: 38472 - protein, 16 aa, BK virus
PVQVLPTFTEACRDSW

SEQ ID NO: 38473 - protein, 16 aa, BK virus
VQVLPTFTEACRDSWR

SEQ ID NO: 38474 - protein, 16 aa, BK virus
QVLPTFTEACRDSWRR

SEQ ID NO: 38475 - protein, 16 aa, BK virus
VLPTFTEACRDSWRRT

SEQ ID NO: 38476 - protein, 16 aa, BK virus
LPTFTEACRDSWRRTM

SEQ ID NO: 38477 - protein, 16 aa, BK virus
PTFTEACRDSWRRTMA

SEQ ID NO: 38478 - protein, 16 aa, BK virus
TFTEACRDSWRRTMAF

SEQ ID NO: 38479 - protein, 16 aa, BK virus
FTEACRDSWRRTMAFV

SEQ ID NO: 38480 - protein, 16 aa, BK virus
TEACRDSWRRTMAFVQ

SEQ ID NO: 38481 - protein, 16 aa, BK virus
EACRDSWRRTMAFVQF

SEQ ID NO: 38482 - protein, 16 aa, BK virus
ACRDSWRRTMAFVQFN

SEQ ID NO: 38483 - protein, 16 aa, BK virus
CRDSWRRTMAFVQFNW

SEQ ID NO: 38484 - protein, 16 aa, BK virus
RDSWRRTMAFVQFNWG

SEQ ID NO: 38485 - protein, 16 aa, BK virus
DSWRRTMAFVQFNWGQ

SEQ ID NO: 38486 - protein, 16 aa, BK virus
SWRRTMAFVQFNWGQG

SEQ ID NO: 38487 - protein, 16 aa, BK virus
WRRTMAFVQFNWGQGQ

SEQ ID NO: 38488 - protein, 16 aa, BK virus
RRTMAFVQFNWGQGQD

SEQ ID NO: 38489 - protein, 16 aa, BK virus
RTMAFVQFNWGQGQDS

SEQ ID NO: 38490 - protein, 16 aa, BK virus
ARKTCLSCTFLPEVMV

SEQ ID NO: 38491 - protein, 16 aa, BK virus
RKTCLSCTFLPEVMVW

SEQ ID NO: 38492 - protein, 16 aa, BK virus
KTCLSCTFLPEVMVWL

SEQ ID NO: 38493 - protein, 16 aa, BK virus
TCLSCTFLPEVMVWLH

SEQ ID NO: 38494 - protein, 16 aa, BK virus
CLSCTFLPEVMVWLHS

SEQ ID NO: 38495 - protein, 16 aa, BK virus
LSCTFLPEVMVWLHSM

SEQ ID NO: 38496 - protein, 16 aa, BK virus
SCTFLPEVMVWLHSMG

SEQ ID NO: 38497 - protein, 16 aa, BK virus
CTFLPEVMVWLHSMGK

SEQ ID NO: 38498 - protein, 16 aa, BK virus
TFLPEVMVWLHSMGKQ

SEQ ID NO: 38499 - protein, 16 aa, BK virus
FLPEVMVWLHSMGKQL

SEQ ID NO: 38500 - protein, 16 aa, BK virus
LPEVMVWLHSMGKQLL

SEQ ID NO: 38501 - protein, 16 aa, BK virus
PEVMVWLHSMGKQLLP

SEQ ID NO: 38502 - protein, 16 aa, BK virus
EVMVWLHSMGKQLLPV

SEQ ID NO: 38503 - protein, 16 aa, BK virus
VMVWLHSMGKQLLPVS

SEQ ID NO: 38504 - protein, 16 aa, BK virus
MVWLHSMGKQLLPVSH

SEQ ID NO: 38505 - protein, 16 aa, BK virus
VWLHSMGKQLLPVSHA

SEQ ID NO: 38506 - protein, 16 aa, BK virus
WLHSMGKQLLPVSHAL

SEQ ID NO: 38507 - protein, 16 aa, BK virus
LHSMGKQLLPVSHALS

SEQ ID NO: 38508 - protein, 16 aa, BK virus
HSMGKQLLPVSHALSF

SEQ ID NO: 38509 - protein, 16 aa, BK virus
SMGKQLLPVSHALSFL

SEQ ID NO: 38510 - protein, 16 aa, BK virus
MGKQLLPVSHALSFLR

SEQ ID NO: 38511 - protein, 16 aa, BK virus
GKQLLPVSHALSFLRS

SEQ ID NO: 38512 - protein, 16 aa, BK virus
KQLLPVSHALSFLRSW

SEQ ID NO: 38513 - protein, 16 aa, BK virus
QLLPVSHALSFLRSWF

SEQ ID NO: 38514 - protein, 16 aa, BK virus
LLPVSHALSFLRSWFG

SEQ ID NO: 38515 - protein, 16 aa, BK virus
LPVSHALSFLRSWFGC

SEQ ID NO: 38516 - protein, 16 aa, BK virus
PVSHALSFLRSWFGCI

SEQ ID NO: 38517 - protein, 16 aa, BK virus
VSHALSFLRSWFGCIP

SEQ ID NO: 38518 - protein, 16 aa, BK virus
SHALSFLRSWFGCIPL

SEQ ID NO: 38519 - protein, 16 aa, BK virus
GLAKLFGEIPILLQFL

SEQ ID NO: 38520 - protein, 16 aa, BK virus
LAKLFGEIPILLQFLQ

SEQ ID NO: 38521 - protein, 13 aa, BK virus
WIKFLTGKNPWSS

SEQ ID NO: 38522 - protein, 13 aa, BK virus
IKFLTGKNPWSSW

SEQ ID NO: 38523 - protein, 13 aa, BK virus
KFLTGKNPWSSWT

SEQ ID NO: 38524 - protein, 13 aa, BK virus
FLTGKNPWSSWTF

SEQ ID NO: 38525 - protein, 13 aa, BK virus
GSVRNFTLTKGAT

SEQ ID NO: 38526 - protein, 13 aa, BK virus
SVRNFTLTKGATR

SEQ ID NO: 38527 - protein, 13 aa, BK virus
VRNFTLTKGATRI

SEQ ID NO: 38528 - protein, 13 aa, BK virus
RNFTLTKGATRIK

SEQ ID NO: 38529 - protein, 13 aa, BK virus
LISLILEPGVAQR

SEQ ID NO: 38530 - protein, 13 aa, BK virus
ISLILEPGVAQRF

SEQ ID NO: 38531 - protein, 13 aa, BK virus
SLILEPGVAQRFV

SEQ ID NO: 38532 - protein, 13 aa, BK virus
LILEPGVAQRFVL

SEQ ID NO: 38533 - protein, 13 aa, BK virus
ILEPGVAQRFVLI

SEQ ID NO: 38534 - protein, 13 aa, BK virus
LEPGVAQRFVLIF

SEQ ID NO: 38535 - protein, 13 aa, BK virus
EPGVAQRFVLIFL

SEQ ID NO: 38536 - protein, 13 aa, BK virus
PGVAQRFVLIFLF

SEQ ID NO: 38537 - protein, 13 aa, BK virus
GVAQRFVLIFLFA

SEQ ID NO: 38538 - protein, 13 aa, BK virus
VAQRFVLIFLFAQ

SEQ ID NO: 38539 - protein, 13 aa, BK virus
AQRFVLIFLFAQI

SEQ ID NO: 38540 - protein, 13 aa, BK virus
QRFVLIFLFAQIP

SEQ ID NO: 38541 - protein, 13 aa, BK virus
RFVLIFLFAQIPC

SEQ ID NO: 38542 - protein, 13 aa, BK virus
FVLIFLFAQIPCT

SEQ ID NO: 38543 - protein, 13 aa, BK virus
VLIFLFAQIPCTA

SEQ ID NO: 38544 - protein, 13 aa, BK virus
LIFLFAQIPCTAR

SEQ ID NO: 38545 - protein, 13 aa, BK virus
IFLFAQIPCTARN

SEQ ID NO: 38546 - protein, 13 aa, BK virus
FLFAQIPCTARNG

SEQ ID NO: 38547 - protein, 13 aa, BK virus
LFAQIPCTARNGL

SEQ ID NO: 38548 - protein, 13 aa, BK virus
FAQIPCTARNGLF

SEQ ID NO: 38549 - protein, 13 aa, BK virus
AQIPCTARNGLFV

SEQ ID NO: 38550 - protein, 13 aa, BK virus
QIPCTARNGLFVP

SEQ ID NO: 38551 - protein, 13 aa, BK virus
IPCTARNGLFVPK

SEQ ID NO: 38552 - protein, 13 aa, BK virus
PCTARNGLFVPKS

SEQ ID NO: 38553 - protein, 13 aa, BK virus
CTARNGLFVPKSL

SEQ ID NO: 38554 - protein, 13 aa, BK virus
TARNGLFVPKSLL

SEQ ID NO: 38555 - protein, 13 aa, BK virus
ARNGLFVPKSLLC

SEQ ID NO: 38556 - protein, 13 aa, BK virus
RNGLFVPKSLLCT

SEQ ID NO: 38557 - protein, 13 aa, BK virus
NGLFVPKSLLCTA

SEQ ID NO: 38558 - protein, 13 aa, BK virus
GLFVPKSLLCTAL

SEQ ID NO: 38559 - protein, 13 aa, BK virus
LFVPKSLLCTALA

SEQ ID NO: 38560 - protein, 13 aa, BK virus
FVPKSLLCTALAC

SEQ ID NO: 38561 - protein, 13 aa, BK virus
VPKSLLCTALACY

SEQ ID NO: 38562 - protein, 13 aa, BK virus
PKSLLCTALACYV

SEQ ID NO: 38563 - protein, 13 aa, BK virus
KSLLCTALACYVS

SEQ ID NO: 38564 - protein, 13 aa, BK virus
SLLCTALACYVSL

SEQ ID NO: 38565 - protein, 13 aa, BK virus
LLCTALACYVSLD

SEQ ID NO: 38566 - protein, 13 aa, BK virus
IATALTASHSGLA

SEQ ID NO: 38567 - protein, 13 aa, BK virus
VIIFFIGANLWNR

SEQ ID NO: 38568 - protein, 13 aa, BK virus
IIFFIGANLWNRR

SEQ ID NO: 38569 - protein, 13 aa, BK virus
IFFIGANLWNRRV

SEQ ID NO: 38570 - protein, 13 aa, BK virus
FFIGANLWNRRVG

SEQ ID NO: 38571 - protein, 13 aa, BK virus
FIGANLWNRRVGV

SEQ ID NO: 38572 - protein, 13 aa, BK virus
IGANLWNRRVGVL

SEQ ID NO: 38573 - protein, 13 aa, BK virus
GANLWNRRVGVLV

SEQ ID NO: 38574 - protein, 13 aa, BK virus
ANLWNRRVGVLVE

SEQ ID NO: 38575 - protein, 13 aa, BK virus
NLWNRRVGVLVEF

SEQ ID NO: 38576 - protein, 13 aa, BK virus
LWNRRVGVLVEFL

SEQ ID NO: 38577 - protein, 13 aa, BK virus
RSNSRFSTLNTTQ

SEQ ID NO: 38578 - protein, 13 aa, BK virus
SNSRFSTLNTTQK

SEQ ID NO: 38579 - protein, 13 aa, BK virus
NSRFSTLNTTQKK

SEQ ID NO: 38580 - protein, 13 aa, BK virus
SRFSTLNTTQKKK

SEQ ID NO: 38581 - protein, 13 aa, BK virus
RFSTLNTTQKKKK

SEQ ID NO: 38582 - protein, 13 aa, BK virus
FSTLNTTQKKKKG

SEQ ID NO: 38583 - protein, 13 aa, BK virus
STLNTTQKKKKGR

SEQ ID NO: 38584 - protein, 13 aa, BK virus
TLNTTQKKKKGRR

SEQ ID NO: 38585 - protein, 13 aa, BK virus
LNTTQKKKKGRRP

SEQ ID NO: 38586 - protein, 13 aa, BK virus
RSIPYYRRKHSRG

SEQ ID NO: 38587 - protein, 13 aa, BK virus
SIPYYRRKHSRGL

SEQ ID NO: 38588 - protein, 13 aa, BK virus
IPYYRRKHSRGLK

SEQ ID NO: 38589 - protein, 13 aa, BK virus
PYYRRKHSRGLKG

SEQ ID NO: 38590 - protein, 13 aa, BK virus
YYRRKHSRGLKGA

SEQ ID NO: 38591 - protein, 13 aa, BK virus
GCVFIIRYVFRIS

SEQ ID NO: 38592 - protein, 13 aa, BK virus
CVFIIRYVFRISI

SEQ ID NO: 38593 - protein, 13 aa, BK virus
VFIIRYVFRISIQ

SEQ ID NO: 38594 - protein, 13 aa, BK virus
FIIRYVFRISIQC

SEQ ID NO: 38595 - protein, 13 aa, BK virus
IIRYVFRISIQCR

SEQ ID NO: 38596 - protein, 13 aa, BK virus
IRYVFRISIQCRG

SEQ ID NO: 38597 - protein, 13 aa, BK virus
RYVFRISIQCRGV

SEQ ID NO: 38598 - protein, 13 aa, BK virus
KSKKYLSASSRYS

SEQ ID NO: 38599 - protein, 13 aa, BK virus
SKKYLSASSRYSF

SEQ ID NO: 38600 - protein, 13 aa, BK virus
KKYLSASSRYSFS

SEQ ID NO: 38601 - protein, 13 aa, BK virus
KKSRYPSYDQGRN

SEQ ID NO: 38602 - protein, 13 aa, BK virus
KSRYPSYDQGRNA

SEQ ID NO: 38603 - protein, 13 aa, BK virus
SRYPSYDQGRNAN

SEQ ID NO: 38604 - protein, 13 aa, BK virus
RYPSYDQGRNANR

SEQ ID NO: 38605 - protein, 13 aa, BK virus
YPSYDQGRNANRK

SEQ ID NO: 38606 - protein, 13 aa, BK virus
PSYDQGRNANRKI

SEQ ID NO: 38607 - protein, 13 aa, BK virus
SYDQGRNANRKIQ

SEQ ID NO: 38608 - protein, 13 aa, BK virus
YDQGRNANRKIQS

SEQ ID NO: 38609 - protein, 13 aa, BK virus
DQGRNANRKIQSY

SEQ ID NO: 38610 - protein, 13 aa, BK virus
QGRNANRKIQSYI

SEQ ID NO: 38611 - protein, 13 aa, BK virus
GRNANRKIQSYIR

SEQ ID NO: 38612 - protein, 13 aa, BK virus
NGFNIWSSWKCCT

SEQ ID NO: 38613 - protein, 13 aa, BK virus
GFNIWSSWKCCTR

SEQ ID NO: 38614 - protein, 13 aa, BK virus
FNIWSSWKCCTRT

SEQ ID NO: 38615 - protein, 13 aa, BK virus
NIWSSWKCCTRTI

SEQ ID NO: 38616 - protein, 13 aa, BK virus
IWSSWKCCTRTIY

SEQ ID NO: 38617 - protein, 13 aa, BK virus
WSSWKCCTRTIYG

SEQ ID NO: 38618 - protein, 13 aa, BK virus
SSWKCCTRTIYGR

SEQ ID NO: 38619 - protein, 13 aa, BK virus
SWKCCTRTIYGRC

SEQ ID NO: 38620 - protein, 13 aa, BK virus
WKCCTRTIYGRCC

SEQ ID NO: 38621 - protein, 13 aa, BK virus
KCCTRTIYGRCCL

SEQ ID NO: 38622 - protein, 13 aa, BK virus
CCTRTIYGRCCLA

SEQ ID NO: 38623 - protein, 13 aa, BK virus
CTRTIYGRCCLAA

SEQ ID NO: 38624 - protein, 13 aa, BK virus
TRTIYGRCCLAAL

SEQ ID NO: 38625 - protein, 13 aa, BK virus
RTIYGRCCLAALF

SEQ ID NO: 38626 - protein, 13 aa, BK virus
TIYGRCCLAALFA

SEQ ID NO: 38627 - protein, 13 aa, BK virus
IYGRCCLAALFAT

SEQ ID NO: 38628 - protein, 13 aa, BK virus
WKNNTSCRVIRFV

SEQ ID NO: 38629 - protein, 13 aa, BK virus
KNNTSCRVIRFVW

SEQ ID NO: 38630 - protein, 13 aa, BK virus
NNTSCRVIRFVWW

SEQ ID NO: 38631 - protein, 13 aa, BK virus
SLKCKPTHGKANL

SEQ ID NO: 38632 - protein, 13 aa, BK virus
IKGFAFRTWNKQF

SEQ ID NO: 38633 - protein, 13 aa, BK virus
KGFAFRTWNKQFR

SEQ ID NO: 38634 - protein, 13 aa, BK virus
GFAFRTWNKQFRQ

SEQ ID NO: 38635 - protein, 13 aa, BK virus
FAFRTWNKQFRQF

SEQ ID NO: 38636 - protein, 13 aa, BK virus
AFRTWNKQFRQFE

SEQ ID NO: 38637 - protein, 13 aa, BK virus
FRTWNKQFRQFER

SEQ ID NO: 38638 - protein, 13 aa, BK virus
RTWNKQFRQFERL

SEQ ID NO: 38639 - protein, 13 aa, BK virus
TWNKQFRQFERLF

SEQ ID NO: 38640 - protein, 13 aa, BK virus
WNKQFRQFERLFR

SEQ ID NO: 38641 - protein, 13 aa, BK virus
NKQFRQFERLFRW

SEQ ID NO: 38642 - protein, 13 aa, BK virus
KQFRQFERLFRWK

SEQ ID NO: 38643 - protein, 13 aa, BK virus
QFRQFERLFRWKC

SEQ ID NO: 38644 - protein, 13 aa, BK virus
GKFRKETFKQKNP

SEQ ID NO: 38645 - protein, 13 aa, BK virus
KFRKETFKQKNPN

SEQ ID NO: 38646 - protein, 13 aa, BK virus
FRKETFKQKNPNI

SEQ ID NO: 38647 - protein, 13 aa, BK virus
RKETFKQKNPNIS

SEQ ID NO: 38648 - protein, 13 aa, BK virus
KETFKQKNPNIST

SEQ ID NO: 38649 - protein, 13 aa, BK virus
ETFKQKNPNISTR

SEQ ID NO: 38650 - protein, 13 aa, BK virus
TFKQKNPNISTRL

SEQ ID NO: 38651 - protein, 13 aa, BK virus
FKQKNPNISTRLG

SEQ ID NO: 38652 - protein, 13 aa, BK virus
KQKNPNISTRLGY

SEQ ID NO: 38653 - protein, 13 aa, BK virus
QKNPNISTRLGYN

SEQ ID NO: 38654 - protein, 13 aa, BK virus
KNPNISTRLGYNE

SEQ ID NO: 38655 - protein, 13 aa, BK virus
AQNIFKKILTKLR

SEQ ID NO: 38656 - protein, 13 aa, BK virus
QNIFKKILTKLRV

SEQ ID NO: 38657 - protein, 13 aa, BK virus
NIFKKILTKLRVL

SEQ ID NO: 38658 - protein, 13 aa, BK virus
IFKKILTKLRVLT

SEQ ID NO: 38659 - protein, 13 aa, BK virus
KKNFTKWNDLVAT

SEQ ID NO: 38660 - protein, 13 aa, BK virus
KNFTKWNDLVATA

SEQ ID NO: 38661 - protein, 13 aa, BK virus
NFTKWNDLVATAN

SEQ ID NO: 38662 - protein, 13 aa, BK virus
FTKWNDLVATANL

SEQ ID NO: 38663 - protein, 13 aa, BK virus
TKWNDLVATANLV

SEQ ID NO: 38664 - protein, 13 aa, BK virus
IPITMLFPSLRYF

SEQ ID NO: 38665 - protein, 13 aa, BK virus
PITMLFPSLRYFS

SEQ ID NO: 38666 - protein, 13 aa, BK virus
ITMLFPSLRYFSP

SEQ ID NO: 38667 - protein, 13 aa, BK virus
TMLFPSLRYFSPC

SEQ ID NO: 38668 - protein, 13 aa, BK virus
KWLIQKQHLLNVY

SEQ ID NO: 38669 - protein, 13 aa, BK virus
WLIQKQHLLNVYV

SEQ ID NO: 38670 - protein, 13 aa, BK virus
LIQKQHLLNVYVQ

SEQ ID NO: 38671 - protein, 13 aa, BK virus
KHLFKAFWFAIVP

SEQ ID NO: 38672 - protein, 13 aa, BK virus
HLFKAFWFAIVPV

SEQ ID NO: 38673 - protein, 13 aa, BK virus
LFKAFWFAIVPVC

SEQ ID NO: 38674 - protein, 13 aa, BK virus
FKAFWFAIVPVCQ

SEQ ID NO: 38675 - protein, 13 aa, BK virus
KAFWFAIVPVCQY

SEQ ID NO: 38676 - protein, 13 aa, BK virus
AFWFAIVPVCQYI

SEQ ID NO: 38677 - protein, 13 aa, BK virus
FWFAIVPVCQYIL

SEQ ID NO: 38678 - protein, 13 aa, BK virus
WFAIVPVCQYILS

SEQ ID NO: 38679 - protein, 13 aa, BK virus
FAIVPVCQYILSY

SEQ ID NO: 38680 - protein, 13 aa, BK virus
AIVPVCQYILSYL

SEQ ID NO: 38681 - protein, 13 aa, BK virus
IVPVCQYILSYLG

SEQ ID NO: 38682 - protein, 13 aa, BK virus
VPVCQYILSYLGP

SEQ ID NO: 38683 - protein, 13 aa, BK virus
PVCQYILSYLGPL

SEQ ID NO: 38684 - protein, 13 aa, BK virus
VCQYILSYLGPLE

SEQ ID NO: 38685 - protein, 13 aa, BK virus
CQYILSYLGPLEV

SEQ ID NO: 38686 - protein, 13 aa, BK virus
QYILSYLGPLEVF

SEQ ID NO: 38687 - protein, 13 aa, BK virus
YILSYLGPLEVFL

SEQ ID NO: 38688 - protein, 13 aa, BK virus
ILSYLGPLEVFLC

SEQ ID NO: 38689 - protein, 13 aa, BK virus
LSYLGPLEVFLCH

SEQ ID NO: 38690 - protein, 13 aa, BK virus
SYLGPLEVFLCHQ

SEQ ID NO: 38691 - protein, 13 aa, BK virus
YLGPLEVFLCHQT

SEQ ID NO: 38692 - protein, 13 aa, BK virus
LGPLEVFLCHQTP

SEQ ID NO: 38693 - protein, 13 aa, BK virus
GHLAKRKLGKDSL

SEQ ID NO: 38694 - protein, 13 aa, BK virus
HLAKRKLGKDSLQ

SEQ ID NO: 38695 - protein, 13 aa, BK virus
LAKRKLGKDSLQI

SEQ ID NO: 38696 - protein, 13 aa, BK virus
AKRKLGKDSLQIF

SEQ ID NO: 38697 - protein, 13 aa, BK virus
KRKLGKDSLQIFF

SEQ ID NO: 38698 - protein, 13 aa, BK virus
RKLGKDSLQIFFS

SEQ ID NO: 38699 - protein, 13 aa, BK virus
KLGKDSLQIFFSG

SEQ ID NO: 38700 - protein, 13 aa, BK virus
LGKDSLQIFFSGG

SEQ ID NO: 38701 - protein, 13 aa, BK virus
GKDSLQIFFSGGS

SEQ ID NO: 38702 - protein, 13 aa, BK virus
NILQGLSTVVFQS

SEQ ID NO: 38703 - protein, 13 aa, BK virus
ILQGLSTVVFQSC

SEQ ID NO: 38704 - protein, 13 aa, BK virus
TGHKYQQLKHTGY

SEQ ID NO: 38705 - protein, 13 aa, BK virus
GHKYQQLKHTGYQ

SEQ ID NO: 38706 - protein, 13 aa, BK virus
HKYQQLKHTGYQL

SEQ ID NO: 38707 - protein, 13 aa, BK virus
KYQQLKHTGYQLY

SEQ ID NO: 38708 - protein, 13 aa, BK virus
YQQLKHTGYQLYK

SEQ ID NO: 38709 - protein, 13 aa, BK virus
QQLKHTGYQLYKE

SEQ ID NO: 38710 - protein, 13 aa, BK virus
QLKHTGYQLYKEA

SEQ ID NO: 38711 - protein, 13 aa, BK virus
LKHTGYQLYKEAP

SEQ ID NO: 38712 - protein, 13 aa, BK virus
KHTGYQLYKEAPH

SEQ ID NO: 38713 - protein, 13 aa, BK virus
HTGYQLYKEAPHP

SEQ ID NO: 38714 - protein, 13 aa, BK virus
TGYQLYKEAPHPV

SEQ ID NO: 38715 - protein, 13 aa, BK virus
GYQLYKEAPHPVH

SEQ ID NO: 38716 - protein, 13 aa, BK virus
YQLYKEAPHPVHL

SEQ ID NO: 38717 - protein, 13 aa, BK virus
QLYKEAPHPVHLA

SEQ ID NO: 38718 - protein, 13 aa, BK virus
LYKEAPHPVHLAT

SEQ ID NO: 38719 - protein, 13 aa, BK virus
YKEAPHPVHLATL

SEQ ID NO: 38720 - protein, 13 aa, BK virus
KEAPHPVHLATLW

SEQ ID NO: 38721 - protein, 13 aa, BK virus
LCWSHEVLGEHFP

SEQ ID NO: 38722 - protein, 13 aa, BK virus
CWSHEVLGEHFPL

SEQ ID NO: 38723 - protein, 13 aa, BK virus
WSHEVLGEHFPLL

SEQ ID NO: 38724 - protein, 13 aa, BK virus
HFHFYWDQVPSTQ

SEQ ID NO: 38725 - protein, 13 aa, BK virus
FHFYWDQVPSTQL

SEQ ID NO: 38726 - protein, 13 aa, BK virus
HFYWDQVPSTQLD

SEQ ID NO: 38727 - protein, 13 aa, BK virus
FYWDQVPSTQLDK

SEQ ID NO: 38728 - protein, 13 aa, BK virus
YWDQVPSTQLDKH

SEQ ID NO: 38729 - protein, 13 aa, BK virus
WDQVPSTQLDKHC

SEQ ID NO: 38730 - protein, 13 aa, BK virus
DQVPSTQLDKHCF

SEQ ID NO: 38731 - protein, 13 aa, BK virus
QVPSTQLDKHCFC

SEQ ID NO: 38732 - protein, 13 aa, BK virus
VPSTQLDKHCFCP

SEQ ID NO: 38733 - protein, 13 aa, BK virus
PSTQLDKHCFCPN

SEQ ID NO: 38734 - protein, 13 aa, BK virus
STQLDKHCFCPNR

SEQ ID NO: 38735 - protein, 13 aa, BK virus
TQLDKHCFCPNRP

SEQ ID NO: 38736 - protein, 13 aa, BK virus
QLDKHCFCPNRPY

SEQ ID NO: 38737 - protein, 13 aa, BK virus
LDKHCFCPNRPYG

SEQ ID NO: 38738 - protein, 13 aa, BK virus
DKHCFCPNRPYGQ

SEQ ID NO: 38739 - protein, 13 aa, BK virus
KHCFCPNRPYGQY

SEQ ID NO: 38740 - protein, 13 aa, BK virus
HCFCPNRPYGQYS

SEQ ID NO: 38741 - protein, 13 aa, BK virus
CFCPNRPYGQYSL

SEQ ID NO: 38742 - protein, 13 aa, BK virus
FCPNRPYGQYSLP

SEQ ID NO: 38743 - protein, 13 aa, BK virus
CPNRPYGQYSLPG

SEQ ID NO: 38744 - protein, 13 aa, BK virus
PNRPYGQYSLPGT

SEQ ID NO: 38745 - protein, 13 aa, BK virus
NRPYGQYSLPGTG

SEQ ID NO: 38746 - protein, 13 aa, BK virus
RPYGQYSLPGTGL

SEQ ID NO: 38747 - protein, 13 aa, BK virus
PYGQYSLPGTGLL

SEQ ID NO: 38748 - protein, 13 aa, BK virus
YGQYSLPGTGLLG

SEQ ID NO: 38749 - protein, 13 aa, BK virus
GQYSLPGTGLLGF

SEQ ID NO: 38750 - protein, 13 aa, BK virus
YHQGTLTCNSLAL

SEQ ID NO: 38751 - protein, 13 aa, BK virus
HQGTLTCNSLALP

SEQ ID NO: 38752 - protein, 13 aa, BK virus
QGTLTCNSLALPA

SEQ ID NO: 38753 - protein, 13 aa, BK virus
GTLTCNSLALPAF

SEQ ID NO: 38754 - protein, 13 aa, BK virus
TLTCNSLALPAFP

SEQ ID NO: 38755 - protein, 13 aa, BK virus
LTCNSLALPAFPR

SEQ ID NO: 38756 - protein, 13 aa, BK virus
TCNSLALPAFPRV

SEQ ID NO: 38757 - protein, 13 aa, BK virus
CNSLALPAFPRVL

SEQ ID NO: 38758 - protein, 13 aa, BK virus
NSLALPAFPRVLH

SEQ ID NO: 38759 - protein, 13 aa, BK virus
SLALPAFPRVLHL

SEQ ID NO: 38760 - protein, 13 aa, BK virus
LALPAFPRVLHLQ

SEQ ID NO: 38761 - protein, 13 aa, BK virus
ALPAFPRVLHLQQ

SEQ ID NO: 38762 - protein, 13 aa, BK virus
LPAFPRVLHLQQR

SEQ ID NO: 38763 - protein, 13 aa, BK virus
PAFPRVLHLQQRS

SEQ ID NO: 38764 - protein, 13 aa, BK virus
AFPRVLHLQQRSG

SEQ ID NO: 38765 - protein, 13 aa, BK virus
FPRVLHLQQRSGN

SEQ ID NO: 38766 - protein, 13 aa, BK virus
PRVLHLQQRSGNY

SEQ ID NO: 38767 - protein, 13 aa, BK virus
RVLHLQQRSGNYC

SEQ ID NO: 38768 - protein, 13 aa, BK virus
VLHLQQRSGNYCL

SEQ ID NO: 38769 - protein, 13 aa, BK virus
LHLQQRSGNYCLE

SEQ ID NO: 38770 - protein, 13 aa, BK virus
VFLHHAHALFVTL

SEQ ID NO: 38771 - protein, 13 aa, BK virus
FLHHAHALFVTLH

SEQ ID NO: 38772 - protein, 13 aa, BK virus
LHHAHALFVTLHE

SEQ ID NO: 38773 - protein, 13 aa, BK virus
HHAHALFVTLHEG

SEQ ID NO: 38774 - protein, 13 aa, BK virus
PLFVQLQPPTSVD

SEQ ID NO: 38775 - protein, 13 aa, BK virus
LFVQLQPPTSVDF

SEQ ID NO: 38776 - protein, 13 aa, BK virus
FVQLQPPTSVDFH

SEQ ID NO: 38777 - protein, 13 aa, BK virus
VQLQPPTSVDFHR

SEQ ID NO: 38778 - protein, 13 aa, BK virus
QLQPPTSVDFHRL

SEQ ID NO: 38779 - protein, 13 aa, BK virus
LQPPTSVDFHRLG

SEQ ID NO: 38780 - protein, 13 aa, BK virus
QPPTSVDFHRLGP

SEQ ID NO: 38781 - protein, 13 aa, BK virus
PPTSVDFHRLGPH

SEQ ID NO: 38782 - protein, 13 aa, BK virus
PTSVDFHRLGPHL

SEQ ID NO: 38783 - protein, 13 aa, BK virus
TSVDFHRLGPHLN

SEQ ID NO: 38784 - protein, 13 aa, BK virus
SVDFHRLGPHLNW

SEQ ID NO: 38785 - protein, 13 aa, BK virus
VDFHRLGPHLNWG

SEQ ID NO: 38786 - protein, 13 aa, BK virus
DFHRLGPHLNWGG

SEQ ID NO: 38787 - protein, 13 aa, BK virus
FHRLGPHLNWGGE

SEQ ID NO: 38788 - protein, 13 aa, BK virus
HRLGPHLNWGGEF

SEQ ID NO: 38789 - protein, 13 aa, BK virus
RLGPHLNWGGEFL

SEQ ID NO: 38790 - protein, 13 aa, BK virus
LGPHLNWGGEFLL

SEQ ID NO: 38791 - protein, 13 aa, BK virus
GPHLNWGGEFLLC

SEQ ID NO: 38792 - protein, 13 aa, BK virus
PHLNWGGEFLLCC

SEQ ID NO: 38793 - protein, 13 aa, BK virus
HLNWGGEFLLCCN

SEQ ID NO: 38794 - protein, 13 aa, BK virus
LNWGGEFLLCCNR

SEQ ID NO: 38795 - protein, 13 aa, BK virus
NWGGEFLLCCNRE

SEQ ID NO: 38796 - protein, 13 aa, BK virus
WGGEFLLCCNREA

SEQ ID NO: 38797 - protein, 13 aa, BK virus
GGEFLLCCNREAF

SEQ ID NO: 38798 - protein, 13 aa, BK virus
GEFLLCCNREAFF

SEQ ID NO: 38799 - protein, 13 aa, BK virus
EFLLCCNREAFFS

SEQ ID NO: 38800 - protein, 13 aa, BK virus
FLLCCNREAFFSL

SEQ ID NO: 38801 - protein, 13 aa, BK virus
LLCCNREAFFSLG

SEQ ID NO: 38802 - protein, 13 aa, BK virus
LCCNREAFFSLGY

SEQ ID NO: 38803 - protein, 13 aa, BK virus
CCNREAFFSLGYH

SEQ ID NO: 38804 - protein, 13 aa, BK virus
CNREAFFSLGYHC

SEQ ID NO: 38805 - protein, 13 aa, BK virus
GFHLDPPFLGLGS

SEQ ID NO: 38806 - protein, 13 aa, BK virus
FHLDPPFLGLGSI

SEQ ID NO: 38807 - protein, 13 aa, BK virus
HLDPPFLGLGSIL

SEQ ID NO: 38808 - protein, 13 aa, BK virus
LDPPFLGLGSILP

SEQ ID NO: 38809 - protein, 13 aa, BK virus
DPPFLGLGSILPL

SEQ ID NO: 38810 - protein, 13 aa, BK virus
LLELLLLLLLVVL

SEQ ID NO: 38811 - protein, 13 aa, BK virus
LELLLLLLLVVLA

SEQ ID NO: 38812 - protein, 13 aa, BK virus
ELLLLLLLVVLAL

SEQ ID NO: 38813 - protein, 13 aa, BK virus
LLLLLLLVVLALA

SEQ ID NO: 38814 - protein, 13 aa, BK virus
LLLLLLVVLALAR

SEQ ID NO: 38815 - protein, 13 aa, BK virus
LLLLLVVLALARV

SEQ ID NO: 38816 - protein, 13 aa, BK virus
LLLLVVLALARVP

SEQ ID NO: 38817 - protein, 13 aa, BK virus
LLLVVLALARVPL

SEQ ID NO: 38818 - protein, 13 aa, BK virus
LLVVLALARVPLA

SEQ ID NO: 38819 - protein, 13 aa, BK virus
LVVLALARVPLAF

SEQ ID NO: 38820 - protein, 13 aa, BK virus
VVLALARVPLAFW

SEQ ID NO: 38821 - protein, 13 aa, BK virus
VLALARVPLAFWE

SEQ ID NO: 38822 - protein, 13 aa, BK virus
LALARVPLAFWEL

SEQ ID NO: 38823 - protein, 13 aa, BK virus
ALARVPLAFWELP

SEQ ID NO: 38824 - protein, 13 aa, BK virus
LARVPLAFWELPL

SEQ ID NO: 38825 - protein, 13 aa, BK virus
ARVPLAFWELPLD

SEQ ID NO: 38826 - protein, 13 aa, BK virus
RVPLAFWELPLDT

SEQ ID NO: 38827 - protein, 13 aa, BK virus
VPLAFWELPLDTL

SEQ ID NO: 38828 - protein, 13 aa, BK virus
PLAFWELPLDTLL

SEQ ID NO: 38829 - protein, 13 aa, BK virus
LAFWELPLDTLLF

SEQ ID NO: 38830 - protein, 13 aa, BK virus
AFWELPLDTLLFF

SEQ ID NO: 38831 - protein, 13 aa, BK virus
FWELPLDTLLFFW

SEQ ID NO: 38832 - protein, 13 aa, BK virus
WELPLDTLLFFWL

SEQ ID NO: 38833 - protein, 13 aa, BK virus
ELPLDTLLFFWLG

SEQ ID NO: 38834 - protein, 13 aa, BK virus
LPLDTLLFFWLGP

SEQ ID NO: 38835 - protein, 13 aa, BK virus
PLDTLLFFWLGPS

SEQ ID NO: 38836 - protein, 13 aa, BK virus
LDTLLFFWLGPSS

SEQ ID NO: 38837 - protein, 13 aa, BK virus
DTLLFFWLGPSSY

SEQ ID NO: 38838 - protein, 13 aa, BK virus
TLLFFWLGPSSYA

SEQ ID NO: 38839 - protein, 13 aa, BK virus
LLFFWLGPSSYAS

SEQ ID NO: 38840 - protein, 13 aa, BK virus
LFFWLGPSSYASR

SEQ ID NO: 38841 - protein, 13 aa, BK virus
FFWLGPSSYASRA

SEQ ID NO: 38842 - protein, 13 aa, BK virus
FWLGPSSYASRAG

SEQ ID NO: 38843 - protein, 13 aa, BK virus
WLGPSSYASRAGV

SEQ ID NO: 38844 - protein, 13 aa, BK virus
LGPSSYASRAGVT

SEQ ID NO: 38845 - protein, 13 aa, BK virus
GPSSYASRAGVTV

SEQ ID NO: 38846 - protein, 13 aa, BK virus
PSSYASRAGVTVP

SEQ ID NO: 38847 - protein, 13 aa, BK virus
SSYASRAGVTVPY

SEQ ID NO: 38848 - protein, 13 aa, BK virus
SYASRAGVTVPYR

SEQ ID NO: 38849 - protein, 13 aa, BK virus
YASRAGVTVPYRP

SEQ ID NO: 38850 - protein, 13 aa, BK virus
ASRAGVTVPYRPR

SEQ ID NO: 38851 - protein, 13 aa, BK virus
SRAGVTVPYRPRS

SEQ ID NO: 38852 - protein, 13 aa, BK virus
RAGVTVPYRPRSK

SEQ ID NO: 38853 - protein, 13 aa, BK virus
AGVTVPYRPRSKG

SEQ ID NO: 38854 - protein, 13 aa, BK virus
GVTVPYRPRSKGN

SEQ ID NO: 38855 - protein, 13 aa, BK virus
VTVPYRPRSKGNI

SEQ ID NO: 38856 - protein, 13 aa, BK virus
TVPYRPRSKGNIH

SEQ ID NO: 38857 - protein, 13 aa, BK virus
LAPPGAIVFSINS

SEQ ID NO: 38858 - protein, 13 aa, BK virus
APPGAIVFSINSP

SEQ ID NO: 38859 - protein, 13 aa, BK virus
PPGAIVFSINSPE

SEQ ID NO: 38860 - protein, 13 aa, BK virus
PGAIVFSINSPEC

SEQ ID NO: 38861 - protein, 13 aa, BK virus
GAIVFSINSPECT

SEQ ID NO: 38862 - protein, 13 aa, BK virus
AIVFSINSPECTL

SEQ ID NO: 38863 - protein, 13 aa, BK virus
IVFSINSPECTLC

SEQ ID NO: 38864 - protein, 13 aa, BK virus
FLKSILCVTSSIL

SEQ ID NO: 38865 - protein, 13 aa, BK virus
LKSILCVTSSILS

SEQ ID NO: 38866 - protein, 13 aa, BK virus
KSILCVTSSILSA

SEQ ID NO: 38867 - protein, 13 aa, BK virus
SILCVTSSILSAS

SEQ ID NO: 38868 - protein, 13 aa, BK virus
ILCVTSSILSASS

SEQ ID NO: 38869 - protein, 13 aa, BK virus
LCVTSSILSASSI

SEQ ID NO: 38870 - protein, 13 aa, BK virus
CVTSSILSASSIL

SEQ ID NO: 38871 - protein, 13 aa, BK virus
VWPKCTRVPSLSA

SEQ ID NO: 38872 - protein, 13 aa, BK virus
WPKCTRVPSLSAT

SEQ ID NO: 38873 - protein, 13 aa, BK virus
PKCTRVPSLSATC

SEQ ID NO: 38874 - protein, 13 aa, BK virus
KCTRVPSLSATCL

SEQ ID NO: 38875 - protein, 13 aa, BK virus
CTRVPSLSATCLT

SEQ ID NO: 38876 - protein, 13 aa, BK virus
TRVPSLSATCLTI

SEQ ID NO: 38877 - protein, 13 aa, BK virus
RVPSLSATCLTIE

SEQ ID NO: 38878 - protein, 13 aa, BK virus
VPSLSATCLTIEG

SEQ ID NO: 38879 - protein, 13 aa, BK virus
PSLSATCLTIEGL

SEQ ID NO: 38880 - protein, 13 aa, BK virus
SLSATCLTIEGLI

SEQ ID NO: 38881 - protein, 13 aa, BK virus
LSATCLTIEGLIG

SEQ ID NO: 38882 - protein, 13 aa, BK virus
SATCLTIEGLIGE

SEQ ID NO: 38883 - protein, 13 aa, BK virus
ATCLTIEGLIGER

SEQ ID NO: 38884 - protein, 13 aa, BK virus
TCLTIEGLIGERS

SEQ ID NO: 38885 - protein, 13 aa, BK virus
CLTIEGLIGERSE

SEQ ID NO: 38886 - protein, 13 aa, BK virus
KFIGAFTIVQVVS

SEQ ID NO: 38887 - protein, 13 aa, BK virus
FIGAFTIVQVVSS

SEQ ID NO: 38888 - protein, 13 aa, BK virus
IGAFTIVQVVSSK

SEQ ID NO: 38889 - protein, 13 aa, BK virus
GAFTIVQVVSSKN

SEQ ID NO: 38890 - protein, 13 aa, BK virus
AFTIVQVVSSKNL

SEQ ID NO: 38891 - protein, 13 aa, BK virus
FTIVQVVSSKNLA

SEQ ID NO: 38892 - protein, 13 aa, BK virus
TIVQVVSSKNLAK

SEQ ID NO: 38893 - protein, 13 aa, BK virus
IVQVVSSKNLAKE

SEQ ID NO: 38894 - protein, 13 aa, BK virus
VQVVSSKNLAKES

SEQ ID NO: 38895 - protein, 13 aa, BK virus
QVVSSKNLAKESL

SEQ ID NO: 38896 - protein, 13 aa, BK virus
VVSSKNLAKESLK

SEQ ID NO: 38897 - protein, 13 aa, BK virus
VSSKNLAKESLKN

SEQ ID NO: 38898 - protein, 13 aa, BK virus
SSKNLAKESLKNL

SEQ ID NO: 38899 - protein, 13 aa, BK virus
SKNLAKESLKNLS

SEQ ID NO: 38900 - protein, 13 aa, BK virus
KNLAKESLKNLSV

SEQ ID NO: 38901 - protein, 13 aa, BK virus
NLAKESLKNLSVL

SEQ ID NO: 38902 - protein, 13 aa, BK virus
LAKESLKNLSVLL

SEQ ID NO: 38903 - protein, 13 aa, BK virus
AKESLKNLSVLLC

SEQ ID NO: 38904 - protein, 13 aa, BK virus
KESLKNLSVLLCN

SEQ ID NO: 38905 - protein, 13 aa, BK virus
ESLKNLSVLLCNS

SEQ ID NO: 38906 - protein, 13 aa, BK virus
SLKNLSVLLCNSC

SEQ ID NO: 38907 - protein, 13 aa, BK virus
LKNLSVLLCNSCE

SEQ ID NO: 38908 - protein, 13 aa, BK virus
KNLSVLLCNSCEV

SEQ ID NO: 38909 - protein, 13 aa, BK virus
NLSVLLCNSCEVI

SEQ ID NO: 38910 - protein, 13 aa, BK virus
LSVLLCNSCEVIE

SEQ ID NO: 38911 - protein, 13 aa, BK virus
SVLLCNSCEVIEG

SEQ ID NO: 38912 - protein, 13 aa, BK virus
VLLCNSCEVIEGI

SEQ ID NO: 38913 - protein, 13 aa, BK virus
LLCNSCEVIEGIS

SEQ ID NO: 38914 - protein, 13 aa, BK virus
LCNSCEVIEGISS

SEQ ID NO: 38915 - protein, 13 aa, BK virus
CNSCEVIEGISSL

SEQ ID NO: 38916 - protein, 13 aa, BK virus
NSCEVIEGISSLI

SEQ ID NO: 38917 - protein, 13 aa, BK virus
SCEVIEGISSLIT

SEQ ID NO: 38918 - protein, 13 aa, BK virus
CEVIEGISSLITC

SEQ ID NO: 38919 - protein, 13 aa, BK virus
EVIEGISSLITCH

SEQ ID NO: 38920 - protein, 13 aa, BK virus
VIEGISSLITCHK

SEQ ID NO: 38921 - protein, 13 aa, BK virus
IEGISSLITCHKA

SEQ ID NO: 38922 - protein, 13 aa, BK virus
EGISSLITCHKAW

SEQ ID NO: 38923 - protein, 13 aa, BK virus
GISSLITCHKAWE

SEQ ID NO: 38924 - protein, 13 aa, BK virus
ISSLITCHKAWEI

SEQ ID NO: 38925 - protein, 13 aa, BK virus
SSLITCHKAWEIV

SEQ ID NO: 38926 - protein, 13 aa, BK virus
SLITCHKAWEIVA

SEQ ID NO: 38927 - protein, 13 aa, BK virus
LITCHKAWEIVAN

SEQ ID NO: 38928 - protein, 13 aa, BK virus
ITCHKAWEIVANK

SEQ ID NO: 38929 - protein, 13 aa, BK virus
TCHKAWEIVANKE

SEQ ID NO: 38930 - protein, 13 aa, BK virus
CHKAWEIVANKEG

SEQ ID NO: 38931 - protein, 13 aa, BK virus
HKAWEIVANKEGP

SEQ ID NO: 38932 - protein, 13 aa, BK virus
KAWEIVANKEGPQ

SEQ ID NO: 38933 - protein, 13 aa, BK virus
AWEIVANKEGPQC

SEQ ID NO: 38934 - protein, 13 aa, BK virus
WEIVANKEGPQCL

SEQ ID NO: 38935 - protein, 13 aa, BK virus
EIVANKEGPQCLG

SEQ ID NO: 38936 - protein, 13 aa, BK virus
IVANKEGPQCLGS

SEQ ID NO: 38937 - protein, 13 aa, BK virus
VANKEGPQCLGSR

SEQ ID NO: 38938 - protein, 13 aa, BK virus
ANKEGPQCLGSRY

SEQ ID NO: 38939 - protein, 13 aa, BK virus
ILLTKVFTPGNRI

SEQ ID NO: 38940 - protein, 13 aa, BK virus
LLTKVFTPGNRIS

SEQ ID NO: 38941 - protein, 13 aa, BK virus
YSSGLNNSKAMPD

SEQ ID NO: 38942 - protein, 13 aa, BK virus
SSGLNNSKAMPDC

SEQ ID NO: 38943 - protein, 13 aa, BK virus
IKAANPAIAPGAP

SEQ ID NO: 38944 - protein, 13 aa, BK virus
KAANPAIAPGAPA

SEQ ID NO: 38945 - protein, 13 aa, BK virus
AANPAIAPGAPAI

SEQ ID NO: 38946 - protein, 13 aa, BK virus
ANPAIAPGAPAIT

SEQ ID NO: 38947 - protein, 13 aa, BK virus
NPAIAPGAPAITA

SEQ ID NO: 38948 - protein, 13 aa, BK virus
PAIAPGAPAITAY

SEQ ID NO: 38949 - protein, 13 aa, BK virus
AIAPGAPAITAYV

SEQ ID NO: 38950 - protein, 13 aa, BK virus
GVRPIAAIASEVL

SEQ ID NO: 38951 - protein, 13 aa, BK virus
VRPIAAIASEVLV

SEQ ID NO: 38952 - protein, 13 aa, BK virus
RPIAAIASEVLVM

SEQ ID NO: 38953 - protein, 13 aa, BK virus
PIAAIASEVLVMP

SEQ ID NO: 38954 - protein, 13 aa, BK virus
IAAIASEVLVMPS

SEQ ID NO: 38955 - protein, 13 aa, BK virus
AAIASEVLVMPST

SEQ ID NO: 38956 - protein, 13 aa, BK virus
AIASEVLVMPSTV

SEQ ID NO: 38957 - protein, 13 aa, BK virus
IASEVLVMPSTVA

SEQ ID NO: 38958 - protein, 13 aa, BK virus
ASEVLVMPSTVAR

SEQ ID NO: 38959 - protein, 13 aa, BK virus
SEVLVMPSTVARD

SEQ ID NO: 38960 - protein, 13 aa, BK virus
EVLVMPSTVARDA

SEQ ID NO: 38961 - protein, 13 aa, BK virus
VLVMPSTVARDAI

SEQ ID NO: 38962 - protein, 13 aa, BK virus
TSIAAAASPAAIS

SEQ ID NO: 38963 - protein, 13 aa, BK virus
SIAAAASPAAISA

SEQ ID NO: 38964 - protein, 13 aa, BK virus
IAAAASPAAISAT

SEQ ID NO: 38965 - protein, 13 aa, BK virus
AAAASPAAISATE

SEQ ID NO: 38966 - protein, 13 aa, BK virus
AAASPAAISATEN

SEQ ID NO: 38967 - protein, 13 aa, BK virus
AASPAAISATENP

SEQ ID NO: 38968 - protein, 13 aa, BK virus
ASPAAISATENPV

SEQ ID NO: 38969 - protein, 13 aa, BK virus
SPAAISATENPVA

SEQ ID NO: 38970 - protein, 13 aa, BK virus
PAAISATENPVAA

SEQ ID NO: 38971 - protein, 13 aa, BK virus
AAISATENPVAAA

SEQ ID NO: 38972 - protein, 13 aa, BK virus
AISATENPVAAAA

SEQ ID NO: 38973 - protein, 13 aa, BK virus
ISATENPVAAAAS

SEQ ID NO: 38974 - protein, 13 aa, BK virus
SATENPVAAAASD

SEQ ID NO: 38975 - protein, 13 aa, BK virus
ATENPVAAAASDT

SEQ ID NO: 38976 - protein, 13 aa, BK virus
TENPVAAAASDTL

SEQ ID NO: 38977 - protein, 13 aa, BK virus
ENPVAAAASDTLA

SEQ ID NO: 38978 - protein, 13 aa, BK virus
NPVAAAASDTLAT

SEQ ID NO: 38979 - protein, 13 aa, BK virus
PVAAAASDTLATR

SEQ ID NO: 38980 - protein, 13 aa, BK virus
VAAAASDTLATRS

SEQ ID NO: 38981 - protein, 13 aa, BK virus
AAAASDTLATRSP

SEQ ID NO: 38982 - protein, 13 aa, BK virus
AAASDTLATRSPK

SEQ ID NO: 38983 - protein, 13 aa, BK virus
AASDTLATRSPKS

SEQ ID NO: 38984 - protein, 13 aa, BK virus
ASDTLATRSPKSA

SEQ ID NO: 38985 - protein, 13 aa, BK virus
SDTLATRSPKSAR

SEQ ID NO: 38986 - protein, 13 aa, BK virus
DTLATRSPKSARA

SEQ ID NO: 38987 - protein, 13 aa, BK virus
TLATRSPKSARAA

SEQ ID NO: 38988 - protein, 13 aa, BK virus
LATRSPKSARAAP

SEQ ID NO: 38989 - protein, 13 aa, BK virus
ATRSPKSARAAPM

SEQ ID NO: 38990 - protein, 13 aa, BK virus
TRSPKSARAAPMN

SEQ ID NO: 38991 - protein, 13 aa, BK virus
RSPKSARAAPMNL

SEQ ID NO: 38992 - protein, 13 aa, BK virus
SPKSARAAPMNLE

SEQ ID NO: 38993 - protein, 13 aa, BK virus
PKSARAAPMNLEI

SEQ ID NO: 38994 - protein, 13 aa, BK virus
KSARAAPMNLEIQ

SEQ ID NO: 38995 - protein, 13 aa, BK virus
SARAAPMNLEIQK

SEQ ID NO: 38996 - protein, 13 aa, BK virus
ARAAPMNLEIQKK

SEQ ID NO: 38997 - protein, 13 aa, BK virus
RAAPMNLEIQKKR

SEQ ID NO: 38998 - protein, 13 aa, BK virus
AAPMNLEIQKKRD

SEQ ID NO: 38999 - protein, 13 aa, BK virus
APMNLEIQKKRDY

SEQ ID NO: 39000 - protein, 13 aa, BK virus
PMNLEIQKKRDYL

SEQ ID NO: 39001 - protein, 13 aa, BK virus
MNLEIQKKRDYLP

SEQ ID NO: 39002 - protein, 13 aa, BK virus
NLEIQKKRDYLPR

SEQ ID NO: 39003 - protein, 13 aa, BK virus
LEIQKKRDYLPRS

SEQ ID NO: 39004 - protein, 13 aa, BK virus
EIQKKRDYLPRSL

SEQ ID NO: 39005 - protein, 13 aa, BK virus
IQKKRDYLPRSLL

SEQ ID NO: 39006 - protein, 13 aa, BK virus
QKKRDYLPRSLLQ

SEQ ID NO: 39007 - protein, 13 aa, BK virus
KKRDYLPRSLLQS

SEQ ID NO: 39008 - protein, 13 aa, BK virus
KRDYLPRSLLQSL

SEQ ID NO: 39009 - protein, 13 aa, BK virus
RDYLPRSLLQSLL

SEQ ID NO: 39010 - protein, 13 aa, BK virus
DYLPRSLLQSLLQ

SEQ ID NO: 39011 - protein, 13 aa, BK virus
YLPRSLLQSLLQQ

SEQ ID NO: 39012 - protein, 13 aa, BK virus
LPRSLLQSLLQQV

SEQ ID NO: 39013 - protein, 13 aa, BK virus
PRSLLQSLLQQVK

SEQ ID NO: 39014 - protein, 13 aa, BK virus
RSLLQSLLQQVKQ

SEQ ID NO: 39015 - protein, 13 aa, BK virus
SLLQSLLQQVKQW

SEQ ID NO: 39016 - protein, 13 aa, BK virus
LLQSLLQQVKQWY

SEQ ID NO: 39017 - protein, 13 aa, BK virus
LQSLLQQVKQWYF

SEQ ID NO: 39018 - protein, 13 aa, BK virus
QSLLQQVKQWYFC

SEQ ID NO: 39019 - protein, 13 aa, BK virus
SLLQQVKQWYFCF

SEQ ID NO: 39020 - protein, 13 aa, BK virus
LLQQVKQWYFCFS

SEQ ID NO: 39021 - protein, 13 aa, BK virus
LQQVKQWYFCFSR

SEQ ID NO: 39022 - protein, 13 aa, BK virus
QQVKQWYFCFSRL

SEQ ID NO: 39023 - protein, 13 aa, BK virus
QVKQWYFCFSRLH

SEQ ID NO: 39024 - protein, 13 aa, BK virus
VKQWYFCFSRLHC

SEQ ID NO: 39025 - protein, 13 aa, BK virus
KQWYFCFSRLHCL

SEQ ID NO: 39026 - protein, 13 aa, BK virus
QWYFCFSRLHCLH

SEQ ID NO: 39027 - protein, 13 aa, BK virus
WYFCFSRLHCLHL

SEQ ID NO: 39028 - protein, 13 aa, BK virus
YFCFSRLHCLHLY

SEQ ID NO: 39029 - protein, 13 aa, BK virus
FCFSRLHCLHLYK

SEQ ID NO: 39030 - protein, 13 aa, BK virus
CFSRLHCLHLYKI

SEQ ID NO: 39031 - protein, 13 aa, BK virus
FSRLHCLHLYKIP

SEQ ID NO: 39032 - protein, 13 aa, BK virus
SRLHCLHLYKIPA

SEQ ID NO: 39033 - protein, 13 aa, BK virus
RLHCLHLYKIPAK

SEQ ID NO: 39034 - protein, 13 aa, BK virus
LHCLHLYKIPAKA

SEQ ID NO: 39035 - protein, 13 aa, BK virus
HCLHLYKIPAKAL

SEQ ID NO: 39036 - protein, 13 aa, BK virus
CLHLYKIPAKALK

SEQ ID NO: 39037 - protein, 13 aa, BK virus
KSSELFFLFQSRF

SEQ ID NO: 39038 - protein, 13 aa, BK virus
SSELFFLFQSRFY

SEQ ID NO: 39039 - protein, 13 aa, BK virus
SELFFLFQSRFYQ

SEQ ID NO: 39040 - protein, 13 aa, BK virus
ELFFLFQSRFYQL

SEQ ID NO: 39041 - protein, 13 aa, BK virus
LFFLFQSRFYQLS

SEQ ID NO: 39042 - protein, 13 aa, BK virus
FFLFQSRFYQLSL

SEQ ID NO: 39043 - protein, 13 aa, BK virus
FLFQSRFYQLSLK

SEQ ID NO: 39044 - protein, 13 aa, BK virus
LFQSRFYQLSLKL

SEQ ID NO: 39045 - protein, 13 aa, BK virus
FQSRFYQLSLKLV

SEQ ID NO: 39046 - protein, 13 aa, BK virus
QSRFYQLSLKLVV

SEQ ID NO: 39047 - protein, 13 aa, BK virus
SRFYQLSLKLVVT

SEQ ID NO: 39048 - protein, 13 aa, BK virus
RFYQLSLKLVVTA

SEQ ID NO: 39049 - protein, 13 aa, BK virus
FYQLSLKLVVTAG

SEQ ID NO: 39050 - protein, 13 aa, BK virus
YQLSLKLVVTAGA

SEQ ID NO: 39051 - protein, 13 aa, BK virus
QLSLKLVVTAGAE

SEQ ID NO: 39052 - protein, 13 aa, BK virus
LSLKLVVTAGAEP

SEQ ID NO: 39053 - protein, 13 aa, BK virus
SLKLVVTAGAEPW

SEQ ID NO: 39054 - protein, 13 aa, BK virus
LKLVVTAGAEPWP

SEQ ID NO: 39055 - protein, 13 aa, BK virus
KLVVTAGAEPWPL

SEQ ID NO: 39056 - protein, 13 aa, BK virus
LVVTAGAEPWPLS

SEQ ID NO: 39057 - protein, 13 aa, BK virus
VVTAGAEPWPLSS

SEQ ID NO: 39058 - protein, 13 aa, BK virus
VTAGAEPWPLSSL

SEQ ID NO: 39059 - protein, 13 aa, BK virus
TAGAEPWPLSSLT

SEQ ID NO: 39060 - protein, 13 aa, BK virus
AGAEPWPLSSLTG

SEQ ID NO: 39061 - protein, 13 aa, BK virus
GAEPWPLSSLTGD

SEQ ID NO: 39062 - protein, 13 aa, BK virus
AEPWPLSSLTGDK

SEQ ID NO: 39063 - protein, 13 aa, BK virus
EPWPLSSLTGDKA

SEQ ID NO: 39064 - protein, 13 aa, BK virus
PWPLSSLTGDKAK

SEQ ID NO: 39065 - protein, 13 aa, BK virus
WPLSSLTGDKAKI

SEQ ID NO: 39066 - protein, 13 aa, BK virus
PLSSLTGDKAKIP

SEQ ID NO: 39067 - protein, 13 aa, BK virus
LSSLTGDKAKIPR

SEQ ID NO: 39068 - protein, 13 aa, BK virus
SSLTGDKAKIPRL

SEQ ID NO: 39069 - protein, 13 aa, BK virus
SLTGDKAKIPRLA

SEQ ID NO: 39070 - protein, 13 aa, BK virus
LTGDKAKIPRLAK

SEQ ID NO: 39071 - protein, 13 aa, BK virus
TGDKAKIPRLAKH

SEQ ID NO: 39072 - protein, 13 aa, BK virus
GDKAKIPRLAKHV

SEQ ID NO: 39073 - protein, 13 aa, BK virus
DKAKIPRLAKHVC

SEQ ID NO: 39074 - protein, 13 aa, BK virus
KAKIPRLAKHVCH

SEQ ID NO: 39075 - protein, 13 aa, BK virus
AKIPRLAKHVCHA

SEQ ID NO: 39076 - protein, 13 aa, BK virus
KIPRLAKHVCHAL

SEQ ID NO: 39077 - protein, 13 aa, BK virus
IPRLAKHVCHALS

SEQ ID NO: 39078 - protein, 13 aa, BK virus
PRLAKHVCHALSF

SEQ ID NO: 39079 - protein, 13 aa, BK virus
RLAKHVCHALSFL

SEQ ID NO: 39080 - protein, 13 aa, BK virus
LAKHVCHALSFLR

SEQ ID NO: 39081 - protein, 13 aa, BK virus
AKHVCHALSFLRS

SEQ ID NO: 39082 - protein, 13 aa, BK virus
KHVCHALSFLRSW

SEQ ID NO: 39083 - protein, 13 aa, BK virus
HVCHALSFLRSWF

SEQ ID NO: 39084 - protein, 13 aa, BK virus
VCHALSFLRSWFG

SEQ ID NO: 39085 - protein, 13 aa, BK virus
CHALSFLRSWFGC

SEQ ID NO: 39086 - protein, 13 aa, BK virus
HALSFLRSWFGCI

SEQ ID NO: 39087 - protein, 13 aa, BK virus
ALSFLRSWFGCIP

SEQ ID NO: 39088 - protein, 13 aa, BK virus
LSFLRSWFGCIPW

SEQ ID NO: 39089 - protein, 13 aa, BK virus
SFLRSWFGCIPWV

SEQ ID NO: 39090 - protein, 13 aa, BK virus
FLRSWFGCIPWVS

SEQ ID NO: 39091 - protein, 13 aa, BK virus
LRSWFGCIPWVSS

SEQ ID NO: 39092 - protein, 13 aa, BK virus
RSWFGCIPWVSSS

SEQ ID NO: 39093 - protein, 13 aa, BK virus
SWFGCIPWVSSSS

SEQ ID NO: 39094 - protein, 13 aa, BK virus
WFGCIPWVSSSSL

SEQ ID NO: 39095 - protein, 13 aa, BK virus
GHGLAAFPCESCT

SEQ ID NO: 39096 - protein, 13 aa, BK virus
HGLAAFPCESCTF

SEQ ID NO: 39097 - protein, 13 aa, BK virus
GLAAFPCESCTFL

SEQ ID NO: 39098 - protein, 13 aa, BK virus
LAAFPCESCTFLP

SEQ ID NO: 39099 - protein, 13 aa, BK virus
AAFPCESCTFLPE

SEQ ID NO: 39100 - protein, 13 aa, BK virus
AFPCESCTFLPEV

SEQ ID NO: 39101 - protein, 13 aa, BK virus
FPCESCTFLPEVM

SEQ ID NO: 39102 - protein, 13 aa, BK virus
PCESCTFLPEVMV

SEQ ID NO: 39103 - protein, 13 aa, BK virus
CESCTFLPEVMVW

SEQ ID NO: 39104 - protein, 13 aa, BK virus
ESCTFLPEVMVWL

SEQ ID NO: 39105 - protein, 13 aa, BK virus
SCTFLPEVMVWLH

SEQ ID NO: 39106 - protein, 13 aa, BK virus
CTFLPEVMVWLHS

SEQ ID NO: 39107 - protein, 13 aa, BK virus
TFLPEVMVWLHSM

SEQ ID NO: 39108 - protein, 13 aa, BK virus
FLPEVMVWLHSMG

SEQ ID NO: 39109 - protein, 13 aa, BK virus
LPEVMVWLHSMGK

SEQ ID NO: 39110 - protein, 13 aa, BK virus
PEVMVWLHSMGKQ

SEQ ID NO: 39111 - protein, 13 aa, BK virus
EVMVWLHSMGKQL

SEQ ID NO: 39112 - protein, 13 aa, BK virus
VMVWLHSMGKQLL

SEQ ID NO: 39113 - protein, 13 aa, BK virus
MVWLHSMGKQLLP

SEQ ID NO: 39114 - protein, 13 aa, BK virus
VWLHSMGKQLLPV

SEQ ID NO: 39115 - protein, 13 aa, BK virus
WLHSMGKQLLPVA

SEQ ID NO: 39116 - protein, 13 aa, BK virus
LHSMGKQLLPVAF

SEQ ID NO: 39117 - protein, 13 aa, BK virus
HSMGKQLLPVAFF

SEQ ID NO: 39118 - protein, 13 aa, BK virus
SMGKQLLPVAFFF

SEQ ID NO: 39119 - protein, 13 aa, BK virus
MGKQLLPVAFFFI

SEQ ID NO: 39120 - protein, 13 aa, BK virus
GKQLLPVAFFFII

SEQ ID NO: 39121 - protein, 13 aa, BK virus
KQLLPVAFFFIIY

SEQ ID NO: 39122 - protein, 13 aa, BK virus
QLLPVAFFFIIYK

SEQ ID NO: 39123 - protein, 13 aa, BK virus
LLPVAFFFIIYKR

SEQ ID NO: 39124 - protein, 13 aa, BK virus
LPVAFFFIIYKRP

SEQ ID NO: 39125 - protein, 13 aa, BK virus
PVAFFFIIYKRPR

SEQ ID NO: 39126 - protein, 13 aa, BK virus
VAFFFIIYKRPRP

SEQ ID NO: 39127 - protein, 13 aa, BK virus
AFFFIIYKRPRPP

SEQ ID NO: 39128 - protein, 13 aa, BK virus
FFFIIYKRPRPPL

SEQ ID NO: 39129 - protein, 13 aa, BK virus
FFIIYKRPRPPLP

SEQ ID NO: 39130 - protein, 13 aa, BK virus
FIIYKRPRPPLPP

SEQ ID NO: 39131 - protein, 13 aa, BK virus
IIYKRPRPPLPPP

SEQ ID NO: 39132 - protein, 13 aa, BK virus
IYKRPRPPLPPPF

SEQ ID NO: 39133 - protein, 13 aa, BK virus
YKRPRPPLPPPFL

SEQ ID NO: 39134 - protein, 13 aa, BK virus
KRPRPPLPPPFLS

SEQ ID NO: 39135 - protein, 13 aa, BK virus
RPRPPLPPPFLSS

SEQ ID NO: 39136 - protein, 13 aa, BK virus
PRPPLPPPFLSSS

SEQ ID NO: 39137 - protein, 13 aa, BK virus
RPPLPPPFLSSSK

SEQ ID NO: 39138 - protein, 13 aa, BK virus
PPLPPPFLSSSKG

SEQ ID NO: 39139 - protein, 13 aa, BK virus
PLPPPFLSSSKGV

SEQ ID NO: 39140 - protein, 13 aa, BK virus
LPPPFLSSSKGVE

SEQ ID NO: 39141 - protein, 13 aa, BK virus
PPPFLSSSKGVEA

SEQ ID NO: 39142 - protein, 13 aa, BK virus
PPFLSSSKGVEAF

SEQ ID NO: 39143 - protein, 13 aa, BK virus
PFLSSSKGVEAFS

SEQ ID NO: 39144 - protein, 13 aa, BK virus
FLSSSKGVEAFSE

SEQ ID NO: 39145 - protein, 13 aa, BK virus
LSSSKGVEAFSEA

SEQ ID NO: 39146 - protein, 13 aa, BK virus
QNYLGKSLFFCNF

SEQ ID NO: 39147 - protein, 13 aa, BK virus
NYLGKSLFFCNFC

SEQ ID NO: 39148 - protein, 13 aa, BK virus
YLGKSLFFCNFCK

SEQ ID NO: 39149 - protein, 14 aa, BK virus
WIKFLTGKNPWSSW

SEQ ID NO: 39150 - protein, 14 aa, BK virus
IKFLTGKNPWSSWT

SEQ ID NO: 39151 - protein, 14 aa, BK virus
KFLTGKNPWSSWTF

SEQ ID NO: 39152 - protein, 14 aa, BK virus
GSVRNFTLTKGATR

SEQ ID NO: 39153 - protein, 14 aa, BK virus
SVRNFTLTKGATRI

SEQ ID NO: 39154 - protein, 14 aa, BK virus
VRNFTLTKGATRIK

SEQ ID NO: 39155 - protein, 14 aa, BK virus
LISLILEPGVAQRF

SEQ ID NO: 39156 - protein, 14 aa, BK virus
ISLILEPGVAQRFV

SEQ ID NO: 39157 - protein, 14 aa, BK virus
SLILEPGVAQRFVL

SEQ ID NO: 39158 - protein, 14 aa, BK virus
LILEPGVAQRFVLI

SEQ ID NO: 39159 - protein, 14 aa, BK virus
ILEPGVAQRFVLIF

SEQ ID NO: 39160 - protein, 14 aa, BK virus
LEPGVAQRFVLIFL

SEQ ID NO: 39161 - protein, 14 aa, BK virus
EPGVAQRFVLIFLF

SEQ ID NO: 39162 - protein, 14 aa, BK virus
PGVAQRFVLIFLFA

SEQ ID NO: 39163 - protein, 14 aa, BK virus
GVAQRFVLIFLFAQ

SEQ ID NO: 39164 - protein, 14 aa, BK virus
VAQRFVLIFLFAQI

SEQ ID NO: 39165 - protein, 14 aa, BK virus
AQRFVLIFLFAQIP

SEQ ID NO: 39166 - protein, 14 aa, BK virus
QRFVLIFLFAQIPC

SEQ ID NO: 39167 - protein, 14 aa, BK virus
RFVLIFLFAQIPCT

SEQ ID NO: 39168 - protein, 14 aa, BK virus
FVLIFLFAQIPCTA

SEQ ID NO: 39169 - protein, 14 aa, BK virus
VLIFLFAQIPCTAR

SEQ ID NO: 39170 - protein, 14 aa, BK virus
LIFLFAQIPCTARN

SEQ ID NO: 39171 - protein, 14 aa, BK virus
IFLFAQIPCTARNG

SEQ ID NO: 39172 - protein, 14 aa, BK virus
FLFAQIPCTARNGL

SEQ ID NO: 39173 - protein, 14 aa, BK virus
LFAQIPCTARNGLF

SEQ ID NO: 39174 - protein, 14 aa, BK virus
FAQIPCTARNGLFV

SEQ ID NO: 39175 - protein, 14 aa, BK virus
AQIPCTARNGLFVP

SEQ ID NO: 39176 - protein, 14 aa, BK virus
QIPCTARNGLFVPK

SEQ ID NO: 39177 - protein, 14 aa, BK virus
IPCTARNGLFVPKS

SEQ ID NO: 39178 - protein, 14 aa, BK virus
PCTARNGLFVPKSL

SEQ ID NO: 39179 - protein, 14 aa, BK virus
CTARNGLFVPKSLL

SEQ ID NO: 39180 - protein, 14 aa, BK virus
TARNGLFVPKSLLC

SEQ ID NO: 39181 - protein, 14 aa, BK virus
ARNGLFVPKSLLCT

SEQ ID NO: 39182 - protein, 14 aa, BK virus
RNGLFVPKSLLCTA

SEQ ID NO: 39183 - protein, 14 aa, BK virus
NGLFVPKSLLCTAL

SEQ ID NO: 39184 - protein, 14 aa, BK virus
GLFVPKSLLCTALA

SEQ ID NO: 39185 - protein, 14 aa, BK virus
LFVPKSLLCTALAC

SEQ ID NO: 39186 - protein, 14 aa, BK virus
FVPKSLLCTALACY

SEQ ID NO: 39187 - protein, 14 aa, BK virus
VPKSLLCTALACYV

SEQ ID NO: 39188 - protein, 14 aa, BK virus
PKSLLCTALACYVS

SEQ ID NO: 39189 - protein, 14 aa, BK virus
KSLLCTALACYVSL

SEQ ID NO: 39190 - protein, 14 aa, BK virus
SLLCTALACYVSLD

SEQ ID NO: 39191 - protein, 14 aa, BK virus
VIIFFIGANLWNRR

SEQ ID NO: 39192 - protein, 14 aa, BK virus
IIFFIGANLWNRRV

SEQ ID NO: 39193 - protein, 14 aa, BK virus
IFFIGANLWNRRVG

SEQ ID NO: 39194 - protein, 14 aa, BK virus
FFIGANLWNRRVGV

SEQ ID NO: 39195 - protein, 14 aa, BK virus
FIGANLWNRRVGVL

SEQ ID NO: 39196 - protein, 14 aa, BK virus
IGANLWNRRVGVLV

SEQ ID NO: 39197 - protein, 14 aa, BK virus
GANLWNRRVGVLVE

SEQ ID NO: 39198 - protein, 14 aa, BK virus
ANLWNRRVGVLVEF

SEQ ID NO: 39199 - protein, 14 aa, BK virus
NLWNRRVGVLVEFL

SEQ ID NO: 39200 - protein, 14 aa, BK virus
RSNSRFSTLNTTQK

SEQ ID NO: 39201 - protein, 14 aa, BK virus
SNSRFSTLNTTQKK

SEQ ID NO: 39202 - protein, 14 aa, BK virus
NSRFSTLNTTQKKK

SEQ ID NO: 39203 - protein, 14 aa, BK virus
SRFSTLNTTQKKKK

SEQ ID NO: 39204 - protein, 14 aa, BK virus
RFSTLNTTQKKKKG

SEQ ID NO: 39205 - protein, 14 aa, BK virus
FSTLNTTQKKKKGR

SEQ ID NO: 39206 - protein, 14 aa, BK virus
STLNTTQKKKKGRR

SEQ ID NO: 39207 - protein, 14 aa, BK virus
TLNTTQKKKKGRRP

SEQ ID NO: 39208 - protein, 14 aa, BK virus
RSIPYYRRKHSRGL

SEQ ID NO: 39209 - protein, 14 aa, BK virus
SIPYYRRKHSRGLK

SEQ ID NO: 39210 - protein, 14 aa, BK virus
IPYYRRKHSRGLKG

SEQ ID NO: 39211 - protein, 14 aa, BK virus
PYYRRKHSRGLKGA

SEQ ID NO: 39212 - protein, 14 aa, BK virus
GCVFIIRYVFRISI

SEQ ID NO: 39213 - protein, 14 aa, BK virus
CVFIIRYVFRISIQ

SEQ ID NO: 39214 - protein, 14 aa, BK virus
VFIIRYVFRISIQC

SEQ ID NO: 39215 - protein, 14 aa, BK virus
FIIRYVFRISIQCR

SEQ ID NO: 39216 - protein, 14 aa, BK virus
IIRYVFRISIQCRG

SEQ ID NO: 39217 - protein, 14 aa, BK virus
IRYVFRISIQCRGV

SEQ ID NO: 39218 - protein, 14 aa, BK virus
KSKKYLSASSRYSF

SEQ ID NO: 39219 - protein, 14 aa, BK virus
SKKYLSASSRYSFS

SEQ ID NO: 39220 - protein, 14 aa, BK virus
KKSRYPSYDQGRNA

SEQ ID NO: 39221 - protein, 14 aa, BK virus
KSRYPSYDQGRNAN

SEQ ID NO: 39222 - protein, 14 aa, BK virus
SRYPSYDQGRNANR

SEQ ID NO: 39223 - protein, 14 aa, BK virus
RYPSYDQGRNANRK

SEQ ID NO: 39224 - protein, 14 aa, BK virus
YPSYDQGRNANRKI

SEQ ID NO: 39225 - protein, 14 aa, BK virus
PSYDQGRNANRKIQ

SEQ ID NO: 39226 - protein, 14 aa, BK virus
SYDQGRNANRKIQS

SEQ ID NO: 39227 - protein, 14 aa, BK virus
YDQGRNANRKIQSY

SEQ ID NO: 39228 - protein, 14 aa, BK virus
DQGRNANRKIQSYI

SEQ ID NO: 39229 - protein, 14 aa, BK virus
QGRNANRKIQSYIR

SEQ ID NO: 39230 - protein, 14 aa, BK virus
NGFNIWSSWKCCTR

SEQ ID NO: 39231 - protein, 14 aa, BK virus
GFNIWSSWKCCTRT

SEQ ID NO: 39232 - protein, 14 aa, BK virus
FNIWSSWKCCTRTI

SEQ ID NO: 39233 - protein, 14 aa, BK virus
NIWSSWKCCTRTIY

SEQ ID NO: 39234 - protein, 14 aa, BK virus
IWSSWKCCTRTIYG

SEQ ID NO: 39235 - protein, 14 aa, BK virus
WSSWKCCTRTIYGR

SEQ ID NO: 39236 - protein, 14 aa, BK virus
SSWKCCTRTIYGRC

SEQ ID NO: 39237 - protein, 14 aa, BK virus
SWKCCTRTIYGRCC

SEQ ID NO: 39238 - protein, 14 aa, BK virus
WKCCTRTIYGRCCL

SEQ ID NO: 39239 - protein, 14 aa, BK virus
KCCTRTIYGRCCLA

SEQ ID NO: 39240 - protein, 14 aa, BK virus
CCTRTIYGRCCLAA

SEQ ID NO: 39241 - protein, 14 aa, BK virus
CTRTIYGRCCLAAL

SEQ ID NO: 39242 - protein, 14 aa, BK virus
TRTIYGRCCLAALF

SEQ ID NO: 39243 - protein, 14 aa, BK virus
RTIYGRCCLAALFA

SEQ ID NO: 39244 - protein, 14 aa, BK virus
TIYGRCCLAALFAT

SEQ ID NO: 39245 - protein, 14 aa, BK virus
WKNNTSCRVIRFVW

SEQ ID NO: 39246 - protein, 14 aa, BK virus
KNNTSCRVIRFVWW

SEQ ID NO: 39247 - protein, 14 aa, BK virus
IKGFAFRTWNKQFR

SEQ ID NO: 39248 - protein, 14 aa, BK virus
KGFAFRTWNKQFRQ

SEQ ID NO: 39249 - protein, 14 aa, BK virus
GFAFRTWNKQFRQF

SEQ ID NO: 39250 - protein, 14 aa, BK virus
FAFRTWNKQFRQFE

SEQ ID NO: 39251 - protein, 14 aa, BK virus
AFRTWNKQFRQFER

SEQ ID NO: 39252 - protein, 14 aa, BK virus
FRTWNKQFRQFERL

SEQ ID NO: 39253 - protein, 14 aa, BK virus
RTWNKQFRQFERLF

SEQ ID NO: 39254 - protein, 14 aa, BK virus
TWNKQFRQFERLFR

SEQ ID NO: 39255 - protein, 14 aa, BK virus
WNKQFRQFERLFRW

SEQ ID NO: 39256 - protein, 14 aa, BK virus
NKQFRQFERLFRWK

SEQ ID NO: 39257 - protein, 14 aa, BK virus
KQFRQFERLFRWKC

SEQ ID NO: 39258 - protein, 14 aa, BK virus
GKFRKETFKQKNPN

SEQ ID NO: 39259 - protein, 14 aa, BK virus
KFRKETFKQKNPNI

SEQ ID NO: 39260 - protein, 14 aa, BK virus
FRKETFKQKNPNIS

SEQ ID NO: 39261 - protein, 14 aa, BK virus
RKETFKQKNPNIST

SEQ ID NO: 39262 - protein, 14 aa, BK virus
KETFKQKNPNISTR

SEQ ID NO: 39263 - protein, 14 aa, BK virus
ETFKQKNPNISTRL

SEQ ID NO: 39264 - protein, 14 aa, BK virus
TFKQKNPNISTRLG

SEQ ID NO: 39265 - protein, 14 aa, BK virus
FKQKNPNISTRLGY

SEQ ID NO: 39266 - protein, 14 aa, BK virus
KQKNPNISTRLGYN

SEQ ID NO: 39267 - protein, 14 aa, BK virus
QKNPNISTRLGYNE

SEQ ID NO: 39268 - protein, 14 aa, BK virus
AQNIFKKILTKLRV

SEQ ID NO: 39269 - protein, 14 aa, BK virus
QNIFKKILTKLRVL

SEQ ID NO: 39270 - protein, 14 aa, BK virus
NIFKKILTKLRVLT

SEQ ID NO: 39271 - protein, 14 aa, BK virus
KKNFTKWNDLVATA

SEQ ID NO: 39272 - protein, 14 aa, BK virus
KNFTKWNDLVATAN

SEQ ID NO: 39273 - protein, 14 aa, BK virus
NFTKWNDLVATANL

SEQ ID NO: 39274 - protein, 14 aa, BK virus
FTKWNDLVATANLV

SEQ ID NO: 39275 - protein, 14 aa, BK virus
IPITMLFPSLRYFS

SEQ ID NO: 39276 - protein, 14 aa, BK virus
PITMLFPSLRYFSP

SEQ ID NO: 39277 - protein, 14 aa, BK virus
ITMLFPSLRYFSPC

SEQ ID NO: 39278 - protein, 14 aa, BK virus
KWLIQKQHLLNVYV

SEQ ID NO: 39279 - protein, 14 aa, BK virus
WLIQKQHLLNVYVQ

SEQ ID NO: 39280 - protein, 14 aa, BK virus
KHLFKAFWFAIVPV

SEQ ID NO: 39281 - protein, 14 aa, BK virus
HLFKAFWFAIVPVC

SEQ ID NO: 39282 - protein, 14 aa, BK virus
LFKAFWFAIVPVCQ

SEQ ID NO: 39283 - protein, 14 aa, BK virus
FKAFWFAIVPVCQY

SEQ ID NO: 39284 - protein, 14 aa, BK virus
KAFWFAIVPVCQYI

SEQ ID NO: 39285 - protein, 14 aa, BK virus
AFWFAIVPVCQYIL

SEQ ID NO: 39286 - protein, 14 aa, BK virus
FWFAIVPVCQYILS

SEQ ID NO: 39287 - protein, 14 aa, BK virus
WFAIVPVCQYILSY

SEQ ID NO: 39288 - protein, 14 aa, BK virus
FAIVPVCQYILSYL

SEQ ID NO: 39289 - protein, 14 aa, BK virus
AIVPVCQYILSYLG

SEQ ID NO: 39290 - protein, 14 aa, BK virus
IVPVCQYILSYLGP

SEQ ID NO: 39291 - protein, 14 aa, BK virus
VPVCQYILSYLGPL

SEQ ID NO: 39292 - protein, 14 aa, BK virus
PVCQYILSYLGPLE

SEQ ID NO: 39293 - protein, 14 aa, BK virus
VCQYILSYLGPLEV

SEQ ID NO: 39294 - protein, 14 aa, BK virus
CQYILSYLGPLEVF

SEQ ID NO: 39295 - protein, 14 aa, BK virus
QYILSYLGPLEVFL

SEQ ID NO: 39296 - protein, 14 aa, BK virus
YILSYLGPLEVFLC

SEQ ID NO: 39297 - protein, 14 aa, BK virus
ILSYLGPLEVFLCH

SEQ ID NO: 39298 - protein, 14 aa, BK virus
LSYLGPLEVFLCHQ

SEQ ID NO: 39299 - protein, 14 aa, BK virus
SYLGPLEVFLCHQT

SEQ ID NO: 39300 - protein, 14 aa, BK virus
YLGPLEVFLCHQTP

SEQ ID NO: 39301 - protein, 14 aa, BK virus
GHLAKRKLGKDSLQ

SEQ ID NO: 39302 - protein, 14 aa, BK virus
HLAKRKLGKDSLQI

SEQ ID NO: 39303 - protein, 14 aa, BK virus
LAKRKLGKDSLQIF

SEQ ID NO: 39304 - protein, 14 aa, BK virus
AKRKLGKDSLQIFF

SEQ ID NO: 39305 - protein, 14 aa, BK virus
KRKLGKDSLQIFFS

SEQ ID NO: 39306 - protein, 14 aa, BK virus
RKLGKDSLQIFFSG

SEQ ID NO: 39307 - protein, 14 aa, BK virus
KLGKDSLQIFFSGG

SEQ ID NO: 39308 - protein, 14 aa, BK virus
LGKDSLQIFFSGGS

SEQ ID NO: 39309 - protein, 14 aa, BK virus
NILQGLSTVVFQSC

SEQ ID NO: 39310 - protein, 14 aa, BK virus
TGHKYQQLKHTGYQ

SEQ ID NO: 39311 - protein, 14 aa, BK virus
GHKYQQLKHTGYQL

SEQ ID NO: 39312 - protein, 14 aa, BK virus
HKYQQLKHTGYQLY

SEQ ID NO: 39313 - protein, 14 aa, BK virus
KYQQLKHTGYQLYK

SEQ ID NO: 39314 - protein, 14 aa, BK virus
YQQLKHTGYQLYKE

SEQ ID NO: 39315 - protein, 14 aa, BK virus
QQLKHTGYQLYKEA

SEQ ID NO: 39316 - protein, 14 aa, BK virus
QLKHTGYQLYKEAP

SEQ ID NO: 39317 - protein, 14 aa, BK virus
LKHTGYQLYKEAPH

SEQ ID NO: 39318 - protein, 14 aa, BK virus
KHTGYQLYKEAPHP

SEQ ID NO: 39319 - protein, 14 aa, BK virus
HTGYQLYKEAPHPV

SEQ ID NO: 39320 - protein, 14 aa, BK virus
TGYQLYKEAPHPVH

SEQ ID NO: 39321 - protein, 14 aa, BK virus
GYQLYKEAPHPVHL

SEQ ID NO: 39322 - protein, 14 aa, BK virus
YQLYKEAPHPVHLA

SEQ ID NO: 39323 - protein, 14 aa, BK virus
QLYKEAPHPVHLAT

SEQ ID NO: 39324 - protein, 14 aa, BK virus
LYKEAPHPVHLATL

SEQ ID NO: 39325 - protein, 14 aa, BK virus
YKEAPHPVHLATLW

SEQ ID NO: 39326 - protein, 14 aa, BK virus
LCWSHEVLGEHFPL

SEQ ID NO: 39327 - protein, 14 aa, BK virus
CWSHEVLGEHFPLL

SEQ ID NO: 39328 - protein, 14 aa, BK virus
HFHFYWDQVPSTQL

SEQ ID NO: 39329 - protein, 14 aa, BK virus
FHFYWDQVPSTQLD

SEQ ID NO: 39330 - protein, 14 aa, BK virus
HFYWDQVPSTQLDK

SEQ ID NO: 39331 - protein, 14 aa, BK virus
FYWDQVPSTQLDKH

SEQ ID NO: 39332 - protein, 14 aa, BK virus
YWDQVPSTQLDKHC

SEQ ID NO: 39333 - protein, 14 aa, BK virus
WDQVPSTQLDKHCF

SEQ ID NO: 39334 - protein, 14 aa, BK virus
DQVPSTQLDKHCFC

SEQ ID NO: 39335 - protein, 14 aa, BK virus
QVPSTQLDKHCFCP

SEQ ID NO: 39336 - protein, 14 aa, BK virus
VPSTQLDKHCFCPN

SEQ ID NO: 39337 - protein, 14 aa, BK virus
PSTQLDKHCFCPNR

SEQ ID NO: 39338 - protein, 14 aa, BK virus
STQLDKHCFCPNRP

SEQ ID NO: 39339 - protein, 14 aa, BK virus
TQLDKHCFCPNRPY

SEQ ID NO: 39340 - protein, 14 aa, BK virus
QLDKHCFCPNRPYG

SEQ ID NO: 39341 - protein, 14 aa, BK virus
LDKHCFCPNRPYGQ

SEQ ID NO: 39342 - protein, 14 aa, BK virus
DKHCFCPNRPYGQY

SEQ ID NO: 39343 - protein, 14 aa, BK virus
KHCFCPNRPYGQYS

SEQ ID NO: 39344 - protein, 14 aa, BK virus
HCFCPNRPYGQYSL

SEQ ID NO: 39345 - protein, 14 aa, BK virus
CFCPNRPYGQYSLP

SEQ ID NO: 39346 - protein, 14 aa, BK virus
FCPNRPYGQYSLPG

SEQ ID NO: 39347 - protein, 14 aa, BK virus
CPNRPYGQYSLPGT

SEQ ID NO: 39348 - protein, 14 aa, BK virus
PNRPYGQYSLPGTG

SEQ ID NO: 39349 - protein, 14 aa, BK virus
NRPYGQYSLPGTGL

SEQ ID NO: 39350 - protein, 14 aa, BK virus
RPYGQYSLPGTGLL

SEQ ID NO: 39351 - protein, 14 aa, BK virus
PYGQYSLPGTGLLG

SEQ ID NO: 39352 - protein, 14 aa, BK virus
YGQYSLPGTGLLGF

SEQ ID NO: 39353 - protein, 14 aa, BK virus
YHQGTLTCNSLALP

SEQ ID NO: 39354 - protein, 14 aa, BK virus
HQGTLTCNSLALPA

SEQ ID NO: 39355 - protein, 14 aa, BK virus
QGTLTCNSLALPAF

SEQ ID NO: 39356 - protein, 14 aa, BK virus
GTLTCNSLALPAFP

SEQ ID NO: 39357 - protein, 14 aa, BK virus
TLTCNSLALPAFPR

SEQ ID NO: 39358 - protein, 14 aa, BK virus
LTCNSLALPAFPRV

SEQ ID NO: 39359 - protein, 14 aa, BK virus
TCNSLALPAFPRVL

SEQ ID NO: 39360 - protein, 14 aa, BK virus
CNSLALPAFPRVLH

SEQ ID NO: 39361 - protein, 14 aa, BK virus
NSLALPAFPRVLHL

SEQ ID NO: 39362 - protein, 14 aa, BK virus
SLALPAFPRVLHLQ

SEQ ID NO: 39363 - protein, 14 aa, BK virus
LALPAFPRVLHLQQ

SEQ ID NO: 39364 - protein, 14 aa, BK virus
ALPAFPRVLHLQQR

SEQ ID NO: 39365 - protein, 14 aa, BK virus
LPAFPRVLHLQQRS

SEQ ID NO: 39366 - protein, 14 aa, BK virus
PAFPRVLHLQQRSG

SEQ ID NO: 39367 - protein, 14 aa, BK virus
AFPRVLHLQQRSGN

SEQ ID NO: 39368 - protein, 14 aa, BK virus
FPRVLHLQQRSGNY

SEQ ID NO: 39369 - protein, 14 aa, BK virus
PRVLHLQQRSGNYC

SEQ ID NO: 39370 - protein, 14 aa, BK virus
RVLHLQQRSGNYCL

SEQ ID NO: 39371 - protein, 14 aa, BK virus
VLHLQQRSGNYCLE

SEQ ID NO: 39372 - protein, 14 aa, BK virus
VFLHHAHALFVTLH

SEQ ID NO: 39373 - protein, 14 aa, BK virus
FLHHAHALFVTLHE

SEQ ID NO: 39374 - protein, 14 aa, BK virus
LHHAHALFVTLHEG

SEQ ID NO: 39375 - protein, 14 aa, BK virus
PLFVQLQPPTSVDF

SEQ ID NO: 39376 - protein, 14 aa, BK virus
LFVQLQPPTSVDFH

SEQ ID NO: 39377 - protein, 14 aa, BK virus
FVQLQPPTSVDFHR

SEQ ID NO: 39378 - protein, 14 aa, BK virus
VQLQPPTSVDFHRL

SEQ ID NO: 39379 - protein, 14 aa, BK virus
QLQPPTSVDFHRLG

SEQ ID NO: 39380 - protein, 14 aa, BK virus
LQPPTSVDFHRLGP

SEQ ID NO: 39381 - protein, 14 aa, BK virus
QPPTSVDFHRLGPH

SEQ ID NO: 39382 - protein, 14 aa, BK virus
PPTSVDFHRLGPHL

SEQ ID NO: 39383 - protein, 14 aa, BK virus
PTSVDFHRLGPHLN

SEQ ID NO: 39384 - protein, 14 aa, BK virus
TSVDFHRLGPHLNW

SEQ ID NO: 39385 - protein, 14 aa, BK virus
SVDFHRLGPHLNWG

SEQ ID NO: 39386 - protein, 14 aa, BK virus
VDFHRLGPHLNWGG

SEQ ID NO: 39387 - protein, 14 aa, BK virus
DFHRLGPHLNWGGE

SEQ ID NO: 39388 - protein, 14 aa, BK virus
FHRLGPHLNWGGEF

SEQ ID NO: 39389 - protein, 14 aa, BK virus
HRLGPHLNWGGEFL

SEQ ID NO: 39390 - protein, 14 aa, BK virus
RLGPHLNWGGEFLL

SEQ ID NO: 39391 - protein, 14 aa, BK virus
LGPHLNWGGEFLLC

SEQ ID NO: 39392 - protein, 14 aa, BK virus
GPHLNWGGEFLLCC

SEQ ID NO: 39393 - protein, 14 aa, BK virus
PHLNWGGEFLLCCN

SEQ ID NO: 39394 - protein, 14 aa, BK virus
HLNWGGEFLLCCNR

SEQ ID NO: 39395 - protein, 14 aa, BK virus
LNWGGEFLLCCNRE

SEQ ID NO: 39396 - protein, 14 aa, BK virus
NWGGEFLLCCNREA

SEQ ID NO: 39397 - protein, 14 aa, BK virus
WGGEFLLCCNREAF

SEQ ID NO: 39398 - protein, 14 aa, BK virus
GGEFLLCCNREAFF

SEQ ID NO: 39399 - protein, 14 aa, BK virus
GEFLLCCNREAFFS

SEQ ID NO: 39400 - protein, 14 aa, BK virus
EFLLCCNREAFFSL

SEQ ID NO: 39401 - protein, 14 aa, BK virus
FLLCCNREAFFSLG

SEQ ID NO: 39402 - protein, 14 aa, BK virus
LLCCNREAFFSLGY

SEQ ID NO: 39403 - protein, 14 aa, BK virus
LCCNREAFFSLGYH

SEQ ID NO: 39404 - protein, 14 aa, BK virus
CCNREAFFSLGYHC

SEQ ID NO: 39405 - protein, 14 aa, BK virus
GFHLDPPFLGLGSI

SEQ ID NO: 39406 - protein, 14 aa, BK virus
FHLDPPFLGLGSIL

SEQ ID NO: 39407 - protein, 14 aa, BK virus
HLDPPFLGLGSILP

SEQ ID NO: 39408 - protein, 14 aa, BK virus
LDPPFLGLGSILPL

SEQ ID NO: 39409 - protein, 14 aa, BK virus
LLELLLLLLLVVLA

SEQ ID NO: 39410 - protein, 14 aa, BK virus
LELLLLLLLVVLAL

SEQ ID NO: 39411 - protein, 14 aa, BK virus
ELLLLLLLVVLALA

SEQ ID NO: 39412 - protein, 14 aa, BK virus
LLLLLLLVVLALAR

SEQ ID NO: 39413 - protein, 14 aa, BK virus
LLLLLLVVLALARV

SEQ ID NO: 39414 - protein, 14 aa, BK virus
LLLLLVVLALARVP

SEQ ID NO: 39415 - protein, 14 aa, BK virus
LLLLVVLALARVPL

SEQ ID NO: 39416 - protein, 14 aa, BK virus
LLLVVLALARVPLA

SEQ ID NO: 39417 - protein, 14 aa, BK virus
LLVVLALARVPLAF

SEQ ID NO: 39418 - protein, 14 aa, BK virus
LVVLALARVPLAFW

SEQ ID NO: 39419 - protein, 14 aa, BK virus
VVLALARVPLAFWE

SEQ ID NO: 39420 - protein, 14 aa, BK virus
VLALARVPLAFWEL

SEQ ID NO: 39421 - protein, 14 aa, BK virus
LALARVPLAFWELP

SEQ ID NO: 39422 - protein, 14 aa, BK virus
ALARVPLAFWELPL

SEQ ID NO: 39423 - protein, 14 aa, BK virus
LARVPLAFWELPLD

SEQ ID NO: 39424 - protein, 14 aa, BK virus
ARVPLAFWELPLDT

SEQ ID NO: 39425 - protein, 14 aa, BK virus
RVPLAFWELPLDTL

SEQ ID NO: 39426 - protein, 14 aa, BK virus
VPLAFWELPLDTLL

SEQ ID NO: 39427 - protein, 14 aa, BK virus
PLAFWELPLDTLLF

SEQ ID NO: 39428 - protein, 14 aa, BK virus
LAFWELPLDTLLFF

SEQ ID NO: 39429 - protein, 14 aa, BK virus
AFWELPLDTLLFFW

SEQ ID NO: 39430 - protein, 14 aa, BK virus
FWELPLDTLLFFWL

SEQ ID NO: 39431 - protein, 14 aa, BK virus
WELPLDTLLFFWLG

SEQ ID NO: 39432 - protein, 14 aa, BK virus
ELPLDTLLFFWLGP

SEQ ID NO: 39433 - protein, 14 aa, BK virus
LPLDTLLFFWLGPS

SEQ ID NO: 39434 - protein, 14 aa, BK virus
PLDTLLFFWLGPSS

SEQ ID NO: 39435 - protein, 14 aa, BK virus
LDTLLFFWLGPSSY

SEQ ID NO: 39436 - protein, 14 aa, BK virus
DTLLFFWLGPSSYA

SEQ ID NO: 39437 - protein, 14 aa, BK virus
TLLFFWLGPSSYAS

SEQ ID NO: 39438 - protein, 14 aa, BK virus
LLFFWLGPSSYASR

SEQ ID NO: 39439 - protein, 14 aa, BK virus
LFFWLGPSSYASRA

SEQ ID NO: 39440 - protein, 14 aa, BK virus
FFWLGPSSYASRAG

SEQ ID NO: 39441 - protein, 14 aa, BK virus
FWLGPSSYASRAGV

SEQ ID NO: 39442 - protein, 14 aa, BK virus
WLGPSSYASRAGVT

SEQ ID NO: 39443 - protein, 14 aa, BK virus
LGPSSYASRAGVTV

SEQ ID NO: 39444 - protein, 14 aa, BK virus
GPSSYASRAGVTVP

SEQ ID NO: 39445 - protein, 14 aa, BK virus
PSSYASRAGVTVPY

SEQ ID NO: 39446 - protein, 14 aa, BK virus
SSYASRAGVTVPYR

SEQ ID NO: 39447 - protein, 14 aa, BK virus
SYASRAGVTVPYRP

SEQ ID NO: 39448 - protein, 14 aa, BK virus
YASRAGVTVPYRPR

SEQ ID NO: 39449 - protein, 14 aa, BK virus
ASRAGVTVPYRPRS

SEQ ID NO: 39450 - protein, 14 aa, BK virus
SRAGVTVPYRPRSK

SEQ ID NO: 39451 - protein, 14 aa, BK virus
RAGVTVPYRPRSKG

SEQ ID NO: 39452 - protein, 14 aa, BK virus
AGVTVPYRPRSKGN

SEQ ID NO: 39453 - protein, 14 aa, BK virus
GVTVPYRPRSKGNI

SEQ ID NO: 39454 - protein, 14 aa, BK virus
VTVPYRPRSKGNIH

SEQ ID NO: 39455 - protein, 14 aa, BK virus
LAPPGAIVFSINSP

SEQ ID NO: 39456 - protein, 14 aa, BK virus
APPGAIVFSINSPE

SEQ ID NO: 39457 - protein, 14 aa, BK virus
PPGAIVFSINSPEC

SEQ ID NO: 39458 - protein, 14 aa, BK virus
PGAIVFSINSPECT

SEQ ID NO: 39459 - protein, 14 aa, BK virus
GAIVFSINSPECTL

SEQ ID NO: 39460 - protein, 14 aa, BK virus
AIVFSINSPECTLC

SEQ ID NO: 39461 - protein, 14 aa, BK virus
FLKSILCVTSSILS

SEQ ID NO: 39462 - protein, 14 aa, BK virus
LKSILCVTSSILSA

SEQ ID NO: 39463 - protein, 14 aa, BK virus
KSILCVTSSILSAS

SEQ ID NO: 39464 - protein, 14 aa, BK virus
SILCVTSSILSASS

SEQ ID NO: 39465 - protein, 14 aa, BK virus
ILCVTSSILSASSI

SEQ ID NO: 39466 - protein, 14 aa, BK virus
LCVTSSILSASSIL

SEQ ID NO: 39467 - protein, 14 aa, BK virus
VWPKCTRVPSLSAT

SEQ ID NO: 39468 - protein, 14 aa, BK virus
WPKCTRVPSLSATC

SEQ ID NO: 39469 - protein, 14 aa, BK virus
PKCTRVPSLSATCL

SEQ ID NO: 39470 - protein, 14 aa, BK virus
KCTRVPSLSATCLT

SEQ ID NO: 39471 - protein, 14 aa, BK virus
CTRVPSLSATCLTI

SEQ ID NO: 39472 - protein, 14 aa, BK virus
TRVPSLSATCLTIE

SEQ ID NO: 39473 - protein, 14 aa, BK virus
RVPSLSATCLTIEG

SEQ ID NO: 39474 - protein, 14 aa, BK virus
VPSLSATCLTIEGL

SEQ ID NO: 39475 - protein, 14 aa, BK virus
PSLSATCLTIEGLI

SEQ ID NO: 39476 - protein, 14 aa, BK virus
SLSATCLTIEGLIG

SEQ ID NO: 39477 - protein, 14 aa, BK virus
LSATCLTIEGLIGE

SEQ ID NO: 39478 - protein, 14 aa, BK virus
SATCLTIEGLIGER

SEQ ID NO: 39479 - protein, 14 aa, BK virus
ATCLTIEGLIGERS

SEQ ID NO: 39480 - protein, 14 aa, BK virus
TCLTIEGLIGERSE

SEQ ID NO: 39481 - protein, 14 aa, BK virus
KFIGAFTIVQVVSS

SEQ ID NO: 39482 - protein, 14 aa, BK virus
FIGAFTIVQVVSSK

SEQ ID NO: 39483 - protein, 14 aa, BK virus
IGAFTIVQVVSSKN

SEQ ID NO: 39484 - protein, 14 aa, BK virus
GAFTIVQVVSSKNL

SEQ ID NO: 39485 - protein, 14 aa, BK virus
AFTIVQVVSSKNLA

SEQ ID NO: 39486 - protein, 14 aa, BK virus
FTIVQVVSSKNLAK

SEQ ID NO: 39487 - protein, 14 aa, BK virus
TIVQVVSSKNLAKE

SEQ ID NO: 39488 - protein, 14 aa, BK virus
IVQVVSSKNLAKES

SEQ ID NO: 39489 - protein, 14 aa, BK virus
VQVVSSKNLAKESL

SEQ ID NO: 39490 - protein, 14 aa, BK virus
QVVSSKNLAKESLK

SEQ ID NO: 39491 - protein, 14 aa, BK virus
VVSSKNLAKESLKN

SEQ ID NO: 39492 - protein, 14 aa, BK virus
VSSKNLAKESLKNL

SEQ ID NO: 39493 - protein, 14 aa, BK virus
SSKNLAKESLKNLS

SEQ ID NO: 39494 - protein, 14 aa, BK virus
SKNLAKESLKNLSV

SEQ ID NO: 39495 - protein, 14 aa, BK virus
KNLAKESLKNLSVL

SEQ ID NO: 39496 - protein, 14 aa, BK virus
NLAKESLKNLSVLL

SEQ ID NO: 39497 - protein, 14 aa, BK virus
LAKESLKNLSVLLC

SEQ ID NO: 39498 - protein, 14 aa, BK virus
AKESLKNLSVLLCN

SEQ ID NO: 39499 - protein, 14 aa, BK virus
KESLKNLSVLLCNS

SEQ ID NO: 39500 - protein, 14 aa, BK virus
ESLKNLSVLLCNSC

SEQ ID NO: 39501 - protein, 14 aa, BK virus
SLKNLSVLLCNSCE

SEQ ID NO: 39502 - protein, 14 aa, BK virus
LKNLSVLLCNSCEV

SEQ ID NO: 39503 - protein, 14 aa, BK virus
KNLSVLLCNSCEVI

SEQ ID NO: 39504 - protein, 14 aa, BK virus
NLSVLLCNSCEVIE

SEQ ID NO: 39505 - protein, 14 aa, BK virus
LSVLLCNSCEVIEG

SEQ ID NO: 39506 - protein, 14 aa, BK virus
SVLLCNSCEVIEGI

SEQ ID NO: 39507 - protein, 14 aa, BK virus
VLLCNSCEVIEGIS

SEQ ID NO: 39508 - protein, 14 aa, BK virus
LLCNSCEVIEGISS

SEQ ID NO: 39509 - protein, 14 aa, BK virus
LCNSCEVIEGISSL

SEQ ID NO: 39510 - protein, 14 aa, BK virus
CNSCEVIEGISSLI

SEQ ID NO: 39511 - protein, 14 aa, BK virus
NSCEVIEGISSLIT

SEQ ID NO: 39512 - protein, 14 aa, BK virus
SCEVIEGISSLITC

SEQ ID NO: 39513 - protein, 14 aa, BK virus
CEVIEGISSLITCH

SEQ ID NO: 39514 - protein, 14 aa, BK virus
EVIEGISSLITCHK

SEQ ID NO: 39515 - protein, 14 aa, BK virus
VIEGISSLITCHKA

SEQ ID NO: 39516 - protein, 14 aa, BK virus
IEGISSLITCHKAW

SEQ ID NO: 39517 - protein, 14 aa, BK virus
EGISSLITCHKAWE

SEQ ID NO: 39518 - protein, 14 aa, BK virus
GISSLITCHKAWEI

SEQ ID NO: 39519 - protein, 14 aa, BK virus
ISSLITCHKAWEIV

SEQ ID NO: 39520 - protein, 14 aa, BK virus
SSLITCHKAWEIVA

SEQ ID NO: 39521 - protein, 14 aa, BK virus
SLITCHKAWEIVAN

SEQ ID NO: 39522 - protein, 14 aa, BK virus
LITCHKAWEIVANK

SEQ ID NO: 39523 - protein, 14 aa, BK virus
ITCHKAWEIVANKE

SEQ ID NO: 39524 - protein, 14 aa, BK virus
TCHKAWEIVANKEG

SEQ ID NO: 39525 - protein, 14 aa, BK virus
CHKAWEIVANKEGP

SEQ ID NO: 39526 - protein, 14 aa, BK virus
HKAWEIVANKEGPQ

SEQ ID NO: 39527 - protein, 14 aa, BK virus
KAWEIVANKEGPQC

SEQ ID NO: 39528 - protein, 14 aa, BK virus
AWEIVANKEGPQCL

SEQ ID NO: 39529 - protein, 14 aa, BK virus
WEIVANKEGPQCLG

SEQ ID NO: 39530 - protein, 14 aa, BK virus
EIVANKEGPQCLGS

SEQ ID NO: 39531 - protein, 14 aa, BK virus
IVANKEGPQCLGSR

SEQ ID NO: 39532 - protein, 14 aa, BK virus
VANKEGPQCLGSRY

SEQ ID NO: 39533 - protein, 14 aa, BK virus
ILLTKVFTPGNRIS

SEQ ID NO: 39534 - protein, 14 aa, BK virus
YSSGLNNSKAMPDC

SEQ ID NO: 39535 - protein, 14 aa, BK virus
IKAANPAIAPGAPA

SEQ ID NO: 39536 - protein, 14 aa, BK virus
KAANPAIAPGAPAI

SEQ ID NO: 39537 - protein, 14 aa, BK virus
AANPAIAPGAPAIT

SEQ ID NO: 39538 - protein, 14 aa, BK virus
ANPAIAPGAPAITA

SEQ ID NO: 39539 - protein, 14 aa, BK virus
NPAIAPGAPAITAY

SEQ ID NO: 39540 - protein, 14 aa, BK virus
PAIAPGAPAITAYV

SEQ ID NO: 39541 - protein, 14 aa, BK virus
GVRPIAAIASEVLV

SEQ ID NO: 39542 - protein, 14 aa, BK virus
VRPIAAIASEVLVM

SEQ ID NO: 39543 - protein, 14 aa, BK virus
RPIAAIASEVLVMP

SEQ ID NO: 39544 - protein, 14 aa, BK virus
PIAAIASEVLVMPS

SEQ ID NO: 39545 - protein, 14 aa, BK virus
IAAIASEVLVMPST

SEQ ID NO: 39546 - protein, 14 aa, BK virus
AAIASEVLVMPSTV

SEQ ID NO: 39547 - protein, 14 aa, BK virus
AIASEVLVMPSTVA

SEQ ID NO: 39548 - protein, 14 aa, BK virus
IASEVLVMPSTVAR

SEQ ID NO: 39549 - protein, 14 aa, BK virus
ASEVLVMPSTVARD

SEQ ID NO: 39550 - protein, 14 aa, BK virus
SEVLVMPSTVARDA

SEQ ID NO: 39551 - protein, 14 aa, BK virus
EVLVMPSTVARDAI

SEQ ID NO: 39552 - protein, 14 aa, BK virus
TSIAAAASPAAISA

SEQ ID NO: 39553 - protein, 14 aa, BK virus
SIAAAASPAAISAT

SEQ ID NO: 39554 - protein, 14 aa, BK virus
IAAAASPAAISATE

SEQ ID NO: 39555 - protein, 14 aa, BK virus
AAAASPAAISATEN

SEQ ID NO: 39556 - protein, 14 aa, BK virus
AAASPAAISATENP

SEQ ID NO: 39557 - protein, 14 aa, BK virus
AASPAAISATENPV

SEQ ID NO: 39558 - protein, 14 aa, BK virus
ASPAAISATENPVA

SEQ ID NO: 39559 - protein, 14 aa, BK virus
SPAAISATENPVAA

SEQ ID NO: 39560 - protein, 14 aa, BK virus
PAAISATENPVAAA

SEQ ID NO: 39561 - protein, 14 aa, BK virus
AAISATENPVAAAA

SEQ ID NO: 39562 - protein, 14 aa, BK virus
AISATENPVAAAAS

SEQ ID NO: 39563 - protein, 14 aa, BK virus
ISATENPVAAAASD

SEQ ID NO: 39564 - protein, 14 aa, BK virus
SATENPVAAAASDT

SEQ ID NO: 39565 - protein, 14 aa, BK virus
ATENPVAAAASDTL

SEQ ID NO: 39566 - protein, 14 aa, BK virus
TENPVAAAASDTLA

SEQ ID NO: 39567 - protein, 14 aa, BK virus
ENPVAAAASDTLAT

SEQ ID NO: 39568 - protein, 14 aa, BK virus
NPVAAAASDTLATR

SEQ ID NO: 39569 - protein, 14 aa, BK virus
PVAAAASDTLATRS

SEQ ID NO: 39570 - protein, 14 aa, BK virus
VAAAASDTLATRSP

SEQ ID NO: 39571 - protein, 14 aa, BK virus
AAAASDTLATRSPK

SEQ ID NO: 39572 - protein, 14 aa, BK virus
AAASDTLATRSPKS

SEQ ID NO: 39573 - protein, 14 aa, BK virus
AASDTLATRSPKSA

SEQ ID NO: 39574 - protein, 14 aa, BK virus
ASDTLATRSPKSAR

SEQ ID NO: 39575 - protein, 14 aa, BK virus
SDTLATRSPKSARA

SEQ ID NO: 39576 - protein, 14 aa, BK virus
DTLATRSPKSARAA

SEQ ID NO: 39577 - protein, 14 aa, BK virus
TLATRSPKSARAAP

SEQ ID NO: 39578 - protein, 14 aa, BK virus
LATRSPKSARAAPM

SEQ ID NO: 39579 - protein, 14 aa, BK virus
ATRSPKSARAAPMN

SEQ ID NO: 39580 - protein, 14 aa, BK virus
TRSPKSARAAPMNL

SEQ ID NO: 39581 - protein, 14 aa, BK virus
RSPKSARAAPMNLE

SEQ ID NO: 39582 - protein, 14 aa, BK virus
SPKSARAAPMNLEI

SEQ ID NO: 39583 - protein, 14 aa, BK virus
PKSARAAPMNLEIQ

SEQ ID NO: 39584 - protein, 14 aa, BK virus
KSARAAPMNLEIQK

SEQ ID NO: 39585 - protein, 14 aa, BK virus
SARAAPMNLEIQKK

SEQ ID NO: 39586 - protein, 14 aa, BK virus
ARAAPMNLEIQKKR

SEQ ID NO: 39587 - protein, 14 aa, BK virus
RAAPMNLEIQKKRD

SEQ ID NO: 39588 - protein, 14 aa, BK virus
AAPMNLEIQKKRDY

SEQ ID NO: 39589 - protein, 14 aa, BK virus
APMNLEIQKKRDYL

SEQ ID NO: 39590 - protein, 14 aa, BK virus
PMNLEIQKKRDYLP

SEQ ID NO: 39591 - protein, 14 aa, BK virus
MNLEIQKKRDYLPR

SEQ ID NO: 39592 - protein, 14 aa, BK virus
NLEIQKKRDYLPRS

SEQ ID NO: 39593 - protein, 14 aa, BK virus
LEIQKKRDYLPRSL

SEQ ID NO: 39594 - protein, 14 aa, BK virus
EIQKKRDYLPRSLL

SEQ ID NO: 39595 - protein, 14 aa, BK virus
IQKKRDYLPRSLLQ

SEQ ID NO: 39596 - protein, 14 aa, BK virus
QKKRDYLPRSLLQS

SEQ ID NO: 39597 - protein, 14 aa, BK virus
KKRDYLPRSLLQSL

SEQ ID NO: 39598 - protein, 14 aa, BK virus
KRDYLPRSLLQSLL

SEQ ID NO: 39599 - protein, 14 aa, BK virus
RDYLPRSLLQSLLQ

SEQ ID NO: 39600 - protein, 14 aa, BK virus
DYLPRSLLQSLLQQ

SEQ ID NO: 39601 - protein, 14 aa, BK virus
YLPRSLLQSLLQQV

SEQ ID NO: 39602 - protein, 14 aa, BK virus
LPRSLLQSLLQQVK

SEQ ID NO: 39603 - protein, 14 aa, BK virus
PRSLLQSLLQQVKQ

SEQ ID NO: 39604 - protein, 14 aa, BK virus
RSLLQSLLQQVKQW

SEQ ID NO: 39605 - protein, 14 aa, BK virus
SLLQSLLQQVKQWY

SEQ ID NO: 39606 - protein, 14 aa, BK virus
LLQSLLQQVKQWYF

SEQ ID NO: 39607 - protein, 14 aa, BK virus
LQSLLQQVKQWYFC

SEQ ID NO: 39608 - protein, 14 aa, BK virus
QSLLQQVKQWYFCF

SEQ ID NO: 39609 - protein, 14 aa, BK virus
SLLQQVKQWYFCFS

SEQ ID NO: 39610 - protein, 14 aa, BK virus
LLQQVKQWYFCFSR

SEQ ID NO: 39611 - protein, 14 aa, BK virus
LQQVKQWYFCFSRL

SEQ ID NO: 39612 - protein, 14 aa, BK virus
QQVKQWYFCFSRLH

SEQ ID NO: 39613 - protein, 14 aa, BK virus
QVKQWYFCFSRLHC

SEQ ID NO: 39614 - protein, 14 aa, BK virus
VKQWYFCFSRLHCL

SEQ ID NO: 39615 - protein, 14 aa, BK virus
KQWYFCFSRLHCLH

SEQ ID NO: 39616 - protein, 14 aa, BK virus
QWYFCFSRLHCLHL

SEQ ID NO: 39617 - protein, 14 aa, BK virus
WYFCFSRLHCLHLY

SEQ ID NO: 39618 - protein, 14 aa, BK virus
YFCFSRLHCLHLYK

SEQ ID NO: 39619 - protein, 14 aa, BK virus
FCFSRLHCLHLYKI

SEQ ID NO: 39620 - protein, 14 aa, BK virus
CFSRLHCLHLYKIP

SEQ ID NO: 39621 - protein, 14 aa, BK virus
FSRLHCLHLYKIPA

SEQ ID NO: 39622 - protein, 14 aa, BK virus
SRLHCLHLYKIPAK

SEQ ID NO: 39623 - protein, 14 aa, BK virus
RLHCLHLYKIPAKA

SEQ ID NO: 39624 - protein, 14 aa, BK virus
LHCLHLYKIPAKAL

SEQ ID NO: 39625 - protein, 14 aa, BK virus
HCLHLYKIPAKALK

SEQ ID NO: 39626 - protein, 14 aa, BK virus
KSSELFFLFQSRFY

SEQ ID NO: 39627 - protein, 14 aa, BK virus
SSELFFLFQSRFYQ

SEQ ID NO: 39628 - protein, 14 aa, BK virus
SELFFLFQSRFYQL

SEQ ID NO: 39629 - protein, 14 aa, BK virus
ELFFLFQSRFYQLS

SEQ ID NO: 39630 - protein, 14 aa, BK virus
LFFLFQSRFYQLSL

SEQ ID NO: 39631 - protein, 14 aa, BK virus
FFLFQSRFYQLSLK

SEQ ID NO: 39632 - protein, 14 aa, BK virus
FLFQSRFYQLSLKL

SEQ ID NO: 39633 - protein, 14 aa, BK virus
LFQSRFYQLSLKLV

SEQ ID NO: 39634 - protein, 14 aa, BK virus
FQSRFYQLSLKLVV

SEQ ID NO: 39635 - protein, 14 aa, BK virus
QSRFYQLSLKLVVT

SEQ ID NO: 39636 - protein, 14 aa, BK virus
SRFYQLSLKLVVTA

SEQ ID NO: 39637 - protein, 14 aa, BK virus
RFYQLSLKLVVTAG

SEQ ID NO: 39638 - protein, 14 aa, BK virus
FYQLSLKLVVTAGA

SEQ ID NO: 39639 - protein, 14 aa, BK virus
YQLSLKLVVTAGAE

SEQ ID NO: 39640 - protein, 14 aa, BK virus
QLSLKLVVTAGAEP

SEQ ID NO: 39641 - protein, 14 aa, BK virus
LSLKLVVTAGAEPW

SEQ ID NO: 39642 - protein, 14 aa, BK virus
SLKLVVTAGAEPWP

SEQ ID NO: 39643 - protein, 14 aa, BK virus
LKLVVTAGAEPWPL

SEQ ID NO: 39644 - protein, 14 aa, BK virus
KLVVTAGAEPWPLS

SEQ ID NO: 39645 - protein, 14 aa, BK virus
LVVTAGAEPWPLSS

SEQ ID NO: 39646 - protein, 14 aa, BK virus
VVTAGAEPWPLSSL

SEQ ID NO: 39647 - protein, 14 aa, BK virus
VTAGAEPWPLSSLT

SEQ ID NO: 39648 - protein, 14 aa, BK virus
TAGAEPWPLSSLTG

SEQ ID NO: 39649 - protein, 14 aa, BK virus
AGAEPWPLSSLTGD

SEQ ID NO: 39650 - protein, 14 aa, BK virus
GAEPWPLSSLTGDK

SEQ ID NO: 39651 - protein, 14 aa, BK virus
AEPWPLSSLTGDKA

SEQ ID NO: 39652 - protein, 14 aa, BK virus
EPWPLSSLTGDKAK

SEQ ID NO: 39653 - protein, 14 aa, BK virus
PWPLSSLTGDKAKI

SEQ ID NO: 39654 - protein, 14 aa, BK virus
WPLSSLTGDKAKIP

SEQ ID NO: 39655 - protein, 14 aa, BK virus
PLSSLTGDKAKIPR

SEQ ID NO: 39656 - protein, 14 aa, BK virus
LSSLTGDKAKIPRL

SEQ ID NO: 39657 - protein, 14 aa, BK virus
SSLTGDKAKIPRLA

SEQ ID NO: 39658 - protein, 14 aa, BK virus
SLTGDKAKIPRLAK

SEQ ID NO: 39659 - protein, 14 aa, BK virus
LTGDKAKIPRLAKH

SEQ ID NO: 39660 - protein, 14 aa, BK virus
TGDKAKIPRLAKHV

SEQ ID NO: 39661 - protein, 14 aa, BK virus
GDKAKIPRLAKHVC

SEQ ID NO: 39662 - protein, 14 aa, BK virus
DKAKIPRLAKHVCH

SEQ ID NO: 39663 - protein, 14 aa, BK virus
KAKIPRLAKHVCHA

SEQ ID NO: 39664 - protein, 14 aa, BK virus
AKIPRLAKHVCHAL

SEQ ID NO: 39665 - protein, 14 aa, BK virus
KIPRLAKHVCHALS

SEQ ID NO: 39666 - protein, 14 aa, BK virus
IPRLAKHVCHALSF

SEQ ID NO: 39667 - protein, 14 aa, BK virus
PRLAKHVCHALSFL

SEQ ID NO: 39668 - protein, 14 aa, BK virus
RLAKHVCHALSFLR

SEQ ID NO: 39669 - protein, 14 aa, BK virus
LAKHVCHALSFLRS

SEQ ID NO: 39670 - protein, 14 aa, BK virus
AKHVCHALSFLRSW

SEQ ID NO: 39671 - protein, 14 aa, BK virus
KHVCHALSFLRSWF

SEQ ID NO: 39672 - protein, 14 aa, BK virus
HVCHALSFLRSWFG

SEQ ID NO: 39673 - protein, 14 aa, BK virus
VCHALSFLRSWFGC

SEQ ID NO: 39674 - protein, 14 aa, BK virus
CHALSFLRSWFGCI

SEQ ID NO: 39675 - protein, 14 aa, BK virus
HALSFLRSWFGCIP

SEQ ID NO: 39676 - protein, 14 aa, BK virus
ALSFLRSWFGCIPW

SEQ ID NO: 39677 - protein, 14 aa, BK virus
LSFLRSWFGCIPWV

SEQ ID NO: 39678 - protein, 14 aa, BK virus
SFLRSWFGCIPWVS

SEQ ID NO: 39679 - protein, 14 aa, BK virus
FLRSWFGCIPWVSS

SEQ ID NO: 39680 - protein, 14 aa, BK virus
LRSWFGCIPWVSSS

SEQ ID NO: 39681 - protein, 14 aa, BK virus
RSWFGCIPWVSSSS

SEQ ID NO: 39682 - protein, 14 aa, BK virus
SWFGCIPWVSSSSL

SEQ ID NO: 39683 - protein, 14 aa, BK virus
GHGLAAFPCESCTF

SEQ ID NO: 39684 - protein, 14 aa, BK virus
HGLAAFPCESCTFL

SEQ ID NO: 39685 - protein, 14 aa, BK virus
GLAAFPCESCTFLP

SEQ ID NO: 39686 - protein, 14 aa, BK virus
LAAFPCESCTFLPE

SEQ ID NO: 39687 - protein, 14 aa, BK virus
AAFPCESCTFLPEV

SEQ ID NO: 39688 - protein, 14 aa, BK virus
AFPCESCTFLPEVM

SEQ ID NO: 39689 - protein, 14 aa, BK virus
FPCESCTFLPEVMV

SEQ ID NO: 39690 - protein, 14 aa, BK virus
PCESCTFLPEVMVW

SEQ ID NO: 39691 - protein, 14 aa, BK virus
CESCTFLPEVMVWL

SEQ ID NO: 39692 - protein, 14 aa, BK virus
ESCTFLPEVMVWLH

SEQ ID NO: 39693 - protein, 14 aa, BK virus
SCTFLPEVMVWLHS

SEQ ID NO: 39694 - protein, 14 aa, BK virus
CTFLPEVMVWLHSM

SEQ ID NO: 39695 - protein, 14 aa, BK virus
TFLPEVMVWLHSMG

SEQ ID NO: 39696 - protein, 14 aa, BK virus
FLPEVMVWLHSMGK

SEQ ID NO: 39697 - protein, 14 aa, BK virus
LPEVMVWLHSMGKQ

SEQ ID NO: 39698 - protein, 14 aa, BK virus
PEVMVWLHSMGKQL

SEQ ID NO: 39699 - protein, 14 aa, BK virus
EVMVWLHSMGKQLL

SEQ ID NO: 39700 - protein, 14 aa, BK virus
VMVWLHSMGKQLLP

SEQ ID NO: 39701 - protein, 14 aa, BK virus
MVWLHSMGKQLLPV

SEQ ID NO: 39702 - protein, 14 aa, BK virus
VWLHSMGKQLLPVA

SEQ ID NO: 39703 - protein, 14 aa, BK virus
WLHSMGKQLLPVAF

SEQ ID NO: 39704 - protein, 14 aa, BK virus
LHSMGKQLLPVAFF

SEQ ID NO: 39705 - protein, 14 aa, BK virus
HSMGKQLLPVAFFF

SEQ ID NO: 39706 - protein, 14 aa, BK virus
SMGKQLLPVAFFFI

SEQ ID NO: 39707 - protein, 14 aa, BK virus
MGKQLLPVAFFFII

SEQ ID NO: 39708 - protein, 14 aa, BK virus
GKQLLPVAFFFIIY

SEQ ID NO: 39709 - protein, 14 aa, BK virus
KQLLPVAFFFIIYK

SEQ ID NO: 39710 - protein, 14 aa, BK virus
QLLPVAFFFIIYKR

SEQ ID NO: 39711 - protein, 14 aa, BK virus
LLPVAFFFIIYKRP

SEQ ID NO: 39712 - protein, 14 aa, BK virus
LPVAFFFIIYKRPR

SEQ ID NO: 39713 - protein, 14 aa, BK virus
PVAFFFIIYKRPRP

SEQ ID NO: 39714 - protein, 14 aa, BK virus
VAFFFIIYKRPRPP

SEQ ID NO: 39715 - protein, 14 aa, BK virus
AFFFIIYKRPRPPL

SEQ ID NO: 39716 - protein, 14 aa, BK virus
FFFIIYKRPRPPLP

SEQ ID NO: 39717 - protein, 14 aa, BK virus
FFIIYKRPRPPLPP

SEQ ID NO: 39718 - protein, 14 aa, BK virus
FIIYKRPRPPLPPP

SEQ ID NO: 39719 - protein, 14 aa, BK virus
IIYKRPRPPLPPPF

SEQ ID NO: 39720 - protein, 14 aa, BK virus
IYKRPRPPLPPPFL

SEQ ID NO: 39721 - protein, 14 aa, BK virus
YKRPRPPLPPPFLS

SEQ ID NO: 39722 - protein, 14 aa, BK virus
KRPRPPLPPPFLSS

SEQ ID NO: 39723 - protein, 14 aa, BK virus
RPRPPLPPPFLSSS

SEQ ID NO: 39724 - protein, 14 aa, BK virus
PRPPLPPPFLSSSK

SEQ ID NO: 39725 - protein, 14 aa, BK virus
RPPLPPPFLSSSKG

SEQ ID NO: 39726 - protein, 14 aa, BK virus
PPLPPPFLSSSKGV

SEQ ID NO: 39727 - protein, 14 aa, BK virus
PLPPPFLSSSKGVE

SEQ ID NO: 39728 - protein, 14 aa, BK virus
LPPPFLSSSKGVEA

SEQ ID NO: 39729 - protein, 14 aa, BK virus
PPPFLSSSKGVEAF

SEQ ID NO: 39730 - protein, 14 aa, BK virus
PPFLSSSKGVEAFS

SEQ ID NO: 39731 - protein, 14 aa, BK virus
PFLSSSKGVEAFSE

SEQ ID NO: 39732 - protein, 14 aa, BK virus
FLSSSKGVEAFSEA

SEQ ID NO: 39733 - protein, 14 aa, BK virus
QNYLGKSLFFCNFC

SEQ ID NO: 39734 - protein, 14 aa, BK virus
NYLGKSLFFCNFCK

SEQ ID NO: 39735 - protein, 15 aa, BK virus
WIKFLTGKNPWSSWT

SEQ ID NO: 39736 - protein, 15 aa, BK virus
IKFLTGKNPWSSWTF

SEQ ID NO: 39737 - protein, 15 aa, BK virus
GSVRNFTLTKGATRI

SEQ ID NO: 39738 - protein, 15 aa, BK virus
SVRNFTLTKGATRIK

SEQ ID NO: 39739 - protein, 15 aa, BK virus
LISLILEPGVAQRFV

SEQ ID NO: 39740 - protein, 15 aa, BK virus
ISLILEPGVAQRFVL

SEQ ID NO: 39741 - protein, 15 aa, BK virus
SLILEPGVAQRFVLI

SEQ ID NO: 39742 - protein, 15 aa, BK virus
LILEPGVAQRFVLIF

SEQ ID NO: 39743 - protein, 15 aa, BK virus
ILEPGVAQRFVLIFL

SEQ ID NO: 39744 - protein, 15 aa, BK virus
LEPGVAQRFVLIFLF

SEQ ID NO: 39745 - protein, 15 aa, BK virus
EPGVAQRFVLIFLFA

SEQ ID NO: 39746 - protein, 15 aa, BK virus
PGVAQRFVLIFLFAQ

SEQ ID NO: 39747 - protein, 15 aa, BK virus
GVAQRFVLIFLFAQI

SEQ ID NO: 39748 - protein, 15 aa, BK virus
VAQRFVLIFLFAQIP

SEQ ID NO: 39749 - protein, 15 aa, BK virus
AQRFVLIFLFAQIPC

SEQ ID NO: 39750 - protein, 15 aa, BK virus
QRFVLIFLFAQIPCT

SEQ ID NO: 39751 - protein, 15 aa, BK virus
RFVLIFLFAQIPCTA

SEQ ID NO: 39752 - protein, 15 aa, BK virus
FVLIFLFAQIPCTAR

SEQ ID NO: 39753 - protein, 15 aa, BK virus
VLIFLFAQIPCTARN

SEQ ID NO: 39754 - protein, 15 aa, BK virus
LIFLFAQIPCTARNG

SEQ ID NO: 39755 - protein, 15 aa, BK virus
IFLFAQIPCTARNGL

SEQ ID NO: 39756 - protein, 15 aa, BK virus
FLFAQIPCTARNGLF

SEQ ID NO: 39757 - protein, 15 aa, BK virus
LFAQIPCTARNGLFV

SEQ ID NO: 39758 - protein, 15 aa, BK virus
FAQIPCTARNGLFVP

SEQ ID NO: 39759 - protein, 15 aa, BK virus
AQIPCTARNGLFVPK

SEQ ID NO: 39760 - protein, 15 aa, BK virus
QIPCTARNGLFVPKS

SEQ ID NO: 39761 - protein, 15 aa, BK virus
IPCTARNGLFVPKSL

SEQ ID NO: 39762 - protein, 15 aa, BK virus
PCTARNGLFVPKSLL

SEQ ID NO: 39763 - protein, 15 aa, BK virus
CTARNGLFVPKSLLC

SEQ ID NO: 39764 - protein, 15 aa, BK virus
TARNGLFVPKSLLCT

SEQ ID NO: 39765 - protein, 15 aa, BK virus
ARNGLFVPKSLLCTA

SEQ ID NO: 39766 - protein, 15 aa, BK virus
RNGLFVPKSLLCTAL

SEQ ID NO: 39767 - protein, 15 aa, BK virus
NGLFVPKSLLCTALA

SEQ ID NO: 39768 - protein, 15 aa, BK virus
GLFVPKSLLCTALAC

SEQ ID NO: 39769 - protein, 15 aa, BK virus
LFVPKSLLCTALACY

SEQ ID NO: 39770 - protein, 15 aa, BK virus
FVPKSLLCTALACYV

SEQ ID NO: 39771 - protein, 15 aa, BK virus
VPKSLLCTALACYVS

SEQ ID NO: 39772 - protein, 15 aa, BK virus
PKSLLCTALACYVSL

SEQ ID NO: 39773 - protein, 15 aa, BK virus
KSLLCTALACYVSLD

SEQ ID NO: 39774 - protein, 15 aa, BK virus
VIIFFIGANLWNRRV

SEQ ID NO: 39775 - protein, 15 aa, BK virus
IIFFIGANLWNRRVG

SEQ ID NO: 39776 - protein, 15 aa, BK virus
IFFIGANLWNRRVGV

SEQ ID NO: 39777 - protein, 15 aa, BK virus
FFIGANLWNRRVGVL

SEQ ID NO: 39778 - protein, 15 aa, BK virus
FIGANLWNRRVGVLV

SEQ ID NO: 39779 - protein, 15 aa, BK virus
IGANLWNRRVGVLVE

SEQ ID NO: 39780 - protein, 15 aa, BK virus
GANLWNRRVGVLVEF

SEQ ID NO: 39781 - protein, 15 aa, BK virus
ANLWNRRVGVLVEFL

SEQ ID NO: 39782 - protein, 15 aa, BK virus
RSNSRFSTLNTTQKK

SEQ ID NO: 39783 - protein, 15 aa, BK virus
SNSRFSTLNTTQKKK

SEQ ID NO: 39784 - protein, 15 aa, BK virus
NSRFSTLNTTQKKKK

SEQ ID NO: 39785 - protein, 15 aa, BK virus
SRFSTLNTTQKKKKG

SEQ ID NO: 39786 - protein, 15 aa, BK virus
RFSTLNTTQKKKKGR

SEQ ID NO: 39787 - protein, 15 aa, BK virus
FSTLNTTQKKKKGRR

SEQ ID NO: 39788 - protein, 15 aa, BK virus
STLNTTQKKKKGRRP

SEQ ID NO: 39789 - protein, 15 aa, BK virus
RSIPYYRRKHSRGLK

SEQ ID NO: 39790 - protein, 15 aa, BK virus
SIPYYRRKHSRGLKG

SEQ ID NO: 39791 - protein, 15 aa, BK virus
IPYYRRKHSRGLKGA

SEQ ID NO: 39792 - protein, 15 aa, BK virus
GCVFIIRYVFRISIQ

SEQ ID NO: 39793 - protein, 15 aa, BK virus
CVFIIRYVFRISIQC

SEQ ID NO: 39794 - protein, 15 aa, BK virus
VFIIRYVFRISIQCR

SEQ ID NO: 39795 - protein, 15 aa, BK virus
FIIRYVFRISIQCRG

SEQ ID NO: 39796 - protein, 15 aa, BK virus
IIRYVFRISIQCRGV

SEQ ID NO: 39797 - protein, 15 aa, BK virus
KSKKYLSASSRYSFS

SEQ ID NO: 39798 - protein, 15 aa, BK virus
KKSRYPSYDQGRNAN

SEQ ID NO: 39799 - protein, 15 aa, BK virus
KSRYPSYDQGRNANR

SEQ ID NO: 39800 - protein, 15 aa, BK virus
SRYPSYDQGRNANRK

SEQ ID NO: 39801 - protein, 15 aa, BK virus
RYPSYDQGRNANRKI

SEQ ID NO: 39802 - protein, 15 aa, BK virus
YPSYDQGRNANRKIQ

SEQ ID NO: 39803 - protein, 15 aa, BK virus
PSYDQGRNANRKIQS

SEQ ID NO: 39804 - protein, 15 aa, BK virus
SYDQGRNANRKIQSY

SEQ ID NO: 39805 - protein, 15 aa, BK virus
YDQGRNANRKIQSYI

SEQ ID NO: 39806 - protein, 15 aa, BK virus
DQGRNANRKIQSYIR

SEQ ID NO: 39807 - protein, 15 aa, BK virus
NGFNIWSSWKCCTRT

SEQ ID NO: 39808 - protein, 15 aa, BK virus
GFNIWSSWKCCTRTI

SEQ ID NO: 39809 - protein, 15 aa, BK virus
FNIWSSWKCCTRTIY

SEQ ID NO: 39810 - protein, 15 aa, BK virus
NIWSSWKCCTRTIYG

SEQ ID NO: 39811 - protein, 15 aa, BK virus
IWSSWKCCTRTIYGR

SEQ ID NO: 39812 - protein, 15 aa, BK virus
WSSWKCCTRTIYGRC

SEQ ID NO: 39813 - protein, 15 aa, BK virus
SSWKCCTRTIYGRCC

SEQ ID NO: 39814 - protein, 15 aa, BK virus
SWKCCTRTIYGRCCL

SEQ ID NO: 39815 - protein, 15 aa, BK virus
WKCCTRTIYGRCCLA

SEQ ID NO: 39816 - protein, 15 aa, BK virus
KCCTRTIYGRCCLAA

SEQ ID NO: 39817 - protein, 15 aa, BK virus
CCTRTIYGRCCLAAL

SEQ ID NO: 39818 - protein, 15 aa, BK virus
CTRTIYGRCCLAALF

SEQ ID NO: 39819 - protein, 15 aa, BK virus
TRTIYGRCCLAALFA

SEQ ID NO: 39820 - protein, 15 aa, BK virus
RTIYGRCCLAALFAT

SEQ ID NO: 39821 - protein, 15 aa, BK virus
WKNNTSCRVIRFVWW

SEQ ID NO: 39822 - protein, 15 aa, BK virus
IKGFAFRTWNKQFRQ

SEQ ID NO: 39823 - protein, 15 aa, BK virus
KGFAFRTWNKQFRQF

SEQ ID NO: 39824 - protein, 15 aa, BK virus
GFAFRTWNKQFRQFE

SEQ ID NO: 39825 - protein, 15 aa, BK virus
FAFRTWNKQFRQFER

SEQ ID NO: 39826 - protein, 15 aa, BK virus
AFRTWNKQFRQFERL

SEQ ID NO: 39827 - protein, 15 aa, BK virus
FRTWNKQFRQFERLF

SEQ ID NO: 39828 - protein, 15 aa, BK virus
RTWNKQFRQFERLFR

SEQ ID NO: 39829 - protein, 15 aa, BK virus
TWNKQFRQFERLFRW

SEQ ID NO: 39830 - protein, 15 aa, BK virus
WNKQFRQFERLFRWK

SEQ ID NO: 39831 - protein, 15 aa, BK virus
NKQFRQFERLFRWKC

SEQ ID NO: 39832 - protein, 15 aa, BK virus
GKFRKETFKQKNPNI

SEQ ID NO: 39833 - protein, 15 aa, BK virus
KFRKETFKQKNPNIS

SEQ ID NO: 39834 - protein, 15 aa, BK virus
FRKETFKQKNPNIST

SEQ ID NO: 39835 - protein, 15 aa, BK virus
RKETFKQKNPNISTR

SEQ ID NO: 39836 - protein, 15 aa, BK virus
KETFKQKNPNISTRL

SEQ ID NO: 39837 - protein, 15 aa, BK virus
ETFKQKNPNISTRLG

SEQ ID NO: 39838 - protein, 15 aa, BK virus
TFKQKNPNISTRLGY

SEQ ID NO: 39839 - protein, 15 aa, BK virus
FKQKNPNISTRLGYN

SEQ ID NO: 39840 - protein, 15 aa, BK virus
KQKNPNISTRLGYNE

SEQ ID NO: 39841 - protein, 15 aa, BK virus
AQNIFKKILTKLRVL

SEQ ID NO: 39842 - protein, 15 aa, BK virus
QNIFKKILTKLRVLT

SEQ ID NO: 39843 - protein, 15 aa, BK virus
KKNFTKWNDLVATAN

SEQ ID NO: 39844 - protein, 15 aa, BK virus
KNFTKWNDLVATANL

SEQ ID NO: 39845 - protein, 15 aa, BK virus
NFTKWNDLVATANLV

SEQ ID NO: 39846 - protein, 15 aa, BK virus
IPITMLFPSLRYFSP

SEQ ID NO: 39847 - protein, 15 aa, BK virus
PITMLFPSLRYFSPC

SEQ ID NO: 39848 - protein, 15 aa, BK virus
KWLIQKQHLLNVYVQ

SEQ ID NO: 39849 - protein, 15 aa, BK virus
KHLFKAFWFAIVPVC

SEQ ID NO: 39850 - protein, 15 aa, BK virus
HLFKAFWFAIVPVCQ

SEQ ID NO: 39851 - protein, 15 aa, BK virus
LFKAFWFAIVPVCQY

SEQ ID NO: 39852 - protein, 15 aa, BK virus
FKAFWFAIVPVCQYI

SEQ ID NO: 39853 - protein, 15 aa, BK virus
KAFWFAIVPVCQYIL

SEQ ID NO: 39854 - protein, 15 aa, BK virus
AFWFAIVPVCQYILS

SEQ ID NO: 39855 - protein, 15 aa, BK virus
FWFAIVPVCQYILSY

SEQ ID NO: 39856 - protein, 15 aa, BK virus
WFAIVPVCQYILSYL

SEQ ID NO: 39857 - protein, 15 aa, BK virus
FAIVPVCQYILSYLG

SEQ ID NO: 39858 - protein, 15 aa, BK virus
AIVPVCQYILSYLGP

SEQ ID NO: 39859 - protein, 15 aa, BK virus
IVPVCQYILSYLGPL

SEQ ID NO: 39860 - protein, 15 aa, BK virus
VPVCQYILSYLGPLE

SEQ ID NO: 39861 - protein, 15 aa, BK virus
PVCQYILSYLGPLEV

SEQ ID NO: 39862 - protein, 15 aa, BK virus
VCQYILSYLGPLEVF

SEQ ID NO: 39863 - protein, 15 aa, BK virus
CQYILSYLGPLEVFL

SEQ ID NO: 39864 - protein, 15 aa, BK virus
QYILSYLGPLEVFLC

SEQ ID NO: 39865 - protein, 15 aa, BK virus
YILSYLGPLEVFLCH

SEQ ID NO: 39866 - protein, 15 aa, BK virus
ILSYLGPLEVFLCHQ

SEQ ID NO: 39867 - protein, 15 aa, BK virus
LSYLGPLEVFLCHQT

SEQ ID NO: 39868 - protein, 15 aa, BK virus
SYLGPLEVFLCHQTP

SEQ ID NO: 39869 - protein, 15 aa, BK virus
GHLAKRKLGKDSLQI

SEQ ID NO: 39870 - protein, 15 aa, BK virus
HLAKRKLGKDSLQIF

SEQ ID NO: 39871 - protein, 15 aa, BK virus
LAKRKLGKDSLQIFF

SEQ ID NO: 39872 - protein, 15 aa, BK virus
AKRKLGKDSLQIFFS

SEQ ID NO: 39873 - protein, 15 aa, BK virus
KRKLGKDSLQIFFSG

SEQ ID NO: 39874 - protein, 15 aa, BK virus
RKLGKDSLQIFFSGG

SEQ ID NO: 39875 - protein, 15 aa, BK virus
KLGKDSLQIFFSGGS

SEQ ID NO: 39876 - protein, 15 aa, BK virus
TGHKYQQLKHTGYQL

SEQ ID NO: 39877 - protein, 15 aa, BK virus
GHKYQQLKHTGYQLY

SEQ ID NO: 39878 - protein, 15 aa, BK virus
HKYQQLKHTGYQLYK

SEQ ID NO: 39879 - protein, 15 aa, BK virus
KYQQLKHTGYQLYKE

SEQ ID NO: 39880 - protein, 15 aa, BK virus
YQQLKHTGYQLYKEA

SEQ ID NO: 39881 - protein, 15 aa, BK virus
QQLKHTGYQLYKEAP

SEQ ID NO: 39882 - protein, 15 aa, BK virus
QLKHTGYQLYKEAPH

SEQ ID NO: 39883 - protein, 15 aa, BK virus
LKHTGYQLYKEAPHP

SEQ ID NO: 39884 - protein, 15 aa, BK virus
KHTGYQLYKEAPHPV

SEQ ID NO: 39885 - protein, 15 aa, BK virus
HTGYQLYKEAPHPVH

SEQ ID NO: 39886 - protein, 15 aa, BK virus
TGYQLYKEAPHPVHL

SEQ ID NO: 39887 - protein, 15 aa, BK virus
GYQLYKEAPHPVHLA

SEQ ID NO: 39888 - protein, 15 aa, BK virus
YQLYKEAPHPVHLAT

SEQ ID NO: 39889 - protein, 15 aa, BK virus
QLYKEAPHPVHLATL

SEQ ID NO: 39890 - protein, 15 aa, BK virus
LYKEAPHPVHLATLW

SEQ ID NO: 39891 - protein, 15 aa, BK virus
LCWSHEVLGEHFPLL

SEQ ID NO: 39892 - protein, 15 aa, BK virus
HFHFYWDQVPSTQLD

SEQ ID NO: 39893 - protein, 15 aa, BK virus
FHFYWDQVPSTQLDK

SEQ ID NO: 39894 - protein, 15 aa, BK virus
HFYWDQVPSTQLDKH

SEQ ID NO: 39895 - protein, 15 aa, BK virus
FYWDQVPSTQLDKHC

SEQ ID NO: 39896 - protein, 15 aa, BK virus
YWDQVPSTQLDKHCF

SEQ ID NO: 39897 - protein, 15 aa, BK virus
WDQVPSTQLDKHCFC

SEQ ID NO: 39898 - protein, 15 aa, BK virus
DQVPSTQLDKHCFCP

SEQ ID NO: 39899 - protein, 15 aa, BK virus
QVPSTQLDKHCFCPN

SEQ ID NO: 39900 - protein, 15 aa, BK virus
VPSTQLDKHCFCPNR

SEQ ID NO: 39901 - protein, 15 aa, BK virus
PSTQLDKHCFCPNRP

SEQ ID NO: 39902 - protein, 15 aa, BK virus
STQLDKHCFCPNRPY

SEQ ID NO: 39903 - protein, 15 aa, BK virus
TQLDKHCFCPNRPYG

SEQ ID NO: 39904 - protein, 15 aa, BK virus
QLDKHCFCPNRPYGQ

SEQ ID NO: 39905 - protein, 15 aa, BK virus
LDKHCFCPNRPYGQY

SEQ ID NO: 39906 - protein, 15 aa, BK virus
DKHCFCPNRPYGQYS

SEQ ID NO: 39907 - protein, 15 aa, BK virus
KHCFCPNRPYGQYSL

SEQ ID NO: 39908 - protein, 15 aa, BK virus
HCFCPNRPYGQYSLP

SEQ ID NO: 39909 - protein, 15 aa, BK virus
CFCPNRPYGQYSLPG

SEQ ID NO: 39910 - protein, 15 aa, BK virus
FCPNRPYGQYSLPGT

SEQ ID NO: 39911 - protein, 15 aa, BK virus
CPNRPYGQYSLPGTG

SEQ ID NO: 39912 - protein, 15 aa, BK virus
PNRPYGQYSLPGTGL

SEQ ID NO: 39913 - protein, 15 aa, BK virus
NRPYGQYSLPGTGLL

SEQ ID NO: 39914 - protein, 15 aa, BK virus
RPYGQYSLPGTGLLG

SEQ ID NO: 39915 - protein, 15 aa, BK virus
PYGQYSLPGTGLLGF

SEQ ID NO: 39916 - protein, 15 aa, BK virus
YHQGTLTCNSLALPA

SEQ ID NO: 39917 - protein, 15 aa, BK virus
HQGTLTCNSLALPAF

SEQ ID NO: 39918 - protein, 15 aa, BK virus
QGTLTCNSLALPAFP

SEQ ID NO: 39919 - protein, 15 aa, BK virus
GTLTCNSLALPAFPR

SEQ ID NO: 39920 - protein, 15 aa, BK virus
TLTCNSLALPAFPRV

SEQ ID NO: 39921 - protein, 15 aa, BK virus
LTCNSLALPAFPRVL

SEQ ID NO: 39922 - protein, 15 aa, BK virus
TCNSLALPAFPRVLH

SEQ ID NO: 39923 - protein, 15 aa, BK virus
CNSLALPAFPRVLHL

SEQ ID NO: 39924 - protein, 15 aa, BK virus
NSLALPAFPRVLHLQ

SEQ ID NO: 39925 - protein, 15 aa, BK virus
SLALPAFPRVLHLQQ

SEQ ID NO: 39926 - protein, 15 aa, BK virus
LALPAFPRVLHLQQR

SEQ ID NO: 39927 - protein, 15 aa, BK virus
ALPAFPRVLHLQQRS

SEQ ID NO: 39928 - protein, 15 aa, BK virus
LPAFPRVLHLQQRSG

SEQ ID NO: 39929 - protein, 15 aa, BK virus
PAFPRVLHLQQRSGN

SEQ ID NO: 39930 - protein, 15 aa, BK virus
AFPRVLHLQQRSGNY

SEQ ID NO: 39931 - protein, 15 aa, BK virus
FPRVLHLQQRSGNYC

SEQ ID NO: 39932 - protein, 15 aa, BK virus
PRVLHLQQRSGNYCL

SEQ ID NO: 39933 - protein, 15 aa, BK virus
RVLHLQQRSGNYCLE

SEQ ID NO: 39934 - protein, 15 aa, BK virus
VFLHHAHALFVTLHE

SEQ ID NO: 39935 - protein, 15 aa, BK virus
FLHHAHALFVTLHEG

SEQ ID NO: 39936 - protein, 15 aa, BK virus
PLFVQLQPPTSVDFH

SEQ ID NO: 39937 - protein, 15 aa, BK virus
LFVQLQPPTSVDFHR

SEQ ID NO: 39938 - protein, 15 aa, BK virus
FVQLQPPTSVDFHRL

SEQ ID NO: 39939 - protein, 15 aa, BK virus
VQLQPPTSVDFHRLG

SEQ ID NO: 39940 - protein, 15 aa, BK virus
QLQPPTSVDFHRLGP

SEQ ID NO: 39941 - protein, 15 aa, BK virus
LQPPTSVDFHRLGPH

SEQ ID NO: 39942 - protein, 15 aa, BK virus
QPPTSVDFHRLGPHL

SEQ ID NO: 39943 - protein, 15 aa, BK virus
PPTSVDFHRLGPHLN

SEQ ID NO: 39944 - protein, 15 aa, BK virus
PTSVDFHRLGPHLNW

SEQ ID NO: 39945 - protein, 15 aa, BK virus
TSVDFHRLGPHLNWG

SEQ ID NO: 39946 - protein, 15 aa, BK virus
SVDFHRLGPHLNWGG

SEQ ID NO: 39947 - protein, 15 aa, BK virus
VDFHRLGPHLNWGGE

SEQ ID NO: 39948 - protein, 15 aa, BK virus
DFHRLGPHLNWGGEF

SEQ ID NO: 39949 - protein, 15 aa, BK virus
FHRLGPHLNWGGEFL

SEQ ID NO: 39950 - protein, 15 aa, BK virus
HRLGPHLNWGGEFLL

SEQ ID NO: 39951 - protein, 15 aa, BK virus
RLGPHLNWGGEFLLC

SEQ ID NO: 39952 - protein, 15 aa, BK virus
LGPHLNWGGEFLLCC

SEQ ID NO: 39953 - protein, 15 aa, BK virus
GPHLNWGGEFLLCCN

SEQ ID NO: 39954 - protein, 15 aa, BK virus
PHLNWGGEFLLCCNR

SEQ ID NO: 39955 - protein, 15 aa, BK virus
HLNWGGEFLLCCNRE

SEQ ID NO: 39956 - protein, 15 aa, BK virus
LNWGGEFLLCCNREA

SEQ ID NO: 39957 - protein, 15 aa, BK virus
NWGGEFLLCCNREAF

SEQ ID NO: 39958 - protein, 15 aa, BK virus
WGGEFLLCCNREAFF

SEQ ID NO: 39959 - protein, 15 aa, BK virus
GGEFLLCCNREAFFS

SEQ ID NO: 39960 - protein, 15 aa, BK virus
GEFLLCCNREAFFSL

SEQ ID NO: 39961 - protein, 15 aa, BK virus
EFLLCCNREAFFSLG

SEQ ID NO: 39962 - protein, 15 aa, BK virus
FLLCCNREAFFSLGY

SEQ ID NO: 39963 - protein, 15 aa, BK virus
LLCCNREAFFSLGYH

SEQ ID NO: 39964 - protein, 15 aa, BK virus
LCCNREAFFSLGYHC

SEQ ID NO: 39965 - protein, 15 aa, BK virus
GFHLDPPFLGLGSIL

SEQ ID NO: 39966 - protein, 15 aa, BK virus
FHLDPPFLGLGSILP

SEQ ID NO: 39967 - protein, 15 aa, BK virus
HLDPPFLGLGSILPL

SEQ ID NO: 39968 - protein, 15 aa, BK virus
LLELLLLLLLVVLAL

SEQ ID NO: 39969 - protein, 15 aa, BK virus
LELLLLLLLVVLALA

SEQ ID NO: 39970 - protein, 15 aa, BK virus
ELLLLLLLVVLALAR

SEQ ID NO: 39971 - protein, 15 aa, BK virus
LLLLLLLVVLALARV

SEQ ID NO: 39972 - protein, 15 aa, BK virus
LLLLLLVVLALARVP

SEQ ID NO: 39973 - protein, 15 aa, BK virus
LLLLLVVLALARVPL

SEQ ID NO: 39974 - protein, 15 aa, BK virus
LLLLVVLALARVPLA

SEQ ID NO: 39975 - protein, 15 aa, BK virus
LLLVVLALARVPLAF

SEQ ID NO: 39976 - protein, 15 aa, BK virus
LLVVLALARVPLAFW

SEQ ID NO: 39977 - protein, 15 aa, BK virus
LVVLALARVPLAFWE

SEQ ID NO: 39978 - protein, 15 aa, BK virus
VVLALARVPLAFWEL

SEQ ID NO: 39979 - protein, 15 aa, BK virus
VLALARVPLAFWELP

SEQ ID NO: 39980 - protein, 15 aa, BK virus
LALARVPLAFWELPL

SEQ ID NO: 39981 - protein, 15 aa, BK virus
ALARVPLAFWELPLD

SEQ ID NO: 39982 - protein, 15 aa, BK virus
LARVPLAFWELPLDT

SEQ ID NO: 39983 - protein, 15 aa, BK virus
ARVPLAFWELPLDTL

SEQ ID NO: 39984 - protein, 15 aa, BK virus
RVPLAFWELPLDTLL

SEQ ID NO: 39985 - protein, 15 aa, BK virus
VPLAFWELPLDTLLF

SEQ ID NO: 39986 - protein, 15 aa, BK virus
PLAFWELPLDTLLFF

SEQ ID NO: 39987 - protein, 15 aa, BK virus
LAFWELPLDTLLFFW

SEQ ID NO: 39988 - protein, 15 aa, BK virus
AFWELPLDTLLFFWL

SEQ ID NO: 39989 - protein, 15 aa, BK virus
FWELPLDTLLFFWLG

SEQ ID NO: 39990 - protein, 15 aa, BK virus
WELPLDTLLFFWLGP

SEQ ID NO: 39991 - protein, 15 aa, BK virus
ELPLDTLLFFWLGPS

SEQ ID NO: 39992 - protein, 15 aa, BK virus
LPLDTLLFFWLGPSS

SEQ ID NO: 39993 - protein, 15 aa, BK virus
PLDTLLFFWLGPSSY

SEQ ID NO: 39994 - protein, 15 aa, BK virus
LDTLLFFWLGPSSYA

SEQ ID NO: 39995 - protein, 15 aa, BK virus
DTLLFFWLGPSSYAS

SEQ ID NO: 39996 - protein, 15 aa, BK virus
TLLFFWLGPSSYASR

SEQ ID NO: 39997 - protein, 15 aa, BK virus
LLFFWLGPSSYASRA

SEQ ID NO: 39998 - protein, 15 aa, BK virus
LFFWLGPSSYASRAG

SEQ ID NO: 39999 - protein, 15 aa, BK virus
FFWLGPSSYASRAGV

SEQ ID NO: 40000 - protein, 15 aa, BK virus
FWLGPSSYASRAGVT

SEQ ID NO: 40001 - protein, 15 aa, BK virus
WLGPSSYASRAGVTV

SEQ ID NO: 40002 - protein, 15 aa, BK virus
LGPSSYASRAGVTVP

SEQ ID NO: 40003 - protein, 15 aa, BK virus
GPSSYASRAGVTVPY

SEQ ID NO: 40004 - protein, 15 aa, BK virus
PSSYASRAGVTVPYR

SEQ ID NO: 40005 - protein, 15 aa, BK virus
SSYASRAGVTVPYRP

SEQ ID NO: 40006 - protein, 15 aa, BK virus
SYASRAGVTVPYRPR

SEQ ID NO: 40007 - protein, 15 aa, BK virus
YASRAGVTVPYRPRS

SEQ ID NO: 40008 - protein, 15 aa, BK virus
ASRAGVTVPYRPRSK

SEQ ID NO: 40009 - protein, 15 aa, BK virus
SRAGVTVPYRPRSKG

SEQ ID NO: 40010 - protein, 15 aa, BK virus
RAGVTVPYRPRSKGN

SEQ ID NO: 40011 - protein, 15 aa, BK virus
AGVTVPYRPRSKGNI

SEQ ID NO: 40012 - protein, 15 aa, BK virus
GVTVPYRPRSKGNIH

SEQ ID NO: 40013 - protein, 15 aa, BK virus
LAPPGAIVFSINSPE

SEQ ID NO: 40014 - protein, 15 aa, BK virus
APPGAIVFSINSPEC

SEQ ID NO: 40015 - protein, 15 aa, BK virus
PPGAIVFSINSPECT

SEQ ID NO: 40016 - protein, 15 aa, BK virus
PGAIVFSINSPECTL

SEQ ID NO: 40017 - protein, 15 aa, BK virus
GAIVFSINSPECTLC

SEQ ID NO: 40018 - protein, 15 aa, BK virus
FLKSILCVTSSILSA

SEQ ID NO: 40019 - protein, 15 aa, BK virus
LKSILCVTSSILSAS

SEQ ID NO: 40020 - protein, 15 aa, BK virus
KSILCVTSSILSASS

SEQ ID NO: 40021 - protein, 15 aa, BK virus
SILCVTSSILSASSI

SEQ ID NO: 40022 - protein, 15 aa, BK virus
ILCVTSSILSASSIL

SEQ ID NO: 40023 - protein, 15 aa, BK virus
VWPKCTRVPSLSATC

SEQ ID NO: 40024 - protein, 15 aa, BK virus
WPKCTRVPSLSATCL

SEQ ID NO: 40025 - protein, 15 aa, BK virus
PKCTRVPSLSATCLT

SEQ ID NO: 40026 - protein, 15 aa, BK virus
KCTRVPSLSATCLTI

SEQ ID NO: 40027 - protein, 15 aa, BK virus
CTRVPSLSATCLTIE

SEQ ID NO: 40028 - protein, 15 aa, BK virus
TRVPSLSATCLTIEG

SEQ ID NO: 40029 - protein, 15 aa, BK virus
RVPSLSATCLTIEGL

SEQ ID NO: 40030 - protein, 15 aa, BK virus
VPSLSATCLTIEGLI

SEQ ID NO: 40031 - protein, 15 aa, BK virus
PSLSATCLTIEGLIG

SEQ ID NO: 40032 - protein, 15 aa, BK virus
SLSATCLTIEGLIGE

SEQ ID NO: 40033 - protein, 15 aa, BK virus
LSATCLTIEGLIGER

SEQ ID NO: 40034 - protein, 15 aa, BK virus
SATCLTIEGLIGERS

SEQ ID NO: 40035 - protein, 15 aa, BK virus
ATCLTIEGLIGERSE

SEQ ID NO: 40036 - protein, 15 aa, BK virus
KFIGAFTIVQVVSSK

SEQ ID NO: 40037 - protein, 15 aa, BK virus
FIGAFTIVQVVSSKN

SEQ ID NO: 40038 - protein, 15 aa, BK virus
IGAFTIVQVVSSKNL

SEQ ID NO: 40039 - protein, 15 aa, BK virus
GAFTIVQVVSSKNLA

SEQ ID NO: 40040 - protein, 15 aa, BK virus
AFTIVQVVSSKNLAK

SEQ ID NO: 40041 - protein, 15 aa, BK virus
FTIVQVVSSKNLAKE

SEQ ID NO: 40042 - protein, 15 aa, BK virus
TIVQVVSSKNLAKES

SEQ ID NO: 40043 - protein, 15 aa, BK virus
IVQVVSSKNLAKESL

SEQ ID NO: 40044 - protein, 15 aa, BK virus
VQVVSSKNLAKESLK

SEQ ID NO: 40045 - protein, 15 aa, BK virus
QVVSSKNLAKESLKN

SEQ ID NO: 40046 - protein, 15 aa, BK virus
VVSSKNLAKESLKNL

SEQ ID NO: 40047 - protein, 15 aa, BK virus
VSSKNLAKESLKNLS

SEQ ID NO: 40048 - protein, 15 aa, BK virus
SSKNLAKESLKNLSV

SEQ ID NO: 40049 - protein, 15 aa, BK virus
SKNLAKESLKNLSVL

SEQ ID NO: 40050 - protein, 15 aa, BK virus
KNLAKESLKNLSVLL

SEQ ID NO: 40051 - protein, 15 aa, BK virus
NLAKESLKNLSVLLC

SEQ ID NO: 40052 - protein, 15 aa, BK virus
LAKESLKNLSVLLCN

SEQ ID NO: 40053 - protein, 15 aa, BK virus
AKESLKNLSVLLCNS

SEQ ID NO: 40054 - protein, 15 aa, BK virus
KESLKNLSVLLCNSC

SEQ ID NO: 40055 - protein, 15 aa, BK virus
ESLKNLSVLLCNSCE

SEQ ID NO: 40056 - protein, 15 aa, BK virus
SLKNLSVLLCNSCEV

SEQ ID NO: 40057 - protein, 15 aa, BK virus
LKNLSVLLCNSCEVI

SEQ ID NO: 40058 - protein, 15 aa, BK virus
KNLSVLLCNSCEVIE

SEQ ID NO: 40059 - protein, 15 aa, BK virus
NLSVLLCNSCEVIEG

SEQ ID NO: 40060 - protein, 15 aa, BK virus
LSVLLCNSCEVIEGI

SEQ ID NO: 40061 - protein, 15 aa, BK virus
SVLLCNSCEVIEGIS

SEQ ID NO: 40062 - protein, 15 aa, BK virus
VLLCNSCEVIEGISS

SEQ ID NO: 40063 - protein, 15 aa, BK virus
LLCNSCEVIEGISSL

SEQ ID NO: 40064 - protein, 15 aa, BK virus
LCNSCEVIEGISSLI

SEQ ID NO: 40065 - protein, 15 aa, BK virus
CNSCEVIEGISSLIT

SEQ ID NO: 40066 - protein, 15 aa, BK virus
NSCEVIEGISSLITC

SEQ ID NO: 40067 - protein, 15 aa, BK virus
SCEVIEGISSLITCH

SEQ ID NO: 40068 - protein, 15 aa, BK virus
CEVIEGISSLITCHK

SEQ ID NO: 40069 - protein, 15 aa, BK virus
EVIEGISSLITCHKA

SEQ ID NO: 40070 - protein, 15 aa, BK virus
VIEGISSLITCHKAW

SEQ ID NO: 40071 - protein, 15 aa, BK virus
IEGISSLITCHKAWE

SEQ ID NO: 40072 - protein, 15 aa, BK virus
EGISSLITCHKAWEI

SEQ ID NO: 40073 - protein, 15 aa, BK virus
GISSLITCHKAWEIV

SEQ ID NO: 40074 - protein, 15 aa, BK virus
ISSLITCHKAWEIVA

SEQ ID NO: 40075 - protein, 15 aa, BK virus
SSLITCHKAWEIVAN

SEQ ID NO: 40076 - protein, 15 aa, BK virus
SLITCHKAWEIVANK

SEQ ID NO: 40077 - protein, 15 aa, BK virus
LITCHKAWEIVANKE

SEQ ID NO: 40078 - protein, 15 aa, BK virus
ITCHKAWEIVANKEG

SEQ ID NO: 40079 - protein, 15 aa, BK virus
TCHKAWEIVANKEGP

SEQ ID NO: 40080 - protein, 15 aa, BK virus
CHKAWEIVANKEGPQ

SEQ ID NO: 40081 - protein, 15 aa, BK virus
HKAWEIVANKEGPQC

SEQ ID NO: 40082 - protein, 15 aa, BK virus
KAWEIVANKEGPQCL

SEQ ID NO: 40083 - protein, 15 aa, BK virus
AWEIVANKEGPQCLG

SEQ ID NO: 40084 - protein, 15 aa, BK virus
WEIVANKEGPQCLGS

SEQ ID NO: 40085 - protein, 15 aa, BK virus
EIVANKEGPQCLGSR

SEQ ID NO: 40086 - protein, 15 aa, BK virus
IVANKEGPQCLGSRY

SEQ ID NO: 40087 - protein, 15 aa, BK virus
IKAANPAIAPGAPAI

SEQ ID NO: 40088 - protein, 15 aa, BK virus
KAANPAIAPGAPAIT

SEQ ID NO: 40089 - protein, 15 aa, BK virus
AANPAIAPGAPAITA

SEQ ID NO: 40090 - protein, 15 aa, BK virus
ANPAIAPGAPAITAY

SEQ ID NO: 40091 - protein, 15 aa, BK virus
NPAIAPGAPAITAYV

SEQ ID NO: 40092 - protein, 15 aa, BK virus
GVRPIAAIASEVLVM

SEQ ID NO: 40093 - protein, 15 aa, BK virus
VRPIAAIASEVLVMP

SEQ ID NO: 40094 - protein, 15 aa, BK virus
RPIAAIASEVLVMPS

SEQ ID NO: 40095 - protein, 15 aa, BK virus
PIAAIASEVLVMPST

SEQ ID NO: 40096 - protein, 15 aa, BK virus
IAAIASEVLVMPSTV

SEQ ID NO: 40097 - protein, 15 aa, BK virus
AAIASEVLVMPSTVA

SEQ ID NO: 40098 - protein, 15 aa, BK virus
AIASEVLVMPSTVAR

SEQ ID NO: 40099 - protein, 15 aa, BK virus
IASEVLVMPSTVARD

SEQ ID NO: 40100 - protein, 15 aa, BK virus
ASEVLVMPSTVARDA

SEQ ID NO: 40101 - protein, 15 aa, BK virus
SEVLVMPSTVARDAI

SEQ ID NO: 40102 - protein, 15 aa, BK virus
TSIAAAASPAAISAT

SEQ ID NO: 40103 - protein, 15 aa, BK virus
SIAAAASPAAISATE

SEQ ID NO: 40104 - protein, 15 aa, BK virus
IAAAASPAAISATEN

SEQ ID NO: 40105 - protein, 15 aa, BK virus
AAAASPAAISATENP

SEQ ID NO: 40106 - protein, 15 aa, BK virus
AAASPAAISATENPV

SEQ ID NO: 40107 - protein, 15 aa, BK virus
AASPAAISATENPVA

SEQ ID NO: 40108 - protein, 15 aa, BK virus
ASPAAISATENPVAA

SEQ ID NO: 40109 - protein, 15 aa, BK virus
SPAAISATENPVAAA

SEQ ID NO: 40110 - protein, 15 aa, BK virus
PAAISATENPVAAAA

SEQ ID NO: 40111 - protein, 15 aa, BK virus
AAISATENPVAAAAS

SEQ ID NO: 40112 - protein, 15 aa, BK virus
AISATENPVAAAASD

SEQ ID NO: 40113 - protein, 15 aa, BK virus
ISATENPVAAAASDT

SEQ ID NO: 40114 - protein, 15 aa, BK virus
SATENPVAAAASDTL

SEQ ID NO: 40115 - protein, 15 aa, BK virus
ATENPVAAAASDTLA

SEQ ID NO: 40116 - protein, 15 aa, BK virus
TENPVAAAASDTLAT

SEQ ID NO: 40117 - protein, 15 aa, BK virus
ENPVAAAASDTLATR

SEQ ID NO: 40118 - protein, 15 aa, BK virus
NPVAAAASDTLATRS

SEQ ID NO: 40119 - protein, 15 aa, BK virus
PVAAAASDTLATRSP

SEQ ID NO: 40120 - protein, 15 aa, BK virus
VAAAASDTLATRSPK

SEQ ID NO: 40121 - protein, 15 aa, BK virus
AAAASDTLATRSPKS

SEQ ID NO: 40122 - protein, 15 aa, BK virus
AAASDTLATRSPKSA

SEQ ID NO: 40123 - protein, 15 aa, BK virus
AASDTLATRSPKSAR

SEQ ID NO: 40124 - protein, 15 aa, BK virus
ASDTLATRSPKSARA

SEQ ID NO: 40125 - protein, 15 aa, BK virus
SDTLATRSPKSARAA

SEQ ID NO: 40126 - protein, 15 aa, BK virus
DTLATRSPKSARAAP

SEQ ID NO: 40127 - protein, 15 aa, BK virus
TLATRSPKSARAAPM

SEQ ID NO: 40128 - protein, 15 aa, BK virus
LATRSPKSARAAPMN

SEQ ID NO: 40129 - protein, 15 aa, BK virus
ATRSPKSARAAPMNL

SEQ ID NO: 40130 - protein, 15 aa, BK virus
TRSPKSARAAPMNLE

SEQ ID NO: 40131 - protein, 15 aa, BK virus
RSPKSARAAPMNLEI

SEQ ID NO: 40132 - protein, 15 aa, BK virus
SPKSARAAPMNLEIQ

SEQ ID NO: 40133 - protein, 15 aa, BK virus
PKSARAAPMNLEIQK

SEQ ID NO: 40134 - protein, 15 aa, BK virus
KSARAAPMNLEIQKK

SEQ ID NO: 40135 - protein, 15 aa, BK virus
SARAAPMNLEIQKKR

SEQ ID NO: 40136 - protein, 15 aa, BK virus
ARAAPMNLEIQKKRD

SEQ ID NO: 40137 - protein, 15 aa, BK virus
RAAPMNLEIQKKRDY

SEQ ID NO: 40138 - protein, 15 aa, BK virus
AAPMNLEIQKKRDYL

SEQ ID NO: 40139 - protein, 15 aa, BK virus
APMNLEIQKKRDYLP

SEQ ID NO: 40140 - protein, 15 aa, BK virus
PMNLEIQKKRDYLPR

SEQ ID NO: 40141 - protein, 15 aa, BK virus
MNLEIQKKRDYLPRS

SEQ ID NO: 40142 - protein, 15 aa, BK virus
NLEIQKKRDYLPRSL

SEQ ID NO: 40143 - protein, 15 aa, BK virus
LEIQKKRDYLPRSLL

SEQ ID NO: 40144 - protein, 15 aa, BK virus
EIQKKRDYLPRSLLQ

SEQ ID NO: 40145 - protein, 15 aa, BK virus
IQKKRDYLPRSLLQS

SEQ ID NO: 40146 - protein, 15 aa, BK virus
QKKRDYLPRSLLQSL

SEQ ID NO: 40147 - protein, 15 aa, BK virus
KKRDYLPRSLLQSLL

SEQ ID NO: 40148 - protein, 15 aa, BK virus
KRDYLPRSLLQSLLQ

SEQ ID NO: 40149 - protein, 15 aa, BK virus
RDYLPRSLLQSLLQQ

SEQ ID NO: 40150 - protein, 15 aa, BK virus
DYLPRSLLQSLLQQV

SEQ ID NO: 40151 - protein, 15 aa, BK virus
YLPRSLLQSLLQQVK

SEQ ID NO: 40152 - protein, 15 aa, BK virus
LPRSLLQSLLQQVKQ

SEQ ID NO: 40153 - protein, 15 aa, BK virus
PRSLLQSLLQQVKQW

SEQ ID NO: 40154 - protein, 15 aa, BK virus
RSLLQSLLQQVKQWY

SEQ ID NO: 40155 - protein, 15 aa, BK virus
SLLQSLLQQVKQWYF

SEQ ID NO: 40156 - protein, 15 aa, BK virus
LLQSLLQQVKQWYFC

SEQ ID NO: 40157 - protein, 15 aa, BK virus
LQSLLQQVKQWYFCF

SEQ ID NO: 40158 - protein, 15 aa, BK virus
QSLLQQVKQWYFCFS

SEQ ID NO: 40159 - protein, 15 aa, BK virus
SLLQQVKQWYFCFSR

SEQ ID NO: 40160 - protein, 15 aa, BK virus
LLQQVKQWYFCFSRL

SEQ ID NO: 40161 - protein, 15 aa, BK virus
LQQVKQWYFCFSRLH

SEQ ID NO: 40162 - protein, 15 aa, BK virus
QQVKQWYFCFSRLHC

SEQ ID NO: 40163 - protein, 15 aa, BK virus
QVKQWYFCFSRLHCL

SEQ ID NO: 40164 - protein, 15 aa, BK virus
VKQWYFCFSRLHCLH

SEQ ID NO: 40165 - protein, 15 aa, BK virus
KQWYFCFSRLHCLHL

SEQ ID NO: 40166 - protein, 15 aa, BK virus
QWYFCFSRLHCLHLY

SEQ ID NO: 40167 - protein, 15 aa, BK virus
WYFCFSRLHCLHLYK

SEQ ID NO: 40168 - protein, 15 aa, BK virus
YFCFSRLHCLHLYKI

SEQ ID NO: 40169 - protein, 15 aa, BK virus
FCFSRLHCLHLYKIP

SEQ ID NO: 40170 - protein, 15 aa, BK virus
CFSRLHCLHLYKIPA

SEQ ID NO: 40171 - protein, 15 aa, BK virus
FSRLHCLHLYKIPAK

SEQ ID NO: 40172 - protein, 15 aa, BK virus
SRLHCLHLYKIPAKA

SEQ ID NO: 40173 - protein, 15 aa, BK virus
RLHCLHLYKIPAKAL

SEQ ID NO: 40174 - protein, 15 aa, BK virus
LHCLHLYKIPAKALK

SEQ ID NO: 40175 - protein, 15 aa, BK virus
KSSELFFLFQSRFYQ

SEQ ID NO: 40176 - protein, 15 aa, BK virus
SSELFFLFQSRFYQL

SEQ ID NO: 40177 - protein, 15 aa, BK virus
SELFFLFQSRFYQLS

SEQ ID NO: 40178 - protein, 15 aa, BK virus
ELFFLFQSRFYQLSL

SEQ ID NO: 40179 - protein, 15 aa, BK virus
LFFLFQSRFYQLSLK

SEQ ID NO: 40180 - protein, 15 aa, BK virus
FFLFQSRFYQLSLKL

SEQ ID NO: 40181 - protein, 15 aa, BK virus
FLFQSRFYQLSLKLV

SEQ ID NO: 40182 - protein, 15 aa, BK virus
LFQSRFYQLSLKLVV

SEQ ID NO: 40183 - protein, 15 aa, BK virus
FQSRFYQLSLKLVVT

SEQ ID NO: 40184 - protein, 15 aa, BK virus
QSRFYQLSLKLVVTA

SEQ ID NO: 40185 - protein, 15 aa, BK virus
SRFYQLSLKLVVTAG

SEQ ID NO: 40186 - protein, 15 aa, BK virus
RFYQLSLKLVVTAGA

SEQ ID NO: 40187 - protein, 15 aa, BK virus
FYQLSLKLVVTAGAE

SEQ ID NO: 40188 - protein, 15 aa, BK virus
YQLSLKLVVTAGAEP

SEQ ID NO: 40189 - protein, 15 aa, BK virus
QLSLKLVVTAGAEPW

SEQ ID NO: 40190 - protein, 15 aa, BK virus
LSLKLVVTAGAEPWP

SEQ ID NO: 40191 - protein, 15 aa, BK virus
SLKLVVTAGAEPWPL

SEQ ID NO: 40192 - protein, 15 aa, BK virus
LKLVVTAGAEPWPLS

SEQ ID NO: 40193 - protein, 15 aa, BK virus
KLVVTAGAEPWPLSS

SEQ ID NO: 40194 - protein, 15 aa, BK virus
LVVTAGAEPWPLSSL

SEQ ID NO: 40195 - protein, 15 aa, BK virus
VVTAGAEPWPLSSLT

SEQ ID NO: 40196 - protein, 15 aa, BK virus
VTAGAEPWPLSSLTG

SEQ ID NO: 40197 - protein, 15 aa, BK virus
TAGAEPWPLSSLTGD

SEQ ID NO: 40198 - protein, 15 aa, BK virus
AGAEPWPLSSLTGDK

SEQ ID NO: 40199 - protein, 15 aa, BK virus
GAEPWPLSSLTGDKA

SEQ ID NO: 40200 - protein, 15 aa, BK virus
AEPWPLSSLTGDKAK

SEQ ID NO: 40201 - protein, 15 aa, BK virus
EPWPLSSLTGDKAKI

SEQ ID NO: 40202 - protein, 15 aa, BK virus
PWPLSSLTGDKAKIP

SEQ ID NO: 40203 - protein, 15 aa, BK virus
WPLSSLTGDKAKIPR

SEQ ID NO: 40204 - protein, 15 aa, BK virus
PLSSLTGDKAKIPRL

SEQ ID NO: 40205 - protein, 15 aa, BK virus
LSSLTGDKAKIPRLA

SEQ ID NO: 40206 - protein, 15 aa, BK virus
SSLTGDKAKIPRLAK

SEQ ID NO: 40207 - protein, 15 aa, BK virus
SLTGDKAKIPRLAKH

SEQ ID NO: 40208 - protein, 15 aa, BK virus
LTGDKAKIPRLAKHV

SEQ ID NO: 40209 - protein, 15 aa, BK virus
TGDKAKIPRLAKHVC

SEQ ID NO: 40210 - protein, 15 aa, BK virus
GDKAKIPRLAKHVCH

SEQ ID NO: 40211 - protein, 15 aa, BK virus
DKAKIPRLAKHVCHA

SEQ ID NO: 40212 - protein, 15 aa, BK virus
KAKIPRLAKHVCHAL

SEQ ID NO: 40213 - protein, 15 aa, BK virus
AKIPRLAKHVCHALS

SEQ ID NO: 40214 - protein, 15 aa, BK virus
KIPRLAKHVCHALSF

SEQ ID NO: 40215 - protein, 15 aa, BK virus
IPRLAKHVCHALSFL

SEQ ID NO: 40216 - protein, 15 aa, BK virus
PRLAKHVCHALSFLR

SEQ ID NO: 40217 - protein, 15 aa, BK virus
RLAKHVCHALSFLRS

SEQ ID NO: 40218 - protein, 15 aa, BK virus
LAKHVCHALSFLRSW

SEQ ID NO: 40219 - protein, 15 aa, BK virus
AKHVCHALSFLRSWF

SEQ ID NO: 40220 - protein, 15 aa, BK virus
KHVCHALSFLRSWFG

SEQ ID NO: 40221 - protein, 15 aa, BK virus
HVCHALSFLRSWFGC

SEQ ID NO: 40222 - protein, 15 aa, BK virus
VCHALSFLRSWFGCI

SEQ ID NO: 40223 - protein, 15 aa, BK virus
CHALSFLRSWFGCIP

SEQ ID NO: 40224 - protein, 15 aa, BK virus
HALSFLRSWFGCIPW

SEQ ID NO: 40225 - protein, 15 aa, BK virus
ALSFLRSWFGCIPWV

SEQ ID NO: 40226 - protein, 15 aa, BK virus
LSFLRSWFGCIPWVS

SEQ ID NO: 40227 - protein, 15 aa, BK virus
SFLRSWFGCIPWVSS

SEQ ID NO: 40228 - protein, 15 aa, BK virus
FLRSWFGCIPWVSSS

SEQ ID NO: 40229 - protein, 15 aa, BK virus
LRSWFGCIPWVSSSS

SEQ ID NO: 40230 - protein, 15 aa, BK virus
RSWFGCIPWVSSSSL

SEQ ID NO: 40231 - protein, 15 aa, BK virus
GHGLAAFPCESCTFL

SEQ ID NO: 40232 - protein, 15 aa, BK virus
HGLAAFPCESCTFLP

SEQ ID NO: 40233 - protein, 15 aa, BK virus
GLAAFPCESCTFLPE

SEQ ID NO: 40234 - protein, 15 aa, BK virus
LAAFPCESCTFLPEV

SEQ ID NO: 40235 - protein, 15 aa, BK virus
AAFPCESCTFLPEVM

SEQ ID NO: 40236 - protein, 15 aa, BK virus
AFPCESCTFLPEVMV

SEQ ID NO: 40237 - protein, 15 aa, BK virus
FPCESCTFLPEVMVW

SEQ ID NO: 40238 - protein, 15 aa, BK virus
PCESCTFLPEVMVWL

SEQ ID NO: 40239 - protein, 15 aa, BK virus
CESCTFLPEVMVWLH

SEQ ID NO: 40240 - protein, 15 aa, BK virus
ESCTFLPEVMVWLHS

SEQ ID NO: 40241 - protein, 15 aa, BK virus
SCTFLPEVMVWLHSM

SEQ ID NO: 40242 - protein, 15 aa, BK virus
CTFLPEVMVWLHSMG

SEQ ID NO: 40243 - protein, 15 aa, BK virus
TFLPEVMVWLHSMGK

SEQ ID NO: 40244 - protein, 15 aa, BK virus
FLPEVMVWLHSMGKQ

SEQ ID NO: 40245 - protein, 15 aa, BK virus
LPEVMVWLHSMGKQL

SEQ ID NO: 40246 - protein, 15 aa, BK virus
PEVMVWLHSMGKQLL

SEQ ID NO: 40247 - protein, 15 aa, BK virus
EVMVWLHSMGKQLLP

SEQ ID NO: 40248 - protein, 15 aa, BK virus
VMVWLHSMGKQLLPV

SEQ ID NO: 40249 - protein, 15 aa, BK virus
MVWLHSMGKQLLPVA

SEQ ID NO: 40250 - protein, 15 aa, BK virus
VWLHSMGKQLLPVAF

SEQ ID NO: 40251 - protein, 15 aa, BK virus
WLHSMGKQLLPVAFF

SEQ ID NO: 40252 - protein, 15 aa, BK virus
LHSMGKQLLPVAFFF

SEQ ID NO: 40253 - protein, 15 aa, BK virus
HSMGKQLLPVAFFFI

SEQ ID NO: 40254 - protein, 15 aa, BK virus
SMGKQLLPVAFFFII

SEQ ID NO: 40255 - protein, 15 aa, BK virus
MGKQLLPVAFFFIIY

SEQ ID NO: 40256 - protein, 15 aa, BK virus
GKQLLPVAFFFIIYK

SEQ ID NO: 40257 - protein, 15 aa, BK virus
KQLLPVAFFFIIYKR

SEQ ID NO: 40258 - protein, 15 aa, BK virus
QLLPVAFFFIIYKRP

SEQ ID NO: 40259 - protein, 15 aa, BK virus
LLPVAFFFIIYKRPR

SEQ ID NO: 40260 - protein, 15 aa, BK virus
LPVAFFFIIYKRPRP

SEQ ID NO: 40261 - protein, 15 aa, BK virus
PVAFFFIIYKRPRPP

SEQ ID NO: 40262 - protein, 15 aa, BK virus
VAFFFIIYKRPRPPL

SEQ ID NO: 40263 - protein, 15 aa, BK virus
AFFFIIYKRPRPPLP

SEQ ID NO: 40264 - protein, 15 aa, BK virus
FFFIIYKRPRPPLPP

SEQ ID NO: 40265 - protein, 15 aa, BK virus
FFIIYKRPRPPLPPP

SEQ ID NO: 40266 - protein, 15 aa, BK virus
FIIYKRPRPPLPPPF

SEQ ID NO: 40267 - protein, 15 aa, BK virus
IIYKRPRPPLPPPFL

SEQ ID NO: 40268 - protein, 15 aa, BK virus
IYKRPRPPLPPPFLS

SEQ ID NO: 40269 - protein, 15 aa, BK virus
YKRPRPPLPPPFLSS

SEQ ID NO: 40270 - protein, 15 aa, BK virus
KRPRPPLPPPFLSSS

SEQ ID NO: 40271 - protein, 15 aa, BK virus
RPRPPLPPPFLSSSK

SEQ ID NO: 40272 - protein, 15 aa, BK virus
PRPPLPPPFLSSSKG

SEQ ID NO: 40273 - protein, 15 aa, BK virus
RPPLPPPFLSSSKGV

SEQ ID NO: 40274 - protein, 15 aa, BK virus
PPLPPPFLSSSKGVE

SEQ ID NO: 40275 - protein, 15 aa, BK virus
PLPPPFLSSSKGVEA

SEQ ID NO: 40276 - protein, 15 aa, BK virus
LPPPFLSSSKGVEAF

SEQ ID NO: 40277 - protein, 15 aa, BK virus
PPPFLSSSKGVEAFS

SEQ ID NO: 40278 - protein, 15 aa, BK virus
PPFLSSSKGVEAFSE

SEQ ID NO: 40279 - protein, 15 aa, BK virus
PFLSSSKGVEAFSEA

SEQ ID NO: 40280 - protein, 15 aa, BK virus
QNYLGKSLFFCNFCK

SEQ ID NO: 40281 - protein, 16 aa, BK virus
WIKFLTGKNPWSSWTF

SEQ ID NO: 40282 - protein, 16 aa, BK virus
GSVRNFTLTKGATRIK

SEQ ID NO: 40283 - protein, 16 aa, BK virus
LISLILEPGVAQRFVL

SEQ ID NO: 40284 - protein, 16 aa, BK virus
ISLILEPGVAQRFVLI

SEQ ID NO: 40285 - protein, 16 aa, BK virus
SLILEPGVAQRFVLIF

SEQ ID NO: 40286 - protein, 16 aa, BK virus
LILEPGVAQRFVLIFL

SEQ ID NO: 40287 - protein, 16 aa, BK virus
ILEPGVAQRFVLIFLF

SEQ ID NO: 40288 - protein, 16 aa, BK virus
LEPGVAQRFVLIFLFA

SEQ ID NO: 40289 - protein, 16 aa, BK virus
EPGVAQRFVLIFLFAQ

SEQ ID NO: 40290 - protein, 16 aa, BK virus
PGVAQRFVLIFLFAQI

SEQ ID NO: 40291 - protein, 16 aa, BK virus
GVAQRFVLIFLFAQIP

SEQ ID NO: 40292 - protein, 16 aa, BK virus
VAQRFVLIFLFAQIPC

SEQ ID NO: 40293 - protein, 16 aa, BK virus
AQRFVLIFLFAQIPCT

SEQ ID NO: 40294 - protein, 16 aa, BK virus
QRFVLIFLFAQIPCTA

SEQ ID NO: 40295 - protein, 16 aa, BK virus
RFVLIFLFAQIPCTAR

SEQ ID NO: 40296 - protein, 16 aa, BK virus
FVLIFLFAQIPCTARN

SEQ ID NO: 40297 - protein, 16 aa, BK virus
VLIFLFAQIPCTARNG

SEQ ID NO: 40298 - protein, 16 aa, BK virus
LIFLFAQIPCTARNGL

SEQ ID NO: 40299 - protein, 16 aa, BK virus
IFLFAQIPCTARNGLF

SEQ ID NO: 40300 - protein, 16 aa, BK virus
FLFAQIPCTARNGLFV

SEQ ID NO: 40301 - protein, 16 aa, BK virus
LFAQIPCTARNGLFVP

SEQ ID NO: 40302 - protein, 16 aa, BK virus
FAQIPCTARNGLFVPK

SEQ ID NO: 40303 - protein, 16 aa, BK virus
AQIPCTARNGLFVPKS

SEQ ID NO: 40304 - protein, 16 aa, BK virus
QIPCTARNGLFVPKSL

SEQ ID NO: 40305 - protein, 16 aa, BK virus
IPCTARNGLFVPKSLL

SEQ ID NO: 40306 - protein, 16 aa, BK virus
PCTARNGLFVPKSLLC

SEQ ID NO: 40307 - protein, 16 aa, BK virus
CTARNGLFVPKSLLCT

SEQ ID NO: 40308 - protein, 16 aa, BK virus
TARNGLFVPKSLLCTA

SEQ ID NO: 40309 - protein, 16 aa, BK virus
ARNGLFVPKSLLCTAL

SEQ ID NO: 40310 - protein, 16 aa, BK virus
RNGLFVPKSLLCTALA

SEQ ID NO: 40311 - protein, 16 aa, BK virus
NGLFVPKSLLCTALAC

SEQ ID NO: 40312 - protein, 16 aa, BK virus
GLFVPKSLLCTALACY

SEQ ID NO: 40313 - protein, 16 aa, BK virus
LFVPKSLLCTALACYV

SEQ ID NO: 40314 - protein, 16 aa, BK virus
FVPKSLLCTALACYVS

SEQ ID NO: 40315 - protein, 16 aa, BK virus
VPKSLLCTALACYVSL

SEQ ID NO: 40316 - protein, 16 aa, BK virus
PKSLLCTALACYVSLD

SEQ ID NO: 40317 - protein, 16 aa, BK virus
VIIFFIGANLWNRRVG

SEQ ID NO: 40318 - protein, 16 aa, BK virus
IIFFIGANLWNRRVGV

SEQ ID NO: 40319 - protein, 16 aa, BK virus
IFFIGANLWNRRVGVL

SEQ ID NO: 40320 - protein, 16 aa, BK virus
FFIGANLWNRRVGVLV

SEQ ID NO: 40321 - protein, 16 aa, BK virus
FIGANLWNRRVGVLVE

SEQ ID NO: 40322 - protein, 16 aa, BK virus
IGANLWNRRVGVLVEF

SEQ ID NO: 40323 - protein, 16 aa, BK virus
GANLWNRRVGVLVEFL

SEQ ID NO: 40324 - protein, 16 aa, BK virus
RSNSRFSTLNTTQKKK

SEQ ID NO: 40325 - protein, 16 aa, BK virus
SNSRFSTLNTTQKKKK

SEQ ID NO: 40326 - protein, 16 aa, BK virus
NSRFSTLNTTQKKKKG

SEQ ID NO: 40327 - protein, 16 aa, BK virus
SRFSTLNTTQKKKKGR

SEQ ID NO: 40328 - protein, 16 aa, BK virus
RFSTLNTTQKKKKGRR

SEQ ID NO: 40329 - protein, 16 aa, BK virus
FSTLNTTQKKKKGRRP

SEQ ID NO: 40330 - protein, 16 aa, BK virus
RSIPYYRRKHSRGLKG

SEQ ID NO: 40331 - protein, 16 aa, BK virus
SIPYYRRKHSRGLKGA

SEQ ID NO: 40332 - protein, 16 aa, BK virus
GCVFIIRYVFRISIQC

SEQ ID NO: 40333 - protein, 16 aa, BK virus
CVFIIRYVFRISIQCR

SEQ ID NO: 40334 - protein, 16 aa, BK virus
VFIIRYVFRISIQCRG

SEQ ID NO: 40335 - protein, 16 aa, BK virus
FIIRYVFRISIQCRGV

SEQ ID NO: 40336 - protein, 16 aa, BK virus
KKSRYPSYDQGRNANR

SEQ ID NO: 40337 - protein, 16 aa, BK virus
KSRYPSYDQGRNANRK

SEQ ID NO: 40338 - protein, 16 aa, BK virus
SRYPSYDQGRNANRKI

SEQ ID NO: 40339 - protein, 16 aa, BK virus
RYPSYDQGRNANRKIQ

SEQ ID NO: 40340 - protein, 16 aa, BK virus
YPSYDQGRNANRKIQS

SEQ ID NO: 40341 - protein, 16 aa, BK virus
PSYDQGRNANRKIQSY

SEQ ID NO: 40342 - protein, 16 aa, BK virus
SYDQGRNANRKIQSYI

SEQ ID NO: 40343 - protein, 16 aa, BK virus
YDQGRNANRKIQSYIR

SEQ ID NO: 40344 - protein, 16 aa, BK virus
NGFNIWSSWKCCTRTI

SEQ ID NO: 40345 - protein, 16 aa, BK virus
GFNIWSSWKCCTRTIY

SEQ ID NO: 40346 - protein, 16 aa, BK virus
FNIWSSWKCCTRTIYG

SEQ ID NO: 40347 - protein, 16 aa, BK virus
NIWSSWKCCTRTIYGR

SEQ ID NO: 40348 - protein, 16 aa, BK virus
IWSSWKCCTRTIYGRC

SEQ ID NO: 40349 - protein, 16 aa, BK virus
WSSWKCCTRTIYGRCC

SEQ ID NO: 40350 - protein, 16 aa, BK virus
SSWKCCTRTIYGRCCL

SEQ ID NO: 40351 - protein, 16 aa, BK virus
SWKCCTRTIYGRCCLA

SEQ ID NO: 40352 - protein, 16 aa, BK virus
WKCCTRTIYGRCCLAA

SEQ ID NO: 40353 - protein, 16 aa, BK virus
KCCTRTIYGRCCLAAL

SEQ ID NO: 40354 - protein, 16 aa, BK virus
CCTRTIYGRCCLAALF

SEQ ID NO: 40355 - protein, 16 aa, BK virus
CTRTIYGRCCLAALFA

SEQ ID NO: 40356 - protein, 16 aa, BK virus
TRTIYGRCCLAALFAT

SEQ ID NO: 40357 - protein, 16 aa, BK virus
IKGFAFRTWNKQFRQF

SEQ ID NO: 40358 - protein, 16 aa, BK virus
KGFAFRTWNKQFRQFE

SEQ ID NO: 40359 - protein, 16 aa, BK virus
GFAFRTWNKQFRQFER

SEQ ID NO: 40360 - protein, 16 aa, BK virus
FAFRTWNKQFRQFERL

SEQ ID NO: 40361 - protein, 16 aa, BK virus
AFRTWNKQFRQFERLF

SEQ ID NO: 40362 - protein, 16 aa, BK virus
FRTWNKQFRQFERLFR

SEQ ID NO: 40363 - protein, 16 aa, BK virus
RTWNKQFRQFERLFRW

SEQ ID NO: 40364 - protein, 16 aa, BK virus
TWNKQFRQFERLFRWK

SEQ ID NO: 40365 - protein, 16 aa, BK virus
WNKQFRQFERLFRWKC

SEQ ID NO: 40366 - protein, 16 aa, BK virus
GKFRKETFKQKNPNIS

SEQ ID NO: 40367 - protein, 16 aa, BK virus
KFRKETFKQKNPNIST

SEQ ID NO: 40368 - protein, 16 aa, BK virus
FRKETFKQKNPNISTR

SEQ ID NO: 40369 - protein, 16 aa, BK virus
RKETFKQKNPNISTRL

SEQ ID NO: 40370 - protein, 16 aa, BK virus
KETFKQKNPNISTRLG

SEQ ID NO: 40371 - protein, 16 aa, BK virus
ETFKQKNPNISTRLGY

SEQ ID NO: 40372 - protein, 16 aa, BK virus
TFKQKNPNISTRLGYN

SEQ ID NO: 40373 - protein, 16 aa, BK virus
FKQKNPNISTRLGYNE

SEQ ID NO: 40374 - protein, 16 aa, BK virus
AQNIFKKILTKLRVLT

SEQ ID NO: 40375 - protein, 16 aa, BK virus
KKNFTKWNDLVATANL

SEQ ID NO: 40376 - protein, 16 aa, BK virus
KNFTKWNDLVATANLV

SEQ ID NO: 40377 - protein, 16 aa, BK virus
IPITMLFPSLRYFSPC

SEQ ID NO: 40378 - protein, 16 aa, BK virus
KHLFKAFWFAIVPVCQ

SEQ ID NO: 40379 - protein, 16 aa, BK virus
HLFKAFWFAIVPVCQY

SEQ ID NO: 40380 - protein, 16 aa, BK virus
LFKAFWFAIVPVCQYI

SEQ ID NO: 40381 - protein, 16 aa, BK virus
FKAFWFAIVPVCQYIL

SEQ ID NO: 40382 - protein, 16 aa, BK virus
KAFWFAIVPVCQYILS

SEQ ID NO: 40383 - protein, 16 aa, BK virus
AFWFAIVPVCQYILSY

SEQ ID NO: 40384 - protein, 16 aa, BK virus
FWFAIVPVCQYILSYL

SEQ ID NO: 40385 - protein, 16 aa, BK virus
WFAIVPVCQYILSYLG

SEQ ID NO: 40386 - protein, 16 aa, BK virus
FAIVPVCQYILSYLGP

SEQ ID NO: 40387 - protein, 16 aa, BK virus
AIVPVCQYILSYLGPL

SEQ ID NO: 40388 - protein, 16 aa, BK virus
IVPVCQYILSYLGPLE

SEQ ID NO: 40389 - protein, 16 aa, BK virus
VPVCQYILSYLGPLEV

SEQ ID NO: 40390 - protein, 16 aa, BK virus
PVCQYILSYLGPLEVF

SEQ ID NO: 40391 - protein, 16 aa, BK virus
VCQYILSYLGPLEVFL

SEQ ID NO: 40392 - protein, 16 aa, BK virus
CQYILSYLGPLEVFLC

SEQ ID NO: 40393 - protein, 16 aa, BK virus
QYILSYLGPLEVFLCH

SEQ ID NO: 40394 - protein, 16 aa, BK virus
YILSYLGPLEVFLCHQ

SEQ ID NO: 40395 - protein, 16 aa, BK virus
ILSYLGPLEVFLCHQT

SEQ ID NO: 40396 - protein, 16 aa, BK virus
LSYLGPLEVFLCHQTP

SEQ ID NO: 40397 - protein, 16 aa, BK virus
GHLAKRKLGKDSLQIF

SEQ ID NO: 40398 - protein, 16 aa, BK virus
HLAKRKLGKDSLQIFF

SEQ ID NO: 40399 - protein, 16 aa, BK virus
LAKRKLGKDSLQIFFS

SEQ ID NO: 40400 - protein, 16 aa, BK virus
AKRKLGKDSLQIFFSG

SEQ ID NO: 40401 - protein, 16 aa, BK virus
KRKLGKDSLQIFFSGG

SEQ ID NO: 40402 - protein, 16 aa, BK virus
RKLGKDSLQIFFSGGS

SEQ ID NO: 40403 - protein, 16 aa, BK virus
TGHKYQQLKHTGYQLY

SEQ ID NO: 40404 - protein, 16 aa, BK virus
GHKYQQLKHTGYQLYK

SEQ ID NO: 40405 - protein, 16 aa, BK virus
HKYQQLKHTGYQLYKE

SEQ ID NO: 40406 - protein, 16 aa, BK virus
KYQQLKHTGYQLYKEA

SEQ ID NO: 40407 - protein, 16 aa, BK virus
YQQLKHTGYQLYKEAP

SEQ ID NO: 40408 - protein, 16 aa, BK virus
QQLKHTGYQLYKEAPH

SEQ ID NO: 40409 - protein, 16 aa, BK virus
QLKHTGYQLYKEAPHP

SEQ ID NO: 40410 - protein, 16 aa, BK virus
LKHTGYQLYKEAPHPV

SEQ ID NO: 40411 - protein, 16 aa, BK virus
KHTGYQLYKEAPHPVH

SEQ ID NO: 40412 - protein, 16 aa, BK virus
HTGYQLYKEAPHPVHL

SEQ ID NO: 40413 - protein, 16 aa, BK virus
TGYQLYKEAPHPVHLA

SEQ ID NO: 40414 - protein, 16 aa, BK virus
GYQLYKEAPHPVHLAT

SEQ ID NO: 40415 - protein, 16 aa, BK virus
YQLYKEAPHPVHLATL

SEQ ID NO: 40416 - protein, 16 aa, BK virus
QLYKEAPHPVHLATLW

SEQ ID NO: 40417 - protein, 16 aa, BK virus
HFHFYWDQVPSTQLDK

SEQ ID NO: 40418 - protein, 16 aa, BK virus
FHFYWDQVPSTQLDKH

SEQ ID NO: 40419 - protein, 16 aa, BK virus
HFYWDQVPSTQLDKHC

SEQ ID NO: 40420 - protein, 16 aa, BK virus
FYWDQVPSTQLDKHCF

SEQ ID NO: 40421 - protein, 16 aa, BK virus
YWDQVPSTQLDKHCFC

SEQ ID NO: 40422 - protein, 16 aa, BK virus
WDQVPSTQLDKHCFCP

SEQ ID NO: 40423 - protein, 16 aa, BK virus
DQVPSTQLDKHCFCPN

SEQ ID NO: 40424 - protein, 16 aa, BK virus
QVPSTQLDKHCFCPNR

SEQ ID NO: 40425 - protein, 16 aa, BK virus
VPSTQLDKHCFCPNRP

SEQ ID NO: 40426 - protein, 16 aa, BK virus
PSTQLDKHCFCPNRPY

SEQ ID NO: 40427 - protein, 16 aa, BK virus
STQLDKHCFCPNRPYG

SEQ ID NO: 40428 - protein, 16 aa, BK virus
TQLDKHCFCPNRPYGQ

SEQ ID NO: 40429 - protein, 16 aa, BK virus
QLDKHCFCPNRPYGQY

SEQ ID NO: 40430 - protein, 16 aa, BK virus
LDKHCFCPNRPYGQYS

SEQ ID NO: 40431 - protein, 16 aa, BK virus
DKHCFCPNRPYGQYSL

SEQ ID NO: 40432 - protein, 16 aa, BK virus
KHCFCPNRPYGQYSLP

SEQ ID NO: 40433 - protein, 16 aa, BK virus
HCFCPNRPYGQYSLPG

SEQ ID NO: 40434 - protein, 16 aa, BK virus
CFCPNRPYGQYSLPGT

SEQ ID NO: 40435 - protein, 16 aa, BK virus
FCPNRPYGQYSLPGTG

SEQ ID NO: 40436 - protein, 16 aa, BK virus
CPNRPYGQYSLPGTGL

SEQ ID NO: 40437 - protein, 16 aa, BK virus
PNRPYGQYSLPGTGLL

SEQ ID NO: 40438 - protein, 16 aa, BK virus
NRPYGQYSLPGTGLLG

SEQ ID NO: 40439 - protein, 16 aa, BK virus
RPYGQYSLPGTGLLGF

SEQ ID NO: 40440 - protein, 16 aa, BK virus
YHQGTLTCNSLALPAF

SEQ ID NO: 40441 - protein, 16 aa, BK virus
HQGTLTCNSLALPAFP

SEQ ID NO: 40442 - protein, 16 aa, BK virus
QGTLTCNSLALPAFPR

SEQ ID NO: 40443 - protein, 16 aa, BK virus
GTLTCNSLALPAFPRV

SEQ ID NO: 40444 - protein, 16 aa, BK virus
TLTCNSLALPAFPRVL

SEQ ID NO: 40445 - protein, 16 aa, BK virus
LTCNSLALPAFPRVLH

SEQ ID NO: 40446 - protein, 16 aa, BK virus
TCNSLALPAFPRVLHL

SEQ ID NO: 40447 - protein, 16 aa, BK virus
CNSLALPAFPRVLHLQ

SEQ ID NO: 40448 - protein, 16 aa, BK virus
NSLALPAFPRVLHLQQ

SEQ ID NO: 40449 - protein, 16 aa, BK virus
SLALPAFPRVLHLQQR

SEQ ID NO: 40450 - protein, 16 aa, BK virus
LALPAFPRVLHLQQRS

SEQ ID NO: 40451 - protein, 16 aa, BK virus
ALPAFPRVLHLQQRSG

SEQ ID NO: 40452 - protein, 16 aa, BK virus
LPAFPRVLHLQQRSGN

SEQ ID NO: 40453 - protein, 16 aa, BK virus
PAFPRVLHLQQRSGNY

SEQ ID NO: 40454 - protein, 16 aa, BK virus
AFPRVLHLQQRSGNYC

SEQ ID NO: 40455 - protein, 16 aa, BK virus
FPRVLHLQQRSGNYCL

SEQ ID NO: 40456 - protein, 16 aa, BK virus
PRVLHLQQRSGNYCLE

SEQ ID NO: 40457 - protein, 16 aa, BK virus
VFLHHAHALFVTLHEG

SEQ ID NO: 40458 - protein, 16 aa, BK virus
PLFVQLQPPTSVDFHR

SEQ ID NO: 40459 - protein, 16 aa, BK virus
LFVQLQPPTSVDFHRL

SEQ ID NO: 40460 - protein, 16 aa, BK virus
FVQLQPPTSVDFHRLG

SEQ ID NO: 40461 - protein, 16 aa, BK virus
VQLQPPTSVDFHRLGP

SEQ ID NO: 40462 - protein, 16 aa, BK virus
QLQPPTSVDFHRLGPH

SEQ ID NO: 40463 - protein, 16 aa, BK virus
LQPPTSVDFHRLGPHL

SEQ ID NO: 40464 - protein, 16 aa, BK virus
QPPTSVDFHRLGPHLN

SEQ ID NO: 40465 - protein, 16 aa, BK virus
PPTSVDFHRLGPHLNW

SEQ ID NO: 40466 - protein, 16 aa, BK virus
PTSVDFHRLGPHLNWG

SEQ ID NO: 40467 - protein, 16 aa, BK virus
TSVDFHRLGPHLNWGG

SEQ ID NO: 40468 - protein, 16 aa, BK virus
SVDFHRLGPHLNWGGE

SEQ ID NO: 40469 - protein, 16 aa, BK virus
VDFHRLGPHLNWGGEF

SEQ ID NO: 40470 - protein, 16 aa, BK virus
DFHRLGPHLNWGGEFL

SEQ ID NO: 40471 - protein, 16 aa, BK virus
FHRLGPHLNWGGEFLL

SEQ ID NO: 40472 - protein, 16 aa, BK virus
HRLGPHLNWGGEFLLC

SEQ ID NO: 40473 - protein, 16 aa, BK virus
RLGPHLNWGGEFLLCC

SEQ ID NO: 40474 - protein, 16 aa, BK virus
LGPHLNWGGEFLLCCN

SEQ ID NO: 40475 - protein, 16 aa, BK virus
GPHLNWGGEFLLCCNR

SEQ ID NO: 40476 - protein, 16 aa, BK virus
PHLNWGGEFLLCCNRE

SEQ ID NO: 40477 - protein, 16 aa, BK virus
HLNWGGEFLLCCNREA

SEQ ID NO: 40478 - protein, 16 aa, BK virus
LNWGGEFLLCCNREAF

SEQ ID NO: 40479 - protein, 16 aa, BK virus
NWGGEFLLCCNREAFF

SEQ ID NO: 40480 - protein, 16 aa, BK virus
WGGEFLLCCNREAFFS

SEQ ID NO: 40481 - protein, 16 aa, BK virus
GGEFLLCCNREAFFSL

SEQ ID NO: 40482 - protein, 16 aa, BK virus
GEFLLCCNREAFFSLG

SEQ ID NO: 40483 - protein, 16 aa, BK virus
EFLLCCNREAFFSLGY

SEQ ID NO: 40484 - protein, 16 aa, BK virus
FLLCCNREAFFSLGYH

SEQ ID NO: 40485 - protein, 16 aa, BK virus
LLCCNREAFFSLGYHC

SEQ ID NO: 40486 - protein, 16 aa, BK virus
GFHLDPPFLGLGSILP

SEQ ID NO: 40487 - protein, 16 aa, BK virus
FHLDPPFLGLGSILPL

SEQ ID NO: 40488 - protein, 16 aa, BK virus
LLELLLLLLLVVLALA

SEQ ID NO: 40489 - protein, 16 aa, BK virus
LELLLLLLLVVLALAR

SEQ ID NO: 40490 - protein, 16 aa, BK virus
ELLLLLLLVVLALARV

SEQ ID NO: 40491 - protein, 16 aa, BK virus
LLLLLLLVVLALARVP

SEQ ID NO: 40492 - protein, 16 aa, BK virus
LLLLLLVVLALARVPL

SEQ ID NO: 40493 - protein, 16 aa, BK virus
LLLLLVVLALARVPLA

SEQ ID NO: 40494 - protein, 16 aa, BK virus
LLLLVVLALARVPLAF

SEQ ID NO: 40495 - protein, 16 aa, BK virus
LLLVVLALARVPLAFW

SEQ ID NO: 40496 - protein, 16 aa, BK virus
LLVVLALARVPLAFWE

SEQ ID NO: 40497 - protein, 16 aa, BK virus
LVVLALARVPLAFWEL

SEQ ID NO: 40498 - protein, 16 aa, BK virus
VVLALARVPLAFWELP

SEQ ID NO: 40499 - protein, 16 aa, BK virus
VLALARVPLAFWELPL

SEQ ID NO: 40500 - protein, 16 aa, BK virus
LALARVPLAFWELPLD

SEQ ID NO: 40501 - protein, 16 aa, BK virus
ALARVPLAFWELPLDT

SEQ ID NO: 40502 - protein, 16 aa, BK virus
LARVPLAFWELPLDTL

SEQ ID NO: 40503 - protein, 16 aa, BK virus
ARVPLAFWELPLDTLL

SEQ ID NO: 40504 - protein, 16 aa, BK virus
RVPLAFWELPLDTLLF

SEQ ID NO: 40505 - protein, 16 aa, BK virus
VPLAFWELPLDTLLFF

SEQ ID NO: 40506 - protein, 16 aa, BK virus
PLAFWELPLDTLLFFW

SEQ ID NO: 40507 - protein, 16 aa, BK virus
LAFWELPLDTLLFFWL

SEQ ID NO: 40508 - protein, 16 aa, BK virus
AFWELPLDTLLFFWLG

SEQ ID NO: 40509 - protein, 16 aa, BK virus
FWELPLDTLLFFWLGP

SEQ ID NO: 40510 - protein, 16 aa, BK virus
WELPLDTLLFFWLGPS

SEQ ID NO: 40511 - protein, 16 aa, BK virus
ELPLDTLLFFWLGPSS

SEQ ID NO: 40512 - protein, 16 aa, BK virus
LPLDTLLFFWLGPSSY

SEQ ID NO: 40513 - protein, 16 aa, BK virus
PLDTLLFFWLGPSSYA

SEQ ID NO: 40514 - protein, 16 aa, BK virus
LDTLLFFWLGPSSYAS

SEQ ID NO: 40515 - protein, 16 aa, BK virus
DTLLFFWLGPSSYASR

SEQ ID NO: 40516 - protein, 16 aa, BK virus
TLLFFWLGPSSYASRA

SEQ ID NO: 40517 - protein, 16 aa, BK virus
LLFFWLGPSSYASRAG

SEQ ID NO: 40518 - protein, 16 aa, BK virus
LFFWLGPSSYASRAGV

SEQ ID NO: 40519 - protein, 16 aa, BK virus
FFWLGPSSYASRAGVT

SEQ ID NO: 40520 - protein, 16 aa, BK virus
FWLGPSSYASRAGVTV

SEQ ID NO: 40521 - protein, 16 aa, BK virus
WLGPSSYASRAGVTVP

SEQ ID NO: 40522 - protein, 16 aa, BK virus
LGPSSYASRAGVTVPY

SEQ ID NO: 40523 - protein, 16 aa, BK virus
GPSSYASRAGVTVPYR

SEQ ID NO: 40524 - protein, 16 aa, BK virus
PSSYASRAGVTVPYRP

SEQ ID NO: 40525 - protein, 16 aa, BK virus
SSYASRAGVTVPYRPR

SEQ ID NO: 40526 - protein, 16 aa, BK virus
SYASRAGVTVPYRPRS

SEQ ID NO: 40527 - protein, 16 aa, BK virus
YASRAGVTVPYRPRSK

SEQ ID NO: 40528 - protein, 16 aa, BK virus
ASRAGVTVPYRPRSKG

SEQ ID NO: 40529 - protein, 16 aa, BK virus
SRAGVTVPYRPRSKGN

SEQ ID NO: 40530 - protein, 16 aa, BK virus
RAGVTVPYRPRSKGNI

SEQ ID NO: 40531 - protein, 16 aa, BK virus
AGVTVPYRPRSKGNIH

SEQ ID NO: 40532 - protein, 16 aa, BK virus
LAPPGAIVFSINSPEC

SEQ ID NO: 40533 - protein, 16 aa, BK virus
APPGAIVFSINSPECT

SEQ ID NO: 40534 - protein, 16 aa, BK virus
PPGAIVFSINSPECTL

SEQ ID NO: 40535 - protein, 16 aa, BK virus
PGAIVFSINSPECTLC

SEQ ID NO: 40536 - protein, 16 aa, BK virus
FLKSILCVTSSILSAS

SEQ ID NO: 40537 - protein, 16 aa, BK virus
LKSILCVTSSILSASS

SEQ ID NO: 40538 - protein, 16 aa, BK virus
KSILCVTSSILSASSI

SEQ ID NO: 40539 - protein, 16 aa, BK virus
SILCVTSSILSASSIL

SEQ ID NO: 40540 - protein, 16 aa, BK virus
VWPKCTRVPSLSATCL

SEQ ID NO: 40541 - protein, 16 aa, BK virus
WPKCTRVPSLSATCLT

SEQ ID NO: 40542 - protein, 16 aa, BK virus
PKCTRVPSLSATCLTI

SEQ ID NO: 40543 - protein, 16 aa, BK virus
KCTRVPSLSATCLTIE

SEQ ID NO: 40544 - protein, 16 aa, BK virus
CTRVPSLSATCLTIEG

SEQ ID NO: 40545 - protein, 16 aa, BK virus
TRVPSLSATCLTIEGL

SEQ ID NO: 40546 - protein, 16 aa, BK virus
RVPSLSATCLTIEGLI

SEQ ID NO: 40547 - protein, 16 aa, BK virus
VPSLSATCLTIEGLIG

SEQ ID NO: 40548 - protein, 16 aa, BK virus
PSLSATCLTIEGLIGE

SEQ ID NO: 40549 - protein, 16 aa, BK virus
SLSATCLTIEGLIGER

SEQ ID NO: 40550 - protein, 16 aa, BK virus
LSATCLTIEGLIGERS

SEQ ID NO: 40551 - protein, 16 aa, BK virus
SATCLTIEGLIGERSE

SEQ ID NO: 40552 - protein, 16 aa, BK virus
KFIGAFTIVQVVSSKN

SEQ ID NO: 40553 - protein, 16 aa, BK virus
FIGAFTIVQVVSSKNL

SEQ ID NO: 40554 - protein, 16 aa, BK virus
IGAFTIVQVVSSKNLA

SEQ ID NO: 40555 - protein, 16 aa, BK virus
GAFTIVQVVSSKNLAK

SEQ ID NO: 40556 - protein, 16 aa, BK virus
AFTIVQVVSSKNLAKE

SEQ ID NO: 40557 - protein, 16 aa, BK virus
FTIVQVVSSKNLAKES

SEQ ID NO: 40558 - protein, 16 aa, BK virus
TIVQVVSSKNLAKESL

SEQ ID NO: 40559 - protein, 16 aa, BK virus
IVQVVSSKNLAKESLK

SEQ ID NO: 40560 - protein, 16 aa, BK virus
VQVVSSKNLAKESLKN

SEQ ID NO: 40561 - protein, 16 aa, BK virus
QVVSSKNLAKESLKNL

SEQ ID NO: 40562 - protein, 16 aa, BK virus
VVSSKNLAKESLKNLS

SEQ ID NO: 40563 - protein, 16 aa, BK virus
VSSKNLAKESLKNLSV

SEQ ID NO: 40564 - protein, 16 aa, BK virus
SSKNLAKESLKNLSVL

SEQ ID NO: 40565 - protein, 16 aa, BK virus
SKNLAKESLKNLSVLL

SEQ ID NO: 40566 - protein, 16 aa, BK virus
KNLAKESLKNLSVLLC

SEQ ID NO: 40567 - protein, 16 aa, BK virus
NLAKESLKNLSVLLCN

SEQ ID NO: 40568 - protein, 16 aa, BK virus
LAKESLKNLSVLLCNS

SEQ ID NO: 40569 - protein, 16 aa, BK virus
AKESLKNLSVLLCNSC

SEQ ID NO: 40570 - protein, 16 aa, BK virus
KESLKNLSVLLCNSCE

SEQ ID NO: 40571 - protein, 16 aa, BK virus
ESLKNLSVLLCNSCEV

SEQ ID NO: 40572 - protein, 16 aa, BK virus
SLKNLSVLLCNSCEVI

SEQ ID NO: 40573 - protein, 16 aa, BK virus
LKNLSVLLCNSCEVIE

SEQ ID NO: 40574 - protein, 16 aa, BK virus
KNLSVLLCNSCEVIEG

SEQ ID NO: 40575 - protein, 16 aa, BK virus
NLSVLLCNSCEVIEGI

SEQ ID NO: 40576 - protein, 16 aa, BK virus
LSVLLCNSCEVIEGIS

SEQ ID NO: 40577 - protein, 16 aa, BK virus
SVLLCNSCEVIEGISS

SEQ ID NO: 40578 - protein, 16 aa, BK virus
VLLCNSCEVIEGISSL

SEQ ID NO: 40579 - protein, 16 aa, BK virus
LLCNSCEVIEGISSLI

SEQ ID NO: 40580 - protein, 16 aa, BK virus
LCNSCEVIEGISSLIT

SEQ ID NO: 40581 - protein, 16 aa, BK virus
CNSCEVIEGISSLITC

SEQ ID NO: 40582 - protein, 16 aa, BK virus
NSCEVIEGISSLITCH

SEQ ID NO: 40583 - protein, 16 aa, BK virus
SCEVIEGISSLITCHK

SEQ ID NO: 40584 - protein, 16 aa, BK virus
CEVIEGISSLITCHKA

SEQ ID NO: 40585 - protein, 16 aa, BK virus
EVIEGISSLITCHKAW

SEQ ID NO: 40586 - protein, 16 aa, BK virus
VIEGISSLITCHKAWE

SEQ ID NO: 40587 - protein, 16 aa, BK virus
IEGISSLITCHKAWEI

SEQ ID NO: 40588 - protein, 16 aa, BK virus
EGISSLITCHKAWEIV

SEQ ID NO: 40589 - protein, 16 aa, BK virus
GISSLITCHKAWEIVA

SEQ ID NO: 40590 - protein, 16 aa, BK virus
ISSLITCHKAWEIVAN

SEQ ID NO: 40591 - protein, 16 aa, BK virus
SSLITCHKAWEIVANK

SEQ ID NO: 40592 - protein, 16 aa, BK virus
SLITCHKAWEIVANKE

SEQ ID NO: 40593 - protein, 16 aa, BK virus
LITCHKAWEIVANKEG

SEQ ID NO: 40594 - protein, 16 aa, BK virus
ITCHKAWEIVANKEGP

SEQ ID NO: 40595 - protein, 16 aa, BK virus
TCHKAWEIVANKEGPQ

SEQ ID NO: 40596 - protein, 16 aa, BK virus
CHKAWEIVANKEGPQC

SEQ ID NO: 40597 - protein, 16 aa, BK virus
HKAWEIVANKEGPQCL

SEQ ID NO: 40598 - protein, 16 aa, BK virus
KAWEIVANKEGPQCLG

SEQ ID NO: 40599 - protein, 16 aa, BK virus
AWEIVANKEGPQCLGS

SEQ ID NO: 40600 - protein, 16 aa, BK virus
WEIVANKEGPQCLGSR

SEQ ID NO: 40601 - protein, 16 aa, BK virus
EIVANKEGPQCLGSRY

SEQ ID NO: 40602 - protein, 16 aa, BK virus
IKAANPAIAPGAPAIT

SEQ ID NO: 40603 - protein, 16 aa, BK virus
KAANPAIAPGAPAITA

SEQ ID NO: 40604 - protein, 16 aa, BK virus
AANPAIAPGAPAITAY

SEQ ID NO: 40605 - protein, 16 aa, BK virus
ANPAIAPGAPAITAYV

SEQ ID NO: 40606 - protein, 16 aa, BK virus
GVRPIAAIASEVLVMP

SEQ ID NO: 40607 - protein, 16 aa, BK virus
VRPIAAIASEVLVMPS

SEQ ID NO: 40608 - protein, 16 aa, BK virus
RPIAAIASEVLVMPST

SEQ ID NO: 40609 - protein, 16 aa, BK virus
PIAAIASEVLVMPSTV

SEQ ID NO: 40610 - protein, 16 aa, BK virus
IAAIASEVLVMPSTVA

SEQ ID NO: 40611 - protein, 16 aa, BK virus
AAIASEVLVMPSTVAR

SEQ ID NO: 40612 - protein, 16 aa, BK virus
AIASEVLVMPSTVARD

SEQ ID NO: 40613 - protein, 16 aa, BK virus
IASEVLVMPSTVARDA

SEQ ID NO: 40614 - protein, 16 aa, BK virus
ASEVLVMPSTVARDAI

SEQ ID NO: 40615 - protein, 16 aa, BK virus
TSIAAAASPAAISATE

SEQ ID NO: 40616 - protein, 16 aa, BK virus
SIAAAASPAAISATEN

SEQ ID NO: 40617 - protein, 16 aa, BK virus
IAAAASPAAISATENP

SEQ ID NO: 40618 - protein, 16 aa, BK virus
AAAASPAAISATENPV

SEQ ID NO: 40619 - protein, 16 aa, BK virus
AAASPAAISATENPVA

SEQ ID NO: 40620 - protein, 16 aa, BK virus
AASPAAISATENPVAA

SEQ ID NO: 40621 - protein, 16 aa, BK virus
ASPAAISATENPVAAA

SEQ ID NO: 40622 - protein, 16 aa, BK virus
SPAAISATENPVAAAA

SEQ ID NO: 40623 - protein, 16 aa, BK virus
PAAISATENPVAAAAS

SEQ ID NO: 40624 - protein, 16 aa, BK virus
AAISATENPVAAAASD

SEQ ID NO: 40625 - protein, 16 aa, BK virus
AISATENPVAAAASDT

SEQ ID NO: 40626 - protein, 16 aa, BK virus
ISATENPVAAAASDTL

SEQ ID NO: 40627 - protein, 16 aa, BK virus
SATENPVAAAASDTLA

SEQ ID NO: 40628 - protein, 16 aa, BK virus
ATENPVAAAASDTLAT

SEQ ID NO: 40629 - protein, 16 aa, BK virus
TENPVAAAASDTLATR

SEQ ID NO: 40630 - protein, 16 aa, BK virus
ENPVAAAASDTLATRS

SEQ ID NO: 40631 - protein, 16 aa, BK virus
NPVAAAASDTLATRSP

SEQ ID NO: 40632 - protein, 16 aa, BK virus
PVAAAASDTLATRSPK

SEQ ID NO: 40633 - protein, 16 aa, BK virus
VAAAASDTLATRSPKS

SEQ ID NO: 40634 - protein, 16 aa, BK virus
AAAASDTLATRSPKSA

SEQ ID NO: 40635 - protein, 16 aa, BK virus
AAASDTLATRSPKSAR

SEQ ID NO: 40636 - protein, 16 aa, BK virus
AASDTLATRSPKSARA

SEQ ID NO: 40637 - protein, 16 aa, BK virus
ASDTLATRSPKSARAA

SEQ ID NO: 40638 - protein, 16 aa, BK virus
SDTLATRSPKSARAAP

SEQ ID NO: 40639 - protein, 16 aa, BK virus
DTLATRSPKSARAAPM

SEQ ID NO: 40640 - protein, 16 aa, BK virus
TLATRSPKSARAAPMN

SEQ ID NO: 40641 - protein, 16 aa, BK virus
LATRSPKSARAAPMNL

SEQ ID NO: 40642 - protein, 16 aa, BK virus
ATRSPKSARAAPMNLE

SEQ ID NO: 40643 - protein, 16 aa, BK virus
TRSPKSARAAPMNLEI

SEQ ID NO: 40644 - protein, 16 aa, BK virus
RSPKSARAAPMNLEIQ

SEQ ID NO: 40645 - protein, 16 aa, BK virus
SPKSARAAPMNLEIQK

SEQ ID NO: 40646 - protein, 16 aa, BK virus
PKSARAAPMNLEIQKK

SEQ ID NO: 40647 - protein, 16 aa, BK virus
KSARAAPMNLEIQKKR

SEQ ID NO: 40648 - protein, 16 aa, BK virus
SARAAPMNLEIQKKRD

SEQ ID NO: 40649 - protein, 16 aa, BK virus
ARAAPMNLEIQKKRDY

SEQ ID NO: 40650 - protein, 16 aa, BK virus
RAAPMNLEIQKKRDYL

SEQ ID NO: 40651 - protein, 16 aa, BK virus
AAPMNLEIQKKRDYLP

SEQ ID NO: 40652 - protein, 16 aa, BK virus
APMNLEIQKKRDYLPR

SEQ ID NO: 40653 - protein, 16 aa, BK virus
PMNLEIQKKRDYLPRS

SEQ ID NO: 40654 - protein, 16 aa, BK virus
MNLEIQKKRDYLPRSL

SEQ ID NO: 40655 - protein, 16 aa, BK virus
NLEIQKKRDYLPRSLL

SEQ ID NO: 40656 - protein, 16 aa, BK virus
LEIQKKRDYLPRSLLQ

SEQ ID NO: 40657 - protein, 16 aa, BK virus
EIQKKRDYLPRSLLQS

SEQ ID NO: 40658 - protein, 16 aa, BK virus
IQKKRDYLPRSLLQSL

SEQ ID NO: 40659 - protein, 16 aa, BK virus
QKKRDYLPRSLLQSLL

SEQ ID NO: 40660 - protein, 16 aa, BK virus
KKRDYLPRSLLQSLLQ

SEQ ID NO: 40661 - protein, 16 aa, BK virus
KRDYLPRSLLQSLLQQ

SEQ ID NO: 40662 - protein, 16 aa, BK virus
RDYLPRSLLQSLLQQV

SEQ ID NO: 40663 - protein, 16 aa, BK virus
DYLPRSLLQSLLQQVK

SEQ ID NO: 40664 - protein, 16 aa, BK virus
YLPRSLLQSLLQQVKQ

SEQ ID NO: 40665 - protein, 16 aa, BK virus
LPRSLLQSLLQQVKQW

SEQ ID NO: 40666 - protein, 16 aa, BK virus
PRSLLQSLLQQVKQWY

SEQ ID NO: 40667 - protein, 16 aa, BK virus
RSLLQSLLQQVKQWYF

SEQ ID NO: 40668 - protein, 16 aa, BK virus
SLLQSLLQQVKQWYFC

SEQ ID NO: 40669 - protein, 16 aa, BK virus
LLQSLLQQVKQWYFCF

SEQ ID NO: 40670 - protein, 16 aa, BK virus
LQSLLQQVKQWYFCFS

SEQ ID NO: 40671 - protein, 16 aa, BK virus
QSLLQQVKQWYFCFSR

SEQ ID NO: 40672 - protein, 16 aa, BK virus
SLLQQVKQWYFCFSRL

SEQ ID NO: 40673 - protein, 16 aa, BK virus
LLQQVKQWYFCFSRLH

SEQ ID NO: 40674 - protein, 16 aa, BK virus
LQQVKQWYFCFSRLHC

SEQ ID NO: 40675 - protein, 16 aa, BK virus
QQVKQWYFCFSRLHCL

SEQ ID NO: 40676 - protein, 16 aa, BK virus
QVKQWYFCFSRLHCLH

SEQ ID NO: 40677 - protein, 16 aa, BK virus
VKQWYFCFSRLHCLHL

SEQ ID NO: 40678 - protein, 16 aa, BK virus
KQWYFCFSRLHCLHLY

SEQ ID NO: 40679 - protein, 16 aa, BK virus
QWYFCFSRLHCLHLYK

SEQ ID NO: 40680 - protein, 16 aa, BK virus
WYFCFSRLHCLHLYKI

SEQ ID NO: 40681 - protein, 16 aa, BK virus
YFCFSRLHCLHLYKIP

SEQ ID NO: 40682 - protein, 16 aa, BK virus
FCFSRLHCLHLYKIPA

SEQ ID NO: 40683 - protein, 16 aa, BK virus
CFSRLHCLHLYKIPAK

SEQ ID NO: 40684 - protein, 16 aa, BK virus
FSRLHCLHLYKIPAKA

SEQ ID NO: 40685 - protein, 16 aa, BK virus
SRLHCLHLYKIPAKAL

SEQ ID NO: 40686 - protein, 16 aa, BK virus
RLHCLHLYKIPAKALK

SEQ ID NO: 40687 - protein, 16 aa, BK virus
KSSELFFLFQSRFYQL

SEQ ID NO: 40688 - protein, 16 aa, BK virus
SSELFFLFQSRFYQLS

SEQ ID NO: 40689 - protein, 16 aa, BK virus
SELFFLFQSRFYQLSL

SEQ ID NO: 40690 - protein, 16 aa, BK virus
ELFFLFQSRFYQLSLK

SEQ ID NO: 40691 - protein, 16 aa, BK virus
LFFLFQSRFYQLSLKL

SEQ ID NO: 40692 - protein, 16 aa, BK virus
FFLFQSRFYQLSLKLV

SEQ ID NO: 40693 - protein, 16 aa, BK virus
FLFQSRFYQLSLKLVV

SEQ ID NO: 40694 - protein, 16 aa, BK virus
LFQSRFYQLSLKLVVT

SEQ ID NO: 40695 - protein, 16 aa, BK virus
FQSRFYQLSLKLVVTA

SEQ ID NO: 40696 - protein, 16 aa, BK virus
QSRFYQLSLKLVVTAG

SEQ ID NO: 40697 - protein, 16 aa, BK virus
SRFYQLSLKLVVTAGA

SEQ ID NO: 40698 - protein, 16 aa, BK virus
RFYQLSLKLVVTAGAE

SEQ ID NO: 40699 - protein, 16 aa, BK virus
FYQLSLKLVVTAGAEP

SEQ ID NO: 40700 - protein, 16 aa, BK virus
YQLSLKLVVTAGAEPW

SEQ ID NO: 40701 - protein, 16 aa, BK virus
QLSLKLVVTAGAEPWP

SEQ ID NO: 40702 - protein, 16 aa, BK virus
LSLKLVVTAGAEPWPL

SEQ ID NO: 40703 - protein, 16 aa, BK virus
SLKLVVTAGAEPWPLS

SEQ ID NO: 40704 - protein, 16 aa, BK virus
LKLVVTAGAEPWPLSS

SEQ ID NO: 40705 - protein, 16 aa, BK virus
KLVVTAGAEPWPLSSL

SEQ ID NO: 40706 - protein, 16 aa, BK virus
LVVTAGAEPWPLSSLT

SEQ ID NO: 40707 - protein, 16 aa, BK virus
VVTAGAEPWPLSSLTG

SEQ ID NO: 40708 - protein, 16 aa, BK virus
VTAGAEPWPLSSLTGD

SEQ ID NO: 40709 - protein, 16 aa, BK virus
TAGAEPWPLSSLTGDK

SEQ ID NO: 40710 - protein, 16 aa, BK virus
AGAEPWPLSSLTGDKA

SEQ ID NO: 40711 - protein, 16 aa, BK virus
GAEPWPLSSLTGDKAK

SEQ ID NO: 40712 - protein, 16 aa, BK virus
AEPWPLSSLTGDKAKI

SEQ ID NO: 40713 - protein, 16 aa, BK virus
EPWPLSSLTGDKAKIP

SEQ ID NO: 40714 - protein, 16 aa, BK virus
PWPLSSLTGDKAKIPR

SEQ ID NO: 40715 - protein, 16 aa, BK virus
WPLSSLTGDKAKIPRL

SEQ ID NO: 40716 - protein, 16 aa, BK virus
PLSSLTGDKAKIPRLA

SEQ ID NO: 40717 - protein, 16 aa, BK virus
LSSLTGDKAKIPRLAK

SEQ ID NO: 40718 - protein, 16 aa, BK virus
SSLTGDKAKIPRLAKH

SEQ ID NO: 40719 - protein, 16 aa, BK virus
SLTGDKAKIPRLAKHV

SEQ ID NO: 40720 - protein, 16 aa, BK virus
LTGDKAKIPRLAKHVC

SEQ ID NO: 40721 - protein, 16 aa, BK virus
TGDKAKIPRLAKHVCH

SEQ ID NO: 40722 - protein, 16 aa, BK virus
GDKAKIPRLAKHVCHA

SEQ ID NO: 40723 - protein, 16 aa, BK virus
DKAKIPRLAKHVCHAL

SEQ ID NO: 40724 - protein, 16 aa, BK virus
KAKIPRLAKHVCHALS

SEQ ID NO: 40725 - protein, 16 aa, BK virus
AKIPRLAKHVCHALSF

SEQ ID NO: 40726 - protein, 16 aa, BK virus
KIPRLAKHVCHALSFL

SEQ ID NO: 40727 - protein, 16 aa, BK virus
IPRLAKHVCHALSFLR

SEQ ID NO: 40728 - protein, 16 aa, BK virus
PRLAKHVCHALSFLRS

SEQ ID NO: 40729 - protein, 16 aa, BK virus
RLAKHVCHALSFLRSW

SEQ ID NO: 40730 - protein, 16 aa, BK virus
LAKHVCHALSFLRSWF

SEQ ID NO: 40731 - protein, 16 aa, BK virus
AKHVCHALSFLRSWFG

SEQ ID NO: 40732 - protein, 16 aa, BK virus
KHVCHALSFLRSWFGC

SEQ ID NO: 40733 - protein, 16 aa, BK virus
HVCHALSFLRSWFGCI

SEQ ID NO: 40734 - protein, 16 aa, BK virus
VCHALSFLRSWFGCIP

SEQ ID NO: 40735 - protein, 16 aa, BK virus
CHALSFLRSWFGCIPW

SEQ ID NO: 40736 - protein, 16 aa, BK virus
HALSFLRSWFGCIPWV

SEQ ID NO: 40737 - protein, 16 aa, BK virus
ALSFLRSWFGCIPWVS

SEQ ID NO: 40738 - protein, 16 aa, BK virus
LSFLRSWFGCIPWVSS

SEQ ID NO: 40739 - protein, 16 aa, BK virus
SFLRSWFGCIPWVSSS

SEQ ID NO: 40740 - protein, 16 aa, BK virus
FLRSWFGCIPWVSSSS

SEQ ID NO: 40741 - protein, 16 aa, BK virus
LRSWFGCIPWVSSSSL

SEQ ID NO: 40742 - protein, 16 aa, BK virus
GHGLAAFPCESCTFLP

SEQ ID NO: 40743 - protein, 16 aa, BK virus
HGLAAFPCESCTFLPE

SEQ ID NO: 40744 - protein, 16 aa, BK virus
GLAAFPCESCTFLPEV

SEQ ID NO: 40745 - protein, 16 aa, BK virus
LAAFPCESCTFLPEVM

SEQ ID NO: 40746 - protein, 16 aa, BK virus
AAFPCESCTFLPEVMV

SEQ ID NO: 40747 - protein, 16 aa, BK virus
AFPCESCTFLPEVMVW

SEQ ID NO: 40748 - protein, 16 aa, BK virus
FPCESCTFLPEVMVWL

SEQ ID NO: 40749 - protein, 16 aa, BK virus
PCESCTFLPEVMVWLH

SEQ ID NO: 40750 - protein, 16 aa, BK virus
CESCTFLPEVMVWLHS

SEQ ID NO: 40751 - protein, 16 aa, BK virus
ESCTFLPEVMVWLHSM

SEQ ID NO: 40752 - protein, 16 aa, BK virus
SCTFLPEVMVWLHSMG

SEQ ID NO: 40753 - protein, 16 aa, BK virus
CTFLPEVMVWLHSMGK

SEQ ID NO: 40754 - protein, 16 aa, BK virus
TFLPEVMVWLHSMGKQ

SEQ ID NO: 40755 - protein, 16 aa, BK virus
FLPEVMVWLHSMGKQL

SEQ ID NO: 40756 - protein, 16 aa, BK virus
LPEVMVWLHSMGKQLL

SEQ ID NO: 40757 - protein, 16 aa, BK virus
PEVMVWLHSMGKQLLP

SEQ ID NO: 40758 - protein, 16 aa, BK virus
EVMVWLHSMGKQLLPV

SEQ ID NO: 40759 - protein, 16 aa, BK virus
VMVWLHSMGKQLLPVA

SEQ ID NO: 40760 - protein, 16 aa, BK virus
MVWLHSMGKQLLPVAF

SEQ ID NO: 40761 - protein, 16 aa, BK virus
VWLHSMGKQLLPVAFF

SEQ ID NO: 40762 - protein, 16 aa, BK virus
WLHSMGKQLLPVAFFF

SEQ ID NO: 40763 - protein, 16 aa, BK virus
LHSMGKQLLPVAFFFI

SEQ ID NO: 40764 - protein, 16 aa, BK virus
HSMGKQLLPVAFFFII

SEQ ID NO: 40765 - protein, 16 aa, BK virus
SMGKQLLPVAFFFIIY

SEQ ID NO: 40766 - protein, 16 aa, BK virus
MGKQLLPVAFFFIIYK

SEQ ID NO: 40767 - protein, 16 aa, BK virus
GKQLLPVAFFFIIYKR

SEQ ID NO: 40768 - protein, 16 aa, BK virus
KQLLPVAFFFIIYKRP

SEQ ID NO: 40769 - protein, 16 aa, BK virus
QLLPVAFFFIIYKRPR

SEQ ID NO: 40770 - protein, 16 aa, BK virus
LLPVAFFFIIYKRPRP

SEQ ID NO: 40771 - protein, 16 aa, BK virus
LPVAFFFIIYKRPRPP

SEQ ID NO: 40772 - protein, 16 aa, BK virus
PVAFFFIIYKRPRPPL

SEQ ID NO: 40773 - protein, 16 aa, BK virus
VAFFFIIYKRPRPPLP

SEQ ID NO: 40774 - protein, 16 aa, BK virus
AFFFIIYKRPRPPLPP

SEQ ID NO: 40775 - protein, 16 aa, BK virus
FFFIIYKRPRPPLPPP

SEQ ID NO: 40776 - protein, 16 aa, BK virus
FFIIYKRPRPPLPPPF

SEQ ID NO: 40777 - protein, 16 aa, BK virus
FIIYKRPRPPLPPPFL

SEQ ID NO: 40778 - protein, 16 aa, BK virus
IIYKRPRPPLPPPFLS

SEQ ID NO: 40779 - protein, 16 aa, BK virus
IYKRPRPPLPPPFLSS

SEQ ID NO: 40780 - protein, 16 aa, BK virus
YKRPRPPLPPPFLSSS

SEQ ID NO: 40781 - protein, 16 aa, BK virus
KRPRPPLPPPFLSSSK

SEQ ID NO: 40782 - protein, 16 aa, BK virus
RPRPPLPPPFLSSSKG

SEQ ID NO: 40783 - protein, 16 aa, BK virus
PRPPLPPPFLSSSKGV

SEQ ID NO: 40784 - protein, 16 aa, BK virus
RPPLPPPFLSSSKGVE

SEQ ID NO: 40785 - protein, 16 aa, BK virus
PPLPPPFLSSSKGVEA

SEQ ID NO: 40786 - protein, 16 aa, BK virus
PLPPPFLSSSKGVEAF

SEQ ID NO: 40787 - protein, 16 aa, BK virus
LPPPFLSSSKGVEAFS

SEQ ID NO: 40788 - protein, 16 aa, BK virus
PPPFLSSSKGVEAFSE

SEQ ID NO: 40789 - protein, 16 aa, BK virus
PPFLSSSKGVEAFSEA

SEQ ID NO: 40790 - protein, 13 aa, BK virus
QGRIHGAHGPFRP

SEQ ID NO: 40791 - protein, 13 aa, BK virus
KSCLGKSSLNEKS

SEQ ID NO: 40792 - protein, 13 aa, BK virus
SCLGKSSLNEKSL

SEQ ID NO: 40793 - protein, 13 aa, BK virus
CLGKSSLNEKSLF

SEQ ID NO: 40794 - protein, 13 aa, BK virus
LGKSSLNEKSLFK

SEQ ID NO: 40795 - protein, 13 aa, BK virus
GKSSLNEKSLFKE

SEQ ID NO: 40796 - protein, 13 aa, BK virus
KSSLNEKSLFKEV

SEQ ID NO: 40797 - protein, 13 aa, BK virus
FSSLPRYPVLQGM

SEQ ID NO: 40798 - protein, 13 aa, BK virus
SSLPRYPVLQGMA

SEQ ID NO: 40799 - protein, 13 aa, BK virus
SLPRYPVLQGMAY

SEQ ID NO: 40800 - protein, 13 aa, BK virus
LPRYPVLQGMAYL

SEQ ID NO: 40801 - protein, 13 aa, BK virus
PRYPVLQGMAYLF

SEQ ID NO: 40802 - protein, 13 aa, BK virus
RYPVLQGMAYLFQ

SEQ ID NO: 40803 - protein, 13 aa, BK virus
YPVLQGMAYLFQK

SEQ ID NO: 40804 - protein, 13 aa, BK virus
PVLQGMAYLFQKA

SEQ ID NO: 40805 - protein, 13 aa, BK virus
VLQGMAYLFQKAF

SEQ ID NO: 40806 - protein, 13 aa, BK virus
LQGMAYLFQKAFC

SEQ ID NO: 40807 - protein, 13 aa, BK virus
QGMAYLFQKAFCA

SEQ ID NO: 40808 - protein, 13 aa, BK virus
GMAYLFQKAFCAL

SEQ ID NO: 40809 - protein, 13 aa, BK virus
MAYLFQKAFCALP

SEQ ID NO: 40810 - protein, 13 aa, BK virus
AYLFQKAFCALPL

SEQ ID NO: 40811 - protein, 13 aa, BK virus
YLFQKAFCALPLH

SEQ ID NO: 40812 - protein, 13 aa, BK virus
LFQKAFCALPLHA

SEQ ID NO: 40813 - protein, 13 aa, BK virus
FQKAFCALPLHAM

SEQ ID NO: 40814 - protein, 13 aa, BK virus
QKAFCALPLHAMS

SEQ ID NO: 40815 - protein, 13 aa, BK virus
KAFCALPLHAMSA

SEQ ID NO: 40816 - protein, 13 aa, BK virus
KIFKKRALGLDRL

SEQ ID NO: 40817 - protein, 13 aa, BK virus
IFKKRALGLDRLL

SEQ ID NO: 40818 - protein, 13 aa, BK virus
FKKRALGLDRLLL

SEQ ID NO: 40819 - protein, 13 aa, BK virus
KKRALGLDRLLLH

SEQ ID NO: 40820 - protein, 13 aa, BK virus
RNSAMVGPNNWRN

SEQ ID NO: 40821 - protein, 13 aa, BK virus
NSAMVGPNNWRNS

SEQ ID NO: 40822 - protein, 13 aa, BK virus
SAMVGPNNWRNSL

SEQ ID NO: 40823 - protein, 13 aa, BK virus
AMVGPNNWRNSLQ

SEQ ID NO: 40824 - protein, 13 aa, BK virus
MVGPNNWRNSLQR

SEQ ID NO: 40825 - protein, 13 aa, BK virus
VGPNNWRNSLQRS

SEQ ID NO: 40826 - protein, 13 aa, BK virus
GPNNWRNSLQRSK

SEQ ID NO: 40827 - protein, 13 aa, BK virus
PNNWRNSLQRSKA

SEQ ID NO: 40828 - protein, 13 aa, BK virus
NNWRNSLQRSKAL

SEQ ID NO: 40829 - protein, 13 aa, BK virus
NWRNSLQRSKALR

SEQ ID NO: 40830 - protein, 13 aa, BK virus
VPTYGTEEWESWW

SEQ ID NO: 40831 - protein, 13 aa, BK virus
PTYGTEEWESWWS

SEQ ID NO: 40832 - protein, 13 aa, BK virus
TYGTEEWESWWSS

SEQ ID NO: 40833 - protein, 13 aa, BK virus
YGTEEWESWWSSF

SEQ ID NO: 40834 - protein, 13 aa, BK virus
GTEEWESWWSSFN

SEQ ID NO: 40835 - protein, 13 aa, BK virus
TEEWESWWSSFNE

SEQ ID NO: 40836 - protein, 13 aa, BK virus
EEWESWWSSFNEK

SEQ ID NO: 40837 - protein, 13 aa, BK virus
EWESWWSSFNEKW

SEQ ID NO: 40838 - protein, 13 aa, BK virus
WESWWSSFNEKWD

SEQ ID NO: 40839 - protein, 13 aa, BK virus
ESWWSSFNEKWDE

SEQ ID NO: 40840 - protein, 13 aa, BK virus
SWWSSFNEKWDED

SEQ ID NO: 40841 - protein, 13 aa, BK virus
WWSSFNEKWDEDL

SEQ ID NO: 40842 - protein, 13 aa, BK virus
WSSFNEKWDEDLF

SEQ ID NO: 40843 - protein, 13 aa, BK virus
SSFNEKWDEDLFC

SEQ ID NO: 40844 - protein, 13 aa, BK virus
SFNEKWDEDLFCH

SEQ ID NO: 40845 - protein, 13 aa, BK virus
FNEKWDEDLFCHE

SEQ ID NO: 40846 - protein, 13 aa, BK virus
NEKWDEDLFCHED

SEQ ID NO: 40847 - protein, 13 aa, BK virus
EKWDEDLFCHEDM

SEQ ID NO: 40848 - protein, 13 aa, BK virus
KWDEDLFCHEDMF

SEQ ID NO: 40849 - protein, 13 aa, BK virus
WDEDLFCHEDMFA

SEQ ID NO: 40850 - protein, 13 aa, BK virus
DEDLFCHEDMFAS

SEQ ID NO: 40851 - protein, 13 aa, BK virus
EDLFCHEDMFASD

SEQ ID NO: 40852 - protein, 13 aa, BK virus
DLFCHEDMFASDE

SEQ ID NO: 40853 - protein, 13 aa, BK virus
LFCHEDMFASDEE

SEQ ID NO: 40854 - protein, 13 aa, BK virus
FCHEDMFASDEEA

SEQ ID NO: 40855 - protein, 13 aa, BK virus
CHEDMFASDEEAT

SEQ ID NO: 40856 - protein, 13 aa, BK virus
HEDMFASDEEATA

SEQ ID NO: 40857 - protein, 13 aa, BK virus
EDMFASDEEATAD

SEQ ID NO: 40858 - protein, 13 aa, BK virus
DMFASDEEATADS

SEQ ID NO: 40859 - protein, 13 aa, BK virus
MFASDEEATADSQ

SEQ ID NO: 40860 - protein, 13 aa, BK virus
FASDEEATADSQH

SEQ ID NO: 40861 - protein, 13 aa, BK virus
ASDEEATADSQHS

SEQ ID NO: 40862 - protein, 13 aa, BK virus
SDEEATADSQHST

SEQ ID NO: 40863 - protein, 13 aa, BK virus
DEEATADSQHSTP

SEQ ID NO: 40864 - protein, 13 aa, BK virus
EEATADSQHSTPP

SEQ ID NO: 40865 - protein, 13 aa, BK virus
EATADSQHSTPPK

SEQ ID NO: 40866 - protein, 13 aa, BK virus
ATADSQHSTPPKK

SEQ ID NO: 40867 - protein, 13 aa, BK virus
TADSQHSTPPKKK

SEQ ID NO: 40868 - protein, 13 aa, BK virus
ADSQHSTPPKKKR

SEQ ID NO: 40869 - protein, 13 aa, BK virus
DSQHSTPPKKKRK

SEQ ID NO: 40870 - protein, 13 aa, BK virus
SQHSTPPKKKRKV

SEQ ID NO: 40871 - protein, 13 aa, BK virus
QHSTPPKKKRKVE

SEQ ID NO: 40872 - protein, 13 aa, BK virus
HSTPPKKKRKVED

SEQ ID NO: 40873 - protein, 13 aa, BK virus
STPPKKKRKVEDP

SEQ ID NO: 40874 - protein, 13 aa, BK virus
TPPKKKRKVEDPK

SEQ ID NO: 40875 - protein, 13 aa, BK virus
PPKKKRKVEDPKD

SEQ ID NO: 40876 - protein, 13 aa, BK virus
PKKKRKVEDPKDF

SEQ ID NO: 40877 - protein, 13 aa, BK virus
KKKRKVEDPKDFP

SEQ ID NO: 40878 - protein, 13 aa, BK virus
KKRKVEDPKDFPS

SEQ ID NO: 40879 - protein, 13 aa, BK virus
KRKVEDPKDFPSD

SEQ ID NO: 40880 - protein, 13 aa, BK virus
RKVEDPKDFPSDL

SEQ ID NO: 40881 - protein, 13 aa, BK virus
KVEDPKDFPSDLH

SEQ ID NO: 40882 - protein, 13 aa, BK virus
VEDPKDFPSDLHQ

SEQ ID NO: 40883 - protein, 13 aa, BK virus
EDPKDFPSDLHQF

SEQ ID NO: 40884 - protein, 13 aa, BK virus
DPKDFPSDLHQFL

SEQ ID NO: 40885 - protein, 13 aa, BK virus
PKDFPSDLHQFLS

SEQ ID NO: 40886 - protein, 13 aa, BK virus
KDFPSDLHQFLSQ

SEQ ID NO: 40887 - protein, 13 aa, BK virus
DFPSDLHQFLSQA

SEQ ID NO: 40888 - protein, 13 aa, BK virus
FPSDLHQFLSQAV

SEQ ID NO: 40889 - protein, 13 aa, BK virus
PSDLHQFLSQAVF

SEQ ID NO: 40890 - protein, 13 aa, BK virus
SDLHQFLSQAVFS

SEQ ID NO: 40891 - protein, 13 aa, BK virus
DLHQFLSQAVFSN

SEQ ID NO: 40892 - protein, 13 aa, BK virus
LHQFLSQAVFSNR

SEQ ID NO: 40893 - protein, 13 aa, BK virus
HQFLSQAVFSNRT

SEQ ID NO: 40894 - protein, 13 aa, BK virus
QFLSQAVFSNRTL

SEQ ID NO: 40895 - protein, 13 aa, BK virus
FLSQAVFSNRTLA

SEQ ID NO: 40896 - protein, 13 aa, BK virus
LSQAVFSNRTLAC

SEQ ID NO: 40897 - protein, 13 aa, BK virus
SQAVFSNRTLACF

SEQ ID NO: 40898 - protein, 13 aa, BK virus
QAVFSNRTLACFA

SEQ ID NO: 40899 - protein, 13 aa, BK virus
AVFSNRTLACFAV

SEQ ID NO: 40900 - protein, 13 aa, BK virus
VFSNRTLACFAVY

SEQ ID NO: 40901 - protein, 13 aa, BK virus
FSNRTLACFAVYT

SEQ ID NO: 40902 - protein, 13 aa, BK virus
SNRTLACFAVYTT

SEQ ID NO: 40903 - protein, 13 aa, BK virus
NRTLACFAVYTTK

SEQ ID NO: 40904 - protein, 13 aa, BK virus
RTLACFAVYTTKE

SEQ ID NO: 40905 - protein, 13 aa, BK virus
TLACFAVYTTKEK

SEQ ID NO: 40906 - protein, 13 aa, BK virus
LACFAVYTTKEKA

SEQ ID NO: 40907 - protein, 13 aa, BK virus
ACFAVYTTKEKAQ

SEQ ID NO: 40908 - protein, 13 aa, BK virus
CFAVYTTKEKAQI

SEQ ID NO: 40909 - protein, 13 aa, BK virus
FAVYTTKEKAQIL

SEQ ID NO: 40910 - protein, 13 aa, BK virus
AVYTTKEKAQILY

SEQ ID NO: 40911 - protein, 13 aa, BK virus
VYTTKEKAQILYK

SEQ ID NO: 40912 - protein, 13 aa, BK virus
YTTKEKAQILYKK

SEQ ID NO: 40913 - protein, 13 aa, BK virus
TTKEKAQILYKKL

SEQ ID NO: 40914 - protein, 13 aa, BK virus
TKEKAQILYKKLM

SEQ ID NO: 40915 - protein, 13 aa, BK virus
KEKAQILYKKLME

SEQ ID NO: 40916 - protein, 13 aa, BK virus
EKAQILYKKLMEK

SEQ ID NO: 40917 - protein, 13 aa, BK virus
KAQILYKKLMEKY

SEQ ID NO: 40918 - protein, 13 aa, BK virus
AQILYKKLMEKYS

SEQ ID NO: 40919 - protein, 13 aa, BK virus
QILYKKLMEKYSV

SEQ ID NO: 40920 - protein, 13 aa, BK virus
ILYKKLMEKYSVT

SEQ ID NO: 40921 - protein, 13 aa, BK virus
LYKKLMEKYSVTF

SEQ ID NO: 40922 - protein, 13 aa, BK virus
YKKLMEKYSVTFI

SEQ ID NO: 40923 - protein, 13 aa, BK virus
KKLMEKYSVTFIS

SEQ ID NO: 40924 - protein, 13 aa, BK virus
KLMEKYSVTFISR

SEQ ID NO: 40925 - protein, 13 aa, BK virus
LMEKYSVTFISRH

SEQ ID NO: 40926 - protein, 13 aa, BK virus
MEKYSVTFISRHM

SEQ ID NO: 40927 - protein, 13 aa, BK virus
EKYSVTFISRHMC

SEQ ID NO: 40928 - protein, 13 aa, BK virus
KYSVTFISRHMCA

SEQ ID NO: 40929 - protein, 13 aa, BK virus
YSVTFISRHMCAG

SEQ ID NO: 40930 - protein, 13 aa, BK virus
SVTFISRHMCAGH

SEQ ID NO: 40931 - protein, 13 aa, BK virus
VTFISRHMCAGHN

SEQ ID NO: 40932 - protein, 13 aa, BK virus
TFISRHMCAGHNI

SEQ ID NO: 40933 - protein, 13 aa, BK virus
FISRHMCAGHNII

SEQ ID NO: 40934 - protein, 13 aa, BK virus
ISRHMCAGHNIIF

SEQ ID NO: 40935 - protein, 13 aa, BK virus
SRHMCAGHNIIFF

SEQ ID NO: 40936 - protein, 13 aa, BK virus
RHMCAGHNIIFFL

SEQ ID NO: 40937 - protein, 13 aa, BK virus
HMCAGHNIIFFLT

SEQ ID NO: 40938 - protein, 13 aa, BK virus
MCAGHNIIFFLTP

SEQ ID NO: 40939 - protein, 13 aa, BK virus
CAGHNIIFFLTPH

SEQ ID NO: 40940 - protein, 13 aa, BK virus
AGHNIIFFLTPHR

SEQ ID NO: 40941 - protein, 13 aa, BK virus
GHNIIFFLTPHRH

SEQ ID NO: 40942 - protein, 13 aa, BK virus
HNIIFFLTPHRHR

SEQ ID NO: 40943 - protein, 13 aa, BK virus
NIIFFLTPHRHRV

SEQ ID NO: 40944 - protein, 13 aa, BK virus
IIFFLTPHRHRVS

SEQ ID NO: 40945 - protein, 13 aa, BK virus
IFFLTPHRHRVSA

SEQ ID NO: 40946 - protein, 13 aa, BK virus
FFLTPHRHRVSAI

SEQ ID NO: 40947 - protein, 13 aa, BK virus
FLTPHRHRVSAIN

SEQ ID NO: 40948 - protein, 13 aa, BK virus
LTPHRHRVSAINN

SEQ ID NO: 40949 - protein, 13 aa, BK virus
TPHRHRVSAINNF

SEQ ID NO: 40950 - protein, 13 aa, BK virus
PHRHRVSAINNFC

SEQ ID NO: 40951 - protein, 13 aa, BK virus
HRHRVSAINNFCQ

SEQ ID NO: 40952 - protein, 13 aa, BK virus
RHRVSAINNFCQK

SEQ ID NO: 40953 - protein, 13 aa, BK virus
HRVSAINNFCQKL

SEQ ID NO: 40954 - protein, 13 aa, BK virus
RVSAINNFCQKLC

SEQ ID NO: 40955 - protein, 13 aa, BK virus
VSAINNFCQKLCT

SEQ ID NO: 40956 - protein, 13 aa, BK virus
SAINNFCQKLCTF

SEQ ID NO: 40957 - protein, 13 aa, BK virus
AINNFCQKLCTFS

SEQ ID NO: 40958 - protein, 13 aa, BK virus
INNFCQKLCTFSF

SEQ ID NO: 40959 - protein, 13 aa, BK virus
NNFCQKLCTFSFL

SEQ ID NO: 40960 - protein, 13 aa, BK virus
NFCQKLCTFSFLI

SEQ ID NO: 40961 - protein, 13 aa, BK virus
FCQKLCTFSFLIC

SEQ ID NO: 40962 - protein, 13 aa, BK virus
CQKLCTFSFLICK

SEQ ID NO: 40963 - protein, 13 aa, BK virus
QKLCTFSFLICKG

SEQ ID NO: 40964 - protein, 13 aa, BK virus
KLCTFSFLICKGV

SEQ ID NO: 40965 - protein, 13 aa, BK virus
LCTFSFLICKGVN

SEQ ID NO: 40966 - protein, 13 aa, BK virus
CTFSFLICKGVNK

SEQ ID NO: 40967 - protein, 13 aa, BK virus
TFSFLICKGVNKE

SEQ ID NO: 40968 - protein, 13 aa, BK virus
FSFLICKGVNKEY

SEQ ID NO: 40969 - protein, 13 aa, BK virus
SFLICKGVNKEYL

SEQ ID NO: 40970 - protein, 13 aa, BK virus
FLICKGVNKEYLL

SEQ ID NO: 40971 - protein, 13 aa, BK virus
LICKGVNKEYLLY

SEQ ID NO: 40972 - protein, 13 aa, BK virus
ICKGVNKEYLLYS

SEQ ID NO: 40973 - protein, 13 aa, BK virus
CKGVNKEYLLYSA

SEQ ID NO: 40974 - protein, 13 aa, BK virus
KGVNKEYLLYSAL

SEQ ID NO: 40975 - protein, 13 aa, BK virus
GVNKEYLLYSALT

SEQ ID NO: 40976 - protein, 13 aa, BK virus
VNKEYLLYSALTR

SEQ ID NO: 40977 - protein, 13 aa, BK virus
NKEYLLYSALTRD

SEQ ID NO: 40978 - protein, 13 aa, BK virus
KEYLLYSALTRDP

SEQ ID NO: 40979 - protein, 13 aa, BK virus
EYLLYSALTRDPY

SEQ ID NO: 40980 - protein, 13 aa, BK virus
YLLYSALTRDPYH

SEQ ID NO: 40981 - protein, 13 aa, BK virus
LLYSALTRDPYHT

SEQ ID NO: 40982 - protein, 13 aa, BK virus
LYSALTRDPYHTI

SEQ ID NO: 40983 - protein, 13 aa, BK virus
YSALTRDPYHTIE

SEQ ID NO: 40984 - protein, 13 aa, BK virus
SALTRDPYHTIEE

SEQ ID NO: 40985 - protein, 13 aa, BK virus
ALTRDPYHTIEES

SEQ ID NO: 40986 - protein, 13 aa, BK virus
LTRDPYHTIEESI

SEQ ID NO: 40987 - protein, 13 aa, BK virus
TRDPYHTIEESIQ

SEQ ID NO: 40988 - protein, 13 aa, BK virus
RDPYHTIEESIQG

SEQ ID NO: 40989 - protein, 13 aa, BK virus
DPYHTIEESIQGG

SEQ ID NO: 40990 - protein, 13 aa, BK virus
PYHTIEESIQGGL

SEQ ID NO: 40991 - protein, 13 aa, BK virus
YHTIEESIQGGLK

SEQ ID NO: 40992 - protein, 13 aa, BK virus
HTIEESIQGGLKE

SEQ ID NO: 40993 - protein, 13 aa, BK virus
TIEESIQGGLKEH

SEQ ID NO: 40994 - protein, 13 aa, BK virus
IEESIQGGLKEHD

SEQ ID NO: 40995 - protein, 13 aa, BK virus
EESIQGGLKEHDF

SEQ ID NO: 40996 - protein, 13 aa, BK virus
ESIQGGLKEHDFS

SEQ ID NO: 40997 - protein, 13 aa, BK virus
SIQGGLKEHDFSP

SEQ ID NO: 40998 - protein, 13 aa, BK virus
IQGGLKEHDFSPE

SEQ ID NO: 40999 - protein, 13 aa, BK virus
QGGLKEHDFSPEE

SEQ ID NO: 41000 - protein, 13 aa, BK virus
GGLKEHDFSPEEP

SEQ ID NO: 41001 - protein, 13 aa, BK virus
GLKEHDFSPEEPE

SEQ ID NO: 41002 - protein, 13 aa, BK virus
LKEHDFSPEEPEE

SEQ ID NO: 41003 - protein, 13 aa, BK virus
KEHDFSPEEPEET

SEQ ID NO: 41004 - protein, 13 aa, BK virus
EHDFSPEEPEETK

SEQ ID NO: 41005 - protein, 13 aa, BK virus
HDFSPEEPEETKQ

SEQ ID NO: 41006 - protein, 13 aa, BK virus
DFSPEEPEETKQV

SEQ ID NO: 41007 - protein, 13 aa, BK virus
FSPEEPEETKQVS

SEQ ID NO: 41008 - protein, 13 aa, BK virus
SPEEPEETKQVSW

SEQ ID NO: 41009 - protein, 13 aa, BK virus
PEEPEETKQVSWK

SEQ ID NO: 41010 - protein, 13 aa, BK virus
EEPEETKQVSWKL

SEQ ID NO: 41011 - protein, 13 aa, BK virus
EPEETKQVSWKLI

SEQ ID NO: 41012 - protein, 13 aa, BK virus
PEETKQVSWKLIT

SEQ ID NO: 41013 - protein, 13 aa, BK virus
EETKQVSWKLITE

SEQ ID NO: 41014 - protein, 13 aa, BK virus
ETKQVSWKLITEY

SEQ ID NO: 41015 - protein, 13 aa, BK virus
TKQVSWKLITEYA

SEQ ID NO: 41016 - protein, 13 aa, BK virus
KQVSWKLITEYAV

SEQ ID NO: 41017 - protein, 13 aa, BK virus
QVSWKLITEYAVE

SEQ ID NO: 41018 - protein, 13 aa, BK virus
VSWKLITEYAVET

SEQ ID NO: 41019 - protein, 13 aa, BK virus
SWKLITEYAVETK

SEQ ID NO: 41020 - protein, 13 aa, BK virus
WKLITEYAVETKC

SEQ ID NO: 41021 - protein, 13 aa, BK virus
KLITEYAVETKCE

SEQ ID NO: 41022 - protein, 13 aa, BK virus
LITEYAVETKCED

SEQ ID NO: 41023 - protein, 13 aa, BK virus
ITEYAVETKCEDV

SEQ ID NO: 41024 - protein, 13 aa, BK virus
TEYAVETKCEDVF

SEQ ID NO: 41025 - protein, 13 aa, BK virus
EYAVETKCEDVFL

SEQ ID NO: 41026 - protein, 13 aa, BK virus
YAVETKCEDVFLL

SEQ ID NO: 41027 - protein, 13 aa, BK virus
AVETKCEDVFLLL

SEQ ID NO: 41028 - protein, 13 aa, BK virus
VETKCEDVFLLLG

SEQ ID NO: 41029 - protein, 13 aa, BK virus
ETKCEDVFLLLGM

SEQ ID NO: 41030 - protein, 13 aa, BK virus
TKCEDVFLLLGMY

SEQ ID NO: 41031 - protein, 13 aa, BK virus
KCEDVFLLLGMYL

SEQ ID NO: 41032 - protein, 13 aa, BK virus
CEDVFLLLGMYLE

SEQ ID NO: 41033 - protein, 13 aa, BK virus
EDVFLLLGMYLEF

SEQ ID NO: 41034 - protein, 13 aa, BK virus
DVFLLLGMYLEFQ

SEQ ID NO: 41035 - protein, 13 aa, BK virus
VFLLLGMYLEFQY

SEQ ID NO: 41036 - protein, 13 aa, BK virus
FLLLGMYLEFQYN

SEQ ID NO: 41037 - protein, 13 aa, BK virus
LLLGMYLEFQYNV

SEQ ID NO: 41038 - protein, 13 aa, BK virus
LLGMYLEFQYNVE

SEQ ID NO: 41039 - protein, 13 aa, BK virus
LGMYLEFQYNVEE

SEQ ID NO: 41040 - protein, 13 aa, BK virus
GMYLEFQYNVEEC

SEQ ID NO: 41041 - protein, 13 aa, BK virus
MYLEFQYNVEECK

SEQ ID NO: 41042 - protein, 13 aa, BK virus
YLEFQYNVEECKK

SEQ ID NO: 41043 - protein, 13 aa, BK virus
LEFQYNVEECKKC

SEQ ID NO: 41044 - protein, 13 aa, BK virus
EFQYNVEECKKCQ

SEQ ID NO: 41045 - protein, 13 aa, BK virus
FQYNVEECKKCQK

SEQ ID NO: 41046 - protein, 13 aa, BK virus
QYNVEECKKCQKK

SEQ ID NO: 41047 - protein, 13 aa, BK virus
YNVEECKKCQKKD

SEQ ID NO: 41048 - protein, 13 aa, BK virus
NVEECKKCQKKDQ

SEQ ID NO: 41049 - protein, 13 aa, BK virus
VEECKKCQKKDQP

SEQ ID NO: 41050 - protein, 13 aa, BK virus
EECKKCQKKDQPY

SEQ ID NO: 41051 - protein, 13 aa, BK virus
ECKKCQKKDQPYH

SEQ ID NO: 41052 - protein, 13 aa, BK virus
CKKCQKKDQPYHF

SEQ ID NO: 41053 - protein, 13 aa, BK virus
KKCQKKDQPYHFK

SEQ ID NO: 41054 - protein, 13 aa, BK virus
KCQKKDQPYHFKY

SEQ ID NO: 41055 - protein, 13 aa, BK virus
CQKKDQPYHFKYH

SEQ ID NO: 41056 - protein, 13 aa, BK virus
QKKDQPYHFKYHE

SEQ ID NO: 41057 - protein, 13 aa, BK virus
KKDQPYHFKYHEK

SEQ ID NO: 41058 - protein, 13 aa, BK virus
KDQPYHFKYHEKH

SEQ ID NO: 41059 - protein, 13 aa, BK virus
DQPYHFKYHEKHF

SEQ ID NO: 41060 - protein, 13 aa, BK virus
QPYHFKYHEKHFA

SEQ ID NO: 41061 - protein, 13 aa, BK virus
PYHFKYHEKHFAN

SEQ ID NO: 41062 - protein, 13 aa, BK virus
YHFKYHEKHFANA

SEQ ID NO: 41063 - protein, 13 aa, BK virus
HFKYHEKHFANAI

SEQ ID NO: 41064 - protein, 13 aa, BK virus
FKYHEKHFANAII

SEQ ID NO: 41065 - protein, 13 aa, BK virus
KYHEKHFANAIIF

SEQ ID NO: 41066 - protein, 13 aa, BK virus
YHEKHFANAIIFA

SEQ ID NO: 41067 - protein, 13 aa, BK virus
HEKHFANAIIFAE

SEQ ID NO: 41068 - protein, 13 aa, BK virus
EKHFANAIIFAES

SEQ ID NO: 41069 - protein, 13 aa, BK virus
KHFANAIIFAESK

SEQ ID NO: 41070 - protein, 13 aa, BK virus
HFANAIIFAESKN

SEQ ID NO: 41071 - protein, 13 aa, BK virus
FANAIIFAESKNQ

SEQ ID NO: 41072 - protein, 13 aa, BK virus
ANAIIFAESKNQK

SEQ ID NO: 41073 - protein, 13 aa, BK virus
NAIIFAESKNQKS

SEQ ID NO: 41074 - protein, 13 aa, BK virus
AIIFAESKNQKSI

SEQ ID NO: 41075 - protein, 13 aa, BK virus
IIFAESKNQKSIC

SEQ ID NO: 41076 - protein, 13 aa, BK virus
IFAESKNQKSICQ

SEQ ID NO: 41077 - protein, 13 aa, BK virus
FAESKNQKSICQQ

SEQ ID NO: 41078 - protein, 13 aa, BK virus
AESKNQKSICQQA

SEQ ID NO: 41079 - protein, 13 aa, BK virus
ESKNQKSICQQAV

SEQ ID NO: 41080 - protein, 13 aa, BK virus
SKNQKSICQQAVD

SEQ ID NO: 41081 - protein, 13 aa, BK virus
KNQKSICQQAVDT

SEQ ID NO: 41082 - protein, 13 aa, BK virus
NQKSICQQAVDTV

SEQ ID NO: 41083 - protein, 13 aa, BK virus
QKSICQQAVDTVL

SEQ ID NO: 41084 - protein, 13 aa, BK virus
KSICQQAVDTVLA

SEQ ID NO: 41085 - protein, 13 aa, BK virus
SICQQAVDTVLAK

SEQ ID NO: 41086 - protein, 13 aa, BK virus
ICQQAVDTVLAKK

SEQ ID NO: 41087 - protein, 13 aa, BK virus
CQQAVDTVLAKKR

SEQ ID NO: 41088 - protein, 13 aa, BK virus
QQAVDTVLAKKRV

SEQ ID NO: 41089 - protein, 13 aa, BK virus
QAVDTVLAKKRVD

SEQ ID NO: 41090 - protein, 13 aa, BK virus
AVDTVLAKKRVDT

SEQ ID NO: 41091 - protein, 13 aa, BK virus
VDTVLAKKRVDTL

SEQ ID NO: 41092 - protein, 13 aa, BK virus
DTVLAKKRVDTLH

SEQ ID NO: 41093 - protein, 13 aa, BK virus
TVLAKKRVDTLHM

SEQ ID NO: 41094 - protein, 13 aa, BK virus
VLAKKRVDTLHMT

SEQ ID NO: 41095 - protein, 13 aa, BK virus
LAKKRVDTLHMTR

SEQ ID NO: 41096 - protein, 13 aa, BK virus
AKKRVDTLHMTRE

SEQ ID NO: 41097 - protein, 13 aa, BK virus
KKRVDTLHMTREE

SEQ ID NO: 41098 - protein, 13 aa, BK virus
KRVDTLHMTREEM

SEQ ID NO: 41099 - protein, 13 aa, BK virus
RVDTLHMTREEML

SEQ ID NO: 41100 - protein, 13 aa, BK virus
VDTLHMTREEMLT

SEQ ID NO: 41101 - protein, 13 aa, BK virus
DTLHMTREEMLTE

SEQ ID NO: 41102 - protein, 13 aa, BK virus
TLHMTREEMLTER

SEQ ID NO: 41103 - protein, 13 aa, BK virus
LHMTREEMLTERF

SEQ ID NO: 41104 - protein, 13 aa, BK virus
HMTREEMLTERFN

SEQ ID NO: 41105 - protein, 13 aa, BK virus
MTREEMLTERFNH

SEQ ID NO: 41106 - protein, 13 aa, BK virus
TREEMLTERFNHI

SEQ ID NO: 41107 - protein, 13 aa, BK virus
REEMLTERFNHIL

SEQ ID NO: 41108 - protein, 13 aa, BK virus
EEMLTERFNHILD

SEQ ID NO: 41109 - protein, 13 aa, BK virus
EMLTERFNHILDK

SEQ ID NO: 41110 - protein, 13 aa, BK virus
MLTERFNHILDKM

SEQ ID NO: 41111 - protein, 13 aa, BK virus
LTERFNHILDKMD

SEQ ID NO: 41112 - protein, 13 aa, BK virus
TERFNHILDKMDL

SEQ ID NO: 41113 - protein, 13 aa, BK virus
ERFNHILDKMDLI

SEQ ID NO: 41114 - protein, 13 aa, BK virus
RFNHILDKMDLIF

SEQ ID NO: 41115 - protein, 13 aa, BK virus
FNHILDKMDLIFG

SEQ ID NO: 41116 - protein, 13 aa, BK virus
NHILDKMDLIFGA

SEQ ID NO: 41117 - protein, 13 aa, BK virus
HILDKMDLIFGAH

SEQ ID NO: 41118 - protein, 13 aa, BK virus
ILDKMDLIFGAHG

SEQ ID NO: 41119 - protein, 13 aa, BK virus
LDKMDLIFGAHGN

SEQ ID NO: 41120 - protein, 13 aa, BK virus
DKMDLIFGAHGNA

SEQ ID NO: 41121 - protein, 13 aa, BK virus
KMDLIFGAHGNAV

SEQ ID NO: 41122 - protein, 13 aa, BK virus
MDLIFGAHGNAVL

SEQ ID NO: 41123 - protein, 13 aa, BK virus
DLIFGAHGNAVLE

SEQ ID NO: 41124 - protein, 13 aa, BK virus
LIFGAHGNAVLEQ

SEQ ID NO: 41125 - protein, 13 aa, BK virus
IFGAHGNAVLEQY

SEQ ID NO: 41126 - protein, 13 aa, BK virus
FGAHGNAVLEQYM

SEQ ID NO: 41127 - protein, 13 aa, BK virus
GAHGNAVLEQYMA

SEQ ID NO: 41128 - protein, 13 aa, BK virus
AHGNAVLEQYMAG

SEQ ID NO: 41129 - protein, 13 aa, BK virus
HGNAVLEQYMAGV

SEQ ID NO: 41130 - protein, 13 aa, BK virus
GNAVLEQYMAGVA

SEQ ID NO: 41131 - protein, 13 aa, BK virus
NAVLEQYMAGVAW

SEQ ID NO: 41132 - protein, 13 aa, BK virus
AVLEQYMAGVAWL

SEQ ID NO: 41133 - protein, 13 aa, BK virus
VLEQYMAGVAWLH

SEQ ID NO: 41134 - protein, 13 aa, BK virus
LEQYMAGVAWLHC

SEQ ID NO: 41135 - protein, 13 aa, BK virus
EQYMAGVAWLHCL

SEQ ID NO: 41136 - protein, 13 aa, BK virus
QYMAGVAWLHCLL

SEQ ID NO: 41137 - protein, 13 aa, BK virus
YMAGVAWLHCLLP

SEQ ID NO: 41138 - protein, 13 aa, BK virus
MAGVAWLHCLLPK

SEQ ID NO: 41139 - protein, 13 aa, BK virus
AGVAWLHCLLPKM

SEQ ID NO: 41140 - protein, 13 aa, BK virus
GVAWLHCLLPKMD

SEQ ID NO: 41141 - protein, 13 aa, BK virus
VAWLHCLLPKMDS

SEQ ID NO: 41142 - protein, 13 aa, BK virus
AWLHCLLPKMDSV

SEQ ID NO: 41143 - protein, 13 aa, BK virus
WLHCLLPKMDSVI

SEQ ID NO: 41144 - protein, 13 aa, BK virus
LHCLLPKMDSVIF

SEQ ID NO: 41145 - protein, 13 aa, BK virus
HCLLPKMDSVIFD

SEQ ID NO: 41146 - protein, 13 aa, BK virus
CLLPKMDSVIFDF

SEQ ID NO: 41147 - protein, 13 aa, BK virus
LLPKMDSVIFDFL

SEQ ID NO: 41148 - protein, 13 aa, BK virus
LPKMDSVIFDFLH

SEQ ID NO: 41149 - protein, 13 aa, BK virus
PKMDSVIFDFLHC

SEQ ID NO: 41150 - protein, 13 aa, BK virus
KMDSVIFDFLHCI

SEQ ID NO: 41151 - protein, 13 aa, BK virus
MDSVIFDFLHCIV

SEQ ID NO: 41152 - protein, 13 aa, BK virus
DSVIFDFLHCIVF

SEQ ID NO: 41153 - protein, 13 aa, BK virus
SVIFDFLHCIVFN

SEQ ID NO: 41154 - protein, 13 aa, BK virus
VIFDFLHCIVFNV

SEQ ID NO: 41155 - protein, 13 aa, BK virus
IFDFLHCIVFNVP

SEQ ID NO: 41156 - protein, 13 aa, BK virus
FDFLHCIVFNVPK

SEQ ID NO: 41157 - protein, 13 aa, BK virus
DFLHCIVFNVPKR

SEQ ID NO: 41158 - protein, 13 aa, BK virus
FLHCIVFNVPKRR

SEQ ID NO: 41159 - protein, 13 aa, BK virus
LHCIVFNVPKRRY

SEQ ID NO: 41160 - protein, 13 aa, BK virus
HCIVFNVPKRRYW

SEQ ID NO: 41161 - protein, 13 aa, BK virus
CIVFNVPKRRYWL

SEQ ID NO: 41162 - protein, 13 aa, BK virus
IVFNVPKRRYWLF

SEQ ID NO: 41163 - protein, 13 aa, BK virus
VFNVPKRRYWLFK

SEQ ID NO: 41164 - protein, 13 aa, BK virus
FNVPKRRYWLFKG

SEQ ID NO: 41165 - protein, 13 aa, BK virus
NVPKRRYWLFKGP

SEQ ID NO: 41166 - protein, 13 aa, BK virus
VPKRRYWLFKGPI

SEQ ID NO: 41167 - protein, 13 aa, BK virus
PKRRYWLFKGPID

SEQ ID NO: 41168 - protein, 13 aa, BK virus
KRRYWLFKGPIDS

SEQ ID NO: 41169 - protein, 13 aa, BK virus
RRYWLFKGPIDSG

SEQ ID NO: 41170 - protein, 13 aa, BK virus
RYWLFKGPIDSGK

SEQ ID NO: 41171 - protein, 13 aa, BK virus
YWLFKGPIDSGKT

SEQ ID NO: 41172 - protein, 13 aa, BK virus
WLFKGPIDSGKTT

SEQ ID NO: 41173 - protein, 13 aa, BK virus
LFKGPIDSGKTTL

SEQ ID NO: 41174 - protein, 13 aa, BK virus
FKGPIDSGKTTLA

SEQ ID NO: 41175 - protein, 13 aa, BK virus
KGPIDSGKTTLAA

SEQ ID NO: 41176 - protein, 13 aa, BK virus
GPIDSGKTTLAAG

SEQ ID NO: 41177 - protein, 13 aa, BK virus
PIDSGKTTLAAGL

SEQ ID NO: 41178 - protein, 13 aa, BK virus
IDSGKTTLAAGLL

SEQ ID NO: 41179 - protein, 13 aa, BK virus
DSGKTTLAAGLLD

SEQ ID NO: 41180 - protein, 13 aa, BK virus
SGKTTLAAGLLDL

SEQ ID NO: 41181 - protein, 13 aa, BK virus
GKTTLAAGLLDLC

SEQ ID NO: 41182 - protein, 13 aa, BK virus
KTTLAAGLLDLCG

SEQ ID NO: 41183 - protein, 13 aa, BK virus
TTLAAGLLDLCGG

SEQ ID NO: 41184 - protein, 13 aa, BK virus
TLAAGLLDLCGGK

SEQ ID NO: 41185 - protein, 13 aa, BK virus
LAAGLLDLCGGKA

SEQ ID NO: 41186 - protein, 13 aa, BK virus
AAGLLDLCGGKAL

SEQ ID NO: 41187 - protein, 13 aa, BK virus
AGLLDLCGGKALN

SEQ ID NO: 41188 - protein, 13 aa, BK virus
GLLDLCGGKALNV

SEQ ID NO: 41189 - protein, 13 aa, BK virus
LLDLCGGKALNVN

SEQ ID NO: 41190 - protein, 13 aa, BK virus
LDLCGGKALNVNL

SEQ ID NO: 41191 - protein, 13 aa, BK virus
DLCGGKALNVNLP

SEQ ID NO: 41192 - protein, 13 aa, BK virus
LCGGKALNVNLPM

SEQ ID NO: 41193 - protein, 13 aa, BK virus
CGGKALNVNLPME

SEQ ID NO: 41194 - protein, 13 aa, BK virus
GGKALNVNLPMER

SEQ ID NO: 41195 - protein, 13 aa, BK virus
GKALNVNLPMERL

SEQ ID NO: 41196 - protein, 13 aa, BK virus
KALNVNLPMERLT

SEQ ID NO: 41197 - protein, 13 aa, BK virus
ALNVNLPMERLTF

SEQ ID NO: 41198 - protein, 13 aa, BK virus
LNVNLPMERLTFE

SEQ ID NO: 41199 - protein, 13 aa, BK virus
NVNLPMERLTFEL

SEQ ID NO: 41200 - protein, 13 aa, BK virus
VNLPMERLTFELG

SEQ ID NO: 41201 - protein, 13 aa, BK virus
NLPMERLTFELGV

SEQ ID NO: 41202 - protein, 13 aa, BK virus
LPMERLTFELGVA

SEQ ID NO: 41203 - protein, 13 aa, BK virus
PMERLTFELGVAI

SEQ ID NO: 41204 - protein, 13 aa, BK virus
MERLTFELGVAID

SEQ ID NO: 41205 - protein, 13 aa, BK virus
ERLTFELGVAIDQ

SEQ ID NO: 41206 - protein, 13 aa, BK virus
RLTFELGVAIDQY

SEQ ID NO: 41207 - protein, 13 aa, BK virus
LTFELGVAIDQYM

SEQ ID NO: 41208 - protein, 13 aa, BK virus
TFELGVAIDQYMV

SEQ ID NO: 41209 - protein, 13 aa, BK virus
FELGVAIDQYMVV

SEQ ID NO: 41210 - protein, 13 aa, BK virus
ELGVAIDQYMVVF

SEQ ID NO: 41211 - protein, 13 aa, BK virus
LGVAIDQYMVVFE

SEQ ID NO: 41212 - protein, 13 aa, BK virus
GVAIDQYMVVFED

SEQ ID NO: 41213 - protein, 13 aa, BK virus
VAIDQYMVVFEDV

SEQ ID NO: 41214 - protein, 13 aa, BK virus
AIDQYMVVFEDVK

SEQ ID NO: 41215 - protein, 13 aa, BK virus
IDQYMVVFEDVKG

SEQ ID NO: 41216 - protein, 13 aa, BK virus
DQYMVVFEDVKGT

SEQ ID NO: 41217 - protein, 13 aa, BK virus
QYMVVFEDVKGTG

SEQ ID NO: 41218 - protein, 13 aa, BK virus
YMVVFEDVKGTGA

SEQ ID NO: 41219 - protein, 13 aa, BK virus
MVVFEDVKGTGAE

SEQ ID NO: 41220 - protein, 13 aa, BK virus
VVFEDVKGTGAES

SEQ ID NO: 41221 - protein, 13 aa, BK virus
VFEDVKGTGAESK

SEQ ID NO: 41222 - protein, 13 aa, BK virus
FEDVKGTGAESKD

SEQ ID NO: 41223 - protein, 13 aa, BK virus
EDVKGTGAESKDL

SEQ ID NO: 41224 - protein, 13 aa, BK virus
DVKGTGAESKDLP

SEQ ID NO: 41225 - protein, 13 aa, BK virus
VKGTGAESKDLPS

SEQ ID NO: 41226 - protein, 13 aa, BK virus
KGTGAESKDLPSG

SEQ ID NO: 41227 - protein, 13 aa, BK virus
GTGAESKDLPSGH

SEQ ID NO: 41228 - protein, 13 aa, BK virus
TGAESKDLPSGHG

SEQ ID NO: 41229 - protein, 13 aa, BK virus
GAESKDLPSGHGI

SEQ ID NO: 41230 - protein, 13 aa, BK virus
AESKDLPSGHGIN

SEQ ID NO: 41231 - protein, 13 aa, BK virus
ESKDLPSGHGINN

SEQ ID NO: 41232 - protein, 13 aa, BK virus
SKDLPSGHGINNL

SEQ ID NO: 41233 - protein, 13 aa, BK virus
KDLPSGHGINNLD

SEQ ID NO: 41234 - protein, 13 aa, BK virus
DLPSGHGINNLDS

SEQ ID NO: 41235 - protein, 13 aa, BK virus
LPSGHGINNLDSL

SEQ ID NO: 41236 - protein, 13 aa, BK virus
PSGHGINNLDSLR

SEQ ID NO: 41237 - protein, 13 aa, BK virus
SGHGINNLDSLRD

SEQ ID NO: 41238 - protein, 13 aa, BK virus
GHGINNLDSLRDY

SEQ ID NO: 41239 - protein, 13 aa, BK virus
HGINNLDSLRDYL

SEQ ID NO: 41240 - protein, 13 aa, BK virus
GINNLDSLRDYLD

SEQ ID NO: 41241 - protein, 13 aa, BK virus
INNLDSLRDYLDG

SEQ ID NO: 41242 - protein, 13 aa, BK virus
NNLDSLRDYLDGS

SEQ ID NO: 41243 - protein, 13 aa, BK virus
NLDSLRDYLDGSV

SEQ ID NO: 41244 - protein, 13 aa, BK virus
LDSLRDYLDGSVK

SEQ ID NO: 41245 - protein, 13 aa, BK virus
DSLRDYLDGSVKV

SEQ ID NO: 41246 - protein, 13 aa, BK virus
SLRDYLDGSVKVN

SEQ ID NO: 41247 - protein, 13 aa, BK virus
LRDYLDGSVKVNL

SEQ ID NO: 41248 - protein, 13 aa, BK virus
RDYLDGSVKVNLE

SEQ ID NO: 41249 - protein, 13 aa, BK virus
DYLDGSVKVNLEK

SEQ ID NO: 41250 - protein, 13 aa, BK virus
YLDGSVKVNLEKK

SEQ ID NO: 41251 - protein, 13 aa, BK virus
LDGSVKVNLEKKH

SEQ ID NO: 41252 - protein, 13 aa, BK virus
DGSVKVNLEKKHL

SEQ ID NO: 41253 - protein, 13 aa, BK virus
GSVKVNLEKKHLN

SEQ ID NO: 41254 - protein, 13 aa, BK virus
SVKVNLEKKHLNK

SEQ ID NO: 41255 - protein, 13 aa, BK virus
VKVNLEKKHLNKR

SEQ ID NO: 41256 - protein, 13 aa, BK virus
KVNLEKKHLNKRT

SEQ ID NO: 41257 - protein, 13 aa, BK virus
VNLEKKHLNKRTQ

SEQ ID NO: 41258 - protein, 13 aa, BK virus
NLEKKHLNKRTQI

SEQ ID NO: 41259 - protein, 13 aa, BK virus
LEKKHLNKRTQIF

SEQ ID NO: 41260 - protein, 13 aa, BK virus
EKKHLNKRTQIFP

SEQ ID NO: 41261 - protein, 13 aa, BK virus
KKHLNKRTQIFPP

SEQ ID NO: 41262 - protein, 13 aa, BK virus
KHLNKRTQIFPPG

SEQ ID NO: 41263 - protein, 13 aa, BK virus
HLNKRTQIFPPGL

SEQ ID NO: 41264 - protein, 13 aa, BK virus
LNKRTQIFPPGLV

SEQ ID NO: 41265 - protein, 13 aa, BK virus
NKRTQIFPPGLVT

SEQ ID NO: 41266 - protein, 13 aa, BK virus
KRTQIFPPGLVTM

SEQ ID NO: 41267 - protein, 13 aa, BK virus
RTQIFPPGLVTMN

SEQ ID NO: 41268 - protein, 13 aa, BK virus
TQIFPPGLVTMNE

SEQ ID NO: 41269 - protein, 13 aa, BK virus
QIFPPGLVTMNEY

SEQ ID NO: 41270 - protein, 13 aa, BK virus
IFPPGLVTMNEYP

SEQ ID NO: 41271 - protein, 13 aa, BK virus
FPPGLVTMNEYPV

SEQ ID NO: 41272 - protein, 13 aa, BK virus
PPGLVTMNEYPVP

SEQ ID NO: 41273 - protein, 13 aa, BK virus
PGLVTMNEYPVPK

SEQ ID NO: 41274 - protein, 13 aa, BK virus
GLVTMNEYPVPKT

SEQ ID NO: 41275 - protein, 13 aa, BK virus
LVTMNEYPVPKTL

SEQ ID NO: 41276 - protein, 13 aa, BK virus
VTMNEYPVPKTLQ

SEQ ID NO: 41277 - protein, 13 aa, BK virus
TMNEYPVPKTLQA

SEQ ID NO: 41278 - protein, 13 aa, BK virus
MNEYPVPKTLQAR

SEQ ID NO: 41279 - protein, 13 aa, BK virus
NEYPVPKTLQARF

SEQ ID NO: 41280 - protein, 13 aa, BK virus
EYPVPKTLQARFV

SEQ ID NO: 41281 - protein, 13 aa, BK virus
YPVPKTLQARFVR

SEQ ID NO: 41282 - protein, 13 aa, BK virus
PVPKTLQARFVRQ

SEQ ID NO: 41283 - protein, 13 aa, BK virus
VPKTLQARFVRQI

SEQ ID NO: 41284 - protein, 13 aa, BK virus
PKTLQARFVRQID

SEQ ID NO: 41285 - protein, 13 aa, BK virus
KTLQARFVRQIDF

SEQ ID NO: 41286 - protein, 13 aa, BK virus
TLQARFVRQIDFR

SEQ ID NO: 41287 - protein, 13 aa, BK virus
LQARFVRQIDFRP

SEQ ID NO: 41288 - protein, 13 aa, BK virus
QARFVRQIDFRPK

SEQ ID NO: 41289 - protein, 13 aa, BK virus
ARFVRQIDFRPKI

SEQ ID NO: 41290 - protein, 13 aa, BK virus
RFVRQIDFRPKIY

SEQ ID NO: 41291 - protein, 13 aa, BK virus
FVRQIDFRPKIYL

SEQ ID NO: 41292 - protein, 13 aa, BK virus
VRQIDFRPKIYLR

SEQ ID NO: 41293 - protein, 13 aa, BK virus
RQIDFRPKIYLRK

SEQ ID NO: 41294 - protein, 13 aa, BK virus
QIDFRPKIYLRKS

SEQ ID NO: 41295 - protein, 13 aa, BK virus
IDFRPKIYLRKSL

SEQ ID NO: 41296 - protein, 13 aa, BK virus
DFRPKIYLRKSLQ

SEQ ID NO: 41297 - protein, 13 aa, BK virus
FRPKIYLRKSLQN

SEQ ID NO: 41298 - protein, 13 aa, BK virus
RPKIYLRKSLQNS

SEQ ID NO: 41299 - protein, 13 aa, BK virus
PKIYLRKSLQNSE

SEQ ID NO: 41300 - protein, 13 aa, BK virus
KIYLRKSLQNSEF

SEQ ID NO: 41301 - protein, 13 aa, BK virus
IYLRKSLQNSEFL

SEQ ID NO: 41302 - protein, 13 aa, BK virus
YLRKSLQNSEFLL

SEQ ID NO: 41303 - protein, 13 aa, BK virus
LRKSLQNSEFLLE

SEQ ID NO: 41304 - protein, 13 aa, BK virus
RKSLQNSEFLLEK

SEQ ID NO: 41305 - protein, 13 aa, BK virus
KSLQNSEFLLEKR

SEQ ID NO: 41306 - protein, 13 aa, BK virus
SLQNSEFLLEKRI

SEQ ID NO: 41307 - protein, 13 aa, BK virus
LQNSEFLLEKRIL

SEQ ID NO: 41308 - protein, 13 aa, BK virus
QNSEFLLEKRILQ

SEQ ID NO: 41309 - protein, 13 aa, BK virus
NSEFLLEKRILQS

SEQ ID NO: 41310 - protein, 13 aa, BK virus
SEFLLEKRILQSG

SEQ ID NO: 41311 - protein, 13 aa, BK virus
EFLLEKRILQSGM

SEQ ID NO: 41312 - protein, 13 aa, BK virus
FLLEKRILQSGMT

SEQ ID NO: 41313 - protein, 13 aa, BK virus
LLEKRILQSGMTL

SEQ ID NO: 41314 - protein, 13 aa, BK virus
LEKRILQSGMTLL

SEQ ID NO: 41315 - protein, 13 aa, BK virus
EKRILQSGMTLLL

SEQ ID NO: 41316 - protein, 13 aa, BK virus
KRILQSGMTLLLL

SEQ ID NO: 41317 - protein, 13 aa, BK virus
RILQSGMTLLLLL

SEQ ID NO: 41318 - protein, 13 aa, BK virus
ILQSGMTLLLLLI

SEQ ID NO: 41319 - protein, 13 aa, BK virus
LQSGMTLLLLLIW

SEQ ID NO: 41320 - protein, 13 aa, BK virus
QSGMTLLLLLIWF

SEQ ID NO: 41321 - protein, 13 aa, BK virus
SGMTLLLLLIWFR

SEQ ID NO: 41322 - protein, 13 aa, BK virus
GMTLLLLLIWFRP

SEQ ID NO: 41323 - protein, 13 aa, BK virus
MTLLLLLIWFRPV

SEQ ID NO: 41324 - protein, 13 aa, BK virus
TLLLLLIWFRPVA

SEQ ID NO: 41325 - protein, 13 aa, BK virus
LLLLLIWFRPVAD

SEQ ID NO: 41326 - protein, 13 aa, BK virus
LLLLIWFRPVADF

SEQ ID NO: 41327 - protein, 13 aa, BK virus
LLLIWFRPVADFA

SEQ ID NO: 41328 - protein, 13 aa, BK virus
LLIWFRPVADFAT

SEQ ID NO: 41329 - protein, 13 aa, BK virus
LIWFRPVADFATD

SEQ ID NO: 41330 - protein, 13 aa, BK virus
IWFRPVADFATDI

SEQ ID NO: 41331 - protein, 13 aa, BK virus
WFRPVADFATDIQ

SEQ ID NO: 41332 - protein, 13 aa, BK virus
FRPVADFATDIQS

SEQ ID NO: 41333 - protein, 13 aa, BK virus
RPVADFATDIQSR

SEQ ID NO: 41334 - protein, 13 aa, BK virus
PVADFATDIQSRI

SEQ ID NO: 41335 - protein, 13 aa, BK virus
VADFATDIQSRIV

SEQ ID NO: 41336 - protein, 13 aa, BK virus
ADFATDIQSRIVE

SEQ ID NO: 41337 - protein, 13 aa, BK virus
DFATDIQSRIVEW

SEQ ID NO: 41338 - protein, 13 aa, BK virus
FATDIQSRIVEWK

SEQ ID NO: 41339 - protein, 13 aa, BK virus
ATDIQSRIVEWKE

SEQ ID NO: 41340 - protein, 13 aa, BK virus
TDIQSRIVEWKER

SEQ ID NO: 41341 - protein, 13 aa, BK virus
DIQSRIVEWKERL

SEQ ID NO: 41342 - protein, 13 aa, BK virus
IQSRIVEWKERLD

SEQ ID NO: 41343 - protein, 13 aa, BK virus
QSRIVEWKERLDS

SEQ ID NO: 41344 - protein, 13 aa, BK virus
SRIVEWKERLDSE

SEQ ID NO: 41345 - protein, 13 aa, BK virus
RIVEWKERLDSEI

SEQ ID NO: 41346 - protein, 13 aa, BK virus
IVEWKERLDSEIS

SEQ ID NO: 41347 - protein, 13 aa, BK virus
VEWKERLDSEISM

SEQ ID NO: 41348 - protein, 13 aa, BK virus
EWKERLDSEISMY

SEQ ID NO: 41349 - protein, 13 aa, BK virus
WKERLDSEISMYT

SEQ ID NO: 41350 - protein, 13 aa, BK virus
KERLDSEISMYTF

SEQ ID NO: 41351 - protein, 13 aa, BK virus
ERLDSEISMYTFS

SEQ ID NO: 41352 - protein, 13 aa, BK virus
RLDSEISMYTFSR

SEQ ID NO: 41353 - protein, 13 aa, BK virus
LDSEISMYTFSRM

SEQ ID NO: 41354 - protein, 13 aa, BK virus
DSEISMYTFSRMK

SEQ ID NO: 41355 - protein, 13 aa, BK virus
SEISMYTFSRMKY

SEQ ID NO: 41356 - protein, 13 aa, BK virus
EISMYTFSRMKYN

SEQ ID NO: 41357 - protein, 13 aa, BK virus
ISMYTFSRMKYNI

SEQ ID NO: 41358 - protein, 13 aa, BK virus
SMYTFSRMKYNIC

SEQ ID NO: 41359 - protein, 13 aa, BK virus
MYTFSRMKYNICM

SEQ ID NO: 41360 - protein, 13 aa, BK virus
YTFSRMKYNICMG

SEQ ID NO: 41361 - protein, 13 aa, BK virus
TFSRMKYNICMGK

SEQ ID NO: 41362 - protein, 13 aa, BK virus
FSRMKYNICMGKC

SEQ ID NO: 41363 - protein, 13 aa, BK virus
SRMKYNICMGKCI

SEQ ID NO: 41364 - protein, 13 aa, BK virus
RMKYNICMGKCIL

SEQ ID NO: 41365 - protein, 13 aa, BK virus
MKYNICMGKCILD

SEQ ID NO: 41366 - protein, 13 aa, BK virus
KYNICMGKCILDI

SEQ ID NO: 41367 - protein, 13 aa, BK virus
YNICMGKCILDIT

SEQ ID NO: 41368 - protein, 13 aa, BK virus
NICMGKCILDITR

SEQ ID NO: 41369 - protein, 13 aa, BK virus
ICMGKCILDITRE

SEQ ID NO: 41370 - protein, 13 aa, BK virus
CMGKCILDITREE

SEQ ID NO: 41371 - protein, 13 aa, BK virus
MGKCILDITREED

SEQ ID NO: 41372 - protein, 13 aa, BK virus
GKCILDITREEDS

SEQ ID NO: 41373 - protein, 13 aa, BK virus
KCILDITREEDSE

SEQ ID NO: 41374 - protein, 13 aa, BK virus
CILDITREEDSET

SEQ ID NO: 41375 - protein, 13 aa, BK virus
ILDITREEDSETE

SEQ ID NO: 41376 - protein, 13 aa, BK virus
LDITREEDSETED

SEQ ID NO: 41377 - protein, 13 aa, BK virus
DITREEDSETEDS

SEQ ID NO: 41378 - protein, 13 aa, BK virus
ITREEDSETEDSG

SEQ ID NO: 41379 - protein, 13 aa, BK virus
TREEDSETEDSGH

SEQ ID NO: 41380 - protein, 13 aa, BK virus
REEDSETEDSGHG

SEQ ID NO: 41381 - protein, 13 aa, BK virus
EEDSETEDSGHGS

SEQ ID NO: 41382 - protein, 13 aa, BK virus
EDSETEDSGHGSS

SEQ ID NO: 41383 - protein, 13 aa, BK virus
DSETEDSGHGSST

SEQ ID NO: 41384 - protein, 13 aa, BK virus
SETEDSGHGSSTE

SEQ ID NO: 41385 - protein, 13 aa, BK virus
ETEDSGHGSSTES

SEQ ID NO: 41386 - protein, 13 aa, BK virus
TEDSGHGSSTESQ

SEQ ID NO: 41387 - protein, 13 aa, BK virus
EDSGHGSSTESQS

SEQ ID NO: 41388 - protein, 13 aa, BK virus
DSGHGSSTESQSQ

SEQ ID NO: 41389 - protein, 13 aa, BK virus
SGHGSSTESQSQC

SEQ ID NO: 41390 - protein, 13 aa, BK virus
GHGSSTESQSQCS

SEQ ID NO: 41391 - protein, 13 aa, BK virus
HGSSTESQSQCSS

SEQ ID NO: 41392 - protein, 13 aa, BK virus
GSSTESQSQCSSQ

SEQ ID NO: 41393 - protein, 13 aa, BK virus
SSTESQSQCSSQV

SEQ ID NO: 41394 - protein, 13 aa, BK virus
STESQSQCSSQVS

SEQ ID NO: 41395 - protein, 13 aa, BK virus
TESQSQCSSQVSD

SEQ ID NO: 41396 - protein, 13 aa, BK virus
ESQSQCSSQVSDT

SEQ ID NO: 41397 - protein, 13 aa, BK virus
SQSQCSSQVSDTS

SEQ ID NO: 41398 - protein, 13 aa, BK virus
QSQCSSQVSDTSA

SEQ ID NO: 41399 - protein, 13 aa, BK virus
SQCSSQVSDTSAP

SEQ ID NO: 41400 - protein, 13 aa, BK virus
QCSSQVSDTSAPA

SEQ ID NO: 41401 - protein, 13 aa, BK virus
CSSQVSDTSAPAE

SEQ ID NO: 41402 - protein, 13 aa, BK virus
SSQVSDTSAPAED

SEQ ID NO: 41403 - protein, 13 aa, BK virus
SQVSDTSAPAEDS

SEQ ID NO: 41404 - protein, 13 aa, BK virus
QVSDTSAPAEDSQ

SEQ ID NO: 41405 - protein, 13 aa, BK virus
VSDTSAPAEDSQR

SEQ ID NO: 41406 - protein, 13 aa, BK virus
SDTSAPAEDSQRS

SEQ ID NO: 41407 - protein, 13 aa, BK virus
DTSAPAEDSQRSD

SEQ ID NO: 41408 - protein, 13 aa, BK virus
TSAPAEDSQRSDP

SEQ ID NO: 41409 - protein, 13 aa, BK virus
SAPAEDSQRSDPH

SEQ ID NO: 41410 - protein, 13 aa, BK virus
APAEDSQRSDPHS

SEQ ID NO: 41411 - protein, 13 aa, BK virus
PAEDSQRSDPHSQ

SEQ ID NO: 41412 - protein, 13 aa, BK virus
AEDSQRSDPHSQE

SEQ ID NO: 41413 - protein, 13 aa, BK virus
EDSQRSDPHSQEL

SEQ ID NO: 41414 - protein, 13 aa, BK virus
DSQRSDPHSQELH

SEQ ID NO: 41415 - protein, 13 aa, BK virus
SQRSDPHSQELHL

SEQ ID NO: 41416 - protein, 13 aa, BK virus
QRSDPHSQELHLC

SEQ ID NO: 41417 - protein, 13 aa, BK virus
RSDPHSQELHLCK

SEQ ID NO: 41418 - protein, 13 aa, BK virus
SDPHSQELHLCKG

SEQ ID NO: 41419 - protein, 13 aa, BK virus
DPHSQELHLCKGF

SEQ ID NO: 41420 - protein, 13 aa, BK virus
PHSQELHLCKGFQ

SEQ ID NO: 41421 - protein, 13 aa, BK virus
HSQELHLCKGFQC

SEQ ID NO: 41422 - protein, 13 aa, BK virus
SQELHLCKGFQCF

SEQ ID NO: 41423 - protein, 13 aa, BK virus
QELHLCKGFQCFK

SEQ ID NO: 41424 - protein, 13 aa, BK virus
ELHLCKGFQCFKR

SEQ ID NO: 41425 - protein, 13 aa, BK virus
LHLCKGFQCFKRP

SEQ ID NO: 41426 - protein, 13 aa, BK virus
HLCKGFQCFKRPK

SEQ ID NO: 41427 - protein, 13 aa, BK virus
LCKGFQCFKRPKT

SEQ ID NO: 41428 - protein, 13 aa, BK virus
CKGFQCFKRPKTP

SEQ ID NO: 41429 - protein, 13 aa, BK virus
KGFQCFKRPKTPP

SEQ ID NO: 41430 - protein, 13 aa, BK virus
GFQCFKRPKTPPP

SEQ ID NO: 41431 - protein, 13 aa, BK virus
FQCFKRPKTPPPK

SEQ ID NO: 41432 - protein, 13 aa, BK virus
HKLKSGLYKSSIY

SEQ ID NO: 41433 - protein, 13 aa, BK virus
MYMYNKSTCLKHF

SEQ ID NO: 41434 - protein, 13 aa, BK virus
YMYNKSTCLKHFG

SEQ ID NO: 41435 - protein, 13 aa, BK virus
MYNKSTCLKHFGL

SEQ ID NO: 41436 - protein, 13 aa, BK virus
YNKSTCLKHFGLQ

SEQ ID NO: 41437 - protein, 13 aa, BK virus
NKSTCLKHFGLQL

SEQ ID NO: 41438 - protein, 13 aa, BK virus
KSTCLKHFGLQLS

SEQ ID NO: 41439 - protein, 13 aa, BK virus
STCLKHFGLQLSL

SEQ ID NO: 41440 - protein, 13 aa, BK virus
TCLKHFGLQLSLF

SEQ ID NO: 41441 - protein, 13 aa, BK virus
CLKHFGLQLSLFV

SEQ ID NO: 41442 - protein, 13 aa, BK virus
LKHFGLQLSLFVN

SEQ ID NO: 41443 - protein, 13 aa, BK virus
KHFGLQLSLFVNI

SEQ ID NO: 41444 - protein, 13 aa, BK virus
HFGLQLSLFVNIS

SEQ ID NO: 41445 - protein, 13 aa, BK virus
FGLQLSLFVNISY

SEQ ID NO: 41446 - protein, 13 aa, BK virus
GLQLSLFVNISYH

SEQ ID NO: 41447 - protein, 13 aa, BK virus
LQLSLFVNISYHI

SEQ ID NO: 41448 - protein, 13 aa, BK virus
QLSLFVNISYHIW

SEQ ID NO: 41449 - protein, 13 aa, BK virus
LSLFVNISYHIWV

SEQ ID NO: 41450 - protein, 13 aa, BK virus
SLFVNISYHIWVP

SEQ ID NO: 41451 - protein, 13 aa, BK virus
LFVNISYHIWVPW

SEQ ID NO: 41452 - protein, 13 aa, BK virus
FVNISYHIWVPWK

SEQ ID NO: 41453 - protein, 13 aa, BK virus
VNISYHIWVPWKS

SEQ ID NO: 41454 - protein, 13 aa, BK virus
NISYHIWVPWKSF

SEQ ID NO: 41455 - protein, 13 aa, BK virus
ISYHIWVPWKSFC

SEQ ID NO: 41456 - protein, 13 aa, BK virus
SYHIWVPWKSFCA

SEQ ID NO: 41457 - protein, 13 aa, BK virus
YHIWVPWKSFCAI

SEQ ID NO: 41458 - protein, 13 aa, BK virus
HIWVPWKSFCAIK

SEQ ID NO: 41459 - protein, 13 aa, BK virus
IWVPWKSFCAIKH

SEQ ID NO: 41460 - protein, 13 aa, BK virus
WVPWKSFCAIKHP

SEQ ID NO: 41461 - protein, 13 aa, BK virus
VPWKSFCAIKHPN

SEQ ID NO: 41462 - protein, 13 aa, BK virus
PWKSFCAIKHPNL

SEQ ID NO: 41463 - protein, 13 aa, BK virus
WKSFCAIKHPNLF

SEQ ID NO: 41464 - protein, 13 aa, BK virus
KSFCAIKHPNLFY

SEQ ID NO: 41465 - protein, 13 aa, BK virus
SFCAIKHPNLFYL

SEQ ID NO: 41466 - protein, 13 aa, BK virus
FCAIKHPNLFYLG

SEQ ID NO: 41467 - protein, 13 aa, BK virus
CAIKHPNLFYLGF

SEQ ID NO: 41468 - protein, 13 aa, BK virus
AIKHPNLFYLGFH

SEQ ID NO: 41469 - protein, 13 aa, BK virus
IKHPNLFYLGFHT

SEQ ID NO: 41470 - protein, 13 aa, BK virus
KHPNLFYLGFHTI

SEQ ID NO: 41471 - protein, 13 aa, BK virus
HPNLFYLGFHTIH

SEQ ID NO: 41472 - protein, 13 aa, BK virus
PNLFYLGFHTIHR

SEQ ID NO: 41473 - protein, 13 aa, BK virus
NLFYLGFHTIHRL

SEQ ID NO: 41474 - protein, 13 aa, BK virus
LFYLGFHTIHRLP

SEQ ID NO: 41475 - protein, 13 aa, BK virus
FYLGFHTIHRLPI

SEQ ID NO: 41476 - protein, 13 aa, BK virus
YLGFHTIHRLPIH

SEQ ID NO: 41477 - protein, 13 aa, BK virus
LGFHTIHRLPIHS

SEQ ID NO: 41478 - protein, 13 aa, BK virus
GFHTIHRLPIHSL

SEQ ID NO: 41479 - protein, 13 aa, BK virus
FHTIHRLPIHSLG

SEQ ID NO: 41480 - protein, 13 aa, BK virus
HTIHRLPIHSLGS

SEQ ID NO: 41481 - protein, 13 aa, BK virus
TIHRLPIHSLGSP

SEQ ID NO: 41482 - protein, 13 aa, BK virus
IHRLPIHSLGSPV

SEQ ID NO: 41483 - protein, 13 aa, BK virus
HRLPIHSLGSPVY

SEQ ID NO: 41484 - protein, 13 aa, BK virus
RLPIHSLGSPVYK

SEQ ID NO: 41485 - protein, 13 aa, BK virus
LPIHSLGSPVYKV

SEQ ID NO: 41486 - protein, 13 aa, BK virus
PIHSLGSPVYKVT

SEQ ID NO: 41487 - protein, 13 aa, BK virus
QKGNWVRILYRSF

SEQ ID NO: 41488 - protein, 13 aa, BK virus
KGNWVRILYRSFS

SEQ ID NO: 41489 - protein, 13 aa, BK virus
GNWVRILYRSFSQ

SEQ ID NO: 41490 - protein, 13 aa, BK virus
NWVRILYRSFSQA

SEQ ID NO: 41491 - protein, 13 aa, BK virus
WVRILYRSFSQAD

SEQ ID NO: 41492 - protein, 13 aa, BK virus
VRILYRSFSQADL

SEQ ID NO: 41493 - protein, 13 aa, BK virus
RILYRSFSQADLK

SEQ ID NO: 41494 - protein, 13 aa, BK virus
ILYRSFSQADLKI

SEQ ID NO: 41495 - protein, 13 aa, BK virus
LYRSFSQADLKIS

SEQ ID NO: 41496 - protein, 13 aa, BK virus
YRSFSQADLKISC

SEQ ID NO: 41497 - protein, 13 aa, BK virus
RSFSQADLKISCK

SEQ ID NO: 41498 - protein, 13 aa, BK virus
SFSQADLKISCKA

SEQ ID NO: 41499 - protein, 13 aa, BK virus
FSQADLKISCKAS

SEQ ID NO: 41500 - protein, 13 aa, BK virus
SQADLKISCKASP

SEQ ID NO: 41501 - protein, 13 aa, BK virus
QADLKISCKASPL

SEQ ID NO: 41502 - protein, 13 aa, BK virus
ADLKISCKASPLL

SEQ ID NO: 41503 - protein, 13 aa, BK virus
DLKISCKASPLLC

SEQ ID NO: 41504 - protein, 13 aa, BK virus
LKISCKASPLLCS

SEQ ID NO: 41505 - protein, 13 aa, BK virus
KISCKASPLLCSR

SEQ ID NO: 41506 - protein, 13 aa, BK virus
ISCKASPLLCSRA

SEQ ID NO: 41507 - protein, 13 aa, BK virus
SCKASPLLCSRAV

SEQ ID NO: 41508 - protein, 13 aa, BK virus
CKASPLLCSRAVS

SEQ ID NO: 41509 - protein, 13 aa, BK virus
KASPLLCSRAVSK

SEQ ID NO: 41510 - protein, 13 aa, BK virus
ASPLLCSRAVSKQ

SEQ ID NO: 41511 - protein, 13 aa, BK virus
SPLLCSRAVSKQA

SEQ ID NO: 41512 - protein, 13 aa, BK virus
PLLCSRAVSKQAT

SEQ ID NO: 41513 - protein, 13 aa, BK virus
LLCSRAVSKQATN

SEQ ID NO: 41514 - protein, 13 aa, BK virus
LCSRAVSKQATNI

SEQ ID NO: 41515 - protein, 13 aa, BK virus
CSRAVSKQATNIS

SEQ ID NO: 41516 - protein, 13 aa, BK virus
SRAVSKQATNISS

SEQ ID NO: 41517 - protein, 13 aa, BK virus
NIQAISFTKRPHT

SEQ ID NO: 41518 - protein, 13 aa, BK virus
IQAISFTKRPHTL

SEQ ID NO: 41519 - protein, 13 aa, BK virus
QAISFTKRPHTLF

SEQ ID NO: 41520 - protein, 13 aa, BK virus
AISFTKRPHTLFI

SEQ ID NO: 41521 - protein, 13 aa, BK virus
QHCGSCVGHMKYW

SEQ ID NO: 41522 - protein, 13 aa, BK virus
HCGSCVGHMKYWG

SEQ ID NO: 41523 - protein, 13 aa, BK virus
CGSCVGHMKYWGN

SEQ ID NO: 41524 - protein, 13 aa, BK virus
GSCVGHMKYWGNI

SEQ ID NO: 41525 - protein, 13 aa, BK virus
SCVGHMKYWGNIF

SEQ ID NO: 41526 - protein, 13 aa, BK virus
CVGHMKYWGNIFP

SEQ ID NO: 41527 - protein, 13 aa, BK virus
VGHMKYWGNIFPS

SEQ ID NO: 41528 - protein, 13 aa, BK virus
GHMKYWGNIFPSC

SEQ ID NO: 41529 - protein, 13 aa, BK virus
HMKYWGNIFPSCE

SEQ ID NO: 41530 - protein, 13 aa, BK virus
MKYWGNIFPSCES

SEQ ID NO: 41531 - protein, 13 aa, BK virus
KYWGNIFPSCESP

SEQ ID NO: 41532 - protein, 13 aa, BK virus
YWGNIFPSCESPK

SEQ ID NO: 41533 - protein, 13 aa, BK virus
WGNIFPSCESPKI

SEQ ID NO: 41534 - protein, 13 aa, BK virus
GNIFPSCESPKIP

SEQ ID NO: 41535 - protein, 13 aa, BK virus
NIFPSCESPKIPS

SEQ ID NO: 41536 - protein, 13 aa, BK virus
IFPSCESPKIPSI

SEQ ID NO: 41537 - protein, 13 aa, BK virus
FPSCESPKIPSIF

SEQ ID NO: 41538 - protein, 13 aa, BK virus
PSCESPKIPSIFI

SEQ ID NO: 41539 - protein, 13 aa, BK virus
SCESPKIPSIFIS

SEQ ID NO: 41540 - protein, 13 aa, BK virus
CESPKIPSIFIST

SEQ ID NO: 41541 - protein, 13 aa, BK virus
ESPKIPSIFISTG

SEQ ID NO: 41542 - protein, 13 aa, BK virus
SPKIPSIFISTGI

SEQ ID NO: 41543 - protein, 13 aa, BK virus
PKIPSIFISTGIR

SEQ ID NO: 41544 - protein, 13 aa, BK virus
KIPSIFISTGIRY

SEQ ID NO: 41545 - protein, 13 aa, BK virus
IPSIFISTGIRYP

SEQ ID NO: 41546 - protein, 13 aa, BK virus
PSIFISTGIRYPA

SEQ ID NO: 41547 - protein, 13 aa, BK virus
SIFISTGIRYPAL

SEQ ID NO: 41548 - protein, 13 aa, BK virus
IFISTGIRYPALN

SEQ ID NO: 41549 - protein, 13 aa, BK virus
FISTGIRYPALNW

SEQ ID NO: 41550 - protein, 13 aa, BK virus
ISTGIRYPALNWI

SEQ ID NO: 41551 - protein, 13 aa, BK virus
STGIRYPALNWIS

SEQ ID NO: 41552 - protein, 13 aa, BK virus
TGIRYPALNWISI

SEQ ID NO: 41553 - protein, 13 aa, BK virus
GIRYPALNWISIV

SEQ ID NO: 41554 - protein, 13 aa, BK virus
IRYPALNWISIVF

SEQ ID NO: 41555 - protein, 13 aa, BK virus
RYPALNWISIVFV

SEQ ID NO: 41556 - protein, 13 aa, BK virus
YPALNWISIVFVQ

SEQ ID NO: 41557 - protein, 13 aa, BK virus
PALNWISIVFVQI

SEQ ID NO: 41558 - protein, 13 aa, BK virus
ALNWISIVFVQIG

SEQ ID NO: 41559 - protein, 13 aa, BK virus
LNWISIVFVQIGL

SEQ ID NO: 41560 - protein, 13 aa, BK virus
NWISIVFVQIGLM

SEQ ID NO: 41561 - protein, 13 aa, BK virus
WISIVFVQIGLMV

SEQ ID NO: 41562 - protein, 13 aa, BK virus
ISIVFVQIGLMVS

SEQ ID NO: 41563 - protein, 13 aa, BK virus
SIVFVQIGLMVSI

SEQ ID NO: 41564 - protein, 13 aa, BK virus
IVFVQIGLMVSIH

SEQ ID NO: 41565 - protein, 13 aa, BK virus
VFVQIGLMVSIHY

SEQ ID NO: 41566 - protein, 13 aa, BK virus
FVQIGLMVSIHYL

SEQ ID NO: 41567 - protein, 13 aa, BK virus
VQIGLMVSIHYLG

SEQ ID NO: 41568 - protein, 13 aa, BK virus
QIGLMVSIHYLGL

SEQ ID NO: 41569 - protein, 13 aa, BK virus
IGLMVSIHYLGLG

SEQ ID NO: 41570 - protein, 13 aa, BK virus
GLMVSIHYLGLGC

SEQ ID NO: 41571 - protein, 13 aa, BK virus
LMVSIHYLGLGCW

SEQ ID NO: 41572 - protein, 13 aa, BK virus
MVSIHYLGLGCWV

SEQ ID NO: 41573 - protein, 13 aa, BK virus
VSIHYLGLGCWVF

SEQ ID NO: 41574 - protein, 13 aa, BK virus
SIHYLGLGCWVFR

SEQ ID NO: 41575 - protein, 13 aa, BK virus
IHYLGLGCWVFRG

SEQ ID NO: 41576 - protein, 13 aa, BK virus
HYLGLGCWVFRGY

SEQ ID NO: 41577 - protein, 13 aa, BK virus
YLGLGCWVFRGYS

SEQ ID NO: 41578 - protein, 13 aa, BK virus
LGLGCWVFRGYST

SEQ ID NO: 41579 - protein, 13 aa, BK virus
GLGCWVFRGYSTI

SEQ ID NO: 41580 - protein, 13 aa, BK virus
LGCWVFRGYSTIR

SEQ ID NO: 41581 - protein, 13 aa, BK virus
GCWVFRGYSTIRV

SEQ ID NO: 41582 - protein, 13 aa, BK virus
CWVFRGYSTIRVL

SEQ ID NO: 41583 - protein, 13 aa, BK virus
HSLHFQGFSTYSK

SEQ ID NO: 41584 - protein, 13 aa, BK virus
SLHFQGFSTYSKE

SEQ ID NO: 41585 - protein, 13 aa, BK virus
LHFQGFSTYSKEV

SEQ ID NO: 41586 - protein, 13 aa, BK virus
HFQGFSTYSKEVE

SEQ ID NO: 41587 - protein, 13 aa, BK virus
FQGFSTYSKEVEI

SEQ ID NO: 41588 - protein, 13 aa, BK virus
QGFSTYSKEVEIT

SEQ ID NO: 41589 - protein, 13 aa, BK virus
GFSTYSKEVEITA

SEQ ID NO: 41590 - protein, 13 aa, BK virus
FSTYSKEVEITAL

SEQ ID NO: 41591 - protein, 13 aa, BK virus
STYSKEVEITALN

SEQ ID NO: 41592 - protein, 13 aa, BK virus
TYSKEVEITALNR

SEQ ID NO: 41593 - protein, 13 aa, BK virus
YSKEVEITALNRF

SEQ ID NO: 41594 - protein, 13 aa, BK virus
SKEVEITALNRFS

SEQ ID NO: 41595 - protein, 13 aa, BK virus
KEVEITALNRFSS

SEQ ID NO: 41596 - protein, 13 aa, BK virus
EVEITALNRFSST

SEQ ID NO: 41597 - protein, 13 aa, BK virus
VEITALNRFSSTM

SEQ ID NO: 41598 - protein, 13 aa, BK virus
EITALNRFSSTML

SEQ ID NO: 41599 - protein, 13 aa, BK virus
ITALNRFSSTMLM

SEQ ID NO: 41600 - protein, 13 aa, BK virus
TALNRFSSTMLMH

SEQ ID NO: 41601 - protein, 13 aa, BK virus
ALNRFSSTMLMHF

SEQ ID NO: 41602 - protein, 13 aa, BK virus
LNRFSSTMLMHFL

SEQ ID NO: 41603 - protein, 13 aa, BK virus
PCMKVKHASYSNN

SEQ ID NO: 41604 - protein, 13 aa, BK virus
CMKVKHASYSNNL

SEQ ID NO: 41605 - protein, 13 aa, BK virus
MKVKHASYSNNLC

SEQ ID NO: 41606 - protein, 13 aa, BK virus
KVKHASYSNNLCL

SEQ ID NO: 41607 - protein, 13 aa, BK virus
VKHASYSNNLCLY

SEQ ID NO: 41608 - protein, 13 aa, BK virus
KHASYSNNLCLYS

SEQ ID NO: 41609 - protein, 13 aa, BK virus
HASYSNNLCLYSY

SEQ ID NO: 41610 - protein, 13 aa, BK virus
ASYSNNLCLYSYS

SEQ ID NO: 41611 - protein, 13 aa, BK virus
SYSNNLCLYSYSL

SEQ ID NO: 41612 - protein, 13 aa, BK virus
YSNNLCLYSYSLP

SEQ ID NO: 41613 - protein, 13 aa, BK virus
SNNLCLYSYSLPH

SEQ ID NO: 41614 - protein, 13 aa, BK virus
NNLCLYSYSLPHQ

SEQ ID NO: 41615 - protein, 13 aa, BK virus
IGEGNSCCAVTGK

SEQ ID NO: 41616 - protein, 13 aa, BK virus
GEGNSCCAVTGKH

SEQ ID NO: 41617 - protein, 13 aa, BK virus
EGNSCCAVTGKHF

SEQ ID NO: 41618 - protein, 13 aa, BK virus
GNSCCAVTGKHFS

SEQ ID NO: 41619 - protein, 13 aa, BK virus
NSCCAVTGKHFSL

SEQ ID NO: 41620 - protein, 13 aa, BK virus
SCCAVTGKHFSLW

SEQ ID NO: 41621 - protein, 13 aa, BK virus
CCAVTGKHFSLWA

SEQ ID NO: 41622 - protein, 13 aa, BK virus
CAVTGKHFSLWAI

SEQ ID NO: 41623 - protein, 13 aa, BK virus
AVTGKHFSLWAIT

SEQ ID NO: 41624 - protein, 13 aa, BK virus
VTGKHFSLWAITA

SEQ ID NO: 41625 - protein, 13 aa, BK virus
TGKHFSLWAITAK

SEQ ID NO: 41626 - protein, 13 aa, BK virus
GKHFSLWAITAKV

SEQ ID NO: 41627 - protein, 13 aa, BK virus
KHFSLWAITAKVI

SEQ ID NO: 41628 - protein, 13 aa, BK virus
HFSLWAITAKVIF

SEQ ID NO: 41629 - protein, 13 aa, BK virus
FSLWAITAKVIFS

SEQ ID NO: 41630 - protein, 13 aa, BK virus
SLWAITAKVIFST

SEQ ID NO: 41631 - protein, 13 aa, BK virus
TKAPKVFIWIPHF

SEQ ID NO: 41632 - protein, 13 aa, BK virus
KAPKVFIWIPHFW

SEQ ID NO: 41633 - protein, 13 aa, BK virus
APKVFIWIPHFWV

SEQ ID NO: 41634 - protein, 13 aa, BK virus
EAFYLCNSIYPSF

SEQ ID NO: 41635 - protein, 13 aa, BK virus
AFYLCNSIYPSFN

SEQ ID NO: 41636 - protein, 13 aa, BK virus
FYLCNSIYPSFNF

SEQ ID NO: 41637 - protein, 13 aa, BK virus
FWHLHGFLWLFGS

SEQ ID NO: 41638 - protein, 13 aa, BK virus
WHLHGFLWLFGSC

SEQ ID NO: 41639 - protein, 13 aa, BK virus
HLHGFLWLFGSCP

SEQ ID NO: 41640 - protein, 13 aa, BK virus
LHGFLWLFGSCPW

SEQ ID NO: 41641 - protein, 13 aa, BK virus
HGFLWLFGSCPWT

SEQ ID NO: 41642 - protein, 13 aa, BK virus
GFLWLFGSCPWTL

SEQ ID NO: 41643 - protein, 13 aa, BK virus
FLWLFGSCPWTLS

SEQ ID NO: 41644 - protein, 13 aa, BK virus
LWLFGSCPWTLSF

SEQ ID NO: 41645 - protein, 13 aa, BK virus
WLFGSCPWTLSFS

SEQ ID NO: 41646 - protein, 13 aa, BK virus
LFGSCPWTLSFSF

SEQ ID NO: 41647 - protein, 13 aa, BK virus
FGSCPWTLSFSFG

SEQ ID NO: 41648 - protein, 13 aa, BK virus
GSCPWTLSFSFGW

SEQ ID NO: 41649 - protein, 13 aa, BK virus
SCPWTLSFSFGWG

SEQ ID NO: 41650 - protein, 13 aa, BK virus
CPWTLSFSFGWGH

SEQ ID NO: 41651 - protein, 13 aa, BK virus
PWTLSFSFGWGHL

SEQ ID NO: 41652 - protein, 13 aa, BK virus
WTLSFSFGWGHLH

SEQ ID NO: 41653 - protein, 13 aa, BK virus
TLSFSFGWGHLHM

SEQ ID NO: 41654 - protein, 13 aa, BK virus
LSFSFGWGHLHML

SEQ ID NO: 41655 - protein, 13 aa, BK virus
SFSFGWGHLHMLQ

SEQ ID NO: 41656 - protein, 13 aa, BK virus
FSFGWGHLHMLQE

SEQ ID NO: 41657 - protein, 13 aa, BK virus
SFGWGHLHMLQEQ

SEQ ID NO: 41658 - protein, 13 aa, BK virus
FGWGHLHMLQEQV

SEQ ID NO: 41659 - protein, 13 aa, BK virus
GWGHLHMLQEQVL

SEQ ID NO: 41660 - protein, 13 aa, BK virus
WGHLHMLQEQVLQ

SEQ ID NO: 41661 - protein, 13 aa, BK virus
GHLHMLQEQVLQS

SEQ ID NO: 41662 - protein, 13 aa, BK virus
HLHMLQEQVLQSR

SEQ ID NO: 41663 - protein, 13 aa, BK virus
LHMLQEQVLQSRT

SEQ ID NO: 41664 - protein, 13 aa, BK virus
HMLQEQVLQSRTG

SEQ ID NO: 41665 - protein, 13 aa, BK virus
MLQEQVLQSRTGL

SEQ ID NO: 41666 - protein, 13 aa, BK virus
LQEQVLQSRTGLE

SEQ ID NO: 41667 - protein, 13 aa, BK virus
QEQVLQSRTGLEV

SEQ ID NO: 41668 - protein, 13 aa, BK virus
EQVLQSRTGLEVK

SEQ ID NO: 41669 - protein, 13 aa, BK virus
QVLQSRTGLEVKA

SEQ ID NO: 41670 - protein, 13 aa, BK virus
VLQSRTGLEVKAT

SEQ ID NO: 41671 - protein, 13 aa, BK virus
LQSRTGLEVKATS

SEQ ID NO: 41672 - protein, 13 aa, BK virus
QSRTGLEVKATSI

SEQ ID NO: 41673 - protein, 13 aa, BK virus
SRTGLEVKATSIE

SEQ ID NO: 41674 - protein, 13 aa, BK virus
RTGLEVKATSIEE

SEQ ID NO: 41675 - protein, 13 aa, BK virus
TGLEVKATSIEEQ

SEQ ID NO: 41676 - protein, 13 aa, BK virus
GLEVKATSIEEQF

SEQ ID NO: 41677 - protein, 13 aa, BK virus
LEVKATSIEEQFF

SEQ ID NO: 41678 - protein, 13 aa, BK virus
EVKATSIEEQFFD

SEQ ID NO: 41679 - protein, 13 aa, BK virus
TLLNVHFVDFLSP

SEQ ID NO: 41680 - protein, 13 aa, BK virus
LLNVHFVDFLSPF

SEQ ID NO: 41681 - protein, 13 aa, BK virus
LNVHFVDFLSPFF

SEQ ID NO: 41682 - protein, 13 aa, BK virus
NVHFVDFLSPFFV

SEQ ID NO: 41683 - protein, 13 aa, BK virus
LLLYCQHHLYYKY

SEQ ID NO: 41684 - protein, 13 aa, BK virus
LLYCQHHLYYKYG

SEQ ID NO: 41685 - protein, 13 aa, BK virus
LYCQHHLYYKYGQ

SEQ ID NO: 41686 - protein, 13 aa, BK virus
YCQHHLYYKYGQN

SEQ ID NO: 41687 - protein, 13 aa, BK virus
CQHHLYYKYGQNV

SEQ ID NO: 41688 - protein, 13 aa, BK virus
QHHLYYKYGQNVH

SEQ ID NO: 41689 - protein, 13 aa, BK virus
HHLYYKYGQNVHG

SEQ ID NO: 41690 - protein, 13 aa, BK virus
HLYYKYGQNVHGY

SEQ ID NO: 41691 - protein, 13 aa, BK virus
LYYKYGQNVHGYL

SEQ ID NO: 41692 - protein, 13 aa, BK virus
YYKYGQNVHGYLP

SEQ ID NO: 41693 - protein, 13 aa, BK virus
YKYGQNVHGYLPF

SEQ ID NO: 41694 - protein, 13 aa, BK virus
KYGQNVHGYLPFQ

SEQ ID NO: 41695 - protein, 13 aa, BK virus
YGQNVHGYLPFQL

SEQ ID NO: 41696 - protein, 13 aa, BK virus
GQNVHGYLPFQLL

SEQ ID NO: 41697 - protein, 13 aa, BK virus
QNVHGYLPFQLLV

SEQ ID NO: 41698 - protein, 13 aa, BK virus
GKDQNNIVEYNYK

SEQ ID NO: 41699 - protein, 13 aa, BK virus
KDQNNIVEYNYKS

SEQ ID NO: 41700 - protein, 13 aa, BK virus
DQNNIVEYNYKSL

SEQ ID NO: 41701 - protein, 13 aa, BK virus
KIFLFFSAIPVRL

SEQ ID NO: 41702 - protein, 13 aa, BK virus
QKYLHQETEYHST

SEQ ID NO: 41703 - protein, 13 aa, BK virus
KYLHQETEYHSTH

SEQ ID NO: 41704 - protein, 13 aa, BK virus
YLHQETEYHSTHL

SEQ ID NO: 41705 - protein, 13 aa, BK virus
LHQETEYHSTHLG

SEQ ID NO: 41706 - protein, 13 aa, BK virus
TIPKPCLIADRGL

SEQ ID NO: 41707 - protein, 13 aa, BK virus
IPKPCLIADRGLQ

SEQ ID NO: 41708 - protein, 13 aa, BK virus
PKPCLIADRGLQW

SEQ ID NO: 41709 - protein, 13 aa, BK virus
KPCLIADRGLQWK

SEQ ID NO: 41710 - protein, 13 aa, BK virus
PCLIADRGLQWKL

SEQ ID NO: 41711 - protein, 13 aa, BK virus
CLIADRGLQWKLC

SEQ ID NO: 41712 - protein, 13 aa, BK virus
LIADRGLQWKLCD

SEQ ID NO: 41713 - protein, 13 aa, BK virus
IADRGLQWKLCDP

SEQ ID NO: 41714 - protein, 13 aa, BK virus
ADRGLQWKLCDPN

SEQ ID NO: 41715 - protein, 13 aa, BK virus
DRGLQWKLCDPNH

SEQ ID NO: 41716 - protein, 13 aa, BK virus
RGLQWKLCDPNHQ

SEQ ID NO: 41717 - protein, 13 aa, BK virus
GLQWKLCDPNHQR

SEQ ID NO: 41718 - protein, 13 aa, BK virus
LQWKLCDPNHQRT

SEQ ID NO: 41719 - protein, 13 aa, BK virus
QWKLCDPNHQRTY

SEQ ID NO: 41720 - protein, 13 aa, BK virus
WKLCDPNHQRTYT

SEQ ID NO: 41721 - protein, 13 aa, BK virus
KLCDPNHQRTYTL

SEQ ID NO: 41722 - protein, 13 aa, BK virus
LCDPNHQRTYTLL

SEQ ID NO: 41723 - protein, 13 aa, BK virus
CDPNHQRTYTLLE

SEQ ID NO: 41724 - protein, 13 aa, BK virus
DPNHQRTYTLLEL

SEQ ID NO: 41725 - protein, 13 aa, BK virus
PNHQRTYTLLELR

SEQ ID NO: 41726 - protein, 13 aa, BK virus
NHQRTYTLLELRN

SEQ ID NO: 41727 - protein, 13 aa, BK virus
PQEHQQLQHMFEE

SEQ ID NO: 41728 - protein, 13 aa, BK virus
QEHQQLQHMFEEL

SEQ ID NO: 41729 - protein, 13 aa, BK virus
EHQQLQHMFEELG

SEQ ID NO: 41730 - protein, 13 aa, BK virus
HQQLQHMFEELGL

SEQ ID NO: 41731 - protein, 13 aa, BK virus
QQQPPQQQFQPLK

SEQ ID NO: 41732 - protein, 13 aa, BK virus
QQPPQQQFQPLKI

SEQ ID NO: 41733 - protein, 13 aa, BK virus
QPPQQQFQPLKIL

SEQ ID NO: 41734 - protein, 13 aa, BK virus
PPQQQFQPLKILW

SEQ ID NO: 41735 - protein, 13 aa, BK virus
PQQQFQPLKILWQ

SEQ ID NO: 41736 - protein, 13 aa, BK virus
QQQFQPLKILWQQ

SEQ ID NO: 41737 - protein, 13 aa, BK virus
QQFQPLKILWQQQ

SEQ ID NO: 41738 - protein, 13 aa, BK virus
QFQPLKILWQQQP

SEQ ID NO: 41739 - protein, 13 aa, BK virus
FQPLKILWQQQPQ

SEQ ID NO: 41740 - protein, 13 aa, BK virus
QPLKILWQQQPQI

SEQ ID NO: 41741 - protein, 13 aa, BK virus
PLKILWQQQPQIH

SEQ ID NO: 41742 - protein, 13 aa, BK virus
LKILWQQQPQIHW

SEQ ID NO: 41743 - protein, 13 aa, BK virus
KILWQQQPQIHWQ

SEQ ID NO: 41744 - protein, 13 aa, BK virus
ILWQQQPQIHWQL

SEQ ID NO: 41745 - protein, 13 aa, BK virus
LWQQQPQIHWQLG

SEQ ID NO: 41746 - protein, 13 aa, BK virus
WQQQPQIHWQLGP

SEQ ID NO: 41747 - protein, 13 aa, BK virus
QQQPQIHWQLGPP

SEQ ID NO: 41748 - protein, 13 aa, BK virus
QQPQIHWQLGPPK

SEQ ID NO: 41749 - protein, 13 aa, BK virus
QPQIHWQLGPPKV

SEQ ID NO: 41750 - protein, 13 aa, BK virus
PQIHWQLGPPKVL

SEQ ID NO: 41751 - protein, 13 aa, BK virus
QIHWQLGPPKVLE

SEQ ID NO: 41752 - protein, 13 aa, BK virus
IHWQLGPPKVLEQ

SEQ ID NO: 41753 - protein, 13 aa, BK virus
HWQLGPPKVLEQH

SEQ ID NO: 41754 - protein, 13 aa, BK virus
WQLGPPKVLEQHP

SEQ ID NO: 41755 - protein, 13 aa, BK virus
TWKYKKKGITYLG

SEQ ID NO: 41756 - protein, 13 aa, BK virus
WKYKKKGITYLGV

SEQ ID NO: 41757 - protein, 13 aa, BK virus
KYKKKGITYLGVF

SEQ ID NO: 41758 - protein, 13 aa, BK virus
YKKKGITYLGVFY

SEQ ID NO: 41759 - protein, 13 aa, BK virus
KKKGITYLGVFYR

SEQ ID NO: 41760 - protein, 13 aa, BK virus
KKGITYLGVFYRV

SEQ ID NO: 41761 - protein, 13 aa, BK virus
KGITYLGVFYRVF

SEQ ID NO: 41762 - protein, 13 aa, BK virus
GITYLGVFYRVFY

SEQ ID NO: 41763 - protein, 13 aa, BK virus
ITYLGVFYRVFYS

SEQ ID NO: 41764 - protein, 13 aa, BK virus
TYLGVFYRVFYSR

SEQ ID NO: 41765 - protein, 13 aa, BK virus
SSGTFVFPVYTVF

SEQ ID NO: 41766 - protein, 13 aa, BK virus
SGTFVFPVYTVFT

SEQ ID NO: 41767 - protein, 13 aa, BK virus
GTFVFPVYTVFTS

SEQ ID NO: 41768 - protein, 13 aa, BK virus
TFVFPVYTVFTST

SEQ ID NO: 41769 - protein, 13 aa, BK virus
FVFPVYTVFTSTK

SEQ ID NO: 41770 - protein, 13 aa, BK virus
VFPVYTVFTSTKF

SEQ ID NO: 41771 - protein, 13 aa, BK virus
FPVYTVFTSTKFQ

SEQ ID NO: 41772 - protein, 13 aa, BK virus
PVYTVFTSTKFQQ

SEQ ID NO: 41773 - protein, 13 aa, BK virus
VYTVFTSTKFQQK

SEQ ID NO: 41774 - protein, 13 aa, BK virus
YTVFTSTKFQQKL

SEQ ID NO: 41775 - protein, 13 aa, BK virus
NKNKNPLSSFFCS

SEQ ID NO: 41776 - protein, 13 aa, BK virus
KNKNPLSSFFCSS

SEQ ID NO: 41777 - protein, 13 aa, BK virus
NKNPLSSFFCSSP

SEQ ID NO: 41778 - protein, 13 aa, BK virus
KNPLSSFFCSSPG

SEQ ID NO: 41779 - protein, 13 aa, BK virus
NPLSSFFCSSPGF

SEQ ID NO: 41780 - protein, 13 aa, BK virus
PLSSFFCSSPGFT

SEQ ID NO: 41781 - protein, 13 aa, BK virus
LSSFFCSSPGFTN

SEQ ID NO: 41782 - protein, 13 aa, BK virus
SSFFCSSPGFTNF

SEQ ID NO: 41783 - protein, 13 aa, BK virus
SFFCSSPGFTNFH

SEQ ID NO: 41784 - protein, 13 aa, BK virus
LGTRPRFLGSQNM

SEQ ID NO: 41785 - protein, 13 aa, BK virus
GTRPRFLGSQNMS

SEQ ID NO: 41786 - protein, 13 aa, BK virus
TRPRFLGSQNMSV

SEQ ID NO: 41787 - protein, 13 aa, BK virus
RPRFLGSQNMSVM

SEQ ID NO: 41788 - protein, 13 aa, BK virus
PRFLGSQNMSVMH

SEQ ID NO: 41789 - protein, 13 aa, BK virus
RFLGSQNMSVMHF

SEQ ID NO: 41790 - protein, 13 aa, BK virus
FLGSQNMSVMHFP

SEQ ID NO: 41791 - protein, 13 aa, BK virus
LGSQNMSVMHFPS

SEQ ID NO: 41792 - protein, 13 aa, BK virus
AAPPCESCTFLPE

SEQ ID NO: 41793 - protein, 13 aa, BK virus
APPCESCTFLPEV

SEQ ID NO: 41794 - protein, 13 aa, BK virus
PPCESCTFLPEVM

SEQ ID NO: 41795 - protein, 13 aa, BK virus
PCESCTFLPEVMV

SEQ ID NO: 41796 - protein, 13 aa, BK virus
CESCTFLPEVMVW

SEQ ID NO: 41797 - protein, 13 aa, BK virus
ESCTFLPEVMVWL

SEQ ID NO: 41798 - protein, 13 aa, BK virus
SCTFLPEVMVWLH

SEQ ID NO: 41799 - protein, 13 aa, BK virus
CTFLPEVMVWLHS

SEQ ID NO: 41800 - protein, 13 aa, BK virus
TFLPEVMVWLHSP

SEQ ID NO: 41801 - protein, 13 aa, BK virus
FLPEVMVWLHSPV

SEQ ID NO: 41802 - protein, 13 aa, BK virus
LPEVMVWLHSPVS

SEQ ID NO: 41803 - protein, 13 aa, BK virus
PEVMVWLHSPVSH

SEQ ID NO: 41804 - protein, 13 aa, BK virus
EVMVWLHSPVSHA

SEQ ID NO: 41805 - protein, 13 aa, BK virus
VMVWLHSPVSHAL

SEQ ID NO: 41806 - protein, 13 aa, BK virus
MVWLHSPVSHALS

SEQ ID NO: 41807 - protein, 13 aa, BK virus
VWLHSPVSHALSF

SEQ ID NO: 41808 - protein, 13 aa, BK virus
WLHSPVSHALSFL

SEQ ID NO: 41809 - protein, 13 aa, BK virus
LHSPVSHALSFLR

SEQ ID NO: 41810 - protein, 13 aa, BK virus
HSPVSHALSFLRS

SEQ ID NO: 41811 - protein, 13 aa, BK virus
SPVSHALSFLRSW

SEQ ID NO: 41812 - protein, 13 aa, BK virus
PVSHALSFLRSWF

SEQ ID NO: 41813 - protein, 13 aa, BK virus
VSHALSFLRSWFG

SEQ ID NO: 41814 - protein, 13 aa, BK virus
SHALSFLRSWFGC

SEQ ID NO: 41815 - protein, 13 aa, BK virus
HALSFLRSWFGCI

SEQ ID NO: 41816 - protein, 13 aa, BK virus
ALSFLRSWFGCIP

SEQ ID NO: 41817 - protein, 13 aa, BK virus
LSFLRSWFGCIPW

SEQ ID NO: 41818 - protein, 13 aa, BK virus
SFLRSWFGCIPWV

SEQ ID NO: 41819 - protein, 13 aa, BK virus
FLRSWFGCIPWVS

SEQ ID NO: 41820 - protein, 13 aa, BK virus
LRSWFGCIPWVSS

SEQ ID NO: 41821 - protein, 13 aa, BK virus
RSWFGCIPWVSSS

SEQ ID NO: 41822 - protein, 13 aa, BK virus
SWFGCIPWVSSSS

SEQ ID NO: 41823 - protein, 13 aa, BK virus
WFGCIPWVSSSSL

SEQ ID NO: 41824 - protein, 13 aa, BK virus
FGCIPWVSSSSLW

SEQ ID NO: 41825 - protein, 13 aa, BK virus
GCIPWVSSSSLWP

SEQ ID NO: 41826 - protein, 13 aa, BK virus
CIPWVSSSSLWPF

SEQ ID NO: 41827 - protein, 13 aa, BK virus
IPWVSSSSLWPFF

SEQ ID NO: 41828 - protein, 13 aa, BK virus
PWVSSSSLWPFFL

SEQ ID NO: 41829 - protein, 13 aa, BK virus
YIRGRGRLCLHPF

SEQ ID NO: 41830 - protein, 13 aa, BK virus
IRGRGRLCLHPFS

SEQ ID NO: 41831 - protein, 13 aa, BK virus
RGRGRLCLHPFSQ

SEQ ID NO: 41832 - protein, 13 aa, BK virus
GRGRLCLHPFSQV

SEQ ID NO: 41833 - protein, 13 aa, BK virus
RGRLCLHPFSQVV

SEQ ID NO: 41834 - protein, 13 aa, BK virus
GRLCLHPFSQVVR

SEQ ID NO: 41835 - protein, 13 aa, BK virus
RLCLHPFSQVVRV

SEQ ID NO: 41836 - protein, 13 aa, BK virus
LCLHPFSQVVRVW

SEQ ID NO: 41837 - protein, 13 aa, BK virus
CLHPFSQVVRVWR

SEQ ID NO: 41838 - protein, 13 aa, BK virus
LHPFSQVVRVWRL

SEQ ID NO: 41839 - protein, 13 aa, BK virus
HPFSQVVRVWRLF

SEQ ID NO: 41840 - protein, 13 aa, BK virus
PFSQVVRVWRLFL

SEQ ID NO: 41841 - protein, 13 aa, BK virus
FSQVVRVWRLFLR

SEQ ID NO: 41842 - protein, 13 aa, BK virus
SQVVRVWRLFLRP

SEQ ID NO: 41843 - protein, 13 aa, BK virus
QVVRVWRLFLRPS

SEQ ID NO: 41844 - protein, 13 aa, BK virus
VVRVWRLFLRPSK

SEQ ID NO: 41845 - protein, 13 aa, BK virus
VRVWRLFLRPSKT

SEQ ID NO: 41846 - protein, 13 aa, BK virus
RVWRLFLRPSKTI

SEQ ID NO: 41847 - protein, 13 aa, BK virus
VWRLFLRPSKTIW

SEQ ID NO: 41848 - protein, 13 aa, BK virus
WRLFLRPSKTIWG

SEQ ID NO: 41849 - protein, 13 aa, BK virus
RLFLRPSKTIWGN

SEQ ID NO: 41850 - protein, 13 aa, BK virus
LFLRPSKTIWGNP

SEQ ID NO: 41851 - protein, 13 aa, BK virus
FLRPSKTIWGNPY

SEQ ID NO: 41852 - protein, 13 aa, BK virus
LRPSKTIWGNPYS

SEQ ID NO: 41853 - protein, 13 aa, BK virus
RPSKTIWGNPYSF

SEQ ID NO: 41854 - protein, 13 aa, BK virus
PSKTIWGNPYSFA

SEQ ID NO: 41855 - protein, 13 aa, BK virus
SKTIWGNPYSFAI

SEQ ID NO: 41856 - protein, 13 aa, BK virus
KTIWGNPYSFAIF

SEQ ID NO: 41857 - protein, 13 aa, BK virus
TIWGNPYSFAIFA

SEQ ID NO: 41858 - protein, 13 aa, BK virus
IWGNPYSFAIFAK

SEQ ID NO: 41859 - protein, 14 aa, BK virus
KSCLGKSSLNEKSL

SEQ ID NO: 41860 - protein, 14 aa, BK virus
SCLGKSSLNEKSLF

SEQ ID NO: 41861 - protein, 14 aa, BK virus
CLGKSSLNEKSLFK

SEQ ID NO: 41862 - protein, 14 aa, BK virus
LGKSSLNEKSLFKE

SEQ ID NO: 41863 - protein, 14 aa, BK virus
GKSSLNEKSLFKEV

SEQ ID NO: 41864 - protein, 14 aa, BK virus
FSSLPRYPVLQGMA

SEQ ID NO: 41865 - protein, 14 aa, BK virus
SSLPRYPVLQGMAY

SEQ ID NO: 41866 - protein, 14 aa, BK virus
SLPRYPVLQGMAYL

SEQ ID NO: 41867 - protein, 14 aa, BK virus
LPRYPVLQGMAYLF

SEQ ID NO: 41868 - protein, 14 aa, BK virus
PRYPVLQGMAYLFQ

SEQ ID NO: 41869 - protein, 14 aa, BK virus
RYPVLQGMAYLFQK

SEQ ID NO: 41870 - protein, 14 aa, BK virus
YPVLQGMAYLFQKA

SEQ ID NO: 41871 - protein, 14 aa, BK virus
PVLQGMAYLFQKAF

SEQ ID NO: 41872 - protein, 14 aa, BK virus
VLQGMAYLFQKAFC

SEQ ID NO: 41873 - protein, 14 aa, BK virus
LQGMAYLFQKAFCA

SEQ ID NO: 41874 - protein, 14 aa, BK virus
QGMAYLFQKAFCAL

SEQ ID NO: 41875 - protein, 14 aa, BK virus
GMAYLFQKAFCALP

SEQ ID NO: 41876 - protein, 14 aa, BK virus
MAYLFQKAFCALPL

SEQ ID NO: 41877 - protein, 14 aa, BK virus
AYLFQKAFCALPLH

SEQ ID NO: 41878 - protein, 14 aa, BK virus
YLFQKAFCALPLHA

SEQ ID NO: 41879 - protein, 14 aa, BK virus
LFQKAFCALPLHAM

SEQ ID NO: 41880 - protein, 14 aa, BK virus
FQKAFCALPLHAMS

SEQ ID NO: 41881 - protein, 14 aa, BK virus
QKAFCALPLHAMSA

SEQ ID NO: 41882 - protein, 14 aa, BK virus
KIFKKRALGLDRLL

SEQ ID NO: 41883 - protein, 14 aa, BK virus
IFKKRALGLDRLLL

SEQ ID NO: 41884 - protein, 14 aa, BK virus
FKKRALGLDRLLLH

SEQ ID NO: 41885 - protein, 14 aa, BK virus
RNSAMVGPNNWRNS

SEQ ID NO: 41886 - protein, 14 aa, BK virus
NSAMVGPNNWRNSL

SEQ ID NO: 41887 - protein, 14 aa, BK virus
SAMVGPNNWRNSLQ

SEQ ID NO: 41888 - protein, 14 aa, BK virus
AMVGPNNWRNSLQR

SEQ ID NO: 41889 - protein, 14 aa, BK virus
MVGPNNWRNSLQRS

SEQ ID NO: 41890 - protein, 14 aa, BK virus
VGPNNWRNSLQRSK

SEQ ID NO: 41891 - protein, 14 aa, BK virus
GPNNWRNSLQRSKA

SEQ ID NO: 41892 - protein, 14 aa, BK virus
PNNWRNSLQRSKAL

SEQ ID NO: 41893 - protein, 14 aa, BK virus
NNWRNSLQRSKALR

SEQ ID NO: 41894 - protein, 14 aa, BK virus
VPTYGTEEWESWWS

SEQ ID NO: 41895 - protein, 14 aa, BK virus
PTYGTEEWESWWSS

SEQ ID NO: 41896 - protein, 14 aa, BK virus
TYGTEEWESWWSSF

SEQ ID NO: 41897 - protein, 14 aa, BK virus
YGTEEWESWWSSFN

SEQ ID NO: 41898 - protein, 14 aa, BK virus
GTEEWESWWSSFNE

SEQ ID NO: 41899 - protein, 14 aa, BK virus
TEEWESWWSSFNEK

SEQ ID NO: 41900 - protein, 14 aa, BK virus
EEWESWWSSFNEKW

SEQ ID NO: 41901 - protein, 14 aa, BK virus
EWESWWSSFNEKWD

SEQ ID NO: 41902 - protein, 14 aa, BK virus
WESWWSSFNEKWDE

SEQ ID NO: 41903 - protein, 14 aa, BK virus
ESWWSSFNEKWDED

SEQ ID NO: 41904 - protein, 14 aa, BK virus
SWWSSFNEKWDEDL

SEQ ID NO: 41905 - protein, 14 aa, BK virus
WWSSFNEKWDEDLF

SEQ ID NO: 41906 - protein, 14 aa, BK virus
WSSFNEKWDEDLFC

SEQ ID NO: 41907 - protein, 14 aa, BK virus
SSFNEKWDEDLFCH

SEQ ID NO: 41908 - protein, 14 aa, BK virus
SFNEKWDEDLFCHE

SEQ ID NO: 41909 - protein, 14 aa, BK virus
FNEKWDEDLFCHED

SEQ ID NO: 41910 - protein, 14 aa, BK virus
NEKWDEDLFCHEDM

SEQ ID NO: 41911 - protein, 14 aa, BK virus
EKWDEDLFCHEDMF

SEQ ID NO: 41912 - protein, 14 aa, BK virus
KWDEDLFCHEDMFA

SEQ ID NO: 41913 - protein, 14 aa, BK virus
WDEDLFCHEDMFAS

SEQ ID NO: 41914 - protein, 14 aa, BK virus
DEDLFCHEDMFASD

SEQ ID NO: 41915 - protein, 14 aa, BK virus
EDLFCHEDMFASDE

SEQ ID NO: 41916 - protein, 14 aa, BK virus
DLFCHEDMFASDEE

SEQ ID NO: 41917 - protein, 14 aa, BK virus
LFCHEDMFASDEEA

SEQ ID NO: 41918 - protein, 14 aa, BK virus
FCHEDMFASDEEAT

SEQ ID NO: 41919 - protein, 14 aa, BK virus
CHEDMFASDEEATA

SEQ ID NO: 41920 - protein, 14 aa, BK virus
HEDMFASDEEATAD

SEQ ID NO: 41921 - protein, 14 aa, BK virus
EDMFASDEEATADS

SEQ ID NO: 41922 - protein, 14 aa, BK virus
DMFASDEEATADSQ

SEQ ID NO: 41923 - protein, 14 aa, BK virus
MFASDEEATADSQH

SEQ ID NO: 41924 - protein, 14 aa, BK virus
FASDEEATADSQHS

SEQ ID NO: 41925 - protein, 14 aa, BK virus
ASDEEATADSQHST

SEQ ID NO: 41926 - protein, 14 aa, BK virus
SDEEATADSQHSTP

SEQ ID NO: 41927 - protein, 14 aa, BK virus
DEEATADSQHSTPP

SEQ ID NO: 41928 - protein, 14 aa, BK virus
EEATADSQHSTPPK

SEQ ID NO: 41929 - protein, 14 aa, BK virus
EATADSQHSTPPKK

SEQ ID NO: 41930 - protein, 14 aa, BK virus
ATADSQHSTPPKKK

SEQ ID NO: 41931 - protein, 14 aa, BK virus
TADSQHSTPPKKKR

SEQ ID NO: 41932 - protein, 14 aa, BK virus
ADSQHSTPPKKKRK

SEQ ID NO: 41933 - protein, 14 aa, BK virus
DSQHSTPPKKKRKV

SEQ ID NO: 41934 - protein, 14 aa, BK virus
SQHSTPPKKKRKVE

SEQ ID NO: 41935 - protein, 14 aa, BK virus
QHSTPPKKKRKVED

SEQ ID NO: 41936 - protein, 14 aa, BK virus
HSTPPKKKRKVEDP

SEQ ID NO: 41937 - protein, 14 aa, BK virus
STPPKKKRKVEDPK

SEQ ID NO: 41938 - protein, 14 aa, BK virus
TPPKKKRKVEDPKD

SEQ ID NO: 41939 - protein, 14 aa, BK virus
PPKKKRKVEDPKDF

SEQ ID NO: 41940 - protein, 14 aa, BK virus
PKKKRKVEDPKDFP

SEQ ID NO: 41941 - protein, 14 aa, BK virus
KKKRKVEDPKDFPS

SEQ ID NO: 41942 - protein, 14 aa, BK virus
KKRKVEDPKDFPSD

SEQ ID NO: 41943 - protein, 14 aa, BK virus
KRKVEDPKDFPSDL

SEQ ID NO: 41944 - protein, 14 aa, BK virus
RKVEDPKDFPSDLH

SEQ ID NO: 41945 - protein, 14 aa, BK virus
KVEDPKDFPSDLHQ

SEQ ID NO: 41946 - protein, 14 aa, BK virus
VEDPKDFPSDLHQF

SEQ ID NO: 41947 - protein, 14 aa, BK virus
EDPKDFPSDLHQFL

SEQ ID NO: 41948 - protein, 14 aa, BK virus
DPKDFPSDLHQFLS

SEQ ID NO: 41949 - protein, 14 aa, BK virus
PKDFPSDLHQFLSQ

SEQ ID NO: 41950 - protein, 14 aa, BK virus
KDFPSDLHQFLSQA

SEQ ID NO: 41951 - protein, 14 aa, BK virus
DFPSDLHQFLSQAV

SEQ ID NO: 41952 - protein, 14 aa, BK virus
FPSDLHQFLSQAVF

SEQ ID NO: 41953 - protein, 14 aa, BK virus
PSDLHQFLSQAVFS

SEQ ID NO: 41954 - protein, 14 aa, BK virus
SDLHQFLSQAVFSN

SEQ ID NO: 41955 - protein, 14 aa, BK virus
DLHQFLSQAVFSNR

SEQ ID NO: 41956 - protein, 14 aa, BK virus
LHQFLSQAVFSNRT

SEQ ID NO: 41957 - protein, 14 aa, BK virus
HQFLSQAVFSNRTL

SEQ ID NO: 41958 - protein, 14 aa, BK virus
QFLSQAVFSNRTLA

SEQ ID NO: 41959 - protein, 14 aa, BK virus
FLSQAVFSNRTLAC

SEQ ID NO: 41960 - protein, 14 aa, BK virus
LSQAVFSNRTLACF

SEQ ID NO: 41961 - protein, 14 aa, BK virus
SQAVFSNRTLACFA

SEQ ID NO: 41962 - protein, 14 aa, BK virus
QAVFSNRTLACFAV

SEQ ID NO: 41963 - protein, 14 aa, BK virus
AVFSNRTLACFAVY

SEQ ID NO: 41964 - protein, 14 aa, BK virus
VFSNRTLACFAVYT

SEQ ID NO: 41965 - protein, 14 aa, BK virus
FSNRTLACFAVYTT

SEQ ID NO: 41966 - protein, 14 aa, BK virus
SNRTLACFAVYTTK

SEQ ID NO: 41967 - protein, 14 aa, BK virus
NRTLACFAVYTTKE

SEQ ID NO: 41968 - protein, 14 aa, BK virus
RTLACFAVYTTKEK

SEQ ID NO: 41969 - protein, 14 aa, BK virus
TLACFAVYTTKEKA

SEQ ID NO: 41970 - protein, 14 aa, BK virus
LACFAVYTTKEKAQ

SEQ ID NO: 41971 - protein, 14 aa, BK virus
ACFAVYTTKEKAQI

SEQ ID NO: 41972 - protein, 14 aa, BK virus
CFAVYTTKEKAQIL

SEQ ID NO: 41973 - protein, 14 aa, BK virus
FAVYTTKEKAQILY

SEQ ID NO: 41974 - protein, 14 aa, BK virus
AVYTTKEKAQILYK

SEQ ID NO: 41975 - protein, 14 aa, BK virus
VYTTKEKAQILYKK

SEQ ID NO: 41976 - protein, 14 aa, BK virus
YTTKEKAQILYKKL

SEQ ID NO: 41977 - protein, 14 aa, BK virus
TTKEKAQILYKKLM

SEQ ID NO: 41978 - protein, 14 aa, BK virus
TKEKAQILYKKLME

SEQ ID NO: 41979 - protein, 14 aa, BK virus
KEKAQILYKKLMEK

SEQ ID NO: 41980 - protein, 14 aa, BK virus
EKAQILYKKLMEKY

SEQ ID NO: 41981 - protein, 14 aa, BK virus
KAQILYKKLMEKYS

SEQ ID NO: 41982 - protein, 14 aa, BK virus
AQILYKKLMEKYSV

SEQ ID NO: 41983 - protein, 14 aa, BK virus
QILYKKLMEKYSVT

SEQ ID NO: 41984 - protein, 14 aa, BK virus
ILYKKLMEKYSVTF

SEQ ID NO: 41985 - protein, 14 aa, BK virus
LYKKLMEKYSVTFI

SEQ ID NO: 41986 - protein, 14 aa, BK virus
YKKLMEKYSVTFIS

SEQ ID NO: 41987 - protein, 14 aa, BK virus
KKLMEKYSVTFISR

SEQ ID NO: 41988 - protein, 14 aa, BK virus
KLMEKYSVTFISRH

SEQ ID NO: 41989 - protein, 14 aa, BK virus
LMEKYSVTFISRHM

SEQ ID NO: 41990 - protein, 14 aa, BK virus
MEKYSVTFISRHMC

SEQ ID NO: 41991 - protein, 14 aa, BK virus
EKYSVTFISRHMCA

SEQ ID NO: 41992 - protein, 14 aa, BK virus
KYSVTFISRHMCAG

SEQ ID NO: 41993 - protein, 14 aa, BK virus
YSVTFISRHMCAGH

SEQ ID NO: 41994 - protein, 14 aa, BK virus
SVTFISRHMCAGHN

SEQ ID NO: 41995 - protein, 14 aa, BK virus
VTFISRHMCAGHNI

SEQ ID NO: 41996 - protein, 14 aa, BK virus
TFISRHMCAGHNII

SEQ ID NO: 41997 - protein, 14 aa, BK virus
FISRHMCAGHNIIF

SEQ ID NO: 41998 - protein, 14 aa, BK virus
ISRHMCAGHNIIFF

SEQ ID NO: 41999 - protein, 14 aa, BK virus
SRHMCAGHNIIFFL

SEQ ID NO: 42000 - protein, 14 aa, BK virus
RHMCAGHNIIFFLT

SEQ ID NO: 42001 - protein, 14 aa, BK virus
HMCAGHNIIFFLTP

SEQ ID NO: 42002 - protein, 14 aa, BK virus
MCAGHNIIFFLTPH

SEQ ID NO: 42003 - protein, 14 aa, BK virus
CAGHNIIFFLTPHR

SEQ ID NO: 42004 - protein, 14 aa, BK virus
AGHNIIFFLTPHRH

SEQ ID NO: 42005 - protein, 14 aa, BK virus
GHNIIFFLTPHRHR

SEQ ID NO: 42006 - protein, 14 aa, BK virus
HNIIFFLTPHRHRV

SEQ ID NO: 42007 - protein, 14 aa, BK virus
NIIFFLTPHRHRVS

SEQ ID NO: 42008 - protein, 14 aa, BK virus
IIFFLTPHRHRVSA

SEQ ID NO: 42009 - protein, 14 aa, BK virus
IFFLTPHRHRVSAI

SEQ ID NO: 42010 - protein, 14 aa, BK virus
FFLTPHRHRVSAIN

SEQ ID NO: 42011 - protein, 14 aa, BK virus
FLTPHRHRVSAINN

SEQ ID NO: 42012 - protein, 14 aa, BK virus
LTPHRHRVSAINNF

SEQ ID NO: 42013 - protein, 14 aa, BK virus
TPHRHRVSAINNFC

SEQ ID NO: 42014 - protein, 14 aa, BK virus
PHRHRVSAINNFCQ

SEQ ID NO: 42015 - protein, 14 aa, BK virus
HRHRVSAINNFCQK

SEQ ID NO: 42016 - protein, 14 aa, BK virus
RHRVSAINNFCQKL

SEQ ID NO: 42017 - protein, 14 aa, BK virus
HRVSAINNFCQKLC

SEQ ID NO: 42018 - protein, 14 aa, BK virus
RVSAINNFCQKLCT

SEQ ID NO: 42019 - protein, 14 aa, BK virus
VSAINNFCQKLCTF

SEQ ID NO: 42020 - protein, 14 aa, BK virus
SAINNFCQKLCTFS

SEQ ID NO: 42021 - protein, 14 aa, BK virus
AINNFCQKLCTFSF

SEQ ID NO: 42022 - protein, 14 aa, BK virus
INNFCQKLCTFSFL

SEQ ID NO: 42023 - protein, 14 aa, BK virus
NNFCQKLCTFSFLI

SEQ ID NO: 42024 - protein, 14 aa, BK virus
NFCQKLCTFSFLIC

SEQ ID NO: 42025 - protein, 14 aa, BK virus
FCQKLCTFSFLICK

SEQ ID NO: 42026 - protein, 14 aa, BK virus
CQKLCTFSFLICKG

SEQ ID NO: 42027 - protein, 14 aa, BK virus
QKLCTFSFLICKGV

SEQ ID NO: 42028 - protein, 14 aa, BK virus
KLCTFSFLICKGVN

SEQ ID NO: 42029 - protein, 14 aa, BK virus
LCTFSFLICKGVNK

SEQ ID NO: 42030 - protein, 14 aa, BK virus
CTFSFLICKGVNKE

SEQ ID NO: 42031 - protein, 14 aa, BK virus
TFSFLICKGVNKEY

SEQ ID NO: 42032 - protein, 14 aa, BK virus
FSFLICKGVNKEYL

SEQ ID NO: 42033 - protein, 14 aa, BK virus
SFLICKGVNKEYLL

SEQ ID NO: 42034 - protein, 14 aa, BK virus
FLICKGVNKEYLLY

SEQ ID NO: 42035 - protein, 14 aa, BK virus
LICKGVNKEYLLYS

SEQ ID NO: 42036 - protein, 14 aa, BK virus
ICKGVNKEYLLYSA

SEQ ID NO: 42037 - protein, 14 aa, BK virus
CKGVNKEYLLYSAL

SEQ ID NO: 42038 - protein, 14 aa, BK virus
KGVNKEYLLYSALT

SEQ ID NO: 42039 - protein, 14 aa, BK virus
GVNKEYLLYSALTR

SEQ ID NO: 42040 - protein, 14 aa, BK virus
VNKEYLLYSALTRD

SEQ ID NO: 42041 - protein, 14 aa, BK virus
NKEYLLYSALTRDP

SEQ ID NO: 42042 - protein, 14 aa, BK virus
KEYLLYSALTRDPY

SEQ ID NO: 42043 - protein, 14 aa, BK virus
EYLLYSALTRDPYH

SEQ ID NO: 42044 - protein, 14 aa, BK virus
YLLYSALTRDPYHT

SEQ ID NO: 42045 - protein, 14 aa, BK virus
LLYSALTRDPYHTI

SEQ ID NO: 42046 - protein, 14 aa, BK virus
LYSALTRDPYHTIE

SEQ ID NO: 42047 - protein, 14 aa, BK virus
YSALTRDPYHTIEE

SEQ ID NO: 42048 - protein, 14 aa, BK virus
SALTRDPYHTIEES

SEQ ID NO: 42049 - protein, 14 aa, BK virus
ALTRDPYHTIEESI

SEQ ID NO: 42050 - protein, 14 aa, BK virus
LTRDPYHTIEESIQ

SEQ ID NO: 42051 - protein, 14 aa, BK virus
TRDPYHTIEESIQG

SEQ ID NO: 42052 - protein, 14 aa, BK virus
RDPYHTIEESIQGG

SEQ ID NO: 42053 - protein, 14 aa, BK virus
DPYHTIEESIQGGL

SEQ ID NO: 42054 - protein, 14 aa, BK virus
PYHTIEESIQGGLK

SEQ ID NO: 42055 - protein, 14 aa, BK virus
YHTIEESIQGGLKE

SEQ ID NO: 42056 - protein, 14 aa, BK virus
HTIEESIQGGLKEH

SEQ ID NO: 42057 - protein, 14 aa, BK virus
TIEESIQGGLKEHD

SEQ ID NO: 42058 - protein, 14 aa, BK virus
IEESIQGGLKEHDF

SEQ ID NO: 42059 - protein, 14 aa, BK virus
EESIQGGLKEHDFS

SEQ ID NO: 42060 - protein, 14 aa, BK virus
ESIQGGLKEHDFSP

SEQ ID NO: 42061 - protein, 14 aa, BK virus
SIQGGLKEHDFSPE

SEQ ID NO: 42062 - protein, 14 aa, BK virus
IQGGLKEHDFSPEE

SEQ ID NO: 42063 - protein, 14 aa, BK virus
QGGLKEHDFSPEEP

SEQ ID NO: 42064 - protein, 14 aa, BK virus
GGLKEHDFSPEEPE

SEQ ID NO: 42065 - protein, 14 aa, BK virus
GLKEHDFSPEEPEE

SEQ ID NO: 42066 - protein, 14 aa, BK virus
LKEHDFSPEEPEET

SEQ ID NO: 42067 - protein, 14 aa, BK virus
KEHDFSPEEPEETK

SEQ ID NO: 42068 - protein, 14 aa, BK virus
EHDFSPEEPEETKQ

SEQ ID NO: 42069 - protein, 14 aa, BK virus
HDFSPEEPEETKQV

SEQ ID NO: 42070 - protein, 14 aa, BK virus
DFSPEEPEETKQVS

SEQ ID NO: 42071 - protein, 14 aa, BK virus
FSPEEPEETKQVSW

SEQ ID NO: 42072 - protein, 14 aa, BK virus
SPEEPEETKQVSWK

SEQ ID NO: 42073 - protein, 14 aa, BK virus
PEEPEETKQVSWKL

SEQ ID NO: 42074 - protein, 14 aa, BK virus
EEPEETKQVSWKLI

SEQ ID NO: 42075 - protein, 14 aa, BK virus
EPEETKQVSWKLIT

SEQ ID NO: 42076 - protein, 14 aa, BK virus
PEETKQVSWKLITE

SEQ ID NO: 42077 - protein, 14 aa, BK virus
EETKQVSWKLITEY

SEQ ID NO: 42078 - protein, 14 aa, BK virus
ETKQVSWKLITEYA

SEQ ID NO: 42079 - protein, 14 aa, BK virus
TKQVSWKLITEYAV

SEQ ID NO: 42080 - protein, 14 aa, BK virus
KQVSWKLITEYAVE

SEQ ID NO: 42081 - protein, 14 aa, BK virus
QVSWKLITEYAVET

SEQ ID NO: 42082 - protein, 14 aa, BK virus
VSWKLITEYAVETK

SEQ ID NO: 42083 - protein, 14 aa, BK virus
SWKLITEYAVETKC

SEQ ID NO: 42084 - protein, 14 aa, BK virus
WKLITEYAVETKCE

SEQ ID NO: 42085 - protein, 14 aa, BK virus
KLITEYAVETKCED

SEQ ID NO: 42086 - protein, 14 aa, BK virus
LITEYAVETKCEDV

SEQ ID NO: 42087 - protein, 14 aa, BK virus
ITEYAVETKCEDVF

SEQ ID NO: 42088 - protein, 14 aa, BK virus
TEYAVETKCEDVFL

SEQ ID NO: 42089 - protein, 14 aa, BK virus
EYAVETKCEDVFLL

SEQ ID NO: 42090 - protein, 14 aa, BK virus
YAVETKCEDVFLLL

SEQ ID NO: 42091 - protein, 14 aa, BK virus
AVETKCEDVFLLLG

SEQ ID NO: 42092 - protein, 14 aa, BK virus
VETKCEDVFLLLGM

SEQ ID NO: 42093 - protein, 14 aa, BK virus
ETKCEDVFLLLGMY

SEQ ID NO: 42094 - protein, 14 aa, BK virus
TKCEDVFLLLGMYL

SEQ ID NO: 42095 - protein, 14 aa, BK virus
KCEDVFLLLGMYLE

SEQ ID NO: 42096 - protein, 14 aa, BK virus
CEDVFLLLGMYLEF

SEQ ID NO: 42097 - protein, 14 aa, BK virus
EDVFLLLGMYLEFQ

SEQ ID NO: 42098 - protein, 14 aa, BK virus
DVFLLLGMYLEFQY

SEQ ID NO: 42099 - protein, 14 aa, BK virus
VFLLLGMYLEFQYN

SEQ ID NO: 42100 - protein, 14 aa, BK virus
FLLLGMYLEFQYNV

SEQ ID NO: 42101 - protein, 14 aa, BK virus
LLLGMYLEFQYNVE

SEQ ID NO: 42102 - protein, 14 aa, BK virus
LLGMYLEFQYNVEE

SEQ ID NO: 42103 - protein, 14 aa, BK virus
LGMYLEFQYNVEEC

SEQ ID NO: 42104 - protein, 14 aa, BK virus
GMYLEFQYNVEECK

SEQ ID NO: 42105 - protein, 14 aa, BK virus
MYLEFQYNVEECKK

SEQ ID NO: 42106 - protein, 14 aa, BK virus
YLEFQYNVEECKKC

SEQ ID NO: 42107 - protein, 14 aa, BK virus
LEFQYNVEECKKCQ

SEQ ID NO: 42108 - protein, 14 aa, BK virus
EFQYNVEECKKCQK

SEQ ID NO: 42109 - protein, 14 aa, BK virus
FQYNVEECKKCQKK

SEQ ID NO: 42110 - protein, 14 aa, BK virus
QYNVEECKKCQKKD

SEQ ID NO: 42111 - protein, 14 aa, BK virus
YNVEECKKCQKKDQ

SEQ ID NO: 42112 - protein, 14 aa, BK virus
NVEECKKCQKKDQP

SEQ ID NO: 42113 - protein, 14 aa, BK virus
VEECKKCQKKDQPY

SEQ ID NO: 42114 - protein, 14 aa, BK virus
EECKKCQKKDQPYH

SEQ ID NO: 42115 - protein, 14 aa, BK virus
ECKKCQKKDQPYHF

SEQ ID NO: 42116 - protein, 14 aa, BK virus
CKKCQKKDQPYHFK

SEQ ID NO: 42117 - protein, 14 aa, BK virus
KKCQKKDQPYHFKY

SEQ ID NO: 42118 - protein, 14 aa, BK virus
KCQKKDQPYHFKYH

SEQ ID NO: 42119 - protein, 14 aa, BK virus
CQKKDQPYHFKYHE

SEQ ID NO: 42120 - protein, 14 aa, BK virus
QKKDQPYHFKYHEK

SEQ ID NO: 42121 - protein, 14 aa, BK virus
KKDQPYHFKYHEKH

SEQ ID NO: 42122 - protein, 14 aa, BK virus
KDQPYHFKYHEKHF

SEQ ID NO: 42123 - protein, 14 aa, BK virus
DQPYHFKYHEKHFA

SEQ ID NO: 42124 - protein, 14 aa, BK virus
QPYHFKYHEKHFAN

SEQ ID NO: 42125 - protein, 14 aa, BK virus
PYHFKYHEKHFANA

SEQ ID NO: 42126 - protein, 14 aa, BK virus
YHFKYHEKHFANAI

SEQ ID NO: 42127 - protein, 14 aa, BK virus
HFKYHEKHFANAII

SEQ ID NO: 42128 - protein, 14 aa, BK virus
FKYHEKHFANAIIF

SEQ ID NO: 42129 - protein, 14 aa, BK virus
KYHEKHFANAIIFA

SEQ ID NO: 42130 - protein, 14 aa, BK virus
YHEKHFANAIIFAE

SEQ ID NO: 42131 - protein, 14 aa, BK virus
HEKHFANAIIFAES

SEQ ID NO: 42132 - protein, 14 aa, BK virus
EKHFANAIIFAESK

SEQ ID NO: 42133 - protein, 14 aa, BK virus
KHFANAIIFAESKN

SEQ ID NO: 42134 - protein, 14 aa, BK virus
HFANAIIFAESKNQ

SEQ ID NO: 42135 - protein, 14 aa, BK virus
FANAIIFAESKNQK

SEQ ID NO: 42136 - protein, 14 aa, BK virus
ANAIIFAESKNQKS

SEQ ID NO: 42137 - protein, 14 aa, BK virus
NAIIFAESKNQKSI

SEQ ID NO: 42138 - protein, 14 aa, BK virus
AIIFAESKNQKSIC

SEQ ID NO: 42139 - protein, 14 aa, BK virus
IIFAESKNQKSICQ

SEQ ID NO: 42140 - protein, 14 aa, BK virus
IFAESKNQKSICQQ

SEQ ID NO: 42141 - protein, 14 aa, BK virus
FAESKNQKSICQQA

SEQ ID NO: 42142 - protein, 14 aa, BK virus
AESKNQKSICQQAV

SEQ ID NO: 42143 - protein, 14 aa, BK virus
ESKNQKSICQQAVD

SEQ ID NO: 42144 - protein, 14 aa, BK virus
SKNQKSICQQAVDT

SEQ ID NO: 42145 - protein, 14 aa, BK virus
KNQKSICQQAVDTV

SEQ ID NO: 42146 - protein, 14 aa, BK virus
NQKSICQQAVDTVL

SEQ ID NO: 42147 - protein, 14 aa, BK virus
QKSICQQAVDTVLA

SEQ ID NO: 42148 - protein, 14 aa, BK virus
KSICQQAVDTVLAK

SEQ ID NO: 42149 - protein, 14 aa, BK virus
SICQQAVDTVLAKK

SEQ ID NO: 42150 - protein, 14 aa, BK virus
ICQQAVDTVLAKKR

SEQ ID NO: 42151 - protein, 14 aa, BK virus
CQQAVDTVLAKKRV

SEQ ID NO: 42152 - protein, 14 aa, BK virus
QQAVDTVLAKKRVD

SEQ ID NO: 42153 - protein, 14 aa, BK virus
QAVDTVLAKKRVDT

SEQ ID NO: 42154 - protein, 14 aa, BK virus
AVDTVLAKKRVDTL

SEQ ID NO: 42155 - protein, 14 aa, BK virus
VDTVLAKKRVDTLH

SEQ ID NO: 42156 - protein, 14 aa, BK virus
DTVLAKKRVDTLHM

SEQ ID NO: 42157 - protein, 14 aa, BK virus
TVLAKKRVDTLHMT

SEQ ID NO: 42158 - protein, 14 aa, BK virus
VLAKKRVDTLHMTR

SEQ ID NO: 42159 - protein, 14 aa, BK virus
LAKKRVDTLHMTRE

SEQ ID NO: 42160 - protein, 14 aa, BK virus
AKKRVDTLHMTREE

SEQ ID NO: 42161 - protein, 14 aa, BK virus
KKRVDTLHMTREEM

SEQ ID NO: 42162 - protein, 14 aa, BK virus
KRVDTLHMTREEML

SEQ ID NO: 42163 - protein, 14 aa, BK virus
RVDTLHMTREEMLT

SEQ ID NO: 42164 - protein, 14 aa, BK virus
VDTLHMTREEMLTE

SEQ ID NO: 42165 - protein, 14 aa, BK virus
DTLHMTREEMLTER

SEQ ID NO: 42166 - protein, 14 aa, BK virus
TLHMTREEMLTERF

SEQ ID NO: 42167 - protein, 14 aa, BK virus
LHMTREEMLTERFN

SEQ ID NO: 42168 - protein, 14 aa, BK virus
HMTREEMLTERFNH

SEQ ID NO: 42169 - protein, 14 aa, BK virus
MTREEMLTERFNHI

SEQ ID NO: 42170 - protein, 14 aa, BK virus
TREEMLTERFNHIL

SEQ ID NO: 42171 - protein, 14 aa, BK virus
REEMLTERFNHILD

SEQ ID NO: 42172 - protein, 14 aa, BK virus
EEMLTERFNHILDK

SEQ ID NO: 42173 - protein, 14 aa, BK virus
EMLTERFNHILDKM

SEQ ID NO: 42174 - protein, 14 aa, BK virus
MLTERFNHILDKMD

SEQ ID NO: 42175 - protein, 14 aa, BK virus
LTERFNHILDKMDL

SEQ ID NO: 42176 - protein, 14 aa, BK virus
TERFNHILDKMDLI

SEQ ID NO: 42177 - protein, 14 aa, BK virus
ERFNHILDKMDLIF

SEQ ID NO: 42178 - protein, 14 aa, BK virus
RFNHILDKMDLIFG

SEQ ID NO: 42179 - protein, 14 aa, BK virus
FNHILDKMDLIFGA

SEQ ID NO: 42180 - protein, 14 aa, BK virus
NHILDKMDLIFGAH

SEQ ID NO: 42181 - protein, 14 aa, BK virus
HILDKMDLIFGAHG

SEQ ID NO: 42182 - protein, 14 aa, BK virus
ILDKMDLIFGAHGN

SEQ ID NO: 42183 - protein, 14 aa, BK virus
LDKMDLIFGAHGNA

SEQ ID NO: 42184 - protein, 14 aa, BK virus
DKMDLIFGAHGNAV

SEQ ID NO: 42185 - protein, 14 aa, BK virus
KMDLIFGAHGNAVL

SEQ ID NO: 42186 - protein, 14 aa, BK virus
MDLIFGAHGNAVLE

SEQ ID NO: 42187 - protein, 14 aa, BK virus
DLIFGAHGNAVLEQ

SEQ ID NO: 42188 - protein, 14 aa, BK virus
LIFGAHGNAVLEQY

SEQ ID NO: 42189 - protein, 14 aa, BK virus
IFGAHGNAVLEQYM

SEQ ID NO: 42190 - protein, 14 aa, BK virus
FGAHGNAVLEQYMA

SEQ ID NO: 42191 - protein, 14 aa, BK virus
GAHGNAVLEQYMAG

SEQ ID NO: 42192 - protein, 14 aa, BK virus
AHGNAVLEQYMAGV

SEQ ID NO: 42193 - protein, 14 aa, BK virus
HGNAVLEQYMAGVA

SEQ ID NO: 42194 - protein, 14 aa, BK virus
GNAVLEQYMAGVAW

SEQ ID NO: 42195 - protein, 14 aa, BK virus
NAVLEQYMAGVAWL

SEQ ID NO: 42196 - protein, 14 aa, BK virus
AVLEQYMAGVAWLH

SEQ ID NO: 42197 - protein, 14 aa, BK virus
VLEQYMAGVAWLHC

SEQ ID NO: 42198 - protein, 14 aa, BK virus
LEQYMAGVAWLHCL

SEQ ID NO: 42199 - protein, 14 aa, BK virus
EQYMAGVAWLHCLL

SEQ ID NO: 42200 - protein, 14 aa, BK virus
QYMAGVAWLHCLLP

SEQ ID NO: 42201 - protein, 14 aa, BK virus
YMAGVAWLHCLLPK

SEQ ID NO: 42202 - protein, 14 aa, BK virus
MAGVAWLHCLLPKM

SEQ ID NO: 42203 - protein, 14 aa, BK virus
AGVAWLHCLLPKMD

SEQ ID NO: 42204 - protein, 14 aa, BK virus
GVAWLHCLLPKMDS

SEQ ID NO: 42205 - protein, 14 aa, BK virus
VAWLHCLLPKMDSV

SEQ ID NO: 42206 - protein, 14 aa, BK virus
AWLHCLLPKMDSVI

SEQ ID NO: 42207 - protein, 14 aa, BK virus
WLHCLLPKMDSVIF

SEQ ID NO: 42208 - protein, 14 aa, BK virus
LHCLLPKMDSVIFD

SEQ ID NO: 42209 - protein, 14 aa, BK virus
HCLLPKMDSVIFDF

SEQ ID NO: 42210 - protein, 14 aa, BK virus
CLLPKMDSVIFDFL

SEQ ID NO: 42211 - protein, 14 aa, BK virus
LLPKMDSVIFDFLH

SEQ ID NO: 42212 - protein, 14 aa, BK virus
LPKMDSVIFDFLHC

SEQ ID NO: 42213 - protein, 14 aa, BK virus
PKMDSVIFDFLHCI

SEQ ID NO: 42214 - protein, 14 aa, BK virus
KMDSVIFDFLHCIV

SEQ ID NO: 42215 - protein, 14 aa, BK virus
MDSVIFDFLHCIVF

SEQ ID NO: 42216 - protein, 14 aa, BK virus
DSVIFDFLHCIVFN

SEQ ID NO: 42217 - protein, 14 aa, BK virus
SVIFDFLHCIVFNV

SEQ ID NO: 42218 - protein, 14 aa, BK virus
VIFDFLHCIVFNVP

SEQ ID NO: 42219 - protein, 14 aa, BK virus
IFDFLHCIVFNVPK

SEQ ID NO: 42220 - protein, 14 aa, BK virus
FDFLHCIVFNVPKR

SEQ ID NO: 42221 - protein, 14 aa, BK virus
DFLHCIVFNVPKRR

SEQ ID NO: 42222 - protein, 14 aa, BK virus
FLHCIVFNVPKRRY

SEQ ID NO: 42223 - protein, 14 aa, BK virus
LHCIVFNVPKRRYW

SEQ ID NO: 42224 - protein, 14 aa, BK virus
HCIVFNVPKRRYWL

SEQ ID NO: 42225 - protein, 14 aa, BK virus
CIVFNVPKRRYWLF

SEQ ID NO: 42226 - protein, 14 aa, BK virus
IVFNVPKRRYWLFK

SEQ ID NO: 42227 - protein, 14 aa, BK virus
VFNVPKRRYWLFKG

SEQ ID NO: 42228 - protein, 14 aa, BK virus
FNVPKRRYWLFKGP

SEQ ID NO: 42229 - protein, 14 aa, BK virus
NVPKRRYWLFKGPI

SEQ ID NO: 42230 - protein, 14 aa, BK virus
VPKRRYWLFKGPID

SEQ ID NO: 42231 - protein, 14 aa, BK virus
PKRRYWLFKGPIDS

SEQ ID NO: 42232 - protein, 14 aa, BK virus
KRRYWLFKGPIDSG

SEQ ID NO: 42233 - protein, 14 aa, BK virus
RRYWLFKGPIDSGK

SEQ ID NO: 42234 - protein, 14 aa, BK virus
RYWLFKGPIDSGKT

SEQ ID NO: 42235 - protein, 14 aa, BK virus
YWLFKGPIDSGKTT

SEQ ID NO: 42236 - protein, 14 aa, BK virus
WLFKGPIDSGKTTL

SEQ ID NO: 42237 - protein, 14 aa, BK virus
LFKGPIDSGKTTLA

SEQ ID NO: 42238 - protein, 14 aa, BK virus
FKGPIDSGKTTLAA

SEQ ID NO: 42239 - protein, 14 aa, BK virus
KGPIDSGKTTLAAG

SEQ ID NO: 42240 - protein, 14 aa, BK virus
GPIDSGKTTLAAGL

SEQ ID NO: 42241 - protein, 14 aa, BK virus
PIDSGKTTLAAGLL

SEQ ID NO: 42242 - protein, 14 aa, BK virus
IDSGKTTLAAGLLD

SEQ ID NO: 42243 - protein, 14 aa, BK virus
DSGKTTLAAGLLDL

SEQ ID NO: 42244 - protein, 14 aa, BK virus
SGKTTLAAGLLDLC

SEQ ID NO: 42245 - protein, 14 aa, BK virus
GKTTLAAGLLDLCG

SEQ ID NO: 42246 - protein, 14 aa, BK virus
KTTLAAGLLDLCGG

SEQ ID NO: 42247 - protein, 14 aa, BK virus
TTLAAGLLDLCGGK

SEQ ID NO: 42248 - protein, 14 aa, BK virus
TLAAGLLDLCGGKA

SEQ ID NO: 42249 - protein, 14 aa, BK virus
LAAGLLDLCGGKAL

SEQ ID NO: 42250 - protein, 14 aa, BK virus
AAGLLDLCGGKALN

SEQ ID NO: 42251 - protein, 14 aa, BK virus
AGLLDLCGGKALNV

SEQ ID NO: 42252 - protein, 14 aa, BK virus
GLLDLCGGKALNVN

SEQ ID NO: 42253 - protein, 14 aa, BK virus
LLDLCGGKALNVNL

SEQ ID NO: 42254 - protein, 14 aa, BK virus
LDLCGGKALNVNLP

SEQ ID NO: 42255 - protein, 14 aa, BK virus
DLCGGKALNVNLPM

SEQ ID NO: 42256 - protein, 14 aa, BK virus
LCGGKALNVNLPME

SEQ ID NO: 42257 - protein, 14 aa, BK virus
CGGKALNVNLPMER

SEQ ID NO: 42258 - protein, 14 aa, BK virus
GGKALNVNLPMERL

SEQ ID NO: 42259 - protein, 14 aa, BK virus
GKALNVNLPMERLT

SEQ ID NO: 42260 - protein, 14 aa, BK virus
KALNVNLPMERLTF

SEQ ID NO: 42261 - protein, 14 aa, BK virus
ALNVNLPMERLTFE

SEQ ID NO: 42262 - protein, 14 aa, BK virus
LNVNLPMERLTFEL

SEQ ID NO: 42263 - protein, 14 aa, BK virus
NVNLPMERLTFELG

SEQ ID NO: 42264 - protein, 14 aa, BK virus
VNLPMERLTFELGV

SEQ ID NO: 42265 - protein, 14 aa, BK virus
NLPMERLTFELGVA

SEQ ID NO: 42266 - protein, 14 aa, BK virus
LPMERLTFELGVAI

SEQ ID NO: 42267 - protein, 14 aa, BK virus
PMERLTFELGVAID

SEQ ID NO: 42268 - protein, 14 aa, BK virus
MERLTFELGVAIDQ

SEQ ID NO: 42269 - protein, 14 aa, BK virus
ERLTFELGVAIDQY

SEQ ID NO: 42270 - protein, 14 aa, BK virus
RLTFELGVAIDQYM

SEQ ID NO: 42271 - protein, 14 aa, BK virus
LTFELGVAIDQYMV

SEQ ID NO: 42272 - protein, 14 aa, BK virus
TFELGVAIDQYMVV

SEQ ID NO: 42273 - protein, 14 aa, BK virus
FELGVAIDQYMVVF

SEQ ID NO: 42274 - protein, 14 aa, BK virus
ELGVAIDQYMVVFE

SEQ ID NO: 42275 - protein, 14 aa, BK virus
LGVAIDQYMVVFED

SEQ ID NO: 42276 - protein, 14 aa, BK virus
GVAIDQYMVVFEDV

SEQ ID NO: 42277 - protein, 14 aa, BK virus
VAIDQYMVVFEDVK

SEQ ID NO: 42278 - protein, 14 aa, BK virus
AIDQYMVVFEDVKG

SEQ ID NO: 42279 - protein, 14 aa, BK virus
IDQYMVVFEDVKGT

SEQ ID NO: 42280 - protein, 14 aa, BK virus
DQYMVVFEDVKGTG

SEQ ID NO: 42281 - protein, 14 aa, BK virus
QYMVVFEDVKGTGA

SEQ ID NO: 42282 - protein, 14 aa, BK virus
YMVVFEDVKGTGAE

SEQ ID NO: 42283 - protein, 14 aa, BK virus
MVVFEDVKGTGAES

SEQ ID NO: 42284 - protein, 14 aa, BK virus
VVFEDVKGTGAESK

SEQ ID NO: 42285 - protein, 14 aa, BK virus
VFEDVKGTGAESKD

SEQ ID NO: 42286 - protein, 14 aa, BK virus
FEDVKGTGAESKDL

SEQ ID NO: 42287 - protein, 14 aa, BK virus
EDVKGTGAESKDLP

SEQ ID NO: 42288 - protein, 14 aa, BK virus
DVKGTGAESKDLPS

SEQ ID NO: 42289 - protein, 14 aa, BK virus
VKGTGAESKDLPSG

SEQ ID NO: 42290 - protein, 14 aa, BK virus
KGTGAESKDLPSGH

SEQ ID NO: 42291 - protein, 14 aa, BK virus
GTGAESKDLPSGHG

SEQ ID NO: 42292 - protein, 14 aa, BK virus
TGAESKDLPSGHGI

SEQ ID NO: 42293 - protein, 14 aa, BK virus
GAESKDLPSGHGIN

SEQ ID NO: 42294 - protein, 14 aa, BK virus
AESKDLPSGHGINN

SEQ ID NO: 42295 - protein, 14 aa, BK virus
ESKDLPSGHGINNL

SEQ ID NO: 42296 - protein, 14 aa, BK virus
SKDLPSGHGINNLD

SEQ ID NO: 42297 - protein, 14 aa, BK virus
KDLPSGHGINNLDS

SEQ ID NO: 42298 - protein, 14 aa, BK virus
DLPSGHGINNLDSL

SEQ ID NO: 42299 - protein, 14 aa, BK virus
LPSGHGINNLDSLR

SEQ ID NO: 42300 - protein, 14 aa, BK virus
PSGHGINNLDSLRD

SEQ ID NO: 42301 - protein, 14 aa, BK virus
SGHGINNLDSLRDY

SEQ ID NO: 42302 - protein, 14 aa, BK virus
GHGINNLDSLRDYL

SEQ ID NO: 42303 - protein, 14 aa, BK virus
HGINNLDSLRDYLD

SEQ ID NO: 42304 - protein, 14 aa, BK virus
GINNLDSLRDYLDG

SEQ ID NO: 42305 - protein, 14 aa, BK virus
INNLDSLRDYLDGS

SEQ ID NO: 42306 - protein, 14 aa, BK virus
NNLDSLRDYLDGSV

SEQ ID NO: 42307 - protein, 14 aa, BK virus
NLDSLRDYLDGSVK

SEQ ID NO: 42308 - protein, 14 aa, BK virus
LDSLRDYLDGSVKV

SEQ ID NO: 42309 - protein, 14 aa, BK virus
DSLRDYLDGSVKVN

SEQ ID NO: 42310 - protein, 14 aa, BK virus
SLRDYLDGSVKVNL

SEQ ID NO: 42311 - protein, 14 aa, BK virus
LRDYLDGSVKVNLE

SEQ ID NO: 42312 - protein, 14 aa, BK virus
RDYLDGSVKVNLEK

SEQ ID NO: 42313 - protein, 14 aa, BK virus
DYLDGSVKVNLEKK

SEQ ID NO: 42314 - protein, 14 aa, BK virus
YLDGSVKVNLEKKH

SEQ ID NO: 42315 - protein, 14 aa, BK virus
LDGSVKVNLEKKHL

SEQ ID NO: 42316 - protein, 14 aa, BK virus
DGSVKVNLEKKHLN

SEQ ID NO: 42317 - protein, 14 aa, BK virus
GSVKVNLEKKHLNK

SEQ ID NO: 42318 - protein, 14 aa, BK virus
SVKVNLEKKHLNKR

SEQ ID NO: 42319 - protein, 14 aa, BK virus
VKVNLEKKHLNKRT

SEQ ID NO: 42320 - protein, 14 aa, BK virus
KVNLEKKHLNKRTQ

SEQ ID NO: 42321 - protein, 14 aa, BK virus
VNLEKKHLNKRTQI

SEQ ID NO: 42322 - protein, 14 aa, BK virus
NLEKKHLNKRTQIF

SEQ ID NO: 42323 - protein, 14 aa, BK virus
LEKKHLNKRTQIFP

SEQ ID NO: 42324 - protein, 14 aa, BK virus
EKKHLNKRTQIFPP

SEQ ID NO: 42325 - protein, 14 aa, BK virus
KKHLNKRTQIFPPG

SEQ ID NO: 42326 - protein, 14 aa, BK virus
KHLNKRTQIFPPGL

SEQ ID NO: 42327 - protein, 14 aa, BK virus
HLNKRTQIFPPGLV

SEQ ID NO: 42328 - protein, 14 aa, BK virus
LNKRTQIFPPGLVT

SEQ ID NO: 42329 - protein, 14 aa, BK virus
NKRTQIFPPGLVTM

SEQ ID NO: 42330 - protein, 14 aa, BK virus
KRTQIFPPGLVTMN

SEQ ID NO: 42331 - protein, 14 aa, BK virus
RTQIFPPGLVTMNE

SEQ ID NO: 42332 - protein, 14 aa, BK virus
TQIFPPGLVTMNEY

SEQ ID NO: 42333 - protein, 14 aa, BK virus
QIFPPGLVTMNEYP

SEQ ID NO: 42334 - protein, 14 aa, BK virus
IFPPGLVTMNEYPV

SEQ ID NO: 42335 - protein, 14 aa, BK virus
FPPGLVTMNEYPVP

SEQ ID NO: 42336 - protein, 14 aa, BK virus
PPGLVTMNEYPVPK

SEQ ID NO: 42337 - protein, 14 aa, BK virus
PGLVTMNEYPVPKT

SEQ ID NO: 42338 - protein, 14 aa, BK virus
GLVTMNEYPVPKTL

SEQ ID NO: 42339 - protein, 14 aa, BK virus
LVTMNEYPVPKTLQ

SEQ ID NO: 42340 - protein, 14 aa, BK virus
VTMNEYPVPKTLQA

SEQ ID NO: 42341 - protein, 14 aa, BK virus
TMNEYPVPKTLQAR

SEQ ID NO: 42342 - protein, 14 aa, BK virus
MNEYPVPKTLQARF

SEQ ID NO: 42343 - protein, 14 aa, BK virus
NEYPVPKTLQARFV

SEQ ID NO: 42344 - protein, 14 aa, BK virus
EYPVPKTLQARFVR

SEQ ID NO: 42345 - protein, 14 aa, BK virus
YPVPKTLQARFVRQ

SEQ ID NO: 42346 - protein, 14 aa, BK virus
PVPKTLQARFVRQI

SEQ ID NO: 42347 - protein, 14 aa, BK virus
VPKTLQARFVRQID

SEQ ID NO: 42348 - protein, 14 aa, BK virus
PKTLQARFVRQIDF

SEQ ID NO: 42349 - protein, 14 aa, BK virus
KTLQARFVRQIDFR

SEQ ID NO: 42350 - protein, 14 aa, BK virus
TLQARFVRQIDFRP

SEQ ID NO: 42351 - protein, 14 aa, BK virus
LQARFVRQIDFRPK

SEQ ID NO: 42352 - protein, 14 aa, BK virus
QARFVRQIDFRPKI

SEQ ID NO: 42353 - protein, 14 aa, BK virus
ARFVRQIDFRPKIY

SEQ ID NO: 42354 - protein, 14 aa, BK virus
RFVRQIDFRPKIYL

SEQ ID NO: 42355 - protein, 14 aa, BK virus
FVRQIDFRPKIYLR

SEQ ID NO: 42356 - protein, 14 aa, BK virus
VRQIDFRPKIYLRK

SEQ ID NO: 42357 - protein, 14 aa, BK virus
RQIDFRPKIYLRKS

SEQ ID NO: 42358 - protein, 14 aa, BK virus
QIDFRPKIYLRKSL

SEQ ID NO: 42359 - protein, 14 aa, BK virus
IDFRPKIYLRKSLQ

SEQ ID NO: 42360 - protein, 14 aa, BK virus
DFRPKIYLRKSLQN

SEQ ID NO: 42361 - protein, 14 aa, BK virus
FRPKIYLRKSLQNS

SEQ ID NO: 42362 - protein, 14 aa, BK virus
RPKIYLRKSLQNSE

SEQ ID NO: 42363 - protein, 14 aa, BK virus
PKIYLRKSLQNSEF

SEQ ID NO: 42364 - protein, 14 aa, BK virus
KIYLRKSLQNSEFL

SEQ ID NO: 42365 - protein, 14 aa, BK virus
IYLRKSLQNSEFLL

SEQ ID NO: 42366 - protein, 14 aa, BK virus
YLRKSLQNSEFLLE

SEQ ID NO: 42367 - protein, 14 aa, BK virus
LRKSLQNSEFLLEK

SEQ ID NO: 42368 - protein, 14 aa, BK virus
RKSLQNSEFLLEKR

SEQ ID NO: 42369 - protein, 14 aa, BK virus
KSLQNSEFLLEKRI

SEQ ID NO: 42370 - protein, 14 aa, BK virus
SLQNSEFLLEKRIL

SEQ ID NO: 42371 - protein, 14 aa, BK virus
LQNSEFLLEKRILQ

SEQ ID NO: 42372 - protein, 14 aa, BK virus
QNSEFLLEKRILQS

SEQ ID NO: 42373 - protein, 14 aa, BK virus
NSEFLLEKRILQSG

SEQ ID NO: 42374 - protein, 14 aa, BK virus
SEFLLEKRILQSGM

SEQ ID NO: 42375 - protein, 14 aa, BK virus
EFLLEKRILQSGMT

SEQ ID NO: 42376 - protein, 14 aa, BK virus
FLLEKRILQSGMTL

SEQ ID NO: 42377 - protein, 14 aa, BK virus
LLEKRILQSGMTLL

SEQ ID NO: 42378 - protein, 14 aa, BK virus
LEKRILQSGMTLLL

SEQ ID NO: 42379 - protein, 14 aa, BK virus
EKRILQSGMTLLLL

SEQ ID NO: 42380 - protein, 14 aa, BK virus
KRILQSGMTLLLLL

SEQ ID NO: 42381 - protein, 14 aa, BK virus
RILQSGMTLLLLLI

SEQ ID NO: 42382 - protein, 14 aa, BK virus
ILQSGMTLLLLLIW

SEQ ID NO: 42383 - protein, 14 aa, BK virus
LQSGMTLLLLLIWF

SEQ ID NO: 42384 - protein, 14 aa, BK virus
QSGMTLLLLLIWFR

SEQ ID NO: 42385 - protein, 14 aa, BK virus
SGMTLLLLLIWFRP

SEQ ID NO: 42386 - protein, 14 aa, BK virus
GMTLLLLLIWFRPV

SEQ ID NO: 42387 - protein, 14 aa, BK virus
MTLLLLLIWFRPVA

SEQ ID NO: 42388 - protein, 14 aa, BK virus
TLLLLLIWFRPVAD

SEQ ID NO: 42389 - protein, 14 aa, BK virus
LLLLLIWFRPVADF

SEQ ID NO: 42390 - protein, 14 aa, BK virus
LLLLIWFRPVADFA

SEQ ID NO: 42391 - protein, 14 aa, BK virus
LLLIWFRPVADFAT

SEQ ID NO: 42392 - protein, 14 aa, BK virus
LLIWFRPVADFATD

SEQ ID NO: 42393 - protein, 14 aa, BK virus
LIWFRPVADFATDI

SEQ ID NO: 42394 - protein, 14 aa, BK virus
IWFRPVADFATDIQ

SEQ ID NO: 42395 - protein, 14 aa, BK virus
WFRPVADFATDIQS

SEQ ID NO: 42396 - protein, 14 aa, BK virus
FRPVADFATDIQSR

SEQ ID NO: 42397 - protein, 14 aa, BK virus
RPVADFATDIQSRI

SEQ ID NO: 42398 - protein, 14 aa, BK virus
PVADFATDIQSRIV

SEQ ID NO: 42399 - protein, 14 aa, BK virus
VADFATDIQSRIVE

SEQ ID NO: 42400 - protein, 14 aa, BK virus
ADFATDIQSRIVEW

SEQ ID NO: 42401 - protein, 14 aa, BK virus
DFATDIQSRIVEWK

SEQ ID NO: 42402 - protein, 14 aa, BK virus
FATDIQSRIVEWKE

SEQ ID NO: 42403 - protein, 14 aa, BK virus
ATDIQSRIVEWKER

SEQ ID NO: 42404 - protein, 14 aa, BK virus
TDIQSRIVEWKERL

SEQ ID NO: 42405 - protein, 14 aa, BK virus
DIQSRIVEWKERLD

SEQ ID NO: 42406 - protein, 14 aa, BK virus
IQSRIVEWKERLDS

SEQ ID NO: 42407 - protein, 14 aa, BK virus
QSRIVEWKERLDSE

SEQ ID NO: 42408 - protein, 14 aa, BK virus
SRIVEWKERLDSEI

SEQ ID NO: 42409 - protein, 14 aa, BK virus
RIVEWKERLDSEIS

SEQ ID NO: 42410 - protein, 14 aa, BK virus
IVEWKERLDSEISM

SEQ ID NO: 42411 - protein, 14 aa, BK virus
VEWKERLDSEISMY

SEQ ID NO: 42412 - protein, 14 aa, BK virus
EWKERLDSEISMYT

SEQ ID NO: 42413 - protein, 14 aa, BK virus
WKERLDSEISMYTF

SEQ ID NO: 42414 - protein, 14 aa, BK virus
KERLDSEISMYTFS

SEQ ID NO: 42415 - protein, 14 aa, BK virus
ERLDSEISMYTFSR

SEQ ID NO: 42416 - protein, 14 aa, BK virus
RLDSEISMYTFSRM

SEQ ID NO: 42417 - protein, 14 aa, BK virus
LDSEISMYTFSRMK

SEQ ID NO: 42418 - protein, 14 aa, BK virus
DSEISMYTFSRMKY

SEQ ID NO: 42419 - protein, 14 aa, BK virus
SEISMYTFSRMKYN

SEQ ID NO: 42420 - protein, 14 aa, BK virus
EISMYTFSRMKYNI

SEQ ID NO: 42421 - protein, 14 aa, BK virus
ISMYTFSRMKYNIC

SEQ ID NO: 42422 - protein, 14 aa, BK virus
SMYTFSRMKYNICM

SEQ ID NO: 42423 - protein, 14 aa, BK virus
MYTFSRMKYNICMG

SEQ ID NO: 42424 - protein, 14 aa, BK virus
YTFSRMKYNICMGK

SEQ ID NO: 42425 - protein, 14 aa, BK virus
TFSRMKYNICMGKC

SEQ ID NO: 42426 - protein, 14 aa, BK virus
FSRMKYNICMGKCI

SEQ ID NO: 42427 - protein, 14 aa, BK virus
SRMKYNICMGKCIL

SEQ ID NO: 42428 - protein, 14 aa, BK virus
RMKYNICMGKCILD

SEQ ID NO: 42429 - protein, 14 aa, BK virus
MKYNICMGKCILDI

SEQ ID NO: 42430 - protein, 14 aa, BK virus
KYNICMGKCILDIT

SEQ ID NO: 42431 - protein, 14 aa, BK virus
YNICMGKCILDITR

SEQ ID NO: 42432 - protein, 14 aa, BK virus
NICMGKCILDITRE

SEQ ID NO: 42433 - protein, 14 aa, BK virus
ICMGKCILDITREE

SEQ ID NO: 42434 - protein, 14 aa, BK virus
CMGKCILDITREED

SEQ ID NO: 42435 - protein, 14 aa, BK virus
MGKCILDITREEDS

SEQ ID NO: 42436 - protein, 14 aa, BK virus
GKCILDITREEDSE

SEQ ID NO: 42437 - protein, 14 aa, BK virus
KCILDITREEDSET

SEQ ID NO: 42438 - protein, 14 aa, BK virus
CILDITREEDSETE

SEQ ID NO: 42439 - protein, 14 aa, BK virus
ILDITREEDSETED

SEQ ID NO: 42440 - protein, 14 aa, BK virus
LDITREEDSETEDS

SEQ ID NO: 42441 - protein, 14 aa, BK virus
DITREEDSETEDSG

SEQ ID NO: 42442 - protein, 14 aa, BK virus
ITREEDSETEDSGH

SEQ ID NO: 42443 - protein, 14 aa, BK virus
TREEDSETEDSGHG

SEQ ID NO: 42444 - protein, 14 aa, BK virus
REEDSETEDSGHGS

SEQ ID NO: 42445 - protein, 14 aa, BK virus
EEDSETEDSGHGSS

SEQ ID NO: 42446 - protein, 14 aa, BK virus
EDSETEDSGHGSST

SEQ ID NO: 42447 - protein, 14 aa, BK virus
DSETEDSGHGSSTE

SEQ ID NO: 42448 - protein, 14 aa, BK virus
SETEDSGHGSSTES

SEQ ID NO: 42449 - protein, 14 aa, BK virus
ETEDSGHGSSTESQ

SEQ ID NO: 42450 - protein, 14 aa, BK virus
TEDSGHGSSTESQS

SEQ ID NO: 42451 - protein, 14 aa, BK virus
EDSGHGSSTESQSQ

SEQ ID NO: 42452 - protein, 14 aa, BK virus
DSGHGSSTESQSQC

SEQ ID NO: 42453 - protein, 14 aa, BK virus
SGHGSSTESQSQCS

SEQ ID NO: 42454 - protein, 14 aa, BK virus
GHGSSTESQSQCSS

SEQ ID NO: 42455 - protein, 14 aa, BK virus
HGSSTESQSQCSSQ

SEQ ID NO: 42456 - protein, 14 aa, BK virus
GSSTESQSQCSSQV

SEQ ID NO: 42457 - protein, 14 aa, BK virus
SSTESQSQCSSQVS

SEQ ID NO: 42458 - protein, 14 aa, BK virus
STESQSQCSSQVSD

SEQ ID NO: 42459 - protein, 14 aa, BK virus
TESQSQCSSQVSDT

SEQ ID NO: 42460 - protein, 14 aa, BK virus
ESQSQCSSQVSDTS

SEQ ID NO: 42461 - protein, 14 aa, BK virus
SQSQCSSQVSDTSA

SEQ ID NO: 42462 - protein, 14 aa, BK virus
QSQCSSQVSDTSAP

SEQ ID NO: 42463 - protein, 14 aa, BK virus
SQCSSQVSDTSAPA

SEQ ID NO: 42464 - protein, 14 aa, BK virus
QCSSQVSDTSAPAE

SEQ ID NO: 42465 - protein, 14 aa, BK virus
CSSQVSDTSAPAED

SEQ ID NO: 42466 - protein, 14 aa, BK virus
SSQVSDTSAPAEDS

SEQ ID NO: 42467 - protein, 14 aa, BK virus
SQVSDTSAPAEDSQ

SEQ ID NO: 42468 - protein, 14 aa, BK virus
QVSDTSAPAEDSQR

SEQ ID NO: 42469 - protein, 14 aa, BK virus
VSDTSAPAEDSQRS

SEQ ID NO: 42470 - protein, 14 aa, BK virus
SDTSAPAEDSQRSD

SEQ ID NO: 42471 - protein, 14 aa, BK virus
DTSAPAEDSQRSDP

SEQ ID NO: 42472 - protein, 14 aa, BK virus
TSAPAEDSQRSDPH

SEQ ID NO: 42473 - protein, 14 aa, BK virus
SAPAEDSQRSDPHS

SEQ ID NO: 42474 - protein, 14 aa, BK virus
APAEDSQRSDPHSQ

SEQ ID NO: 42475 - protein, 14 aa, BK virus
PAEDSQRSDPHSQE

SEQ ID NO: 42476 - protein, 14 aa, BK virus
AEDSQRSDPHSQEL

SEQ ID NO: 42477 - protein, 14 aa, BK virus
EDSQRSDPHSQELH

SEQ ID NO: 42478 - protein, 14 aa, BK virus
DSQRSDPHSQELHL

SEQ ID NO: 42479 - protein, 14 aa, BK virus
SQRSDPHSQELHLC

SEQ ID NO: 42480 - protein, 14 aa, BK virus
QRSDPHSQELHLCK

SEQ ID NO: 42481 - protein, 14 aa, BK virus
RSDPHSQELHLCKG

SEQ ID NO: 42482 - protein, 14 aa, BK virus
SDPHSQELHLCKGF

SEQ ID NO: 42483 - protein, 14 aa, BK virus
DPHSQELHLCKGFQ

SEQ ID NO: 42484 - protein, 14 aa, BK virus
PHSQELHLCKGFQC

SEQ ID NO: 42485 - protein, 14 aa, BK virus
HSQELHLCKGFQCF

SEQ ID NO: 42486 - protein, 14 aa, BK virus
SQELHLCKGFQCFK

SEQ ID NO: 42487 - protein, 14 aa, BK virus
QELHLCKGFQCFKR

SEQ ID NO: 42488 - protein, 14 aa, BK virus
ELHLCKGFQCFKRP

SEQ ID NO: 42489 - protein, 14 aa, BK virus
LHLCKGFQCFKRPK

SEQ ID NO: 42490 - protein, 14 aa, BK virus
HLCKGFQCFKRPKT

SEQ ID NO: 42491 - protein, 14 aa, BK virus
LCKGFQCFKRPKTP

SEQ ID NO: 42492 - protein, 14 aa, BK virus
CKGFQCFKRPKTPP

SEQ ID NO: 42493 - protein, 14 aa, BK virus
KGFQCFKRPKTPPP

SEQ ID NO: 42494 - protein, 14 aa, BK virus
GFQCFKRPKTPPPK

SEQ ID NO: 42495 - protein, 14 aa, BK virus
MYMYNKSTCLKHFG

SEQ ID NO: 42496 - protein, 14 aa, BK virus
YMYNKSTCLKHFGL

SEQ ID NO: 42497 - protein, 14 aa, BK virus
MYNKSTCLKHFGLQ

SEQ ID NO: 42498 - protein, 14 aa, BK virus
YNKSTCLKHFGLQL

SEQ ID NO: 42499 - protein, 14 aa, BK virus
NKSTCLKHFGLQLS

SEQ ID NO: 42500 - protein, 14 aa, BK virus
KSTCLKHFGLQLSL

SEQ ID NO: 42501 - protein, 14 aa, BK virus
STCLKHFGLQLSLF

SEQ ID NO: 42502 - protein, 14 aa, BK virus
TCLKHFGLQLSLFV

SEQ ID NO: 42503 - protein, 14 aa, BK virus
CLKHFGLQLSLFVN

SEQ ID NO: 42504 - protein, 14 aa, BK virus
LKHFGLQLSLFVNI

SEQ ID NO: 42505 - protein, 14 aa, BK virus
KHFGLQLSLFVNIS

SEQ ID NO: 42506 - protein, 14 aa, BK virus
HFGLQLSLFVNISY

SEQ ID NO: 42507 - protein, 14 aa, BK virus
FGLQLSLFVNISYH

SEQ ID NO: 42508 - protein, 14 aa, BK virus
GLQLSLFVNISYHI

SEQ ID NO: 42509 - protein, 14 aa, BK virus
LQLSLFVNISYHIW

SEQ ID NO: 42510 - protein, 14 aa, BK virus
QLSLFVNISYHIWV

SEQ ID NO: 42511 - protein, 14 aa, BK virus
LSLFVNISYHIWVP

SEQ ID NO: 42512 - protein, 14 aa, BK virus
SLFVNISYHIWVPW

SEQ ID NO: 42513 - protein, 14 aa, BK virus
LFVNISYHIWVPWK

SEQ ID NO: 42514 - protein, 14 aa, BK virus
FVNISYHIWVPWKS

SEQ ID NO: 42515 - protein, 14 aa, BK virus
VNISYHIWVPWKSF

SEQ ID NO: 42516 - protein, 14 aa, BK virus
NISYHIWVPWKSFC

SEQ ID NO: 42517 - protein, 14 aa, BK virus
ISYHIWVPWKSFCA

SEQ ID NO: 42518 - protein, 14 aa, BK virus
SYHIWVPWKSFCAI

SEQ ID NO: 42519 - protein, 14 aa, BK virus
YHIWVPWKSFCAIK

SEQ ID NO: 42520 - protein, 14 aa, BK virus
HIWVPWKSFCAIKH

SEQ ID NO: 42521 - protein, 14 aa, BK virus
IWVPWKSFCAIKHP

SEQ ID NO: 42522 - protein, 14 aa, BK virus
WVPWKSFCAIKHPN

SEQ ID NO: 42523 - protein, 14 aa, BK virus
VPWKSFCAIKHPNL

SEQ ID NO: 42524 - protein, 14 aa, BK virus
PWKSFCAIKHPNLF

SEQ ID NO: 42525 - protein, 14 aa, BK virus
WKSFCAIKHPNLFY

SEQ ID NO: 42526 - protein, 14 aa, BK virus
KSFCAIKHPNLFYL

SEQ ID NO: 42527 - protein, 14 aa, BK virus
SFCAIKHPNLFYLG

SEQ ID NO: 42528 - protein, 14 aa, BK virus
FCAIKHPNLFYLGF

SEQ ID NO: 42529 - protein, 14 aa, BK virus
CAIKHPNLFYLGFH

SEQ ID NO: 42530 - protein, 14 aa, BK virus
AIKHPNLFYLGFHT

SEQ ID NO: 42531 - protein, 14 aa, BK virus
IKHPNLFYLGFHTI

SEQ ID NO: 42532 - protein, 14 aa, BK virus
KHPNLFYLGFHTIH

SEQ ID NO: 42533 - protein, 14 aa, BK virus
HPNLFYLGFHTIHR

SEQ ID NO: 42534 - protein, 14 aa, BK virus
PNLFYLGFHTIHRL

SEQ ID NO: 42535 - protein, 14 aa, BK virus
NLFYLGFHTIHRLP

SEQ ID NO: 42536 - protein, 14 aa, BK virus
LFYLGFHTIHRLPI

SEQ ID NO: 42537 - protein, 14 aa, BK virus
FYLGFHTIHRLPIH

SEQ ID NO: 42538 - protein, 14 aa, BK virus
YLGFHTIHRLPIHS

SEQ ID NO: 42539 - protein, 14 aa, BK virus
LGFHTIHRLPIHSL

SEQ ID NO: 42540 - protein, 14 aa, BK virus
GFHTIHRLPIHSLG

SEQ ID NO: 42541 - protein, 14 aa, BK virus
FHTIHRLPIHSLGS

SEQ ID NO: 42542 - protein, 14 aa, BK virus
HTIHRLPIHSLGSP

SEQ ID NO: 42543 - protein, 14 aa, BK virus
TIHRLPIHSLGSPV

SEQ ID NO: 42544 - protein, 14 aa, BK virus
IHRLPIHSLGSPVY

SEQ ID NO: 42545 - protein, 14 aa, BK virus
HRLPIHSLGSPVYK

SEQ ID NO: 42546 - protein, 14 aa, BK virus
RLPIHSLGSPVYKV

SEQ ID NO: 42547 - protein, 14 aa, BK virus
LPIHSLGSPVYKVT

SEQ ID NO: 42548 - protein, 14 aa, BK virus
QKGNWVRILYRSFS

SEQ ID NO: 42549 - protein, 14 aa, BK virus
KGNWVRILYRSFSQ

SEQ ID NO: 42550 - protein, 14 aa, BK virus
GNWVRILYRSFSQA

SEQ ID NO: 42551 - protein, 14 aa, BK virus
NWVRILYRSFSQAD

SEQ ID NO: 42552 - protein, 14 aa, BK virus
WVRILYRSFSQADL

SEQ ID NO: 42553 - protein, 14 aa, BK virus
VRILYRSFSQADLK

SEQ ID NO: 42554 - protein, 14 aa, BK virus
RILYRSFSQADLKI

SEQ ID NO: 42555 - protein, 14 aa, BK virus
ILYRSFSQADLKIS

SEQ ID NO: 42556 - protein, 14 aa, BK virus
LYRSFSQADLKISC

SEQ ID NO: 42557 - protein, 14 aa, BK virus
YRSFSQADLKISCK

SEQ ID NO: 42558 - protein, 14 aa, BK virus
RSFSQADLKISCKA

SEQ ID NO: 42559 - protein, 14 aa, BK virus
SFSQADLKISCKAS

SEQ ID NO: 42560 - protein, 14 aa, BK virus
FSQADLKISCKASP

SEQ ID NO: 42561 - protein, 14 aa, BK virus
SQADLKISCKASPL

SEQ ID NO: 42562 - protein, 14 aa, BK virus
QADLKISCKASPLL

SEQ ID NO: 42563 - protein, 14 aa, BK virus
ADLKISCKASPLLC

SEQ ID NO: 42564 - protein, 14 aa, BK virus
DLKISCKASPLLCS

SEQ ID NO: 42565 - protein, 14 aa, BK virus
LKISCKASPLLCSR

SEQ ID NO: 42566 - protein, 14 aa, BK virus
KISCKASPLLCSRA

SEQ ID NO: 42567 - protein, 14 aa, BK virus
ISCKASPLLCSRAV

SEQ ID NO: 42568 - protein, 14 aa, BK virus
SCKASPLLCSRAVS

SEQ ID NO: 42569 - protein, 14 aa, BK virus
CKASPLLCSRAVSK

SEQ ID NO: 42570 - protein, 14 aa, BK virus
KASPLLCSRAVSKQ

SEQ ID NO: 42571 - protein, 14 aa, BK virus
ASPLLCSRAVSKQA

SEQ ID NO: 42572 - protein, 14 aa, BK virus
SPLLCSRAVSKQAT

SEQ ID NO: 42573 - protein, 14 aa, BK virus
PLLCSRAVSKQATN

SEQ ID NO: 42574 - protein, 14 aa, BK virus
LLCSRAVSKQATNI

SEQ ID NO: 42575 - protein, 14 aa, BK virus
LCSRAVSKQATNIS

SEQ ID NO: 42576 - protein, 14 aa, BK virus
CSRAVSKQATNISS

SEQ ID NO: 42577 - protein, 14 aa, BK virus
NIQAISFTKRPHTL

SEQ ID NO: 42578 - protein, 14 aa, BK virus
IQAISFTKRPHTLF

SEQ ID NO: 42579 - protein, 14 aa, BK virus
QAISFTKRPHTLFI

SEQ ID NO: 42580 - protein, 14 aa, BK virus
QHCGSCVGHMKYWG

SEQ ID NO: 42581 - protein, 14 aa, BK virus
HCGSCVGHMKYWGN

SEQ ID NO: 42582 - protein, 14 aa, BK virus
CGSCVGHMKYWGNI

SEQ ID NO: 42583 - protein, 14 aa, BK virus
GSCVGHMKYWGNIF

SEQ ID NO: 42584 - protein, 14 aa, BK virus
SCVGHMKYWGNIFP

SEQ ID NO: 42585 - protein, 14 aa, BK virus
CVGHMKYWGNIFPS

SEQ ID NO: 42586 - protein, 14 aa, BK virus
VGHMKYWGNIFPSC

SEQ ID NO: 42587 - protein, 14 aa, BK virus
GHMKYWGNIFPSCE

SEQ ID NO: 42588 - protein, 14 aa, BK virus
HMKYWGNIFPSCES

SEQ ID NO: 42589 - protein, 14 aa, BK virus
MKYWGNIFPSCESP

SEQ ID NO: 42590 - protein, 14 aa, BK virus
KYWGNIFPSCESPK

SEQ ID NO: 42591 - protein, 14 aa, BK virus
YWGNIFPSCESPKI

SEQ ID NO: 42592 - protein, 14 aa, BK virus
WGNIFPSCESPKIP

SEQ ID NO: 42593 - protein, 14 aa, BK virus
GNIFPSCESPKIPS

SEQ ID NO: 42594 - protein, 14 aa, BK virus
NIFPSCESPKIPSI

SEQ ID NO: 42595 - protein, 14 aa, BK virus
IFPSCESPKIPSIF

SEQ ID NO: 42596 - protein, 14 aa, BK virus
FPSCESPKIPSIFI

SEQ ID NO: 42597 - protein, 14 aa, BK virus
PSCESPKIPSIFIS

SEQ ID NO: 42598 - protein, 14 aa, BK virus
SCESPKIPSIFIST

SEQ ID NO: 42599 - protein, 14 aa, BK virus
CESPKIPSIFISTG

SEQ ID NO: 42600 - protein, 14 aa, BK virus
ESPKIPSIFISTGI

SEQ ID NO: 42601 - protein, 14 aa, BK virus
SPKIPSIFISTGIR

SEQ ID NO: 42602 - protein, 14 aa, BK virus
PKIPSIFISTGIRY

SEQ ID NO: 42603 - protein, 14 aa, BK virus
KIPSIFISTGIRYP

SEQ ID NO: 42604 - protein, 14 aa, BK virus
IPSIFISTGIRYPA

SEQ ID NO: 42605 - protein, 14 aa, BK virus
PSIFISTGIRYPAL

SEQ ID NO: 42606 - protein, 14 aa, BK virus
SIFISTGIRYPALN

SEQ ID NO: 42607 - protein, 14 aa, BK virus
IFISTGIRYPALNW

SEQ ID NO: 42608 - protein, 14 aa, BK virus
FISTGIRYPALNWI

SEQ ID NO: 42609 - protein, 14 aa, BK virus
ISTGIRYPALNWIS

SEQ ID NO: 42610 - protein, 14 aa, BK virus
STGIRYPALNWISI

SEQ ID NO: 42611 - protein, 14 aa, BK virus
TGIRYPALNWISIV

SEQ ID NO: 42612 - protein, 14 aa, BK virus
GIRYPALNWISIVF

SEQ ID NO: 42613 - protein, 14 aa, BK virus
IRYPALNWISIVFV

SEQ ID NO: 42614 - protein, 14 aa, BK virus
RYPALNWISIVFVQ

SEQ ID NO: 42615 - protein, 14 aa, BK virus
YPALNWISIVFVQI

SEQ ID NO: 42616 - protein, 14 aa, BK virus
PALNWISIVFVQIG

SEQ ID NO: 42617 - protein, 14 aa, BK virus
ALNWISIVFVQIGL

SEQ ID NO: 42618 - protein, 14 aa, BK virus
LNWISIVFVQIGLM

SEQ ID NO: 42619 - protein, 14 aa, BK virus
NWISIVFVQIGLMV

SEQ ID NO: 42620 - protein, 14 aa, BK virus
WISIVFVQIGLMVS

SEQ ID NO: 42621 - protein, 14 aa, BK virus
ISIVFVQIGLMVSI

SEQ ID NO: 42622 - protein, 14 aa, BK virus
SIVFVQIGLMVSIH

SEQ ID NO: 42623 - protein, 14 aa, BK virus
IVFVQIGLMVSIHY

SEQ ID NO: 42624 - protein, 14 aa, BK virus
VFVQIGLMVSIHYL

SEQ ID NO: 42625 - protein, 14 aa, BK virus
FVQIGLMVSIHYLG

SEQ ID NO: 42626 - protein, 14 aa, BK virus
VQIGLMVSIHYLGL

SEQ ID NO: 42627 - protein, 14 aa, BK virus
QIGLMVSIHYLGLG

SEQ ID NO: 42628 - protein, 14 aa, BK virus
IGLMVSIHYLGLGC

SEQ ID NO: 42629 - protein, 14 aa, BK virus
GLMVSIHYLGLGCW

SEQ ID NO: 42630 - protein, 14 aa, BK virus
LMVSIHYLGLGCWV

SEQ ID NO: 42631 - protein, 14 aa, BK virus
MVSIHYLGLGCWVF

SEQ ID NO: 42632 - protein, 14 aa, BK virus
VSIHYLGLGCWVFR

SEQ ID NO: 42633 - protein, 14 aa, BK virus
SIHYLGLGCWVFRG

SEQ ID NO: 42634 - protein, 14 aa, BK virus
IHYLGLGCWVFRGY

SEQ ID NO: 42635 - protein, 14 aa, BK virus
HYLGLGCWVFRGYS

SEQ ID NO: 42636 - protein, 14 aa, BK virus
YLGLGCWVFRGYST

SEQ ID NO: 42637 - protein, 14 aa, BK virus
LGLGCWVFRGYSTI

SEQ ID NO: 42638 - protein, 14 aa, BK virus
GLGCWVFRGYSTIR

SEQ ID NO: 42639 - protein, 14 aa, BK virus
LGCWVFRGYSTIRV

SEQ ID NO: 42640 - protein, 14 aa, BK virus
GCWVFRGYSTIRVL

SEQ ID NO: 42641 - protein, 14 aa, BK virus
HSLHFQGFSTYSKE

SEQ ID NO: 42642 - protein, 14 aa, BK virus
SLHFQGFSTYSKEV

SEQ ID NO: 42643 - protein, 14 aa, BK virus
LHFQGFSTYSKEVE

SEQ ID NO: 42644 - protein, 14 aa, BK virus
HFQGFSTYSKEVEI

SEQ ID NO: 42645 - protein, 14 aa, BK virus
FQGFSTYSKEVEIT

SEQ ID NO: 42646 - protein, 14 aa, BK virus
QGFSTYSKEVEITA

SEQ ID NO: 42647 - protein, 14 aa, BK virus
GFSTYSKEVEITAL

SEQ ID NO: 42648 - protein, 14 aa, BK virus
FSTYSKEVEITALN

SEQ ID NO: 42649 - protein, 14 aa, BK virus
STYSKEVEITALNR

SEQ ID NO: 42650 - protein, 14 aa, BK virus
TYSKEVEITALNRF

SEQ ID NO: 42651 - protein, 14 aa, BK virus
YSKEVEITALNRFS

SEQ ID NO: 42652 - protein, 14 aa, BK virus
SKEVEITALNRFSS

SEQ ID NO: 42653 - protein, 14 aa, BK virus
KEVEITALNRFSST

SEQ ID NO: 42654 - protein, 14 aa, BK virus
EVEITALNRFSSTM

SEQ ID NO: 42655 - protein, 14 aa, BK virus
VEITALNRFSSTML

SEQ ID NO: 42656 - protein, 14 aa, BK virus
EITALNRFSSTMLM

SEQ ID NO: 42657 - protein, 14 aa, BK virus
ITALNRFSSTMLMH

SEQ ID NO: 42658 - protein, 14 aa, BK virus
TALNRFSSTMLMHF

SEQ ID NO: 42659 - protein, 14 aa, BK virus
ALNRFSSTMLMHFL

SEQ ID NO: 42660 - protein, 14 aa, BK virus
PCMKVKHASYSNNL

SEQ ID NO: 42661 - protein, 14 aa, BK virus
CMKVKHASYSNNLC

SEQ ID NO: 42662 - protein, 14 aa, BK virus
MKVKHASYSNNLCL

SEQ ID NO: 42663 - protein, 14 aa, BK virus
KVKHASYSNNLCLY

SEQ ID NO: 42664 - protein, 14 aa, BK virus
VKHASYSNNLCLYS

SEQ ID NO: 42665 - protein, 14 aa, BK virus
KHASYSNNLCLYSY

SEQ ID NO: 42666 - protein, 14 aa, BK virus
HASYSNNLCLYSYS

SEQ ID NO: 42667 - protein, 14 aa, BK virus
ASYSNNLCLYSYSL

SEQ ID NO: 42668 - protein, 14 aa, BK virus
SYSNNLCLYSYSLP

SEQ ID NO: 42669 - protein, 14 aa, BK virus
YSNNLCLYSYSLPH

SEQ ID NO: 42670 - protein, 14 aa, BK virus
SNNLCLYSYSLPHQ

SEQ ID NO: 42671 - protein, 14 aa, BK virus
IGEGNSCCAVTGKH

SEQ ID NO: 42672 - protein, 14 aa, BK virus
GEGNSCCAVTGKHF

SEQ ID NO: 42673 - protein, 14 aa, BK virus
EGNSCCAVTGKHFS

SEQ ID NO: 42674 - protein, 14 aa, BK virus
GNSCCAVTGKHFSL

SEQ ID NO: 42675 - protein, 14 aa, BK virus
NSCCAVTGKHFSLW

SEQ ID NO: 42676 - protein, 14 aa, BK virus
SCCAVTGKHFSLWA

SEQ ID NO: 42677 - protein, 14 aa, BK virus
CCAVTGKHFSLWAI

SEQ ID NO: 42678 - protein, 14 aa, BK virus
CAVTGKHFSLWAIT

SEQ ID NO: 42679 - protein, 14 aa, BK virus
AVTGKHFSLWAITA

SEQ ID NO: 42680 - protein, 14 aa, BK virus
VTGKHFSLWAITAK

SEQ ID NO: 42681 - protein, 14 aa, BK virus
TGKHFSLWAITAKV

SEQ ID NO: 42682 - protein, 14 aa, BK virus
GKHFSLWAITAKVI

SEQ ID NO: 42683 - protein, 14 aa, BK virus
KHFSLWAITAKVIF

SEQ ID NO: 42684 - protein, 14 aa, BK virus
HFSLWAITAKVIFS

SEQ ID NO: 42685 - protein, 14 aa, BK virus
FSLWAITAKVIFST

SEQ ID NO: 42686 - protein, 14 aa, BK virus
TKAPKVFIWIPHFW

SEQ ID NO: 42687 - protein, 14 aa, BK virus
KAPKVFIWIPHFWV

SEQ ID NO: 42688 - protein, 14 aa, BK virus
EAFYLCNSIYPSFN

SEQ ID NO: 42689 - protein, 14 aa, BK virus
AFYLCNSIYPSFNF

SEQ ID NO: 42690 - protein, 14 aa, BK virus
FWHLHGFLWLFGSC

SEQ ID NO: 42691 - protein, 14 aa, BK virus
WHLHGFLWLFGSCP

SEQ ID NO: 42692 - protein, 14 aa, BK virus
HLHGFLWLFGSCPW

SEQ ID NO: 42693 - protein, 14 aa, BK virus
LHGFLWLFGSCPWT

SEQ ID NO: 42694 - protein, 14 aa, BK virus
HGFLWLFGSCPWTL

SEQ ID NO: 42695 - protein, 14 aa, BK virus
GFLWLFGSCPWTLS

SEQ ID NO: 42696 - protein, 14 aa, BK virus
FLWLFGSCPWTLSF

SEQ ID NO: 42697 - protein, 14 aa, BK virus
LWLFGSCPWTLSFS

SEQ ID NO: 42698 - protein, 14 aa, BK virus
WLFGSCPWTLSFSF

SEQ ID NO: 42699 - protein, 14 aa, BK virus
LFGSCPWTLSFSFG

SEQ ID NO: 42700 - protein, 14 aa, BK virus
FGSCPWTLSFSFGW

SEQ ID NO: 42701 - protein, 14 aa, BK virus
GSCPWTLSFSFGWG

SEQ ID NO: 42702 - protein, 14 aa, BK virus
SCPWTLSFSFGWGH

SEQ ID NO: 42703 - protein, 14 aa, BK virus
CPWTLSFSFGWGHL

SEQ ID NO: 42704 - protein, 14 aa, BK virus
PWTLSFSFGWGHLH

SEQ ID NO: 42705 - protein, 14 aa, BK virus
WTLSFSFGWGHLHM

SEQ ID NO: 42706 - protein, 14 aa, BK virus
TLSFSFGWGHLHML

SEQ ID NO: 42707 - protein, 14 aa, BK virus
LSFSFGWGHLHMLQ

SEQ ID NO: 42708 - protein, 14 aa, BK virus
SFSFGWGHLHMLQE

SEQ ID NO: 42709 - protein, 14 aa, BK virus
FSFGWGHLHMLQEQ

SEQ ID NO: 42710 - protein, 14 aa, BK virus
SFGWGHLHMLQEQV

SEQ ID NO: 42711 - protein, 14 aa, BK virus
FGWGHLHMLQEQVL

SEQ ID NO: 42712 - protein, 14 aa, BK virus
GWGHLHMLQEQVLQ

SEQ ID NO: 42713 - protein, 14 aa, BK virus
WGHLHMLQEQVLQS

SEQ ID NO: 42714 - protein, 14 aa, BK virus
GHLHMLQEQVLQSR

SEQ ID NO: 42715 - protein, 14 aa, BK virus
HLHMLQEQVLQSRT

SEQ ID NO: 42716 - protein, 14 aa, BK virus
LHMLQEQVLQSRTG

SEQ ID NO: 42717 - protein, 14 aa, BK virus
HMLQEQVLQSRTGL

SEQ ID NO: 42718 - protein, 14 aa, BK virus
MLQEQVLQSRTGLE

SEQ ID NO: 42719 - protein, 14 aa, BK virus
LQEQVLQSRTGLEV

SEQ ID NO: 42720 - protein, 14 aa, BK virus
QEQVLQSRTGLEVK

SEQ ID NO: 42721 - protein, 14 aa, BK virus
EQVLQSRTGLEVKA

SEQ ID NO: 42722 - protein, 14 aa, BK virus
QVLQSRTGLEVKAT

SEQ ID NO: 42723 - protein, 14 aa, BK virus
VLQSRTGLEVKATS

SEQ ID NO: 42724 - protein, 14 aa, BK virus
LQSRTGLEVKATSI

SEQ ID NO: 42725 - protein, 14 aa, BK virus
QSRTGLEVKATSIE

SEQ ID NO: 42726 - protein, 14 aa, BK virus
SRTGLEVKATSIEE

SEQ ID NO: 42727 - protein, 14 aa, BK virus
RTGLEVKATSIEEQ

SEQ ID NO: 42728 - protein, 14 aa, BK virus
TGLEVKATSIEEQF

SEQ ID NO: 42729 - protein, 14 aa, BK virus
GLEVKATSIEEQFF

SEQ ID NO: 42730 - protein, 14 aa, BK virus
LEVKATSIEEQFFD

SEQ ID NO: 42731 - protein, 14 aa, BK virus
TLLNVHFVDFLSPF

SEQ ID NO: 42732 - protein, 14 aa, BK virus
LLNVHFVDFLSPFF

SEQ ID NO: 42733 - protein, 14 aa, BK virus
LNVHFVDFLSPFFV

SEQ ID NO: 42734 - protein, 14 aa, BK virus
LLLYCQHHLYYKYG

SEQ ID NO: 42735 - protein, 14 aa, BK virus
LLYCQHHLYYKYGQ

SEQ ID NO: 42736 - protein, 14 aa, BK virus
LYCQHHLYYKYGQN

SEQ ID NO: 42737 - protein, 14 aa, BK virus
YCQHHLYYKYGQNV

SEQ ID NO: 42738 - protein, 14 aa, BK virus
CQHHLYYKYGQNVH

SEQ ID NO: 42739 - protein, 14 aa, BK virus
QHHLYYKYGQNVHG

SEQ ID NO: 42740 - protein, 14 aa, BK virus
HHLYYKYGQNVHGY

SEQ ID NO: 42741 - protein, 14 aa, BK virus
HLYYKYGQNVHGYL

SEQ ID NO: 42742 - protein, 14 aa, BK virus
LYYKYGQNVHGYLP

SEQ ID NO: 42743 - protein, 14 aa, BK virus
YYKYGQNVHGYLPF

SEQ ID NO: 42744 - protein, 14 aa, BK virus
YKYGQNVHGYLPFQ

SEQ ID NO: 42745 - protein, 14 aa, BK virus
KYGQNVHGYLPFQL

SEQ ID NO: 42746 - protein, 14 aa, BK virus
YGQNVHGYLPFQLL

SEQ ID NO: 42747 - protein, 14 aa, BK virus
GQNVHGYLPFQLLV

SEQ ID NO: 42748 - protein, 14 aa, BK virus
GKDQNNIVEYNYKS

SEQ ID NO: 42749 - protein, 14 aa, BK virus
KDQNNIVEYNYKSL

SEQ ID NO: 42750 - protein, 14 aa, BK virus
QKYLHQETEYHSTH

SEQ ID NO: 42751 - protein, 14 aa, BK virus
KYLHQETEYHSTHL

SEQ ID NO: 42752 - protein, 14 aa, BK virus
YLHQETEYHSTHLG

SEQ ID NO: 42753 - protein, 14 aa, BK virus
TIPKPCLIADRGLQ

SEQ ID NO: 42754 - protein, 14 aa, BK virus
IPKPCLIADRGLQW

SEQ ID NO: 42755 - protein, 14 aa, BK virus
PKPCLIADRGLQWK

SEQ ID NO: 42756 - protein, 14 aa, BK virus
KPCLIADRGLQWKL

SEQ ID NO: 42757 - protein, 14 aa, BK virus
PCLIADRGLQWKLC

SEQ ID NO: 42758 - protein, 14 aa, BK virus
CLIADRGLQWKLCD

SEQ ID NO: 42759 - protein, 14 aa, BK virus
LIADRGLQWKLCDP

SEQ ID NO: 42760 - protein, 14 aa, BK virus
IADRGLQWKLCDPN

SEQ ID NO: 42761 - protein, 14 aa, BK virus
ADRGLQWKLCDPNH

SEQ ID NO: 42762 - protein, 14 aa, BK virus
DRGLQWKLCDPNHQ

SEQ ID NO: 42763 - protein, 14 aa, BK virus
RGLQWKLCDPNHQR

SEQ ID NO: 42764 - protein, 14 aa, BK virus
GLQWKLCDPNHQRT

SEQ ID NO: 42765 - protein, 14 aa, BK virus
LQWKLCDPNHQRTY

SEQ ID NO: 42766 - protein, 14 aa, BK virus
QWKLCDPNHQRTYT

SEQ ID NO: 42767 - protein, 14 aa, BK virus
WKLCDPNHQRTYTL

SEQ ID NO: 42768 - protein, 14 aa, BK virus
KLCDPNHQRTYTLL

SEQ ID NO: 42769 - protein, 14 aa, BK virus
LCDPNHQRTYTLLE

SEQ ID NO: 42770 - protein, 14 aa, BK virus
CDPNHQRTYTLLEL

SEQ ID NO: 42771 - protein, 14 aa, BK virus
DPNHQRTYTLLELR

SEQ ID NO: 42772 - protein, 14 aa, BK virus
PNHQRTYTLLELRN

SEQ ID NO: 42773 - protein, 14 aa, BK virus
PQEHQQLQHMFEEL

SEQ ID NO: 42774 - protein, 14 aa, BK virus
QEHQQLQHMFEELG

SEQ ID NO: 42775 - protein, 14 aa, BK virus
EHQQLQHMFEELGL

SEQ ID NO: 42776 - protein, 14 aa, BK virus
QQQPPQQQFQPLKI

SEQ ID NO: 42777 - protein, 14 aa, BK virus
QQPPQQQFQPLKIL

SEQ ID NO: 42778 - protein, 14 aa, BK virus
QPPQQQFQPLKILW

SEQ ID NO: 42779 - protein, 14 aa, BK virus
PPQQQFQPLKILWQ

SEQ ID NO: 42780 - protein, 14 aa, BK virus
PQQQFQPLKILWQQ

SEQ ID NO: 42781 - protein, 14 aa, BK virus
QQQFQPLKILWQQQ

SEQ ID NO: 42782 - protein, 14 aa, BK virus
QQFQPLKILWQQQP

SEQ ID NO: 42783 - protein, 14 aa, BK virus
QFQPLKILWQQQPQ

SEQ ID NO: 42784 - protein, 14 aa, BK virus
FQPLKILWQQQPQI

SEQ ID NO: 42785 - protein, 14 aa, BK virus
QPLKILWQQQPQIH

SEQ ID NO: 42786 - protein, 14 aa, BK virus
PLKILWQQQPQIHW

SEQ ID NO: 42787 - protein, 14 aa, BK virus
LKILWQQQPQIHWQ

SEQ ID NO: 42788 - protein, 14 aa, BK virus
KILWQQQPQIHWQL

SEQ ID NO: 42789 - protein, 14 aa, BK virus
ILWQQQPQIHWQLG

SEQ ID NO: 42790 - protein, 14 aa, BK virus
LWQQQPQIHWQLGP

SEQ ID NO: 42791 - protein, 14 aa, BK virus
WQQQPQIHWQLGPP

SEQ ID NO: 42792 - protein, 14 aa, BK virus
QQQPQIHWQLGPPK

SEQ ID NO: 42793 - protein, 14 aa, BK virus
QQPQIHWQLGPPKV

SEQ ID NO: 42794 - protein, 14 aa, BK virus
QPQIHWQLGPPKVL

SEQ ID NO: 42795 - protein, 14 aa, BK virus
PQIHWQLGPPKVLE

SEQ ID NO: 42796 - protein, 14 aa, BK virus
QIHWQLGPPKVLEQ

SEQ ID NO: 42797 - protein, 14 aa, BK virus
IHWQLGPPKVLEQH

SEQ ID NO: 42798 - protein, 14 aa, BK virus
HWQLGPPKVLEQHP

SEQ ID NO: 42799 - protein, 14 aa, BK virus
TWKYKKKGITYLGV

SEQ ID NO: 42800 - protein, 14 aa, BK virus
WKYKKKGITYLGVF

SEQ ID NO: 42801 - protein, 14 aa, BK virus
KYKKKGITYLGVFY

SEQ ID NO: 42802 - protein, 14 aa, BK virus
YKKKGITYLGVFYR

SEQ ID NO: 42803 - protein, 14 aa, BK virus
KKKGITYLGVFYRV

SEQ ID NO: 42804 - protein, 14 aa, BK virus
KKGITYLGVFYRVF

SEQ ID NO: 42805 - protein, 14 aa, BK virus
KGITYLGVFYRVFY

SEQ ID NO: 42806 - protein, 14 aa, BK virus
GITYLGVFYRVFYS

SEQ ID NO: 42807 - protein, 14 aa, BK virus
ITYLGVFYRVFYSR

SEQ ID NO: 42808 - protein, 14 aa, BK virus
SSGTFVFPVYTVFT

SEQ ID NO: 42809 - protein, 14 aa, BK virus
SGTFVFPVYTVFTS

SEQ ID NO: 42810 - protein, 14 aa, BK virus
GTFVFPVYTVFTST

SEQ ID NO: 42811 - protein, 14 aa, BK virus
TFVFPVYTVFTSTK

SEQ ID NO: 42812 - protein, 14 aa, BK virus
FVFPVYTVFTSTKF

SEQ ID NO: 42813 - protein, 14 aa, BK virus
VFPVYTVFTSTKFQ

SEQ ID NO: 42814 - protein, 14 aa, BK virus
FPVYTVFTSTKFQQ

SEQ ID NO: 42815 - protein, 14 aa, BK virus
PVYTVFTSTKFQQK

SEQ ID NO: 42816 - protein, 14 aa, BK virus
VYTVFTSTKFQQKL

SEQ ID NO: 42817 - protein, 14 aa, BK virus
NKNKNPLSSFFCSS

SEQ ID NO: 42818 - protein, 14 aa, BK virus
KNKNPLSSFFCSSP

SEQ ID NO: 42819 - protein, 14 aa, BK virus
NKNPLSSFFCSSPG

SEQ ID NO: 42820 - protein, 14 aa, BK virus
KNPLSSFFCSSPGF

SEQ ID NO: 42821 - protein, 14 aa, BK virus
NPLSSFFCSSPGFT

SEQ ID NO: 42822 - protein, 14 aa, BK virus
PLSSFFCSSPGFTN

SEQ ID NO: 42823 - protein, 14 aa, BK virus
LSSFFCSSPGFTNF

SEQ ID NO: 42824 - protein, 14 aa, BK virus
SSFFCSSPGFTNFH

SEQ ID NO: 42825 - protein, 14 aa, BK virus
LGTRPRFLGSQNMS

SEQ ID NO: 42826 - protein, 14 aa, BK virus
GTRPRFLGSQNMSV

SEQ ID NO: 42827 - protein, 14 aa, BK virus
TRPRFLGSQNMSVM

SEQ ID NO: 42828 - protein, 14 aa, BK virus
RPRFLGSQNMSVMH

SEQ ID NO: 42829 - protein, 14 aa, BK virus
PRFLGSQNMSVMHF

SEQ ID NO: 42830 - protein, 14 aa, BK virus
RFLGSQNMSVMHFP

SEQ ID NO: 42831 - protein, 14 aa, BK virus
FLGSQNMSVMHFPS

SEQ ID NO: 42832 - protein, 14 aa, BK virus
AAPPCESCTFLPEV

SEQ ID NO: 42833 - protein, 14 aa, BK virus
APPCESCTFLPEVM

SEQ ID NO: 42834 - protein, 14 aa, BK virus
PPCESCTFLPEVMV

SEQ ID NO: 42835 - protein, 14 aa, BK virus
PCESCTFLPEVMVW

SEQ ID NO: 42836 - protein, 14 aa, BK virus
CESCTFLPEVMVWL

SEQ ID NO: 42837 - protein, 14 aa, BK virus
ESCTFLPEVMVWLH

SEQ ID NO: 42838 - protein, 14 aa, BK virus
SCTFLPEVMVWLHS

SEQ ID NO: 42839 - protein, 14 aa, BK virus
CTFLPEVMVWLHSP

SEQ ID NO: 42840 - protein, 14 aa, BK virus
TFLPEVMVWLHSPV

SEQ ID NO: 42841 - protein, 14 aa, BK virus
FLPEVMVWLHSPVS

SEQ ID NO: 42842 - protein, 14 aa, BK virus
LPEVMVWLHSPVSH

SEQ ID NO: 42843 - protein, 14 aa, BK virus
PEVMVWLHSPVSHA

SEQ ID NO: 42844 - protein, 14 aa, BK virus
EVMVWLHSPVSHAL

SEQ ID NO: 42845 - protein, 14 aa, BK virus
VMVWLHSPVSHALS

SEQ ID NO: 42846 - protein, 14 aa, BK virus
MVWLHSPVSHALSF

SEQ ID NO: 42847 - protein, 14 aa, BK virus
VWLHSPVSHALSFL

SEQ ID NO: 42848 - protein, 14 aa, BK virus
WLHSPVSHALSFLR

SEQ ID NO: 42849 - protein, 14 aa, BK virus
LHSPVSHALSFLRS

SEQ ID NO: 42850 - protein, 14 aa, BK virus
HSPVSHALSFLRSW

SEQ ID NO: 42851 - protein, 14 aa, BK virus
SPVSHALSFLRSWF

SEQ ID NO: 42852 - protein, 14 aa, BK virus
PVSHALSFLRSWFG

SEQ ID NO: 42853 - protein, 14 aa, BK virus
VSHALSFLRSWFGC

SEQ ID NO: 42854 - protein, 14 aa, BK virus
SHALSFLRSWFGCI

SEQ ID NO: 42855 - protein, 14 aa, BK virus
HALSFLRSWFGCIP

SEQ ID NO: 42856 - protein, 14 aa, BK virus
ALSFLRSWFGCIPW

SEQ ID NO: 42857 - protein, 14 aa, BK virus
LSFLRSWFGCIPWV

SEQ ID NO: 42858 - protein, 14 aa, BK virus
SFLRSWFGCIPWVS

SEQ ID NO: 42859 - protein, 14 aa, BK virus
FLRSWFGCIPWVSS

SEQ ID NO: 42860 - protein, 14 aa, BK virus
LRSWFGCIPWVSSS

SEQ ID NO: 42861 - protein, 14 aa, BK virus
RSWFGCIPWVSSSS

SEQ ID NO: 42862 - protein, 14 aa, BK virus
SWFGCIPWVSSSSL

SEQ ID NO: 42863 - protein, 14 aa, BK virus
WFGCIPWVSSSSLW

SEQ ID NO: 42864 - protein, 14 aa, BK virus
FGCIPWVSSSSLWP

SEQ ID NO: 42865 - protein, 14 aa, BK virus
GCIPWVSSSSLWPF

SEQ ID NO: 42866 - protein, 14 aa, BK virus
CIPWVSSSSLWPFF

SEQ ID NO: 42867 - protein, 14 aa, BK virus
IPWVSSSSLWPFFL

SEQ ID NO: 42868 - protein, 14 aa, BK virus
YIRGRGRLCLHPFS

SEQ ID NO: 42869 - protein, 14 aa, BK virus
IRGRGRLCLHPFSQ

SEQ ID NO: 42870 - protein, 14 aa, BK virus
RGRGRLCLHPFSQV

SEQ ID NO: 42871 - protein, 14 aa, BK virus
GRGRLCLHPFSQVV

SEQ ID NO: 42872 - protein, 14 aa, BK virus
RGRLCLHPFSQVVR

SEQ ID NO: 42873 - protein, 14 aa, BK virus
GRLCLHPFSQVVRV

SEQ ID NO: 42874 - protein, 14 aa, BK virus
RLCLHPFSQVVRVW

SEQ ID NO: 42875 - protein, 14 aa, BK virus
LCLHPFSQVVRVWR

SEQ ID NO: 42876 - protein, 14 aa, BK virus
CLHPFSQVVRVWRL

SEQ ID NO: 42877 - protein, 14 aa, BK virus
LHPFSQVVRVWRLF

SEQ ID NO: 42878 - protein, 14 aa, BK virus
HPFSQVVRVWRLFL

SEQ ID NO: 42879 - protein, 14 aa, BK virus
PFSQVVRVWRLFLR

SEQ ID NO: 42880 - protein, 14 aa, BK virus
FSQVVRVWRLFLRP

SEQ ID NO: 42881 - protein, 14 aa, BK virus
SQVVRVWRLFLRPS

SEQ ID NO: 42882 - protein, 14 aa, BK virus
QVVRVWRLFLRPSK

SEQ ID NO: 42883 - protein, 14 aa, BK virus
VVRVWRLFLRPSKT

SEQ ID NO: 42884 - protein, 14 aa, BK virus
VRVWRLFLRPSKTI

SEQ ID NO: 42885 - protein, 14 aa, BK virus
RVWRLFLRPSKTIW

SEQ ID NO: 42886 - protein, 14 aa, BK virus
VWRLFLRPSKTIWG

SEQ ID NO: 42887 - protein, 14 aa, BK virus
WRLFLRPSKTIWGN

SEQ ID NO: 42888 - protein, 14 aa, BK virus
RLFLRPSKTIWGNP

SEQ ID NO: 42889 - protein, 14 aa, BK virus
LFLRPSKTIWGNPY

SEQ ID NO: 42890 - protein, 14 aa, BK virus
FLRPSKTIWGNPYS

SEQ ID NO: 42891 - protein, 14 aa, BK virus
LRPSKTIWGNPYSF

SEQ ID NO: 42892 - protein, 14 aa, BK virus
RPSKTIWGNPYSFA

SEQ ID NO: 42893 - protein, 14 aa, BK virus
PSKTIWGNPYSFAI

SEQ ID NO: 42894 - protein, 14 aa, BK virus
SKTIWGNPYSFAIF

SEQ ID NO: 42895 - protein, 14 aa, BK virus
KTIWGNPYSFAIFA

SEQ ID NO: 42896 - protein, 14 aa, BK virus
TIWGNPYSFAIFAK

SEQ ID NO: 42897 - protein, 15 aa, BK virus
KSCLGKSSLNEKSLF

SEQ ID NO: 42898 - protein, 15 aa, BK virus
SCLGKSSLNEKSLFK

SEQ ID NO: 42899 - protein, 15 aa, BK virus
CLGKSSLNEKSLFKE

SEQ ID NO: 42900 - protein, 15 aa, BK virus
LGKSSLNEKSLFKEV

SEQ ID NO: 42901 - protein, 15 aa, BK virus
FSSLPRYPVLQGMAY

SEQ ID NO: 42902 - protein, 15 aa, BK virus
SSLPRYPVLQGMAYL

SEQ ID NO: 42903 - protein, 15 aa, BK virus
SLPRYPVLQGMAYLF

SEQ ID NO: 42904 - protein, 15 aa, BK virus
LPRYPVLQGMAYLFQ

SEQ ID NO: 42905 - protein, 15 aa, BK virus
PRYPVLQGMAYLFQK

SEQ ID NO: 42906 - protein, 15 aa, BK virus
RYPVLQGMAYLFQKA

SEQ ID NO: 42907 - protein, 15 aa, BK virus
YPVLQGMAYLFQKAF

SEQ ID NO: 42908 - protein, 15 aa, BK virus
PVLQGMAYLFQKAFC

SEQ ID NO: 42909 - protein, 15 aa, BK virus
VLQGMAYLFQKAFCA

SEQ ID NO: 42910 - protein, 15 aa, BK virus
LQGMAYLFQKAFCAL

SEQ ID NO: 42911 - protein, 15 aa, BK virus
QGMAYLFQKAFCALP

SEQ ID NO: 42912 - protein, 15 aa, BK virus
GMAYLFQKAFCALPL

SEQ ID NO: 42913 - protein, 15 aa, BK virus
MAYLFQKAFCALPLH

SEQ ID NO: 42914 - protein, 15 aa, BK virus
AYLFQKAFCALPLHA

SEQ ID NO: 42915 - protein, 15 aa, BK virus
YLFQKAFCALPLHAM

SEQ ID NO: 42916 - protein, 15 aa, BK virus
LFQKAFCALPLHAMS

SEQ ID NO: 42917 - protein, 15 aa, BK virus
FQKAFCALPLHAMSA

SEQ ID NO: 42918 - protein, 15 aa, BK virus
KIFKKRALGLDRLLL

SEQ ID NO: 42919 - protein, 15 aa, BK virus
IFKKRALGLDRLLLH

SEQ ID NO: 42920 - protein, 15 aa, BK virus
RNSAMVGPNNWRNSL

SEQ ID NO: 42921 - protein, 15 aa, BK virus
NSAMVGPNNWRNSLQ

SEQ ID NO: 42922 - protein, 15 aa, BK virus
SAMVGPNNWRNSLQR

SEQ ID NO: 42923 - protein, 15 aa, BK virus
AMVGPNNWRNSLQRS

SEQ ID NO: 42924 - protein, 15 aa, BK virus
MVGPNNWRNSLQRSK

SEQ ID NO: 42925 - protein, 15 aa, BK virus
VGPNNWRNSLQRSKA

SEQ ID NO: 42926 - protein, 15 aa, BK virus
GPNNWRNSLQRSKAL

SEQ ID NO: 42927 - protein, 15 aa, BK virus
PNNWRNSLQRSKALR

SEQ ID NO: 42928 - protein, 15 aa, BK virus
VPTYGTEEWESWWSS

SEQ ID NO: 42929 - protein, 15 aa, BK virus
PTYGTEEWESWWSSF

SEQ ID NO: 42930 - protein, 15 aa, BK virus
TYGTEEWESWWSSFN

SEQ ID NO: 42931 - protein, 15 aa, BK virus
YGTEEWESWWSSFNE

SEQ ID NO: 42932 - protein, 15 aa, BK virus
GTEEWESWWSSFNEK

SEQ ID NO: 42933 - protein, 15 aa, BK virus
TEEWESWWSSFNEKW

SEQ ID NO: 42934 - protein, 15 aa, BK virus
EEWESWWSSFNEKWD

SEQ ID NO: 42935 - protein, 15 aa, BK virus
EWESWWSSFNEKWDE

SEQ ID NO: 42936 - protein, 15 aa, BK virus
WESWWSSFNEKWDED

SEQ ID NO: 42937 - protein, 15 aa, BK virus
ESWWSSFNEKWDEDL

SEQ ID NO: 42938 - protein, 15 aa, BK virus
SWWSSFNEKWDEDLF

SEQ ID NO: 42939 - protein, 15 aa, BK virus
WWSSFNEKWDEDLFC

SEQ ID NO: 42940 - protein, 15 aa, BK virus
WSSFNEKWDEDLFCH

SEQ ID NO: 42941 - protein, 15 aa, BK virus
SSFNEKWDEDLFCHE

SEQ ID NO: 42942 - protein, 15 aa, BK virus
SFNEKWDEDLFCHED

SEQ ID NO: 42943 - protein, 15 aa, BK virus
FNEKWDEDLFCHEDM

SEQ ID NO: 42944 - protein, 15 aa, BK virus
NEKWDEDLFCHEDMF

SEQ ID NO: 42945 - protein, 15 aa, BK virus
EKWDEDLFCHEDMFA

SEQ ID NO: 42946 - protein, 15 aa, BK virus
KWDEDLFCHEDMFAS

SEQ ID NO: 42947 - protein, 15 aa, BK virus
WDEDLFCHEDMFASD

SEQ ID NO: 42948 - protein, 15 aa, BK virus
DEDLFCHEDMFASDE

SEQ ID NO: 42949 - protein, 15 aa, BK virus
EDLFCHEDMFASDEE

SEQ ID NO: 42950 - protein, 15 aa, BK virus
DLFCHEDMFASDEEA

SEQ ID NO: 42951 - protein, 15 aa, BK virus
LFCHEDMFASDEEAT

SEQ ID NO: 42952 - protein, 15 aa, BK virus
FCHEDMFASDEEATA

SEQ ID NO: 42953 - protein, 15 aa, BK virus
CHEDMFASDEEATAD

SEQ ID NO: 42954 - protein, 15 aa, BK virus
HEDMFASDEEATADS

SEQ ID NO: 42955 - protein, 15 aa, BK virus
EDMFASDEEATADSQ

SEQ ID NO: 42956 - protein, 15 aa, BK virus
DMFASDEEATADSQH

SEQ ID NO: 42957 - protein, 15 aa, BK virus
MFASDEEATADSQHS

SEQ ID NO: 42958 - protein, 15 aa, BK virus
FASDEEATADSQHST

SEQ ID NO: 42959 - protein, 15 aa, BK virus
ASDEEATADSQHSTP

SEQ ID NO: 42960 - protein, 15 aa, BK virus
SDEEATADSQHSTPP

SEQ ID NO: 42961 - protein, 15 aa, BK virus
DEEATADSQHSTPPK

SEQ ID NO: 42962 - protein, 15 aa, BK virus
EEATADSQHSTPPKK

SEQ ID NO: 42963 - protein, 15 aa, BK virus
EATADSQHSTPPKKK

SEQ ID NO: 42964 - protein, 15 aa, BK virus
ATADSQHSTPPKKKR

SEQ ID NO: 42965 - protein, 15 aa, BK virus
TADSQHSTPPKKKRK

SEQ ID NO: 42966 - protein, 15 aa, BK virus
ADSQHSTPPKKKRKV

SEQ ID NO: 42967 - protein, 15 aa, BK virus
DSQHSTPPKKKRKVE

SEQ ID NO: 42968 - protein, 15 aa, BK virus
SQHSTPPKKKRKVED

SEQ ID NO: 42969 - protein, 15 aa, BK virus
QHSTPPKKKRKVEDP

SEQ ID NO: 42970 - protein, 15 aa, BK virus
HSTPPKKKRKVEDPK

SEQ ID NO: 42971 - protein, 15 aa, BK virus
STPPKKKRKVEDPKD

SEQ ID NO: 42972 - protein, 15 aa, BK virus
TPPKKKRKVEDPKDF

SEQ ID NO: 42973 - protein, 15 aa, BK virus
PPKKKRKVEDPKDFP

SEQ ID NO: 42974 - protein, 15 aa, BK virus
PKKKRKVEDPKDFPS

SEQ ID NO: 42975 - protein, 15 aa, BK virus
KKKRKVEDPKDFPSD

SEQ ID NO: 42976 - protein, 15 aa, BK virus
KKRKVEDPKDFPSDL

SEQ ID NO: 42977 - protein, 15 aa, BK virus
KRKVEDPKDFPSDLH

SEQ ID NO: 42978 - protein, 15 aa, BK virus
RKVEDPKDFPSDLHQ

SEQ ID NO: 42979 - protein, 15 aa, BK virus
KVEDPKDFPSDLHQF

SEQ ID NO: 42980 - protein, 15 aa, BK virus
VEDPKDFPSDLHQFL

SEQ ID NO: 42981 - protein, 15 aa, BK virus
EDPKDFPSDLHQFLS

SEQ ID NO: 42982 - protein, 15 aa, BK virus
DPKDFPSDLHQFLSQ

SEQ ID NO: 42983 - protein, 15 aa, BK virus
PKDFPSDLHQFLSQA

SEQ ID NO: 42984 - protein, 15 aa, BK virus
KDFPSDLHQFLSQAV

SEQ ID NO: 42985 - protein, 15 aa, BK virus
DFPSDLHQFLSQAVF

SEQ ID NO: 42986 - protein, 15 aa, BK virus
FPSDLHQFLSQAVFS

SEQ ID NO: 42987 - protein, 15 aa, BK virus
PSDLHQFLSQAVFSN

SEQ ID NO: 42988 - protein, 15 aa, BK virus
SDLHQFLSQAVFSNR

SEQ ID NO: 42989 - protein, 15 aa, BK virus
DLHQFLSQAVFSNRT

SEQ ID NO: 42990 - protein, 15 aa, BK virus
LHQFLSQAVFSNRTL

SEQ ID NO: 42991 - protein, 15 aa, BK virus
HQFLSQAVFSNRTLA

SEQ ID NO: 42992 - protein, 15 aa, BK virus
QFLSQAVFSNRTLAC

SEQ ID NO: 42993 - protein, 15 aa, BK virus
FLSQAVFSNRTLACF

SEQ ID NO: 42994 - protein, 15 aa, BK virus
LSQAVFSNRTLACFA

SEQ ID NO: 42995 - protein, 15 aa, BK virus
SQAVFSNRTLACFAV

SEQ ID NO: 42996 - protein, 15 aa, BK virus
QAVFSNRTLACFAVY

SEQ ID NO: 42997 - protein, 15 aa, BK virus
AVFSNRTLACFAVYT

SEQ ID NO: 42998 - protein, 15 aa, BK virus
VFSNRTLACFAVYTT

SEQ ID NO: 42999 - protein, 15 aa, BK virus
FSNRTLACFAVYTTK

SEQ ID NO: 43000 - protein, 15 aa, BK virus
SNRTLACFAVYTTKE

SEQ ID NO: 43001 - protein, 15 aa, BK virus
NRTLACFAVYTTKEK

SEQ ID NO: 43002 - protein, 15 aa, BK virus
RTLACFAVYTTKEKA

SEQ ID NO: 43003 - protein, 15 aa, BK virus
TLACFAVYTTKEKAQ

SEQ ID NO: 43004 - protein, 15 aa, BK virus
LACFAVYTTKEKAQI

SEQ ID NO: 43005 - protein, 15 aa, BK virus
ACFAVYTTKEKAQIL

SEQ ID NO: 43006 - protein, 15 aa, BK virus
CFAVYTTKEKAQILY

SEQ ID NO: 43007 - protein, 15 aa, BK virus
FAVYTTKEKAQILYK

SEQ ID NO: 43008 - protein, 15 aa, BK virus
AVYTTKEKAQILYKK

SEQ ID NO: 43009 - protein, 15 aa, BK virus
VYTTKEKAQILYKKL

SEQ ID NO: 43010 - protein, 15 aa, BK virus
YTTKEKAQILYKKLM

SEQ ID NO: 43011 - protein, 15 aa, BK virus
TTKEKAQILYKKLME

SEQ ID NO: 43012 - protein, 15 aa, BK virus
TKEKAQILYKKLMEK

SEQ ID NO: 43013 - protein, 15 aa, BK virus
KEKAQILYKKLMEKY

SEQ ID NO: 43014 - protein, 15 aa, BK virus
EKAQILYKKLMEKYS

SEQ ID NO: 43015 - protein, 15 aa, BK virus
KAQILYKKLMEKYSV

SEQ ID NO: 43016 - protein, 15 aa, BK virus
AQILYKKLMEKYSVT

SEQ ID NO: 43017 - protein, 15 aa, BK virus
QILYKKLMEKYSVTF

SEQ ID NO: 43018 - protein, 15 aa, BK virus
ILYKKLMEKYSVTFI

SEQ ID NO: 43019 - protein, 15 aa, BK virus
LYKKLMEKYSVTFIS

SEQ ID NO: 43020 - protein, 15 aa, BK virus
YKKLMEKYSVTFISR

SEQ ID NO: 43021 - protein, 15 aa, BK virus
KKLMEKYSVTFISRH

SEQ ID NO: 43022 - protein, 15 aa, BK virus
KLMEKYSVTFISRHM

SEQ ID NO: 43023 - protein, 15 aa, BK virus
LMEKYSVTFISRHMC

SEQ ID NO: 43024 - protein, 15 aa, BK virus
MEKYSVTFISRHMCA

SEQ ID NO: 43025 - protein, 15 aa, BK virus
EKYSVTFISRHMCAG

SEQ ID NO: 43026 - protein, 15 aa, BK virus
KYSVTFISRHMCAGH

SEQ ID NO: 43027 - protein, 15 aa, BK virus
YSVTFISRHMCAGHN

SEQ ID NO: 43028 - protein, 15 aa, BK virus
SVTFISRHMCAGHNI

SEQ ID NO: 43029 - protein, 15 aa, BK virus
VTFISRHMCAGHNII

SEQ ID NO: 43030 - protein, 15 aa, BK virus
TFISRHMCAGHNIIF

SEQ ID NO: 43031 - protein, 15 aa, BK virus
FISRHMCAGHNIIFF

SEQ ID NO: 43032 - protein, 15 aa, BK virus
ISRHMCAGHNIIFFL

SEQ ID NO: 43033 - protein, 15 aa, BK virus
SRHMCAGHNIIFFLT

SEQ ID NO: 43034 - protein, 15 aa, BK virus
RHMCAGHNIIFFLTP

SEQ ID NO: 43035 - protein, 15 aa, BK virus
HMCAGHNIIFFLTPH

SEQ ID NO: 43036 - protein, 15 aa, BK virus
MCAGHNIIFFLTPHR

SEQ ID NO: 43037 - protein, 15 aa, BK virus
CAGHNIIFFLTPHRH

SEQ ID NO: 43038 - protein, 15 aa, BK virus
AGHNIIFFLTPHRHR

SEQ ID NO: 43039 - protein, 15 aa, BK virus
GHNIIFFLTPHRHRV

SEQ ID NO: 43040 - protein, 15 aa, BK virus
HNIIFFLTPHRHRVS

SEQ ID NO: 43041 - protein, 15 aa, BK virus
NIIFFLTPHRHRVSA

SEQ ID NO: 43042 - protein, 15 aa, BK virus
IIFFLTPHRHRVSAI

SEQ ID NO: 43043 - protein, 15 aa, BK virus
IFFLTPHRHRVSAIN

SEQ ID NO: 43044 - protein, 15 aa, BK virus
FFLTPHRHRVSAINN

SEQ ID NO: 43045 - protein, 15 aa, BK virus
FLTPHRHRVSAINNF

SEQ ID NO: 43046 - protein, 15 aa, BK virus
LTPHRHRVSAINNFC

SEQ ID NO: 43047 - protein, 15 aa, BK virus
TPHRHRVSAINNFCQ

SEQ ID NO: 43048 - protein, 15 aa, BK virus
PHRHRVSAINNFCQK

SEQ ID NO: 43049 - protein, 15 aa, BK virus
HRHRVSAINNFCQKL

SEQ ID NO: 43050 - protein, 15 aa, BK virus
RHRVSAINNFCQKLC

SEQ ID NO: 43051 - protein, 15 aa, BK virus
HRVSAINNFCQKLCT

SEQ ID NO: 43052 - protein, 15 aa, BK virus
RVSAINNFCQKLCTF

SEQ ID NO: 43053 - protein, 15 aa, BK virus
VSAINNFCQKLCTFS

SEQ ID NO: 43054 - protein, 15 aa, BK virus
SAINNFCQKLCTFSF

SEQ ID NO: 43055 - protein, 15 aa, BK virus
AINNFCQKLCTFSFL

SEQ ID NO: 43056 - protein, 15 aa, BK virus
INNFCQKLCTFSFLI

SEQ ID NO: 43057 - protein, 15 aa, BK virus
NNFCQKLCTFSFLIC

SEQ ID NO: 43058 - protein, 15 aa, BK virus
NFCQKLCTFSFLICK

SEQ ID NO: 43059 - protein, 15 aa, BK virus
FCQKLCTFSFLICKG

SEQ ID NO: 43060 - protein, 15 aa, BK virus
CQKLCTFSFLICKGV

SEQ ID NO: 43061 - protein, 15 aa, BK virus
QKLCTFSFLICKGVN

SEQ ID NO: 43062 - protein, 15 aa, BK virus
KLCTFSFLICKGVNK

SEQ ID NO: 43063 - protein, 15 aa, BK virus
LCTFSFLICKGVNKE

SEQ ID NO: 43064 - protein, 15 aa, BK virus
CTFSFLICKGVNKEY

SEQ ID NO: 43065 - protein, 15 aa, BK virus
TFSFLICKGVNKEYL

SEQ ID NO: 43066 - protein, 15 aa, BK virus
FSFLICKGVNKEYLL

SEQ ID NO: 43067 - protein, 15 aa, BK virus
SFLICKGVNKEYLLY

SEQ ID NO: 43068 - protein, 15 aa, BK virus
FLICKGVNKEYLLYS

SEQ ID NO: 43069 - protein, 15 aa, BK virus
LICKGVNKEYLLYSA

SEQ ID NO: 43070 - protein, 15 aa, BK virus
ICKGVNKEYLLYSAL

SEQ ID NO: 43071 - protein, 15 aa, BK virus
CKGVNKEYLLYSALT

SEQ ID NO: 43072 - protein, 15 aa, BK virus
KGVNKEYLLYSALTR

SEQ ID NO: 43073 - protein, 15 aa, BK virus
GVNKEYLLYSALTRD

SEQ ID NO: 43074 - protein, 15 aa, BK virus
VNKEYLLYSALTRDP

SEQ ID NO: 43075 - protein, 15 aa, BK virus
NKEYLLYSALTRDPY

SEQ ID NO: 43076 - protein, 15 aa, BK virus
KEYLLYSALTRDPYH

SEQ ID NO: 43077 - protein, 15 aa, BK virus
EYLLYSALTRDPYHT

SEQ ID NO: 43078 - protein, 15 aa, BK virus
YLLYSALTRDPYHTI

SEQ ID NO: 43079 - protein, 15 aa, BK virus
LLYSALTRDPYHTIE

SEQ ID NO: 43080 - protein, 15 aa, BK virus
LYSALTRDPYHTIEE

SEQ ID NO: 43081 - protein, 15 aa, BK virus
YSALTRDPYHTIEES

SEQ ID NO: 43082 - protein, 15 aa, BK virus
SALTRDPYHTIEESI

SEQ ID NO: 43083 - protein, 15 aa, BK virus
ALTRDPYHTIEESIQ

SEQ ID NO: 43084 - protein, 15 aa, BK virus
LTRDPYHTIEESIQG

SEQ ID NO: 43085 - protein, 15 aa, BK virus
TRDPYHTIEESIQGG

SEQ ID NO: 43086 - protein, 15 aa, BK virus
RDPYHTIEESIQGGL

SEQ ID NO: 43087 - protein, 15 aa, BK virus
DPYHTIEESIQGGLK

SEQ ID NO: 43088 - protein, 15 aa, BK virus
PYHTIEESIQGGLKE

SEQ ID NO: 43089 - protein, 15 aa, BK virus
YHTIEESIQGGLKEH

SEQ ID NO: 43090 - protein, 15 aa, BK virus
HTIEESIQGGLKEHD

SEQ ID NO: 43091 - protein, 15 aa, BK virus
TIEESIQGGLKEHDF

SEQ ID NO: 43092 - protein, 15 aa, BK virus
IEESIQGGLKEHDFS

SEQ ID NO: 43093 - protein, 15 aa, BK virus
EESIQGGLKEHDFSP

SEQ ID NO: 43094 - protein, 15 aa, BK virus
ESIQGGLKEHDFSPE

SEQ ID NO: 43095 - protein, 15 aa, BK virus
SIQGGLKEHDFSPEE

SEQ ID NO: 43096 - protein, 15 aa, BK virus
IQGGLKEHDFSPEEP

SEQ ID NO: 43097 - protein, 15 aa, BK virus
QGGLKEHDFSPEEPE

SEQ ID NO: 43098 - protein, 15 aa, BK virus
GGLKEHDFSPEEPEE

SEQ ID NO: 43099 - protein, 15 aa, BK virus
GLKEHDFSPEEPEET

SEQ ID NO: 43100 - protein, 15 aa, BK virus
LKEHDFSPEEPEETK

SEQ ID NO: 43101 - protein, 15 aa, BK virus
KEHDFSPEEPEETKQ

SEQ ID NO: 43102 - protein, 15 aa, BK virus
EHDFSPEEPEETKQV

SEQ ID NO: 43103 - protein, 15 aa, BK virus
HDFSPEEPEETKQVS

SEQ ID NO: 43104 - protein, 15 aa, BK virus
DFSPEEPEETKQVSW

SEQ ID NO: 43105 - protein, 15 aa, BK virus
FSPEEPEETKQVSWK

SEQ ID NO: 43106 - protein, 15 aa, BK virus
SPEEPEETKQVSWKL

SEQ ID NO: 43107 - protein, 15 aa, BK virus
PEEPEETKQVSWKLI

SEQ ID NO: 43108 - protein, 15 aa, BK virus
EEPEETKQVSWKLIT

SEQ ID NO: 43109 - protein, 15 aa, BK virus
EPEETKQVSWKLITE

SEQ ID NO: 43110 - protein, 15 aa, BK virus
PEETKQVSWKLITEY

SEQ ID NO: 43111 - protein, 15 aa, BK virus
EETKQVSWKLITEYA

SEQ ID NO: 43112 - protein, 15 aa, BK virus
ETKQVSWKLITEYAV

SEQ ID NO: 43113 - protein, 15 aa, BK virus
TKQVSWKLITEYAVE

SEQ ID NO: 43114 - protein, 15 aa, BK virus
KQVSWKLITEYAVET

SEQ ID NO: 43115 - protein, 15 aa, BK virus
QVSWKLITEYAVETK

SEQ ID NO: 43116 - protein, 15 aa, BK virus
VSWKLITEYAVETKC

SEQ ID NO: 43117 - protein, 15 aa, BK virus
SWKLITEYAVETKCE

SEQ ID NO: 43118 - protein, 15 aa, BK virus
WKLITEYAVETKCED

SEQ ID NO: 43119 - protein, 15 aa, BK virus
KLITEYAVETKCEDV

SEQ ID NO: 43120 - protein, 15 aa, BK virus
LITEYAVETKCEDVF

SEQ ID NO: 43121 - protein, 15 aa, BK virus
ITEYAVETKCEDVFL

SEQ ID NO: 43122 - protein, 15 aa, BK virus
TEYAVETKCEDVFLL

SEQ ID NO: 43123 - protein, 15 aa, BK virus
EYAVETKCEDVFLLL

SEQ ID NO: 43124 - protein, 15 aa, BK virus
YAVETKCEDVFLLLG

SEQ ID NO: 43125 - protein, 15 aa, BK virus
AVETKCEDVFLLLGM

SEQ ID NO: 43126 - protein, 15 aa, BK virus
VETKCEDVFLLLGMY

SEQ ID NO: 43127 - protein, 15 aa, BK virus
ETKCEDVFLLLGMYL

SEQ ID NO: 43128 - protein, 15 aa, BK virus
TKCEDVFLLLGMYLE

SEQ ID NO: 43129 - protein, 15 aa, BK virus
KCEDVFLLLGMYLEF

SEQ ID NO: 43130 - protein, 15 aa, BK virus
CEDVFLLLGMYLEFQ

SEQ ID NO: 43131 - protein, 15 aa, BK virus
EDVFLLLGMYLEFQY

SEQ ID NO: 43132 - protein, 15 aa, BK virus
DVFLLLGMYLEFQYN

SEQ ID NO: 43133 - protein, 15 aa, BK virus
VFLLLGMYLEFQYNV

SEQ ID NO: 43134 - protein, 15 aa, BK virus
FLLLGMYLEFQYNVE

SEQ ID NO: 43135 - protein, 15 aa, BK virus
LLLGMYLEFQYNVEE

SEQ ID NO: 43136 - protein, 15 aa, BK virus
LLGMYLEFQYNVEEC

SEQ ID NO: 43137 - protein, 15 aa, BK virus
LGMYLEFQYNVEECK

SEQ ID NO: 43138 - protein, 15 aa, BK virus
GMYLEFQYNVEECKK

SEQ ID NO: 43139 - protein, 15 aa, BK virus
MYLEFQYNVEECKKC

SEQ ID NO: 43140 - protein, 15 aa, BK virus
YLEFQYNVEECKKCQ

SEQ ID NO: 43141 - protein, 15 aa, BK virus
LEFQYNVEECKKCQK

SEQ ID NO: 43142 - protein, 15 aa, BK virus
EFQYNVEECKKCQKK

SEQ ID NO: 43143 - protein, 15 aa, BK virus
FQYNVEECKKCQKKD

SEQ ID NO: 43144 - protein, 15 aa, BK virus
QYNVEECKKCQKKDQ

SEQ ID NO: 43145 - protein, 15 aa, BK virus
YNVEECKKCQKKDQP

SEQ ID NO: 43146 - protein, 15 aa, BK virus
NVEECKKCQKKDQPY

SEQ ID NO: 43147 - protein, 15 aa, BK virus
VEECKKCQKKDQPYH

SEQ ID NO: 43148 - protein, 15 aa, BK virus
EECKKCQKKDQPYHF

SEQ ID NO: 43149 - protein, 15 aa, BK virus
ECKKCQKKDQPYHFK

SEQ ID NO: 43150 - protein, 15 aa, BK virus
CKKCQKKDQPYHFKY

SEQ ID NO: 43151 - protein, 15 aa, BK virus
KKCQKKDQPYHFKYH

SEQ ID NO: 43152 - protein, 15 aa, BK virus
KCQKKDQPYHFKYHE

SEQ ID NO: 43153 - protein, 15 aa, BK virus
CQKKDQPYHFKYHEK

SEQ ID NO: 43154 - protein, 15 aa, BK virus
QKKDQPYHFKYHEKH

SEQ ID NO: 43155 - protein, 15 aa, BK virus
KKDQPYHFKYHEKHF

SEQ ID NO: 43156 - protein, 15 aa, BK virus
KDQPYHFKYHEKHFA

SEQ ID NO: 43157 - protein, 15 aa, BK virus
DQPYHFKYHEKHFAN

SEQ ID NO: 43158 - protein, 15 aa, BK virus
QPYHFKYHEKHFANA

SEQ ID NO: 43159 - protein, 15 aa, BK virus
PYHFKYHEKHFANAI

SEQ ID NO: 43160 - protein, 15 aa, BK virus
YHFKYHEKHFANAII

SEQ ID NO: 43161 - protein, 15 aa, BK virus
HFKYHEKHFANAIIF

SEQ ID NO: 43162 - protein, 15 aa, BK virus
FKYHEKHFANAIIFA

SEQ ID NO: 43163 - protein, 15 aa, BK virus
KYHEKHFANAIIFAE

SEQ ID NO: 43164 - protein, 15 aa, BK virus
YHEKHFANAIIFAES

SEQ ID NO: 43165 - protein, 15 aa, BK virus
HEKHFANAIIFAESK

SEQ ID NO: 43166 - protein, 15 aa, BK virus
EKHFANAIIFAESKN

SEQ ID NO: 43167 - protein, 15 aa, BK virus
KHFANAIIFAESKNQ

SEQ ID NO: 43168 - protein, 15 aa, BK virus
HFANAIIFAESKNQK

SEQ ID NO: 43169 - protein, 15 aa, BK virus
FANAIIFAESKNQKS

SEQ ID NO: 43170 - protein, 15 aa, BK virus
ANAIIFAESKNQKSI

SEQ ID NO: 43171 - protein, 15 aa, BK virus
NAIIFAESKNQKSIC

SEQ ID NO: 43172 - protein, 15 aa, BK virus
AIIFAESKNQKSICQ

SEQ ID NO: 43173 - protein, 15 aa, BK virus
IIFAESKNQKSICQQ

SEQ ID NO: 43174 - protein, 15 aa, BK virus
IFAESKNQKSICQQA

SEQ ID NO: 43175 - protein, 15 aa, BK virus
FAESKNQKSICQQAV

SEQ ID NO: 43176 - protein, 15 aa, BK virus
AESKNQKSICQQAVD

SEQ ID NO: 43177 - protein, 15 aa, BK virus
ESKNQKSICQQAVDT

SEQ ID NO: 43178 - protein, 15 aa, BK virus
SKNQKSICQQAVDTV

SEQ ID NO: 43179 - protein, 15 aa, BK virus
KNQKSICQQAVDTVL

SEQ ID NO: 43180 - protein, 15 aa, BK virus
NQKSICQQAVDTVLA

SEQ ID NO: 43181 - protein, 15 aa, BK virus
QKSICQQAVDTVLAK

SEQ ID NO: 43182 - protein, 15 aa, BK virus
KSICQQAVDTVLAKK

SEQ ID NO: 43183 - protein, 15 aa, BK virus
SICQQAVDTVLAKKR

SEQ ID NO: 43184 - protein, 15 aa, BK virus
ICQQAVDTVLAKKRV

SEQ ID NO: 43185 - protein, 15 aa, BK virus
CQQAVDTVLAKKRVD

SEQ ID NO: 43186 - protein, 15 aa, BK virus
QQAVDTVLAKKRVDT

SEQ ID NO: 43187 - protein, 15 aa, BK virus
QAVDTVLAKKRVDTL

SEQ ID NO: 43188 - protein, 15 aa, BK virus
AVDTVLAKKRVDTLH

SEQ ID NO: 43189 - protein, 15 aa, BK virus
VDTVLAKKRVDTLHM

SEQ ID NO: 43190 - protein, 15 aa, BK virus
DTVLAKKRVDTLHMT

SEQ ID NO: 43191 - protein, 15 aa, BK virus
TVLAKKRVDTLHMTR

SEQ ID NO: 43192 - protein, 15 aa, BK virus
VLAKKRVDTLHMTRE

SEQ ID NO: 43193 - protein, 15 aa, BK virus
LAKKRVDTLHMTREE

SEQ ID NO: 43194 - protein, 15 aa, BK virus
AKKRVDTLHMTREEM

SEQ ID NO: 43195 - protein, 15 aa, BK virus
KKRVDTLHMTREEML

SEQ ID NO: 43196 - protein, 15 aa, BK virus
KRVDTLHMTREEMLT

SEQ ID NO: 43197 - protein, 15 aa, BK virus
RVDTLHMTREEMLTE

SEQ ID NO: 43198 - protein, 15 aa, BK virus
VDTLHMTREEMLTER

SEQ ID NO: 43199 - protein, 15 aa, BK virus
DTLHMTREEMLTERF

SEQ ID NO: 43200 - protein, 15 aa, BK virus
TLHMTREEMLTERFN

SEQ ID NO: 43201 - protein, 15 aa, BK virus
LHMTREEMLTERFNH

SEQ ID NO: 43202 - protein, 15 aa, BK virus
HMTREEMLTERFNHI

SEQ ID NO: 43203 - protein, 15 aa, BK virus
MTREEMLTERFNHIL

SEQ ID NO: 43204 - protein, 15 aa, BK virus
TREEMLTERFNHILD

SEQ ID NO: 43205 - protein, 15 aa, BK virus
REEMLTERFNHILDK

SEQ ID NO: 43206 - protein, 15 aa, BK virus
EEMLTERFNHILDKM

SEQ ID NO: 43207 - protein, 15 aa, BK virus
EMLTERFNHILDKMD

SEQ ID NO: 43208 - protein, 15 aa, BK virus
MLTERFNHILDKMDL

SEQ ID NO: 43209 - protein, 15 aa, BK virus
LTERFNHILDKMDLI

SEQ ID NO: 43210 - protein, 15 aa, BK virus
TERFNHILDKMDLIF

SEQ ID NO: 43211 - protein, 15 aa, BK virus
ERFNHILDKMDLIFG

SEQ ID NO: 43212 - protein, 15 aa, BK virus
RFNHILDKMDLIFGA

SEQ ID NO: 43213 - protein, 15 aa, BK virus
FNHILDKMDLIFGAH

SEQ ID NO: 43214 - protein, 15 aa, BK virus
NHILDKMDLIFGAHG

SEQ ID NO: 43215 - protein, 15 aa, BK virus
HILDKMDLIFGAHGN

SEQ ID NO: 43216 - protein, 15 aa, BK virus
ILDKMDLIFGAHGNA

SEQ ID NO: 43217 - protein, 15 aa, BK virus
LDKMDLIFGAHGNAV

SEQ ID NO: 43218 - protein, 15 aa, BK virus
DKMDLIFGAHGNAVL

SEQ ID NO: 43219 - protein, 15 aa, BK virus
KMDLIFGAHGNAVLE

SEQ ID NO: 43220 - protein, 15 aa, BK virus
MDLIFGAHGNAVLEQ

SEQ ID NO: 43221 - protein, 15 aa, BK virus
DLIFGAHGNAVLEQY

SEQ ID NO: 43222 - protein, 15 aa, BK virus
LIFGAHGNAVLEQYM

SEQ ID NO: 43223 - protein, 15 aa, BK virus
IFGAHGNAVLEQYMA

SEQ ID NO: 43224 - protein, 15 aa, BK virus
FGAHGNAVLEQYMAG

SEQ ID NO: 43225 - protein, 15 aa, BK virus
GAHGNAVLEQYMAGV

SEQ ID NO: 43226 - protein, 15 aa, BK virus
AHGNAVLEQYMAGVA

SEQ ID NO: 43227 - protein, 15 aa, BK virus
HGNAVLEQYMAGVAW

SEQ ID NO: 43228 - protein, 15 aa, BK virus
GNAVLEQYMAGVAWL

SEQ ID NO: 43229 - protein, 15 aa, BK virus
NAVLEQYMAGVAWLH

SEQ ID NO: 43230 - protein, 15 aa, BK virus
AVLEQYMAGVAWLHC

SEQ ID NO: 43231 - protein, 15 aa, BK virus
VLEQYMAGVAWLHCL

SEQ ID NO: 43232 - protein, 15 aa, BK virus
LEQYMAGVAWLHCLL

SEQ ID NO: 43233 - protein, 15 aa, BK virus
EQYMAGVAWLHCLLP

SEQ ID NO: 43234 - protein, 15 aa, BK virus
QYMAGVAWLHCLLPK

SEQ ID NO: 43235 - protein, 15 aa, BK virus
YMAGVAWLHCLLPKM

SEQ ID NO: 43236 - protein, 15 aa, BK virus
MAGVAWLHCLLPKMD

SEQ ID NO: 43237 - protein, 15 aa, BK virus
AGVAWLHCLLPKMDS

SEQ ID NO: 43238 - protein, 15 aa, BK virus
GVAWLHCLLPKMDSV

SEQ ID NO: 43239 - protein, 15 aa, BK virus
VAWLHCLLPKMDSVI

SEQ ID NO: 43240 - protein, 15 aa, BK virus
AWLHCLLPKMDSVIF

SEQ ID NO: 43241 - protein, 15 aa, BK virus
WLHCLLPKMDSVIFD

SEQ ID NO: 43242 - protein, 15 aa, BK virus
LHCLLPKMDSVIFDF

SEQ ID NO: 43243 - protein, 15 aa, BK virus
HCLLPKMDSVIFDFL

SEQ ID NO: 43244 - protein, 15 aa, BK virus
CLLPKMDSVIFDFLH

SEQ ID NO: 43245 - protein, 15 aa, BK virus
LLPKMDSVIFDFLHC

SEQ ID NO: 43246 - protein, 15 aa, BK virus
LPKMDSVIFDFLHCI

SEQ ID NO: 43247 - protein, 15 aa, BK virus
PKMDSVIFDFLHCIV

SEQ ID NO: 43248 - protein, 15 aa, BK virus
KMDSVIFDFLHCIVF

SEQ ID NO: 43249 - protein, 15 aa, BK virus
MDSVIFDFLHCIVFN

SEQ ID NO: 43250 - protein, 15 aa, BK virus
DSVIFDFLHCIVFNV

SEQ ID NO: 43251 - protein, 15 aa, BK virus
SVIFDFLHCIVFNVP

SEQ ID NO: 43252 - protein, 15 aa, BK virus
VIFDFLHCIVFNVPK

SEQ ID NO: 43253 - protein, 15 aa, BK virus
IFDFLHCIVFNVPKR

SEQ ID NO: 43254 - protein, 15 aa, BK virus
FDFLHCIVFNVPKRR

SEQ ID NO: 43255 - protein, 15 aa, BK virus
DFLHCIVFNVPKRRY

SEQ ID NO: 43256 - protein, 15 aa, BK virus
FLHCIVFNVPKRRYW

SEQ ID NO: 43257 - protein, 15 aa, BK virus
LHCIVFNVPKRRYWL

SEQ ID NO: 43258 - protein, 15 aa, BK virus
HCIVFNVPKRRYWLF

SEQ ID NO: 43259 - protein, 15 aa, BK virus
CIVFNVPKRRYWLFK

SEQ ID NO: 43260 - protein, 15 aa, BK virus
IVFNVPKRRYWLFKG

SEQ ID NO: 43261 - protein, 15 aa, BK virus
VFNVPKRRYWLFKGP

SEQ ID NO: 43262 - protein, 15 aa, BK virus
FNVPKRRYWLFKGPI

SEQ ID NO: 43263 - protein, 15 aa, BK virus
NVPKRRYWLFKGPID

SEQ ID NO: 43264 - protein, 15 aa, BK virus
VPKRRYWLFKGPIDS

SEQ ID NO: 43265 - protein, 15 aa, BK virus
PKRRYWLFKGPIDSG

SEQ ID NO: 43266 - protein, 15 aa, BK virus
KRRYWLFKGPIDSGK

SEQ ID NO: 43267 - protein, 15 aa, BK virus
RRYWLFKGPIDSGKT

SEQ ID NO: 43268 - protein, 15 aa, BK virus
RYWLFKGPIDSGKTT

SEQ ID NO: 43269 - protein, 15 aa, BK virus
YWLFKGPIDSGKTTL

SEQ ID NO: 43270 - protein, 15 aa, BK virus
WLFKGPIDSGKTTLA

SEQ ID NO: 43271 - protein, 15 aa, BK virus
LFKGPIDSGKTTLAA

SEQ ID NO: 43272 - protein, 15 aa, BK virus
FKGPIDSGKTTLAAG

SEQ ID NO: 43273 - protein, 15 aa, BK virus
KGPIDSGKTTLAAGL

SEQ ID NO: 43274 - protein, 15 aa, BK virus
GPIDSGKTTLAAGLL

SEQ ID NO: 43275 - protein, 15 aa, BK virus
PIDSGKTTLAAGLLD

SEQ ID NO: 43276 - protein, 15 aa, BK virus
IDSGKTTLAAGLLDL

SEQ ID NO: 43277 - protein, 15 aa, BK virus
DSGKTTLAAGLLDLC

SEQ ID NO: 43278 - protein, 15 aa, BK virus
SGKTTLAAGLLDLCG

SEQ ID NO: 43279 - protein, 15 aa, BK virus
GKTTLAAGLLDLCGG

SEQ ID NO: 43280 - protein, 15 aa, BK virus
KTTLAAGLLDLCGGK

SEQ ID NO: 43281 - protein, 15 aa, BK virus
TTLAAGLLDLCGGKA

SEQ ID NO: 43282 - protein, 15 aa, BK virus
TLAAGLLDLCGGKAL

SEQ ID NO: 43283 - protein, 15 aa, BK virus
LAAGLLDLCGGKALN

SEQ ID NO: 43284 - protein, 15 aa, BK virus
AAGLLDLCGGKALNV

SEQ ID NO: 43285 - protein, 15 aa, BK virus
AGLLDLCGGKALNVN

SEQ ID NO: 43286 - protein, 15 aa, BK virus
GLLDLCGGKALNVNL

SEQ ID NO: 43287 - protein, 15 aa, BK virus
LLDLCGGKALNVNLP

SEQ ID NO: 43288 - protein, 15 aa, BK virus
LDLCGGKALNVNLPM

SEQ ID NO: 43289 - protein, 15 aa, BK virus
DLCGGKALNVNLPME

SEQ ID NO: 43290 - protein, 15 aa, BK virus
LCGGKALNVNLPMER

SEQ ID NO: 43291 - protein, 15 aa, BK virus
CGGKALNVNLPMERL

SEQ ID NO: 43292 - protein, 15 aa, BK virus
GGKALNVNLPMERLT

SEQ ID NO: 43293 - protein, 15 aa, BK virus
GKALNVNLPMERLTF

SEQ ID NO: 43294 - protein, 15 aa, BK virus
KALNVNLPMERLTFE

SEQ ID NO: 43295 - protein, 15 aa, BK virus
ALNVNLPMERLTFEL

SEQ ID NO: 43296 - protein, 15 aa, BK virus
LNVNLPMERLTFELG

SEQ ID NO: 43297 - protein, 15 aa, BK virus
NVNLPMERLTFELGV

SEQ ID NO: 43298 - protein, 15 aa, BK virus
VNLPMERLTFELGVA

SEQ ID NO: 43299 - protein, 15 aa, BK virus
NLPMERLTFELGVAI

SEQ ID NO: 43300 - protein, 15 aa, BK virus
LPMERLTFELGVAID

SEQ ID NO: 43301 - protein, 15 aa, BK virus
PMERLTFELGVAIDQ

SEQ ID NO: 43302 - protein, 15 aa, BK virus
MERLTFELGVAIDQY

SEQ ID NO: 43303 - protein, 15 aa, BK virus
ERLTFELGVAIDQYM

SEQ ID NO: 43304 - protein, 15 aa, BK virus
RLTFELGVAIDQYMV

SEQ ID NO: 43305 - protein, 15 aa, BK virus
LTFELGVAIDQYMVV

SEQ ID NO: 43306 - protein, 15 aa, BK virus
TFELGVAIDQYMVVF

SEQ ID NO: 43307 - protein, 15 aa, BK virus
FELGVAIDQYMVVFE

SEQ ID NO: 43308 - protein, 15 aa, BK virus
ELGVAIDQYMVVFED

SEQ ID NO: 43309 - protein, 15 aa, BK virus
LGVAIDQYMVVFEDV

SEQ ID NO: 43310 - protein, 15 aa, BK virus
GVAIDQYMVVFEDVK

SEQ ID NO: 43311 - protein, 15 aa, BK virus
VAIDQYMVVFEDVKG

SEQ ID NO: 43312 - protein, 15 aa, BK virus
AIDQYMVVFEDVKGT

SEQ ID NO: 43313 - protein, 15 aa, BK virus
IDQYMVVFEDVKGTG

SEQ ID NO: 43314 - protein, 15 aa, BK virus
DQYMVVFEDVKGTGA

SEQ ID NO: 43315 - protein, 15 aa, BK virus
QYMVVFEDVKGTGAE

SEQ ID NO: 43316 - protein, 15 aa, BK virus
YMVVFEDVKGTGAES

SEQ ID NO: 43317 - protein, 15 aa, BK virus
MVVFEDVKGTGAESK

SEQ ID NO: 43318 - protein, 15 aa, BK virus
VVFEDVKGTGAESKD

SEQ ID NO: 43319 - protein, 15 aa, BK virus
VFEDVKGTGAESKDL

SEQ ID NO: 43320 - protein, 15 aa, BK virus
FEDVKGTGAESKDLP

SEQ ID NO: 43321 - protein, 15 aa, BK virus
EDVKGTGAESKDLPS

SEQ ID NO: 43322 - protein, 15 aa, BK virus
DVKGTGAESKDLPSG

SEQ ID NO: 43323 - protein, 15 aa, BK virus
VKGTGAESKDLPSGH

SEQ ID NO: 43324 - protein, 15 aa, BK virus
KGTGAESKDLPSGHG

SEQ ID NO: 43325 - protein, 15 aa, BK virus
GTGAESKDLPSGHGI

SEQ ID NO: 43326 - protein, 15 aa, BK virus
TGAESKDLPSGHGIN

SEQ ID NO: 43327 - protein, 15 aa, BK virus
GAESKDLPSGHGINN

SEQ ID NO: 43328 - protein, 15 aa, BK virus
AESKDLPSGHGINNL

SEQ ID NO: 43329 - protein, 15 aa, BK virus
ESKDLPSGHGINNLD

SEQ ID NO: 43330 - protein, 15 aa, BK virus
SKDLPSGHGINNLDS

SEQ ID NO: 43331 - protein, 15 aa, BK virus
KDLPSGHGINNLDSL

SEQ ID NO: 43332 - protein, 15 aa, BK virus
DLPSGHGINNLDSLR

SEQ ID NO: 43333 - protein, 15 aa, BK virus
LPSGHGINNLDSLRD

SEQ ID NO: 43334 - protein, 15 aa, BK virus
PSGHGINNLDSLRDY

SEQ ID NO: 43335 - protein, 15 aa, BK virus
SGHGINNLDSLRDYL

SEQ ID NO: 43336 - protein, 15 aa, BK virus
GHGINNLDSLRDYLD

SEQ ID NO: 43337 - protein, 15 aa, BK virus
HGINNLDSLRDYLDG

SEQ ID NO: 43338 - protein, 15 aa, BK virus
GINNLDSLRDYLDGS

SEQ ID NO: 43339 - protein, 15 aa, BK virus
INNLDSLRDYLDGSV

SEQ ID NO: 43340 - protein, 15 aa, BK virus
NNLDSLRDYLDGSVK

SEQ ID NO: 43341 - protein, 15 aa, BK virus
NLDSLRDYLDGSVKV

SEQ ID NO: 43342 - protein, 15 aa, BK virus
LDSLRDYLDGSVKVN

SEQ ID NO: 43343 - protein, 15 aa, BK virus
DSLRDYLDGSVKVNL

SEQ ID NO: 43344 - protein, 15 aa, BK virus
SLRDYLDGSVKVNLE

SEQ ID NO: 43345 - protein, 15 aa, BK virus
LRDYLDGSVKVNLEK

SEQ ID NO: 43346 - protein, 15 aa, BK virus
RDYLDGSVKVNLEKK

SEQ ID NO: 43347 - protein, 15 aa, BK virus
DYLDGSVKVNLEKKH

SEQ ID NO: 43348 - protein, 15 aa, BK virus
YLDGSVKVNLEKKHL

SEQ ID NO: 43349 - protein, 15 aa, BK virus
LDGSVKVNLEKKHLN

SEQ ID NO: 43350 - protein, 15 aa, BK virus
DGSVKVNLEKKHLNK

SEQ ID NO: 43351 - protein, 15 aa, BK virus
GSVKVNLEKKHLNKR

SEQ ID NO: 43352 - protein, 15 aa, BK virus
SVKVNLEKKHLNKRT

SEQ ID NO: 43353 - protein, 15 aa, BK virus
VKVNLEKKHLNKRTQ

SEQ ID NO: 43354 - protein, 15 aa, BK virus
KVNLEKKHLNKRTQI

SEQ ID NO: 43355 - protein, 15 aa, BK virus
VNLEKKHLNKRTQIF

SEQ ID NO: 43356 - protein, 15 aa, BK virus
NLEKKHLNKRTQIFP

SEQ ID NO: 43357 - protein, 15 aa, BK virus
LEKKHLNKRTQIFPP

SEQ ID NO: 43358 - protein, 15 aa, BK virus
EKKHLNKRTQIFPPG

SEQ ID NO: 43359 - protein, 15 aa, BK virus
KKHLNKRTQIFPPGL

SEQ ID NO: 43360 - protein, 15 aa, BK virus
KHLNKRTQIFPPGLV

SEQ ID NO: 43361 - protein, 15 aa, BK virus
HLNKRTQIFPPGLVT

SEQ ID NO: 43362 - protein, 15 aa, BK virus
LNKRTQIFPPGLVTM

SEQ ID NO: 43363 - protein, 15 aa, BK virus
NKRTQIFPPGLVTMN

SEQ ID NO: 43364 - protein, 15 aa, BK virus
KRTQIFPPGLVTMNE

SEQ ID NO: 43365 - protein, 15 aa, BK virus
RTQIFPPGLVTMNEY

SEQ ID NO: 43366 - protein, 15 aa, BK virus
TQIFPPGLVTMNEYP

SEQ ID NO: 43367 - protein, 15 aa, BK virus
QIFPPGLVTMNEYPV

SEQ ID NO: 43368 - protein, 15 aa, BK virus
IFPPGLVTMNEYPVP

SEQ ID NO: 43369 - protein, 15 aa, BK virus
FPPGLVTMNEYPVPK

SEQ ID NO: 43370 - protein, 15 aa, BK virus
PPGLVTMNEYPVPKT

SEQ ID NO: 43371 - protein, 15 aa, BK virus
PGLVTMNEYPVPKTL

SEQ ID NO: 43372 - protein, 15 aa, BK virus
GLVTMNEYPVPKTLQ

SEQ ID NO: 43373 - protein, 15 aa, BK virus
LVTMNEYPVPKTLQA

SEQ ID NO: 43374 - protein, 15 aa, BK virus
VTMNEYPVPKTLQAR

SEQ ID NO: 43375 - protein, 15 aa, BK virus
TMNEYPVPKTLQARF

SEQ ID NO: 43376 - protein, 15 aa, BK virus
MNEYPVPKTLQARFV

SEQ ID NO: 43377 - protein, 15 aa, BK virus
NEYPVPKTLQARFVR

SEQ ID NO: 43378 - protein, 15 aa, BK virus
EYPVPKTLQARFVRQ

SEQ ID NO: 43379 - protein, 15 aa, BK virus
YPVPKTLQARFVRQI

SEQ ID NO: 43380 - protein, 15 aa, BK virus
PVPKTLQARFVRQID

SEQ ID NO: 43381 - protein, 15 aa, BK virus
VPKTLQARFVRQIDF

SEQ ID NO: 43382 - protein, 15 aa, BK virus
PKTLQARFVRQIDFR

SEQ ID NO: 43383 - protein, 15 aa, BK virus
KTLQARFVRQIDFRP

SEQ ID NO: 43384 - protein, 15 aa, BK virus
TLQARFVRQIDFRPK

SEQ ID NO: 43385 - protein, 15 aa, BK virus
LQARFVRQIDFRPKI

SEQ ID NO: 43386 - protein, 15 aa, BK virus
QARFVRQIDFRPKIY

SEQ ID NO: 43387 - protein, 15 aa, BK virus
ARFVRQIDFRPKIYL

SEQ ID NO: 43388 - protein, 15 aa, BK virus
RFVRQIDFRPKIYLR

SEQ ID NO: 43389 - protein, 15 aa, BK virus
FVRQIDFRPKIYLRK

SEQ ID NO: 43390 - protein, 15 aa, BK virus
VRQIDFRPKIYLRKS

SEQ ID NO: 43391 - protein, 15 aa, BK virus
RQIDFRPKIYLRKSL

SEQ ID NO: 43392 - protein, 15 aa, BK virus
QIDFRPKIYLRKSLQ

SEQ ID NO: 43393 - protein, 15 aa, BK virus
IDFRPKIYLRKSLQN

SEQ ID NO: 43394 - protein, 15 aa, BK virus
DFRPKIYLRKSLQNS

SEQ ID NO: 43395 - protein, 15 aa, BK virus
FRPKIYLRKSLQNSE

SEQ ID NO: 43396 - protein, 15 aa, BK virus
RPKIYLRKSLQNSEF

SEQ ID NO: 43397 - protein, 15 aa, BK virus
PKIYLRKSLQNSEFL

SEQ ID NO: 43398 - protein, 15 aa, BK virus
KIYLRKSLQNSEFLL

SEQ ID NO: 43399 - protein, 15 aa, BK virus
IYLRKSLQNSEFLLE

SEQ ID NO: 43400 - protein, 15 aa, BK virus
YLRKSLQNSEFLLEK

SEQ ID NO: 43401 - protein, 15 aa, BK virus
LRKSLQNSEFLLEKR

SEQ ID NO: 43402 - protein, 15 aa, BK virus
RKSLQNSEFLLEKRI

SEQ ID NO: 43403 - protein, 15 aa, BK virus
KSLQNSEFLLEKRIL

SEQ ID NO: 43404 - protein, 15 aa, BK virus
SLQNSEFLLEKRILQ

SEQ ID NO: 43405 - protein, 15 aa, BK virus
LQNSEFLLEKRILQS

SEQ ID NO: 43406 - protein, 15 aa, BK virus
QNSEFLLEKRILQSG

SEQ ID NO: 43407 - protein, 15 aa, BK virus
NSEFLLEKRILQSGM

SEQ ID NO: 43408 - protein, 15 aa, BK virus
SEFLLEKRILQSGMT

SEQ ID NO: 43409 - protein, 15 aa, BK virus
EFLLEKRILQSGMTL

SEQ ID NO: 43410 - protein, 15 aa, BK virus
FLLEKRILQSGMTLL

SEQ ID NO: 43411 - protein, 15 aa, BK virus
LLEKRILQSGMTLLL

SEQ ID NO: 43412 - protein, 15 aa, BK virus
LEKRILQSGMTLLLL

SEQ ID NO: 43413 - protein, 15 aa, BK virus
EKRILQSGMTLLLLL

SEQ ID NO: 43414 - protein, 15 aa, BK virus
KRILQSGMTLLLLLI

SEQ ID NO: 43415 - protein, 15 aa, BK virus
RILQSGMTLLLLLIW

SEQ ID NO: 43416 - protein, 15 aa, BK virus
ILQSGMTLLLLLIWF

SEQ ID NO: 43417 - protein, 15 aa, BK virus
LQSGMTLLLLLIWFR

SEQ ID NO: 43418 - protein, 15 aa, BK virus
QSGMTLLLLLIWFRP

SEQ ID NO: 43419 - protein, 15 aa, BK virus
SGMTLLLLLIWFRPV

SEQ ID NO: 43420 - protein, 15 aa, BK virus
GMTLLLLLIWFRPVA

SEQ ID NO: 43421 - protein, 15 aa, BK virus
MTLLLLLIWFRPVAD

SEQ ID NO: 43422 - protein, 15 aa, BK virus
TLLLLLIWFRPVADF

SEQ ID NO: 43423 - protein, 15 aa, BK virus
LLLLLIWFRPVADFA

SEQ ID NO: 43424 - protein, 15 aa, BK virus
LLLLIWFRPVADFAT

SEQ ID NO: 43425 - protein, 15 aa, BK virus
LLLIWFRPVADFATD

SEQ ID NO: 43426 - protein, 15 aa, BK virus
LLIWFRPVADFATDI

SEQ ID NO: 43427 - protein, 15 aa, BK virus
LIWFRPVADFATDIQ

SEQ ID NO: 43428 - protein, 15 aa, BK virus
IWFRPVADFATDIQS

SEQ ID NO: 43429 - protein, 15 aa, BK virus
WFRPVADFATDIQSR

SEQ ID NO: 43430 - protein, 15 aa, BK virus
FRPVADFATDIQSRI

SEQ ID NO: 43431 - protein, 15 aa, BK virus
RPVADFATDIQSRIV

SEQ ID NO: 43432 - protein, 15 aa, BK virus
PVADFATDIQSRIVE

SEQ ID NO: 43433 - protein, 15 aa, BK virus
VADFATDIQSRIVEW

SEQ ID NO: 43434 - protein, 15 aa, BK virus
ADFATDIQSRIVEWK

SEQ ID NO: 43435 - protein, 15 aa, BK virus
DFATDIQSRIVEWKE

SEQ ID NO: 43436 - protein, 15 aa, BK virus
FATDIQSRIVEWKER

SEQ ID NO: 43437 - protein, 15 aa, BK virus
ATDIQSRIVEWKERL

SEQ ID NO: 43438 - protein, 15 aa, BK virus
TDIQSRIVEWKERLD

SEQ ID NO: 43439 - protein, 15 aa, BK virus
DIQSRIVEWKERLDS

SEQ ID NO: 43440 - protein, 15 aa, BK virus
IQSRIVEWKERLDSE

SEQ ID NO: 43441 - protein, 15 aa, BK virus
QSRIVEWKERLDSEI

SEQ ID NO: 43442 - protein, 15 aa, BK virus
SRIVEWKERLDSEIS

SEQ ID NO: 43443 - protein, 15 aa, BK virus
RIVEWKERLDSEISM

SEQ ID NO: 43444 - protein, 15 aa, BK virus
IVEWKERLDSEISMY

SEQ ID NO: 43445 - protein, 15 aa, BK virus
VEWKERLDSEISMYT

SEQ ID NO: 43446 - protein, 15 aa, BK virus
EWKERLDSEISMYTF

SEQ ID NO: 43447 - protein, 15 aa, BK virus
WKERLDSEISMYTFS

SEQ ID NO: 43448 - protein, 15 aa, BK virus
KERLDSEISMYTFSR

SEQ ID NO: 43449 - protein, 15 aa, BK virus
ERLDSEISMYTFSRM

SEQ ID NO: 43450 - protein, 15 aa, BK virus
RLDSEISMYTFSRMK

SEQ ID NO: 43451 - protein, 15 aa, BK virus
LDSEISMYTFSRMKY

SEQ ID NO: 43452 - protein, 15 aa, BK virus
DSEISMYTFSRMKYN

SEQ ID NO: 43453 - protein, 15 aa, BK virus
SEISMYTFSRMKYNI

SEQ ID NO: 43454 - protein, 15 aa, BK virus
EISMYTFSRMKYNIC

SEQ ID NO: 43455 - protein, 15 aa, BK virus
ISMYTFSRMKYNICM

SEQ ID NO: 43456 - protein, 15 aa, BK virus
SMYTFSRMKYNICMG

SEQ ID NO: 43457 - protein, 15 aa, BK virus
MYTFSRMKYNICMGK

SEQ ID NO: 43458 - protein, 15 aa, BK virus
YTFSRMKYNICMGKC

SEQ ID NO: 43459 - protein, 15 aa, BK virus
TFSRMKYNICMGKCI

SEQ ID NO: 43460 - protein, 15 aa, BK virus
FSRMKYNICMGKCIL

SEQ ID NO: 43461 - protein, 15 aa, BK virus
SRMKYNICMGKCILD

SEQ ID NO: 43462 - protein, 15 aa, BK virus
RMKYNICMGKCILDI

SEQ ID NO: 43463 - protein, 15 aa, BK virus
MKYNICMGKCILDIT

SEQ ID NO: 43464 - protein, 15 aa, BK virus
KYNICMGKCILDITR

SEQ ID NO: 43465 - protein, 15 aa, BK virus
YNICMGKCILDITRE

SEQ ID NO: 43466 - protein, 15 aa, BK virus
NICMGKCILDITREE

SEQ ID NO: 43467 - protein, 15 aa, BK virus
ICMGKCILDITREED

SEQ ID NO: 43468 - protein, 15 aa, BK virus
CMGKCILDITREEDS

SEQ ID NO: 43469 - protein, 15 aa, BK virus
MGKCILDITREEDSE

SEQ ID NO: 43470 - protein, 15 aa, BK virus
GKCILDITREEDSET

SEQ ID NO: 43471 - protein, 15 aa, BK virus
KCILDITREEDSETE

SEQ ID NO: 43472 - protein, 15 aa, BK virus
CILDITREEDSETED

SEQ ID NO: 43473 - protein, 15 aa, BK virus
ILDITREEDSETEDS

SEQ ID NO: 43474 - protein, 15 aa, BK virus
LDITREEDSETEDSG

SEQ ID NO: 43475 - protein, 15 aa, BK virus
DITREEDSETEDSGH

SEQ ID NO: 43476 - protein, 15 aa, BK virus
ITREEDSETEDSGHG

SEQ ID NO: 43477 - protein, 15 aa, BK virus
TREEDSETEDSGHGS

SEQ ID NO: 43478 - protein, 15 aa, BK virus
REEDSETEDSGHGSS

SEQ ID NO: 43479 - protein, 15 aa, BK virus
EEDSETEDSGHGSST

SEQ ID NO: 43480 - protein, 15 aa, BK virus
EDSETEDSGHGSSTE

SEQ ID NO: 43481 - protein, 15 aa, BK virus
DSETEDSGHGSSTES

SEQ ID NO: 43482 - protein, 15 aa, BK virus
SETEDSGHGSSTESQ

SEQ ID NO: 43483 - protein, 15 aa, BK virus
ETEDSGHGSSTESQS

SEQ ID NO: 43484 - protein, 15 aa, BK virus
TEDSGHGSSTESQSQ

SEQ ID NO: 43485 - protein, 15 aa, BK virus
EDSGHGSSTESQSQC

SEQ ID NO: 43486 - protein, 15 aa, BK virus
DSGHGSSTESQSQCS

SEQ ID NO: 43487 - protein, 15 aa, BK virus
SGHGSSTESQSQCSS

SEQ ID NO: 43488 - protein, 15 aa, BK virus
GHGSSTESQSQCSSQ

SEQ ID NO: 43489 - protein, 15 aa, BK virus
HGSSTESQSQCSSQV

SEQ ID NO: 43490 - protein, 15 aa, BK virus
GSSTESQSQCSSQVS

SEQ ID NO: 43491 - protein, 15 aa, BK virus
SSTESQSQCSSQVSD

SEQ ID NO: 43492 - protein, 15 aa, BK virus
STESQSQCSSQVSDT

SEQ ID NO: 43493 - protein, 15 aa, BK virus
TESQSQCSSQVSDTS

SEQ ID NO: 43494 - protein, 15 aa, BK virus
ESQSQCSSQVSDTSA

SEQ ID NO: 43495 - protein, 15 aa, BK virus
SQSQCSSQVSDTSAP

SEQ ID NO: 43496 - protein, 15 aa, BK virus
QSQCSSQVSDTSAPA

SEQ ID NO: 43497 - protein, 15 aa, BK virus
SQCSSQVSDTSAPAE

SEQ ID NO: 43498 - protein, 15 aa, BK virus
QCSSQVSDTSAPAED

SEQ ID NO: 43499 - protein, 15 aa, BK virus
CSSQVSDTSAPAEDS

SEQ ID NO: 43500 - protein, 15 aa, BK virus
SSQVSDTSAPAEDSQ

SEQ ID NO: 43501 - protein, 15 aa, BK virus
SQVSDTSAPAEDSQR

SEQ ID NO: 43502 - protein, 15 aa, BK virus
QVSDTSAPAEDSQRS

SEQ ID NO: 43503 - protein, 15 aa, BK virus
VSDTSAPAEDSQRSD

SEQ ID NO: 43504 - protein, 15 aa, BK virus
SDTSAPAEDSQRSDP

SEQ ID NO: 43505 - protein, 15 aa, BK virus
DTSAPAEDSQRSDPH

SEQ ID NO: 43506 - protein, 15 aa, BK virus
TSAPAEDSQRSDPHS

SEQ ID NO: 43507 - protein, 15 aa, BK virus
SAPAEDSQRSDPHSQ

SEQ ID NO: 43508 - protein, 15 aa, BK virus
APAEDSQRSDPHSQE

SEQ ID NO: 43509 - protein, 15 aa, BK virus
PAEDSQRSDPHSQEL

SEQ ID NO: 43510 - protein, 15 aa, BK virus
AEDSQRSDPHSQELH

SEQ ID NO: 43511 - protein, 15 aa, BK virus
EDSQRSDPHSQELHL

SEQ ID NO: 43512 - protein, 15 aa, BK virus
DSQRSDPHSQELHLC

SEQ ID NO: 43513 - protein, 15 aa, BK virus
SQRSDPHSQELHLCK

SEQ ID NO: 43514 - protein, 15 aa, BK virus
QRSDPHSQELHLCKG

SEQ ID NO: 43515 - protein, 15 aa, BK virus
RSDPHSQELHLCKGF

SEQ ID NO: 43516 - protein, 15 aa, BK virus
SDPHSQELHLCKGFQ

SEQ ID NO: 43517 - protein, 15 aa, BK virus
DPHSQELHLCKGFQC

SEQ ID NO: 43518 - protein, 15 aa, BK virus
PHSQELHLCKGFQCF

SEQ ID NO: 43519 - protein, 15 aa, BK virus
HSQELHLCKGFQCFK

SEQ ID NO: 43520 - protein, 15 aa, BK virus
SQELHLCKGFQCFKR

SEQ ID NO: 43521 - protein, 15 aa, BK virus
QELHLCKGFQCFKRP

SEQ ID NO: 43522 - protein, 15 aa, BK virus
ELHLCKGFQCFKRPK

SEQ ID NO: 43523 - protein, 15 aa, BK virus
LHLCKGFQCFKRPKT

SEQ ID NO: 43524 - protein, 15 aa, BK virus
HLCKGFQCFKRPKTP

SEQ ID NO: 43525 - protein, 15 aa, BK virus
LCKGFQCFKRPKTPP

SEQ ID NO: 43526 - protein, 15 aa, BK virus
CKGFQCFKRPKTPPP

SEQ ID NO: 43527 - protein, 15 aa, BK virus
KGFQCFKRPKTPPPK

SEQ ID NO: 43528 - protein, 15 aa, BK virus
MYMYNKSTCLKHFGL

SEQ ID NO: 43529 - protein, 15 aa, BK virus
YMYNKSTCLKHFGLQ

SEQ ID NO: 43530 - protein, 15 aa, BK virus
MYNKSTCLKHFGLQL

SEQ ID NO: 43531 - protein, 15 aa, BK virus
YNKSTCLKHFGLQLS

SEQ ID NO: 43532 - protein, 15 aa, BK virus
NKSTCLKHFGLQLSL

SEQ ID NO: 43533 - protein, 15 aa, BK virus
KSTCLKHFGLQLSLF

SEQ ID NO: 43534 - protein, 15 aa, BK virus
STCLKHFGLQLSLFV

SEQ ID NO: 43535 - protein, 15 aa, BK virus
TCLKHFGLQLSLFVN

SEQ ID NO: 43536 - protein, 15 aa, BK virus
CLKHFGLQLSLFVNI

SEQ ID NO: 43537 - protein, 15 aa, BK virus
LKHFGLQLSLFVNIS

SEQ ID NO: 43538 - protein, 15 aa, BK virus
KHFGLQLSLFVNISY

SEQ ID NO: 43539 - protein, 15 aa, BK virus
HFGLQLSLFVNISYH

SEQ ID NO: 43540 - protein, 15 aa, BK virus
FGLQLSLFVNISYHI

SEQ ID NO: 43541 - protein, 15 aa, BK virus
GLQLSLFVNISYHIW

SEQ ID NO: 43542 - protein, 15 aa, BK virus
LQLSLFVNISYHIWV

SEQ ID NO: 43543 - protein, 15 aa, BK virus
QLSLFVNISYHIWVP

SEQ ID NO: 43544 - protein, 15 aa, BK virus
LSLFVNISYHIWVPW

SEQ ID NO: 43545 - protein, 15 aa, BK virus
SLFVNISYHIWVPWK

SEQ ID NO: 43546 - protein, 15 aa, BK virus
LFVNISYHIWVPWKS

SEQ ID NO: 43547 - protein, 15 aa, BK virus
FVNISYHIWVPWKSF

SEQ ID NO: 43548 - protein, 15 aa, BK virus
VNISYHIWVPWKSFC

SEQ ID NO: 43549 - protein, 15 aa, BK virus
NISYHIWVPWKSFCA

SEQ ID NO: 43550 - protein, 15 aa, BK virus
ISYHIWVPWKSFCAI

SEQ ID NO: 43551 - protein, 15 aa, BK virus
SYHIWVPWKSFCAIK

SEQ ID NO: 43552 - protein, 15 aa, BK virus
YHIWVPWKSFCAIKH

SEQ ID NO: 43553 - protein, 15 aa, BK virus
HIWVPWKSFCAIKHP

SEQ ID NO: 43554 - protein, 15 aa, BK virus
IWVPWKSFCAIKHPN

SEQ ID NO: 43555 - protein, 15 aa, BK virus
WVPWKSFCAIKHPNL

SEQ ID NO: 43556 - protein, 15 aa, BK virus
VPWKSFCAIKHPNLF

SEQ ID NO: 43557 - protein, 15 aa, BK virus
PWKSFCAIKHPNLFY

SEQ ID NO: 43558 - protein, 15 aa, BK virus
WKSFCAIKHPNLFYL

SEQ ID NO: 43559 - protein, 15 aa, BK virus
KSFCAIKHPNLFYLG

SEQ ID NO: 43560 - protein, 15 aa, BK virus
SFCAIKHPNLFYLGF

SEQ ID NO: 43561 - protein, 15 aa, BK virus
FCAIKHPNLFYLGFH

SEQ ID NO: 43562 - protein, 15 aa, BK virus
CAIKHPNLFYLGFHT

SEQ ID NO: 43563 - protein, 15 aa, BK virus
AIKHPNLFYLGFHTI

SEQ ID NO: 43564 - protein, 15 aa, BK virus
IKHPNLFYLGFHTIH

SEQ ID NO: 43565 - protein, 15 aa, BK virus
KHPNLFYLGFHTIHR

SEQ ID NO: 43566 - protein, 15 aa, BK virus
HPNLFYLGFHTIHRL

SEQ ID NO: 43567 - protein, 15 aa, BK virus
PNLFYLGFHTIHRLP

SEQ ID NO: 43568 - protein, 15 aa, BK virus
NLFYLGFHTIHRLPI

SEQ ID NO: 43569 - protein, 15 aa, BK virus
LFYLGFHTIHRLPIH

SEQ ID NO: 43570 - protein, 15 aa, BK virus
FYLGFHTIHRLPIHS

SEQ ID NO: 43571 - protein, 15 aa, BK virus
YLGFHTIHRLPIHSL

SEQ ID NO: 43572 - protein, 15 aa, BK virus
LGFHTIHRLPIHSLG

SEQ ID NO: 43573 - protein, 15 aa, BK virus
GFHTIHRLPIHSLGS

SEQ ID NO: 43574 - protein, 15 aa, BK virus
FHTIHRLPIHSLGSP

SEQ ID NO: 43575 - protein, 15 aa, BK virus
HTIHRLPIHSLGSPV

SEQ ID NO: 43576 - protein, 15 aa, BK virus
TIHRLPIHSLGSPVY

SEQ ID NO: 43577 - protein, 15 aa, BK virus
IHRLPIHSLGSPVYK

SEQ ID NO: 43578 - protein, 15 aa, BK virus
HRLPIHSLGSPVYKV

SEQ ID NO: 43579 - protein, 15 aa, BK virus
RLPIHSLGSPVYKVT

SEQ ID NO: 43580 - protein, 15 aa, BK virus
QKGNWVRILYRSFSQ

SEQ ID NO: 43581 - protein, 15 aa, BK virus
KGNWVRILYRSFSQA

SEQ ID NO: 43582 - protein, 15 aa, BK virus
GNWVRILYRSFSQAD

SEQ ID NO: 43583 - protein, 15 aa, BK virus
NWVRILYRSFSQADL

SEQ ID NO: 43584 - protein, 15 aa, BK virus
WVRILYRSFSQADLK

SEQ ID NO: 43585 - protein, 15 aa, BK virus
VRILYRSFSQADLKI

SEQ ID NO: 43586 - protein, 15 aa, BK virus
RILYRSFSQADLKIS

SEQ ID NO: 43587 - protein, 15 aa, BK virus
ILYRSFSQADLKISC

SEQ ID NO: 43588 - protein, 15 aa, BK virus
LYRSFSQADLKISCK

SEQ ID NO: 43589 - protein, 15 aa, BK virus
YRSFSQADLKISCKA

SEQ ID NO: 43590 - protein, 15 aa, BK virus
RSFSQADLKISCKAS

SEQ ID NO: 43591 - protein, 15 aa, BK virus
SFSQADLKISCKASP

SEQ ID NO: 43592 - protein, 15 aa, BK virus
FSQADLKISCKASPL

SEQ ID NO: 43593 - protein, 15 aa, BK virus
SQADLKISCKASPLL

SEQ ID NO: 43594 - protein, 15 aa, BK virus
QADLKISCKASPLLC

SEQ ID NO: 43595 - protein, 15 aa, BK virus
ADLKISCKASPLLCS

SEQ ID NO: 43596 - protein, 15 aa, BK virus
DLKISCKASPLLCSR

SEQ ID NO: 43597 - protein, 15 aa, BK virus
LKISCKASPLLCSRA

SEQ ID NO: 43598 - protein, 15 aa, BK virus
KISCKASPLLCSRAV

SEQ ID NO: 43599 - protein, 15 aa, BK virus
ISCKASPLLCSRAVS

SEQ ID NO: 43600 - protein, 15 aa, BK virus
SCKASPLLCSRAVSK

SEQ ID NO: 43601 - protein, 15 aa, BK virus
CKASPLLCSRAVSKQ

SEQ ID NO: 43602 - protein, 15 aa, BK virus
KASPLLCSRAVSKQA

SEQ ID NO: 43603 - protein, 15 aa, BK virus
ASPLLCSRAVSKQAT

SEQ ID NO: 43604 - protein, 15 aa, BK virus
SPLLCSRAVSKQATN

SEQ ID NO: 43605 - protein, 15 aa, BK virus
PLLCSRAVSKQATNI

SEQ ID NO: 43606 - protein, 15 aa, BK virus
LLCSRAVSKQATNIS

SEQ ID NO: 43607 - protein, 15 aa, BK virus
LCSRAVSKQATNISS

SEQ ID NO: 43608 - protein, 15 aa, BK virus
NIQAISFTKRPHTLF

SEQ ID NO: 43609 - protein, 15 aa, BK virus
IQAISFTKRPHTLFI

SEQ ID NO: 43610 - protein, 15 aa, BK virus
QHCGSCVGHMKYWGN

SEQ ID NO: 43611 - protein, 15 aa, BK virus
HCGSCVGHMKYWGNI

SEQ ID NO: 43612 - protein, 15 aa, BK virus
CGSCVGHMKYWGNIF

SEQ ID NO: 43613 - protein, 15 aa, BK virus
GSCVGHMKYWGNIFP

SEQ ID NO: 43614 - protein, 15 aa, BK virus
SCVGHMKYWGNIFPS

SEQ ID NO: 43615 - protein, 15 aa, BK virus
CVGHMKYWGNIFPSC

SEQ ID NO: 43616 - protein, 15 aa, BK virus
VGHMKYWGNIFPSCE

SEQ ID NO: 43617 - protein, 15 aa, BK virus
GHMKYWGNIFPSCES

SEQ ID NO: 43618 - protein, 15 aa, BK virus
HMKYWGNIFPSCESP

SEQ ID NO: 43619 - protein, 15 aa, BK virus
MKYWGNIFPSCESPK

SEQ ID NO: 43620 - protein, 15 aa, BK virus
KYWGNIFPSCESPKI

SEQ ID NO: 43621 - protein, 15 aa, BK virus
YWGNIFPSCESPKIP

SEQ ID NO: 43622 - protein, 15 aa, BK virus
WGNIFPSCESPKIPS

SEQ ID NO: 43623 - protein, 15 aa, BK virus
GNIFPSCESPKIPSI

SEQ ID NO: 43624 - protein, 15 aa, BK virus
NIFPSCESPKIPSIF

SEQ ID NO: 43625 - protein, 15 aa, BK virus
IFPSCESPKIPSIFI

SEQ ID NO: 43626 - protein, 15 aa, BK virus
FPSCESPKIPSIFIS

SEQ ID NO: 43627 - protein, 15 aa, BK virus
PSCESPKIPSIFIST

SEQ ID NO: 43628 - protein, 15 aa, BK virus
SCESPKIPSIFISTG

SEQ ID NO: 43629 - protein, 15 aa, BK virus
CESPKIPSIFISTGI

SEQ ID NO: 43630 - protein, 15 aa, BK virus
ESPKIPSIFISTGIR

SEQ ID NO: 43631 - protein, 15 aa, BK virus
SPKIPSIFISTGIRY

SEQ ID NO: 43632 - protein, 15 aa, BK virus
PKIPSIFISTGIRYP

SEQ ID NO: 43633 - protein, 15 aa, BK virus
KIPSIFISTGIRYPA

SEQ ID NO: 43634 - protein, 15 aa, BK virus
IPSIFISTGIRYPAL

SEQ ID NO: 43635 - protein, 15 aa, BK virus
PSIFISTGIRYPALN

SEQ ID NO: 43636 - protein, 15 aa, BK virus
SIFISTGIRYPALNW

SEQ ID NO: 43637 - protein, 15 aa, BK virus
IFISTGIRYPALNWI

SEQ ID NO: 43638 - protein, 15 aa, BK virus
FISTGIRYPALNWIS

SEQ ID NO: 43639 - protein, 15 aa, BK virus
ISTGIRYPALNWISI

SEQ ID NO: 43640 - protein, 15 aa, BK virus
STGIRYPALNWISIV

SEQ ID NO: 43641 - protein, 15 aa, BK virus
TGIRYPALNWISIVF

SEQ ID NO: 43642 - protein, 15 aa, BK virus
GIRYPALNWISIVFV

SEQ ID NO: 43643 - protein, 15 aa, BK virus
IRYPALNWISIVFVQ

SEQ ID NO: 43644 - protein, 15 aa, BK virus
RYPALNWISIVFVQI

SEQ ID NO: 43645 - protein, 15 aa, BK virus
YPALNWISIVFVQIG

SEQ ID NO: 43646 - protein, 15 aa, BK virus
PALNWISIVFVQIGL

SEQ ID NO: 43647 - protein, 15 aa, BK virus
ALNWISIVFVQIGLM

SEQ ID NO: 43648 - protein, 15 aa, BK virus
LNWISIVFVQIGLMV

SEQ ID NO: 43649 - protein, 15 aa, BK virus
NWISIVFVQIGLMVS

SEQ ID NO: 43650 - protein, 15 aa, BK virus
WISIVFVQIGLMVSI

SEQ ID NO: 43651 - protein, 15 aa, BK virus
ISIVFVQIGLMVSIH

SEQ ID NO: 43652 - protein, 15 aa, BK virus
SIVFVQIGLMVSIHY

SEQ ID NO: 43653 - protein, 15 aa, BK virus
IVFVQIGLMVSIHYL

SEQ ID NO: 43654 - protein, 15 aa, BK virus
VFVQIGLMVSIHYLG

SEQ ID NO: 43655 - protein, 15 aa, BK virus
FVQIGLMVSIHYLGL

SEQ ID NO: 43656 - protein, 15 aa, BK virus
VQIGLMVSIHYLGLG

SEQ ID NO: 43657 - protein, 15 aa, BK virus
QIGLMVSIHYLGLGC

SEQ ID NO: 43658 - protein, 15 aa, BK virus
IGLMVSIHYLGLGCW

SEQ ID NO: 43659 - protein, 15 aa, BK virus
GLMVSIHYLGLGCWV

SEQ ID NO: 43660 - protein, 15 aa, BK virus
LMVSIHYLGLGCWVF

SEQ ID NO: 43661 - protein, 15 aa, BK virus
MVSIHYLGLGCWVFR

SEQ ID NO: 43662 - protein, 15 aa, BK virus
VSIHYLGLGCWVFRG

SEQ ID NO: 43663 - protein, 15 aa, BK virus
SIHYLGLGCWVFRGY

SEQ ID NO: 43664 - protein, 15 aa, BK virus
IHYLGLGCWVFRGYS

SEQ ID NO: 43665 - protein, 15 aa, BK virus
HYLGLGCWVFRGYST

SEQ ID NO: 43666 - protein, 15 aa, BK virus
YLGLGCWVFRGYSTI

SEQ ID NO: 43667 - protein, 15 aa, BK virus
LGLGCWVFRGYSTIR

SEQ ID NO: 43668 - protein, 15 aa, BK virus
GLGCWVFRGYSTIRV

SEQ ID NO: 43669 - protein, 15 aa, BK virus
LGCWVFRGYSTIRVL

SEQ ID NO: 43670 - protein, 15 aa, BK virus
HSLHFQGFSTYSKEV

SEQ ID NO: 43671 - protein, 15 aa, BK virus
SLHFQGFSTYSKEVE

SEQ ID NO: 43672 - protein, 15 aa, BK virus
LHFQGFSTYSKEVEI

SEQ ID NO: 43673 - protein, 15 aa, BK virus
HFQGFSTYSKEVEIT

SEQ ID NO: 43674 - protein, 15 aa, BK virus
FQGFSTYSKEVEITA

SEQ ID NO: 43675 - protein, 15 aa, BK virus
QGFSTYSKEVEITAL

SEQ ID NO: 43676 - protein, 15 aa, BK virus
GFSTYSKEVEITALN

SEQ ID NO: 43677 - protein, 15 aa, BK virus
FSTYSKEVEITALNR

SEQ ID NO: 43678 - protein, 15 aa, BK virus
STYSKEVEITALNRF

SEQ ID NO: 43679 - protein, 15 aa, BK virus
TYSKEVEITALNRFS

SEQ ID NO: 43680 - protein, 15 aa, BK virus
YSKEVEITALNRFSS

SEQ ID NO: 43681 - protein, 15 aa, BK virus
SKEVEITALNRFSST

SEQ ID NO: 43682 - protein, 15 aa, BK virus
KEVEITALNRFSSTM

SEQ ID NO: 43683 - protein, 15 aa, BK virus
EVEITALNRFSSTML

SEQ ID NO: 43684 - protein, 15 aa, BK virus
VEITALNRFSSTMLM

SEQ ID NO: 43685 - protein, 15 aa, BK virus
EITALNRFSSTMLMH

SEQ ID NO: 43686 - protein, 15 aa, BK virus
ITALNRFSSTMLMHF

SEQ ID NO: 43687 - protein, 15 aa, BK virus
TALNRFSSTMLMHFL

SEQ ID NO: 43688 - protein, 15 aa, BK virus
PCMKVKHASYSNNLC

SEQ ID NO: 43689 - protein, 15 aa, BK virus
CMKVKHASYSNNLCL

SEQ ID NO: 43690 - protein, 15 aa, BK virus
MKVKHASYSNNLCLY

SEQ ID NO: 43691 - protein, 15 aa, BK virus
KVKHASYSNNLCLYS

SEQ ID NO: 43692 - protein, 15 aa, BK virus
VKHASYSNNLCLYSY

SEQ ID NO: 43693 - protein, 15 aa, BK virus
KHASYSNNLCLYSYS

SEQ ID NO: 43694 - protein, 15 aa, BK virus
HASYSNNLCLYSYSL

SEQ ID NO: 43695 - protein, 15 aa, BK virus
ASYSNNLCLYSYSLP

SEQ ID NO: 43696 - protein, 15 aa, BK virus
SYSNNLCLYSYSLPH

SEQ ID NO: 43697 - protein, 15 aa, BK virus
YSNNLCLYSYSLPHQ

SEQ ID NO: 43698 - protein, 15 aa, BK virus
IGEGNSCCAVTGKHF

SEQ ID NO: 43699 - protein, 15 aa, BK virus
GEGNSCCAVTGKHFS

SEQ ID NO: 43700 - protein, 15 aa, BK virus
EGNSCCAVTGKHFSL

SEQ ID NO: 43701 - protein, 15 aa, BK virus
GNSCCAVTGKHFSLW

SEQ ID NO: 43702 - protein, 15 aa, BK virus
NSCCAVTGKHFSLWA

SEQ ID NO: 43703 - protein, 15 aa, BK virus
SCCAVTGKHFSLWAI

SEQ ID NO: 43704 - protein, 15 aa, BK virus
CCAVTGKHFSLWAIT

SEQ ID NO: 43705 - protein, 15 aa, BK virus
CAVTGKHFSLWAITA

SEQ ID NO: 43706 - protein, 15 aa, BK virus
AVTGKHFSLWAITAK

SEQ ID NO: 43707 - protein, 15 aa, BK virus
VTGKHFSLWAITAKV

SEQ ID NO: 43708 - protein, 15 aa, BK virus
TGKHFSLWAITAKVI

SEQ ID NO: 43709 - protein, 15 aa, BK virus
GKHFSLWAITAKVIF

SEQ ID NO: 43710 - protein, 15 aa, BK virus
KHFSLWAITAKVIFS

SEQ ID NO: 43711 - protein, 15 aa, BK virus
HFSLWAITAKVIFST

SEQ ID NO: 43712 - protein, 15 aa, BK virus
TKAPKVFIWIPHFWV

SEQ ID NO: 43713 - protein, 15 aa, BK virus
EAFYLCNSIYPSFNF

SEQ ID NO: 43714 - protein, 15 aa, BK virus
FWHLHGFLWLFGSCP

SEQ ID NO: 43715 - protein, 15 aa, BK virus
WHLHGFLWLFGSCPW

SEQ ID NO: 43716 - protein, 15 aa, BK virus
HLHGFLWLFGSCPWT

SEQ ID NO: 43717 - protein, 15 aa, BK virus
LHGFLWLFGSCPWTL

SEQ ID NO: 43718 - protein, 15 aa, BK virus
HGFLWLFGSCPWTLS

SEQ ID NO: 43719 - protein, 15 aa, BK virus
GFLWLFGSCPWTLSF

SEQ ID NO: 43720 - protein, 15 aa, BK virus
FLWLFGSCPWTLSFS

SEQ ID NO: 43721 - protein, 15 aa, BK virus
LWLFGSCPWTLSFSF

SEQ ID NO: 43722 - protein, 15 aa, BK virus
WLFGSCPWTLSFSFG

SEQ ID NO: 43723 - protein, 15 aa, BK virus
LFGSCPWTLSFSFGW

SEQ ID NO: 43724 - protein, 15 aa, BK virus
FGSCPWTLSFSFGWG

SEQ ID NO: 43725 - protein, 15 aa, BK virus
GSCPWTLSFSFGWGH

SEQ ID NO: 43726 - protein, 15 aa, BK virus
SCPWTLSFSFGWGHL

SEQ ID NO: 43727 - protein, 15 aa, BK virus
CPWTLSFSFGWGHLH

SEQ ID NO: 43728 - protein, 15 aa, BK virus
PWTLSFSFGWGHLHM

SEQ ID NO: 43729 - protein, 15 aa, BK virus
WTLSFSFGWGHLHML

SEQ ID NO: 43730 - protein, 15 aa, BK virus
TLSFSFGWGHLHMLQ

SEQ ID NO: 43731 - protein, 15 aa, BK virus
LSFSFGWGHLHMLQE

SEQ ID NO: 43732 - protein, 15 aa, BK virus
SFSFGWGHLHMLQEQ

SEQ ID NO: 43733 - protein, 15 aa, BK virus
FSFGWGHLHMLQEQV

SEQ ID NO: 43734 - protein, 15 aa, BK virus
SFGWGHLHMLQEQVL

SEQ ID NO: 43735 - protein, 15 aa, BK virus
FGWGHLHMLQEQVLQ

SEQ ID NO: 43736 - protein, 15 aa, BK virus
GWGHLHMLQEQVLQS

SEQ ID NO: 43737 - protein, 15 aa, BK virus
WGHLHMLQEQVLQSR

SEQ ID NO: 43738 - protein, 15 aa, BK virus
GHLHMLQEQVLQSRT

SEQ ID NO: 43739 - protein, 15 aa, BK virus
HLHMLQEQVLQSRTG

SEQ ID NO: 43740 - protein, 15 aa, BK virus
LHMLQEQVLQSRTGL

SEQ ID NO: 43741 - protein, 15 aa, BK virus
HMLQEQVLQSRTGLE

SEQ ID NO: 43742 - protein, 15 aa, BK virus
MLQEQVLQSRTGLEV

SEQ ID NO: 43743 - protein, 15 aa, BK virus
LQEQVLQSRTGLEVK

SEQ ID NO: 43744 - protein, 15 aa, BK virus
QEQVLQSRTGLEVKA

SEQ ID NO: 43745 - protein, 15 aa, BK virus
EQVLQSRTGLEVKAT

SEQ ID NO: 43746 - protein, 15 aa, BK virus
QVLQSRTGLEVKATS

SEQ ID NO: 43747 - protein, 15 aa, BK virus
VLQSRTGLEVKATSI

SEQ ID NO: 43748 - protein, 15 aa, BK virus
LQSRTGLEVKATSIE

SEQ ID NO: 43749 - protein, 15 aa, BK virus
QSRTGLEVKATSIEE

SEQ ID NO: 43750 - protein, 15 aa, BK virus
SRTGLEVKATSIEEQ

SEQ ID NO: 43751 - protein, 15 aa, BK virus
RTGLEVKATSIEEQF

SEQ ID NO: 43752 - protein, 15 aa, BK virus
TGLEVKATSIEEQFF

SEQ ID NO: 43753 - protein, 15 aa, BK virus
GLEVKATSIEEQFFD

SEQ ID NO: 43754 - protein, 15 aa, BK virus
TLLNVHFVDFLSPFF

SEQ ID NO: 43755 - protein, 15 aa, BK virus
LLNVHFVDFLSPFFV

SEQ ID NO: 43756 - protein, 15 aa, BK virus
LLLYCQHHLYYKYGQ

SEQ ID NO: 43757 - protein, 15 aa, BK virus
LLYCQHHLYYKYGQN

SEQ ID NO: 43758 - protein, 15 aa, BK virus
LYCQHHLYYKYGQNV

SEQ ID NO: 43759 - protein, 15 aa, BK virus
YCQHHLYYKYGQNVH

SEQ ID NO: 43760 - protein, 15 aa, BK virus
CQHHLYYKYGQNVHG

SEQ ID NO: 43761 - protein, 15 aa, BK virus
QHHLYYKYGQNVHGY

SEQ ID NO: 43762 - protein, 15 aa, BK virus
HHLYYKYGQNVHGYL

SEQ ID NO: 43763 - protein, 15 aa, BK virus
HLYYKYGQNVHGYLP

SEQ ID NO: 43764 - protein, 15 aa, BK virus
LYYKYGQNVHGYLPF

SEQ ID NO: 43765 - protein, 15 aa, BK virus
YYKYGQNVHGYLPFQ

SEQ ID NO: 43766 - protein, 15 aa, BK virus
YKYGQNVHGYLPFQL

SEQ ID NO: 43767 - protein, 15 aa, BK virus
KYGQNVHGYLPFQLL

SEQ ID NO: 43768 - protein, 15 aa, BK virus
YGQNVHGYLPFQLLV

SEQ ID NO: 43769 - protein, 15 aa, BK virus
GKDQNNIVEYNYKSL

SEQ ID NO: 43770 - protein, 15 aa, BK virus
QKYLHQETEYHSTHL

SEQ ID NO: 43771 - protein, 15 aa, BK virus
KYLHQETEYHSTHLG

SEQ ID NO: 43772 - protein, 15 aa, BK virus
TIPKPCLIADRGLQW

SEQ ID NO: 43773 - protein, 15 aa, BK virus
IPKPCLIADRGLQWK

SEQ ID NO: 43774 - protein, 15 aa, BK virus
PKPCLIADRGLQWKL

SEQ ID NO: 43775 - protein, 15 aa, BK virus
KPCLIADRGLQWKLC

SEQ ID NO: 43776 - protein, 15 aa, BK virus
PCLIADRGLQWKLCD

SEQ ID NO: 43777 - protein, 15 aa, BK virus
CLIADRGLQWKLCDP

SEQ ID NO: 43778 - protein, 15 aa, BK virus
LIADRGLQWKLCDPN

SEQ ID NO: 43779 - protein, 15 aa, BK virus
IADRGLQWKLCDPNH

SEQ ID NO: 43780 - protein, 15 aa, BK virus
ADRGLQWKLCDPNHQ

SEQ ID NO: 43781 - protein, 15 aa, BK virus
DRGLQWKLCDPNHQR

SEQ ID NO: 43782 - protein, 15 aa, BK virus
RGLQWKLCDPNHQRT

SEQ ID NO: 43783 - protein, 15 aa, BK virus
GLQWKLCDPNHQRTY

SEQ ID NO: 43784 - protein, 15 aa, BK virus
LQWKLCDPNHQRTYT

SEQ ID NO: 43785 - protein, 15 aa, BK virus
QWKLCDPNHQRTYTL

SEQ ID NO: 43786 - protein, 15 aa, BK virus
WKLCDPNHQRTYTLL

SEQ ID NO: 43787 - protein, 15 aa, BK virus
KLCDPNHQRTYTLLE

SEQ ID NO: 43788 - protein, 15 aa, BK virus
LCDPNHQRTYTLLEL

SEQ ID NO: 43789 - protein, 15 aa, BK virus
CDPNHQRTYTLLELR

SEQ ID NO: 43790 - protein, 15 aa, BK virus
DPNHQRTYTLLELRN

SEQ ID NO: 43791 - protein, 15 aa, BK virus
PQEHQQLQHMFEELG

SEQ ID NO: 43792 - protein, 15 aa, BK virus
QEHQQLQHMFEELGL

SEQ ID NO: 43793 - protein, 15 aa, BK virus
QQQPPQQQFQPLKIL

SEQ ID NO: 43794 - protein, 15 aa, BK virus
QQPPQQQFQPLKILW

SEQ ID NO: 43795 - protein, 15 aa, BK virus
QPPQQQFQPLKILWQ

SEQ ID NO: 43796 - protein, 15 aa, BK virus
PPQQQFQPLKILWQQ

SEQ ID NO: 43797 - protein, 15 aa, BK virus
PQQQFQPLKILWQQQ

SEQ ID NO: 43798 - protein, 15 aa, BK virus
QQQFQPLKILWQQQP

SEQ ID NO: 43799 - protein, 15 aa, BK virus
QQFQPLKILWQQQPQ

SEQ ID NO: 43800 - protein, 15 aa, BK virus
QFQPLKILWQQQPQI

SEQ ID NO: 43801 - protein, 15 aa, BK virus
FQPLKILWQQQPQIH

SEQ ID NO: 43802 - protein, 15 aa, BK virus
QPLKILWQQQPQIHW

SEQ ID NO: 43803 - protein, 15 aa, BK virus
PLKILWQQQPQIHWQ

SEQ ID NO: 43804 - protein, 15 aa, BK virus
LKILWQQQPQIHWQL

SEQ ID NO: 43805 - protein, 15 aa, BK virus
KILWQQQPQIHWQLG

SEQ ID NO: 43806 - protein, 15 aa, BK virus
ILWQQQPQIHWQLGP

SEQ ID NO: 43807 - protein, 15 aa, BK virus
LWQQQPQIHWQLGPP

SEQ ID NO: 43808 - protein, 15 aa, BK virus
WQQQPQIHWQLGPPK

SEQ ID NO: 43809 - protein, 15 aa, BK virus
QQQPQIHWQLGPPKV

SEQ ID NO: 43810 - protein, 15 aa, BK virus
QQPQIHWQLGPPKVL

SEQ ID NO: 43811 - protein, 15 aa, BK virus
QPQIHWQLGPPKVLE

SEQ ID NO: 43812 - protein, 15 aa, BK virus
PQIHWQLGPPKVLEQ

SEQ ID NO: 43813 - protein, 15 aa, BK virus
QIHWQLGPPKVLEQH

SEQ ID NO: 43814 - protein, 15 aa, BK virus
IHWQLGPPKVLEQHP

SEQ ID NO: 43815 - protein, 15 aa, BK virus
TWKYKKKGITYLGVF

SEQ ID NO: 43816 - protein, 15 aa, BK virus
WKYKKKGITYLGVFY

SEQ ID NO: 43817 - protein, 15 aa, BK virus
KYKKKGITYLGVFYR

SEQ ID NO: 43818 - protein, 15 aa, BK virus
YKKKGITYLGVFYRV

SEQ ID NO: 43819 - protein, 15 aa, BK virus
KKKGITYLGVFYRVF

SEQ ID NO: 43820 - protein, 15 aa, BK virus
KKGITYLGVFYRVFY

SEQ ID NO: 43821 - protein, 15 aa, BK virus
KGITYLGVFYRVFYS

SEQ ID NO: 43822 - protein, 15 aa, BK virus
GITYLGVFYRVFYSR

SEQ ID NO: 43823 - protein, 15 aa, BK virus
SSGTFVFPVYTVFTS

SEQ ID NO: 43824 - protein, 15 aa, BK virus
SGTFVFPVYTVFTST

SEQ ID NO: 43825 - protein, 15 aa, BK virus
GTFVFPVYTVFTSTK

SEQ ID NO: 43826 - protein, 15 aa, BK virus
TFVFPVYTVFTSTKF

SEQ ID NO: 43827 - protein, 15 aa, BK virus
FVFPVYTVFTSTKFQ

SEQ ID NO: 43828 - protein, 15 aa, BK virus
VFPVYTVFTSTKFQQ

SEQ ID NO: 43829 - protein, 15 aa, BK virus
FPVYTVFTSTKFQQK

SEQ ID NO: 43830 - protein, 15 aa, BK virus
PVYTVFTSTKFQQKL

SEQ ID NO: 43831 - protein, 15 aa, BK virus
NKNKNPLSSFFCSSP

SEQ ID NO: 43832 - protein, 15 aa, BK virus
KNKNPLSSFFCSSPG

SEQ ID NO: 43833 - protein, 15 aa, BK virus
NKNPLSSFFCSSPGF

SEQ ID NO: 43834 - protein, 15 aa, BK virus
KNPLSSFFCSSPGFT

SEQ ID NO: 43835 - protein, 15 aa, BK virus
NPLSSFFCSSPGFTN

SEQ ID NO: 43836 - protein, 15 aa, BK virus
PLSSFFCSSPGFTNF

SEQ ID NO: 43837 - protein, 15 aa, BK virus
LSSFFCSSPGFTNFH

SEQ ID NO: 43838 - protein, 15 aa, BK virus
LGTRPRFLGSQNMSV

SEQ ID NO: 43839 - protein, 15 aa, BK virus
GTRPRFLGSQNMSVM

SEQ ID NO: 43840 - protein, 15 aa, BK virus
TRPRFLGSQNMSVMH

SEQ ID NO: 43841 - protein, 15 aa, BK virus
RPRFLGSQNMSVMHF

SEQ ID NO: 43842 - protein, 15 aa, BK virus
PRFLGSQNMSVMHFP

SEQ ID NO: 43843 - protein, 15 aa, BK virus
RFLGSQNMSVMHFPS

SEQ ID NO: 43844 - protein, 15 aa, BK virus
AAPPCESCTFLPEVM

SEQ ID NO: 43845 - protein, 15 aa, BK virus
APPCESCTFLPEVMV

SEQ ID NO: 43846 - protein, 15 aa, BK virus
PPCESCTFLPEVMVW

SEQ ID NO: 43847 - protein, 15 aa, BK virus
PCESCTFLPEVMVWL

SEQ ID NO: 43848 - protein, 15 aa, BK virus
CESCTFLPEVMVWLH

SEQ ID NO: 43849 - protein, 15 aa, BK virus
ESCTFLPEVMVWLHS

SEQ ID NO: 43850 - protein, 15 aa, BK virus
SCTFLPEVMVWLHSP

SEQ ID NO: 43851 - protein, 15 aa, BK virus
CTFLPEVMVWLHSPV

SEQ ID NO: 43852 - protein, 15 aa, BK virus
TFLPEVMVWLHSPVS

SEQ ID NO: 43853 - protein, 15 aa, BK virus
FLPEVMVWLHSPVSH

SEQ ID NO: 43854 - protein, 15 aa, BK virus
LPEVMVWLHSPVSHA

SEQ ID NO: 43855 - protein, 15 aa, BK virus
PEVMVWLHSPVSHAL

SEQ ID NO: 43856 - protein, 15 aa, BK virus
EVMVWLHSPVSHALS

SEQ ID NO: 43857 - protein, 15 aa, BK virus
VMVWLHSPVSHALSF

SEQ ID NO: 43858 - protein, 15 aa, BK virus
MVWLHSPVSHALSFL

SEQ ID NO: 43859 - protein, 15 aa, BK virus
VWLHSPVSHALSFLR

SEQ ID NO: 43860 - protein, 15 aa, BK virus
WLHSPVSHALSFLRS

SEQ ID NO: 43861 - protein, 15 aa, BK virus
LHSPVSHALSFLRSW

SEQ ID NO: 43862 - protein, 15 aa, BK virus
HSPVSHALSFLRSWF

SEQ ID NO: 43863 - protein, 15 aa, BK virus
SPVSHALSFLRSWFG

SEQ ID NO: 43864 - protein, 15 aa, BK virus
PVSHALSFLRSWFGC

SEQ ID NO: 43865 - protein, 15 aa, BK virus
VSHALSFLRSWFGCI

SEQ ID NO: 43866 - protein, 15 aa, BK virus
SHALSFLRSWFGCIP

SEQ ID NO: 43867 - protein, 15 aa, BK virus
HALSFLRSWFGCIPW

SEQ ID NO: 43868 - protein, 15 aa, BK virus
ALSFLRSWFGCIPWV

SEQ ID NO: 43869 - protein, 15 aa, BK virus
LSFLRSWFGCIPWVS

SEQ ID NO: 43870 - protein, 15 aa, BK virus
SFLRSWFGCIPWVSS

SEQ ID NO: 43871 - protein, 15 aa, BK virus
FLRSWFGCIPWVSSS

SEQ ID NO: 43872 - protein, 15 aa, BK virus
LRSWFGCIPWVSSSS

SEQ ID NO: 43873 - protein, 15 aa, BK virus
RSWFGCIPWVSSSSL

SEQ ID NO: 43874 - protein, 15 aa, BK virus
SWFGCIPWVSSSSLW

SEQ ID NO: 43875 - protein, 15 aa, BK virus
WFGCIPWVSSSSLWP

SEQ ID NO: 43876 - protein, 15 aa, BK virus
FGCIPWVSSSSLWPF

SEQ ID NO: 43877 - protein, 15 aa, BK virus
GCIPWVSSSSLWPFF

SEQ ID NO: 43878 - protein, 15 aa, BK virus
CIPWVSSSSLWPFFL

SEQ ID NO: 43879 - protein, 15 aa, BK virus
YIRGRGRLCLHPFSQ

SEQ ID NO: 43880 - protein, 15 aa, BK virus
IRGRGRLCLHPFSQV

SEQ ID NO: 43881 - protein, 15 aa, BK virus
RGRGRLCLHPFSQVV

SEQ ID NO: 43882 - protein, 15 aa, BK virus
GRGRLCLHPFSQVVR

SEQ ID NO: 43883 - protein, 15 aa, BK virus
RGRLCLHPFSQVVRV

SEQ ID NO: 43884 - protein, 15 aa, BK virus
GRLCLHPFSQVVRVW

SEQ ID NO: 43885 - protein, 15 aa, BK virus
RLCLHPFSQVVRVWR

SEQ ID NO: 43886 - protein, 15 aa, BK virus
LCLHPFSQVVRVWRL

SEQ ID NO: 43887 - protein, 15 aa, BK virus
CLHPFSQVVRVWRLF

SEQ ID NO: 43888 - protein, 15 aa, BK virus
LHPFSQVVRVWRLFL

SEQ ID NO: 43889 - protein, 15 aa, BK virus
HPFSQVVRVWRLFLR

SEQ ID NO: 43890 - protein, 15 aa, BK virus
PFSQVVRVWRLFLRP

SEQ ID NO: 43891 - protein, 15 aa, BK virus
FSQVVRVWRLFLRPS

SEQ ID NO: 43892 - protein, 15 aa, BK virus
SQVVRVWRLFLRPSK

SEQ ID NO: 43893 - protein, 15 aa, BK virus
QVVRVWRLFLRPSKT

SEQ ID NO: 43894 - protein, 15 aa, BK virus
VVRVWRLFLRPSKTI

SEQ ID NO: 43895 - protein, 15 aa, BK virus
VRVWRLFLRPSKTIW

SEQ ID NO: 43896 - protein, 15 aa, BK virus
RVWRLFLRPSKTIWG

SEQ ID NO: 43897 - protein, 15 aa, BK virus
VWRLFLRPSKTIWGN

SEQ ID NO: 43898 - protein, 15 aa, BK virus
WRLFLRPSKTIWGNP

SEQ ID NO: 43899 - protein, 15 aa, BK virus
RLFLRPSKTIWGNPY

SEQ ID NO: 43900 - protein, 15 aa, BK virus
LFLRPSKTIWGNPYS

SEQ ID NO: 43901 - protein, 15 aa, BK virus
FLRPSKTIWGNPYSF

SEQ ID NO: 43902 - protein, 15 aa, BK virus
LRPSKTIWGNPYSFA

SEQ ID NO: 43903 - protein, 15 aa, BK virus
RPSKTIWGNPYSFAI

SEQ ID NO: 43904 - protein, 15 aa, BK virus
PSKTIWGNPYSFAIF

SEQ ID NO: 43905 - protein, 15 aa, BK virus
SKTIWGNPYSFAIFA

SEQ ID NO: 43906 - protein, 15 aa, BK virus
KTIWGNPYSFAIFAK

SEQ ID NO: 43907 - protein, 16 aa, BK virus
KSCLGKSSLNEKSLFK

SEQ ID NO: 43908 - protein, 16 aa, BK virus
SCLGKSSLNEKSLFKE

SEQ ID NO: 43909 - protein, 16 aa, BK virus
CLGKSSLNEKSLFKEV

SEQ ID NO: 43910 - protein, 16 aa, BK virus
FSSLPRYPVLQGMAYL

SEQ ID NO: 43911 - protein, 16 aa, BK virus
SSLPRYPVLQGMAYLF

SEQ ID NO: 43912 - protein, 16 aa, BK virus
SLPRYPVLQGMAYLFQ

SEQ ID NO: 43913 - protein, 16 aa, BK virus
LPRYPVLQGMAYLFQK

SEQ ID NO: 43914 - protein, 16 aa, BK virus
PRYPVLQGMAYLFQKA

SEQ ID NO: 43915 - protein, 16 aa, BK virus
RYPVLQGMAYLFQKAF

SEQ ID NO: 43916 - protein, 16 aa, BK virus
YPVLQGMAYLFQKAFC

SEQ ID NO: 43917 - protein, 16 aa, BK virus
PVLQGMAYLFQKAFCA

SEQ ID NO: 43918 - protein, 16 aa, BK virus
VLQGMAYLFQKAFCAL

SEQ ID NO: 43919 - protein, 16 aa, BK virus
LQGMAYLFQKAFCALP

SEQ ID NO: 43920 - protein, 16 aa, BK virus
QGMAYLFQKAFCALPL

SEQ ID NO: 43921 - protein, 16 aa, BK virus
GMAYLFQKAFCALPLH

SEQ ID NO: 43922 - protein, 16 aa, BK virus
MAYLFQKAFCALPLHA

SEQ ID NO: 43923 - protein, 16 aa, BK virus
AYLFQKAFCALPLHAM

SEQ ID NO: 43924 - protein, 16 aa, BK virus
YLFQKAFCALPLHAMS

SEQ ID NO: 43925 - protein, 16 aa, BK virus
LFQKAFCALPLHAMSA

SEQ ID NO: 43926 - protein, 16 aa, BK virus
KIFKKRALGLDRLLLH

SEQ ID NO: 43927 - protein, 16 aa, BK virus
RNSAMVGPNNWRNSLQ

SEQ ID NO: 43928 - protein, 16 aa, BK virus
NSAMVGPNNWRNSLQR

SEQ ID NO: 43929 - protein, 16 aa, BK virus
SAMVGPNNWRNSLQRS

SEQ ID NO: 43930 - protein, 16 aa, BK virus
AMVGPNNWRNSLQRSK

SEQ ID NO: 43931 - protein, 16 aa, BK virus
MVGPNNWRNSLQRSKA

SEQ ID NO: 43932 - protein, 16 aa, BK virus
VGPNNWRNSLQRSKAL

SEQ ID NO: 43933 - protein, 16 aa, BK virus
GPNNWRNSLQRSKALR

SEQ ID NO: 43934 - protein, 16 aa, BK virus
VPTYGTEEWESWWSSF

SEQ ID NO: 43935 - protein, 16 aa, BK virus
PTYGTEEWESWWSSFN

SEQ ID NO: 43936 - protein, 16 aa, BK virus
TYGTEEWESWWSSFNE

SEQ ID NO: 43937 - protein, 16 aa, BK virus
YGTEEWESWWSSFNEK

SEQ ID NO: 43938 - protein, 16 aa, BK virus
GTEEWESWWSSFNEKW

SEQ ID NO: 43939 - protein, 16 aa, BK virus
TEEWESWWSSFNEKWD

SEQ ID NO: 43940 - protein, 16 aa, BK virus
EEWESWWSSFNEKWDE

SEQ ID NO: 43941 - protein, 16 aa, BK virus
EWESWWSSFNEKWDED

SEQ ID NO: 43942 - protein, 16 aa, BK virus
WESWWSSFNEKWDEDL

SEQ ID NO: 43943 - protein, 16 aa, BK virus
ESWWSSFNEKWDEDLF

SEQ ID NO: 43944 - protein, 16 aa, BK virus
SWWSSFNEKWDEDLFC

SEQ ID NO: 43945 - protein, 16 aa, BK virus
WWSSFNEKWDEDLFCH

SEQ ID NO: 43946 - protein, 16 aa, BK virus
WSSFNEKWDEDLFCHE

SEQ ID NO: 43947 - protein, 16 aa, BK virus
SSFNEKWDEDLFCHED

SEQ ID NO: 43948 - protein, 16 aa, BK virus
SFNEKWDEDLFCHEDM

SEQ ID NO: 43949 - protein, 16 aa, BK virus
FNEKWDEDLFCHEDMF

SEQ ID NO: 43950 - protein, 16 aa, BK virus
NEKWDEDLFCHEDMFA

SEQ ID NO: 43951 - protein, 16 aa, BK virus
EKWDEDLFCHEDMFAS

SEQ ID NO: 43952 - protein, 16 aa, BK virus
KWDEDLFCHEDMFASD

SEQ ID NO: 43953 - protein, 16 aa, BK virus
WDEDLFCHEDMFASDE

SEQ ID NO: 43954 - protein, 16 aa, BK virus
DEDLFCHEDMFASDEE

SEQ ID NO: 43955 - protein, 16 aa, BK virus
EDLFCHEDMFASDEEA

SEQ ID NO: 43956 - protein, 16 aa, BK virus
DLFCHEDMFASDEEAT

SEQ ID NO: 43957 - protein, 16 aa, BK virus
LFCHEDMFASDEEATA

SEQ ID NO: 43958 - protein, 16 aa, BK virus
FCHEDMFASDEEATAD

SEQ ID NO: 43959 - protein, 16 aa, BK virus
CHEDMFASDEEATADS

SEQ ID NO: 43960 - protein, 16 aa, BK virus
HEDMFASDEEATADSQ

SEQ ID NO: 43961 - protein, 16 aa, BK virus
EDMFASDEEATADSQH

SEQ ID NO: 43962 - protein, 16 aa, BK virus
DMFASDEEATADSQHS

SEQ ID NO: 43963 - protein, 16 aa, BK virus
MFASDEEATADSQHST

SEQ ID NO: 43964 - protein, 16 aa, BK virus
FASDEEATADSQHSTP

SEQ ID NO: 43965 - protein, 16 aa, BK virus
ASDEEATADSQHSTPP

SEQ ID NO: 43966 - protein, 16 aa, BK virus
SDEEATADSQHSTPPK

SEQ ID NO: 43967 - protein, 16 aa, BK virus
DEEATADSQHSTPPKK

SEQ ID NO: 43968 - protein, 16 aa, BK virus
EEATADSQHSTPPKKK

SEQ ID NO: 43969 - protein, 16 aa, BK virus
EATADSQHSTPPKKKR

SEQ ID NO: 43970 - protein, 16 aa, BK virus
ATADSQHSTPPKKKRK

SEQ ID NO: 43971 - protein, 16 aa, BK virus
TADSQHSTPPKKKRKV

SEQ ID NO: 43972 - protein, 16 aa, BK virus
ADSQHSTPPKKKRKVE

SEQ ID NO: 43973 - protein, 16 aa, BK virus
DSQHSTPPKKKRKVED

SEQ ID NO: 43974 - protein, 16 aa, BK virus
SQHSTPPKKKRKVEDP

SEQ ID NO: 43975 - protein, 16 aa, BK virus
QHSTPPKKKRKVEDPK

SEQ ID NO: 43976 - protein, 16 aa, BK virus
HSTPPKKKRKVEDPKD

SEQ ID NO: 43977 - protein, 16 aa, BK virus
STPPKKKRKVEDPKDF

SEQ ID NO: 43978 - protein, 16 aa, BK virus
TPPKKKRKVEDPKDFP

SEQ ID NO: 43979 - protein, 16 aa, BK virus
PPKKKRKVEDPKDFPS

SEQ ID NO: 43980 - protein, 16 aa, BK virus
PKKKRKVEDPKDFPSD

SEQ ID NO: 43981 - protein, 16 aa, BK virus
KKKRKVEDPKDFPSDL

SEQ ID NO: 43982 - protein, 16 aa, BK virus
KKRKVEDPKDFPSDLH

SEQ ID NO: 43983 - protein, 16 aa, BK virus
KRKVEDPKDFPSDLHQ

SEQ ID NO: 43984 - protein, 16 aa, BK virus
RKVEDPKDFPSDLHQF

SEQ ID NO: 43985 - protein, 16 aa, BK virus
KVEDPKDFPSDLHQFL

SEQ ID NO: 43986 - protein, 16 aa, BK virus
VEDPKDFPSDLHQFLS

SEQ ID NO: 43987 - protein, 16 aa, BK virus
EDPKDFPSDLHQFLSQ

SEQ ID NO: 43988 - protein, 16 aa, BK virus
DPKDFPSDLHQFLSQA

SEQ ID NO: 43989 - protein, 16 aa, BK virus
PKDFPSDLHQFLSQAV

SEQ ID NO: 43990 - protein, 16 aa, BK virus
KDFPSDLHQFLSQAVF

SEQ ID NO: 43991 - protein, 16 aa, BK virus
DFPSDLHQFLSQAVFS

SEQ ID NO: 43992 - protein, 16 aa, BK virus
FPSDLHQFLSQAVFSN

SEQ ID NO: 43993 - protein, 16 aa, BK virus
PSDLHQFLSQAVFSNR

SEQ ID NO: 43994 - protein, 16 aa, BK virus
SDLHQFLSQAVFSNRT

SEQ ID NO: 43995 - protein, 16 aa, BK virus
DLHQFLSQAVFSNRTL

SEQ ID NO: 43996 - protein, 16 aa, BK virus
LHQFLSQAVFSNRTLA

SEQ ID NO: 43997 - protein, 16 aa, BK virus
HQFLSQAVFSNRTLAC

SEQ ID NO: 43998 - protein, 16 aa, BK virus
QFLSQAVFSNRTLACF

SEQ ID NO: 43999 - protein, 16 aa, BK virus
FLSQAVFSNRTLACFA

SEQ ID NO: 44000 - protein, 16 aa, BK virus
LSQAVFSNRTLACFAV

SEQ ID NO: 44001 - protein, 16 aa, BK virus
SQAVFSNRTLACFAVY

SEQ ID NO: 44002 - protein, 16 aa, BK virus
QAVFSNRTLACFAVYT

SEQ ID NO: 44003 - protein, 16 aa, BK virus
AVFSNRTLACFAVYTT

SEQ ID NO: 44004 - protein, 16 aa, BK virus
VFSNRTLACFAVYTTK

SEQ ID NO: 44005 - protein, 16 aa, BK virus
FSNRTLACFAVYTTKE

SEQ ID NO: 44006 - protein, 16 aa, BK virus
SNRTLACFAVYTTKEK

SEQ ID NO: 44007 - protein, 16 aa, BK virus
NRTLACFAVYTTKEKA

SEQ ID NO: 44008 - protein, 16 aa, BK virus
RTLACFAVYTTKEKAQ

SEQ ID NO: 44009 - protein, 16 aa, BK virus
TLACFAVYTTKEKAQI

SEQ ID NO: 44010 - protein, 16 aa, BK virus
LACFAVYTTKEKAQIL

SEQ ID NO: 44011 - protein, 16 aa, BK virus
ACFAVYTTKEKAQILY

SEQ ID NO: 44012 - protein, 16 aa, BK virus
CFAVYTTKEKAQILYK

SEQ ID NO: 44013 - protein, 16 aa, BK virus
FAVYTTKEKAQILYKK

SEQ ID NO: 44014 - protein, 16 aa, BK virus
AVYTTKEKAQILYKKL

SEQ ID NO: 44015 - protein, 16 aa, BK virus
VYTTKEKAQILYKKLM

SEQ ID NO: 44016 - protein, 16 aa, BK virus
YTTKEKAQILYKKLME

SEQ ID NO: 44017 - protein, 16 aa, BK virus
TTKEKAQILYKKLMEK

SEQ ID NO: 44018 - protein, 16 aa, BK virus
TKEKAQILYKKLMEKY

SEQ ID NO: 44019 - protein, 16 aa, BK virus
KEKAQILYKKLMEKYS

SEQ ID NO: 44020 - protein, 16 aa, BK virus
EKAQILYKKLMEKYSV

SEQ ID NO: 44021 - protein, 16 aa, BK virus
KAQILYKKLMEKYSVT

SEQ ID NO: 44022 - protein, 16 aa, BK virus
AQILYKKLMEKYSVTF

SEQ ID NO: 44023 - protein, 16 aa, BK virus
QILYKKLMEKYSVTFI

SEQ ID NO: 44024 - protein, 16 aa, BK virus
ILYKKLMEKYSVTFIS

SEQ ID NO: 44025 - protein, 16 aa, BK virus
LYKKLMEKYSVTFISR

SEQ ID NO: 44026 - protein, 16 aa, BK virus
YKKLMEKYSVTFISRH

SEQ ID NO: 44027 - protein, 16 aa, BK virus
KKLMEKYSVTFISRHM

SEQ ID NO: 44028 - protein, 16 aa, BK virus
KLMEKYSVTFISRHMC

SEQ ID NO: 44029 - protein, 16 aa, BK virus
LMEKYSVTFISRHMCA

SEQ ID NO: 44030 - protein, 16 aa, BK virus
MEKYSVTFISRHMCAG

SEQ ID NO: 44031 - protein, 16 aa, BK virus
EKYSVTFISRHMCAGH

SEQ ID NO: 44032 - protein, 16 aa, BK virus
KYSVTFISRHMCAGHN

SEQ ID NO: 44033 - protein, 16 aa, BK virus
YSVTFISRHMCAGHNI

SEQ ID NO: 44034 - protein, 16 aa, BK virus
SVTFISRHMCAGHNII

SEQ ID NO: 44035 - protein, 16 aa, BK virus
VTFISRHMCAGHNIIF

SEQ ID NO: 44036 - protein, 16 aa, BK virus
TFISRHMCAGHNIIFF

SEQ ID NO: 44037 - protein, 16 aa, BK virus
FISRHMCAGHNIIFFL

SEQ ID NO: 44038 - protein, 16 aa, BK virus
ISRHMCAGHNIIFFLT

SEQ ID NO: 44039 - protein, 16 aa, BK virus
SRHMCAGHNIIFFLTP

SEQ ID NO: 44040 - protein, 16 aa, BK virus
RHMCAGHNIIFFLTPH

SEQ ID NO: 44041 - protein, 16 aa, BK virus
HMCAGHNIIFFLTPHR

SEQ ID NO: 44042 - protein, 16 aa, BK virus
MCAGHNIIFFLTPHRH

SEQ ID NO: 44043 - protein, 16 aa, BK virus
CAGHNIIFFLTPHRHR

SEQ ID NO: 44044 - protein, 16 aa, BK virus
AGHNIIFFLTPHRHRV

SEQ ID NO: 44045 - protein, 16 aa, BK virus
GHNIIFFLTPHRHRVS

SEQ ID NO: 44046 - protein, 16 aa, BK virus
HNIIFFLTPHRHRVSA

SEQ ID NO: 44047 - protein, 16 aa, BK virus
NIIFFLTPHRHRVSAI

SEQ ID NO: 44048 - protein, 16 aa, BK virus
IIFFLTPHRHRVSAIN

SEQ ID NO: 44049 - protein, 16 aa, BK virus
IFFLTPHRHRVSAINN

SEQ ID NO: 44050 - protein, 16 aa, BK virus
FFLTPHRHRVSAINNF

SEQ ID NO: 44051 - protein, 16 aa, BK virus
FLTPHRHRVSAINNFC

SEQ ID NO: 44052 - protein, 16 aa, BK virus
LTPHRHRVSAINNFCQ

SEQ ID NO: 44053 - protein, 16 aa, BK virus
TPHRHRVSAINNFCQK

SEQ ID NO: 44054 - protein, 16 aa, BK virus
PHRHRVSAINNFCQKL

SEQ ID NO: 44055 - protein, 16 aa, BK virus
HRHRVSAINNFCQKLC

SEQ ID NO: 44056 - protein, 16 aa, BK virus
RHRVSAINNFCQKLCT

SEQ ID NO: 44057 - protein, 16 aa, BK virus
HRVSAINNFCQKLCTF

SEQ ID NO: 44058 - protein, 16 aa, BK virus
RVSAINNFCQKLCTFS

SEQ ID NO: 44059 - protein, 16 aa, BK virus
VSAINNFCQKLCTFSF

SEQ ID NO: 44060 - protein, 16 aa, BK virus
SAINNFCQKLCTFSFL

SEQ ID NO: 44061 - protein, 16 aa, BK virus
AINNFCQKLCTFSFLI

SEQ ID NO: 44062 - protein, 16 aa, BK virus
INNFCQKLCTFSFLIC

SEQ ID NO: 44063 - protein, 16 aa, BK virus
NNFCQKLCTFSFLICK

SEQ ID NO: 44064 - protein, 16 aa, BK virus
NFCQKLCTFSFLICKG

SEQ ID NO: 44065 - protein, 16 aa, BK virus
FCQKLCTFSFLICKGV

SEQ ID NO: 44066 - protein, 16 aa, BK virus
CQKLCTFSFLICKGVN

SEQ ID NO: 44067 - protein, 16 aa, BK virus
QKLCTFSFLICKGVNK

SEQ ID NO: 44068 - protein, 16 aa, BK virus
KLCTFSFLICKGVNKE

SEQ ID NO: 44069 - protein, 16 aa, BK virus
LCTFSFLICKGVNKEY

SEQ ID NO: 44070 - protein, 16 aa, BK virus
CTFSFLICKGVNKEYL

SEQ ID NO: 44071 - protein, 16 aa, BK virus
TFSFLICKGVNKEYLL

SEQ ID NO: 44072 - protein, 16 aa, BK virus
FSFLICKGVNKEYLLY

SEQ ID NO: 44073 - protein, 16 aa, BK virus
SFLICKGVNKEYLLYS

SEQ ID NO: 44074 - protein, 16 aa, BK virus
FLICKGVNKEYLLYSA

SEQ ID NO: 44075 - protein, 16 aa, BK virus
LICKGVNKEYLLYSAL

SEQ ID NO: 44076 - protein, 16 aa, BK virus
ICKGVNKEYLLYSALT

SEQ ID NO: 44077 - protein, 16 aa, BK virus
CKGVNKEYLLYSALTR

SEQ ID NO: 44078 - protein, 16 aa, BK virus
KGVNKEYLLYSALTRD

SEQ ID NO: 44079 - protein, 16 aa, BK virus
GVNKEYLLYSALTRDP

SEQ ID NO: 44080 - protein, 16 aa, BK virus
VNKEYLLYSALTRDPY

SEQ ID NO: 44081 - protein, 16 aa, BK virus
NKEYLLYSALTRDPYH

SEQ ID NO: 44082 - protein, 16 aa, BK virus
KEYLLYSALTRDPYHT

SEQ ID NO: 44083 - protein, 16 aa, BK virus
EYLLYSALTRDPYHTI

SEQ ID NO: 44084 - protein, 16 aa, BK virus
YLLYSALTRDPYHTIE

SEQ ID NO: 44085 - protein, 16 aa, BK virus
LLYSALTRDPYHTIEE

SEQ ID NO: 44086 - protein, 16 aa, BK virus
LYSALTRDPYHTIEES

SEQ ID NO: 44087 - protein, 16 aa, BK virus
YSALTRDPYHTIEESI

SEQ ID NO: 44088 - protein, 16 aa, BK virus
SALTRDPYHTIEESIQ

SEQ ID NO: 44089 - protein, 16 aa, BK virus
ALTRDPYHTIEESIQG

SEQ ID NO: 44090 - protein, 16 aa, BK virus
LTRDPYHTIEESIQGG

SEQ ID NO: 44091 - protein, 16 aa, BK virus
TRDPYHTIEESIQGGL

SEQ ID NO: 44092 - protein, 16 aa, BK virus
RDPYHTIEESIQGGLK

SEQ ID NO: 44093 - protein, 16 aa, BK virus
DPYHTIEESIQGGLKE

SEQ ID NO: 44094 - protein, 16 aa, BK virus
PYHTIEESIQGGLKEH

SEQ ID NO: 44095 - protein, 16 aa, BK virus
YHTIEESIQGGLKEHD

SEQ ID NO: 44096 - protein, 16 aa, BK virus
HTIEESIQGGLKEHDF

SEQ ID NO: 44097 - protein, 16 aa, BK virus
TIEESIQGGLKEHDFS

SEQ ID NO: 44098 - protein, 16 aa, BK virus
IEESIQGGLKEHDFSP

SEQ ID NO: 44099 - protein, 16 aa, BK virus
EESIQGGLKEHDFSPE

SEQ ID NO: 44100 - protein, 16 aa, BK virus
ESIQGGLKEHDFSPEE

SEQ ID NO: 44101 - protein, 16 aa, BK virus
SIQGGLKEHDFSPEEP

SEQ ID NO: 44102 - protein, 16 aa, BK virus
IQGGLKEHDFSPEEPE

SEQ ID NO: 44103 - protein, 16 aa, BK virus
QGGLKEHDFSPEEPEE

SEQ ID NO: 44104 - protein, 16 aa, BK virus
GGLKEHDFSPEEPEET

SEQ ID NO: 44105 - protein, 16 aa, BK virus
GLKEHDFSPEEPEETK

SEQ ID NO: 44106 - protein, 16 aa, BK virus
LKEHDFSPEEPEETKQ

SEQ ID NO: 44107 - protein, 16 aa, BK virus
KEHDFSPEEPEETKQV

SEQ ID NO: 44108 - protein, 16 aa, BK virus
EHDFSPEEPEETKQVS

SEQ ID NO: 44109 - protein, 16 aa, BK virus
HDFSPEEPEETKQVSW

SEQ ID NO: 44110 - protein, 16 aa, BK virus
DFSPEEPEETKQVSWK

SEQ ID NO: 44111 - protein, 16 aa, BK virus
FSPEEPEETKQVSWKL

SEQ ID NO: 44112 - protein, 16 aa, BK virus
SPEEPEETKQVSWKLI

SEQ ID NO: 44113 - protein, 16 aa, BK virus
PEEPEETKQVSWKLIT

SEQ ID NO: 44114 - protein, 16 aa, BK virus
EEPEETKQVSWKLITE

SEQ ID NO: 44115 - protein, 16 aa, BK virus
EPEETKQVSWKLITEY

SEQ ID NO: 44116 - protein, 16 aa, BK virus
PEETKQVSWKLITEYA

SEQ ID NO: 44117 - protein, 16 aa, BK virus
EETKQVSWKLITEYAV

SEQ ID NO: 44118 - protein, 16 aa, BK virus
ETKQVSWKLITEYAVE

SEQ ID NO: 44119 - protein, 16 aa, BK virus
TKQVSWKLITEYAVET

SEQ ID NO: 44120 - protein, 16 aa, BK virus
KQVSWKLITEYAVETK

SEQ ID NO: 44121 - protein, 16 aa, BK virus
QVSWKLITEYAVETKC

SEQ ID NO: 44122 - protein, 16 aa, BK virus
VSWKLITEYAVETKCE

SEQ ID NO: 44123 - protein, 16 aa, BK virus
SWKLITEYAVETKCED

SEQ ID NO: 44124 - protein, 16 aa, BK virus
WKLITEYAVETKCEDV

SEQ ID NO: 44125 - protein, 16 aa, BK virus
KLITEYAVETKCEDVF

SEQ ID NO: 44126 - protein, 16 aa, BK virus
LITEYAVETKCEDVFL

SEQ ID NO: 44127 - protein, 16 aa, BK virus
ITEYAVETKCEDVFLL

SEQ ID NO: 44128 - protein, 16 aa, BK virus
TEYAVETKCEDVFLLL

SEQ ID NO: 44129 - protein, 16 aa, BK virus
EYAVETKCEDVFLLLG

SEQ ID NO: 44130 - protein, 16 aa, BK virus
YAVETKCEDVFLLLGM

SEQ ID NO: 44131 - protein, 16 aa, BK virus
AVETKCEDVFLLLGMY

SEQ ID NO: 44132 - protein, 16 aa, BK virus
VETKCEDVFLLLGMYL

SEQ ID NO: 44133 - protein, 16 aa, BK virus
ETKCEDVFLLLGMYLE

SEQ ID NO: 44134 - protein, 16 aa, BK virus
TKCEDVFLLLGMYLEF

SEQ ID NO: 44135 - protein, 16 aa, BK virus
KCEDVFLLLGMYLEFQ

SEQ ID NO: 44136 - protein, 16 aa, BK virus
CEDVFLLLGMYLEFQY

SEQ ID NO: 44137 - protein, 16 aa, BK virus
EDVFLLLGMYLEFQYN

SEQ ID NO: 44138 - protein, 16 aa, BK virus
DVFLLLGMYLEFQYNV

SEQ ID NO: 44139 - protein, 16 aa, BK virus
VFLLLGMYLEFQYNVE

SEQ ID NO: 44140 - protein, 16 aa, BK virus
FLLLGMYLEFQYNVEE

SEQ ID NO: 44141 - protein, 16 aa, BK virus
LLLGMYLEFQYNVEEC

SEQ ID NO: 44142 - protein, 16 aa, BK virus
LLGMYLEFQYNVEECK

SEQ ID NO: 44143 - protein, 16 aa, BK virus
LGMYLEFQYNVEECKK

SEQ ID NO: 44144 - protein, 16 aa, BK virus
GMYLEFQYNVEECKKC

SEQ ID NO: 44145 - protein, 16 aa, BK virus
MYLEFQYNVEECKKCQ

SEQ ID NO: 44146 - protein, 16 aa, BK virus
YLEFQYNVEECKKCQK

SEQ ID NO: 44147 - protein, 16 aa, BK virus
LEFQYNVEECKKCQKK

SEQ ID NO: 44148 - protein, 16 aa, BK virus
EFQYNVEECKKCQKKD

SEQ ID NO: 44149 - protein, 16 aa, BK virus
FQYNVEECKKCQKKDQ

SEQ ID NO: 44150 - protein, 16 aa, BK virus
QYNVEECKKCQKKDQP

SEQ ID NO: 44151 - protein, 16 aa, BK virus
YNVEECKKCQKKDQPY

SEQ ID NO: 44152 - protein, 16 aa, BK virus
NVEECKKCQKKDQPYH

SEQ ID NO: 44153 - protein, 16 aa, BK virus
VEECKKCQKKDQPYHF

SEQ ID NO: 44154 - protein, 16 aa, BK virus
EECKKCQKKDQPYHFK

SEQ ID NO: 44155 - protein, 16 aa, BK virus
ECKKCQKKDQPYHFKY

SEQ ID NO: 44156 - protein, 16 aa, BK virus
CKKCQKKDQPYHFKYH

SEQ ID NO: 44157 - protein, 16 aa, BK virus
KKCQKKDQPYHFKYHE

SEQ ID NO: 44158 - protein, 16 aa, BK virus
KCQKKDQPYHFKYHEK

SEQ ID NO: 44159 - protein, 16 aa, BK virus
CQKKDQPYHFKYHEKH

SEQ ID NO: 44160 - protein, 16 aa, BK virus
QKKDQPYHFKYHEKHF

SEQ ID NO: 44161 - protein, 16 aa, BK virus
KKDQPYHFKYHEKHFA

SEQ ID NO: 44162 - protein, 16 aa, BK virus
KDQPYHFKYHEKHFAN

SEQ ID NO: 44163 - protein, 16 aa, BK virus
DQPYHFKYHEKHFANA

SEQ ID NO: 44164 - protein, 16 aa, BK virus
QPYHFKYHEKHFANAI

SEQ ID NO: 44165 - protein, 16 aa, BK virus
PYHFKYHEKHFANAII

SEQ ID NO: 44166 - protein, 16 aa, BK virus
YHFKYHEKHFANAIIF

SEQ ID NO: 44167 - protein, 16 aa, BK virus
HFKYHEKHFANAIIFA

SEQ ID NO: 44168 - protein, 16 aa, BK virus
FKYHEKHFANAIIFAE

SEQ ID NO: 44169 - protein, 16 aa, BK virus
KYHEKHFANAIIFAES

SEQ ID NO: 44170 - protein, 16 aa, BK virus
YHEKHFANAIIFAESK

SEQ ID NO: 44171 - protein, 16 aa, BK virus
HEKHFANAIIFAESKN

SEQ ID NO: 44172 - protein, 16 aa, BK virus
EKHFANAIIFAESKNQ

SEQ ID NO: 44173 - protein, 16 aa, BK virus
KHFANAIIFAESKNQK

SEQ ID NO: 44174 - protein, 16 aa, BK virus
HFANAIIFAESKNQKS

SEQ ID NO: 44175 - protein, 16 aa, BK virus
FANAIIFAESKNQKSI

SEQ ID NO: 44176 - protein, 16 aa, BK virus
ANAIIFAESKNQKSIC

SEQ ID NO: 44177 - protein, 16 aa, BK virus
NAIIFAESKNQKSICQ

SEQ ID NO: 44178 - protein, 16 aa, BK virus
AIIFAESKNQKSICQQ

SEQ ID NO: 44179 - protein, 16 aa, BK virus
IIFAESKNQKSICQQA

SEQ ID NO: 44180 - protein, 16 aa, BK virus
IFAESKNQKSICQQAV

SEQ ID NO: 44181 - protein, 16 aa, BK virus
FAESKNQKSICQQAVD

SEQ ID NO: 44182 - protein, 16 aa, BK virus
AESKNQKSICQQAVDT

SEQ ID NO: 44183 - protein, 16 aa, BK virus
ESKNQKSICQQAVDTV

SEQ ID NO: 44184 - protein, 16 aa, BK virus
SKNQKSICQQAVDTVL

SEQ ID NO: 44185 - protein, 16 aa, BK virus
KNQKSICQQAVDTVLA

SEQ ID NO: 44186 - protein, 16 aa, BK virus
NQKSICQQAVDTVLAK

SEQ ID NO: 44187 - protein, 16 aa, BK virus
QKSICQQAVDTVLAKK

SEQ ID NO: 44188 - protein, 16 aa, BK virus
KSICQQAVDTVLAKKR

SEQ ID NO: 44189 - protein, 16 aa, BK virus
SICQQAVDTVLAKKRV

SEQ ID NO: 44190 - protein, 16 aa, BK virus
ICQQAVDTVLAKKRVD

SEQ ID NO: 44191 - protein, 16 aa, BK virus
CQQAVDTVLAKKRVDT

SEQ ID NO: 44192 - protein, 16 aa, BK virus
QQAVDTVLAKKRVDTL

SEQ ID NO: 44193 - protein, 16 aa, BK virus
QAVDTVLAKKRVDTLH

SEQ ID NO: 44194 - protein, 16 aa, BK virus
AVDTVLAKKRVDTLHM

SEQ ID NO: 44195 - protein, 16 aa, BK virus
VDTVLAKKRVDTLHMT

SEQ ID NO: 44196 - protein, 16 aa, BK virus
DTVLAKKRVDTLHMTR

SEQ ID NO: 44197 - protein, 16 aa, BK virus
TVLAKKRVDTLHMTRE

SEQ ID NO: 44198 - protein, 16 aa, BK virus
VLAKKRVDTLHMTREE

SEQ ID NO: 44199 - protein, 16 aa, BK virus
LAKKRVDTLHMTREEM

SEQ ID NO: 44200 - protein, 16 aa, BK virus
AKKRVDTLHMTREEML

SEQ ID NO: 44201 - protein, 16 aa, BK virus
KKRVDTLHMTREEMLT

SEQ ID NO: 44202 - protein, 16 aa, BK virus
KRVDTLHMTREEMLTE

SEQ ID NO: 44203 - protein, 16 aa, BK virus
RVDTLHMTREEMLTER

SEQ ID NO: 44204 - protein, 16 aa, BK virus
VDTLHMTREEMLTERF

SEQ ID NO: 44205 - protein, 16 aa, BK virus
DTLHMTREEMLTERFN

SEQ ID NO: 44206 - protein, 16 aa, BK virus
TLHMTREEMLTERFNH

SEQ ID NO: 44207 - protein, 16 aa, BK virus
LHMTREEMLTERFNHI

SEQ ID NO: 44208 - protein, 16 aa, BK virus
HMTREEMLTERFNHIL

SEQ ID NO: 44209 - protein, 16 aa, BK virus
MTREEMLTERFNHILD

SEQ ID NO: 44210 - protein, 16 aa, BK virus
TREEMLTERFNHILDK

SEQ ID NO: 44211 - protein, 16 aa, BK virus
REEMLTERFNHILDKM

SEQ ID NO: 44212 - protein, 16 aa, BK virus
EEMLTERFNHILDKMD

SEQ ID NO: 44213 - protein, 16 aa, BK virus
EMLTERFNHILDKMDL

SEQ ID NO: 44214 - protein, 16 aa, BK virus
MLTERFNHILDKMDLI

SEQ ID NO: 44215 - protein, 16 aa, BK virus
LTERFNHILDKMDLIF

SEQ ID NO: 44216 - protein, 16 aa, BK virus
TERFNHILDKMDLIFG

SEQ ID NO: 44217 - protein, 16 aa, BK virus
ERFNHILDKMDLIFGA

SEQ ID NO: 44218 - protein, 16 aa, BK virus
RFNHILDKMDLIFGAH

SEQ ID NO: 44219 - protein, 16 aa, BK virus
FNHILDKMDLIFGAHG

SEQ ID NO: 44220 - protein, 16 aa, BK virus
NHILDKMDLIFGAHGN

SEQ ID NO: 44221 - protein, 16 aa, BK virus
HILDKMDLIFGAHGNA

SEQ ID NO: 44222 - protein, 16 aa, BK virus
ILDKMDLIFGAHGNAV

SEQ ID NO: 44223 - protein, 16 aa, BK virus
LDKMDLIFGAHGNAVL

SEQ ID NO: 44224 - protein, 16 aa, BK virus
DKMDLIFGAHGNAVLE

SEQ ID NO: 44225 - protein, 16 aa, BK virus
KMDLIFGAHGNAVLEQ

SEQ ID NO: 44226 - protein, 16 aa, BK virus
MDLIFGAHGNAVLEQY

SEQ ID NO: 44227 - protein, 16 aa, BK virus
DLIFGAHGNAVLEQYM

SEQ ID NO: 44228 - protein, 16 aa, BK virus
LIFGAHGNAVLEQYMA

SEQ ID NO: 44229 - protein, 16 aa, BK virus
IFGAHGNAVLEQYMAG

SEQ ID NO: 44230 - protein, 16 aa, BK virus
FGAHGNAVLEQYMAGV

SEQ ID NO: 44231 - protein, 16 aa, BK virus
GAHGNAVLEQYMAGVA

SEQ ID NO: 44232 - protein, 16 aa, BK virus
AHGNAVLEQYMAGVAW

SEQ ID NO: 44233 - protein, 16 aa, BK virus
HGNAVLEQYMAGVAWL

SEQ ID NO: 44234 - protein, 16 aa, BK virus
GNAVLEQYMAGVAWLH

SEQ ID NO: 44235 - protein, 16 aa, BK virus
NAVLEQYMAGVAWLHC

SEQ ID NO: 44236 - protein, 16 aa, BK virus
AVLEQYMAGVAWLHCL

SEQ ID NO: 44237 - protein, 16 aa, BK virus
VLEQYMAGVAWLHCLL

SEQ ID NO: 44238 - protein, 16 aa, BK virus
LEQYMAGVAWLHCLLP

SEQ ID NO: 44239 - protein, 16 aa, BK virus
EQYMAGVAWLHCLLPK

SEQ ID NO: 44240 - protein, 16 aa, BK virus
QYMAGVAWLHCLLPKM

SEQ ID NO: 44241 - protein, 16 aa, BK virus
YMAGVAWLHCLLPKMD

SEQ ID NO: 44242 - protein, 16 aa, BK virus
MAGVAWLHCLLPKMDS

SEQ ID NO: 44243 - protein, 16 aa, BK virus
AGVAWLHCLLPKMDSV

SEQ ID NO: 44244 - protein, 16 aa, BK virus
GVAWLHCLLPKMDSVI

SEQ ID NO: 44245 - protein, 16 aa, BK virus
VAWLHCLLPKMDSVIF

SEQ ID NO: 44246 - protein, 16 aa, BK virus
AWLHCLLPKMDSVIFD

SEQ ID NO: 44247 - protein, 16 aa, BK virus
WLHCLLPKMDSVIFDF

SEQ ID NO: 44248 - protein, 16 aa, BK virus
LHCLLPKMDSVIFDFL

SEQ ID NO: 44249 - protein, 16 aa, BK virus
HCLLPKMDSVIFDFLH

SEQ ID NO: 44250 - protein, 16 aa, BK virus
CLLPKMDSVIFDFLHC

SEQ ID NO: 44251 - protein, 16 aa, BK virus
LLPKMDSVIFDFLHCI

SEQ ID NO: 44252 - protein, 16 aa, BK virus
LPKMDSVIFDFLHCIV

SEQ ID NO: 44253 - protein, 16 aa, BK virus
PKMDSVIFDFLHCIVF

SEQ ID NO: 44254 - protein, 16 aa, BK virus
KMDSVIFDFLHCIVFN

SEQ ID NO: 44255 - protein, 16 aa, BK virus
MDSVIFDFLHCIVFNV

SEQ ID NO: 44256 - protein, 16 aa, BK virus
DSVIFDFLHCIVFNVP

SEQ ID NO: 44257 - protein, 16 aa, BK virus
SVIFDFLHCIVFNVPK

SEQ ID NO: 44258 - protein, 16 aa, BK virus
VIFDFLHCIVFNVPKR

SEQ ID NO: 44259 - protein, 16 aa, BK virus
IFDFLHCIVFNVPKRR

SEQ ID NO: 44260 - protein, 16 aa, BK virus
FDFLHCIVFNVPKRRY

SEQ ID NO: 44261 - protein, 16 aa, BK virus
DFLHCIVFNVPKRRYW

SEQ ID NO: 44262 - protein, 16 aa, BK virus
FLHCIVFNVPKRRYWL

SEQ ID NO: 44263 - protein, 16 aa, BK virus
LHCIVFNVPKRRYWLF

SEQ ID NO: 44264 - protein, 16 aa, BK virus
HCIVFNVPKRRYWLFK

SEQ ID NO: 44265 - protein, 16 aa, BK virus
CIVFNVPKRRYWLFKG

SEQ ID NO: 44266 - protein, 16 aa, BK virus
IVFNVPKRRYWLFKGP

SEQ ID NO: 44267 - protein, 16 aa, BK virus
VFNVPKRRYWLFKGPI

SEQ ID NO: 44268 - protein, 16 aa, BK virus
FNVPKRRYWLFKGPID

SEQ ID NO: 44269 - protein, 16 aa, BK virus
NVPKRRYWLFKGPIDS

SEQ ID NO: 44270 - protein, 16 aa, BK virus
VPKRRYWLFKGPIDSG

SEQ ID NO: 44271 - protein, 16 aa, BK virus
PKRRYWLFKGPIDSGK

SEQ ID NO: 44272 - protein, 16 aa, BK virus
KRRYWLFKGPIDSGKT

SEQ ID NO: 44273 - protein, 16 aa, BK virus
RRYWLFKGPIDSGKTT

SEQ ID NO: 44274 - protein, 16 aa, BK virus
RYWLFKGPIDSGKTTL

SEQ ID NO: 44275 - protein, 16 aa, BK virus
YWLFKGPIDSGKTTLA

SEQ ID NO: 44276 - protein, 16 aa, BK virus
WLFKGPIDSGKTTLAA

SEQ ID NO: 44277 - protein, 16 aa, BK virus
LFKGPIDSGKTTLAAG

SEQ ID NO: 44278 - protein, 16 aa, BK virus
FKGPIDSGKTTLAAGL

SEQ ID NO: 44279 - protein, 16 aa, BK virus
KGPIDSGKTTLAAGLL

SEQ ID NO: 44280 - protein, 16 aa, BK virus
GPIDSGKTTLAAGLLD

SEQ ID NO: 44281 - protein, 16 aa, BK virus
PIDSGKTTLAAGLLDL

SEQ ID NO: 44282 - protein, 16 aa, BK virus
IDSGKTTLAAGLLDLC

SEQ ID NO: 44283 - protein, 16 aa, BK virus
DSGKTTLAAGLLDLCG

SEQ ID NO: 44284 - protein, 16 aa, BK virus
SGKTTLAAGLLDLCGG

SEQ ID NO: 44285 - protein, 16 aa, BK virus
GKTTLAAGLLDLCGGK

SEQ ID NO: 44286 - protein, 16 aa, BK virus
KTTLAAGLLDLCGGKA

SEQ ID NO: 44287 - protein, 16 aa, BK virus
TTLAAGLLDLCGGKAL

SEQ ID NO: 44288 - protein, 16 aa, BK virus
TLAAGLLDLCGGKALN

SEQ ID NO: 44289 - protein, 16 aa, BK virus
LAAGLLDLCGGKALNV

SEQ ID NO: 44290 - protein, 16 aa, BK virus
AAGLLDLCGGKALNVN

SEQ ID NO: 44291 - protein, 16 aa, BK virus
AGLLDLCGGKALNVNL

SEQ ID NO: 44292 - protein, 16 aa, BK virus
GLLDLCGGKALNVNLP

SEQ ID NO: 44293 - protein, 16 aa, BK virus
LLDLCGGKALNVNLPM

SEQ ID NO: 44294 - protein, 16 aa, BK virus
LDLCGGKALNVNLPME

SEQ ID NO: 44295 - protein, 16 aa, BK virus
DLCGGKALNVNLPMER

SEQ ID NO: 44296 - protein, 16 aa, BK virus
LCGGKALNVNLPMERL

SEQ ID NO: 44297 - protein, 16 aa, BK virus
CGGKALNVNLPMERLT

SEQ ID NO: 44298 - protein, 16 aa, BK virus
GGKALNVNLPMERLTF

SEQ ID NO: 44299 - protein, 16 aa, BK virus
GKALNVNLPMERLTFE

SEQ ID NO: 44300 - protein, 16 aa, BK virus
KALNVNLPMERLTFEL

SEQ ID NO: 44301 - protein, 16 aa, BK virus
ALNVNLPMERLTFELG

SEQ ID NO: 44302 - protein, 16 aa, BK virus
LNVNLPMERLTFELGV

SEQ ID NO: 44303 - protein, 16 aa, BK virus
NVNLPMERLTFELGVA

SEQ ID NO: 44304 - protein, 16 aa, BK virus
VNLPMERLTFELGVAI

SEQ ID NO: 44305 - protein, 16 aa, BK virus
NLPMERLTFELGVAID

SEQ ID NO: 44306 - protein, 16 aa, BK virus
LPMERLTFELGVAIDQ

SEQ ID NO: 44307 - protein, 16 aa, BK virus
PMERLTFELGVAIDQY

SEQ ID NO: 44308 - protein, 16 aa, BK virus
MERLTFELGVAIDQYM

SEQ ID NO: 44309 - protein, 16 aa, BK virus
ERLTFELGVAIDQYMV

SEQ ID NO: 44310 - protein, 16 aa, BK virus
RLTFELGVAIDQYMVV

SEQ ID NO: 44311 - protein, 16 aa, BK virus
LTFELGVAIDQYMVVF

SEQ ID NO: 44312 - protein, 16 aa, BK virus
TFELGVAIDQYMVVFE

SEQ ID NO: 44313 - protein, 16 aa, BK virus
FELGVAIDQYMVVFED

SEQ ID NO: 44314 - protein, 16 aa, BK virus
ELGVAIDQYMVVFEDV

SEQ ID NO: 44315 - protein, 16 aa, BK virus
LGVAIDQYMVVFEDVK

SEQ ID NO: 44316 - protein, 16 aa, BK virus
GVAIDQYMVVFEDVKG

SEQ ID NO: 44317 - protein, 16 aa, BK virus
VAIDQYMVVFEDVKGT

SEQ ID NO: 44318 - protein, 16 aa, BK virus
AIDQYMVVFEDVKGTG

SEQ ID NO: 44319 - protein, 16 aa, BK virus
IDQYMVVFEDVKGTGA

SEQ ID NO: 44320 - protein, 16 aa, BK virus
DQYMVVFEDVKGTGAE

SEQ ID NO: 44321 - protein, 16 aa, BK virus
QYMVVFEDVKGTGAES

SEQ ID NO: 44322 - protein, 16 aa, BK virus
YMVVFEDVKGTGAESK

SEQ ID NO: 44323 - protein, 16 aa, BK virus
MVVFEDVKGTGAESKD

SEQ ID NO: 44324 - protein, 16 aa, BK virus
VVFEDVKGTGAESKDL

SEQ ID NO: 44325 - protein, 16 aa, BK virus
VFEDVKGTGAESKDLP

SEQ ID NO: 44326 - protein, 16 aa, BK virus
FEDVKGTGAESKDLPS

SEQ ID NO: 44327 - protein, 16 aa, BK virus
EDVKGTGAESKDLPSG

SEQ ID NO: 44328 - protein, 16 aa, BK virus
DVKGTGAESKDLPSGH

SEQ ID NO: 44329 - protein, 16 aa, BK virus
VKGTGAESKDLPSGHG

SEQ ID NO: 44330 - protein, 16 aa, BK virus
KGTGAESKDLPSGHGI

SEQ ID NO: 44331 - protein, 16 aa, BK virus
GTGAESKDLPSGHGIN

SEQ ID NO: 44332 - protein, 16 aa, BK virus
TGAESKDLPSGHGINN

SEQ ID NO: 44333 - protein, 16 aa, BK virus
GAESKDLPSGHGINNL

SEQ ID NO: 44334 - protein, 16 aa, BK virus
AESKDLPSGHGINNLD

SEQ ID NO: 44335 - protein, 16 aa, BK virus
ESKDLPSGHGINNLDS

SEQ ID NO: 44336 - protein, 16 aa, BK virus
SKDLPSGHGINNLDSL

SEQ ID NO: 44337 - protein, 16 aa, BK virus
KDLPSGHGINNLDSLR

SEQ ID NO: 44338 - protein, 16 aa, BK virus
DLPSGHGINNLDSLRD

SEQ ID NO: 44339 - protein, 16 aa, BK virus
LPSGHGINNLDSLRDY

SEQ ID NO: 44340 - protein, 16 aa, BK virus
PSGHGINNLDSLRDYL

SEQ ID NO: 44341 - protein, 16 aa, BK virus
SGHGINNLDSLRDYLD

SEQ ID NO: 44342 - protein, 16 aa, BK virus
GHGINNLDSLRDYLDG

SEQ ID NO: 44343 - protein, 16 aa, BK virus
HGINNLDSLRDYLDGS

SEQ ID NO: 44344 - protein, 16 aa, BK virus
GINNLDSLRDYLDGSV

SEQ ID NO: 44345 - protein, 16 aa, BK virus
INNLDSLRDYLDGSVK

SEQ ID NO: 44346 - protein, 16 aa, BK virus
NNLDSLRDYLDGSVKV

SEQ ID NO: 44347 - protein, 16 aa, BK virus
NLDSLRDYLDGSVKVN

SEQ ID NO: 44348 - protein, 16 aa, BK virus
LDSLRDYLDGSVKVNL

SEQ ID NO: 44349 - protein, 16 aa, BK virus
DSLRDYLDGSVKVNLE

SEQ ID NO: 44350 - protein, 16 aa, BK virus
SLRDYLDGSVKVNLEK

SEQ ID NO: 44351 - protein, 16 aa, BK virus
LRDYLDGSVKVNLEKK

SEQ ID NO: 44352 - protein, 16 aa, BK virus
RDYLDGSVKVNLEKKH

SEQ ID NO: 44353 - protein, 16 aa, BK virus
DYLDGSVKVNLEKKHL

SEQ ID NO: 44354 - protein, 16 aa, BK virus
YLDGSVKVNLEKKHLN

SEQ ID NO: 44355 - protein, 16 aa, BK virus
LDGSVKVNLEKKHLNK

SEQ ID NO: 44356 - protein, 16 aa, BK virus
DGSVKVNLEKKHLNKR

SEQ ID NO: 44357 - protein, 16 aa, BK virus
GSVKVNLEKKHLNKRT

SEQ ID NO: 44358 - protein, 16 aa, BK virus
SVKVNLEKKHLNKRTQ

SEQ ID NO: 44359 - protein, 16 aa, BK virus
VKVNLEKKHLNKRTQI

SEQ ID NO: 44360 - protein, 16 aa, BK virus
KVNLEKKHLNKRTQIF

SEQ ID NO: 44361 - protein, 16 aa, BK virus
VNLEKKHLNKRTQIFP

SEQ ID NO: 44362 - protein, 16 aa, BK virus
NLEKKHLNKRTQIFPP

SEQ ID NO: 44363 - protein, 16 aa, BK virus
LEKKHLNKRTQIFPPG

SEQ ID NO: 44364 - protein, 16 aa, BK virus
EKKHLNKRTQIFPPGL

SEQ ID NO: 44365 - protein, 16 aa, BK virus
KKHLNKRTQIFPPGLV

SEQ ID NO: 44366 - protein, 16 aa, BK virus
KHLNKRTQIFPPGLVT

SEQ ID NO: 44367 - protein, 16 aa, BK virus
HLNKRTQIFPPGLVTM

SEQ ID NO: 44368 - protein, 16 aa, BK virus
LNKRTQIFPPGLVTMN

SEQ ID NO: 44369 - protein, 16 aa, BK virus
NKRTQIFPPGLVTMNE

SEQ ID NO: 44370 - protein, 16 aa, BK virus
KRTQIFPPGLVTMNEY

SEQ ID NO: 44371 - protein, 16 aa, BK virus
RTQIFPPGLVTMNEYP

SEQ ID NO: 44372 - protein, 16 aa, BK virus
TQIFPPGLVTMNEYPV

SEQ ID NO: 44373 - protein, 16 aa, BK virus
QIFPPGLVTMNEYPVP

SEQ ID NO: 44374 - protein, 16 aa, BK virus
IFPPGLVTMNEYPVPK

SEQ ID NO: 44375 - protein, 16 aa, BK virus
FPPGLVTMNEYPVPKT

SEQ ID NO: 44376 - protein, 16 aa, BK virus
PPGLVTMNEYPVPKTL

SEQ ID NO: 44377 - protein, 16 aa, BK virus
PGLVTMNEYPVPKTLQ

SEQ ID NO: 44378 - protein, 16 aa, BK virus
GLVTMNEYPVPKTLQA

SEQ ID NO: 44379 - protein, 16 aa, BK virus
LVTMNEYPVPKTLQAR

SEQ ID NO: 44380 - protein, 16 aa, BK virus
VTMNEYPVPKTLQARF

SEQ ID NO: 44381 - protein, 16 aa, BK virus
TMNEYPVPKTLQARFV

SEQ ID NO: 44382 - protein, 16 aa, BK virus
MNEYPVPKTLQARFVR

SEQ ID NO: 44383 - protein, 16 aa, BK virus
NEYPVPKTLQARFVRQ

SEQ ID NO: 44384 - protein, 16 aa, BK virus
EYPVPKTLQARFVRQI

SEQ ID NO: 44385 - protein, 16 aa, BK virus
YPVPKTLQARFVRQID

SEQ ID NO: 44386 - protein, 16 aa, BK virus
PVPKTLQARFVRQIDF

SEQ ID NO: 44387 - protein, 16 aa, BK virus
VPKTLQARFVRQIDFR

SEQ ID NO: 44388 - protein, 16 aa, BK virus
PKTLQARFVRQIDFRP

SEQ ID NO: 44389 - protein, 16 aa, BK virus
KTLQARFVRQIDFRPK

SEQ ID NO: 44390 - protein, 16 aa, BK virus
TLQARFVRQIDFRPKI

SEQ ID NO: 44391 - protein, 16 aa, BK virus
LQARFVRQIDFRPKIY

SEQ ID NO: 44392 - protein, 16 aa, BK virus
QARFVRQIDFRPKIYL

SEQ ID NO: 44393 - protein, 16 aa, BK virus
ARFVRQIDFRPKIYLR

SEQ ID NO: 44394 - protein, 16 aa, BK virus
RFVRQIDFRPKIYLRK

SEQ ID NO: 44395 - protein, 16 aa, BK virus
FVRQIDFRPKIYLRKS

SEQ ID NO: 44396 - protein, 16 aa, BK virus
VRQIDFRPKIYLRKSL

SEQ ID NO: 44397 - protein, 16 aa, BK virus
RQIDFRPKIYLRKSLQ

SEQ ID NO: 44398 - protein, 16 aa, BK virus
QIDFRPKIYLRKSLQN

SEQ ID NO: 44399 - protein, 16 aa, BK virus
IDFRPKIYLRKSLQNS

SEQ ID NO: 44400 - protein, 16 aa, BK virus
DFRPKIYLRKSLQNSE

SEQ ID NO: 44401 - protein, 16 aa, BK virus
FRPKIYLRKSLQNSEF

SEQ ID NO: 44402 - protein, 16 aa, BK virus
RPKIYLRKSLQNSEFL

SEQ ID NO: 44403 - protein, 16 aa, BK virus
PKIYLRKSLQNSEFLL

SEQ ID NO: 44404 - protein, 16 aa, BK virus
KIYLRKSLQNSEFLLE

SEQ ID NO: 44405 - protein, 16 aa, BK virus
IYLRKSLQNSEFLLEK

SEQ ID NO: 44406 - protein, 16 aa, BK virus
YLRKSLQNSEFLLEKR

SEQ ID NO: 44407 - protein, 16 aa, BK virus
LRKSLQNSEFLLEKRI

SEQ ID NO: 44408 - protein, 16 aa, BK virus
RKSLQNSEFLLEKRIL

SEQ ID NO: 44409 - protein, 16 aa, BK virus
KSLQNSEFLLEKRILQ

SEQ ID NO: 44410 - protein, 16 aa, BK virus
SLQNSEFLLEKRILQS

SEQ ID NO: 44411 - protein, 16 aa, BK virus
LQNSEFLLEKRILQSG

SEQ ID NO: 44412 - protein, 16 aa, BK virus
QNSEFLLEKRILQSGM

SEQ ID NO: 44413 - protein, 16 aa, BK virus
NSEFLLEKRILQSGMT

SEQ ID NO: 44414 - protein, 16 aa, BK virus
SEFLLEKRILQSGMTL

SEQ ID NO: 44415 - protein, 16 aa, BK virus
EFLLEKRILQSGMTLL

SEQ ID NO: 44416 - protein, 16 aa, BK virus
FLLEKRILQSGMTLLL

SEQ ID NO: 44417 - protein, 16 aa, BK virus
LLEKRILQSGMTLLLL

SEQ ID NO: 44418 - protein, 16 aa, BK virus
LEKRILQSGMTLLLLL

SEQ ID NO: 44419 - protein, 16 aa, BK virus
EKRILQSGMTLLLLLI

SEQ ID NO: 44420 - protein, 16 aa, BK virus
KRILQSGMTLLLLLIW

SEQ ID NO: 44421 - protein, 16 aa, BK virus
RILQSGMTLLLLLIWF

SEQ ID NO: 44422 - protein, 16 aa, BK virus
ILQSGMTLLLLLIWFR

SEQ ID NO: 44423 - protein, 16 aa, BK virus
LQSGMTLLLLLIWFRP

SEQ ID NO: 44424 - protein, 16 aa, BK virus
QSGMTLLLLLIWFRPV

SEQ ID NO: 44425 - protein, 16 aa, BK virus
SGMTLLLLLIWFRPVA

SEQ ID NO: 44426 - protein, 16 aa, BK virus
GMTLLLLLIWFRPVAD

SEQ ID NO: 44427 - protein, 16 aa, BK virus
MTLLLLLIWFRPVADF

SEQ ID NO: 44428 - protein, 16 aa, BK virus
TLLLLLIWFRPVADFA

SEQ ID NO: 44429 - protein, 16 aa, BK virus
LLLLLIWFRPVADFAT

SEQ ID NO: 44430 - protein, 16 aa, BK virus
LLLLIWFRPVADFATD

SEQ ID NO: 44431 - protein, 16 aa, BK virus
LLLIWFRPVADFATDI

SEQ ID NO: 44432 - protein, 16 aa, BK virus
LLIWFRPVADFATDIQ

SEQ ID NO: 44433 - protein, 16 aa, BK virus
LIWFRPVADFATDIQS

SEQ ID NO: 44434 - protein, 16 aa, BK virus
IWFRPVADFATDIQSR

SEQ ID NO: 44435 - protein, 16 aa, BK virus
WFRPVADFATDIQSRI

SEQ ID NO: 44436 - protein, 16 aa, BK virus
FRPVADFATDIQSRIV

SEQ ID NO: 44437 - protein, 16 aa, BK virus
RPVADFATDIQSRIVE

SEQ ID NO: 44438 - protein, 16 aa, BK virus
PVADFATDIQSRIVEW

SEQ ID NO: 44439 - protein, 16 aa, BK virus
VADFATDIQSRIVEWK

SEQ ID NO: 44440 - protein, 16 aa, BK virus
ADFATDIQSRIVEWKE

SEQ ID NO: 44441 - protein, 16 aa, BK virus
DFATDIQSRIVEWKER

SEQ ID NO: 44442 - protein, 16 aa, BK virus
FATDIQSRIVEWKERL

SEQ ID NO: 44443 - protein, 16 aa, BK virus
ATDIQSRIVEWKERLD

SEQ ID NO: 44444 - protein, 16 aa, BK virus
TDIQSRIVEWKERLDS

SEQ ID NO: 44445 - protein, 16 aa, BK virus
DIQSRIVEWKERLDSE

SEQ ID NO: 44446 - protein, 16 aa, BK virus
IQSRIVEWKERLDSEI

SEQ ID NO: 44447 - protein, 16 aa, BK virus
QSRIVEWKERLDSEIS

SEQ ID NO: 44448 - protein, 16 aa, BK virus
SRIVEWKERLDSEISM

SEQ ID NO: 44449 - protein, 16 aa, BK virus
RIVEWKERLDSEISMY

SEQ ID NO: 44450 - protein, 16 aa, BK virus
IVEWKERLDSEISMYT

SEQ ID NO: 44451 - protein, 16 aa, BK virus
VEWKERLDSEISMYTF

SEQ ID NO: 44452 - protein, 16 aa, BK virus
EWKERLDSEISMYTFS

SEQ ID NO: 44453 - protein, 16 aa, BK virus
WKERLDSEISMYTFSR

SEQ ID NO: 44454 - protein, 16 aa, BK virus
KERLDSEISMYTFSRM

SEQ ID NO: 44455 - protein, 16 aa, BK virus
ERLDSEISMYTFSRMK

SEQ ID NO: 44456 - protein, 16 aa, BK virus
RLDSEISMYTFSRMKY

SEQ ID NO: 44457 - protein, 16 aa, BK virus
LDSEISMYTFSRMKYN

SEQ ID NO: 44458 - protein, 16 aa, BK virus
DSEISMYTFSRMKYNI

SEQ ID NO: 44459 - protein, 16 aa, BK virus
SEISMYTFSRMKYNIC

SEQ ID NO: 44460 - protein, 16 aa, BK virus
EISMYTFSRMKYNICM

SEQ ID NO: 44461 - protein, 16 aa, BK virus
ISMYTFSRMKYNICMG

SEQ ID NO: 44462 - protein, 16 aa, BK virus
SMYTFSRMKYNICMGK

SEQ ID NO: 44463 - protein, 16 aa, BK virus
MYTFSRMKYNICMGKC

SEQ ID NO: 44464 - protein, 16 aa, BK virus
YTFSRMKYNICMGKCI

SEQ ID NO: 44465 - protein, 16 aa, BK virus
TFSRMKYNICMGKCIL

SEQ ID NO: 44466 - protein, 16 aa, BK virus
FSRMKYNICMGKCILD

SEQ ID NO: 44467 - protein, 16 aa, BK virus
SRMKYNICMGKCILDI

SEQ ID NO: 44468 - protein, 16 aa, BK virus
RMKYNICMGKCILDIT

SEQ ID NO: 44469 - protein, 16 aa, BK virus
MKYNICMGKCILDITR

SEQ ID NO: 44470 - protein, 16 aa, BK virus
KYNICMGKCILDITRE

SEQ ID NO: 44471 - protein, 16 aa, BK virus
YNICMGKCILDITREE

SEQ ID NO: 44472 - protein, 16 aa, BK virus
NICMGKCILDITREED

SEQ ID NO: 44473 - protein, 16 aa, BK virus
ICMGKCILDITREEDS

SEQ ID NO: 44474 - protein, 16 aa, BK virus
CMGKCILDITREEDSE

SEQ ID NO: 44475 - protein, 16 aa, BK virus
MGKCILDITREEDSET

SEQ ID NO: 44476 - protein, 16 aa, BK virus
GKCILDITREEDSETE

SEQ ID NO: 44477 - protein, 16 aa, BK virus
KCILDITREEDSETED

SEQ ID NO: 44478 - protein, 16 aa, BK virus
CILDITREEDSETEDS

SEQ ID NO: 44479 - protein, 16 aa, BK virus
ILDITREEDSETEDSG

SEQ ID NO: 44480 - protein, 16 aa, BK virus
LDITREEDSETEDSGH

SEQ ID NO: 44481 - protein, 16 aa, BK virus
DITREEDSETEDSGHG

SEQ ID NO: 44482 - protein, 16 aa, BK virus
ITREEDSETEDSGHGS

SEQ ID NO: 44483 - protein, 16 aa, BK virus
TREEDSETEDSGHGSS

SEQ ID NO: 44484 - protein, 16 aa, BK virus
REEDSETEDSGHGSST

SEQ ID NO: 44485 - protein, 16 aa, BK virus
EEDSETEDSGHGSSTE

SEQ ID NO: 44486 - protein, 16 aa, BK virus
EDSETEDSGHGSSTES

SEQ ID NO: 44487 - protein, 16 aa, BK virus
DSETEDSGHGSSTESQ

SEQ ID NO: 44488 - protein, 16 aa, BK virus
SETEDSGHGSSTESQS

SEQ ID NO: 44489 - protein, 16 aa, BK virus
ETEDSGHGSSTESQSQ

SEQ ID NO: 44490 - protein, 16 aa, BK virus
TEDSGHGSSTESQSQC

SEQ ID NO: 44491 - protein, 16 aa, BK virus
EDSGHGSSTESQSQCS

SEQ ID NO: 44492 - protein, 16 aa, BK virus
DSGHGSSTESQSQCSS

SEQ ID NO: 44493 - protein, 16 aa, BK virus
SGHGSSTESQSQCSSQ

SEQ ID NO: 44494 - protein, 16 aa, BK virus
GHGSSTESQSQCSSQV

SEQ ID NO: 44495 - protein, 16 aa, BK virus
HGSSTESQSQCSSQVS

SEQ ID NO: 44496 - protein, 16 aa, BK virus
GSSTESQSQCSSQVSD

SEQ ID NO: 44497 - protein, 16 aa, BK virus
SSTESQSQCSSQVSDT

SEQ ID NO: 44498 - protein, 16 aa, BK virus
STESQSQCSSQVSDTS

SEQ ID NO: 44499 - protein, 16 aa, BK virus
TESQSQCSSQVSDTSA

SEQ ID NO: 44500 - protein, 16 aa, BK virus
ESQSQCSSQVSDTSAP

SEQ ID NO: 44501 - protein, 16 aa, BK virus
SQSQCSSQVSDTSAPA

SEQ ID NO: 44502 - protein, 16 aa, BK virus
QSQCSSQVSDTSAPAE

SEQ ID NO: 44503 - protein, 16 aa, BK virus
SQCSSQVSDTSAPAED

SEQ ID NO: 44504 - protein, 16 aa, BK virus
QCSSQVSDTSAPAEDS

SEQ ID NO: 44505 - protein, 16 aa, BK virus
CSSQVSDTSAPAEDSQ

SEQ ID NO: 44506 - protein, 16 aa, BK virus
SSQVSDTSAPAEDSQR

SEQ ID NO: 44507 - protein, 16 aa, BK virus
SQVSDTSAPAEDSQRS

SEQ ID NO: 44508 - protein, 16 aa, BK virus
QVSDTSAPAEDSQRSD

SEQ ID NO: 44509 - protein, 16 aa, BK virus
VSDTSAPAEDSQRSDP

SEQ ID NO: 44510 - protein, 16 aa, BK virus
SDTSAPAEDSQRSDPH

SEQ ID NO: 44511 - protein, 16 aa, BK virus
DTSAPAEDSQRSDPHS

SEQ ID NO: 44512 - protein, 16 aa, BK virus
TSAPAEDSQRSDPHSQ

SEQ ID NO: 44513 - protein, 16 aa, BK virus
SAPAEDSQRSDPHSQE

SEQ ID NO: 44514 - protein, 16 aa, BK virus
APAEDSQRSDPHSQEL

SEQ ID NO: 44515 - protein, 16 aa, BK virus
PAEDSQRSDPHSQELH

SEQ ID NO: 44516 - protein, 16 aa, BK virus
AEDSQRSDPHSQELHL

SEQ ID NO: 44517 - protein, 16 aa, BK virus
EDSQRSDPHSQELHLC

SEQ ID NO: 44518 - protein, 16 aa, BK virus
DSQRSDPHSQELHLCK

SEQ ID NO: 44519 - protein, 16 aa, BK virus
SQRSDPHSQELHLCKG

SEQ ID NO: 44520 - protein, 16 aa, BK virus
QRSDPHSQELHLCKGF

SEQ ID NO: 44521 - protein, 16 aa, BK virus
RSDPHSQELHLCKGFQ

SEQ ID NO: 44522 - protein, 16 aa, BK virus
SDPHSQELHLCKGFQC

SEQ ID NO: 44523 - protein, 16 aa, BK virus
DPHSQELHLCKGFQCF

SEQ ID NO: 44524 - protein, 16 aa, BK virus
PHSQELHLCKGFQCFK

SEQ ID NO: 44525 - protein, 16 aa, BK virus
HSQELHLCKGFQCFKR

SEQ ID NO: 44526 - protein, 16 aa, BK virus
SQELHLCKGFQCFKRP

SEQ ID NO: 44527 - protein, 16 aa, BK virus
QELHLCKGFQCFKRPK

SEQ ID NO: 44528 - protein, 16 aa, BK virus
ELHLCKGFQCFKRPKT

SEQ ID NO: 44529 - protein, 16 aa, BK virus
LHLCKGFQCFKRPKTP

SEQ ID NO: 44530 - protein, 16 aa, BK virus
HLCKGFQCFKRPKTPP

SEQ ID NO: 44531 - protein, 16 aa, BK virus
LCKGFQCFKRPKTPPP

SEQ ID NO: 44532 - protein, 16 aa, BK virus
CKGFQCFKRPKTPPPK

SEQ ID NO: 44533 - protein, 16 aa, BK virus
MYMYNKSTCLKHFGLQ

SEQ ID NO: 44534 - protein, 16 aa, BK virus
YMYNKSTCLKHFGLQL

SEQ ID NO: 44535 - protein, 16 aa, BK virus
MYNKSTCLKHFGLQLS

SEQ ID NO: 44536 - protein, 16 aa, BK virus
YNKSTCLKHFGLQLSL

SEQ ID NO: 44537 - protein, 16 aa, BK virus
NKSTCLKHFGLQLSLF

SEQ ID NO: 44538 - protein, 16 aa, BK virus
KSTCLKHFGLQLSLFV

SEQ ID NO: 44539 - protein, 16 aa, BK virus
STCLKHFGLQLSLFVN

SEQ ID NO: 44540 - protein, 16 aa, BK virus
TCLKHFGLQLSLFVNI

SEQ ID NO: 44541 - protein, 16 aa, BK virus
CLKHFGLQLSLFVNIS

SEQ ID NO: 44542 - protein, 16 aa, BK virus
LKHFGLQLSLFVNISY

SEQ ID NO: 44543 - protein, 16 aa, BK virus
KHFGLQLSLFVNISYH

SEQ ID NO: 44544 - protein, 16 aa, BK virus
HFGLQLSLFVNISYHI

SEQ ID NO: 44545 - protein, 16 aa, BK virus
FGLQLSLFVNISYHIW

SEQ ID NO: 44546 - protein, 16 aa, BK virus
GLQLSLFVNISYHIWV

SEQ ID NO: 44547 - protein, 16 aa, BK virus
LQLSLFVNISYHIWVP

SEQ ID NO: 44548 - protein, 16 aa, BK virus
QLSLFVNISYHIWVPW

SEQ ID NO: 44549 - protein, 16 aa, BK virus
LSLFVNISYHIWVPWK

SEQ ID NO: 44550 - protein, 16 aa, BK virus
SLFVNISYHIWVPWKS

SEQ ID NO: 44551 - protein, 16 aa, BK virus
LFVNISYHIWVPWKSF

SEQ ID NO: 44552 - protein, 16 aa, BK virus
FVNISYHIWVPWKSFC

SEQ ID NO: 44553 - protein, 16 aa, BK virus
VNISYHIWVPWKSFCA

SEQ ID NO: 44554 - protein, 16 aa, BK virus
NISYHIWVPWKSFCAI

SEQ ID NO: 44555 - protein, 16 aa, BK virus
ISYHIWVPWKSFCAIK

SEQ ID NO: 44556 - protein, 16 aa, BK virus
SYHIWVPWKSFCAIKH

SEQ ID NO: 44557 - protein, 16 aa, BK virus
YHIWVPWKSFCAIKHP

SEQ ID NO: 44558 - protein, 16 aa, BK virus
HIWVPWKSFCAIKHPN

SEQ ID NO: 44559 - protein, 16 aa, BK virus
IWVPWKSFCAIKHPNL

SEQ ID NO: 44560 - protein, 16 aa, BK virus
WVPWKSFCAIKHPNLF

SEQ ID NO: 44561 - protein, 16 aa, BK virus
VPWKSFCAIKHPNLFY

SEQ ID NO: 44562 - protein, 16 aa, BK virus
PWKSFCAIKHPNLFYL

SEQ ID NO: 44563 - protein, 16 aa, BK virus
WKSFCAIKHPNLFYLG

SEQ ID NO: 44564 - protein, 16 aa, BK virus
KSFCAIKHPNLFYLGF

SEQ ID NO: 44565 - protein, 16 aa, BK virus
SFCAIKHPNLFYLGFH

SEQ ID NO: 44566 - protein, 16 aa, BK virus
FCAIKHPNLFYLGFHT

SEQ ID NO: 44567 - protein, 16 aa, BK virus
CAIKHPNLFYLGFHTI

SEQ ID NO: 44568 - protein, 16 aa, BK virus
AIKHPNLFYLGFHTIH

SEQ ID NO: 44569 - protein, 16 aa, BK virus
IKHPNLFYLGFHTIHR

SEQ ID NO: 44570 - protein, 16 aa, BK virus
KHPNLFYLGFHTIHRL

SEQ ID NO: 44571 - protein, 16 aa, BK virus
HPNLFYLGFHTIHRLP

SEQ ID NO: 44572 - protein, 16 aa, BK virus
PNLFYLGFHTIHRLPI

SEQ ID NO: 44573 - protein, 16 aa, BK virus
NLFYLGFHTIHRLPIH

SEQ ID NO: 44574 - protein, 16 aa, BK virus
LFYLGFHTIHRLPIHS

SEQ ID NO: 44575 - protein, 16 aa, BK virus
FYLGFHTIHRLPIHSL

SEQ ID NO: 44576 - protein, 16 aa, BK virus
YLGFHTIHRLPIHSLG

SEQ ID NO: 44577 - protein, 16 aa, BK virus
LGFHTIHRLPIHSLGS

SEQ ID NO: 44578 - protein, 16 aa, BK virus
GFHTIHRLPIHSLGSP

SEQ ID NO: 44579 - protein, 16 aa, BK virus
FHTIHRLPIHSLGSPV

SEQ ID NO: 44580 - protein, 16 aa, BK virus
HTIHRLPIHSLGSPVY

SEQ ID NO: 44581 - protein, 16 aa, BK virus
TIHRLPIHSLGSPVYK

SEQ ID NO: 44582 - protein, 16 aa, BK virus
IHRLPIHSLGSPVYKV

SEQ ID NO: 44583 - protein, 16 aa, BK virus
HRLPIHSLGSPVYKVT

SEQ ID NO: 44584 - protein, 16 aa, BK virus
QKGNWVRILYRSFSQA

SEQ ID NO: 44585 - protein, 16 aa, BK virus
KGNWVRILYRSFSQAD

SEQ ID NO: 44586 - protein, 16 aa, BK virus
GNWVRILYRSFSQADL

SEQ ID NO: 44587 - protein, 16 aa, BK virus
NWVRILYRSFSQADLK

SEQ ID NO: 44588 - protein, 16 aa, BK virus
WVRILYRSFSQADLKI

SEQ ID NO: 44589 - protein, 16 aa, BK virus
VRILYRSFSQADLKIS

SEQ ID NO: 44590 - protein, 16 aa, BK virus
RILYRSFSQADLKISC

SEQ ID NO: 44591 - protein, 16 aa, BK virus
ILYRSFSQADLKISCK

SEQ ID NO: 44592 - protein, 16 aa, BK virus
LYRSFSQADLKISCKA

SEQ ID NO: 44593 - protein, 16 aa, BK virus
YRSFSQADLKISCKAS

SEQ ID NO: 44594 - protein, 16 aa, BK virus
RSFSQADLKISCKASP

SEQ ID NO: 44595 - protein, 16 aa, BK virus
SFSQADLKISCKASPL

SEQ ID NO: 44596 - protein, 16 aa, BK virus
FSQADLKISCKASPLL

SEQ ID NO: 44597 - protein, 16 aa, BK virus
SQADLKISCKASPLLC

SEQ ID NO: 44598 - protein, 16 aa, BK virus
QADLKISCKASPLLCS

SEQ ID NO: 44599 - protein, 16 aa, BK virus
ADLKISCKASPLLCSR

SEQ ID NO: 44600 - protein, 16 aa, BK virus
DLKISCKASPLLCSRA

SEQ ID NO: 44601 - protein, 16 aa, BK virus
LKISCKASPLLCSRAV

SEQ ID NO: 44602 - protein, 16 aa, BK virus
KISCKASPLLCSRAVS

SEQ ID NO: 44603 - protein, 16 aa, BK virus
ISCKASPLLCSRAVSK

SEQ ID NO: 44604 - protein, 16 aa, BK virus
SCKASPLLCSRAVSKQ

SEQ ID NO: 44605 - protein, 16 aa, BK virus
CKASPLLCSRAVSKQA

SEQ ID NO: 44606 - protein, 16 aa, BK virus
KASPLLCSRAVSKQAT

SEQ ID NO: 44607 - protein, 16 aa, BK virus
ASPLLCSRAVSKQATN

SEQ ID NO: 44608 - protein, 16 aa, BK virus
SPLLCSRAVSKQATNI

SEQ ID NO: 44609 - protein, 16 aa, BK virus
PLLCSRAVSKQATNIS

SEQ ID NO: 44610 - protein, 16 aa, BK virus
LLCSRAVSKQATNISS

SEQ ID NO: 44611 - protein, 16 aa, BK virus
NIQAISFTKRPHTLFI

SEQ ID NO: 44612 - protein, 16 aa, BK virus
QHCGSCVGHMKYWGNI

SEQ ID NO: 44613 - protein, 16 aa, BK virus
HCGSCVGHMKYWGNIF

SEQ ID NO: 44614 - protein, 16 aa, BK virus
CGSCVGHMKYWGNIFP

SEQ ID NO: 44615 - protein, 16 aa, BK virus
GSCVGHMKYWGNIFPS

SEQ ID NO: 44616 - protein, 16 aa, BK virus
SCVGHMKYWGNIFPSC

SEQ ID NO: 44617 - protein, 16 aa, BK virus
CVGHMKYWGNIFPSCE

SEQ ID NO: 44618 - protein, 16 aa, BK virus
VGHMKYWGNIFPSCES

SEQ ID NO: 44619 - protein, 16 aa, BK virus
GHMKYWGNIFPSCESP

SEQ ID NO: 44620 - protein, 16 aa, BK virus
HMKYWGNIFPSCESPK

SEQ ID NO: 44621 - protein, 16 aa, BK virus
MKYWGNIFPSCESPKI

SEQ ID NO: 44622 - protein, 16 aa, BK virus
KYWGNIFPSCESPKIP

SEQ ID NO: 44623 - protein, 16 aa, BK virus
YWGNIFPSCESPKIPS

SEQ ID NO: 44624 - protein, 16 aa, BK virus
WGNIFPSCESPKIPSI

SEQ ID NO: 44625 - protein, 16 aa, BK virus
GNIFPSCESPKIPSIF

SEQ ID NO: 44626 - protein, 16 aa, BK virus
NIFPSCESPKIPSIFI

SEQ ID NO: 44627 - protein, 16 aa, BK virus
IFPSCESPKIPSIFIS

SEQ ID NO: 44628 - protein, 16 aa, BK virus
FPSCESPKIPSIFIST

SEQ ID NO: 44629 - protein, 16 aa, BK virus
PSCESPKIPSIFISTG

SEQ ID NO: 44630 - protein, 16 aa, BK virus
SCESPKIPSIFISTGI

SEQ ID NO: 44631 - protein, 16 aa, BK virus
CESPKIPSIFISTGIR

SEQ ID NO: 44632 - protein, 16 aa, BK virus
ESPKIPSIFISTGIRY

SEQ ID NO: 44633 - protein, 16 aa, BK virus
SPKIPSIFISTGIRYP

SEQ ID NO: 44634 - protein, 16 aa, BK virus
PKIPSIFISTGIRYPA

SEQ ID NO: 44635 - protein, 16 aa, BK virus
KIPSIFISTGIRYPAL

SEQ ID NO: 44636 - protein, 16 aa, BK virus
IPSIFISTGIRYPALN

SEQ ID NO: 44637 - protein, 16 aa, BK virus
PSIFISTGIRYPALNW

SEQ ID NO: 44638 - protein, 16 aa, BK virus
SIFISTGIRYPALNWI

SEQ ID NO: 44639 - protein, 16 aa, BK virus
IFISTGIRYPALNWIS

SEQ ID NO: 44640 - protein, 16 aa, BK virus
FISTGIRYPALNWISI

SEQ ID NO: 44641 - protein, 16 aa, BK virus
ISTGIRYPALNWISIV

SEQ ID NO: 44642 - protein, 16 aa, BK virus
STGIRYPALNWISIVF

SEQ ID NO: 44643 - protein, 16 aa, BK virus
TGIRYPALNWISIVFV

SEQ ID NO: 44644 - protein, 16 aa, BK virus
GIRYPALNWISIVFVQ

SEQ ID NO: 44645 - protein, 16 aa, BK virus
IRYPALNWISIVFVQI

SEQ ID NO: 44646 - protein, 16 aa, BK virus
RYPALNWISIVFVQIG

SEQ ID NO: 44647 - protein, 16 aa, BK virus
YPALNWISIVFVQIGL

SEQ ID NO: 44648 - protein, 16 aa, BK virus
PALNWISIVFVQIGLM

SEQ ID NO: 44649 - protein, 16 aa, BK virus
ALNWISIVFVQIGLMV

SEQ ID NO: 44650 - protein, 16 aa, BK virus
LNWISIVFVQIGLMVS

SEQ ID NO: 44651 - protein, 16 aa, BK virus
NWISIVFVQIGLMVSI

SEQ ID NO: 44652 - protein, 16 aa, BK virus
WISIVFVQIGLMVSIH

SEQ ID NO: 44653 - protein, 16 aa, BK virus
ISIVFVQIGLMVSIHY

SEQ ID NO: 44654 - protein, 16 aa, BK virus
SIVFVQIGLMVSIHYL

SEQ ID NO: 44655 - protein, 16 aa, BK virus
IVFVQIGLMVSIHYLG

SEQ ID NO: 44656 - protein, 16 aa, BK virus
VFVQIGLMVSIHYLGL

SEQ ID NO: 44657 - protein, 16 aa, BK virus
FVQIGLMVSIHYLGLG

SEQ ID NO: 44658 - protein, 16 aa, BK virus
VQIGLMVSIHYLGLGC

SEQ ID NO: 44659 - protein, 16 aa, BK virus
QIGLMVSIHYLGLGCW

SEQ ID NO: 44660 - protein, 16 aa, BK virus
IGLMVSIHYLGLGCWV

SEQ ID NO: 44661 - protein, 16 aa, BK virus
GLMVSIHYLGLGCWVF

SEQ ID NO: 44662 - protein, 16 aa, BK virus
LMVSIHYLGLGCWVFR

SEQ ID NO: 44663 - protein, 16 aa, BK virus
MVSIHYLGLGCWVFRG

SEQ ID NO: 44664 - protein, 16 aa, BK virus
VSIHYLGLGCWVFRGY

SEQ ID NO: 44665 - protein, 16 aa, BK virus
SIHYLGLGCWVFRGYS

SEQ ID NO: 44666 - protein, 16 aa, BK virus
IHYLGLGCWVFRGYST

SEQ ID NO: 44667 - protein, 16 aa, BK virus
HYLGLGCWVFRGYSTI

SEQ ID NO: 44668 - protein, 16 aa, BK virus
YLGLGCWVFRGYSTIR

SEQ ID NO: 44669 - protein, 16 aa, BK virus
LGLGCWVFRGYSTIRV

SEQ ID NO: 44670 - protein, 16 aa, BK virus
GLGCWVFRGYSTIRVL

SEQ ID NO: 44671 - protein, 16 aa, BK virus
HSLHFQGFSTYSKEVE

SEQ ID NO: 44672 - protein, 16 aa, BK virus
SLHFQGFSTYSKEVEI

SEQ ID NO: 44673 - protein, 16 aa, BK virus
LHFQGFSTYSKEVEIT

SEQ ID NO: 44674 - protein, 16 aa, BK virus
HFQGFSTYSKEVEITA

SEQ ID NO: 44675 - protein, 16 aa, BK virus
FQGFSTYSKEVEITAL

SEQ ID NO: 44676 - protein, 16 aa, BK virus
QGFSTYSKEVEITALN

SEQ ID NO: 44677 - protein, 16 aa, BK virus
GFSTYSKEVEITALNR

SEQ ID NO: 44678 - protein, 16 aa, BK virus
FSTYSKEVEITALNRF

SEQ ID NO: 44679 - protein, 16 aa, BK virus
STYSKEVEITALNRFS

SEQ ID NO: 44680 - protein, 16 aa, BK virus
TYSKEVEITALNRFSS

SEQ ID NO: 44681 - protein, 16 aa, BK virus
YSKEVEITALNRFSST

SEQ ID NO: 44682 - protein, 16 aa, BK virus
SKEVEITALNRFSSTM

SEQ ID NO: 44683 - protein, 16 aa, BK virus
KEVEITALNRFSSTML

SEQ ID NO: 44684 - protein, 16 aa, BK virus
EVEITALNRFSSTMLM

SEQ ID NO: 44685 - protein, 16 aa, BK virus
VEITALNRFSSTMLMH

SEQ ID NO: 44686 - protein, 16 aa, BK virus
EITALNRFSSTMLMHF

SEQ ID NO: 44687 - protein, 16 aa, BK virus
ITALNRFSSTMLMHFL

SEQ ID NO: 44688 - protein, 16 aa, BK virus
PCMKVKHASYSNNLCL

SEQ ID NO: 44689 - protein, 16 aa, BK virus
CMKVKHASYSNNLCLY

SEQ ID NO: 44690 - protein, 16 aa, BK virus
MKVKHASYSNNLCLYS

SEQ ID NO: 44691 - protein, 16 aa, BK virus
KVKHASYSNNLCLYSY

SEQ ID NO: 44692 - protein, 16 aa, BK virus
VKHASYSNNLCLYSYS

SEQ ID NO: 44693 - protein, 16 aa, BK virus
KHASYSNNLCLYSYSL

SEQ ID NO: 44694 - protein, 16 aa, BK virus
HASYSNNLCLYSYSLP

SEQ ID NO: 44695 - protein, 16 aa, BK virus
ASYSNNLCLYSYSLPH

SEQ ID NO: 44696 - protein, 16 aa, BK virus
SYSNNLCLYSYSLPHQ

SEQ ID NO: 44697 - protein, 16 aa, BK virus
IGEGNSCCAVTGKHFS

SEQ ID NO: 44698 - protein, 16 aa, BK virus
GEGNSCCAVTGKHFSL

SEQ ID NO: 44699 - protein, 16 aa, BK virus
EGNSCCAVTGKHFSLW

SEQ ID NO: 44700 - protein, 16 aa, BK virus
GNSCCAVTGKHFSLWA

SEQ ID NO: 44701 - protein, 16 aa, BK virus
NSCCAVTGKHFSLWAI

SEQ ID NO: 44702 - protein, 16 aa, BK virus
SCCAVTGKHFSLWAIT

SEQ ID NO: 44703 - protein, 16 aa, BK virus
CCAVTGKHFSLWAITA

SEQ ID NO: 44704 - protein, 16 aa, BK virus
CAVTGKHFSLWAITAK

SEQ ID NO: 44705 - protein, 16 aa, BK virus
AVTGKHFSLWAITAKV

SEQ ID NO: 44706 - protein, 16 aa, BK virus
VTGKHFSLWAITAKVI

SEQ ID NO: 44707 - protein, 16 aa, BK virus
TGKHFSLWAITAKVIF

SEQ ID NO: 44708 - protein, 16 aa, BK virus
GKHFSLWAITAKVIFS

SEQ ID NO: 44709 - protein, 16 aa, BK virus
KHFSLWAITAKVIFST

SEQ ID NO: 44710 - protein, 16 aa, BK virus
FWHLHGFLWLFGSCPW

SEQ ID NO: 44711 - protein, 16 aa, BK virus
WHLHGFLWLFGSCPWT

SEQ ID NO: 44712 - protein, 16 aa, BK virus
HLHGFLWLFGSCPWTL

SEQ ID NO: 44713 - protein, 16 aa, BK virus
LHGFLWLFGSCPWTLS

SEQ ID NO: 44714 - protein, 16 aa, BK virus
HGFLWLFGSCPWTLSF

SEQ ID NO: 44715 - protein, 16 aa, BK virus
GFLWLFGSCPWTLSFS

SEQ ID NO: 44716 - protein, 16 aa, BK virus
FLWLFGSCPWTLSFSF

SEQ ID NO: 44717 - protein, 16 aa, BK virus
LWLFGSCPWTLSFSFG

SEQ ID NO: 44718 - protein, 16 aa, BK virus
WLFGSCPWTLSFSFGW

SEQ ID NO: 44719 - protein, 16 aa, BK virus
LFGSCPWTLSFSFGWG

SEQ ID NO: 44720 - protein, 16 aa, BK virus
FGSCPWTLSFSFGWGH

SEQ ID NO: 44721 - protein, 16 aa, BK virus
GSCPWTLSFSFGWGHL

SEQ ID NO: 44722 - protein, 16 aa, BK virus
SCPWTLSFSFGWGHLH

SEQ ID NO: 44723 - protein, 16 aa, BK virus
CPWTLSFSFGWGHLHM

SEQ ID NO: 44724 - protein, 16 aa, BK virus
PWTLSFSFGWGHLHML

SEQ ID NO: 44725 - protein, 16 aa, BK virus
WTLSFSFGWGHLHMLQ

SEQ ID NO: 44726 - protein, 16 aa, BK virus
TLSFSFGWGHLHMLQE

SEQ ID NO: 44727 - protein, 16 aa, BK virus
LSFSFGWGHLHMLQEQ

SEQ ID NO: 44728 - protein, 16 aa, BK virus
SFSFGWGHLHMLQEQV

SEQ ID NO: 44729 - protein, 16 aa, BK virus
FSFGWGHLHMLQEQVL

SEQ ID NO: 44730 - protein, 16 aa, BK virus
SFGWGHLHMLQEQVLQ

SEQ ID NO: 44731 - protein, 16 aa, BK virus
FGWGHLHMLQEQVLQS

SEQ ID NO: 44732 - protein, 16 aa, BK virus
GWGHLHMLQEQVLQSR

SEQ ID NO: 44733 - protein, 16 aa, BK virus
WGHLHMLQEQVLQSRT

SEQ ID NO: 44734 - protein, 16 aa, BK virus
GHLHMLQEQVLQSRTG

SEQ ID NO: 44735 - protein, 16 aa, BK virus
HLHMLQEQVLQSRTGL

SEQ ID NO: 44736 - protein, 16 aa, BK virus
LHMLQEQVLQSRTGLE

SEQ ID NO: 44737 - protein, 16 aa, BK virus
HMLQEQVLQSRTGLEV

SEQ ID NO: 44738 - protein, 16 aa, BK virus
MLQEQVLQSRTGLEVK

SEQ ID NO: 44739 - protein, 16 aa, BK virus
LQEQVLQSRTGLEVKA

SEQ ID NO: 44740 - protein, 16 aa, BK virus
QEQVLQSRTGLEVKAT

SEQ ID NO: 44741 - protein, 16 aa, BK virus
EQVLQSRTGLEVKATS

SEQ ID NO: 44742 - protein, 16 aa, BK virus
QVLQSRTGLEVKATSI

SEQ ID NO: 44743 - protein, 16 aa, BK virus
VLQSRTGLEVKATSIE

SEQ ID NO: 44744 - protein, 16 aa, BK virus
LQSRTGLEVKATSIEE

SEQ ID NO: 44745 - protein, 16 aa, BK virus
QSRTGLEVKATSIEEQ

SEQ ID NO: 44746 - protein, 16 aa, BK virus
SRTGLEVKATSIEEQF

SEQ ID NO: 44747 - protein, 16 aa, BK virus
RTGLEVKATSIEEQFF

SEQ ID NO: 44748 - protein, 16 aa, BK virus
TGLEVKATSIEEQFFD

SEQ ID NO: 44749 - protein, 16 aa, BK virus
TLLNVHFVDFLSPFFV

SEQ ID NO: 44750 - protein, 16 aa, BK virus
LLLYCQHHLYYKYGQN

SEQ ID NO: 44751 - protein, 16 aa, BK virus
LLYCQHHLYYKYGQNV

SEQ ID NO: 44752 - protein, 16 aa, BK virus
LYCQHHLYYKYGQNVH

SEQ ID NO: 44753 - protein, 16 aa, BK virus
YCQHHLYYKYGQNVHG

SEQ ID NO: 44754 - protein, 16 aa, BK virus
CQHHLYYKYGQNVHGY

SEQ ID NO: 44755 - protein, 16 aa, BK virus
QHHLYYKYGQNVHGYL

SEQ ID NO: 44756 - protein, 16 aa, BK virus
HHLYYKYGQNVHGYLP

SEQ ID NO: 44757 - protein, 16 aa, BK virus
HLYYKYGQNVHGYLPF

SEQ ID NO: 44758 - protein, 16 aa, BK virus
LYYKYGQNVHGYLPFQ

SEQ ID NO: 44759 - protein, 16 aa, BK virus
YYKYGQNVHGYLPFQL

SEQ ID NO: 44760 - protein, 16 aa, BK virus
YKYGQNVHGYLPFQLL

SEQ ID NO: 44761 - protein, 16 aa, BK virus
KYGQNVHGYLPFQLLV

SEQ ID NO: 44762 - protein, 16 aa, BK virus
QKYLHQETEYHSTHLG

SEQ ID NO: 44763 - protein, 16 aa, BK virus
TIPKPCLIADRGLQWK

SEQ ID NO: 44764 - protein, 16 aa, BK virus
IPKPCLIADRGLQWKL

SEQ ID NO: 44765 - protein, 16 aa, BK virus
PKPCLIADRGLQWKLC

SEQ ID NO: 44766 - protein, 16 aa, BK virus
KPCLIADRGLQWKLCD

SEQ ID NO: 44767 - protein, 16 aa, BK virus
PCLIADRGLQWKLCDP

SEQ ID NO: 44768 - protein, 16 aa, BK virus
CLIADRGLQWKLCDPN

SEQ ID NO: 44769 - protein, 16 aa, BK virus
LIADRGLQWKLCDPNH

SEQ ID NO: 44770 - protein, 16 aa, BK virus
IADRGLQWKLCDPNHQ

SEQ ID NO: 44771 - protein, 16 aa, BK virus
ADRGLQWKLCDPNHQR

SEQ ID NO: 44772 - protein, 16 aa, BK virus
DRGLQWKLCDPNHQRT

SEQ ID NO: 44773 - protein, 16 aa, BK virus
RGLQWKLCDPNHQRTY

SEQ ID NO: 44774 - protein, 16 aa, BK virus
GLQWKLCDPNHQRTYT

SEQ ID NO: 44775 - protein, 16 aa, BK virus
LQWKLCDPNHQRTYTL

SEQ ID NO: 44776 - protein, 16 aa, BK virus
QWKLCDPNHQRTYTLL

SEQ ID NO: 44777 - protein, 16 aa, BK virus
WKLCDPNHQRTYTLLE

SEQ ID NO: 44778 - protein, 16 aa, BK virus
KLCDPNHQRTYTLLEL

SEQ ID NO: 44779 - protein, 16 aa, BK virus
LCDPNHQRTYTLLELR

SEQ ID NO: 44780 - protein, 16 aa, BK virus
CDPNHQRTYTLLELRN

SEQ ID NO: 44781 - protein, 16 aa, BK virus
PQEHQQLQHMFEELGL

SEQ ID NO: 44782 - protein, 16 aa, BK virus
QQQPPQQQFQPLKILW

SEQ ID NO: 44783 - protein, 16 aa, BK virus
QQPPQQQFQPLKILWQ

SEQ ID NO: 44784 - protein, 16 aa, BK virus
QPPQQQFQPLKILWQQ

SEQ ID NO: 44785 - protein, 16 aa, BK virus
PPQQQFQPLKILWQQQ

SEQ ID NO: 44786 - protein, 16 aa, BK virus
PQQQFQPLKILWQQQP

SEQ ID NO: 44787 - protein, 16 aa, BK virus
QQQFQPLKILWQQQPQ

SEQ ID NO: 44788 - protein, 16 aa, BK virus
QQFQPLKILWQQQPQI

SEQ ID NO: 44789 - protein, 16 aa, BK virus
QFQPLKILWQQQPQIH

SEQ ID NO: 44790 - protein, 16 aa, BK virus
FQPLKILWQQQPQIHW

SEQ ID NO: 44791 - protein, 16 aa, BK virus
QPLKILWQQQPQIHWQ

SEQ ID NO: 44792 - protein, 16 aa, BK virus
PLKILWQQQPQIHWQL

SEQ ID NO: 44793 - protein, 16 aa, BK virus
LKILWQQQPQIHWQLG

SEQ ID NO: 44794 - protein, 16 aa, BK virus
KILWQQQPQIHWQLGP

SEQ ID NO: 44795 - protein, 16 aa, BK virus
ILWQQQPQIHWQLGPP

SEQ ID NO: 44796 - protein, 16 aa, BK virus
LWQQQPQIHWQLGPPK

SEQ ID NO: 44797 - protein, 16 aa, BK virus
WQQQPQIHWQLGPPKV

SEQ ID NO: 44798 - protein, 16 aa, BK virus
QQQPQIHWQLGPPKVL

SEQ ID NO: 44799 - protein, 16 aa, BK virus
QQPQIHWQLGPPKVLE

SEQ ID NO: 44800 - protein, 16 aa, BK virus
QPQIHWQLGPPKVLEQ

SEQ ID NO: 44801 - protein, 16 aa, BK virus
PQIHWQLGPPKVLEQH

SEQ ID NO: 44802 - protein, 16 aa, BK virus
QIHWQLGPPKVLEQHP

SEQ ID NO: 44803 - protein, 16 aa, BK virus
TWKYKKKGITYLGVFY

SEQ ID NO: 44804 - protein, 16 aa, BK virus
WKYKKKGITYLGVFYR

SEQ ID NO: 44805 - protein, 16 aa, BK virus
KYKKKGITYLGVFYRV

SEQ ID NO: 44806 - protein, 16 aa, BK virus
YKKKGITYLGVFYRVF

SEQ ID NO: 44807 - protein, 16 aa, BK virus
KKKGITYLGVFYRVFY

SEQ ID NO: 44808 - protein, 16 aa, BK virus
KKGITYLGVFYRVFYS

SEQ ID NO: 44809 - protein, 16 aa, BK virus
KGITYLGVFYRVFYSR

SEQ ID NO: 44810 - protein, 16 aa, BK virus
SSGTFVFPVYTVFTST

SEQ ID NO: 44811 - protein, 16 aa, BK virus
SGTFVFPVYTVFTSTK

SEQ ID NO: 44812 - protein, 16 aa, BK virus
GTFVFPVYTVFTSTKF

SEQ ID NO: 44813 - protein, 16 aa, BK virus
TFVFPVYTVFTSTKFQ

SEQ ID NO: 44814 - protein, 16 aa, BK virus
FVFPVYTVFTSTKFQQ

SEQ ID NO: 44815 - protein, 16 aa, BK virus
VFPVYTVFTSTKFQQK

SEQ ID NO: 44816 - protein, 16 aa, BK virus
FPVYTVFTSTKFQQKL

SEQ ID NO: 44817 - protein, 16 aa, BK virus
NKNKNPLSSFFCSSPG

SEQ ID NO: 44818 - protein, 16 aa, BK virus
KNKNPLSSFFCSSPGF

SEQ ID NO: 44819 - protein, 16 aa, BK virus
NKNPLSSFFCSSPGFT

SEQ ID NO: 44820 - protein, 16 aa, BK virus
KNPLSSFFCSSPGFTN

SEQ ID NO: 44821 - protein, 16 aa, BK virus
NPLSSFFCSSPGFTNF

SEQ ID NO: 44822 - protein, 16 aa, BK virus
PLSSFFCSSPGFTNFH

SEQ ID NO: 44823 - protein, 16 aa, BK virus
LGTRPRFLGSQNMSVM

SEQ ID NO: 44824 - protein, 16 aa, BK virus
GTRPRFLGSQNMSVMH

SEQ ID NO: 44825 - protein, 16 aa, BK virus
TRPRFLGSQNMSVMHF

SEQ ID NO: 44826 - protein, 16 aa, BK virus
RPRFLGSQNMSVMHFP

SEQ ID NO: 44827 - protein, 16 aa, BK virus
PRFLGSQNMSVMHFPS

SEQ ID NO: 44828 - protein, 16 aa, BK virus
AAPPCESCTFLPEVMV

SEQ ID NO: 44829 - protein, 16 aa, BK virus
APPCESCTFLPEVMVW

SEQ ID NO: 44830 - protein, 16 aa, BK virus
PPCESCTFLPEVMVWL

SEQ ID NO: 44831 - protein, 16 aa, BK virus
PCESCTFLPEVMVWLH

SEQ ID NO: 44832 - protein, 16 aa, BK virus
CESCTFLPEVMVWLHS

SEQ ID NO: 44833 - protein, 16 aa, BK virus
ESCTFLPEVMVWLHSP

SEQ ID NO: 44834 - protein, 16 aa, BK virus
SCTFLPEVMVWLHSPV

SEQ ID NO: 44835 - protein, 16 aa, BK virus
CTFLPEVMVWLHSPVS

SEQ ID NO: 44836 - protein, 16 aa, BK virus
TFLPEVMVWLHSPVSH

SEQ ID NO: 44837 - protein, 16 aa, BK virus
FLPEVMVWLHSPVSHA

SEQ ID NO: 44838 - protein, 16 aa, BK virus
LPEVMVWLHSPVSHAL

SEQ ID NO: 44839 - protein, 16 aa, BK virus
PEVMVWLHSPVSHALS

SEQ ID NO: 44840 - protein, 16 aa, BK virus
EVMVWLHSPVSHALSF

SEQ ID NO: 44841 - protein, 16 aa, BK virus
VMVWLHSPVSHALSFL

SEQ ID NO: 44842 - protein, 16 aa, BK virus
MVWLHSPVSHALSFLR

SEQ ID NO: 44843 - protein, 16 aa, BK virus
VWLHSPVSHALSFLRS

SEQ ID NO: 44844 - protein, 16 aa, BK virus
WLHSPVSHALSFLRSW

SEQ ID NO: 44845 - protein, 16 aa, BK virus
LHSPVSHALSFLRSWF

SEQ ID NO: 44846 - protein, 16 aa, BK virus
HSPVSHALSFLRSWFG

SEQ ID NO: 44847 - protein, 16 aa, BK virus
SPVSHALSFLRSWFGC

SEQ ID NO: 44848 - protein, 16 aa, BK virus
PVSHALSFLRSWFGCI

SEQ ID NO: 44849 - protein, 16 aa, BK virus
VSHALSFLRSWFGCIP

SEQ ID NO: 44850 - protein, 16 aa, BK virus
SHALSFLRSWFGCIPW

SEQ ID NO: 44851 - protein, 16 aa, BK virus
HALSFLRSWFGCIPWV

SEQ ID NO: 44852 - protein, 16 aa, BK virus
ALSFLRSWFGCIPWVS

SEQ ID NO: 44853 - protein, 16 aa, BK virus
LSFLRSWFGCIPWVSS

SEQ ID NO: 44854 - protein, 16 aa, BK virus
SFLRSWFGCIPWVSSS

SEQ ID NO: 44855 - protein, 16 aa, BK virus
FLRSWFGCIPWVSSSS

SEQ ID NO: 44856 - protein, 16 aa, BK virus
LRSWFGCIPWVSSSSL

SEQ ID NO: 44857 - protein, 16 aa, BK virus
RSWFGCIPWVSSSSLW

SEQ ID NO: 44858 - protein, 16 aa, BK virus
SWFGCIPWVSSSSLWP

SEQ ID NO: 44859 - protein, 16 aa, BK virus
WFGCIPWVSSSSLWPF

SEQ ID NO: 44860 - protein, 16 aa, BK virus
FGCIPWVSSSSLWPFF

SEQ ID NO: 44861 - protein, 16 aa, BK virus
GCIPWVSSSSLWPFFL

SEQ ID NO: 44862 - protein, 16 aa, BK virus
YIRGRGRLCLHPFSQV

SEQ ID NO: 44863 - protein, 16 aa, BK virus
IRGRGRLCLHPFSQVV

SEQ ID NO: 44864 - protein, 16 aa, BK virus
RGRGRLCLHPFSQVVR

SEQ ID NO: 44865 - protein, 16 aa, BK virus
GRGRLCLHPFSQVVRV

SEQ ID NO: 44866 - protein, 16 aa, BK virus
RGRLCLHPFSQVVRVW

SEQ ID NO: 44867 - protein, 16 aa, BK virus
GRLCLHPFSQVVRVWR

SEQ ID NO: 44868 - protein, 16 aa, BK virus
RLCLHPFSQVVRVWRL

SEQ ID NO: 44869 - protein, 16 aa, BK virus
LCLHPFSQVVRVWRLF

SEQ ID NO: 44870 - protein, 16 aa, BK virus
CLHPFSQVVRVWRLFL

SEQ ID NO: 44871 - protein, 16 aa, BK virus
LHPFSQVVRVWRLFLR

SEQ ID NO: 44872 - protein, 16 aa, BK virus
HPFSQVVRVWRLFLRP

SEQ ID NO: 44873 - protein, 16 aa, BK virus
PFSQVVRVWRLFLRPS

SEQ ID NO: 44874 - protein, 16 aa, BK virus
FSQVVRVWRLFLRPSK

SEQ ID NO: 44875 - protein, 16 aa, BK virus
SQVVRVWRLFLRPSKT

SEQ ID NO: 44876 - protein, 16 aa, BK virus
QVVRVWRLFLRPSKTI

SEQ ID NO: 44877 - protein, 16 aa, BK virus
VVRVWRLFLRPSKTIW

SEQ ID NO: 44878 - protein, 16 aa, BK virus
VRVWRLFLRPSKTIWG

SEQ ID NO: 44879 - protein, 16 aa, BK virus
RVWRLFLRPSKTIWGN

SEQ ID NO: 44880 - protein, 16 aa, BK virus
VWRLFLRPSKTIWGNP

SEQ ID NO: 44881 - protein, 16 aa, BK virus
WRLFLRPSKTIWGNPY

SEQ ID NO: 44882 - protein, 16 aa, BK virus
RLFLRPSKTIWGNPYS

SEQ ID NO: 44883 - protein, 16 aa, BK virus
LFLRPSKTIWGNPYSF

SEQ ID NO: 44884 - protein, 16 aa, BK virus
FLRPSKTIWGNPYSFA

SEQ ID NO: 44885 - protein, 16 aa, BK virus
LRPSKTIWGNPYSFAI

SEQ ID NO: 44886 - protein, 16 aa, BK virus
RPSKTIWGNPYSFAIF

SEQ ID NO: 44887 - protein, 16 aa, BK virus
PSKTIWGNPYSFAIFA

SEQ ID NO: 44888 - protein, 16 aa, BK virus
SKTIWGNPYSFAIFAK

SEQ ID NO: 44889 - protein, 239 aa, Homo sapiens; identical to SEQ ID NO: 6

SEQ ID NO: 44890 - protein, 233 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRKGQERFNRWFLTGMTVAGVVLLGSLFSRK

SEQ ID NO: 44891 - protein, 142 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMD

SEQ ID NO: 44892 - protein, 350 aa, Homo sapiens [sequence omitted]

SEQ ID NO: 44893 - protein, 8 aa, Homo sapiens
ALSPVPPV

SEQ ID NO: 44894 - protein, 8 aa, Homo sapiens
TLLSLALV

SEQ ID NO: 44895 - protein, 8 aa, Homo sapiens
ALWMTEYL

SEQ ID NO: 44896 - protein, 8 aa, Homo sapiens
GVMCVESV

SEQ ID NO: 44897 - protein, 8 aa, Homo sapiens
PLFDFSWL

SEQ ID NO: 44898 - protein, 8 aa, Homo sapiens
SLKTLLSL

SEQ ID NO: 44899 - protein, 8 aa, Homo sapiens
ALSPVPPV

SEQ ID NO: 44900 - protein, 8 aa, Homo sapiens
WLSLKTLL

SEQ ID NO: 44901 - protein, 8 aa, Homo sapiens
SLKTLLSL

SEQ ID NO: 44902 - protein, 8 aa, Homo sapiens
PLFDFSWL

SEQ ID NO: 44903 - protein, 8 aa, Homo sapiens
ALWMTEYL

SEQ ID NO: 44904 - protein, 8 aa, Homo sapiens
GVMCVESV

SEQ ID NO: 44905 - protein, 8 aa, Homo sapiens
TLLSLALV

SEQ ID NO: 44906 - protein, 8 aa, Homo sapiens
EMSSQLHL

SEQ ID NO: 44907 - protein, 8 aa, Homo sapiens
LVGACITL

SEQ ID NO: 44908 - protein, 8 aa, Homo sapiens
FATVVEEL

SEQ ID NO: 44909 - protein, 8 aa, Homo sapiens
PLVDNIAL

SEQ ID NO: 44910 - protein, 8 aa, Homo sapiens
YLNRHLHT

SEQ ID NO: 44911 - protein, 8 aa, Homo sapiens
FDFSWLSL

SEQ ID NO: 44912 - protein, 8 aa, Homo sapiens
ALSPVPPV

SEQ ID NO: 44913 - protein, 8 aa, Homo sapiens
SLKTLLSL

SEQ ID NO: 44914 - protein, 8 aa, Homo sapiens
GVMCVESV

SEQ ID NO: 44915 - protein, 8 aa, Homo sapiens
YLNRHLHT

SEQ ID NO: 44916 - protein, 8 aa, Homo sapiens
TLLSLALV

SEQ ID NO: 44917 - protein, 8 aa, Homo sapiens
WLSLKTLL

SEQ ID NO: 44918 - protein, 8 aa, Homo sapiens
GVNWGRIV

SEQ ID NO: 44919 - protein, 8 aa, Homo sapiens
FTARGRFA

SEQ ID NO: 44920 - protein, 8 aa, Homo sapiens
ALWMTEYL

SEQ ID NO: 44921 - protein, 8 aa, Homo sapiens
PLFDFSWL

SEQ ID NO: 44922 - protein, 8 aa, Homo sapiens
ALSPVPPV

SEQ ID NO: 44923 - protein, 8 aa, Homo sapiens
ALWMTEYL

SEQ ID NO: 44924 - protein, 8 aa, Homo sapiens
TLLSLALV

SEQ ID NO: 44925 - protein, 8 aa, Homo sapiens
GVMCVESV

SEQ ID NO: 44926 - protein, 8 aa, Homo sapiens
LVGACITL

SEQ ID NO: 44927 - protein, 8 aa, Homo sapiens
ALSPVPPV

SEQ ID NO: 44928 - protein, 8 aa, Homo sapiens
GVMCVESV

SEQ ID NO: 44929 - protein, 8 aa, Homo sapiens
SQLHLTPF

SEQ ID NO: 44930 - protein, 8 aa, Homo sapiens
TLLSLALV

SEQ ID NO: 44931 - protein, 8 aa, Homo sapiens
RIVAFFEF

SEQ ID NO: 44932 - protein, 8 aa, Homo sapiens
KTLLSLAL

SEQ ID NO: 44933 - protein, 8 aa, Homo sapiens
ALWMTEYL

SEQ ID NO: 44934 - protein, 8 aa, Homo sapiens
LVGACITL

SEQ ID NO: 44935 - protein, 8 aa, Homo sapiens
FTARGRFA

SEQ ID NO: 44936 - protein, 8 aa, Homo sapiens
WLSLKTLL

SEQ ID NO: 44937 - protein, 8 aa, Homo sapiens
FATVVEEL

SEQ ID NO: 44938 - protein, 8 aa, Homo sapiens
RQAGDDFS

SEQ ID NO: 44939 - protein, 8 aa, Homo sapiens
ALSPVPPV

SEQ ID NO: 44940 - protein, 8 aa, Homo sapiens
TLLSLALV

SEQ ID NO: 44941 - protein, 8 aa, Homo sapiens
ALWMTEYL

SEQ ID NO: 44942 - protein, 8 aa, Homo sapiens
PLFDFSWL

SEQ ID NO: 44943 - protein, 8 aa, Homo sapiens
PLVDNIAL

SEQ ID NO: 44944 - protein, 8 aa, Homo sapiens
SLKTLLSL

SEQ ID NO: 44945 - protein, 8 aa, Homo sapiens
WLSLKTLL

SEQ ID NO: 44946 - protein, 8 aa, Homo sapiens
YLNRHLHT

SEQ ID NO: 44947 - protein, 8 aa, Homo sapiens
EMSSQLHL

SEQ ID NO: 44948 - protein, 8 aa, Homo sapiens
GVNWGRIV

SEQ ID NO: 44949 - protein, 8 aa, Homo sapiens
GVMCVESV

SEQ ID NO: 44950 - protein, 8 aa, Homo sapiens
AFFEFGGV

SEQ ID NO: 44951 - protein, 8 aa, Homo sapiens
PVPPVVHL

SEQ ID NO: 44952 - protein, 8 aa, Homo sapiens
CITLGAYL

SEQ ID NO: 44953 - protein, 8 aa, Homo sapiens
LVGACITL

SEQ ID NO: 44954 - protein, 8 aa, Homo sapiens
ALVGACIT

SEQ ID NO: 44955 - protein, 8 aa, Homo sapiens
YEWDAGDV

SEQ ID NO: 44956 - protein, 8 aa, Homo sapiens
EFGGVMCV

SEQ ID NO: 44957 - protein, 8 aa, Homo sapiens
SLALVGAC

SEQ ID NO: 44958 - protein, 8 aa, Homo sapiens
ALSPVPPV

SEQ ID NO: 44959 - protein, 8 aa, Homo sapiens
ALWMTEYL

SEQ ID NO: 44960 - protein, 8 aa, Homo sapiens
TLLSLALV

SEQ ID NO: 44961 - protein, 8 aa, Homo sapiens
PLFDFSWL

SEQ ID NO: 44962 - protein, 8 aa, Homo sapiens
PLVDNIAL

SEQ ID NO: 44963 - protein, 8 aa, Homo sapiens
SLKTLLSL

SEQ ID NO: 44964 - protein, 8 aa, Homo sapiens
YLNRHLHT

SEQ ID NO: 44965 - protein, 8 aa, Homo sapiens
EMSSQLHL

SEQ ID NO: 44966 - protein, 8 aa, Homo sapiens
WLSLKTLL

SEQ ID NO: 44967 - protein, 8 aa, Homo sapiens
YEWDAGDV

SEQ ID NO: 44968 - protein, 8 aa, Homo sapiens
GVMCVESV

SEQ ID NO: 44969 - protein, 8 aa, Homo sapiens
ALSPVPPV

SEQ ID NO: 44970 - protein, 8 aa, Homo sapiens
ALWMTEYL

SEQ ID NO: 44971 - protein, 8 aa, Homo sapiens
TLLSLALV

SEQ ID NO: 44972 - protein, 8 aa, Homo sapiens
PLFDFSWL

SEQ ID NO: 44973 - protein, 8 aa, Homo sapiens
PLVDNIAL

SEQ ID NO: 44974 - protein, 8 aa, Homo sapiens
SLKTLLSL

SEQ ID NO: 44975 - protein, 8 aa, Homo sapiens
WLSLKTLL

SEQ ID NO: 44976 - protein, 8 aa, Homo sapiens
EMSSQLHL

SEQ ID NO: 44977 - protein, 8 aa, Homo sapiens
GVMCVESV

SEQ ID NO: 44978 - protein, 8 aa, Homo sapiens
YLNRHLHT

SEQ ID NO: 44979 - protein, 8 aa, Homo sapiens
ALVGACIT

SEQ ID NO: 44980 - protein, 8 aa, Homo sapiens
LVGACITL

SEQ ID NO: 44981 - protein, 8 aa, Homo sapiens
PVPPVVHL

SEQ ID NO: 44982 - protein, 8 aa, Homo sapiens
EFGGVMCV

SEQ ID NO: 44983 - protein, 8 aa, Homo sapiens
CITLGAYL

SEQ ID NO: 44984 - protein, 8 aa, Homo sapiens
GVNWGRIV

SEQ ID NO: 44985 - protein, 8 aa, Homo sapiens
ALSPVPPV

SEQ ID NO: 44986 - protein, 8 aa, Homo sapiens
ALWMTEYL

SEQ ID NO: 44987 - protein, 8 aa, Homo sapiens
TLLSLALV

SEQ ID NO: 44988 - protein, 8 aa, Homo sapiens
PLFDFSWL

SEQ ID NO: 44989 - protein, 8 aa, Homo sapiens
PLVDNIAL

SEQ ID NO: 44990 - protein, 8 aa, Homo sapiens
EMSSQLHL

SEQ ID NO: 44991 - protein, 8 aa, Homo sapiens
WLSLKTLL

SEQ ID NO: 44992 - protein, 8 aa, Homo sapiens
GVMCVESV

SEQ ID NO: 44993 - protein, 8 aa, Homo sapiens
SLKTLLSL

SEQ ID NO: 44994 - protein, 8 aa, Homo sapiens
YEWDAGDV

SEQ ID NO: 44995 - protein, 8 aa, Homo sapiens
YLNRHLHT

SEQ ID NO: 44996 - protein, 8 aa, Homo sapiens
VMKYIHYK

SEQ ID NO: 44997 - protein, 8 aa, Homo sapiens
IVMKYIHY

SEQ ID NO: 44998 - protein, 8 aa, Homo sapiens
HLTPFTAR

SEQ ID NO: 44999 - protein, 8 aa, Homo sapiens
ELYGPSMR

SEQ ID NO: 45000 - protein, 8 aa, Homo sapiens
VMKYIHYK

SEQ ID NO: 45001 - protein, 8 aa, Homo sapiens
TVVEELFR

SEQ ID NO: 45002 - protein, 8 aa, Homo sapiens
IVMKYIHY

SEQ ID NO: 45003 - protein, 8 aa, Homo sapiens
NWGRIVAF

SEQ ID NO: 45004 - protein, 8 aa, Homo sapiens
RIVAFFEF

SEQ ID NO: 45005 - protein, 8 aa, Homo sapiens
SMRPLFDF

SEQ ID NO: 45006 - protein, 8 aa, Homo sapiens
PFTARGRF

SEQ ID NO: 45007 - protein, 8 aa, Homo sapiens
NWGRIVAF

SEQ ID NO: 45008 - protein, 8 aa, Homo sapiens
SWLSLKTL

SEQ ID NO: 45009 - protein, 8 aa, Homo sapiens
SMRPLFDF

SEQ ID NO: 45010 - protein, 8 aa, Homo sapiens
RIVAFFEF

SEQ ID NO: 45011 - protein, 8 aa, Homo sapiens
IVMKYIHY

SEQ ID NO: 45012 - protein, 8 aa, Homo sapiens
EMSSQLHL

SEQ ID NO: 45013 - protein, 8 aa, Homo sapiens
RIVAFFEF

SEQ ID NO: 45014 - protein, 8 aa, Homo sapiens
EIVMKYIH

SEQ ID NO: 45015 - protein, 8 aa, Homo sapiens
ATVVEELF

SEQ ID NO: 45016 - protein, 8 aa, Homo sapiens
IVMKYIHY

SEQ ID NO: 45017 - protein, 8 aa, Homo sapiens
ACITLGAY

SEQ ID NO: 45018 - protein, 8 aa, Homo sapiens
VMKYIHYK

SEQ ID NO: 45019 - protein, 8 aa, Homo sapiens
ASRDPVAR

SEQ ID NO: 45020 - protein, 8 aa, Homo sapiens
RGRFATVV

SEQ ID NO: 45021 - protein, 8 aa, Homo sapiens
EMSSQLHL

SEQ ID NO: 45022 - protein, 8 aa, Homo sapiens
SMRPLFDF

SEQ ID NO: 45023 - protein, 8 aa, Homo sapiens
VMKYIHYK

SEQ ID NO: 45024 - protein, 8 aa, Homo sapiens
HLTPFTAR

SEQ ID NO: 45025 - protein, 8 aa, Homo sapiens
ASRDPVAR

SEQ ID NO: 45026 - protein, 8 aa, Homo sapiens
DFSRRYRR

SEQ ID NO: 45027 - protein, 8 aa, Homo sapiens
WMTEYLNR

SEQ ID NO: 45028 - protein, 8 aa, Homo sapiens
TVVEELFR

SEQ ID NO: 45029 - protein, 8 aa, Homo sapiens
DFSRRYRR

SEQ ID NO: 45030 - protein, 8 aa, Homo sapiens
HLTPFTAR

SEQ ID NO: 45031 - protein, 8 aa, Homo sapiens
DFSWLSLK

SEQ ID NO: 45032 - protein, 8 aa, Homo sapiens
DDFSRRYR

SEQ ID NO: 45033 - protein, 8 aa, Homo sapiens
ELYGPSMR

SEQ ID NO: 45034 - protein, 8 aa, Homo sapiens
TVVEELFR

SEQ ID NO: 45035 - protein, 8 aa, Homo sapiens
VMKYIHYK

SEQ ID NO: 45036 - protein, 8 aa, Homo sapiens
TVVEELFR

SEQ ID NO: 45037 - protein, 8 aa, Homo sapiens
ELYGPSMR

SEQ ID NO: 45038 - protein, 8 aa, Homo sapiens
HLTPFTAR

SEQ ID NO: 45039 - protein, 8 aa, Homo sapiens
DFSWLSLK

SEQ ID NO: 45040 - protein, 8 aa, Homo sapiens
TPFTARGR

SEQ ID NO: 45041 - protein, 8 aa, Homo sapiens
TPHPAASR

SEQ ID NO: 45042 - protein, 8 aa, Homo sapiens
DDFSRRYR

SEQ ID NO: 45043 - protein, 8 aa, Homo sapiens
VMKYIHYK

SEQ ID NO: 45044 - protein, 8 aa, Homo sapiens
QAGDDFSR

SEQ ID NO: 45045 - protein, 8 aa, Homo sapiens
WMTEYLNR

SEQ ID NO: 45046 - protein, 8 aa, Homo sapiens
MCVESVNR

SEQ ID NO: 45047 - protein, 8 aa, Homo sapiens
DFSRRYRR

SEQ ID NO: 45048 - protein, 8 aa, Homo sapiens
PVVHLTLR

SEQ ID NO: 45049 - protein, 8 aa, Homo sapiens
GVMCVESV

SEQ ID NO: 45050 - protein, 8 aa, Homo sapiens
MSPLVDNI

SEQ ID NO: 45051 - protein, 8 aa, Homo sapiens
FTARGRFA

SEQ ID NO: 45052 - protein, 8 aa, Homo sapiens
FATVVEEL

SEQ ID NO: 45053 - protein, 8 aa, Homo sapiens
QTPAAPGA

SEQ ID NO: 45054 - protein, 8 aa, Homo sapiens
TLLSLALV

SEQ ID NO: 45055 - protein, 8 aa, Homo sapiens
FTARGRFA

SEQ ID NO: 45056 - protein, 8 aa, Homo sapiens
EMSSQLHL

SEQ ID NO: 45057 - protein, 8 aa, Homo sapiens
ALSPVPPV

SEQ ID NO: 45058 - protein, 8 aa, Homo sapiens
GPSMRPLF

SEQ ID NO: 45059 - protein, 8 aa, Homo sapiens
TPAAPGAA

SEQ ID NO: 45060 - protein, 8 aa, Homo sapiens
SPLQTPAA

SEQ ID NO: 45061 - protein, 8 aa, Homo sapiens
PPVVHLTL

SEQ ID NO: 45062 - protein, 8 aa, Homo sapiens
RPLFDFSW

SEQ ID NO: 45063 - protein, 8 aa, Homo sapiens
SQLHLTPF

SEQ ID NO: 45064 - protein, 8 aa, Homo sapiens
SMRPLFDF

SEQ ID NO: 45065 - protein, 8 aa, Homo sapiens
IVMKYIHY

SEQ ID NO: 45066 - protein, 8 aa, Homo sapiens
RIVAFFEF

SEQ ID NO: 45067 - protein, 8 aa, Homo sapiens
VELYGPSM

SEQ ID NO: 45068 - protein, 8 aa, Homo sapiens
TEYLNRHL

SEQ ID NO: 45069 - protein, 8 aa, Homo sapiens
IALWMTEY

SEQ ID NO: 45070 - protein, 8 aa, Homo sapiens
SQLHLTPF

SEQ ID NO: 45071 - protein, 8 aa, Homo sapiens
FEFGGVMC

SEQ ID NO: 45072 - protein, 8 aa, Homo sapiens
IALWMTEY

SEQ ID NO: 45073 - protein, 8 aa, Homo sapiens
FFEFGGVM

SEQ ID NO: 45074 - protein, 8 aa, Homo sapiens
SPLQTPAA

SEQ ID NO: 45075 - protein, 8 aa, Homo sapiens
FAEMSSQL

SEQ ID NO: 45076 - protein, 8 aa, Homo sapiens
SPVPPVVH

SEQ ID NO: 45077 - protein, 8 aa, Homo sapiens
TPAAPGAA

SEQ ID NO: 45078 - protein, 8 aa, Homo sapiens
FATVVEEL

SEQ ID NO: 45079 - protein, 8 aa, Homo sapiens
TEYLNRHL

SEQ ID NO: 45080 - protein, 8 aa, Homo sapiens
REIVMKYI

SEQ ID NO: 45081 - protein, 8 aa, Homo sapiens
FEFGGVMC

SEQ ID NO: 45082 - protein, 8 aa, Homo sapiens
REIVMKYI

SEQ ID NO: 45083 - protein, 8 aa, Homo sapiens
AEMSSQLH

SEQ ID NO: 45084 - protein, 8 aa, Homo sapiens
EELFRDGV

SEQ ID NO: 45085 - protein, 8 aa, Homo sapiens
REIVMKYI

SEQ ID NO: 45086 - protein, 8 aa, Homo sapiens
LALVGACI

SEQ ID NO: 45087 - protein, 8 aa, Homo sapiens
PPVVHLTL

SEQ ID NO: 45088 - protein, 8 aa, Homo sapiens
RPLFDFSW

SEQ ID NO: 45089 - protein, 8 aa, Homo sapiens
GPSMRPLF

SEQ ID NO: 45090 - protein, 8 aa, Homo sapiens
TPAAPGAA

SEQ ID NO: 45091 - protein, 8 aa, Homo sapiens
SPLQTPAA

SEQ ID NO: 45092 - protein, 8 aa, Homo sapiens
APPGAAPA

SEQ ID NO: 45093 - protein, 8 aa, Homo sapiens
SPLVDNIA

SEQ ID NO: 45094 - protein, 8 aa, Homo sapiens
VPPVVHLT

SEQ ID NO: 45095 - protein, 8 aa, Homo sapiens
LSQRGYEW

SEQ ID NO: 45096 - protein, 8 aa, Homo sapiens
RIVAFFEF

SEQ ID NO: 45097 - protein, 8 aa, Homo sapiens
LVDNIALW

SEQ ID NO: 45098 - protein, 8 aa, Homo sapiens
IALWMTEY

SEQ ID NO: 45099 - protein, 9 aa, Homo sapiens
NIALWMTEY

SEQ ID NO: 45100 - protein, 9 aa, Homo sapiens
ALSPVPPVV

SEQ ID NO: 45101 - protein, 9 aa, Homo sapiens
ALVGACITL

SEQ ID NO: 45102 - protein, 9 aa, Homo sapiens
KTLLSLALV

SEQ ID NO: 45103 - protein, 9 aa, Homo sapiens
LLSLALVGA

SEQ ID NO: 45104 - protein, 9 aa, Homo sapiens
IALWMTEYL

SEQ ID NO: 45105 - protein, 9 aa, Homo sapiens
LLSLALVGA

SEQ ID NO: 45106 - protein, 9 aa, Homo sapiens
VMKYIHYKL

SEQ ID NO: 45107 - protein, 9 aa, Homo sapiens
ALVGACITL

SEQ ID NO: 45108 - protein, 9 aa, Homo sapiens
SLKTLLSLA

SEQ ID NO: 45109 - protein, 9 aa, Homo sapiens
SVNREMSPL

SEQ ID NO: 45110 - protein, 9 aa, Homo sapiens
AAGPALSPV

SEQ ID NO: 45111 - protein, 9 aa, Homo sapiens
ALSPVPPVV

SEQ ID NO: 45112 - protein, 9 aa, Homo sapiens
EMSPLVDNI

SEQ ID NO: 45113 - protein, 9 aa, Homo sapiens
SLALVGACI

SEQ ID NO: 45114 - protein, 9 aa, Homo sapiens
RTSPLQTPA

SEQ ID NO: 45115 - protein, 9 aa, Homo sapiens
SMRPLFDFS

SEQ ID NO: 45116 - protein, 9 aa, Homo sapiens
YLNRHLHTW

SEQ ID NO: 45117 - protein, 9 aa, Homo sapiens
IALWMTEYL

SEQ ID NO: 45118 - protein, 9 aa, Homo sapiens
KTLLSLALV

SEQ ID NO: 45119 - protein, 9 aa, Homo sapiens
EMSSQLHLT

SEQ ID NO: 45120 - protein, 9 aa, Homo sapiens
SLKTLLSLA

SEQ ID NO: 45121 - protein, 9 aa, Homo sapiens
ALSPVPPVV

SEQ ID NO: 45122 - protein, 9 aa, Homo sapiens
LLSLALVGA

SEQ ID NO: 45123 - protein, 9 aa, Homo sapiens
AAGPALSPV

SEQ ID NO: 45124 - protein, 9 aa, Homo sapiens
SVNREMSPL

SEQ ID NO: 45125 - protein, 9 aa, Homo sapiens
TARGRFATV

SEQ ID NO: 45126 - protein, 9 aa, Homo sapiens
VMKYIHYKL

SEQ ID NO: 45127 - protein, 9 aa, Homo sapiens
ALVGACITL

SEQ ID NO: 45128 - protein, 9 aa, Homo sapiens
SLALVGACI

SEQ ID NO: 45129 - protein, 9 aa, Homo sapiens
KTLLSLALV

SEQ ID NO: 45130 - protein, 9 aa, Homo sapiens
RTSPLQTPA

SEQ ID NO: 45131 - protein, 9 aa, Homo sapiens
VAFFEFGGV

SEQ ID NO: 45132 - protein, 9 aa, Homo sapiens
EMSPLVDNI

SEQ ID NO: 45133 - protein, 9 aa, Homo sapiens
QLHLTPFTA

SEQ ID NO: 45134 - protein, 9 aa, Homo sapiens
SMRPLFDFS

SEQ ID NO: 45135 - protein, 9 aa, Homo sapiens
YLNRHLHTW

SEQ ID NO: 45136 - protein, 9 aa, Homo sapiens
ALSPVPPVV

SEQ ID NO: 45137 - protein, 9 aa, Homo sapiens
ALVGACITL

SEQ ID NO: 45138 - protein, 9 aa, Homo sapiens
AAGPALSPV

SEQ ID NO: 45139 - protein, 9 aa, Homo sapiens
KTLLSLALV

SEQ ID NO: 45140 - protein, 9 aa, Homo sapiens
AAGPALSPV

SEQ ID NO: 45141 - protein, 9 aa, Homo sapiens
SQLHLTPFT

SEQ ID NO: 45142 - protein, 9 aa, Homo sapiens
LQTPAAPGA

SEQ ID NO: 45143 - protein, 9 aa, Homo sapiens
FEFGGVMCV

SEQ ID NO: 45144 - protein, 9 aa, Homo sapiens
ALVGACITL

SEQ ID NO: 45145 - protein, 9 aa, Homo sapiens
LLSLALVGA

SEQ ID NO: 45146 - protein, 9 aa, Homo sapiens
ALSPVPPVV

SEQ ID NO: 45147 - protein, 9 aa, Homo sapiens
FTARGRFAT

SEQ ID NO: 45148 - protein, 9 aa, Homo sapiens
IQDNGGWDA

SEQ ID NO: 45149 - protein, 9 aa, Homo sapiens
IALWMTEYL

SEQ ID NO: 45150 - protein, 9 aa, Homo sapiens
AAPPGAAPA

SEQ ID NO: 45151 - protein, 9 aa, Homo sapiens
TARGRFATV

SEQ ID NO: 45152 - protein, 9 aa, Homo sapiens
VAFFEFGGV

SEQ ID NO: 45153 - protein, 9 aa, Homo sapiens
RTSPLQTPA

SEQ ID NO: 45154 - protein, 9 aa, Homo sapiens
ALSPVPPVV

SEQ ID NO: 45155 - protein, 9 aa, Homo sapiens
ALVGACITL

SEQ ID NO: 45156 - protein, 9 aa, Homo sapiens
PLFDFSWLS

SEQ ID NO: 45157 - protein, 9 aa, Homo sapiens
FEFGGVMCV

SEQ ID NO: 45158 - protein, 9 aa, Homo sapiens
YLNRHLHTW

SEQ ID NO: 45159 - protein, 9 aa, Homo sapiens
SLALVGACI

SEQ ID NO: 45160 - protein, 9 aa, Homo sapiens
LLSLALVGA

SEQ ID NO: 45161 - protein, 9 aa, Homo sapiens
EMSPLVDNI

SEQ ID NO: 45162 - protein, 9 aa, Homo sapiens
QLHLTPFTA

SEQ ID NO: 45163 - protein, 9 aa, Homo sapiens
SLKTLLSLA

SEQ ID NO: 45164 - protein, 9 aa, Homo sapiens
LVDNIALWM

SEQ ID NO: 45165 - protein, 9 aa, Homo sapiens
KTLLSLALV

SEQ ID NO: 45166 - protein, 9 aa, Homo sapiens
GVNWGRIVA

SEQ ID NO: 45167 - protein, 9 aa, Homo sapiens
VMKYIHYKL

SEQ ID NO: 45168 - protein, 9 aa, Homo sapiens
AAGPALSPV

SEQ ID NO: 45169 - protein, 9 aa, Homo sapiens
EMSSQLHLT

SEQ ID NO: 45170 - protein, 9 aa, Homo sapiens
TGYDNREIV

SEQ ID NO: 45171 - protein, 9 aa, Homo sapiens
HLTPFTARG

SEQ ID NO: 45172 - protein, 9 aa, Homo sapiens
ELYGPSMRP

SEQ ID NO: 45173 - protein, 9 aa, Homo sapiens
GGWDAFVEL

SEQ ID NO: 45174 - protein, 9 aa, Homo sapiens
IALWMTEYL

SEQ ID NO: 45175 - protein, 9 aa, Homo sapiens
ALWMTEYLN

SEQ ID NO: 45176 - protein, 9 aa, Homo sapiens
AAPPGAAPA

SEQ ID NO: 45177 - protein, 9 aa, Homo sapiens
ALSPVPPVV

SEQ ID NO: 45178 - protein, 9 aa, Homo sapiens
ALVGACITL

SEQ ID NO: 45179 - protein, 9 aa, Homo sapiens
YLNRHLHTW

SEQ ID NO: 45180 - protein, 9 aa, Homo sapiens
FEFGGVMCV

SEQ ID NO: 45181 - protein, 9 aa, Homo sapiens
PLFDFSWLS

SEQ ID NO: 45182 - protein, 9 aa, Homo sapiens
VMKYIHYKL

SEQ ID NO: 45183 - protein, 9 aa, Homo sapiens
LLSLALVGA

SEQ ID NO: 45184 - protein, 9 aa, Homo sapiens
SLALVGACI

SEQ ID NO: 45185 - protein, 9 aa, Homo sapiens
EMSPLVDNI

SEQ ID NO: 45186 - protein, 9 aa, Homo sapiens
QLHLTPFTA

SEQ ID NO: 45187 - protein, 9 aa, Homo sapiens
FTARGRFAT

SEQ ID NO: 45188 - protein, 9 aa, Homo sapiens
ALSPVPPVV

SEQ ID NO: 45189 - protein, 9 aa, Homo sapiens
ALVGACITL

SEQ ID NO: 45190 - protein, 9 aa, Homo sapiens
AAGPALSPV

SEQ ID NO: 45191 - protein, 9 aa, Homo sapiens
FEFGGVMCV

SEQ ID NO: 45192 - protein, 9 aa, Homo sapiens
SLALVGACI

SEQ ID NO: 45193 - protein, 9 aa, Homo sapiens
VMKYIHYKL

SEQ ID NO: 45194 - protein, 9 aa, Homo sapiens
PLFDFSWLS

SEQ ID NO: 45195 - protein, 9 aa, Homo sapiens
QLHLTPFTA

SEQ ID NO: 45196 - protein, 9 aa, Homo sapiens
SLKTLLSLA

SEQ ID NO: 45197 - protein, 9 aa, Homo sapiens
YLNRHLHTW

SEQ ID NO: 45198 - protein, 9 aa, Homo sapiens
TARGRFATV

SEQ ID NO: 45199 - protein, 9 aa, Homo sapiens
ALSPVPPVV

SEQ ID NO: 45200 - protein, 9 aa, Homo sapiens
FEFGGVMCV

SEQ ID NO: 45201 - protein, 9 aa, Homo sapiens
ALVGACITL

SEQ ID NO: 45202 - protein, 9 aa, Homo sapiens
AAGPALSPV

SEQ ID NO: 45203 - protein, 9 aa, Homo sapiens
LLSLALVGA

SEQ ID NO: 45204 - protein, 9 aa, Homo sapiens
PALSPVPPV

SEQ ID NO: 45205 - protein, 9 aa, Homo sapiens
EMSPLVDNI

SEQ ID NO: 45206 - protein, 9 aa, Homo sapiens
EMSSQLHLT

SEQ ID NO: 45207 - protein, 9 aa, Homo sapiens
YLNRHLHTW

SEQ ID NO: 45208 - protein, 9 aa, Homo sapiens
IVMKYIHYK

SEQ ID NO: 45209 - protein, 9 aa, Homo sapiens
TLGAYLGHK

SEQ ID NO: 45210 - protein, 9 aa, Homo sapiens
FDFSWLSLK

SEQ ID NO: 45211 - protein, 9 aa, Homo sapiens
IVMKYIHYK

SEQ ID NO: 45212 - protein, 9 aa, Homo sapiens
TLGAYLGHK

SEQ ID NO: 45213 - protein, 9 aa, Homo sapiens
ATVVEELFR

SEQ ID NO: 45214 - protein, 9 aa, Homo sapiens
NWGRIVAFF

SEQ ID NO: 45215 - protein, 9 aa, Homo sapiens
PSMRPLFDF

SEQ ID NO: 45216 - protein, 9 aa, Homo sapiens
GRIVAFFEF

SEQ ID NO: 45217 - protein, 9 aa, Homo sapiens
IVMKYIHYK

SEQ ID NO: 45218 - protein, 9 aa, Homo sapiens
RYRRDFAEM

SEQ ID NO: 45219 - protein, 9 aa, Homo sapiens
RFATVVEEL

SEQ ID NO: 45220 - protein, 9 aa, Homo sapiens
NWGRIVAFF

SEQ ID NO: 45221 - protein, 9 aa, Homo sapiens
RFATVVEEL

SEQ ID NO: 45222 - protein, 9 aa, Homo sapiens
SWLSLKTLL

SEQ ID NO: 45223 - protein, 9 aa, Homo sapiens
RYRRDFAEM

SEQ ID NO: 45224 - protein, 9 aa, Homo sapiens
RFATVVEEL

SEQ ID NO: 45225 - protein, 9 aa, Homo sapiens
LYGPSMRPL

SEQ ID NO: 45226 - protein, 9 aa, Homo sapiens
EIVMKYIHY

SEQ ID NO: 45227 - protein, 9 aa, Homo sapiens
NIALWMTEY

SEQ ID NO: 45228 - protein, 9 aa, Homo sapiens
EIVMKYIHY

SEQ ID NO: 45229 - protein, 9 aa, Homo sapiens
NIALWMTEY

SEQ ID NO: 45230 - protein, 9 aa, Homo sapiens
SVNREMSPL

SEQ ID NO: 45231 - protein, 9 aa, Homo sapiens
YLNRHLHTW

SEQ ID NO: 45232 - protein, 9 aa, Homo sapiens
FVELYGPSM

SEQ ID NO: 45233 - protein, 9 aa, Homo sapiens
LVDNIALWM

SEQ ID NO: 45234 - protein, 9 aa, Homo sapiens
NIALWMTEY

SEQ ID NO: 45235 - protein, 9 aa, Homo sapiens
EIVMKYIHY

SEQ ID NO: 45236 - protein, 9 aa, Homo sapiens
IVMKYIHYK

SEQ ID NO: 45237 - protein, 9 aa, Homo sapiens
MAHAGRTGY

SEQ ID NO: 45238 - protein, 9 aa, Homo sapiens
TLGAYLGHK

SEQ ID NO: 45239 - protein, 9 aa, Homo sapiens
NIALWMTEY

SEQ ID NO: 45240 - protein, 9 aa, Homo sapiens
IVMKYIHYK

SEQ ID NO: 45241 - protein, 9 aa, Homo sapiens
YIHYKLSQR

SEQ ID NO: 45242 - protein, 9 aa, Homo sapiens
VMCVESVNR

SEQ ID NO: 45243 - protein, 9 aa, Homo sapiens
RQAGDDFSR

SEQ ID NO: 45244 - protein, 9 aa, Homo sapiens
VMKYIHYKL

SEQ ID NO: 45245 - protein, 9 aa, Homo sapiens
ATVVEELFR

SEQ ID NO: 45246 - protein, 9 aa, Homo sapiens
DDFSRRYRR

SEQ ID NO: 45247 - protein, 9 aa, Homo sapiens
YIHYKLSQR

SEQ ID NO: 45248 - protein, 9 aa, Homo sapiens
HTPHPAASR

SEQ ID NO: 45249 - protein, 9 aa, Homo sapiens
IVMKYIHYK

SEQ ID NO: 45250 - protein, 9 aa, Homo sapiens
IVMKYIHYK

SEQ ID NO: 45251 - protein, 9 aa, Homo sapiens
YIHYKLSQR

SEQ ID NO: 45252 - protein, 9 aa, Homo sapiens
HTPHPAASR

SEQ ID NO: 45253 - protein, 9 aa, Homo sapiens
LTPFTARGR

SEQ ID NO: 45254 - protein, 9 aa, Homo sapiens
ATVVEELFR

SEQ ID NO: 45255 - protein, 9 aa, Homo sapiens
DDFSRRYRR

SEQ ID NO: 45256 - protein, 9 aa, Homo sapiens
FDFSWLSLK

SEQ ID NO: 45257 - protein, 9 aa, Homo sapiens
QAGDDFSRR

SEQ ID NO: 45258 - protein, 9 aa, Homo sapiens
NIALWMTEY

SEQ ID NO: 45259 - protein, 9 aa, Homo sapiens
TLGAYLGHK

SEQ ID NO: 45260 - protein, 9 aa, Homo sapiens
MAHAGRTGY

SEQ ID NO: 45261 - protein, 9 aa, Homo sapiens
FTARGRFAT

SEQ ID NO: 45262 - protein, 9 aa, Homo sapiens
VAFFEFGGV

SEQ ID NO: 45263 - protein, 9 aa, Homo sapiens
HPAASRDPV

SEQ ID NO: 45264 - protein, 9 aa, Homo sapiens
QTPAAPGAA

SEQ ID NO: 45265 - protein, 9 aa, Homo sapiens
SVNREMSPL

SEQ ID NO: 45266 - protein, 9 aa, Homo sapiens
TARGRFATV

SEQ ID NO: 45267 - protein, 9 aa, Homo sapiens
TGYDNREIV

SEQ ID NO: 45268 - protein, 9 aa, Homo sapiens
EMSPLVDNI

SEQ ID NO: 45269 - protein, 9 aa, Homo sapiens
RTSPLQTPA

SEQ ID NO: 45270 - protein, 9 aa, Homo sapiens
VGACITLGA

SEQ ID NO: 45271 - protein, 9 aa, Homo sapiens
MSPLVDNIA

SEQ ID NO: 45272 - protein, 9 aa, Homo sapiens
FEFGGVMCV

SEQ ID NO: 45273 - protein, 9 aa, Homo sapiens
PALSPVPPV

SEQ ID NO: 45274 - protein, 9 aa, Homo sapiens
DVGAAPPGA

SEQ ID NO: 45275 - protein, 9 aa, Homo sapiens
HPAASRDPV

SEQ ID NO: 45276 - protein, 9 aa, Homo sapiens
EMSPLVDNI

SEQ ID NO: 45277 - protein, 9 aa, Homo sapiens
FTARGRFAT

SEQ ID NO: 45278 - protein, 9 aa, Homo sapiens
KTLLSLALV

SEQ ID NO: 45279 - protein, 9 aa, Homo sapiens
TPAAPGAAA

SEQ ID NO: 45280 - protein, 9 aa, Homo sapiens
IALWMTEYL

SEQ ID NO: 45281 - protein, 9 aa, Homo sapiens
HPAASRDPV

SEQ ID NO: 45282 - protein, 9 aa, Homo sapiens
DPVARTSPL

SEQ ID NO: 45283 - protein, 9 aa, Homo sapiens
SPLVDNIAL

SEQ ID NO: 45284 - protein, 9 aa, Homo sapiens
TPAAPGAAA

SEQ ID NO: 45285 - protein, 9 aa, Homo sapiens
RPLFDFSWL

SEQ ID NO: 45286 - protein, 9 aa, Homo sapiens
SPVPPVVHL

SEQ ID NO: 45287 - protein, 9 aa, Homo sapiens
APGAAAGPA

SEQ ID NO: 45288 - protein, 9 aa, Homo sapiens
VPPVVHLTL

SEQ ID NO: 45289 - protein, 9 aa, Homo sapiens
TPFTARGRF

SEQ ID NO: 45290 - protein, 9 aa, Homo sapiens
TARGRFATV

SEQ ID NO: 45291 - protein, 9 aa, Homo sapiens
MAHAGRTGY

SEQ ID NO: 45292 - protein, 9 aa, Homo sapiens
SSQLHLTPF

SEQ ID NO: 45293 - protein, 9 aa, Homo sapiens
FEFGGVMCV

SEQ ID NO: 45294 - protein, 9 aa, Homo sapiens
DNREIVMKY

SEQ ID NO: 45295 - protein, 9 aa, Homo sapiens
IALWMTEYL

SEQ ID NO: 45296 - protein, 9 aa, Homo sapiens
GRIVAFFEF

SEQ ID NO: 45297 - protein, 9 aa, Homo sapiens
RRYRRDFAE

SEQ ID NO: 45298 - protein, 9 aa, Homo sapiens
SPLVDNIAL

SEQ ID NO: 45299 - protein, 9 aa, Homo sapiens
MAHAGRTGY

SEQ ID NO: 45300 - protein, 9 aa, Homo sapiens
FVELYGPSM

SEQ ID NO: 45301 - protein, 9 aa, Homo sapiens
TPFTARGRF

SEQ ID NO: 45302 - protein, 9 aa, Homo sapiens
IALWMTEYL

SEQ ID NO: 45303 - protein, 9 aa, Homo sapiens
DPVARTSPL

SEQ ID NO: 45304 - protein, 9 aa, Homo sapiens
FATVVEELF

SEQ ID NO: 45305 - protein, 9 aa, Homo sapiens
TPAAPGAAA

SEQ ID NO: 45306 - protein, 9 aa, Homo sapiens
NIALWMTEY

SEQ ID NO: 45307 - protein, 9 aa, Homo sapiens
FAEMSSQLH

SEQ ID NO: 45308 - protein, 9 aa, Homo sapiens
AEMSSQLHL

SEQ ID NO: 45309 - protein, 9 aa, Homo sapiens
FEFGGVMCV

SEQ ID NO: 45310 - protein, 9 aa, Homo sapiens
AEMSSQLHL

SEQ ID NO: 45311 - protein, 9 aa, Homo sapiens
FEFGGVMCV

SEQ ID NO: 45312 - protein, 9 aa, Homo sapiens
AEMSSQLHL

SEQ ID NO: 45313 - protein, 9 aa, Homo sapiens
AEMSSQLHL

SEQ ID NO: 45314 - protein, 9 aa, Homo sapiens
AEMSSQLHL

SEQ ID NO: 45315 - protein, 9 aa, Homo sapiens
VPPVVHLTL

SEQ ID NO: 45316 - protein, 9 aa, Homo sapiens
RPLFDFSWL

SEQ ID NO: 45317 - protein, 9 aa, Homo sapiens
SPLVDNIAL

SEQ ID NO: 45318 - protein, 9 aa, Homo sapiens
IALWMTEYL

SEQ ID NO: 45319 - protein, 9 aa, Homo sapiens
TPAAPGAAA

SEQ ID NO: 45320 - protein, 9 aa, Homo sapiens
HPAASRDPV

SEQ ID NO: 45321 - protein, 9 aa, Homo sapiens
APGAAAGPA

SEQ ID NO: 45322 - protein, 9 aa, Homo sapiens
QPGHTPHPA

SEQ ID NO: 45323 - protein, 9 aa, Homo sapiens
YLNRHLHTW

SEQ ID NO: 45324 - protein, 9 aa, Homo sapiens
KLSQRGYEW

SEQ ID NO: 45325 - protein, 9 aa, Homo sapiens
FATVVEELF

SEQ ID NO: 45326 - protein, 9 aa, Homo sapiens
GAAPAPGIF

SEQ ID NO: 45327 - protein, 10 aa, Homo sapiens
YLNRHLHTWI

SEQ ID NO: 45328 - protein, 10 aa, Homo sapiens
IVMKYIHYKL

SEQ ID NO: 45329 - protein, 10 aa, Homo sapiens
TLLSLALVGA

SEQ ID NO: 45330 - protein, 10 aa, Homo sapiens
PLFDFSWLSL

SEQ ID NO: 45331 - protein, 10 aa, Homo sapiens
WLSLKTLLSL

SEQ ID NO: 45332 - protein, 10 aa, Homo sapiens
FTARGRFATV

SEQ ID NO: 45333 - protein, 10 aa, Homo sapiens
NIALWMTEYL

SEQ ID NO: 45334 - protein, 10 aa, Homo sapiens
WMTEYLNRHL

SEQ ID NO: 45335 - protein, 10 aa, Homo sapiens
TLLSLALVGA

SEQ ID NO: 45336 - protein, 10 aa, Homo sapiens
NIALWMTEYL

SEQ ID NO: 45337 - protein, 10 aa, Homo sapiens
WLSLKTLLSL

SEQ ID NO: 45338 - protein, 10 aa, Homo sapiens
SLKTLLSLAL

SEQ ID NO: 45339 - protein, 10 aa, Homo sapiens
WMTEYLNRHL

SEQ ID NO: 45340 - protein, 10 aa, Homo sapiens
PLFDFSWLSL

SEQ ID NO: 45341 - protein, 10 aa, Homo sapiens
AAAGPALSPV

SEQ ID NO: 45342 - protein, 10 aa, Homo sapiens
IVMKYIHYKL

SEQ ID NO: 45343 - protein, 10 aa, Homo sapiens
FTARGRFATV

SEQ ID NO: 45344 - protein, 10 aa, Homo sapiens
ELYGPSMRPL

SEQ ID NO: 45345 - protein, 10 aa, Homo sapiens
YLNRHLHTWI

SEQ ID NO: 45346 - protein, 10 aa, Homo sapiens
LVGACITLGA

SEQ ID NO: 45347 - protein, 10 aa, Homo sapiens
IVAFFEFGGV

SEQ ID NO: 45348 - protein, 10 aa, Homo sapiens
YLNRHLHTWI

SEQ ID NO: 45349 - protein, 10 aa, Homo sapiens
FTARGRFATV

SEQ ID NO: 45350 - protein, 10 aa, Homo sapiens
WLSLKTLLSL

SEQ ID NO: 45351 - protein, 10 aa, Homo sapiens
SLKTLLSLAL

SEQ ID NO: 45352 - protein, 10 aa, Homo sapiens
NIALWMTEYL

SEQ ID NO: 45353 - protein, 10 aa, Homo sapiens
SVNREMSPLV

SEQ ID NO: 45354 - protein, 10 aa, Homo sapiens
IVAFFEFGGV

SEQ ID NO: 45355 - protein, 10 aa, Homo sapiens
AAAGPALSPV

SEQ ID NO: 45356 - protein, 10 aa, Homo sapiens
WMTEYLNRHL

SEQ ID NO: 45357 - protein, 10 aa, Homo sapiens
TLLSLALVGA

SEQ ID NO: 45358 - protein, 10 aa, Homo sapiens
IVMKYIHYKL

SEQ ID NO: 45359 - protein, 10 aa, Homo sapiens
LVGACITLGA

SEQ ID NO: 45360 - protein, 10 aa, Homo sapiens
ELYGPSMRPL

SEQ ID NO: 45361 - protein, 10 aa, Homo sapiens
SQPGHTPHPA

SEQ ID NO: 45362 - protein, 10 aa, Homo sapiens
LLSLALVGAC

SEQ ID NO: 45363 - protein, 10 aa, Homo sapiens
TARGRFATVV

SEQ ID NO: 45364 - protein, 10 aa, Homo sapiens
YLNRHLHTWI

SEQ ID NO: 45365 - protein, 10 aa, Homo sapiens
FTARGRFATV

SEQ ID NO: 45366 - protein, 10 aa, Homo sapiens
IVMKYIHYKL

SEQ ID NO: 45367 - protein, 10 aa, Homo sapiens
AAAGPALSPV

SEQ ID NO: 45368 - protein, 10 aa, Homo sapiens
SVNREMSPLV

SEQ ID NO: 45369 - protein, 10 aa, Homo sapiens
FTARGRFATV

SEQ ID NO: 45370 - protein, 10 aa, Homo sapiens
SQLHLTPFTA

SEQ ID NO: 45371 - protein, 10 aa, Homo sapiens
IQDNGGWDAF

SEQ ID NO: 45372 - protein, 10 aa, Homo sapiens
WLSLKTLLSL

SEQ ID NO: 45373 - protein, 10 aa, Homo sapiens
SQPGHTPHPA

SEQ ID NO: 45374 - protein, 10 aa, Homo sapiens
YLNRHLHTWI

SEQ ID NO: 45375 - protein, 10 aa, Homo sapiens
AAAGPALSPV

SEQ ID NO: 45376 - protein, 10 aa, Homo sapiens
WMTEYLNRHL

SEQ ID NO: 45377 - protein, 10 aa, Homo sapiens
SVNREMSPLV

SEQ ID NO: 45378 - protein, 10 aa, Homo sapiens
NIALWMTEYL

SEQ ID NO: 45379 - protein, 10 aa, Homo sapiens
TLLSLALVGA

SEQ ID NO: 45380 - protein, 10 aa, Homo sapiens
IVAFFEFGGV

SEQ ID NO: 45381 - protein, 10 aa, Homo sapiens
LQTPAAPGAA

SEQ ID NO: 45382 - protein, 10 aa, Homo sapiens
IVMKYIHYKL

SEQ ID NO: 45383 - protein, 10 aa, Homo sapiens
YEWDAGDVGA

SEQ ID NO: 45384 - protein, 10 aa, Homo sapiens
PLFDFSWLSL

SEQ ID NO: 45385 - protein, 10 aa, Homo sapiens
RTSPLQTPAA

SEQ ID NO: 45386 - protein, 10 aa, Homo sapiens
LVGACITLGA

SEQ ID NO: 45387 - protein, 10 aa, Homo sapiens
PLFDFSWLSL

SEQ ID NO: 45388 - protein, 10 aa, Homo sapiens
YLNRHLHTWI

SEQ ID NO: 45389 - protein, 10 aa, Homo sapiens
ELYGPSMRPL

SEQ ID NO: 45390 - protein, 10 aa, Homo sapiens
WLSLKTLLSL

SEQ ID NO: 45391 - protein, 10 aa, Homo sapiens
TLLSLALVGA

SEQ ID NO: 45392 - protein, 10 aa, Homo sapiens
FTARGRFATV

SEQ ID NO: 45393 - protein, 10 aa, Homo sapiens
PLVDNIALWM

SEQ ID NO: 45394 - protein, 10 aa, Homo sapiens
SLKTLLSLAL

SEQ ID NO: 45395 - protein, 10 aa, Homo sapiens
WMTEYLNRHL

SEQ ID NO: 45396 - protein, 10 aa, Homo sapiens
SVNREMSPLV

SEQ ID NO: 45397 - protein, 10 aa, Homo sapiens
PVPPVVHLTL

SEQ ID NO: 45398 - protein, 10 aa, Homo sapiens
AAAGPALSPV

SEQ ID NO: 45399 - protein, 10 aa, Homo sapiens
IVMKYIHYKL

SEQ ID NO: 45400 - protein, 10 aa, Homo sapiens
IVAFFEFGGV

SEQ ID NO: 45401 - protein, 10 aa, Homo sapiens
VVEELFRDGV

SEQ ID NO: 45402 - protein, 10 aa, Homo sapiens
NIALWMTEYL

SEQ ID NO: 45403 - protein, 10 aa, Homo sapiens
EMSPLVDNIA

SEQ ID NO: 45404 - protein, 10 aa, Homo sapiens
LVDNIALWMT

SEQ ID NO: 45405 - protein, 10 aa, Homo sapiens
FFEFGGVMCV

SEQ ID NO: 45406 - protein, 10 aa, Homo sapiens
SLALVGACIT

SEQ ID NO: 45407 - protein, 10 aa, Homo sapiens
WIQDNGGWDA

SEQ ID NO: 45408 - protein, 10 aa, Homo sapiens
YLNRHLHTWI

SEQ ID NO: 45409 - protein, 10 aa, Homo sapiens
PLFDFSWLSL

SEQ ID NO: 45410 - protein, 10 aa, Homo sapiens
FTARGRFATV

SEQ ID NO: 45411 - protein, 10 aa, Homo sapiens
SLKTLLSLAL

SEQ ID NO: 45412 - protein, 10 aa, Homo sapiens
ELYGPSMRPL

SEQ ID NO: 45413 - protein, 10 aa, Homo sapiens
WMTEYLNRHL

SEQ ID NO: 45414 - protein, 10 aa, Homo sapiens
WLSLKTLLSL

SEQ ID NO: 45415 - protein, 10 aa, Homo sapiens
TLLSLALVGA

SEQ ID NO: 45416 - protein, 10 aa, Homo sapiens
VVEELFRDGV

SEQ ID NO: 45417 - protein, 10 aa, Homo sapiens
PLVDNIALWM

SEQ ID NO: 45418 - protein, 10 aa, Homo sapiens
IVMKYIHYKL

SEQ ID NO: 45419 - protein, 10 aa, Homo sapiens
SVNREMSPLV

SEQ ID NO: 45420 - protein, 10 aa, Homo sapiens
WIQDNGGWDA

SEQ ID NO: 45421 - protein, 10 aa, Homo sapiens
IVAFFEFGGV

SEQ ID NO: 45422 - protein, 10 aa, Homo sapiens
PVPPVVHLTL

SEQ ID NO: 45423 - protein, 10 aa, Homo sapiens
YEWDAGDVGA

SEQ ID NO: 45424 - protein, 10 aa, Homo sapiens
YLNRHLHTWI

SEQ ID NO: 45425 - protein, 10 aa, Homo sapiens
PLFDFSWLSL

SEQ ID NO: 45426 - protein, 10 aa, Homo sapiens
FTARGRFATV

SEQ ID NO: 45427 - protein, 10 aa, Homo sapiens
ELYGPSMRPL

SEQ ID NO: 45428 - protein, 10 aa, Homo sapiens
WLSLKTLLSL

SEQ ID NO: 45429 - protein, 10 aa, Homo sapiens
PLVDNIALWM

SEQ ID NO: 45430 - protein, 10 aa, Homo sapiens
SVNREMSPLV

SEQ ID NO: 45431 - protein, 10 aa, Homo sapiens
IVMKYIHYKL

SEQ ID NO: 45432 - protein, 10 aa, Homo sapiens
WMTEYLNRHL

SEQ ID NO: 45433 - protein, 10 aa, Homo sapiens
AAAGPALSPV

SEQ ID NO: 45434 - protein, 10 aa, Homo sapiens
PVPPVVHLTL

SEQ ID NO: 45435 - protein, 10 aa, Homo sapiens
SLKTLLSLAL

SEQ ID NO: 45436 - protein, 10 aa, Homo sapiens
TLLSLALVGA

SEQ ID NO: 45437 - protein, 10 aa, Homo sapiens
NIALWMTEYL

SEQ ID NO: 45438 - protein, 10 aa, Homo sapiens
SLALVGACIT

SEQ ID NO: 45439 - protein, 10 aa, Homo sapiens
IVAFFEFGGV

SEQ ID NO: 45440 - protein, 10 aa, Homo sapiens
PLFDFSWLSL

SEQ ID NO: 45441 - protein, 10 aa, Homo sapiens
YLNRHLHTWI

SEQ ID NO: 45442 - protein, 10 aa, Homo sapiens
WLSLKTLLSL

SEQ ID NO: 45443 - protein, 10 aa, Homo sapiens
FTARGRFATV

SEQ ID NO: 45444 - protein, 10 aa, Homo sapiens
ELYGPSMRPL

SEQ ID NO: 45445 - protein, 10 aa, Homo sapiens
PLVDNIALWM

SEQ ID NO: 45446 - protein, 10 aa, Homo sapiens
AAAGPALSPV

SEQ ID NO: 45447 - protein, 10 aa, Homo sapiens
TLLSLALVGA

SEQ ID NO: 45448 - protein, 10 aa, Homo sapiens
WMTEYLNRHL

SEQ ID NO: 45449 - protein, 10 aa, Homo sapiens
PALSPVPPVV

SEQ ID NO: 45450 - protein, 10 aa, Homo sapiens
IVMKYIHYKL

SEQ ID NO: 45451 - protein, 10 aa, Homo sapiens
NIALWMTEYL

SEQ ID NO: 45452 - protein, 10 aa, Homo sapiens
ITLGAYLGHK

SEQ ID NO: 45453 - protein, 10 aa, Homo sapiens
LFDFSWLSLK

SEQ ID NO: 45454 - protein, 10 aa, Homo sapiens
EIVMKYIHYK

SEQ ID NO: 45455 - protein, 10 aa, Homo sapiens
GVMCVESVNR

SEQ ID NO: 45456 - protein, 10 aa, Homo sapiens
ALWMTEYLNR

SEQ ID NO: 45457 - protein, 10 aa, Homo sapiens
ITLGAYLGHK

SEQ ID NO: 45458 - protein, 10 aa, Homo sapiens
GVMCVESVNR

SEQ ID NO: 45459 - protein, 10 aa, Homo sapiens
EIVMKYIHYK

SEQ ID NO: 45460 - protein, 10 aa, Homo sapiens
ALWMTEYLNR

SEQ ID NO: 45461 - protein, 10 aa, Homo sapiens
LFDFSWLSLK

SEQ ID NO: 45462 - protein, 10 aa, Homo sapiens
EYLNRHLHTW

SEQ ID NO: 45463 - protein, 10 aa, Homo sapiens
LYGPSMRPLF

SEQ ID NO: 45464 - protein, 10 aa, Homo sapiens
RFATVVEELF

SEQ ID NO: 45465 - protein, 10 aa, Homo sapiens
GYDNREIVMK

SEQ ID NO: 45466 - protein, 10 aa, Homo sapiens
DFSRRYRRDF

SEQ ID NO: 45467 - protein, 10 aa, Homo sapiens
IVMKYIHYKL

SEQ ID NO: 45468 - protein, 10 aa, Homo sapiens
LTLRQAGDDF

SEQ ID NO: 45469 - protein, 10 aa, Homo sapiens
RFATVVEELF

SEQ ID NO: 45470 - protein, 10 aa, Homo sapiens
LYGPSMRPLF

SEQ ID NO: 45471 - protein, 10 aa, Homo sapiens
EYLNRHLHTW

SEQ ID NO: 45472 - protein, 10 aa, Homo sapiens
EYLNRHLHTW

SEQ ID NO: 45473 - protein, 10 aa, Homo sapiens
RFATVVEELF

SEQ ID NO: 45474 - protein, 10 aa, Homo sapiens
LYGPSMRPLF

SEQ ID NO: 45475 - protein, 10 aa, Homo sapiens
DNIALWMTEY

SEQ ID NO: 45476 - protein, 10 aa, Homo sapiens
ESVNREMSPL

SEQ ID NO: 45477 - protein, 10 aa, Homo sapiens
ELYGPSMRPL

SEQ ID NO: 45478 - protein, 10 aa, Homo sapiens
NIALWMTEYL

SEQ ID NO: 45479 - protein, 10 aa, Homo sapiens
DNIALWMTEY

SEQ ID NO: 45480 - protein, 10 aa, Homo sapiens
ITLGAYLGHK

SEQ ID NO: 45481 - protein, 10 aa, Homo sapiens
KYIHYKLSQR

SEQ ID NO: 45482 - protein, 10 aa, Homo sapiens
LFRDGVNWGR

SEQ ID NO: 45483 - protein, 10 aa, Homo sapiens
GVMCVESVNR

SEQ ID NO: 45484 - protein, 10 aa, Homo sapiens
HLTPFTARGR

SEQ ID NO: 45485 - protein, 10 aa, Homo sapiens
ALWMTEYLNR

SEQ ID NO: 45486 - protein, 10 aa, Homo sapiens
AGDDFSRRYR

SEQ ID NO: 45487 - protein, 10 aa, Homo sapiens
FATVVEELFR

SEQ ID NO: 45488 - protein, 10 aa, Homo sapiens
QLHLTPFTAR

SEQ ID NO: 45489 - protein, 10 aa, Homo sapiens
LFRDGVNWGR

SEQ ID NO: 45490 - protein, 10 aa, Homo sapiens
KYIHYKLSQR

SEQ ID NO: 45491 - protein, 10 aa, Homo sapiens
FATVVEELFR

SEQ ID NO: 45492 - protein, 10 aa, Homo sapiens
ALWMTEYLNR

SEQ ID NO: 45493 - protein, 10 aa, Homo sapiens
FATVVEELFR

SEQ ID NO: 45494 - protein, 10 aa, Homo sapiens
EIVMKYIHYK

SEQ ID NO: 45495 - protein, 10 aa, Homo sapiens
HLTPFTARGR

SEQ ID NO: 45496 - protein, 10 aa, Homo sapiens
FVELYGPSMR

SEQ ID NO: 45497 - protein, 10 aa, Homo sapiens
GVMCVESVNR

SEQ ID NO: 45498 - protein, 10 aa, Homo sapiens
ITLGAYLGHK

SEQ ID NO: 45499 - protein, 10 aa, Homo sapiens
MTEYLNRHLH

SEQ ID NO: 45500 - protein, 10 aa, Homo sapiens
QLHLTPFTAR

SEQ ID NO: 45501 - protein, 10 aa, Homo sapiens
HAGRTGYDNR

SEQ ID NO: 45502 - protein, 10 aa, Homo sapiens
FTARGRFATV

SEQ ID NO: 45503 - protein, 10 aa, Homo sapiens
IVAFFEFGGV

SEQ ID NO: 45504 - protein, 10 aa, Homo sapiens
NIALWMTEYL

SEQ ID NO: 45505 - protein, 10 aa, Homo sapiens
IVMKYIHYKL

SEQ ID NO: 45506 - protein, 10 aa, Homo sapiens
AAAGPALSPV

SEQ ID NO: 45507 - protein, 10 aa, Homo sapiens
QTPAAPGAAA

SEQ ID NO: 45508 - protein, 10 aa, Homo sapiens
MSPLVDNIAL

SEQ ID NO: 45509 - protein, 10 aa, Homo sapiens
ELYGPSMRPL

SEQ ID NO: 45510 - protein, 10 aa, Homo sapiens
ESVNREMSPL

SEQ ID NO: 45511 - protein, 10 aa, Homo sapiens
MRPLFDFSWL

SEQ ID NO: 45512 - protein, 10 aa, Homo sapiens
SVNREMSPLV

SEQ ID NO: 45513 - protein, 10 aa, Homo sapiens
TARGRFATVV

SEQ ID NO: 45514 - protein, 10 aa, Homo sapiens
FTARGRFATV

SEQ ID NO: 45515 - protein, 10 aa, Homo sapiens
ELYGPSMRPL

SEQ ID NO: 45516 - protein, 10 aa, Homo sapiens
PALSPVPPVV

SEQ ID NO: 45517 - protein, 10 aa, Homo sapiens
NIALWMTEYL

SEQ ID NO: 45518 - protein, 10 aa, Homo sapiens
SVNREMSPLV

SEQ ID NO: 45519 - protein, 10 aa, Homo sapiens
AAAGPALSPV

SEQ ID NO: 45520 - protein, 10 aa, Homo sapiens
DVGAAPPGAA

SEQ ID NO: 45521 - protein, 10 aa, Homo sapiens
IVAFFEFGGV

SEQ ID NO: 45522 - protein, 10 aa, Homo sapiens
IVMKYIHYKL

SEQ ID NO: 45523 - protein, 10 aa, Homo sapiens
APGAAAGPAL

SEQ ID NO: 45524 - protein, 10 aa, Homo sapiens
GPALSPVPPV

SEQ ID NO: 45525 - protein, 10 aa, Homo sapiens
HPAASRDPVA

SEQ ID NO: 45526 - protein, 10 aa, Homo sapiens
GPSMRPLFDF

SEQ ID NO: 45527 - protein, 10 aa, Homo sapiens
TARGRFATVV

SEQ ID NO: 45528 - protein, 10 aa, Homo sapiens
APAPGIFSSQ

SEQ ID NO: 45529 - protein, 10 aa, Homo sapiens
GVNWGRIVAF

SEQ ID NO: 45530 - protein, 10 aa, Homo sapiens
MSSQLHLTPF

SEQ ID NO: 45531 - protein, 10 aa, Homo sapiens
IQDNGGWDAF

SEQ ID NO: 45532 - protein, 10 aa, Homo sapiens
REIVMKYIHY

SEQ ID NO: 45533 - protein, 10 aa, Homo sapiens
RRYRRDFAEM

SEQ ID NO: 45534 - protein, 10 aa, Homo sapiens
GRFATVVEEL

SEQ ID NO: 45535 - protein, 10 aa, Homo sapiens
MSSQLHLTPF

SEQ ID NO: 45536 - protein, 10 aa, Homo sapiens
VAFFEFGGVM

SEQ ID NO: 45537 - protein, 10 aa, Homo sapiens
APGAAAGPAL

SEQ ID NO: 45538 - protein, 10 aa, Homo sapiens
LALVGACITL

SEQ ID NO: 45539 - protein, 10 aa, Homo sapiens
MCVESVNREM

SEQ ID NO: 45540 - protein, 10 aa, Homo sapiens
QAGDDFSRRY

SEQ ID NO: 45541 - protein, 10 aa, Homo sapiens
TPAAPGAAAG

SEQ ID NO: 45542 - protein, 10 aa, Homo sapiens
GVNWGRIVAF

SEQ ID NO: 45543 - protein, 10 aa, Homo sapiens
SPLVDNIALW

SEQ ID NO: 45544 - protein, 10 aa, Homo sapiens
REIVMKYIHY

SEQ ID NO: 45545 - protein, 10 aa, Homo sapiens
AEMSSQLHLT

SEQ ID NO: 45546 - protein, 10 aa, Homo sapiens
REIVMKYIHY

SEQ ID NO: 45547 - protein, 10 aa, Homo sapiens
REIVMKYIHY

SEQ ID NO: 45548 - protein, 10 aa, Homo sapiens
EELFRDGVNW

SEQ ID NO: 45549 - protein, 10 aa, Homo sapiens
AEMSSQLHLT

SEQ ID NO: 45550 - protein, 10 aa, Homo sapiens
REIVMKYIHY

SEQ ID NO: 45551 - protein, 10 aa, Homo sapiens
EELFRDGVNW

SEQ ID NO: 45552 - protein, 10 aa, Homo sapiens
LALVGACITL

SEQ ID NO: 45553 - protein, 10 aa, Homo sapiens
PPGAAPAPGI

SEQ ID NO: 45554 - protein, 10 aa, Homo sapiens
SPLVDNIALW

SEQ ID NO: 45555 - protein, 10 aa, Homo sapiens
HPAASRDPVA

SEQ ID NO: 45556 - protein, 10 aa, Homo sapiens
TPFTARGRFA

SEQ ID NO: 45557 - protein, 10 aa, Homo sapiens
QPGHTPHPAA

SEQ ID NO: 45558 - protein, 10 aa, Homo sapiens
GPALSPVPPV

SEQ ID NO: 45559 - protein, 10 aa, Homo sapiens
SPVPPVVHLT

SEQ ID NO: 45560 - protein, 10 aa, Homo sapiens
HTWIQDNGGW

SEQ ID NO: 45561 - protein, 10 aa, Homo sapiens
MSSQLHLTPF

SEQ ID NO: 45562 - protein, 10 aa, Homo sapiens
HTWIQDNGGW

SEQ ID NO: 45563 - protein, 10 aa, Homo sapiens
SMRPLFDFSW

SEQ ID NO: 45564 - protein, 11 aa, Homo sapiens
ALVGACITLGA

SEQ ID NO: 45565 - protein, 11 aa, Homo sapiens
ALSPVPPVVHL

SEQ ID NO: 45566 - protein, 11 aa, Homo sapiens
SLKTLLSLALV

SEQ ID NO: 45567 - protein, 11 aa, Homo sapiens
IQDNGGWDAFV

SEQ ID NO: 45568 - protein, 11 aa, Homo sapiens
LLSLALVGACI

SEQ ID NO: 45569 - protein, 11 aa, Homo sapiens
SLALVGACITL

SEQ ID NO: 45570 - protein, 11 aa, Homo sapiens
RIVAFFEFGGV

SEQ ID NO: 45571 - protein, 11 aa, Homo sapiens
KLSQRGYEWDA

SEQ ID NO: 45572 - protein, 11 aa, Homo sapiens
SMRPLFDFSWL

SEQ ID NO: 45573 - protein, 11 aa, Homo sapiens
SLKTLLSLALV

SEQ ID NO: 45574 - protein, 11 aa, Homo sapiens
SLALVGACITL

SEQ ID NO: 45575 - protein, 11 aa, Homo sapiens
ALSPVPPVVHL

SEQ ID NO: 45576 - protein, 11 aa, Homo sapiens
LLSLALVGACI

SEQ ID NO: 45577 - protein, 11 aa, Homo sapiens
EMSPLVDNIAL

SEQ ID NO: 45578 - protein, 11 aa, Homo sapiens
ALVGACITLGA

SEQ ID NO: 45579 - protein, 11 aa, Homo sapiens
WLSLKTLLSLA

SEQ ID NO: 45580 - protein, 11 aa, Homo sapiens
FTARGRFATVV

SEQ ID NO: 45581 - protein, 11 aa, Homo sapiens
GAAAGPALSPV

SEQ ID NO: 45582 - protein, 11 aa, Homo sapiens
RIVAFFEFGGV

SEQ ID NO: 45583 - protein, 11 aa, Homo sapiens
YLNRHLHTWIQ

SEQ ID NO: 45584 - protein, 11 aa, Homo sapiens
KLSQRGYEWDA

SEQ ID NO: 45585 - protein, 11 aa, Homo sapiens
TVVEELFRDGV

SEQ ID NO: 45586 - protein, 11 aa, Homo sapiens
VGACITLGAYL

SEQ ID NO: 45587 - protein, 11 aa, Homo sapiens
SLKTLLSLALV

SEQ ID NO: 45588 - protein, 11 aa, Homo sapiens
SMRPLFDFSWL

SEQ ID NO: 45589 - protein, 11 aa, Homo sapiens
RIVAFFEFGGV

SEQ ID NO: 45590 - protein, 11 aa, Homo sapiens
GAAAGPALSPV

SEQ ID NO: 45591 - protein, 11 aa, Homo sapiens
WLSLKTLLSLA

SEQ ID NO: 45592 - protein, 11 aa, Homo sapiens
ALSPVPPVVHL

SEQ ID NO: 45593 - protein, 11 aa, Homo sapiens
ALVGACITLGA

SEQ ID NO: 45594 - protein, 11 aa, Homo sapiens
LLSLALVGACI

SEQ ID NO: 45595 - protein, 11 aa, Homo sapiens
FTARGRFATVV

SEQ ID NO: 45596 - protein, 11 aa, Homo sapiens
SLALVGACITL

SEQ ID NO: 45597 - protein, 11 aa, Homo sapiens
YLNRHLHTWIQ

SEQ ID NO: 45598 - protein, 11 aa, Homo sapiens
TVVEELFRDGV

SEQ ID NO: 45599 - protein, 11 aa, Homo sapiens
KLSQRGYEWDA

SEQ ID NO: 45600 - protein, 11 aa, Homo sapiens
ALSPVPPVVHL

SEQ ID NO: 45601 - protein, 11 aa, Homo sapiens
SLALVGACITL

SEQ ID NO: 45602 - protein, 11 aa, Homo sapiens
FTARGRFATVV

SEQ ID NO: 45603 - protein, 11 aa, Homo sapiens
GAAAGPALSPV

SEQ ID NO: 45604 - protein, 11 aa, Homo sapiens
KLSQRGYEWDA

SEQ ID NO: 45605 - protein, 11 aa, Homo sapiens
YLNRHLHTWIQ

SEQ ID NO: 45606 - protein, 11 aa, Homo sapiens
RIVAFFEFGGV

SEQ ID NO: 45607 - protein, 11 aa, Homo sapiens
IQDNGGWDAFV

SEQ ID NO: 45608 - protein, 11 aa, Homo sapiens
FTARGRFATVV

SEQ ID NO: 45609 - protein, 11 aa, Homo sapiens
TVVEELFRDGV

SEQ ID NO: 45610 - protein, 11 aa, Homo sapiens
ALVGACITLGA

SEQ ID NO: 45611 - protein, 11 aa, Homo sapiens
SQPGHTPHPAA

SEQ ID NO: 45612 - protein, 11 aa, Homo sapiens
LQTPAAPGAAA

SEQ ID NO: 45613 - protein, 11 aa, Homo sapiens
GAAAGPALSPV

SEQ ID NO: 45614 - protein, 11 aa, Homo sapiens
KTLLSLALVGA

SEQ ID NO: 45615 - protein, 11 aa, Homo sapiens
ALSPVPPVVHL

SEQ ID NO: 45616 - protein, 11 aa, Homo sapiens
SMRPLFDFSWL

SEQ ID NO: 45617 - protein, 11 aa, Homo sapiens
SLKTLLSLALV

SEQ ID NO: 45618 - protein, 11 aa, Homo sapiens
WLSLKTLLSLA

SEQ ID NO: 45619 - protein, 11 aa, Homo sapiens
YEWDAGDVGAA

SEQ ID NO: 45620 - protein, 11 aa, Homo sapiens
KLSQRGYEWDA

SEQ ID NO: 45621 - protein, 11 aa, Homo sapiens
ALSPVPPVVHL

SEQ ID NO: 45622 - protein, 11 aa, Homo sapiens
SLKTLLSLALV

SEQ ID NO: 45623 - protein, 11 aa, Homo sapiens
SLALVGACITL

SEQ ID NO: 45624 - protein, 11 aa, Homo sapiens
YLNRHLHTWIQ

SEQ ID NO: 45625 - protein, 11 aa, Homo sapiens
EMSPLVDNIAL

SEQ ID NO: 45626 - protein, 11 aa, Homo sapiens
SMRPLFDFSWL

SEQ ID NO: 45627 - protein, 11 aa, Homo sapiens
ALVGACITLGA

SEQ ID NO: 45628 - protein, 11 aa, Homo sapiens
FTARGRFATVV

SEQ ID NO: 45629 - protein, 11 aa, Homo sapiens
IQDNGGWDAFV

SEQ ID NO: 45630 - protein, 11 aa, Homo sapiens
AFFEFGGVMCV

SEQ ID NO: 45631 - protein, 11 aa, Homo sapiens
PLFDFSWLSLK

SEQ ID NO: 45632 - protein, 11 aa, Homo sapiens
TVVEELFRDGV

SEQ ID NO: 45633 - protein, 11 aa, Homo sapiens
PLVDNIALWMT

SEQ ID NO: 45634 - protein, 11 aa, Homo sapiens
KLSQRGYEWDA

SEQ ID NO: 45635 - protein, 11 aa, Homo sapiens
WLSLKTLLSLA

SEQ ID NO: 45636 - protein, 11 aa, Homo sapiens
RIVAFFEFGGV

SEQ ID NO: 45637 - protein, 11 aa, Homo sapiens
ELYGPSMRPLF

SEQ ID NO: 45638 - protein, 11 aa, Homo sapiens
LLSLALVGACI

SEQ ID NO: 45639 - protein, 11 aa, Homo sapiens
GAAAGPALSPV

SEQ ID NO: 45640 - protein, 11 aa, Homo sapiens
FRDGVNWGRIV

SEQ ID NO: 45641 - protein, 11 aa, Homo sapiens
TLLSLALVGAC

SEQ ID NO: 45642 - protein, 11 aa, Homo sapiens
HLTPFTARGRF

SEQ ID NO: 45643 - protein, 11 aa, Homo sapiens
WMTEYLNRHLH

SEQ ID NO: 45644 - protein, 11 aa, Homo sapiens
ALSPVPPVVHL

SEQ ID NO: 45645 - protein, 11 aa, Homo sapiens
YLNRHLHTWIQ

SEQ ID NO: 45646 - protein, 11 aa, Homo sapiens
FTARGRFATVV

SEQ ID NO: 45647 - protein, 11 aa, Homo sapiens
SMRPLFDFSWL

SEQ ID NO: 45648 - protein, 11 aa, Homo sapiens
SLKTLLSLALV

SEQ ID NO: 45649 - protein, 11 aa, Homo sapiens
SLALVGACITL

SEQ ID NO: 45650 - protein, 11 aa, Homo sapiens
EMSPLVDNIAL

SEQ ID NO: 45651 - protein, 11 aa, Homo sapiens
KLSQRGYEWDA

SEQ ID NO: 45652 - protein, 11 aa, Homo sapiens
ALVGACITLGA

SEQ ID NO: 45653 - protein, 11 aa, Homo sapiens
TVVEELFRDGV

SEQ ID NO: 45654 - protein, 11 aa, Homo sapiens
IQDNGGWDAFV

SEQ ID NO: 45655 - protein, 11 aa, Homo sapiens
AFFEFGGVMCV

SEQ ID NO: 45656 - protein, 11 aa, Homo sapiens
RIVAFFEFGGV

SEQ ID NO: 45657 - protein, 11 aa, Homo sapiens
LLSLALVGACI

SEQ ID NO: 45658 - protein, 11 aa, Homo sapiens
PLVDNIALWMT

SEQ ID NO: 45659 - protein, 11 aa, Homo sapiens
PLFDFSWLSLK

SEQ ID NO: 45660 - protein, 11 aa, Homo sapiens
FRDGVNWGRIV

SEQ ID NO: 45661 - protein, 11 aa, Homo sapiens
ALSPVPPVVHL

SEQ ID NO: 45662 - protein, 11 aa, Homo sapiens
SLALVGACITL

SEQ ID NO: 45663 - protein, 11 aa, Homo sapiens
SLKTLLSLALV

SEQ ID NO: 45664 - protein, 11 aa, Homo sapiens
SMRPLFDFSWL

SEQ ID NO: 45665 - protein, 11 aa, Homo sapiens
FTARGRFATVV

SEQ ID NO: 45666 - protein, 11 aa, Homo sapiens
ALVGACITLGA

SEQ ID NO: 45667 - protein, 11 aa, Homo sapiens
IQDNGGWDAFV

SEQ ID NO: 45668 - protein, 11 aa, Homo sapiens
EMSPLVDNIAL

SEQ ID NO: 45669 - protein, 11 aa, Homo sapiens
YLNRHLHTWIQ

SEQ ID NO: 45670 - protein, 11 aa, Homo sapiens
TVVEELFRDGV

SEQ ID NO: 45671 - protein, 11 aa, Homo sapiens
GAAAGPALSPV

SEQ ID NO: 45672 - protein, 11 aa, Homo sapiens
AFFEFGGVMCV

SEQ ID NO: 45673 - protein, 11 aa, Homo sapiens
PLVDNIALWMT

SEQ ID NO: 45674 - protein, 11 aa, Homo sapiens
RIVAFFEFGGV

SEQ ID NO: 45675 - protein, 11 aa, Homo sapiens
EFGGVMCVESV

SEQ ID NO: 45676 - protein, 11 aa, Homo sapiens
WLSLKTLLSLA

SEQ ID NO: 45677 - protein, 11 aa, Homo sapiens
KLSQRGYEWDA

SEQ ID NO: 45678 - protein, 11 aa, Homo sapiens
LLSLALVGACI

SEQ ID NO: 45679 - protein, 11 aa, Homo sapiens
PLFDFSWLSLK

SEQ ID NO: 45680 - protein, 11 aa, Homo sapiens
ALSPVPPVVHL

SEQ ID NO: 45681 - protein, 11 aa, Homo sapiens
IQDNGGWDAFV

SEQ ID NO: 45682 - protein, 11 aa, Homo sapiens
FTARGRFATVV

SEQ ID NO: 45683 - protein, 11 aa, Homo sapiens
EMSPLVDNIAL

SEQ ID NO: 45684 - protein, 11 aa, Homo sapiens
YLNRHLHTWIQ

SEQ ID NO: 45685 - protein, 11 aa, Homo sapiens
SLALVGACITL

SEQ ID NO: 45686 - protein, 11 aa, Homo sapiens
LLSLALVGACI

SEQ ID NO: 45687 - protein, 11 aa, Homo sapiens
PLVDNIALWMT

SEQ ID NO: 45688 - protein, 11 aa, Homo sapiens
GAAAGPALSPV

SEQ ID NO: 45689 - protein, 11 aa, Homo sapiens
SLKTLLSLALV

SEQ ID NO: 45690 - protein, 11 aa, Homo sapiens
SMRPLFDFSWL

SEQ ID NO: 45691 - protein, 11 aa, Homo sapiens
ALVGACITLGA

SEQ ID NO: 45692 - protein, 11 aa, Homo sapiens
PLFDFSWLSLK

SEQ ID NO: 45693 - protein, 11 aa, Homo sapiens
CITLGAYLGHK

SEQ ID NO: 45694 - protein, 11 aa, Homo sapiens
PLFDFSWLSLK

SEQ ID NO: 45695 - protein, 11 aa, Homo sapiens
SQLHLTPFTAR

SEQ ID NO: 45696 - protein, 11 aa, Homo sapiens
CITLGAYLGHK

SEQ ID NO: 45697 - protein, 11 aa, Homo sapiens
IALWMTEYLNR

SEQ ID NO: 45698 - protein, 11 aa, Homo sapiens
TGYDNREIVMK

SEQ ID NO: 45699 - protein, 11 aa, Homo sapiens
NWGRIVAFFEF

SEQ ID NO: 45700 - protein, 11 aa, Homo sapiens
EYLNRHLHTWI

SEQ ID NO: 45701 - protein, 11 aa, Homo sapiens
HYKLSQRGYEW

SEQ ID NO: 45702 - protein, 11 aa, Homo sapiens
LWMTEYLNRHL

SEQ ID NO: 45703 - protein, 11 aa, Homo sapiens
SWLSLKTLLSL

SEQ ID NO: 45704 - protein, 11 aa, Homo sapiens
EYLNRHLHTWI

SEQ ID NO: 45705 - protein, 11 aa, Homo sapiens
NWGRIVAFFEF

SEQ ID NO: 45706 - protein, 11 aa, Homo sapiens
SWLSLKTLLSL

SEQ ID NO: 45707 - protein, 11 aa, Homo sapiens
LWMTEYLNRHL

SEQ ID NO: 45708 - protein, 11 aa, Homo sapiens
EYLNRHLHTWI

SEQ ID NO: 45709 - protein, 11 aa, Homo sapiens
HYKLSQRGYEW

SEQ ID NO: 45710 - protein, 11 aa, Homo sapiens
NWGRIVAFFEF

SEQ ID NO: 45711 - protein, 11 aa, Homo sapiens
YIHYKLSQRGY

SEQ ID NO: 45712 - protein, 11 aa, Homo sapiens
EMSSQLHLTPF

SEQ ID NO: 45713 - protein, 11 aa, Homo sapiens
YIHYKLSQRGY

SEQ ID NO: 45714 - protein, 11 aa, Homo sapiens
EIVMKYIHYKL

SEQ ID NO: 45715 - protein, 11 aa, Homo sapiens
WIQDNGGWDAF

SEQ ID NO: 45716 - protein, 11 aa, Homo sapiens
ELYGPSMRPLF

SEQ ID NO: 45717 - protein, 11 aa, Homo sapiens
LVGACITLGAY

SEQ ID NO: 45718 - protein, 11 aa, Homo sapiens
DGVNWGRIVAF

SEQ ID NO: 45719 - protein, 11 aa, Homo sapiens
PLFDFSWLSLK

SEQ ID NO: 45720 - protein, 11 aa, Homo sapiens
REIVMKYIHYK

SEQ ID NO: 45721 - protein, 11 aa, Homo sapiens
EMSSQLHLTPF

SEQ ID NO: 45722 - protein, 11 aa, Homo sapiens
RFATVVEELFR

SEQ ID NO: 45723 - protein, 11 aa, Homo sapiens
SQLHLTPFTAR

SEQ ID NO: 45724 - protein, 11 aa, Homo sapiens
AFVELYGPSMR

SEQ ID NO: 45725 - protein, 11 aa, Homo sapiens
IALWMTEYLNR

SEQ ID NO: 45726 - protein, 11 aa, Homo sapiens
REIVMKYIHYK

SEQ ID NO: 45727 - protein, 11 aa, Homo sapiens
MKYIHYKLSQR

SEQ ID NO: 45728 - protein, 11 aa, Homo sapiens
QAGDDFSRRYR

SEQ ID NO: 45729 - protein, 11 aa, Homo sapiens
ELFRDGVNWGR

SEQ ID NO: 45730 - protein, 11 aa, Homo sapiens
RFATVVEELFR

SEQ ID NO: 45731 - protein, 11 aa, Homo sapiens
IALWMTEYLNR

SEQ ID NO: 45732 - protein, 11 aa, Homo sapiens
AFVELYGPSMR

SEQ ID NO: 45733 - protein, 11 aa, Homo sapiens
ELFRDGVNWGR

SEQ ID NO: 45734 - protein, 11 aa, Homo sapiens
CITLGAYLGHK

SEQ ID NO: 45735 - protein, 11 aa, Homo sapiens
IALWMTEYLNR

SEQ ID NO: 45736 - protein, 11 aa, Homo sapiens
HPAASRDPVAR

SEQ ID NO: 45737 - protein, 11 aa, Homo sapiens
MKYIHYKLSQR

SEQ ID NO: 45738 - protein, 11 aa, Homo sapiens
QAGDDFSRRYR

SEQ ID NO: 45739 - protein, 11 aa, Homo sapiens
TGYDNREIVMK

SEQ ID NO: 45740 - protein, 11 aa, Homo sapiens
RFATVVEELFR

SEQ ID NO: 45741 - protein, 11 aa, Homo sapiens
TLRQAGDDFSR

SEQ ID NO: 45742 - protein, 11 aa, Homo sapiens
PLFDFSWLSLK

SEQ ID NO: 45743 - protein, 11 aa, Homo sapiens
FTARGRFATVV

SEQ ID NO: 45744 - protein, 11 aa, Homo sapiens
TVVEELFRDGV

SEQ ID NO: 45745 - protein, 11 aa, Homo sapiens
RIVAFFEFGGV

SEQ ID NO: 45746 - protein, 11 aa, Homo sapiens
EIVMKYIHYKL

SEQ ID NO: 45747 - protein, 11 aa, Homo sapiens
GAAAGPALSPV

SEQ ID NO: 45748 - protein, 11 aa, Homo sapiens
EMSPLVDNIAL

SEQ ID NO: 45749 - protein, 11 aa, Homo sapiens
ESVNREMSPLV

SEQ ID NO: 45750 - protein, 11 aa, Homo sapiens
VGACITLGAYL

SEQ ID NO: 45751 - protein, 11 aa, Homo sapiens
TPHPAASRDPV

SEQ ID NO: 45752 - protein, 11 aa, Homo sapiens
FTARGRFATVV

SEQ ID NO: 45753 - protein, 11 aa, Homo sapiens
EMSPLVDNIAL

SEQ ID NO: 45754 - protein, 11 aa, Homo sapiens
TVVEELFRDGV

SEQ ID NO: 45755 - protein, 11 aa, Homo sapiens
ESVNREMSPLV

SEQ ID NO: 45756 - protein, 11 aa, Homo sapiens
RPLFDFSWLSL

SEQ ID NO: 45757 - protein, 11 aa, Homo sapiens
SPVPPVVHLTL

SEQ ID NO: 45758 - protein, 11 aa, Homo sapiens
TPHPAASRDPV

SEQ ID NO: 45759 - protein, 11 aa, Homo sapiens
GPALSPVPPVV

SEQ ID NO: 45760 - protein, 11 aa, Homo sapiens
SPLVDNIALWM

SEQ ID NO: 45761 - protein, 11 aa, Homo sapiens
RGRFATVVEEL

SEQ ID NO: 45762 - protein, 11 aa, Homo sapiens
TPFTARGRFAT

SEQ ID NO: 45763 - protein, 11 aa, Homo sapiens
RQAGDDFSRRY

SEQ ID NO: 45764 - protein, 11 aa, Homo sapiens
WIQDNGGWDAF

SEQ ID NO: 45765 - protein, 11 aa, Homo sapiens
LVGACITLGAY

SEQ ID NO: 45766 - protein, 11 aa, Homo sapiens
YIHYKLSQRGY

SEQ ID NO: 45767 - protein, 11 aa, Homo sapiens
EMSSQLHLTPF

SEQ ID NO: 45768 - protein, 11 aa, Homo sapiens
GVNWGRIVAFF

SEQ ID NO: 45769 - protein, 11 aa, Homo sapiens
TEYLNRHLHTW

SEQ ID NO: 45770 - protein, 11 aa, Homo sapiens
VELYGPSMRPL

SEQ ID NO: 45771 - protein, 11 aa, Homo sapiens
VESVNREMSPL

SEQ ID NO: 45772 - protein, 11 aa, Homo sapiens
VEELFRDGVNW

SEQ ID NO: 45773 - protein, 11 aa, Homo sapiens
GRFATVVEELF

SEQ ID NO: 45774 - protein, 11 aa, Homo sapiens
RRDFAEMSSQL

SEQ ID NO: 45775 - protein, 11 aa, Homo sapiens
RQAGDDFSRRY

SEQ ID NO: 45776 - protein, 11 aa, Homo sapiens
SPLVDNIALWM

SEQ ID NO: 45777 - protein, 11 aa, Homo sapiens
WIQDNGGWDAF

SEQ ID NO: 45778 - protein, 11 aa, Homo sapiens
DAFVELYGPSM

SEQ ID NO: 45779 - protein, 11 aa, Homo sapiens
EMSSQLHLTPF

SEQ ID NO: 45780 - protein, 11 aa, Homo sapiens
TPFTARGRFAT

SEQ ID NO: 45781 - protein, 11 aa, Homo sapiens
LVGACITLGAY

SEQ ID NO: 45782 - protein, 11 aa, Homo sapiens
IVAFFEFGGVM

SEQ ID NO: 45783 - protein, 11 aa, Homo sapiens
SPVPPVVHLTL

SEQ ID NO: 45784 - protein, 11 aa, Homo sapiens
DGVNWGRIVAF

SEQ ID NO: 45785 - protein, 11 aa, Homo sapiens
SRDPVARTSPL

SEQ ID NO: 45786 - protein, 11 aa, Homo sapiens
VELYGPSMRPL

SEQ ID NO: 45787 - protein, 11 aa, Homo sapiens
VESVNREMSPL

SEQ ID NO: 45788 - protein, 11 aa, Homo sapiens
TEYLNRHLHTW

SEQ ID NO: 45789 - protein, 11 aa, Homo sapiens
AEMSSQLHLTP

SEQ ID NO: 45790 - protein, 11 aa, Homo sapiens
APPGAAPAPGI

SEQ ID NO: 45791 - protein, 11 aa, Homo sapiens
GPALSPVPPVV

SEQ ID NO: 45792 - protein, 11 aa, Homo sapiens
SPVPPVVHLTL

SEQ ID NO: 45793 - protein, 11 aa, Homo sapiens
SPLVDNIALWM

SEQ ID NO: 45794 - protein, 11 aa, Homo sapiens
RPLFDFSWLSL

SEQ ID NO: 45795 - protein, 11 aa, Homo sapiens
TPFTARGRFAT

SEQ ID NO: 45796 - protein, 11 aa, Homo sapiens
SPLQTPAAPGA

SEQ ID NO: 45797 - protein, 11 aa, Homo sapiens
PPVVHLTLRQA

SEQ ID NO: 45798 - protein, 11 aa, Homo sapiens
TPHPAASRDPV

SEQ ID NO: 45799 - protein, 11 aa, Homo sapiens
MSPLVDNIALW

SEQ ID NO: 45800 - protein, 11 aa, Homo sapiens
PSMRPLFDFSW

SEQ ID NO: 45801 - protein, 8 aa, Homo sapiens
HLADSPAV

SEQ ID NO: 45802 - protein, 8 aa, Homo sapiens
FLTGMTVA

SEQ ID NO: 45803 - protein, 8 aa, Homo sapiens
AAWMATYL

SEQ ID NO: 45804 - protein, 8 aa, Homo sapiens
VLVSRIAA

SEQ ID NO: 45805 - protein, 8 aa, Homo sapiens
YQSFEQVV

SEQ ID NO: 45806 - protein, 8 aa, Homo sapiens
GALCVESV

SEQ ID NO: 45807 - protein, 8 aa, Homo sapiens
VLLGSLFS

SEQ ID NO: 45808 - protein, 8 aa, Homo sapiens
FLTGMTVA

SEQ ID NO: 45809 - protein, 8 aa, Homo sapiens
HLADSPAV

SEQ ID NO: 45810 - protein, 8 aa, Homo sapiens
YQSFEQVV

SEQ ID NO: 45811 - protein, 8 aa, Homo sapiens
TVAGVVLL

SEQ ID NO: 45812 - protein, 8 aa, Homo sapiens
FLSYKLSQ

SEQ ID NO: 45813 - protein, 8 aa, Homo sapiens
MAAVKQAL

SEQ ID NO: 45814 - protein, 8 aa, Homo sapiens
SLDAREVI

SEQ ID NO: 45815 - protein, 8 aa, Homo sapiens
ELYGNNAA

SEQ ID NO: 45816 - protein, 8 aa, Homo sapiens
MTVAGVVL

SEQ ID NO: 45817 - protein, 8 aa, Homo sapiens
VLVSRIAA

SEQ ID NO: 45818 - protein, 8 aa, Homo sapiens
SQSNRELV

SEQ ID NO: 45819 - protein, 8 aa, Homo sapiens
FLTGMTVA

SEQ ID NO: 45820 - protein, 8 aa, Homo sapiens
HLADSPAV

SEQ ID NO: 45821 - protein, 8 aa, Homo sapiens
VLVSRIAA

SEQ ID NO: 45822 - protein, 8 aa, Homo sapiens
MQVLVSRI

SEQ ID NO: 45823 - protein, 8 aa, Homo sapiens
FLSYKLSQ

SEQ ID NO: 45824 - protein, 8 aa, Homo sapiens
GVNWGRIV

SEQ ID NO: 45825 - protein, 8 aa, Homo sapiens
GMTVAGVV

SEQ ID NO: 45826 - protein, 8 aa, Homo sapiens
YQSFEQVV

SEQ ID NO: 45827 - protein, 8 aa, Homo sapiens
RIAAWMAT

SEQ ID NO: 45828 - protein, 8 aa, Homo sapiens
EVIPMAAV

SEQ ID NO: 45829 - protein, 8 aa, Homo sapiens
SQSNRELV

SEQ ID NO: 45830 - protein, 8 aa, Homo sapiens
MTVAGVVL

SEQ ID NO: 45831 - protein, 8 aa, Homo sapiens
GALCVESV

SEQ ID NO: 45832 - protein, 8 aa, Homo sapiens
GVVLLGSL

SEQ ID NO: 45833 - protein, 8 aa, Homo sapiens
TVAGVVLL

SEQ ID NO: 45834 - protein, 8 aa, Homo sapiens
HLADSPAV

SEQ ID NO: 45835 - protein, 8 aa, Homo sapiens
SVDKEMQV

SEQ ID NO: 45836 - protein, 8 aa, Homo sapiens
HLADSPAV

SEQ ID NO: 45837 - protein, 8 aa, Homo sapiens
MQVLVSRI

SEQ ID NO: 45838 - protein, 8 aa, Homo sapiens
FLTGMTVA

SEQ ID NO: 45839 - protein, 8 aa, Homo sapiens
SQSNRELV

SEQ ID NO: 45840 - protein, 8 aa, Homo sapiens
YQSFEQVV

SEQ ID NO: 45841 - protein, 8 aa, Homo sapiens
RIVAFFSF

SEQ ID NO: 45842 - protein, 8 aa, Homo sapiens
RIAAWMAT

SEQ ID NO: 45843 - protein, 8 aa, Homo sapiens
GALCVESV

SEQ ID NO: 45844 - protein, 8 aa, Homo sapiens
AAWMATYL

SEQ ID NO: 45845 - protein, 8 aa, Homo sapiens
MTVAGVVL

SEQ ID NO: 45846 - protein, 8 aa, Homo sapiens
VLVSRIAA

SEQ ID NO: 45847 - protein, 8 aa, Homo sapiens
SEMETPSA

SEQ ID NO: 45848 - protein, 8 aa, Homo sapiens
EVIPMAAV

SEQ ID NO: 45849 - protein, 8 aa, Homo sapiens
SVDKEMQV

SEQ ID NO: 45850 - protein, 8 aa, Homo sapiens
HLADSPAV

SEQ ID NO: 45851 - protein, 8 aa, Homo sapiens
SVDKEMQV

SEQ ID NO: 45852 - protein, 8 aa, Homo sapiens
FLTGMTVA

SEQ ID NO: 45853 - protein, 8 aa, Homo sapiens
SLDAREVI

SEQ ID NO: 45854 - protein, 8 aa, Homo sapiens
ELYGNNAA

SEQ ID NO: 45855 - protein, 8 aa, Homo sapiens
TVAGVVLL

SEQ ID NO: 45856 - protein, 8 aa, Homo sapiens
YLNDHLEP

SEQ ID NO: 45857 - protein, 8 aa, Homo sapiens
EVIPMAAV

SEQ ID NO: 45858 - protein, 8 aa, Homo sapiens
GMTVAGVV

SEQ ID NO: 45859 - protein, 8 aa, Homo sapiens
VLVSRIAA

SEQ ID NO: 45860 - protein, 8 aa, Homo sapiens
VLLGSLFS

SEQ ID NO: 45861 - protein, 8 aa, Homo sapiens
GVNWGRIV

SEQ ID NO: 45862 - protein, 8 aa, Homo sapiens
WFLTGMTV

SEQ ID NO: 45863 - protein, 8 aa, Homo sapiens
SFGGALCV

SEQ ID NO: 45864 - protein, 8 aa, Homo sapiens
SSLDAREV

SEQ ID NO: 45865 - protein, 8 aa, Homo sapiens
DLTSQLHI

SEQ ID NO: 45866 - protein, 8 aa, Homo sapiens
YQSFEQVV

SEQ ID NO: 45867 - protein, 8 aa, Homo sapiens
PMAAVKQA

SEQ ID NO: 45868 - protein, 8 aa, Homo sapiens
FLSYKLSQ

SEQ ID NO: 45869 - protein, 8 aa, Homo sapiens
AAWMATYL

SEQ ID NO: 45870 - protein, 8 aa, Homo sapiens
SQSNRELV

SEQ ID NO: 45871 - protein, 8 aa, Homo sapiens
GALCVESV

SEQ ID NO: 45872 - protein, 8 aa, Homo sapiens
HLADSPAV

SEQ ID NO: 45873 - protein, 8 aa, Homo sapiens
ELYGNNAA

SEQ ID NO: 45874 - protein, 8 aa, Homo sapiens
FLTGMTVA

SEQ ID NO: 45875 - protein, 8 aa, Homo sapiens
SVDKEMQV

SEQ ID NO: 45876 - protein, 8 aa, Homo sapiens
SLDAREVI

SEQ ID NO: 45877 - protein, 8 aa, Homo sapiens
VLVSRIAA

SEQ ID NO: 45878 - protein, 8 aa, Homo sapiens
YLNDHLEP

SEQ ID NO: 45879 - protein, 8 aa, Homo sapiens
YQSFEQVV

SEQ ID NO: 45880 - protein, 8 aa, Homo sapiens
EVIPMAAV

SEQ ID NO: 45881 - protein, 8 aa, Homo sapiens
VLLGSLFS

SEQ ID NO: 45882 - protein, 8 aa, Homo sapiens
FLSYKLSQ

SEQ ID NO: 45883 - protein, 8 aa, Homo sapiens
WFLTGMTV

SEQ ID NO: 45884 - protein, 8 aa, Homo sapiens
GMTVAGVV

SEQ ID NO: 45885 - protein, 8 aa, Homo sapiens
HLADSPAV

SEQ ID NO: 45886 - protein, 8 aa, Homo sapiens
SVDKEMQV

SEQ ID NO: 45887 - protein, 8 aa, Homo sapiens
FLTGMTVA

SEQ ID NO: 45888 - protein, 8 aa, Homo sapiens
ELYGNNAA

SEQ ID NO: 45889 - protein, 8 aa, Homo sapiens
EVIPMAAV

SEQ ID NO: 45890 - protein, 8 aa, Homo sapiens
TVAGVVLL

SEQ ID NO: 45891 - protein, 8 aa, Homo sapiens
SLDAREVI

SEQ ID NO: 45892 - protein, 8 aa, Homo sapiens
SFGGALCV

SEQ ID NO: 45893 - protein, 8 aa, Homo sapiens
GMTVAGVV

SEQ ID NO: 45894 - protein, 8 aa, Homo sapiens
AAWMATYL

SEQ ID NO: 45895 - protein, 8 aa, Homo sapiens
VLVSRIAA

SEQ ID NO: 45896 - protein, 8 aa, Homo sapiens
WFLTGMTV

SEQ ID NO: 45897 - protein, 8 aa, Homo sapiens
FLSYKLSQ

SEQ ID NO: 45898 - protein, 8 aa, Homo sapiens
DLTSQLHI

SEQ ID NO: 45899 - protein, 8 aa, Homo sapiens
GVNWGRIV

SEQ ID NO: 45900 - protein, 8 aa, Homo sapiens
PMAAVKQA

SEQ ID NO: 45901 - protein, 8 aa, Homo sapiens
AYQSFEQV

SEQ ID NO: 45902 - protein, 8 aa, Homo sapiens
VLLGSLFS

SEQ ID NO: 45903 - protein, 8 aa, Homo sapiens
GALCVESV

SEQ ID NO: 45904 - protein, 8 aa, Homo sapiens
HLADSPAV

SEQ ID NO: 45905 - protein, 8 aa, Homo sapiens
FLTGMTVA

SEQ ID NO: 45906 - protein, 8 aa, Homo sapiens
SVDKEMQV

SEQ ID NO: 45907 - protein, 8 aa, Homo sapiens
SLDAREVI

SEQ ID NO: 45908 - protein, 8 aa, Homo sapiens
TVAGVVLL

SEQ ID NO: 45909 - protein, 8 aa, Homo sapiens
ELYGNNAA

SEQ ID NO: 45910 - protein, 8 aa, Homo sapiens
WFLTGMTV

SEQ ID NO: 45911 - protein, 8 aa, Homo sapiens
AAWMATYL

SEQ ID NO: 45912 - protein, 8 aa, Homo sapiens
DLTSQLHI

SEQ ID NO: 45913 - protein, 8 aa, Homo sapiens
VLLGSLFS

SEQ ID NO: 45914 - protein, 8 aa, Homo sapiens
LSYKLSQK

SEQ ID NO: 45915 - protein, 8 aa, Homo sapiens
VVDFLSYK

SEQ ID NO: 45916 - protein, 8 aa, Homo sapiens
LLGSLFSR

SEQ ID NO: 45917 - protein, 8 aa, Homo sapiens
VVDFLSYK

SEQ ID NO: 45918 - protein, 8 aa, Homo sapiens
LSYKLSQK

SEQ ID NO: 45919 - protein, 8 aa, Homo sapiens
VIPMAAVK

SEQ ID NO: 45920 - protein, 8 aa, Homo sapiens
QVVNELFR

SEQ ID NO: 45921 - protein, 8 aa, Homo sapiens
LVVDFLSY

SEQ ID NO: 45922 - protein, 8 aa, Homo sapiens
NAAAESRK

SEQ ID NO: 45923 - protein, 8 aa, Homo sapiens
NWGRIVAF

SEQ ID NO: 45924 - protein, 8 aa, Homo sapiens
RIVAFFSF

SEQ ID NO: 45925 - protein, 8 aa, Homo sapiens
VVLLGSLF

SEQ ID NO: 45926 - protein, 8 aa, Homo sapiens
NWGRIVAF

SEQ ID NO: 45927 - protein, 8 aa, Homo sapiens
AYQSFEQV

SEQ ID NO: 45928 - protein, 8 aa, Homo sapiens
EVIPMAAV

SEQ ID NO: 45929 - protein, 8 aa, Homo sapiens
LVVDFLSY

SEQ ID NO: 45930 - protein, 8 aa, Homo sapiens
EVIPMAAV

SEQ ID NO: 45931 - protein, 8 aa, Homo sapiens
LVVDFLSY

SEQ ID NO: 45932 - protein, 8 aa, Homo sapiens
HITPGTAY

SEQ ID NO: 45933 - protein, 8 aa, Homo sapiens
ELRYRRAF

SEQ ID NO: 45934 - protein, 8 aa, Homo sapiens
RIVAFFSF

SEQ ID NO: 45935 - protein, 8 aa, Homo sapiens
HITPGTAY

SEQ ID NO: 45936 - protein, 8 aa, Homo sapiens
LVVDFLSY

SEQ ID NO: 45937 - protein, 8 aa, Homo sapiens
KGQERFNR

SEQ ID NO: 45938 - protein, 8 aa, Homo sapiens
LLGSLFSR

SEQ ID NO: 45939 - protein, 8 aa, Homo sapiens
EMQVLVSR

SEQ ID NO: 45940 - protein, 8 aa, Homo sapiens
HSSSLDAR

SEQ ID NO: 45941 - protein, 8 aa, Homo sapiens
AAVKQALR

SEQ ID NO: 45942 - protein, 8 aa, Homo sapiens
EFELRYRR

SEQ ID NO: 45943 - protein, 8 aa, Homo sapiens
QVVNELFR

SEQ ID NO: 45944 - protein, 8 aa, Homo sapiens
LSYKLSQK

SEQ ID NO: 45945 - protein, 8 aa, Homo sapiens
EFELRYRR

SEQ ID NO: 45946 - protein, 8 aa, Homo sapiens
EMQVLVSR

SEQ ID NO: 45947 - protein, 8 aa, Homo sapiens
DEFELRYR

SEQ ID NO: 45948 - protein, 8 aa, Homo sapiens
ESRKGQER

SEQ ID NO: 45949 - protein, 8 aa, Homo sapiens
LLGSLFSR

SEQ ID NO: 45950 - protein, 8 aa, Homo sapiens
HSSSLDAR

SEQ ID NO: 45951 - protein, 8 aa, Homo sapiens
QVVNELFR

SEQ ID NO: 45952 - protein, 8 aa, Homo sapiens
HSSSLDAR

SEQ ID NO: 45953 - protein, 8 aa, Homo sapiens
NAAAESRK

SEQ ID NO: 45954 - protein, 8 aa, Homo sapiens
LSYKLSQK

SEQ ID NO: 45955 - protein, 8 aa, Homo sapiens
EMQVLVSR

SEQ ID NO: 45956 - protein, 8 aa, Homo sapiens
NNAAAESR

SEQ ID NO: 45957 - protein, 8 aa, Homo sapiens
AAVKQALR

SEQ ID NO: 45958 - protein, 8 aa, Homo sapiens
ESRKGQER

SEQ ID NO: 45959 - protein, 8 aa, Homo sapiens
IAAWMATY

SEQ ID NO: 45960 - protein, 8 aa, Homo sapiens
EFELRYRR

SEQ ID NO: 45961 - protein, 8 aa, Homo sapiens
TAYQSFEQ

SEQ ID NO: 45962 - protein, 8 aa, Homo sapiens
VVDFLSYK

SEQ ID NO: 45963 - protein, 8 aa, Homo sapiens
DEFELRYR

SEQ ID NO: 45964 - protein, 8 aa, Homo sapiens
FSDVEENR

SEQ ID NO: 45965 - protein, 8 aa, Homo sapiens
LLGSLFSR

SEQ ID NO: 45966 - protein, 8 aa, Homo sapiens
EVIPMAAV

SEQ ID NO: 45967 - protein, 8 aa, Homo sapiens
TVAGVVLL

SEQ ID NO: 45968 - protein, 8 aa, Homo sapiens
TGMTVAGV

SEQ ID NO: 45969 - protein, 8 aa, Homo sapiens
MTVAGVVL

SEQ ID NO: 45970 - protein, 8 aa, Homo sapiens
MAAVKQAL

SEQ ID NO: 45971 - protein, 8 aa, Homo sapiens
HLADSPAV

SEQ ID NO: 45972 - protein, 8 aa, Homo sapiens
ERFNRWFL

SEQ ID NO: 45973 - protein, 8 aa, Homo sapiens
DSPAVNGA

SEQ ID NO: 45974 - protein, 8 aa, Homo sapiens
ELYGNNAA

SEQ ID NO: 45975 - protein, 8 aa, Homo sapiens
EAGDEFEL

SEQ ID NO: 45976 - protein, 8 aa, Homo sapiens
EVIPMAAV

SEQ ID NO: 45977 - protein, 8 aa, Homo sapiens
HLADSPAV

SEQ ID NO: 45978 - protein, 8 aa, Homo sapiens
ELYGNNAA

SEQ ID NO: 45979 - protein, 8 aa, Homo sapiens
MTVAGVVL

SEQ ID NO: 45980 - protein, 8 aa, Homo sapiens
TVAGVVLL

SEQ ID NO: 45981 - protein, 8 aa, Homo sapiens
EAGDEFEL

SEQ ID NO: 45982 - protein, 8 aa, Homo sapiens
SVDKEMQV

SEQ ID NO: 45983 - protein, 8 aa, Homo sapiens
WFLTGMTV

SEQ ID NO: 45984 - protein, 8 aa, Homo sapiens
SPAVNGAT

SEQ ID NO: 45985 - protein, 8 aa, Homo sapiens
MAAVKQAL

SEQ ID NO: 45986 - protein, 8 aa, Homo sapiens
AAWMATYL

SEQ ID NO: 45987 - protein, 8 aa, Homo sapiens
ELRYRRAF

SEQ ID NO: 45988 - protein, 8 aa, Homo sapiens
LVVDFLSY

SEQ ID NO: 45989 - protein, 8 aa, Homo sapiens
RIVAFFSF

SEQ ID NO: 45990 - protein, 8 aa, Homo sapiens
HITPGTAY

SEQ ID NO: 45991 - protein, 8 aa, Homo sapiens
IAAWMATY

SEQ ID NO: 45992 - protein, 8 aa, Homo sapiens
ELRYRRAF

SEQ ID NO: 45993 - protein, 8 aa, Homo sapiens
VVLLGSLF

SEQ ID NO: 45994 - protein, 8 aa, Homo sapiens
QERFNRWF

SEQ ID NO: 45995 - protein, 8 aa, Homo sapiens
RELVVDFL

SEQ ID NO: 45996 - protein, 8 aa, Homo sapiens
FEQVVNEL

SEQ ID NO: 45997 - protein, 8 aa, Homo sapiens
NRWFLTGM

SEQ ID NO: 45998 - protein, 8 aa, Homo sapiens
IAAWMATY

SEQ ID NO: 45999 - protein, 8 aa, Homo sapiens
LVVDFLSY

SEQ ID NO: 46000 - protein, 8 aa, Homo sapiens
MAAVKQAL

SEQ ID NO: 46001 - protein, 8 aa, Homo sapiens
HITPGTAY

SEQ ID NO: 46002 - protein, 8 aa, Homo sapiens
DAREVIPM

SEQ ID NO: 46003 - protein, 8 aa, Homo sapiens
FFSFGGAL

SEQ ID NO: 46004 - protein, 8 aa, Homo sapiens
SPAVNGAT

SEQ ID NO: 46005 - protein, 8 aa, Homo sapiens
AAWMATYL

SEQ ID NO: 46006 - protein, 8 aa, Homo sapiens
MTVAGVVL

SEQ ID NO: 46007 - protein, 8 aa, Homo sapiens
RELVVDFL

SEQ ID NO: 46008 - protein, 8 aa, Homo sapiens
FEQVVNEL

SEQ ID NO: 46009 - protein, 8 aa, Homo sapiens
RELVVDFL

SEQ ID NO: 46010 - protein, 8 aa, Homo sapiens
KEMQVLVS

SEQ ID NO: 46011 - protein, 8 aa, Homo sapiens
REVIPMAA

SEQ ID NO: 46012 - protein, 8 aa, Homo sapiens
LVSRIAAW

SEQ ID NO: 46013 - protein, 8 aa, Homo sapiens
IAAWMATY

SEQ ID NO: 46014 - protein, 8 aa, Homo sapiens
LSQKGYSW

SEQ ID NO: 46015 - protein, 8 aa, Homo sapiens
KGYSWSQF

SEQ ID NO: 46016 - protein, 8 aa, Homo sapiens
RIVAFFSF

SEQ ID NO: 46017 - protein, 8 aa, Homo sapiens
AINGNPSW

SEQ ID NO: 46018 - protein, 9 aa, Homo sapiens
FSDLTSQLH

SEQ ID NO: 46019 - protein, 9 aa, Homo sapiens
FSFGGALCV

SEQ ID NO: 46020 - protein, 9 aa, Homo sapiens
MTVAGVVLL

SEQ ID NO: 46021 - protein, 9 aa, Homo sapiens
YLNDHLEPW

SEQ ID NO: 46022 - protein, 9 aa, Homo sapiens
MTVAGVVLL

SEQ ID NO: 46023 - protein, 9 aa, Homo sapiens
IAAWMATYL

SEQ ID NO: 46024 - protein, 9 aa, Homo sapiens
FLTGMTVAG

SEQ ID NO: 46025 - protein, 9 aa, Homo sapiens
FLSYKLSQK

SEQ ID NO: 46026 - protein, 9 aa, Homo sapiens
LVSRIAAWM

SEQ ID NO: 46027 - protein, 9 aa, Homo sapiens
VVDFLSYKL

SEQ ID NO: 46028 - protein, 9 aa, Homo sapiens
ELYGNNAAA

SEQ ID NO: 46029 - protein, 9 aa, Homo sapiens
PMAAVKQAL

SEQ ID NO: 46030 - protein, 9 aa, Homo sapiens
GMTVAGVVL

SEQ ID NO: 46031 - protein, 9 aa, Homo sapiens
LTGMTVAGV

SEQ ID NO: 46032 - protein, 9 aa, Homo sapiens
MTVAGVVLL

SEQ ID NO: 46033 - protein, 9 aa, Homo sapiens
IAAWMATYL

SEQ ID NO: 46034 - protein, 9 aa, Homo sapiens
AVKQALREA

SEQ ID NO: 46035 - protein, 9 aa, Homo sapiens
QLHITPGTA

SEQ ID NO: 46036 - protein, 9 aa, Homo sapiens
YLNDHLEPW

SEQ ID NO: 46037 - protein, 9 aa, Homo sapiens
TAYQSFEQV

SEQ ID NO: 46038 - protein, 9 aa, Homo sapiens
FLSYKLSQK

SEQ ID NO: 46039 - protein, 9 aa, Homo sapiens
LTGMTVAGV

SEQ ID NO: 46040 - protein, 9 aa, Homo sapiens
MTVAGVVLL

SEQ ID NO: 46041 - protein, 9 aa, Homo sapiens
SQLHITPGT

SEQ ID NO: 46042 - protein, 9 aa, Homo sapiens
MTVAGVVLL

SEQ ID NO: 46043 - protein, 9 aa, Homo sapiens
TAYQSFEQV

SEQ ID NO: 46044 - protein, 9 aa, Homo sapiens
SQSNRELVV

SEQ ID NO: 46045 - protein, 9 aa, Homo sapiens
FSFGGALCV

SEQ ID NO: 46046 - protein, 9 aa, Homo sapiens
REVIPMAAV

SEQ ID NO: 46047 - protein, 9 aa, Homo sapiens
IAAWMATYL

SEQ ID NO: 46048 - protein, 9 aa, Homo sapiens
MQVLVSRIA

SEQ ID NO: 46049 - protein, 9 aa, Homo sapiens
LTGMTVAGV

SEQ ID NO: 46050 - protein, 9 aa, Homo sapiens
YLNDHLEPW

SEQ ID NO: 46051 - protein, 9 aa, Homo sapiens
SEMETPSAI

SEQ ID NO: 46052 - protein, 9 aa, Homo sapiens
ELYGNNAAA

SEQ ID NO: 46053 - protein, 9 aa, Homo sapiens
FSFGGALCV

SEQ ID NO: 46054 - protein, 9 aa, Homo sapiens
PMAAVKQAL

SEQ ID NO: 46055 - protein, 9 aa, Homo sapiens
YLNDHLEPW

SEQ ID NO: 46056 - protein, 9 aa, Homo sapiens
SVDKEMQVL

SEQ ID NO: 46057 - protein, 9 aa, Homo sapiens
VVDFLSYKL

SEQ ID NO: 46058 - protein, 9 aa, Homo sapiens
MTVAGVVLL

SEQ ID NO: 46059 - protein, 9 aa, Homo sapiens
HITPGTAYQ

SEQ ID NO: 46060 - protein, 9 aa, Homo sapiens
TAYQSFEQV

SEQ ID NO: 46061 - protein, 9 aa, Homo sapiens
VLLGSLFSR

SEQ ID NO: 46062 - protein, 9 aa, Homo sapiens
FLTGMTVAG

SEQ ID NO: 46063 - protein, 9 aa, Homo sapiens
GVNWGRIVA

SEQ ID NO: 46064 - protein, 9 aa, Homo sapiens
GMTVAGVVL

SEQ ID NO: 46065 - protein, 9 aa, Homo sapiens
GGWDTFVEL

SEQ ID NO: 46066 - protein, 9 aa, Homo sapiens
AFSDLTSQL

SEQ ID NO: 46067 - protein, 9 aa, Homo sapiens
HLEPWIQEN

SEQ ID NO: 46068 - protein, 9 aa, Homo sapiens
ELYGNNAAA

SEQ ID NO: 46069 - protein, 9 aa, Homo sapiens
PMAAVKQAL

SEQ ID NO: 46070 - protein, 9 aa, Homo sapiens
FSFGGALCV

SEQ ID NO: 46071 - protein, 9 aa, Homo sapiens
YLNDHLEPW

SEQ ID NO: 46072 - protein, 9 aa, Homo sapiens
VLLGSLFSR

SEQ ID NO: 46073 - protein, 9 aa, Homo sapiens
VVDFLSYKL

SEQ ID NO: 46074 - protein, 9 aa, Homo sapiens
SVDKEMQVL

SEQ ID NO: 46075 - protein, 9 aa, Homo sapiens
FLTGMTVAG

SEQ ID NO: 46076 - protein, 9 aa, Homo sapiens
AYQSFEQVV

SEQ ID NO: 46077 - protein, 9 aa, Homo sapiens
ELYGNNAAA

SEQ ID NO: 46078 - protein, 9 aa, Homo sapiens
PMAAVKQAL

SEQ ID NO: 46079 - protein, 9 aa, Homo sapiens
FSFGGALCV

SEQ ID NO: 46080 - protein, 9 aa, Homo sapiens
TAYQSFEQV

SEQ ID NO: 46081 - protein, 9 aa, Homo sapiens
HITPGTAYQ

SEQ ID NO: 46082 - protein, 9 aa, Homo sapiens
GMTVAGVVL

SEQ ID NO: 46083 - protein, 9 aa, Homo sapiens
PMAAVKQAL

SEQ ID NO: 46084 - protein, 9 aa, Homo sapiens
FSFGGALCV

SEQ ID NO: 46085 - protein, 9 aa, Homo sapiens
ELYGNNAAA

SEQ ID NO: 46086 - protein, 9 aa, Homo sapiens
TAYQSFEQV

SEQ ID NO: 46087 - protein, 9 aa, Homo sapiens
YLNDHLEPW

SEQ ID NO: 46088 - protein, 9 aa, Homo sapiens
VLLGSLFSR

SEQ ID NO: 46089 - protein, 9 aa, Homo sapiens
LTGMTVAGV

SEQ ID NO: 46090 - protein, 9 aa, Homo sapiens
LLGSLFSRK

SEQ ID NO: 46091 - protein, 9 aa, Homo sapiens
FLSYKLSQK

SEQ ID NO: 46092 - protein, 9 aa, Homo sapiens
RIAAWMATY

SEQ ID NO: 46093 - protein, 9 aa, Homo sapiens
VLLGSLFSR

SEQ ID NO: 46094 - protein, 9 aa, Homo sapiens
LVVDFLSYK

SEQ ID NO: 46095 - protein, 9 aa, Homo sapiens
LVVDFLSYK

SEQ ID NO: 46096 - protein, 9 aa, Homo sapiens
LLGSLFSRK

SEQ ID NO: 46097 - protein, 9 aa, Homo sapiens
VLLGSLFSR

SEQ ID NO: 46098 - protein, 9 aa, Homo sapiens
RIAAWMATY

SEQ ID NO: 46099 - protein, 9 aa, Homo sapiens
ALCVESVDK

SEQ ID NO: 46100 - protein, 9 aa, Homo sapiens
EVIPMAAVK

SEQ ID NO: 46101 - protein, 9 aa, Homo sapiens
FLSYKLSQK

SEQ ID NO: 46102 - protein, 9 aa, Homo sapiens
RYRRAFSDL

SEQ ID NO: 46103 - protein, 9 aa, Homo sapiens
NWGRIVAFF

SEQ ID NO: 46104 - protein, 9 aa, Homo sapiens
GRIVAFFSF

SEQ ID NO: 46105 - protein, 9 aa, Homo sapiens
NWGRIVAFF

SEQ ID NO: 46106 - protein, 9 aa, Homo sapiens
RYRRAFSDL

SEQ ID NO: 46107 - protein, 9 aa, Homo sapiens
RYRRAFSDL

SEQ ID NO: 46108 - protein, 9 aa, Homo sapiens
SFEQVVNEL

SEQ ID NO: 46109 - protein, 9 aa, Homo sapiens
AYQSFEQVV

SEQ ID NO: 46110 - protein, 9 aa, Homo sapiens
ELVVDFLSY

SEQ ID NO: 46111 - protein, 9 aa, Homo sapiens
RIAAWMATY

SEQ ID NO: 46112 - protein, 9 aa, Homo sapiens
RIAAWMATY

SEQ ID NO: 46113 - protein, 9 aa, Homo sapiens
ELVVDFLSY

SEQ ID NO: 46114 - protein, 9 aa, Homo sapiens
LVSRIAAWM

SEQ ID NO: 46115 - protein, 9 aa, Homo sapiens
SVDKEMQVL

SEQ ID NO: 46116 - protein, 9 aa, Homo sapiens
EVIPMAAVK

SEQ ID NO: 46117 - protein, 9 aa, Homo sapiens
MTVAGVVLL

SEQ ID NO: 46118 - protein, 9 aa, Homo sapiens
LHITPGTAY

SEQ ID NO: 46119 - protein, 9 aa, Homo sapiens
ELVVDFLSY

SEQ ID NO: 46120 - protein, 9 aa, Homo sapiens
RIAAWMATY

SEQ ID NO: 46121 - protein, 9 aa, Homo sapiens
MAAVKQALR

SEQ ID NO: 46122 - protein, 9 aa, Homo sapiens
VLLGSLFSR

SEQ ID NO: 46123 - protein, 9 aa, Homo sapiens
LVVDFLSYK

SEQ ID NO: 46124 - protein, 9 aa, Homo sapiens
KEMQVLVSR

SEQ ID NO: 46125 - protein, 9 aa, Homo sapiens
DEFELRYRR

SEQ ID NO: 46126 - protein, 9 aa, Homo sapiens
MAAVKQALR

SEQ ID NO: 46127 - protein, 9 aa, Homo sapiens
ELRYRRAFS

SEQ ID NO: 46128 - protein, 9 aa, Homo sapiens
VLLGSLFSR

SEQ ID NO: 46129 - protein, 9 aa, Homo sapiens
EAGDEFELR

SEQ ID NO: 46130 - protein, 9 aa, Homo sapiens
QFSDVEENR

SEQ ID NO: 46131 - protein, 9 aa, Homo sapiens
EVIPMAAVK

SEQ ID NO: 46132 - protein, 9 aa, Homo sapiens
MAAVKQALR

SEQ ID NO: 46133 - protein, 9 aa, Homo sapiens
LVVDFLSYK

SEQ ID NO: 46134 - protein, 9 aa, Homo sapiens
EAGDEFELR

SEQ ID NO: 46135 - protein, 9 aa, Homo sapiens
EQVVNELFR

SEQ ID NO: 46136 - protein, 9 aa, Homo sapiens
FLSYKLSQK

SEQ ID NO: 46137 - protein, 9 aa, Homo sapiens
DEFELRYRR

SEQ ID NO: 46138 - protein, 9 aa, Homo sapiens
QFSDVEENR

SEQ ID NO: 46139 - protein, 9 aa, Homo sapiens
NNAAAESRK

SEQ ID NO: 46140 - protein, 9 aa, Homo sapiens
VLLGSLFSR

SEQ ID NO: 46141 - protein, 9 aa, Homo sapiens
MTVAGVVLL

SEQ ID NO: 46142 - protein, 9 aa, Homo sapiens
TAYQSFEQV

SEQ ID NO: 46143 - protein, 9 aa, Homo sapiens
TGMTVAGVV

SEQ ID NO: 46144 - protein, 9 aa, Homo sapiens
MSQSNRELV

SEQ ID NO: 46145 - protein, 9 aa, Homo sapiens
YSWSQFSDV

SEQ ID NO: 46146 - protein, 9 aa, Homo sapiens
FSFGGALCV

SEQ ID NO: 46147 - protein, 9 aa, Homo sapiens
ESVDKEMQV

SEQ ID NO: 46148 - protein, 9 aa, Homo sapiens
MATYLNDHL

SEQ ID NO: 46149 - protein, 9 aa, Homo sapiens
ELYGNNAAA

SEQ ID NO: 46150 - protein, 9 aa, Homo sapiens
VAFFSFGGA

SEQ ID NO: 46151 - protein, 9 aa, Homo sapiens
LTGMTVAGV

SEQ ID NO: 46152 - protein, 9 aa, Homo sapiens
IAAWMATYL

SEQ ID NO: 46153 - protein, 9 aa, Homo sapiens
MTVAGVVLL

SEQ ID NO: 46154 - protein, 9 aa, Homo sapiens
TAYQSFEQV

SEQ ID NO: 46155 - protein, 9 aa, Homo sapiens
ELYGNNAAA

SEQ ID NO: 46156 - protein, 9 aa, Homo sapiens
FSFGGALCV

SEQ ID NO: 46157 - protein, 9 aa, Homo sapiens
LTGMTVAGV

SEQ ID NO: 46158 - protein, 9 aa, Homo sapiens
YSWSQFSDV

SEQ ID NO: 46159 - protein, 9 aa, Homo sapiens
APEGTESEM

SEQ ID NO: 46160 - protein, 9 aa, Homo sapiens
SPAVNGATG

SEQ ID NO: 46161 - protein, 9 aa, Homo sapiens
TPGTAYQSF

SEQ ID NO: 46162 - protein, 9 aa, Homo sapiens
FELRYRRAF

SEQ ID NO: 46163 - protein, 9 aa, Homo sapiens
RIAAWMATY

SEQ ID NO: 46164 - protein, 9 aa, Homo sapiens
ALREAGDEF

SEQ ID NO: 46165 - protein, 9 aa, Homo sapiens
FELRYRRAF

SEQ ID NO: 46166 - protein, 9 aa, Homo sapiens
QERFNRWFL

SEQ ID NO: 46167 - protein, 9 aa, Homo sapiens
FEQVVNELF

SEQ ID NO: 46168 - protein, 9 aa, Homo sapiens
QENGGWDTF

SEQ ID NO: 46169 - protein, 9 aa, Homo sapiens
GRIVAFFSF

SEQ ID NO: 46170 - protein, 9 aa, Homo sapiens
RRAFSDLTS

SEQ ID NO: 46171 - protein, 9 aa, Homo sapiens
TPGTAYQSF

SEQ ID NO: 46172 - protein, 9 aa, Homo sapiens
IAAWMATYL

SEQ ID NO: 46173 - protein, 9 aa, Homo sapiens
APEGTESEM

SEQ ID NO: 46174 - protein, 9 aa, Homo sapiens
ELVVDFLSY

SEQ ID NO: 46175 - protein, 9 aa, Homo sapiens
LHITPGTAY

SEQ ID NO: 46176 - protein, 9 aa, Homo sapiens
NPSWHLADS

SEQ ID NO: 46177 - protein, 9 aa, Homo sapiens
RIAAWMATY

SEQ ID NO: 46178 - protein, 9 aa, Homo sapiens
REAGDEFEL

SEQ ID NO: 46179 - protein, 9 aa, Homo sapiens
QERFNRWFL

SEQ ID NO: 46180 - protein, 9 aa, Homo sapiens
QENGGWDTF

SEQ ID NO: 46181 - protein, 9 aa, Homo sapiens
FEQVVNELF

SEQ ID NO: 46182 - protein, 9 aa, Homo sapiens
FELRYRRAF

SEQ ID NO: 46183 - protein, 9 aa, Homo sapiens
SEMETPSAI

SEQ ID NO: 46184 - protein, 9 aa, Homo sapiens
FELRYRRAF

SEQ ID NO: 46185 - protein, 9 aa, Homo sapiens
QENGGWDTF

SEQ ID NO: 46186 - protein, 9 aa, Homo sapiens
SEMETPSAI

SEQ ID NO: 46187 - protein, 9 aa, Homo sapiens
RELVVDFLS

SEQ ID NO: 46188 - protein, 9 aa, Homo sapiens
REVIPMAAV

SEQ ID NO: 46189 - protein, 9 aa, Homo sapiens
IAAWMATYL

SEQ ID NO: 46190 - protein, 9 aa, Homo sapiens
IPMAAVKQA

SEQ ID NO: 46191 - protein, 9 aa, Homo sapiens
SAINGNPSW

SEQ ID NO: 46192 - protein, 9 aa, Homo sapiens
KLSQKGYSW

SEQ ID NO: 46193 - protein, 9 aa, Homo sapiens
IAAWMATYL

SEQ ID NO: 46194 - protein, 9 aa, Homo sapiens
YLNDHLEPW

SEQ ID NO: 46195 - protein, 10 aa, Homo sapiens
FSDLTSQLHI

SEQ ID NO: 46196 - protein, 10 aa, Homo sapiens
YLNDHLEPWI

SEQ ID NO: 46197 - protein, 10 aa, Homo sapiens
FLTGMTVAGV

SEQ ID NO: 46198 - protein, 10 aa, Homo sapiens
RIAAWMATYL

SEQ ID NO: 46199 - protein, 10 aa, Homo sapiens
WMATYLNDHL

SEQ ID NO: 46200 - protein, 10 aa, Homo sapiens
LVVDFLSYKL

SEQ ID NO: 46201 - protein, 10 aa, Homo sapiens
SLDAREVIPM

SEQ ID NO: 46202 - protein, 10 aa, Homo sapiens
VLVSRIAAWM

SEQ ID NO: 46203 - protein, 10 aa, Homo sapiens
SVDKEMQVLV

SEQ ID NO: 46204 - protein, 10 aa, Homo sapiens
GMTVAGVVLL

SEQ ID NO: 46205 - protein, 10 aa, Homo sapiens
FLTGMTVAGV

SEQ ID NO: 46206 - protein, 10 aa, Homo sapiens
WMATYLNDHL

SEQ ID NO: 46207 - protein, 10 aa, Homo sapiens
RIAAWMATYL

SEQ ID NO: 46208 - protein, 10 aa, Homo sapiens
LVVDFLSYKL

SEQ ID NO: 46209 - protein, 10 aa, Homo sapiens
RAFSDLTSQL

SEQ ID NO: 46210 - protein, 10 aa, Homo sapiens
SLDAREVIPM

SEQ ID NO: 46211 - protein, 10 aa, Homo sapiens
YLNDHLEPWI

SEQ ID NO: 46212 - protein, 10 aa, Homo sapiens
GMTVAGVVLL

SEQ ID NO: 46213 - protein, 10 aa, Homo sapiens
FGGALCVESV

SEQ ID NO: 46214 - protein, 10 aa, Homo sapiens
VLVSRIAAWM

SEQ ID NO: 46215 - protein, 10 aa, Homo sapiens
FLTGMTVAGV

SEQ ID NO: 46216 - protein, 10 aa, Homo sapiens
YLNDHLEPWI

SEQ ID NO: 46217 - protein, 10 aa, Homo sapiens
RIAAWMATYL

SEQ ID NO: 46218 - protein, 10 aa, Homo sapiens
WMATYLNDHL

SEQ ID NO: 46219 - protein, 10 aa, Homo sapiens
VLVSRIAAWM

SEQ ID NO: 46220 - protein, 10 aa, Homo sapiens
IVAFFSFGGA

SEQ ID NO: 46221 - protein, 10 aa, Homo sapiens
LVVDFLSYKL

SEQ ID NO: 46222 - protein, 10 aa, Homo sapiens
VVNELFRDGV

SEQ ID NO: 46223 - protein, 10 aa, Homo sapiens
GMTVAGVVLL

SEQ ID NO: 46224 - protein, 10 aa, Homo sapiens
RAFSDLTSQL

SEQ ID NO: 46225 - protein, 10 aa, Homo sapiens
LTGMTVAGVV

SEQ ID NO: 46226 - protein, 10 aa, Homo sapiens
GTAYQSFEQV

SEQ ID NO: 46227 - protein, 10 aa, Homo sapiens
FLTGMTVAGV

SEQ ID NO: 46228 - protein, 10 aa, Homo sapiens
YLNDHLEPWI

SEQ ID NO: 46229 - protein, 10 aa, Homo sapiens
SLDAREVIPM

SEQ ID NO: 46230 - protein, 10 aa, Homo sapiens
RIAAWMATYL

SEQ ID NO: 46231 - protein, 10 aa, Homo sapiens
LVVDFLSYKL

SEQ ID NO: 46232 - protein, 10 aa, Homo sapiens
AINGNPSWHL

SEQ ID NO: 46233 - protein, 10 aa, Homo sapiens
FLTGMTVAGV

SEQ ID NO: 46234 - protein, 10 aa, Homo sapiens
RIAAWMATYL

SEQ ID NO: 46235 - protein, 10 aa, Homo sapiens
YLNDHLEPWI

SEQ ID NO: 46236 - protein, 10 aa, Homo sapiens
MQVLVSRIAA

SEQ ID NO: 46237 - protein, 10 aa, Homo sapiens
LVVDFLSYKL

SEQ ID NO: 46238 - protein, 10 aa, Homo sapiens
WMATYLNDHL

SEQ ID NO: 46239 - protein, 10 aa, Homo sapiens
SQLHITPGTA

SEQ ID NO: 46240 - protein, 10 aa, Homo sapiens
GTAYQSFEQV

SEQ ID NO: 46241 - protein, 10 aa, Homo sapiens
SVDKEMQVLV

SEQ ID NO: 46242 - protein, 10 aa, Homo sapiens
RAFSDLTSQL

SEQ ID NO: 46243 - protein, 10 aa, Homo sapiens
KEMQVLVSRI

SEQ ID NO: 46244 - protein, 10 aa, Homo sapiens
IQENGGWDTF

SEQ ID NO: 46245 - protein, 10 aa, Homo sapiens
IVAFFSFGGA

SEQ ID NO: 46246 - protein, 10 aa, Homo sapiens
VVNELFRDGV

SEQ ID NO: 46247 - protein, 10 aa, Homo sapiens
TAYQSFEQVV

SEQ ID NO: 46248 - protein, 10 aa, Homo sapiens
FLTGMTVAGV

SEQ ID NO: 46249 - protein, 10 aa, Homo sapiens
YLNDHLEPWI

SEQ ID NO: 46250 - protein, 10 aa, Homo sapiens
SVDKEMQVLV

SEQ ID NO: 46251 - protein, 10 aa, Homo sapiens
SLDAREVIPM

SEQ ID NO: 46252 - protein, 10 aa, Homo sapiens
GMTVAGVVLL

SEQ ID NO: 46253 - protein, 10 aa, Homo sapiens
LVVDFLSYKL

SEQ ID NO: 46254 - protein, 10 aa, Homo sapiens
RIAAWMATYL

SEQ ID NO: 46255 - protein, 10 aa, Homo sapiens
VVNELFRDGV

SEQ ID NO: 46256 - protein, 10 aa, Homo sapiens
AINGNPSWHL

SEQ ID NO: 46257 - protein, 10 aa, Homo sapiens
WMATYLNDHL

SEQ ID NO: 46258 - protein, 10 aa, Homo sapiens
TAYQSFEQVV

SEQ ID NO: 46259 - protein, 10 aa, Homo sapiens
VLVSRIAAWM

SEQ ID NO: 46260 - protein, 10 aa, Homo sapiens
FFSFGGALCV

SEQ ID NO: 46261 - protein, 10 aa, Homo sapiens
VLLGSLFSRK

SEQ ID NO: 46262 - protein, 10 aa, Homo sapiens
RAFSDLTSQL

SEQ ID NO: 46263 - protein, 10 aa, Homo sapiens
GTAYQSFEQV

SEQ ID NO: 46264 - protein, 10 aa, Homo sapiens
FLTGMTVAGV

SEQ ID NO: 46265 - protein, 10 aa, Homo sapiens
YLNDHLEPWI

SEQ ID NO: 46266 - protein, 10 aa, Homo sapiens
SVDKEMQVLV

SEQ ID NO: 46267 - protein, 10 aa, Homo sapiens
WMATYLNDHL

SEQ ID NO: 46268 - protein, 10 aa, Homo sapiens
VVNELFRDGV

SEQ ID NO: 46269 - protein, 10 aa, Homo sapiens
LVVDFLSYKL

SEQ ID NO: 46270 - protein, 10 aa, Homo sapiens
VLVSRIAAWM

SEQ ID NO: 46271 - protein, 10 aa, Homo sapiens
SLDAREVIPM

SEQ ID NO: 46272 - protein, 10 aa, Homo sapiens
AINGNPSWHL

SEQ ID NO: 46273 - protein, 10 aa, Homo sapiens
RIAAWMATYL

SEQ ID NO: 46274 - protein, 10 aa, Homo sapiens
FFSFGGALCV

SEQ ID NO: 46275 - protein, 10 aa, Homo sapiens
VLLGSLFSRK

SEQ ID NO: 46276 - protein, 10 aa, Homo sapiens
TAYQSFEQVV

SEQ ID NO: 46277 - protein, 10 aa, Homo sapiens
ELYGNNAAAE

SEQ ID NO: 46278 - protein, 10 aa, Homo sapiens
GMTVAGVVLL

SEQ ID NO: 46279 - protein, 10 aa, Homo sapiens
FLTGMTVAGV

SEQ ID NO: 46280 - protein, 10 aa, Homo sapiens
YLNDHLEPWI

SEQ ID NO: 46281 - protein, 10 aa, Homo sapiens
SVDKEMQVLV

SEQ ID NO: 46282 - protein, 10 aa, Homo sapiens
WMATYLNDHL

SEQ ID NO: 46283 - protein, 10 aa, Homo sapiens
RIAAWMATYL

SEQ ID NO: 46284 - protein, 10 aa, Homo sapiens
AINGNPSWHL

SEQ ID NO: 46285 - protein, 10 aa, Homo sapiens
VLVSRIAAWM

SEQ ID NO: 46286 - protein, 10 aa, Homo sapiens
LVVDFLSYKL

SEQ ID NO: 46287 - protein, 10 aa, Homo sapiens
SLDAREVIPM

SEQ ID NO: 46288 - protein, 10 aa, Homo sapiens
GMTVAGVVLL

SEQ ID NO: 46289 - protein, 10 aa, Homo sapiens
TAYQSFEQVV

SEQ ID NO: 46290 - protein, 10 aa, Homo sapiens
FFSFGGALCV

SEQ ID NO: 46291 - protein, 10 aa, Homo sapiens
GTAYQSFEQV

SEQ ID NO: 46292 - protein, 10 aa, Homo sapiens
FLTGMTVAGV

SEQ ID NO: 46293 - protein, 10 aa, Homo sapiens
YLNDHLEPWI

SEQ ID NO: 46294 - protein, 10 aa, Homo sapiens
WMATYLNDHL

SEQ ID NO: 46295 - protein, 10 aa, Homo sapiens
AINGNPSWHL

SEQ ID NO: 46296 - protein, 10 aa, Homo sapiens
LVVDFLSYKL

SEQ ID NO: 46297 - protein, 10 aa, Homo sapiens
SVDKEMQVLV

SEQ ID NO: 46298 - protein, 10 aa, Homo sapiens
RIAAWMATYL

SEQ ID NO: 46299 - protein, 10 aa, Homo sapiens
SLDAREVIPM

SEQ ID NO: 46300 - protein, 10 aa, Homo sapiens
VLVSRIAAWM

SEQ ID NO: 46301 - protein, 10 aa, Homo sapiens
VLLGSLFSRK

SEQ ID NO: 46302 - protein, 10 aa, Homo sapiens
ELVVDFLSYK

SEQ ID NO: 46303 - protein, 10 aa, Homo sapiens
GALCVESVDK

SEQ ID NO: 46304 - protein, 10 aa, Homo sapiens
VVLLGSLFSR

SEQ ID NO: 46305 - protein, 10 aa, Homo sapiens
REVIPMAAVK

SEQ ID NO: 46306 - protein, 10 aa, Homo sapiens
VLLGSLFSRK

SEQ ID NO: 46307 - protein, 10 aa, Homo sapiens
VVLLGSLFSR

SEQ ID NO: 46308 - protein, 10 aa, Homo sapiens
GALCVESVDK

SEQ ID NO: 46309 - protein, 10 aa, Homo sapiens
SQFSDVEENR

SEQ ID NO: 46310 - protein, 10 aa, Homo sapiens
SFEQVVNELF

SEQ ID NO: 46311 - protein, 10 aa, Homo sapiens
TYLNDHLEPW

SEQ ID NO: 46312 - protein, 10 aa, Homo sapiens
SFEQVVNELF

SEQ ID NO: 46313 - protein, 10 aa, Homo sapiens
TYLNDHLEPW

SEQ ID NO: 46314 - protein, 10 aa, Homo sapiens
ITPGTAYQSF

SEQ ID NO: 46315 - protein, 10 aa, Homo sapiens
TYLNDHLEPW

SEQ ID NO: 46316 - protein, 10 aa, Homo sapiens
SFEQVVNELF

SEQ ID NO: 46317 - protein, 10 aa, Homo sapiens
ITPGTAYQSF

SEQ ID NO: 46318 - protein, 10 aa, Homo sapiens
EAPEGTESEM

SEQ ID NO: 46319 - protein, 10 aa, Homo sapiens
RIAAWMATYL

SEQ ID NO: 46320 - protein, 10 aa, Homo sapiens
ITPGTAYQSF

SEQ ID NO: 46321 - protein, 10 aa, Homo sapiens
VLVSRIAAWM

SEQ ID NO: 46322 - protein, 10 aa, Homo sapiens
EAPEGTESEM

SEQ ID NO: 46323 - protein, 10 aa, Homo sapiens
ESVDKEMQVL

SEQ ID NO: 46324 - protein, 10 aa, Homo sapiens
EFELRYRRAF

SEQ ID NO: 46325 - protein, 10 aa, Homo sapiens
QLHITPGTAY

SEQ ID NO: 46326 - protein, 10 aa, Homo sapiens
VVLLGSLFSR

SEQ ID NO: 46327 - protein, 10 aa, Homo sapiens
LFRDGVNWGR

SEQ ID NO: 46328 - protein, 10 aa, Homo sapiens
SRKGQERFNR

SEQ ID NO: 46329 - protein, 10 aa, Homo sapiens
PMAAVKQALR

SEQ ID NO: 46330 - protein, 10 aa, Homo sapiens
VVLLGSLFSR

SEQ ID NO: 46331 - protein, 10 aa, Homo sapiens
LFRDGVNWGR

SEQ ID NO: 46332 - protein, 10 aa, Homo sapiens
DFLSYKLSQK

SEQ ID NO: 46333 - protein, 10 aa, Homo sapiens
ELVVDFLSYK

SEQ ID NO: 46334 - protein, 10 aa, Homo sapiens
SQFSDVEENR

SEQ ID NO: 46335 - protein, 10 aa, Homo sapiens
VVLLGSLFSR

SEQ ID NO: 46336 - protein, 10 aa, Homo sapiens
YGNNAAAESR

SEQ ID NO: 46337 - protein, 10 aa, Homo sapiens
EVIPMAAVKQ

SEQ ID NO: 46338 - protein, 10 aa, Homo sapiens
MATYLNDHLE

SEQ ID NO: 46339 - protein, 10 aa, Homo sapiens
IVAFFSFGGA

SEQ ID NO: 46340 - protein, 10 aa, Homo sapiens
GTAYQSFEQV

SEQ ID NO: 46341 - protein, 10 aa, Homo sapiens
LVVDFLSYKL

SEQ ID NO: 46342 - protein, 10 aa, Homo sapiens
QSFEQVVNEL

SEQ ID NO: 46343 - protein, 10 aa, Homo sapiens
FLTGMTVAGV

SEQ ID NO: 46344 - protein, 10 aa, Homo sapiens
TAYQSFEQVV

SEQ ID NO: 46345 - protein, 10 aa, Homo sapiens
RIAAWMATYL

SEQ ID NO: 46346 - protein, 10 aa, Homo sapiens
NGATGHSSSL

SEQ ID NO: 46347 - protein, 10 aa, Homo sapiens
TVAGVVLLGS

SEQ ID NO: 46348 - protein, 10 aa, Homo sapiens
FGGALCVESV

SEQ ID NO: 46349 - protein, 10 aa, Homo sapiens
VVNELFRDGV

SEQ ID NO: 46350 - protein, 10 aa, Homo sapiens
LVSRIAAWMA

SEQ ID NO: 46351 - protein, 10 aa, Homo sapiens
TGMTVAGVVL

SEQ ID NO: 46352 - protein, 10 aa, Homo sapiens
SVDKEMQVLV

SEQ ID NO: 46353 - protein, 10 aa, Homo sapiens
FLTGMTVAGV

SEQ ID NO: 46354 - protein, 10 aa, Homo sapiens
TAYQSFEQVV

SEQ ID NO: 46355 - protein, 10 aa, Homo sapiens
LVVDFLSYKL

SEQ ID NO: 46356 - protein, 10 aa, Homo sapiens
RIAAWMATYL

SEQ ID NO: 46357 - protein, 10 aa, Homo sapiens
GTAYQSFEQV

SEQ ID NO: 46358 - protein, 10 aa, Homo sapiens
IPMAAVKQAL

SEQ ID NO: 46359 - protein, 10 aa, Homo sapiens
SQKGYSWSQF

SEQ ID NO: 46360 - protein, 10 aa, Homo sapiens
QLHITPGTAY

SEQ ID NO: 46361 - protein, 10 aa, Homo sapiens
GVNWGRIVAF

SEQ ID NO: 46362 - protein, 10 aa, Homo sapiens
IQENGGWDTF

SEQ ID NO: 46363 - protein, 10 aa, Homo sapiens
LSYKLSQKGY

SEQ ID NO: 46364 - protein, 10 aa, Homo sapiens
RELVVDFLSY

SEQ ID NO: 46365 - protein, 10 aa, Homo sapiens
SRIAAWMATY

SEQ ID NO: 46366 - protein, 10 aa, Homo sapiens
RRAFSDLTSQ

SEQ ID NO: 46367 - protein, 10 aa, Homo sapiens
IPMAAVKQAL

SEQ ID NO: 46368 - protein, 10 aa, Homo sapiens
EPWIQENGGW

SEQ ID NO: 46369 - protein, 10 aa, Homo sapiens
EAGDEFELRY

SEQ ID NO: 46370 - protein, 10 aa, Homo sapiens
EAPEGTESEM

SEQ ID NO: 46371 - protein, 10 aa, Homo sapiens
QALREAGDEF

SEQ ID NO: 46372 - protein, 10 aa, Homo sapiens
SPAVNGATGH

SEQ ID NO: 46373 - protein, 10 aa, Homo sapiens
TPSAINGNPS

SEQ ID NO: 46374 - protein, 10 aa, Homo sapiens
GVNWGRIVAF

SEQ ID NO: 46375 - protein, 10 aa, Homo sapiens
VAFFSFGGAL

SEQ ID NO: 46376 - protein, 10 aa, Homo sapiens
FVELYGNNAA

SEQ ID NO: 46377 - protein, 10 aa, Homo sapiens
AESRKGQERF

SEQ ID NO: 46378 - protein, 10 aa, Homo sapiens
EPWIQENGGW

SEQ ID NO: 46379 - protein, 10 aa, Homo sapiens
QSNRELVVDF

SEQ ID NO: 46380 - protein, 10 aa, Homo sapiens
QVLVSRIAAW

SEQ ID NO: 46381 - protein, 10 aa, Homo sapiens
PSAINGNPSW

SEQ ID NO: 46382 - protein, 11 aa, Homo sapiens
FLTGMTVAGVV

SEQ ID NO: 46383 - protein, 11 aa, Homo sapiens
SLDAREVIPMA

SEQ ID NO: 46384 - protein, 11 aa, Homo sapiens
VLVSRIAAWMA

SEQ ID NO: 46385 - protein, 11 aa, Homo sapiens
HLADSPAVNGA

SEQ ID NO: 46386 - protein, 11 aa, Homo sapiens
YLNDHLEPWIQ

SEQ ID NO: 46387 - protein, 11 aa, Homo sapiens
ALREAGDEFEL

SEQ ID NO: 46388 - protein, 11 aa, Homo sapiens
YQSFEQVVNEL

SEQ ID NO: 46389 - protein, 11 aa, Homo sapiens
HLADSPAVNGA

SEQ ID NO: 46390 - protein, 11 aa, Homo sapiens
FLTGMTVAGVV

SEQ ID NO: 46391 - protein, 11 aa, Homo sapiens
YQSFEQVVNEL

SEQ ID NO: 46392 - protein, 11 aa, Homo sapiens
ALREAGDEFEL

SEQ ID NO: 46393 - protein, 11 aa, Homo sapiens
YLNDHLEPWIQ

SEQ ID NO: 46394 - protein, 11 aa, Homo sapiens
IVAFFSFGGAL

SEQ ID NO: 46395 - protein, 11 aa, Homo sapiens
TVAGVVLLGSL

SEQ ID NO: 46396 - protein, 11 aa, Homo sapiens
VLVSRIAAWMA

SEQ ID NO: 46397 - protein, 11 aa, Homo sapiens
KLSQKGYSWSQ

SEQ ID NO: 46398 - protein, 11 aa, Homo sapiens
ELVVDFLSYKL

SEQ ID NO: 46399 - protein, 11 aa, Homo sapiens
SLDAREVIPMA

SEQ ID NO: 46400 - protein, 11 aa, Homo sapiens
FLTGMTVAGVV

SEQ ID NO: 46401 - protein, 11 aa, Homo sapiens
HLADSPAVNGA

SEQ ID NO: 46402 - protein, 11 aa, Homo sapiens
RIVAFFSFGGA

SEQ ID NO: 46403 - protein, 11 aa, Homo sapiens
VLVSRIAAWMA

SEQ ID NO: 46404 - protein, 11 aa, Homo sapiens
TVAGVVLLGSL

SEQ ID NO: 46405 - protein, 11 aa, Homo sapiens
ALREAGDEFEL

SEQ ID NO: 46406 - protein, 11 aa, Homo sapiens
YQSFEQVVNEL

SEQ ID NO: 46407 - protein, 11 aa, Homo sapiens
YLNDHLEPWIQ

SEQ ID NO: 46408 - protein, 11 aa, Homo sapiens
AINGNPSWHLA

SEQ ID NO: 46409 - protein, 11 aa, Homo sapiens
FNRWFLTGMTV

SEQ ID NO: 46410 - protein, 11 aa, Homo sapiens
IVAFFSFGGAL

SEQ ID NO: 46411 - protein, 11 aa, Homo sapiens
SLDAREVIPMA

SEQ ID NO: 46412 - protein, 11 aa, Homo sapiens
MAAVKQALREA

SEQ ID NO: 46413 - protein, 11 aa, Homo sapiens
QVVNELFRDGV

SEQ ID NO: 46414 - protein, 11 aa, Homo sapiens
FLTGMTVAGVV

SEQ ID NO: 46415 - protein, 11 aa, Homo sapiens
ALREAGDEFEL

SEQ ID NO: 46416 - protein, 11 aa, Homo sapiens
VLVSRIAAWMA

SEQ ID NO: 46417 - protein, 11 aa, Homo sapiens
YLNDHLEPWIQ

SEQ ID NO: 46418 - protein, 11 aa, Homo sapiens
SLDAREVIPMA

SEQ ID NO: 46419 - protein, 11 aa, Homo sapiens
FLTGMTVAGVV

SEQ ID NO: 46420 - protein, 11 aa, Homo sapiens
RIVAFFSFGGA

SEQ ID NO: 46421 - protein, 11 aa, Homo sapiens
IQENGGWDTFV

SEQ ID NO: 46422 - protein, 11 aa, Homo sapiens
YQSFEQVVNEL

SEQ ID NO: 46423 - protein, 11 aa, Homo sapiens
SAINGNPSWHL

SEQ ID NO: 46424 - protein, 11 aa, Homo sapiens
QVVNELFRDGV

SEQ ID NO: 46425 - protein, 11 aa, Homo sapiens
VLVSRIAAWMA

SEQ ID NO: 46426 - protein, 11 aa, Homo sapiens
KQALREAGDEF

SEQ ID NO: 46427 - protein, 11 aa, Homo sapiens
HLADSPAVNGA

SEQ ID NO: 46428 - protein, 11 aa, Homo sapiens
TVAGVVLLGSL

SEQ ID NO: 46429 - protein, 11 aa, Homo sapiens
ALREAGDEFEL

SEQ ID NO: 46430 - protein, 11 aa, Homo sapiens
SQLHITPGTAY

SEQ ID NO: 46431 - protein, 11 aa, Homo sapiens
FLTGMTVAGVV

SEQ ID NO: 46432 - protein, 11 aa, Homo sapiens
SLDAREVIPMA

SEQ ID NO: 46433 - protein, 11 aa, Homo sapiens
YLNDHLEPWIQ

SEQ ID NO: 46434 - protein, 11 aa, Homo sapiens
ALREAGDEFEL

SEQ ID NO: 46435 - protein, 11 aa, Homo sapiens
HLADSPAVNGA

SEQ ID NO: 46436 - protein, 11 aa, Homo sapiens
VLVSRIAAWMA

SEQ ID NO: 46437 - protein, 11 aa, Homo sapiens
KLSQKGYSWSQ

SEQ ID NO: 46438 - protein, 11 aa, Homo sapiens
ELVVDFLSYKL

SEQ ID NO: 46439 - protein, 11 aa, Homo sapiens
TVAGVVLLGSL

SEQ ID NO: 46440 - protein, 11 aa, Homo sapiens
AINGNPSWHLA

SEQ ID NO: 46441 - protein, 11 aa, Homo sapiens
WFLTGMTVAGV

SEQ ID NO: 46442 - protein, 11 aa, Homo sapiens
AFFSFGGALCV

SEQ ID NO: 46443 - protein, 11 aa, Homo sapiens
SFGGALCVESV

SEQ ID NO: 46444 - protein, 11 aa, Homo sapiens
VIPMAAVKQAL

SEQ ID NO: 46445 - protein, 11 aa, Homo sapiens
QVVNELFRDGV

SEQ ID NO: 46446 - protein, 11 aa, Homo sapiens
FRDGVNWGRIV

SEQ ID NO: 46447 - protein, 11 aa, Homo sapiens
SAINGNPSWHL

SEQ ID NO: 46448 - protein, 11 aa, Homo sapiens
ELYGNNAAAES

SEQ ID NO: 46449 - protein, 11 aa, Homo sapiens
CVESVDKEMQV

SEQ ID NO: 46450 - protein, 11 aa, Homo sapiens
GTAYQSFEQVV

SEQ ID NO: 46451 - protein, 11 aa, Homo sapiens
IVAFFSFGGAL

SEQ ID NO: 46452 - protein, 11 aa, Homo sapiens
FLTGMTVAGVV

SEQ ID NO: 46453 - protein, 11 aa, Homo sapiens
YLNDHLEPWIQ

SEQ ID NO: 46454 - protein, 11 aa, Homo sapiens
ALREAGDEFEL

SEQ ID NO: 46455 - protein, 11 aa, Homo sapiens
SLDAREVIPMA

SEQ ID NO: 46456 - protein, 11 aa, Homo sapiens
HLADSPAVNGA

SEQ ID NO: 46457 - protein, 11 aa, Homo sapiens
VLVSRIAAWMA

SEQ ID NO: 46458 - protein, 11 aa, Homo sapiens
VIPMAAVKQAL

SEQ ID NO: 46459 - protein, 11 aa, Homo sapiens
KLSQKGYSWSQ

SEQ ID NO: 46460 - protein, 11 aa, Homo sapiens
WFLTGMTVAGV

SEQ ID NO: 46461 - protein, 11 aa, Homo sapiens
ELVVDFLSYKL

SEQ ID NO: 46462 - protein, 11 aa, Homo sapiens
FRDGVNWGRIV

SEQ ID NO: 46463 - protein, 11 aa, Homo sapiens
FLTGMTVAGVV

SEQ ID NO: 46464 - protein, 11 aa, Homo sapiens
ALREAGDEFEL

SEQ ID NO: 46465 - protein, 11 aa, Homo sapiens
SLDAREVIPMA

SEQ ID NO: 46466 - protein, 11 aa, Homo sapiens
VLVSRIAAWMA

SEQ ID NO: 46467 - protein, 11 aa, Homo sapiens
CVESVDKEMQV

SEQ ID NO: 46468 - protein, 11 aa, Homo sapiens
HLADSPAVNGA

SEQ ID NO: 46469 - protein, 11 aa, Homo sapiens
SFGGALCVESV

SEQ ID NO: 46470 - protein, 11 aa, Homo sapiens
YLNDHLEPWIQ

SEQ ID NO: 46471 - protein, 11 aa, Homo sapiens
KLSQKGYSWSQ

SEQ ID NO: 46472 - protein, 11 aa, Homo sapiens
ELVVDFLSYKL

SEQ ID NO: 46473 - protein, 11 aa, Homo sapiens
TVAGVVLLGSL

SEQ ID NO: 46474 - protein, 11 aa, Homo sapiens
AFFSFGGALCV

SEQ ID NO: 46475 - protein, 11 aa, Homo sapiens
IQENGGWDTFV

SEQ ID NO: 46476 - protein, 11 aa, Homo sapiens
QVVNELFRDGV

SEQ ID NO: 46477 - protein, 11 aa, Homo sapiens
VIPMAAVKQAL

SEQ ID NO: 46478 - protein, 11 aa, Homo sapiens
ELYGNNAAAES

SEQ ID NO: 46479 - protein, 11 aa, Homo sapiens
SAINGNPSWHL

SEQ ID NO: 46480 - protein, 11 aa, Homo sapiens
WFLTGMTVAGV

SEQ ID NO: 46481 - protein, 11 aa, Homo sapiens
AINGNPSWHLA

SEQ ID NO: 46482 - protein, 11 aa, Homo sapiens
FLTGMTVAGVV

SEQ ID NO: 46483 - protein, 11 aa, Homo sapiens
HLADSPAVNGA

SEQ ID NO: 46484 - protein, 11 aa, Homo sapiens
YLNDHLEPWIQ

SEQ ID NO: 46485 - protein, 11 aa, Homo sapiens
SLDAREVIPMA

SEQ ID NO: 46486 - protein, 11 aa, Homo sapiens
ALREAGDEFEL

SEQ ID NO: 46487 - protein, 11 aa, Homo sapiens
WFLTGMTVAGV

SEQ ID NO: 46488 - protein, 11 aa, Homo sapiens
VLVSRIAAWMA

SEQ ID NO: 46489 - protein, 11 aa, Homo sapiens
VVLLGSLFSRK

SEQ ID NO: 46490 - protein, 11 aa, Homo sapiens
VVLLGSLFSRK

SEQ ID NO: 46491 - protein, 11 aa, Homo sapiens
GVVLLGSLFSR

SEQ ID NO: 46492 - protein, 11 aa, Homo sapiens
ATGHSSSLDAR

SEQ ID NO: 46493 - protein, 11 aa, Homo sapiens
RELVVDFLSYK

SEQ ID NO: 46494 - protein, 11 aa, Homo sapiens
NWGRIVAFFSF

SEQ ID NO: 46495 - protein, 11 aa, Homo sapiens
TYLNDHLEPWI

SEQ ID NO: 46496 - protein, 11 aa, Homo sapiens
AWMATYLNDHL

SEQ ID NO: 46497 - protein, 11 aa, Homo sapiens
SYKLSQKGYSW

SEQ ID NO: 46498 - protein, 11 aa, Homo sapiens
NWGRIVAFFSF

SEQ ID NO: 46499 - protein, 11 aa, Homo sapiens
TYLNDHLEPWI

SEQ ID NO: 46500 - protein, 11 aa, Homo sapiens
AWMATYLNDHL

SEQ ID NO: 46501 - protein, 11 aa, Homo sapiens
TYLNDHLEPWI

SEQ ID NO: 46502 - protein, 11 aa, Homo sapiens
AWMATYLNDHL

SEQ ID NO: 46503 - protein, 11 aa, Homo sapiens
SYKLSQKGYSW

SEQ ID NO: 46504 - protein, 11 aa, Homo sapiens
HITPGTAYQSF

SEQ ID NO: 46505 - protein, 11 aa, Homo sapiens
QVLVSRIAAWM

SEQ ID NO: 46506 - protein, 11 aa, Homo sapiens
HITPGTAYQSF

SEQ ID NO: 46507 - protein, 11 aa, Homo sapiens
WIQENGGWDTF

SEQ ID NO: 46508 - protein, 11 aa, Homo sapiens
FLSYKLSQKGY

SEQ ID NO: 46509 - protein, 11 aa, Homo sapiens
DGVNWGRIVAF

SEQ ID NO: 46510 - protein, 11 aa, Homo sapiens
TVAGVVLLGSL

SEQ ID NO: 46511 - protein, 11 aa, Homo sapiens
SQLHITPGTAY

SEQ ID NO: 46512 - protein, 11 aa, Homo sapiens
VVLLGSLFSRK

SEQ ID NO: 46513 - protein, 11 aa, Homo sapiens
RYRRAFSDLTS

SEQ ID NO: 46514 - protein, 11 aa, Homo sapiens
GVVLLGSLFSR

SEQ ID NO: 46515 - protein, 11 aa, Homo sapiens
SFEQVVNELFR

SEQ ID NO: 46516 - protein, 11 aa, Homo sapiens
ESRKGQERFNR

SEQ ID NO: 46517 - protein, 11 aa, Homo sapiens
ATGHSSSLDAR

SEQ ID NO: 46518 - protein, 11 aa, Homo sapiens
RELVVDFLSYK

SEQ ID NO: 46519 - protein, 11 aa, Homo sapiens
LYGNNAAAESR

SEQ ID NO: 46520 - protein, 11 aa, Homo sapiens
ESRKGQERFNR

SEQ ID NO: 46521 - protein, 11 aa, Homo sapiens
ELFRDGVNWGR

SEQ ID NO: 46522 - protein, 11 aa, Homo sapiens
EAGDEFELRYR

SEQ ID NO: 46523 - protein, 11 aa, Homo sapiens
SFEQVVNELFR

SEQ ID NO: 46524 - protein, 11 aa, Homo sapiens
GVVLLGSLFSR

SEQ ID NO: 46525 - protein, 11 aa, Homo sapiens
EFELRYRRAFS

SEQ ID NO: 46526 - protein, 11 aa, Homo sapiens
ELFRDGVNWGR

SEQ ID NO: 46527 - protein, 11 aa, Homo sapiens
WSQFSDVEENR

SEQ ID NO: 46528 - protein, 11 aa, Homo sapiens
ESRKGQERFNR

SEQ ID NO: 46529 - protein, 11 aa, Homo sapiens
EAGDEFELRYR

SEQ ID NO: 46530 - protein, 11 aa, Homo sapiens
GVVLLGSLFSR

SEQ ID NO: 46531 - protein, 11 aa, Homo sapiens
IPMAAVKQALR

SEQ ID NO: 46532 - protein, 11 aa, Homo sapiens
SFEQVVNELFR

SEQ ID NO: 46533 - protein, 11 aa, Homo sapiens
TVAGVVLLGSL

SEQ ID NO: 46534 - protein, 11 aa, Homo sapiens
QVVNELFRDGV

SEQ ID NO: 46535 - protein, 11 aa, Homo sapiens
IVAFFSFGGAL

SEQ ID NO: 46536 - protein, 11 aa, Homo sapiens
ESVDKEMQVLV

SEQ ID NO: 46537 - protein, 11 aa, Homo sapiens
TGMTVAGVVLL

SEQ ID NO: 46538 - protein, 11 aa, Homo sapiens
ELVVDFLSYKL

SEQ ID NO: 46539 - protein, 11 aa, Homo sapiens
RIVAFFSFGGA

SEQ ID NO: 46540 - protein, 11 aa, Homo sapiens
DTFVELYGNNA

SEQ ID NO: 46541 - protein, 11 aa, Homo sapiens
EVIPMAAVKQA

SEQ ID NO: 46542 - protein, 11 aa, Homo sapiens
GTAYQSFEQVV

SEQ ID NO: 46543 - protein, 11 aa, Homo sapiens
DAREVIPMAAV

SEQ ID NO: 46544 - protein, 11 aa, Homo sapiens
HLADSPAVNGA

SEQ ID NO: 46545 - protein, 11 aa, Homo sapiens
MTVAGVVLLGS

SEQ ID NO: 46546 - protein, 11 aa, Homo sapiens
ETPSAINGNPS

SEQ ID NO: 46547 - protein, 11 aa, Homo sapiens
FLTGMTVAGVV

SEQ ID NO: 46548 - protein, 11 aa, Homo sapiens
HSSSLDAREVI

SEQ ID NO: 46549 - protein, 11 aa, Homo sapiens
SAINGNPSWHL

SEQ ID NO: 46550 - protein, 11 aa, Homo sapiens
DAREVIPMAAV

SEQ ID NO: 46551 - protein, 11 aa, Homo sapiens
ESVDKEMQVLV

SEQ ID NO: 46552 - protein, 11 aa, Homo sapiens
HLADSPAVNGA

SEQ ID NO: 46553 - protein, 11 aa, Homo sapiens
PSWHLADSPAV

SEQ ID NO: 46554 - protein, 11 aa, Homo sapiens
WFLTGMTVAGV

SEQ ID NO: 46555 - protein, 11 aa, Homo sapiens
EVIPMAAVKQA

SEQ ID NO: 46556 - protein, 11 aa, Homo sapiens
ELVVDFLSYKL

SEQ ID NO: 46557 - protein, 11 aa, Homo sapiens
TVAGVVLLGSL

SEQ ID NO: 46558 - protein, 11 aa, Homo sapiens
DTFVELYGNNA

SEQ ID NO: 46559 - protein, 11 aa, Homo sapiens
IVAFFSFGGAL

SEQ ID NO: 46560 - protein, 11 aa, Homo sapiens
NPSWHLADSPA

SEQ ID NO: 46561 - protein, 11 aa, Homo sapiens
SPAVNGATGHS

SEQ ID NO: 46562 - protein, 11 aa, Homo sapiens
SQLHITPGTAY

SEQ ID NO: 46563 - protein, 11 aa, Homo sapiens
KQALREAGDEF

SEQ ID NO: 46564 - protein, 11 aa, Homo sapiens
SQSNRELVVDF

SEQ ID NO: 46565 - protein, 11 aa, Homo sapiens
YQSFEQVVNEL

SEQ ID NO: 46566 - protein, 11 aa, Homo sapiens
MQVLVSRIAAW

SEQ ID NO: 46567 - protein, 11 aa, Homo sapiens
VSRIAAWMATY

SEQ ID NO: 46568 - protein, 11 aa, Homo sapiens
FLSYKLSQKGY

SEQ ID NO: 46569 - protein, 11 aa, Homo sapiens
WIQENGGWDTF

SEQ ID NO: 46570 - protein, 11 aa, Homo sapiens
QSFEQVVNELF

SEQ ID NO: 46571 - protein, 11 aa, Homo sapiens
HITPGTAYQSF

SEQ ID NO: 46572 - protein, 11 aa, Homo sapiens
GVNWGRIVAFF

SEQ ID NO: 46573 - protein, 11 aa, Homo sapiens
DEFELRYRRAF

SEQ ID NO: 46574 - protein, 11 aa, Homo sapiens
REAGDEFELRY

SEQ ID NO: 46575 - protein, 11 aa, Homo sapiens
SQLHITPGTAY

SEQ ID NO: 46576 - protein, 11 aa, Homo sapiens
VESVDKEMQVL

SEQ ID NO: 46577 - protein, 11 aa, Homo sapiens
LEPWIQENGGW

SEQ ID NO: 46578 - protein, 11 aa, Homo sapiens
FNRWFLTGMTV

SEQ ID NO: 46579 - protein, 11 aa, Homo sapiens
RRAFSDLTSQL

SEQ ID NO: 46580 - protein, 11 aa, Homo sapiens
SRIAAWMATYL

SEQ ID NO: 46581 - protein, 11 aa, Homo sapiens
NPSWHLADSPA

SEQ ID NO: 46582 - protein, 11 aa, Homo sapiens
TPSAINGNPSW

SEQ ID NO: 46583 - protein, 11 aa, Homo sapiens
WIQENGGWDTF

SEQ ID NO: 46584 - protein, 11 aa, Homo sapiens
DGVNWGRIVAF

SEQ ID NO: 46585 - protein, 11 aa, Homo sapiens
YQSFEQVVNEL

SEQ ID NO: 46586 - protein, 11 aa, Homo sapiens
VESVDKEMQVL

SEQ ID NO: 46587 - protein, 11 aa, Homo sapiens
TESEMETPSAI

SEQ ID NO: 46588 - protein, 11 aa, Homo sapiens
EENRTEAPEGT

SEQ ID NO: 46589 - protein, 11 aa, Homo sapiens
TPSAINGNPSW

SEQ ID NO: 46590 - protein, 11 aa, Homo sapiens
NPSWHLADSPA

SEQ ID NO: 46591 - protein, 11 aa, Homo sapiens
ATYLNDHLEPW

SEQ ID NO: 46592 - protein, 11 aa, Homo sapiens
ATYLNDHLEPW

SEQ ID NO: 46593 - protein, 11 aa, Homo sapiens
QSFEQVVNELF

SEQ ID NO: 46594 - protein, 15 aa, Homo sapiens
DFSWLSLKTLLSLAL

SEQ ID NO: 46595 - protein, 9 aa, Homo sapiens
WLSLKTLLS

SEQ ID NO: 46596 - protein, 15 aa, Homo sapiens
FSWLSLKTLLSLALV

SEQ ID NO: 46597 - protein, 9 aa, Homo sapiens
LKTLLSLAL

SEQ ID NO: 46598 - protein, 15 aa, Homo sapiens
WLSLKTLLSLALVGA

SEQ ID NO: 46599 - protein, 9 aa, Homo sapiens
LKTLLSLAL

SEQ ID NO: 46600 - protein, 15 aa, Homo sapiens
LSLKTLLSLALVGAC

SEQ ID NO: 46601 - protein, 9 aa, Homo sapiens
LKTLLSLAL

SEQ ID NO: 46602 - protein, 15 aa, Homo sapiens
SWLSLKTLLSLALVG

SEQ ID NO: 46603 - protein, 9 aa, Homo sapiens
LKTLLSLAL

SEQ ID NO: 46604 - protein, 15 aa, Homo sapiens
SLKTLLSLALVGACI

SEQ ID NO: 46605 - protein, 9 aa, Homo sapiens
LKTLLSLAL

SEQ ID NO: 46606 - protein, 15 aa, Homo sapiens
LKTLLSLALVGACIT

SEQ ID NO: 46607 - protein, 9 aa, Homo sapiens
LKTLLSLAL

SEQ ID NO: 46608 - protein, 15 aa, Homo sapiens
RTSPLQTPAAPGAAA

SEQ ID NO: 46609 - protein, 9 aa, Homo sapiens
LQTPAAPGA

SEQ ID NO: 46610 - protein, 15 aa, Homo sapiens
TSPLQTPAAPGAAAG

SEQ ID NO: 46611 - protein, 9 aa, Homo sapiens
LQTPAAPGA

SEQ ID NO: 46612 - protein, 15 aa, Homo sapiens
SPLQTPAAPGAAAGP

SEQ ID NO: 46613 - protein, 9 aa, Homo sapiens
LQTPAAPGA

SEQ ID NO: 46614 - protein, 15 aa, Homo sapiens
VARTSPLQTPAAPGA

SEQ ID NO: 46615 - protein, 9 aa, Homo sapiens
TSPLQTPAA

SEQ ID NO: 46616 - protein, 15 aa, Homo sapiens
ARTSPLQTPAAPGAA

SEQ ID NO: 46617 - protein, 9 aa, Homo sapiens
LQTPAAPGA

SEQ ID NO: 46618 - protein, 15 aa, Homo sapiens
LFDFSWLSLKTLLSL

SEQ ID NO: 46619 - protein, 9 aa, Homo sapiens
WLSLKTLLS

SEQ ID NO: 46620 - protein, 15 aa, Homo sapiens
PLFDFSWLSLKTLLS

SEQ ID NO: 46621 - protein, 9 aa, Homo sapiens
FSWLSLKTL

SEQ ID NO: 46622 - protein, 15 aa, Homo sapiens
FDFSWLSLKTLLSLA

SEQ ID NO: 46623 - protein, 9 aa, Homo sapiens
WLSLKTLLS

SEQ ID NO: 46624 - protein, 15 aa, Homo sapiens
TLLSLALVGACITLG

SEQ ID NO: 46625 - protein, 9 aa, Homo sapiens
LLSLALVGA

SEQ ID NO: 46626 - protein, 15 aa, Homo sapiens
LLSLALVGACITLGA

SEQ ID NO: 46627 - protein, 9 aa, Homo sapiens
LVGACITLG

SEQ ID NO: 46628 - protein, 15 aa, Homo sapiens
LALVGACITLGAYLG

SEQ ID NO: 46629 - protein, 9 aa, Homo sapiens
LVGACITLG

SEQ ID NO: 46630 - protein, 15 aa, Homo sapiens
LSLALVGACITLGAY

SEQ ID NO: 46631 - protein, 9 aa, Homo sapiens
LVGACITLG

SEQ ID NO: 46632 - protein, 15 aa, Homo sapiens
SLALVGACITLGAYL

SEQ ID NO: 46633 - protein, 9 aa, Homo sapiens
LVGACITLG

SEQ ID NO: 46634 - protein, 15 aa, Homo sapiens
RRYRRDFAEMSSQLH

SEQ ID NO: 46635 - protein, 9 aa, Homo sapiens
YRRDFAEMS

SEQ ID NO: 46636 - protein, 15 aa, Homo sapiens
LQTPAAPGAAAGPAL

SEQ ID NO: 46637 - protein, 9 aa, Homo sapiens
LQTPAAPGA

SEQ ID NO: 46638 - protein, 15 aa, Homo sapiens
PLQTPAAPGAAAGPA

SEQ ID NO: 46639 - protein, 9 aa, Homo sapiens
LQTPAAPGA

SEQ ID NO: 46640 - protein, 15 aa, Homo sapiens
YRRDFAEMSSQLHLT

SEQ ID NO: 46641 - protein, 9 aa, Homo sapiens
FAEMSSQLH

SEQ ID NO: 46642 - protein, 15 aa, Homo sapiens
RYRRDFAEMSSQLHL

SEQ ID NO: 46643 - protein, 9 aa, Homo sapiens
FAEMSSQLH

SEQ ID NO: 46644 - protein, 15 aa, Homo sapiens
KTLLSLALVGACITL

SEQ ID NO: 46645 - protein, 9 aa, Homo sapiens
LLSLALVGA

SEQ ID NO: 46646 - protein, 15 aa, Homo sapiens
RRDFAEMSSQLHLTP

SEQ ID NO: 46647 - protein, 9 aa, Homo sapiens
FAEMSSQLH

SEQ ID NO: 46648 - protein, 15 aa, Homo sapiens
RDFAEMSSQLHLTPF

SEQ ID NO: 46649 - protein, 9 aa, Homo sapiens
FAEMSSQLH

SEQ ID NO: 46650 - protein, 15 aa, Homo sapiens
DAGDVGAAPPGAAPA

SEQ ID NO: 46651 - protein, 9 aa, Homo sapiens
VGAAPPGAA

SEQ ID NO: 46652 - protein, 15 aa, Homo sapiens
AGDVGAAPPGAAPAP

SEQ ID NO: 46653 - protein, 9 aa, Homo sapiens
VGAAPPGAA

SEQ ID NO: 46654 - protein, 15 aa, Homo sapiens
EWDAGDVGAAPPGAA

SEQ ID NO: 46655 - protein, 9 aa, Homo sapiens
DVGAAPPGA

SEQ ID NO: 46656 - protein, 15 aa, Homo sapiens
WDAGDVGAAPPGAAP

SEQ ID NO: 46657 - protein, 9 aa, Homo sapiens
VGAAPPGAA

SEQ ID NO: 46658 - protein, 15 aa, Homo sapiens
GDVGAAPPGAAPAPG

SEQ ID NO: 46659 - protein, 9 aa, Homo sapiens
VGAAPPGAA

SEQ ID NO: 46660 - protein, 15 aa, Homo sapiens
RPLFDFSWLSLKTLL

SEQ ID NO: 46661 - protein, 9 aa, Homo sapiens
FSWLSLKTL

SEQ ID NO: 46662 - protein, 15 aa, Homo sapiens
ALVGACITLGAYLGH

SEQ ID NO: 46663 - protein, 9 aa, Homo sapiens
LVGACITLG

SEQ ID NO: 46664 - protein, 15 aa, Homo sapiens
MRPLFDFSWLSLKTL

SEQ ID NO: 46665 - protein, 9 aa, Homo sapiens
DFSWLSLKT

SEQ ID NO: 46666 - protein, 15 aa, Homo sapiens
LVGACITLGAYLGHK

SEQ ID NO: 46667 - protein, 9 aa, Homo sapiens
LVGACITLG

SEQ ID NO: 46668 - protein, 15 aa, Homo sapiens
EIVMKYIHYKLSQRG

SEQ ID NO: 46669 - protein, 9 aa, Homo sapiens
MKYIHYKLS

SEQ ID NO: 46670 - protein, 15 aa, Homo sapiens
IVMKYIHYKLSQRGY

SEQ ID NO: 46671 - protein, 9 aa, Homo sapiens
IHYKLSQRG

SEQ ID NO: 46672 - protein, 15 aa, Homo sapiens
VMKYIHYKLSQRGYE

SEQ ID NO: 46673 - protein, 9 aa, Homo sapiens
IHYKLSQRG

SEQ ID NO: 46674 - protein, 15 aa, Homo sapiens
MKYIHYKLSQRGYEW

SEQ ID NO: 46675 - protein, 9 aa, Homo sapiens
IHYKLSQRG

SEQ ID NO: 46676 - protein, 15 aa, Homo sapiens
KYIHYKLSQRGYEWD

SEQ ID NO: 46677 - protein, 9 aa, Homo sapiens
IHYKLSQRG

SEQ ID NO: 46678 - protein, 15 aa, Homo sapiens
REMSPLVDNIALWMT

SEQ ID NO: 46679 - protein, 9 aa, Homo sapiens
LVDNIALWM

SEQ ID NO: 46680 - protein, 15 aa, Homo sapiens
EMSPLVDNIALWMTE

SEQ ID NO: 46681 - protein, 9 aa, Homo sapiens
VDNIALWMT

SEQ ID NO: 46682 - protein, 15 aa, Homo sapiens
SPLVDNIALWMTEYL

SEQ ID NO: 46683 - protein, 9 aa, Homo sapiens
VDNIALWMT

SEQ ID NO: 46684 - protein, 15 aa, Homo sapiens
MSPLVDNIALWMTEY

SEQ ID NO: 46685 - protein, 9 aa, Homo sapiens
VDNIALWMT

SEQ ID NO: 46686 - protein, 15 aa, Homo sapiens
RDPVARTSPLQTPAA

SEQ ID NO: 46687 - protein, 9 aa, Homo sapiens
VARTSPLQT

SEQ ID NO: 46688 - protein, 15 aa, Homo sapiens
DPVARTSPLQTPAAP

SEQ ID NO: 46689 - protein, 9 aa, Homo sapiens
VARTSPLQT

SEQ ID NO: 46690 - protein, 15 aa, Homo sapiens
PLVDNIALWMTEYLN

SEQ ID NO: 46691 - protein, 9 aa, Homo sapiens
VDNIALWMT

SEQ ID NO: 46692 - protein, 15 aa, Homo sapiens
DAFVELYGPSMRPLF

SEQ ID NO: 46693 - protein, 9 aa, Homo sapiens
FVELYGPSM

SEQ ID NO: 46694 - protein, 15 aa, Homo sapiens
DVGAAPPGAAPAPGI

SEQ ID NO: 46695 - protein, 9 aa, Homo sapiens
VGAAPPGAA

SEQ ID NO: 46696 - protein, 15 aa, Homo sapiens
SRDPVARTSPLQTPA

SEQ ID NO: 46697 - protein, 9 aa, Homo sapiens
VARTSPLQT

SEQ ID NO: 46698 - protein, 15 aa, Homo sapiens
WDAFVELYGPSMRPL

SEQ ID NO: 46699 - protein, 9 aa, Homo sapiens
FVELYGPSM

SEQ ID NO: 46700 - protein, 15 aa, Homo sapiens
ASRDPVARTSPLQTP

SEQ ID NO: 46701 - protein, 9 aa, Homo sapiens
VARTSPLQT

SEQ ID NO: 46702 - protein, 15 aa, Homo sapiens
LSPVPPVVHLTLRQA

SEQ ID NO: 46703 - protein, 9 aa, Homo sapiens
LSPVPPVVH

SEQ ID NO: 46704 - protein, 15 aa, Homo sapiens
DFAEMSSQLHLTPFT

SEQ ID NO: 46705 - protein, 9 aa, Homo sapiens
FAEMSSQLH

SEQ ID NO: 46706 - protein, 15 aa, Homo sapiens
VPPVVHLTLRQAGDD

SEQ ID NO: 46707 - protein, 9 aa, Homo sapiens
VVHLTLRQA

SEQ ID NO: 46708 - protein, 15 aa, Homo sapiens
SPVPPVVHLTLRQAG

SEQ ID NO: 46709 - protein, 9 aa, Homo sapiens
VVHLTLRQA

SEQ ID NO: 46710 - protein, 15 aa, Homo sapiens
PVPPVVHLTLRQAGD

SEQ ID NO: 46711 - protein, 9 aa, Homo sapiens
VVHLTLRQA

SEQ ID NO: 46712 - protein, 15 aa, Homo sapiens
FAEMSSQLHLTPFTA

SEQ ID NO: 46713 - protein, 9 aa, Homo sapiens
FAEMSSQLH

SEQ ID NO: 46714 - protein, 15 aa, Homo sapiens
VGAAPPGAAPAPGIF

SEQ ID NO: 46715 - protein, 9 aa, Homo sapiens
VGAAPPGAA

SEQ ID NO: 46716 - protein, 15 aa, Homo sapiens
PPVVHLTLRQAGDDF

SEQ ID NO: 46717 - protein, 9 aa, Homo sapiens
VVHLTLRQA

SEQ ID NO: 46718 - protein, 15 aa, Homo sapiens
AAAGPALSPVPPVVH

SEQ ID NO: 46719 - protein, 9 aa, Homo sapiens
AAAGPALSP

SEQ ID NO: 46720 - protein, 15 aa, Homo sapiens
ESVNREMSPLVDNIA

SEQ ID NO: 46721 - protein, 9 aa, Homo sapiens
VNREMSPLV

SEQ ID NO: 46722 - protein, 15 aa, Homo sapiens
AASRDPVARTSPLQT

SEQ ID NO: 46723 - protein, 9 aa, Homo sapiens
SRDPVARTS

SEQ ID NO: 46724 - protein, 15 aa, Homo sapiens
SQLHLTPFTARGRFA

SEQ ID NO: 46725 - protein, 9 aa, Homo sapiens
LTPFTARGR

SEQ ID NO: 46726 - protein, 15 aa, Homo sapiens
MSSQLHLTPFTARGR

SEQ ID NO: 46727 - protein, 9 aa, Homo sapiens
LHLTPFTAR

SEQ ID NO: 46728 - protein, 15 aa, Homo sapiens
SSQLHLTPFTARGRF

SEQ ID NO: 46729 - protein, 9 aa, Homo sapiens
LTPFTARGR

SEQ ID NO: 46730 - protein, 15 aa, Homo sapiens
AAGPALSPVPPVVHL

SEQ ID NO: 46731 - protein, 9 aa, Homo sapiens
LSPVPPVVH

SEQ ID NO: 46732 - protein, 15 aa, Homo sapiens
QLHLTPFTARGRFAT

SEQ ID NO: 46733 - protein, 9 aa, Homo sapiens
LTPFTARGR

SEQ ID NO: 46734 - protein, 15 aa, Homo sapiens
AFVELYGPSMRPLFD

SEQ ID NO: 46735 - protein, 9 aa, Homo sapiens
LYGPSMRPL

SEQ ID NO: 46736 - protein, 15 aa, Homo sapiens
VMCVESVNREMSPLV

SEQ ID NO: 46737 - protein, 9 aa, Homo sapiens
VMCVESVNR

SEQ ID NO: 46738 - protein, 15 aa, Homo sapiens
CVESVNREMSPLVDN

SEQ ID NO: 46739 - protein, 9 aa, Homo sapiens
VNREMSPLV

SEQ ID NO: 46740 - protein, 15 aa, Homo sapiens
VESVNREMSPLVDNI

SEQ ID NO: 46741 - protein, 9 aa, Homo sapiens
VNREMSPLV

SEQ ID NO: 46742 - protein, 15 aa, Homo sapiens
FVELYGPSMRPLFDF

SEQ ID NO: 46743 - protein, 9 aa, Homo sapiens
LYGPSMRPL

SEQ ID NO: 46744 - protein, 15 aa, Homo sapiens
MCVESVNREMSPLVD

SEQ ID NO: 46745 - protein, 9 aa, Homo sapiens
VNREMSPLV

SEQ ID NO: 46746 - protein, 15 aa, Homo sapiens
LHLTPFTARGRFATV

SEQ ID NO: 46747 - protein, 9 aa, Homo sapiens
LTPFTARGR

SEQ ID NO: 46748 - protein, 15 aa, Homo sapiens
AGPALSPVPPVVHLT

SEQ ID NO: 46749 - protein, 9 aa, Homo sapiens
LSPVPPVVH

SEQ ID NO: 46750 - protein, 15 aa, Homo sapiens
GPALSPVPPVVHLTL

SEQ ID NO: 46751 - protein, 9 aa, Homo sapiens
LSPVPPVVH

SEQ ID NO: 46752 - protein, 15 aa, Homo sapiens
VAFFEFGGVMCVESV

SEQ ID NO: 46753 - protein, 9 aa, Homo sapiens
FEFGGVMCV

SEQ ID NO: 46754 - protein, 15 aa, Homo sapiens
AFFEFGGVMCVESVN

SEQ ID NO: 46755 - protein, 9 aa, Homo sapiens
FEFGGVMCV

SEQ ID NO: 46756 - protein, 15 aa, Homo sapiens
PGIFSSQPGHTPHPA

SEQ ID NO: 46757 - protein, 9 aa, Homo sapiens
FSSQPGHTP

SEQ ID NO: 46758 - protein, 15 aa, Homo sapiens
VDNIALWMTEYLNRH

SEQ ID NO: 46759 - protein, 9 aa, Homo sapiens
VDNIALWMT

SEQ ID NO: 46760 - protein, 15 aa, Homo sapiens
APAPGIFSSQPGHTP

SEQ ID NO: 46761 - protein, 9 aa, Homo sapiens
IFSSQPGHT

SEQ ID NO: 46762 - protein, 15 aa, Homo sapiens
PALSPVPPVVHLTLR

SEQ ID NO: 46763 - protein, 9 aa, Homo sapiens
LSPVPPVVH

SEQ ID NO: 46764 - protein, 15 aa, Homo sapiens
IVAFFEFGGVMCVES

SEQ ID NO: 46765 - protein, 9 aa, Homo sapiens
FEFGGVMCV

SEQ ID NO: 46766 - protein, 15 aa, Homo sapiens
PVARTSPLQTPAAPG

SEQ ID NO: 46767 - protein, 9 aa, Homo sapiens
VARTSPLQT

SEQ ID NO: 46768 - protein, 15 aa, Homo sapiens
APGIFSSQPGHTPHP

SEQ ID NO: 46769 - protein, 9 aa, Homo sapiens
FSSQPGHTP

SEQ ID NO: 46770 - protein, 15 aa, Homo sapiens
HLTPFTARGRFATVV

SEQ ID NO: 46771 - protein, 9 aa, Homo sapiens
LTPFTARGR

SEQ ID NO: 46772 - protein, 15 aa, Homo sapiens
LTPFTARGRFATVVE

SEQ ID NO: 46773 - protein, 9 aa, Homo sapiens
ARGRFATVV

SEQ ID NO: 46774 - protein, 15 aa, Homo sapiens
ELFRDGVNWGRIVAF

SEQ ID NO: 46775 - protein, 9 aa, Homo sapiens
FRDGVNWGR

SEQ ID NO: 46776 - protein, 15 aa, Homo sapiens
PAPGIFSSQPGHTPH

SEQ ID NO: 46777 - protein, 9 aa, Homo sapiens
FSSQPGHTP

SEQ ID NO: 46778 - protein, 15 aa, Homo sapiens
FRDGVNWGRIVAFFE

SEQ ID NO: 46779 - protein, 9 aa, Homo sapiens
VNWGRIVAF

SEQ ID NO: 46780 - protein, 15 aa, Homo sapiens
LVDNIALWMTEYLNR

SEQ ID NO: 46781 - protein, 9 aa, Homo sapiens
VDNIALWMT

SEQ ID NO: 46782 - protein, 15 aa, Homo sapiens
YIHYKLSQRGYEWDA

SEQ ID NO: 46783 - protein, 9 aa, Homo sapiens
IHYKLSQRG

SEQ ID NO: 46784 - protein, 15 aa, Homo sapiens
LFRDGVNWGRIVAFF

SEQ ID NO: 46785 - protein, 9 aa, Homo sapiens
VNWGRIVAF

SEQ ID NO: 46786 - protein, 15 aa, Homo sapiens
IHYKLSQRGYEWDAG

SEQ ID NO: 46787 - protein, 9 aa, Homo sapiens
IHYKLSQRG

SEQ ID NO: 46788 - protein, 15 aa, Homo sapiens
GIFSSQPGHTPHPAA

SEQ ID NO: 46789 - protein, 9 aa, Homo sapiens
FSSQPGHTP

SEQ ID NO: 46790 - protein, 15 aa, Homo sapiens
AAPGAAAGPALSPVP

SEQ ID NO: 46791 - protein, 9 aa, Homo sapiens
AAAGPALSP

SEQ ID NO: 46792 - protein, 15 aa, Homo sapiens
RDGVNWGRIVAFFEF

SEQ ID NO: 46793 - protein, 9 aa, Homo sapiens
VNWGRIVAF

SEQ ID NO: 46794 - protein, 15 aa, Homo sapiens
TPAAPGAAAGPALSP

SEQ ID NO: 46795 - protein, 9 aa, Homo sapiens
GAAAGPALS

SEQ ID NO: 46796 - protein, 15 aa, Homo sapiens
GWDAFVELYGPSMRP

SEQ ID NO: 46797 - protein, 9 aa, Homo sapiens
FVELYGPSM

SEQ ID NO: 46798 - protein, 15 aa, Homo sapiens
PAAPGAAAGPALSPV

SEQ ID NO: 46799 - protein, 9 aa, Homo sapiens
AAAGPALSP

SEQ ID NO: 46800 - protein, 15 aa, Homo sapiens
APGAAAGPALSPVPP

SEQ ID NO: 46801 - protein, 9 aa, Homo sapiens
AAAGPALSP

SEQ ID NO: 46802 - protein, 15 aa, Homo sapiens
DGVNWGRIVAFFEFG

SEQ ID NO: 46803 - protein, 9 aa, Homo sapiens
VNWGRIVAF

SEQ ID NO: 46804 - protein, 15 aa, Homo sapiens
SRRYRRDFAEMSSQL

SEQ ID NO: 46805 - protein, 9 aa, Homo sapiens
YRRDFAEMS

SEQ ID NO: 46806 - protein, 15 aa, Homo sapiens
PVVHLTLRQAGDDFS

SEQ ID NO: 46807 - protein, 9 aa, Homo sapiens
VVHLTLRQA

SEQ ID NO: 46808 - protein, 15 aa, Homo sapiens
VELYGPSMRPLFDFS

SEQ ID NO: 46809 - protein, 9 aa, Homo sapiens
LYGPSMRPL

SEQ ID NO: 46810 - protein, 15 aa, Homo sapiens
VVHLTLRQAGDDFSR

SEQ ID NO: 46811 - protein, 9 aa, Homo sapiens
VVHLTLRQA

SEQ ID NO: 46812 - protein, 15 aa, Homo sapiens
FSRRYRRDFAEMSSQ

SEQ ID NO: 46813 - protein, 9 aa, Homo sapiens
YRRDFAEMS

SEQ ID NO: 46814 - protein, 15 aa, Homo sapiens
DFSRRYRRDFAEMSS

SEQ ID NO: 46815 - protein, 9 aa, Homo sapiens
YRRDFAEMS

SEQ ID NO: 46816 - protein, 15 aa, Homo sapiens
DDFSRRYRRDFAEMS

SEQ ID NO: 46817 - protein, 9 aa, Homo sapiens
RYRRDFAEM

SEQ ID NO: 46818 - protein, 15 aa, Homo sapiens
GRIVAFFEFGGVMCV

SEQ ID NO: 46819 - protein, 9 aa, Homo sapiens
FFEFGGVMC

SEQ ID NO: 46820 - protein, 15 aa, Homo sapiens
RIVAFFEFGGVMCVE

SEQ ID NO: 46821 - protein, 9 aa, Homo sapiens
FEFGGVMCV

SEQ ID NO: 46822 - protein, 15 aa, Homo sapiens
PGAAAGPALSPVPPV

SEQ ID NO: 46823 - protein, 9 aa, Homo sapiens
AAAGPALSP

SEQ ID NO: 46824 - protein, 15 aa, Homo sapiens
SVNREMSPLVDNIAL

SEQ ID NO: 46825 - protein, 9 aa, Homo sapiens
VNREMSPLV

SEQ ID NO: 46826 - protein, 15 aa, Homo sapiens
FFEFGGVMCVESVNR

SEQ ID NO: 46827 - protein, 9 aa, Homo sapiens
FEFGGVMCV

SEQ ID NO: 46828 - protein, 15 aa, Homo sapiens
VNREMSPLVDNIALW

SEQ ID NO: 46829 - protein, 9 aa, Homo sapiens
VNREMSPLV

SEQ ID NO: 46830 - protein, 15 aa, Homo sapiens
FEFGGVMCVESVNRE

SEQ ID NO: 46831 - protein, 9 aa, Homo sapiens
FEFGGVMCV

SEQ ID NO: 46832 - protein, 15 aa, Homo sapiens
EMSSQLHLTPFTARG

SEQ ID NO: 46833 - protein, 9 aa, Homo sapiens
LHLTPFTAR

SEQ ID NO: 46834 - protein, 15 aa, Homo sapiens
TPFTARGRFATVVEE

SEQ ID NO: 46835 - protein, 9 aa, Homo sapiens
ARGRFATVV

SEQ ID NO: 46836 - protein, 15 aa, Homo sapiens
QTPAAPGAAAGPALS

SEQ ID NO: 46837 - protein, 9 aa, Homo sapiens
APGAAAGPA

SEQ ID NO: 46838 - protein, 15 aa, Homo sapiens
FSSQPGHTPHPAASR

SEQ ID NO: 46839 - protein, 9 aa, Homo sapiens
FSSQPGHTP

SEQ ID NO: 46840 - protein, 15 aa, Homo sapiens
IFSSQPGHTPHPAAS

SEQ ID NO: 46841 - protein, 9 aa, Homo sapiens
FSSQPGHTP

SEQ ID NO: 46842 - protein, 15 aa, Homo sapiens
GAAPPGAAPAPGIFS

SEQ ID NO: 46843 - protein, 9 aa, Homo sapiens
PGAAPAPGI

SEQ ID NO: 46844 - protein, 15 aa, Homo sapiens
PFTARGRFATVVEEL

SEQ ID NO: 46845 - protein, 9 aa, Homo sapiens
ARGRFATVV

SEQ ID NO: 46846 - protein, 15 aa, Homo sapiens
FTARGRFATVVEELF

SEQ ID NO: 46847 - protein, 9 aa, Homo sapiens
ARGRFATVV

SEQ ID NO: 46848 - protein, 15 aa, Homo sapiens
ALWMTEYLNRHLHTW

SEQ ID NO: 46849 - protein, 9 aa, Homo sapiens
WMTEYLNRH

SEQ ID NO: 46850 - protein, 15 aa, Homo sapiens
ALSPVPPVVHLTLRQ

SEQ ID NO: 46851 - protein, 9 aa, Homo sapiens
LSPVPPVVH

SEQ ID NO: 46852 - protein, 15 aa, Homo sapiens
AEMSSQLHLTPFTAR

SEQ ID NO: 46853 - protein, 9 aa, Homo sapiens
SQLHLTPFT

SEQ ID NO: 46854 - protein, 15 aa, Homo sapiens
DNIALWMTEYLNRHL

SEQ ID NO: 46855 - protein, 9 aa, Homo sapiens
WMTEYLNRH

SEQ ID NO: 46856 - protein, 15 aa, Homo sapiens
GGWDAFVELYGPSMR

SEQ ID NO: 46857 - protein, 9 aa, Homo sapiens
FVELYGPSM

SEQ ID NO: 46858 - protein, 15 aa, Homo sapiens
ELYGPSMRPLFDFSW

SEQ ID NO: 46859 - protein, 9 aa, Homo sapiens
LYGPSMRPL

SEQ ID NO: 46860 - protein, 15 aa, Homo sapiens
AAPPGAAPAPGIFSS

SEQ ID NO: 46861 - protein, 9 aa, Homo sapiens
AAPAPGIFS

SEQ ID NO: 46862 - protein, 15 aa, Homo sapiens
GAAAGPALSPVPPVV

SEQ ID NO: 46863 - protein, 9 aa, Homo sapiens
AAAGPALSP

SEQ ID NO: 46864 - protein, 15 aa, Homo sapiens
NIALWMTEYLNRHLH

SEQ ID NO: 46865 - protein, 9 aa, Homo sapiens
WMTEYLNRH

SEQ ID NO: 46866 - protein, 15 aa, Homo sapiens
YEWDAGDVGAAPPGA

SEQ ID NO: 46867 - protein, 9 aa, Homo sapiens
WDAGDVGAA

SEQ ID NO: 46868 - protein, 15 aa, Homo sapiens
AAPAPGIFSSQPGHT

SEQ ID NO: 46869 - protein, 9 aa, Homo sapiens
AAPAPGIFS

SEQ ID NO: 46870 - protein, 15 aa, Homo sapiens
NREMSPLVDNIALWM

SEQ ID NO: 46871 - protein, 9 aa, Homo sapiens
MSPLVDNIA

SEQ ID NO: 46872 - protein, 15 aa, Homo sapiens
PLFDFSWLSLKTLLS

SEQ ID NO: 46873 - protein, 9 aa, Homo sapiens
DFSWLSLKT

SEQ ID NO: 46874 - protein, 15 aa, Homo sapiens
DFSWLSLKTLLSLAL

SEQ ID NO: 46875 - protein, 9 aa, Homo sapiens
WLSLKTLLS

SEQ ID NO: 46876 - protein, 15 aa, Homo sapiens
FSWLSLKTLLSLALV

SEQ ID NO: 46877 - protein, 9 aa, Homo sapiens
WLSLKTLLS

SEQ ID NO: 46878 - protein, 15 aa, Homo sapiens
LFDFSWLSLKTLLSL

SEQ ID NO: 46879 - protein, 9 aa, Homo sapiens
WLSLKTLLS

SEQ ID NO: 46880 - protein, 15 aa, Homo sapiens
FDFSWLSLKTLLSLA

SEQ ID NO: 46881 - protein, 9 aa, Homo sapiens
WLSLKTLLS

SEQ ID NO: 46882 - protein, 15 aa, Homo sapiens
VMCVESVNREMSPLV

SEQ ID NO: 46883 - protein, 9 aa, Homo sapiens
MCVESVNRE

SEQ ID NO: 46884 - protein, 15 aa, Homo sapiens
CVESVNREMSPLVDN

SEQ ID NO: 46885 - protein, 9 aa, Homo sapiens
VNREMSPLV

SEQ ID NO: 46886 - protein, 15 aa, Homo sapiens
MCVESVNREMSPLVD

SEQ ID NO: 46887 - protein, 9 aa, Homo sapiens
VNREMSPLV

SEQ ID NO: 46888 - protein, 15 aa, Homo sapiens
ESVNREMSPLVDNIA

SEQ ID NO: 46889 - protein, 9 aa, Homo sapiens
VNREMSPLV

SEQ ID NO: 46890 - protein, 15 aa, Homo sapiens
VESVNREMSPLVDNI

SEQ ID NO: 46891 - protein, 9 aa, Homo sapiens
VNREMSPLV

SEQ ID NO: 46892 - protein, 15 aa, Homo sapiens
WLSLKTLLSLALVGA

SEQ ID NO: 46893 - protein, 9 aa, Homo sapiens
WLSLKTLLS

SEQ ID NO: 46894 - protein, 15 aa, Homo sapiens
SWLSLKTLLSLALVG

SEQ ID NO: 46895 - protein, 9 aa, Homo sapiens
WLSLKTLLS

SEQ ID NO: 46896 - protein, 15 aa, Homo sapiens
RRYRRDFAEMSSQLH

SEQ ID NO: 46897 - protein, 9 aa, Homo sapiens
YRRDFAEMS

SEQ ID NO: 46898 - protein, 15 aa, Homo sapiens
VDNIALWMTEYLNRH

SEQ ID NO: 46899 - protein, 9 aa, Homo sapiens
NIALWMTEY

SEQ ID NO: 46900 - protein, 15 aa, Homo sapiens
ALWMTEYLNRHLHTW

SEQ ID NO: 46901 - protein, 9 aa, Homo sapiens
WMTEYLNRH

SEQ ID NO: 46902 - protein, 15 aa, Homo sapiens
VDNIALWMTEYLNRH

SEQ ID NO: 46903 - protein, 9 aa, Homo sapiens
IALWMTEYL

SEQ ID NO: 46904 - protein, 15 aa, Homo sapiens
DNIALWMTEYLNRHL

SEQ ID NO: 46905 - protein, 9 aa, Homo sapiens
WMTEYLNRH

SEQ ID NO: 46906 - protein, 15 aa, Homo sapiens
NIALWMTEYLNRHLH

SEQ ID NO: 46907 - protein, 9 aa, Homo sapiens
WMTEYLNRH

SEQ ID NO: 46908 - protein, 15 aa, Homo sapiens
IALWMTEYLNRHLHT

SEQ ID NO: 46909 - protein, 9 aa, Homo sapiens
WMTEYLNRH

SEQ ID NO: 46910 - protein, 15 aa, Homo sapiens
LWMTEYLNRHLHTWI

SEQ ID NO: 46911 - protein, 9 aa, Homo sapiens
WMTEYLNRH

SEQ ID NO: 46912 - protein, 15 aa, Homo sapiens
MSSQLHLTPFTARGR

SEQ ID NO: 46913 - protein, 9 aa, Homo sapiens
HLTPFTARG

SEQ ID NO: 46914 - protein, 15 aa, Homo sapiens
EMSSQLHLTPFTARG

SEQ ID NO: 46915 - protein, 9 aa, Homo sapiens
LHLTPFTAR

SEQ ID NO: 46916 - protein, 15 aa, Homo sapiens
WMTEYLNRHLHTWIQ

SEQ ID NO: 46917 - protein, 9 aa, Homo sapiens
WMTEYLNRH

SEQ ID NO: 46918 - protein, 15 aa, Homo sapiens
SSQLHLTPFTARGRF

SEQ ID NO: 46919 - protein, 9 aa, Homo sapiens
HLTPFTARG

SEQ ID NO: 46920 - protein, 15 aa, Homo sapiens
SQLHLTPFTARGRFA

SEQ ID NO: 46921 - protein, 9 aa, Homo sapiens
HLTPFTARG

SEQ ID NO: 46922 - protein, 15 aa, Homo sapiens
QLHLTPFTARGRFAT

SEQ ID NO: 46923 - protein, 9 aa, Homo sapiens
HLTPFTARG

SEQ ID NO: 46924 - protein, 15 aa, Homo sapiens
APGIFSSQPGHTPHP

SEQ ID NO: 46925 - protein, 9 aa, Homo sapiens
FSSQPGHTP

SEQ ID NO: 46926 - protein, 15 aa, Homo sapiens
PGIFSSQPGHTPHPA

SEQ ID NO: 46927 - protein, 9 aa, Homo sapiens
FSSQPGHTP

SEQ ID NO: 46928 - protein, 15 aa, Homo sapiens
GIFSSQPGHTPHPAA

SEQ ID NO: 46929 - protein, 9 aa, Homo sapiens
SQPGHTPHP

SEQ ID NO: 46930 - protein, 15 aa, Homo sapiens
RRDFAEMSSQLHLTP

SEQ ID NO: 46931 - protein, 9 aa, Homo sapiens
FAEMSSQLH

SEQ ID NO: 46932 - protein, 15 aa, Homo sapiens
FDFSWLSLKTLLSLA

SEQ ID NO: 46933 - protein, 9 aa, Homo sapiens
WLSLKTLLS

SEQ ID NO: 46934 - protein, 15 aa, Homo sapiens
RDFAEMSSQLHLTPF

SEQ ID NO: 46935 - protein, 9 aa, Homo sapiens
FAEMSSQLH

SEQ ID NO: 46936 - protein, 15 aa, Homo sapiens
DFSWLSLKTLLSLAL

SEQ ID NO: 46937 - protein, 9 aa, Homo sapiens
WLSLKTLLS

SEQ ID NO: 46938 - protein, 15 aa, Homo sapiens
FSWLSLKTLLSLALV

SEQ ID NO: 46939 - protein, 9 aa, Homo sapiens
WLSLKTLLS

SEQ ID NO: 46940 - protein, 15 aa, Homo sapiens
PLFDFSWLSLKTLLS

SEQ ID NO: 46941 - protein, 9 aa, Homo sapiens
FSWLSLKTL

SEQ ID NO: 46942 - protein, 15 aa, Homo sapiens
LFDFSWLSLKTLLSL

SEQ ID NO: 46943 - protein, 9 aa, Homo sapiens
WLSLKTLLS

SEQ ID NO: 46944 - protein, 15 aa, Homo sapiens
FDFSWLSLKTLLSLA

SEQ ID NO: 46945 - protein, 9 aa, Homo sapiens
WLSLKTLLS

SEQ ID NO: 46946 - protein, 15 aa, Homo sapiens
DFSWLSLKTLLSLAL

SEQ ID NO: 46947 - protein, 9 aa, Homo sapiens
WLSLKTLLS

SEQ ID NO: 46948 - protein, 15 aa, Homo sapiens
FSWLSLKTLLSLALV

SEQ ID NO: 46949 - protein, 9 aa, Homo sapiens
WLSLKTLLS

SEQ ID NO: 46950 - protein, 15 aa, Homo sapiens
SWLSLKTLLSLALVG

SEQ ID NO: 46951 - protein, 9 aa, Homo sapiens
WLSLKTLLS

SEQ ID NO: 46952 - protein, 15 aa, Homo sapiens
WLSLKTLLSLALVGA

SEQ ID NO: 46953 - protein, 9 aa, Homo sapiens
WLSLKTLLS

SEQ ID NO: 46954 - protein, 15 aa, Homo sapiens
ESVNREMSPLVDNIA

SEQ ID NO: 46955 - protein, 9 aa, Homo sapiens
NREMSPLVD

SEQ ID NO: 46956 - protein, 15 aa, Homo sapiens
CVESVNREMSPLVDN

SEQ ID NO: 46957 - protein, 9 aa, Homo sapiens
NREMSPLVD

SEQ ID NO: 46958 - protein, 15 aa, Homo sapiens
VESVNREMSPLVDNI

SEQ ID NO: 46959 - protein, 9 aa, Homo sapiens
NREMSPLVD

SEQ ID NO: 46960 - protein, 15 aa, Homo sapiens
VDNIALWMTEYLNRH

SEQ ID NO: 46961 - protein, 9 aa, Homo sapiens
IALWMTEYL

SEQ ID NO: 46962 - protein, 15 aa, Homo sapiens
PLVDNIALWMTEYLN

SEQ ID NO: 46963 - protein, 9 aa, Homo sapiens
IALWMTEYL

SEQ ID NO: 46964 - protein, 15 aa, Homo sapiens
DNIALWMTEYLNRHL

SEQ ID NO: 46965 - protein, 9 aa, Homo sapiens
IALWMTEYL

SEQ ID NO: 46966 - protein, 15 aa, Homo sapiens
LVDNIALWMTEYLNR

SEQ ID NO: 46967 - protein, 9 aa, Homo sapiens
IALWMTEYL

SEQ ID NO: 46968 - protein, 15 aa, Homo sapiens
MCVESVNREMSPLVD

SEQ ID NO: 46969 - protein, 9 aa, Homo sapiens
VNREMSPLV

SEQ ID NO: 46970 - protein, 15 aa, Homo sapiens
SPLVDNIALWMTEYL

SEQ ID NO: 46971 - protein, 9 aa, Homo sapiens
NIALWMTEY

SEQ ID NO: 46972 - protein, 15 aa, Homo sapiens
SVNREMSPLVDNIAL

SEQ ID NO: 46973 - protein, 9 aa, Homo sapiens
NREMSPLVD

SEQ ID NO: 46974 - protein, 15 aa, Homo sapiens
RRYRRDFAEMSSQLH

SEQ ID NO: 46975 - protein, 9 aa, Homo sapiens
YRRDFAEMS

SEQ ID NO: 46976 - protein, 15 aa, Homo sapiens
VNREMSPLVDNIALW

SEQ ID NO: 46977 - protein, 9 aa, Homo sapiens
NREMSPLVD

SEQ ID NO: 46978 - protein, 15 aa, Homo sapiens
GPALSPVPPVVHLTL

SEQ ID NO: 46979 - protein, 9 aa, Homo sapiens
LSPVPPVVH

SEQ ID NO: 46980 - protein, 15 aa, Homo sapiens
AGPALSPVPPVVHLT

SEQ ID NO: 46981 - protein, 9 aa, Homo sapiens
LSPVPPVVH

SEQ ID NO: 46982 - protein, 15 aa, Homo sapiens
AAGPALSPVPPVVHL

SEQ ID NO: 46983 - protein, 9 aa, Homo sapiens
LSPVPPVVH

SEQ ID NO: 46984 - protein, 15 aa, Homo sapiens
PALSPVPPVVHLTLR

SEQ ID NO: 46985 - protein, 9 aa, Homo sapiens
LSPVPPVVH

SEQ ID NO: 46986 - protein, 15 aa, Homo sapiens
AAAGPALSPVPPVVH

SEQ ID NO: 46987 - protein, 9 aa, Homo sapiens
ALSPVPPVV

SEQ ID NO: 46988 - protein, 15 aa, Homo sapiens
ALSPVPPVVHLTLRQ

SEQ ID NO: 46989 - protein, 9 aa, Homo sapiens
LSPVPPVVH

SEQ ID NO: 46990 - protein, 15 aa, Homo sapiens
LSPVPPVVHLTLRQA

SEQ ID NO: 46991 - protein, 9 aa, Homo sapiens
LSPVPPVVH

SEQ ID NO: 46992 - protein, 15 aa, Homo sapiens
DAFVELYGPSMRPLF

SEQ ID NO: 46993 - protein, 9 aa, Homo sapiens
VELYGPSMR

SEQ ID NO: 46994 - protein, 15 aa, Homo sapiens
AFVELYGPSMRPLFD

SEQ ID NO: 46995 - protein, 9 aa, Homo sapiens
YGPSMRPLF

SEQ ID NO: 46996 - protein, 15 aa, Homo sapiens
FVELYGPSMRPLFDF

SEQ ID NO: 46997 - protein, 9 aa, Homo sapiens
YGPSMRPLF

SEQ ID NO: 46998 - protein, 15 aa, Homo sapiens
VELYGPSMRPLFDFS

SEQ ID NO: 46999 - protein, 9 aa, Homo sapiens
YGPSMRPLF

SEQ ID NO: 47000 - protein, 15 aa, Homo sapiens
FSWLSLKTLLSLALV

SEQ ID NO: 47001 - protein, 9 aa, Homo sapiens
WLSLKTLLS

SEQ ID NO: 47002 - protein, 15 aa, Homo sapiens
DFSWLSLKTLLSLAL

SEQ ID NO: 47003 - protein, 9 aa, Homo sapiens
WLSLKTLLS

SEQ ID NO: 47004 - protein, 15 aa, Homo sapiens
LFDFSWLSLKTLLSL

SEQ ID NO: 47005 - protein, 9 aa, Homo sapiens
WLSLKTLLS

SEQ ID NO: 47006 - protein, 15 aa, Homo sapiens
FDFSWLSLKTLLSLA

SEQ ID NO: 47007 - protein, 9 aa, Homo sapiens
WLSLKTLLS

SEQ ID NO: 47008 - protein, 15 aa, Homo sapiens
PLFDFSWLSLKTLLS

SEQ ID NO: 47009 - protein, 9 aa, Homo sapiens
FSWLSLKTL

SEQ ID NO: 47010 - protein, 15 aa, Homo sapiens
SWLSLKTLLSLALVG

SEQ ID NO: 47011 - protein, 9 aa, Homo sapiens
WLSLKTLLS

SEQ ID NO: 47012 - protein, 15 aa, Homo sapiens
WLSLKTLLSLALVGA

SEQ ID NO: 47013 - protein, 9 aa, Homo sapiens
WLSLKTLLS

SEQ ID NO: 47014 - protein, 15 aa, Homo sapiens
DAFVELYGPSMRPLF

SEQ ID NO: 47015 - protein, 9 aa, Homo sapiens
VELYGPSMR

SEQ ID NO: 47016 - protein, 15 aa, Homo sapiens
AFVELYGPSMRPLFD

SEQ ID NO: 47017 - protein, 9 aa, Homo sapiens
VELYGPSMR

SEQ ID NO: 47018 - protein, 15 aa, Homo sapiens
SPLVDNIALWMTEYL

SEQ ID NO: 47019 - protein, 9 aa, Homo sapiens
VDNIALWMT

SEQ ID NO: 47020 - protein, 15 aa, Homo sapiens
PLVDNIALWMTEYLN

SEQ ID NO: 47021 - protein, 9 aa, Homo sapiens
VDNIALWMT

SEQ ID NO: 47022 - protein, 15 aa, Homo sapiens
EIVMKYIHYKLSQRG

SEQ ID NO: 47023 - protein, 9 aa, Homo sapiens
YIHYKLSQR

SEQ ID NO: 47024 - protein, 15 aa, Homo sapiens
IVMKYIHYKLSQRGY

SEQ ID NO: 47025 - protein, 9 aa, Homo sapiens
YIHYKLSQR

SEQ ID NO: 47026 - protein, 15 aa, Homo sapiens
VMKYIHYKLSQRGYE

SEQ ID NO: 47027 - protein, 9 aa, Homo sapiens
YIHYKLSQR

SEQ ID NO: 47028 - protein, 15 aa, Homo sapiens
MKYIHYKLSQRGYEW

SEQ ID NO: 47029 - protein, 9 aa, Homo sapiens
YIHYKLSQR

SEQ ID NO: 47030 - protein, 15 aa, Homo sapiens
REIVMKYIHYKLSQR

SEQ ID NO: 47031 - protein, 9 aa, Homo sapiens
IVMKYIHYK

SEQ ID NO: 47032 - protein, 15 aa, Homo sapiens
KYIHYKLSQRGYEWD

SEQ ID NO: 47033 - protein, 9 aa, Homo sapiens
YIHYKLSQR

SEQ ID NO: 47034 - protein, 15 aa, Homo sapiens
MSSQLHLTPFTARGR

SEQ ID NO: 47035 - protein, 9 aa, Homo sapiens
LHLTPFTAR

SEQ ID NO: 47036 - protein, 15 aa, Homo sapiens
SSQLHLTPFTARGRF

SEQ ID NO: 47037 - protein, 9 aa, Homo sapiens
LHLTPFTAR

SEQ ID NO: 47038 - protein, 15 aa, Homo sapiens
YIHYKLSQRGYEWDA

SEQ ID NO: 47039 - protein, 9 aa, Homo sapiens
YIHYKLSQR

SEQ ID NO: 47040 - protein, 15 aa, Homo sapiens
SQLHLTPFTARGRFA

SEQ ID NO: 47041 - protein, 9 aa, Homo sapiens
LHLTPFTAR

SEQ ID NO: 47042 - protein, 15 aa, Homo sapiens
LHLTPFTARGRFATV

SEQ ID NO: 47043 - protein, 9 aa, Homo sapiens
LTPFTARGR

SEQ ID NO: 47044 - protein, 15 aa, Homo sapiens
EELFRDGVNWGRIVA

SEQ ID NO: 47045 - protein, 9 aa, Homo sapiens
LFRDGVNWG

SEQ ID NO: 47046 - protein, 15 aa, Homo sapiens
FSWLSLKTLLSLALV

SEQ ID NO: 47047 - protein, 9 aa, Homo sapiens
WLSLKTLLS

SEQ ID NO: 47048 - protein, 15 aa, Homo sapiens
DFSWLSLKTLLSLAL

SEQ ID NO: 47049 - protein, 9 aa, Homo sapiens
WLSLKTLLS

SEQ ID NO: 47050 - protein, 15 aa, Homo sapiens
QLHLTPFTARGRFAT

SEQ ID NO: 47051 - protein, 9 aa, Homo sapiens
LHLTPFTAR

SEQ ID NO: 47052 - protein, 15 aa, Homo sapiens
SPVPPVVHLTLRQAG

SEQ ID NO: 47053 - protein, 9 aa, Homo sapiens
VVHLTLRQA

SEQ ID NO: 47054 - protein, 15 aa, Homo sapiens
PVPPVVHLTLRQAGD

SEQ ID NO: 47055 - protein, 9 aa, Homo sapiens
VVHLTLRQA

SEQ ID NO: 47056 - protein, 15 aa, Homo sapiens
WLSLKTLLSLALVGA

SEQ ID NO: 47057 - protein, 9 aa, Homo sapiens
LKTLLSLAL

SEQ ID NO: 47058 - protein, 15 aa, Homo sapiens
LFDFSWLSLKTLLSL

SEQ ID NO: 47059 - protein, 9 aa, Homo sapiens
WLSLKTLLS

SEQ ID NO: 47060 - protein, 15 aa, Homo sapiens
VMCVESVNREMSPLV

SEQ ID NO: 47061 - protein, 9 aa, Homo sapiens
VMCVESVNR

SEQ ID NO: 47062 - protein, 15 aa, Homo sapiens
GGWDAFVELYGPSMR

SEQ ID NO: 47063 - protein, 9 aa, Homo sapiens
FVELYGPSM

SEQ ID NO: 47064 - protein, 15 aa, Homo sapiens
WDAFVELYGPSMRPL

SEQ ID NO: 47065 - protein, 9 aa, Homo sapiens
VELYGPSMR

SEQ ID NO: 47066 - protein, 15 aa, Homo sapiens
DAFVELYGPSMRPLF

SEQ ID NO: 47067 - protein, 9 aa, Homo sapiens
FVELYGPSM

SEQ ID NO: 47068 - protein, 15 aa, Homo sapiens
TVVEELFRDGVNWGR

SEQ ID NO: 47069 - protein, 9 aa, Homo sapiens
LFRDGVNWG

SEQ ID NO: 47070 - protein, 15 aa, Homo sapiens
VVEELFRDGVNWGRI

SEQ ID NO: 47071 - protein, 9 aa, Homo sapiens
LFRDGVNWG

SEQ ID NO: 47072 - protein, 15 aa, Homo sapiens
GWDAFVELYGPSMRP

SEQ ID NO: 47073 - protein, 9 aa, Homo sapiens
VELYGPSMR

SEQ ID NO: 47074 - protein, 15 aa, Homo sapiens
ALWMTEYLNRHLHTW

SEQ ID NO: 47075 - protein, 9 aa, Homo sapiens
WMTEYLNRH

SEQ ID NO: 47076 - protein, 15 aa, Homo sapiens
PLFDFSWLSLKTLLS

SEQ ID NO: 47077 - protein, 9 aa, Homo sapiens
LFDFSWLSL

SEQ ID NO: 47078 - protein, 15 aa, Homo sapiens
NIALWMTEYLNRHLH

SEQ ID NO: 47079 - protein, 9 aa, Homo sapiens
WMTEYLNRH

SEQ ID NO: 47080 - protein, 15 aa, Homo sapiens
IALWMTEYLNRHLHT

SEQ ID NO: 47081 - protein, 9 aa, Homo sapiens
WMTEYLNRH

SEQ ID NO: 47082 - protein, 15 aa, Homo sapiens
VEELFRDGVNWGRIV

SEQ ID NO: 47083 - protein, 9 aa, Homo sapiens
LFRDGVNWG

SEQ ID NO: 47084 - protein, 15 aa, Homo sapiens
DNIALWMTEYLNRHL

SEQ ID NO: 47085 - protein, 9 aa, Homo sapiens
WMTEYLNRH

SEQ ID NO: 47086 - protein, 15 aa, Homo sapiens
VPPVVHLTLRQAGDD

SEQ ID NO: 47087 - protein, 9 aa, Homo sapiens
VVHLTLRQA

SEQ ID NO: 47088 - protein, 15 aa, Homo sapiens
FDFSWLSLKTLLSLA

SEQ ID NO: 47089 - protein, 9 aa, Homo sapiens
WLSLKTLLS

SEQ ID NO: 47090 - protein, 15 aa, Homo sapiens
ELFRDGVNWGRIVAF

SEQ ID NO: 47091 - protein, 9 aa, Homo sapiens
LFRDGVNWG

SEQ ID NO: 47092 - protein, 15 aa, Homo sapiens
LSPVPPVVHLTLRQA

SEQ ID NO: 47093 - protein, 9 aa, Homo sapiens
PPVVHLTLR

SEQ ID NO: 47094 - protein, 15 aa, Homo sapiens
SWLSLKTLLSLALVG

SEQ ID NO: 47095 - protein, 9 aa, Homo sapiens
LKTLLSLAL

SEQ ID NO: 47096 - protein, 15 aa, Homo sapiens
PPVVHLTLRQAGDDF

SEQ ID NO: 47097 - protein, 9 aa, Homo sapiens
VVHLTLRQA

SEQ ID NO: 47098 - protein, 15 aa, Homo sapiens
DAFVELYGPSMRPLF

SEQ ID NO: 47099 - protein, 9 aa, Homo sapiens
VELYGPSMR

SEQ ID NO: 47100 - protein, 15 aa, Homo sapiens
AFVELYGPSMRPLFD

SEQ ID NO: 47101 - protein, 9 aa, Homo sapiens
VELYGPSMR

SEQ ID NO: 47102 - protein, 15 aa, Homo sapiens
WDAFVELYGPSMRPL

SEQ ID NO: 47103 - protein, 9 aa, Homo sapiens
VELYGPSMR

SEQ ID NO: 47104 - protein, 15 aa, Homo sapiens
GGWDAFVELYGPSMR

SEQ ID NO: 47105 - protein, 9 aa, Homo sapiens
FVELYGPSM

SEQ ID NO: 47106 - protein, 15 aa, Homo sapiens
GWDAFVELYGPSMRP

SEQ ID NO: 47107 - protein, 9 aa, Homo sapiens
VELYGPSMR

SEQ ID NO: 47108 - protein, 15 aa, Homo sapiens
FVELYGPSMRPLFDF

SEQ ID NO: 47109 - protein, 9 aa, Homo sapiens
VELYGPSMR

SEQ ID NO: 47110 - protein, 15 aa, Homo sapiens
VELYGPSMRPLFDFS

SEQ ID NO: 47111 - protein, 9 aa, Homo sapiens
VELYGPSMR

SEQ ID NO: 47112 - protein, 15 aa, Homo sapiens
AAGPALSPVPPVVHL

SEQ ID NO: 47113 - protein, 9 aa, Homo sapiens
LSPVPPVVH

SEQ ID NO: 47114 - protein, 15 aa, Homo sapiens
AAAGPALSPVPPVVH

SEQ ID NO: 47115 - protein, 9 aa, Homo sapiens
ALSPVPPVV

SEQ ID NO: 47116 - protein, 15 aa, Homo sapiens
VDNIALWMTEYLNRH

SEQ ID NO: 47117 - protein, 9 aa, Homo sapiens
IALWMTEYL

SEQ ID NO: 47118 - protein, 15 aa, Homo sapiens
GPALSPVPPVVHLTL

SEQ ID NO: 47119 - protein, 9 aa, Homo sapiens
LSPVPPVVH

SEQ ID NO: 47120 - protein, 15 aa, Homo sapiens
AGPALSPVPPVVHLT

SEQ ID NO: 47121 - protein, 9 aa, Homo sapiens
LSPVPPVVH

SEQ ID NO: 47122 - protein, 15 aa, Homo sapiens
PALSPVPPVVHLTLR

SEQ ID NO: 47123 - protein, 9 aa, Homo sapiens
LSPVPPVVH

SEQ ID NO: 47124 - protein, 15 aa, Homo sapiens
DNIALWMTEYLNRHL

SEQ ID NO: 47125 - protein, 9 aa, Homo sapiens
WMTEYLNRH

SEQ ID NO: 47126 - protein, 15 aa, Homo sapiens
NIALWMTEYLNRHLH

SEQ ID NO: 47127 - protein, 9 aa, Homo sapiens
LWMTEYLNR

SEQ ID NO: 47128 - protein, 15 aa, Homo sapiens
IALWMTEYLNRHLHT

SEQ ID NO: 47129 - protein, 9 aa, Homo sapiens
WMTEYLNRH

SEQ ID NO: 47130 - protein, 15 aa, Homo sapiens
MKYIHYKLSQRGYEW

SEQ ID NO: 47131 - protein, 9 aa, Homo sapiens
YIHYKLSQR

SEQ ID NO: 47132 - protein, 15 aa, Homo sapiens
VMKYIHYKLSQRGYE

SEQ ID NO: 47133 - protein, 9 aa, Homo sapiens
YIHYKLSQR

SEQ ID NO: 47134 - protein, 15 aa, Homo sapiens
RWFLTGMTVAGVVLL

SEQ ID NO: 47135 - protein, 9 aa, Homo sapiens
LTGMTVAGV

SEQ ID NO: 47136 - protein, 15 aa, Homo sapiens
RFNRWFLTGMTVAGV

SEQ ID NO: 47137 - protein, 9 aa, Homo sapiens
FLTGMTVAG

SEQ ID NO: 47138 - protein, 15 aa, Homo sapiens
FNRWFLTGMTVAGVV

SEQ ID NO: 47139 - protein, 9 aa, Homo sapiens
LTGMTVAGV

SEQ ID NO: 47140 - protein, 15 aa, Homo sapiens
NRWFLTGMTVAGVVL

SEQ ID NO: 47141 - protein, 9 aa, Homo sapiens
LTGMTVAGV

SEQ ID NO: 47142 - protein, 15 aa, Homo sapiens
WFLTGMTVAGVVLLG

SEQ ID NO: 47143 - protein, 9 aa, Homo sapiens
LTGMTVAGV

SEQ ID NO: 47144 - protein, 15 aa, Homo sapiens
DAREVIPMAAVKQAL

SEQ ID NO: 47145 - protein, 9 aa, Homo sapiens
VIPMAAVKQ

SEQ ID NO: 47146 - protein, 15 aa, Homo sapiens
AREVIPMAAVKQALR

SEQ ID NO: 47147 - protein, 9 aa, Homo sapiens
VIPMAAVKQ

SEQ ID NO: 47148 - protein, 15 aa, Homo sapiens
REVIPMAAVKQALRE

SEQ ID NO: 47149 - protein, 9 aa, Homo sapiens
VIPMAAVKQ

SEQ ID NO: 47150 - protein, 15 aa, Homo sapiens
LDAREVIPMAAVKQA

SEQ ID NO: 47151 - protein, 9 aa, Homo sapiens
VIPMAAVKQ

SEQ ID NO: 47152 - protein, 15 aa, Homo sapiens
KEMQVLVSRIAAWMA

SEQ ID NO: 47153 - protein, 9 aa, Homo sapiens
MQVLVSRIA

SEQ ID NO: 47154 - protein, 15 aa, Homo sapiens
LTSQLHITPGTAYQS

SEQ ID NO: 47155 - protein, 9 aa, Homo sapiens
LHITPGTAY

SEQ ID NO: 47156 - protein, 15 aa, Homo sapiens
TSQLHITPGTAYQSF

SEQ ID NO: 47157 - protein, 9 aa, Homo sapiens
ITPGTAYQS

SEQ ID NO: 47158 - protein, 15 aa, Homo sapiens
SLDAREVIPMAAVKQ

SEQ ID NO: 47159 - protein, 9 aa, Homo sapiens
AREVIPMAA

SEQ ID NO: 47160 - protein, 15 aa, Homo sapiens
SQLHITPGTAYQSFE

SEQ ID NO: 47161 - protein, 9 aa, Homo sapiens
ITPGTAYQS

SEQ ID NO: 47162 - protein, 15 aa, Homo sapiens
FLTGMTVAGVVLLGS

SEQ ID NO: 47163 - protein, 9 aa, Homo sapiens
LTGMTVAGV

SEQ ID NO: 47164 - protein, 15 aa, Homo sapiens
DKEMQVLVSRIAAWM

SEQ ID NO: 47165 - protein, 9 aa, Homo sapiens
MQVLVSRIA

SEQ ID NO: 47166 - protein, 15 aa, Homo sapiens
QLHITPGTAYQSFEQ

SEQ ID NO: 47167 - protein, 9 aa, Homo sapiens
ITPGTAYQS

SEQ ID NO: 47168 - protein, 15 aa, Homo sapiens
LHITPGTAYQSFEQV

SEQ ID NO: 47169 - protein, 9 aa, Homo sapiens
ITPGTAYQS

SEQ ID NO: 47170 - protein, 15 aa, Homo sapiens
SVDKEMQVLVSRIAA

SEQ ID NO: 47171 - protein, 9 aa, Homo sapiens
MQVLVSRIA

SEQ ID NO: 47172 - protein, 15 aa, Homo sapiens
EVIPMAAVKQALREA

SEQ ID NO: 47173 - protein, 9 aa, Homo sapiens
IPMAAVKQA

SEQ ID NO: 47174 - protein, 15 aa, Homo sapiens
ESVDKEMQVLVSRIA

SEQ ID NO: 47175 - protein, 9 aa, Homo sapiens
VDKEMQVLV

SEQ ID NO: 47176 - protein, 15 aa, Homo sapiens
VDKEMQVLVSRIAAW

SEQ ID NO: 47177 - protein, 9 aa, Homo sapiens
MQVLVSRIA

SEQ ID NO: 47178 - protein, 15 aa, Homo sapiens
LTGMTVAGVVLLGSL

SEQ ID NO: 47179 - protein, 9 aa, Homo sapiens
LTGMTVAGV

SEQ ID NO: 47180 - protein, 15 aa, Homo sapiens
ERFNRWFLTGMTVAG

SEQ ID NO: 47181 - protein, 9 aa, Homo sapiens
FNRWFLTGM

SEQ ID NO: 47182 - protein, 15 aa, Homo sapiens
ETPSAINGNPSWHLA

SEQ ID NO: 47183 - protein, 9 aa, Homo sapiens
INGNPSWHL

SEQ ID NO: 47184 - protein, 15 aa, Homo sapiens
TPSAINGNPSWHLAD

SEQ ID NO: 47185 - protein, 9 aa, Homo sapiens
INGNPSWHL

SEQ ID NO: 47186 - protein, 15 aa, Homo sapiens
PSAINGNPSWHLADS

SEQ ID NO: 47187 - protein, 9 aa, Homo sapiens
INGNPSWHL

SEQ ID NO: 47188 - protein, 15 aa, Homo sapiens
SAINGNPSWHLADSP

SEQ ID NO: 47189 - protein, 9 aa, Homo sapiens
INGNPSWHL

SEQ ID NO: 47190 - protein, 15 aa, Homo sapiens
METPSAINGNPSWHL

SEQ ID NO: 47191 - protein, 9 aa, Homo sapiens
PSAINGNPS

SEQ ID NO: 47192 - protein, 15 aa, Homo sapiens
EMQVLVSRIAAWMAT

SEQ ID NO: 47193 - protein, 9 aa, Homo sapiens
MQVLVSRIA

SEQ ID NO: 47194 - protein, 15 aa, Homo sapiens
VIPMAAVKQALREAG

SEQ ID NO: 47195 - protein, 9 aa, Homo sapiens
VIPMAAVKQ

SEQ ID NO: 47196 - protein, 15 aa, Homo sapiens
MQVLVSRIAAWMATY

SEQ ID NO: 47197 - protein, 9 aa, Homo sapiens
MQVLVSRIA

SEQ ID NO: 47198 - protein, 15 aa, Homo sapiens
VLVSRIAAWMATYLN

SEQ ID NO: 47199 - protein, 9 aa, Homo sapiens
IAAWMATYL

SEQ ID NO: 47200 - protein, 15 aa, Homo sapiens
GMTVAGVVLLGSLFS

SEQ ID NO: 47201 - protein, 9 aa, Homo sapiens
MTVAGVVLL

SEQ ID NO: 47202 - protein, 15 aa, Homo sapiens
MTVAGVVLLGSLFSR

SEQ ID NO: 47203 - protein, 9 aa, Homo sapiens
VVLLGSLFS

SEQ ID NO: 47204 - protein, 15 aa, Homo sapiens
INGNPSWHLADSPAV

SEQ ID NO: 47205 - protein, 9 aa, Homo sapiens
INGNPSWHL

SEQ ID NO: 47206 - protein, 15 aa, Homo sapiens
VELYGNNAAAESRKG

SEQ ID NO: 47207 - protein, 9 aa, Homo sapiens
YGNNAAAES

SEQ ID NO: 47208 - protein, 15 aa, Homo sapiens
TVAGVVLLGSLFSRK

SEQ ID NO: 47209 - protein, 9 aa, Homo sapiens
VVLLGSLFS

SEQ ID NO: 47210 - protein, 15 aa, Homo sapiens
QVLVSRIAAWMATYL

SEQ ID NO: 47211 - protein, 9 aa, Homo sapiens
VSRIAAWMA

SEQ ID NO: 47212 - protein, 15 aa, Homo sapiens
FVELYGNNAAAESRK

SEQ ID NO: 47213 - protein, 9 aa, Homo sapiens
YGNNAAAES

SEQ ID NO: 47214 - protein, 15 aa, Homo sapiens
ELYGNNAAAESRKGQ

SEQ ID NO: 47215 - protein, 9 aa, Homo sapiens
YGNNAAAES

SEQ ID NO: 47216 - protein, 15 aa, Homo sapiens
LRYRRAFSDLTSQLH

SEQ ID NO: 47217 - protein, 9 aa, Homo sapiens
YRRAFSDLT

SEQ ID NO: 47218 - protein, 15 aa, Homo sapiens
LVSRIAAWMATYLND

SEQ ID NO: 47219 - protein, 9 aa, Homo sapiens
IAAWMATYL

SEQ ID NO: 47220 - protein, 15 aa, Homo sapiens
TFVELYGNNAAAESR

SEQ ID NO: 47221 - protein, 9 aa, Homo sapiens
YGNNAAAES

SEQ ID NO: 47222 - protein, 15 aa, Homo sapiens
DTFVELYGNNAAAES

SEQ ID NO: 47223 - protein, 9 aa, Homo sapiens
FVELYGNNA

SEQ ID NO: 47224 - protein, 15 aa, Homo sapiens
NPSWHLADSPAVNGA

SEQ ID NO: 47225 - protein, 9 aa, Homo sapiens
WHLADSPAV

SEQ ID NO: 47226 - protein, 15 aa, Homo sapiens
PSWHLADSPAVNGAT

SEQ ID NO: 47227 - protein, 9 aa, Homo sapiens
WHLADSPAV

SEQ ID NO: 47228 - protein, 15 aa, Homo sapiens
TGMTVAGVVLLGSLF

SEQ ID NO: 47229 - protein, 9 aa, Homo sapiens
MTVAGVVLL

SEQ ID NO: 47230 - protein, 15 aa, Homo sapiens
VSRIAAWMATYLNDH

SEQ ID NO: 47231 - protein, 9 aa, Homo sapiens
IAAWMATYL

SEQ ID NO: 47232 - protein, 15 aa, Homo sapiens
GNPSWHLADSPAVNG

SEQ ID NO: 47233 - protein, 9 aa, Homo sapiens
WHLADSPAV

SEQ ID NO: 47234 - protein, 15 aa, Homo sapiens
LADSPAVNGATGHSS

SEQ ID NO: 47235 - protein, 9 aa, Homo sapiens
LADSPAVNG

SEQ ID NO: 47236 - protein, 15 aa, Homo sapiens
ELRYRRAFSDLTSQL

SEQ ID NO: 47237 - protein, 9 aa, Homo sapiens
YRRAFSDLT

SEQ ID NO: 47238 - protein, 15 aa, Homo sapiens
SRIAAWMATYLNDHL

SEQ ID NO: 47239 - protein, 9 aa, Homo sapiens
IAAWMATYL

SEQ ID NO: 47240 - protein, 15 aa, Homo sapiens
FELRYRRAFSDLTSQ

SEQ ID NO: 47241 - protein, 9 aa, Homo sapiens
YRRAFSDLT

SEQ ID NO: 47242 - protein, 15 aa, Homo sapiens
EFELRYRRAFSDLTS

SEQ ID NO: 47243 - protein, 9 aa, Homo sapiens
YRRAFSDLT

SEQ ID NO: 47244 - protein, 15 aa, Homo sapiens
DEFELRYRRAFSDLT

SEQ ID NO: 47245 - protein, 9 aa, Homo sapiens
LRYRRAFSD

SEQ ID NO: 47246 - protein, 15 aa, Homo sapiens
IVAFFSFGGALCVES

SEQ ID NO: 47247 - protein, 9 aa, Homo sapiens
FSFGGALCV

SEQ ID NO: 47248 - protein, 15 aa, Homo sapiens
SWHLADSPAVNGATG

SEQ ID NO: 47249 - protein, 9 aa, Homo sapiens
LADSPAVNG

SEQ ID NO: 47250 - protein, 15 aa, Homo sapiens
DSPAVNGATGHSSSL

SEQ ID NO: 47251 - protein, 9 aa, Homo sapiens
VNGATGHSS

SEQ ID NO: 47252 - protein, 15 aa, Homo sapiens
SPAVNGATGHSSSLD

SEQ ID NO: 47253 - protein, 9 aa, Homo sapiens
VNGATGHSS

SEQ ID NO: 47254 - protein, 15 aa, Homo sapiens
VAFFSFGGALCVESV

SEQ ID NO: 47255 - protein, 9 aa, Homo sapiens
FSFGGALCV

SEQ ID NO: 47256 - protein, 15 aa, Homo sapiens
ADSPAVNGATGHSSS

SEQ ID NO: 47257 - protein, 9 aa, Homo sapiens
VNGATGHSS

SEQ ID NO: 47258 - protein, 15 aa, Homo sapiens
AFFSFGGALCVESVD

SEQ ID NO: 47259 - protein, 9 aa, Homo sapiens
FSFGGALCV

SEQ ID NO: 47260 - protein, 15 aa, Homo sapiens
WHLADSPAVNGATGH

SEQ ID NO: 47261 - protein, 9 aa, Homo sapiens
LADSPAVNG

SEQ ID NO: 47262 - protein, 15 aa, Homo sapiens
HITPGTAYQSFEQVV

SEQ ID NO: 47263 - protein, 9 aa, Homo sapiens
ITPGTAYQS

SEQ ID NO: 47264 - protein, 15 aa, Homo sapiens
ITPGTAYQSFEQVVN

SEQ ID NO: 47265 - protein, 9 aa, Homo sapiens
ITPGTAYQS

SEQ ID NO: 47266 - protein, 15 aa, Homo sapiens
AINGNPSWHLADSPA

SEQ ID NO: 47267 - protein, 9 aa, Homo sapiens
INGNPSWHL

SEQ ID NO: 47268 - protein, 15 aa, Homo sapiens
PAVNGATGHSSSLDA

SEQ ID NO: 47269 - protein, 9 aa, Homo sapiens
VNGATGHSS

SEQ ID NO: 47270 - protein, 15 aa, Homo sapiens
RYRRAFSDLTSQLHI

SEQ ID NO: 47271 - protein, 9 aa, Homo sapiens
YRRAFSDLT

SEQ ID NO: 47272 - protein, 15 aa, Homo sapiens
YRRAFSDLTSQLHIT

SEQ ID NO: 47273 - protein, 9 aa, Homo sapiens
YRRAFSDLT

SEQ ID NO: 47274 - protein, 15 aa, Homo sapiens
NGNPSWHLADSPAVN

SEQ ID NO: 47275 - protein, 9 aa, Homo sapiens
WHLADSPAV

SEQ ID NO: 47276 - protein, 15 aa, Homo sapiens
GRIVAFFSFGGALCV

SEQ ID NO: 47277 - protein, 9 aa, Homo sapiens
IVAFFSFGG

SEQ ID NO: 47278 - protein, 15 aa, Homo sapiens
LYGNNAAAESRKGQE

SEQ ID NO: 47279 - protein, 9 aa, Homo sapiens
YGNNAAAES

SEQ ID NO: 47280 - protein, 15 aa, Homo sapiens
RIAAWMATYLNDHLE

SEQ ID NO: 47281 - protein, 9 aa, Homo sapiens
AAWMATYLN

SEQ ID NO: 47282 - protein, 15 aa, Homo sapiens
YGNNAAAESRKGQER

SEQ ID NO: 47283 - protein, 9 aa, Homo sapiens
YGNNAAAES

SEQ ID NO: 47284 - protein, 15 aa, Homo sapiens
RIVAFFSFGGALCVE

SEQ ID NO: 47285 - protein, 9 aa, Homo sapiens
FSFGGALCV

SEQ ID NO: 47286 - protein, 15 aa, Homo sapiens
FRDGVNWGRIVAFFS

SEQ ID NO: 47287 - protein, 9 aa, Homo sapiens
VNWGRIVAF

SEQ ID NO: 47288 - protein, 15 aa, Homo sapiens
FFSFGGALCVESVDK

SEQ ID NO: 47289 - protein, 9 aa, Homo sapiens
FSFGGALCV

SEQ ID NO: 47290 - protein, 15 aa, Homo sapiens
FSFGGALCVESVDKE

SEQ ID NO: 47291 - protein, 9 aa, Homo sapiens
FSFGGALCV

SEQ ID NO: 47292 - protein, 15 aa, Homo sapiens
RDGVNWGRIVAFFSF

SEQ ID NO: 47293 - protein, 9 aa, Homo sapiens
VNWGRIVAF

SEQ ID NO: 47294 - protein, 15 aa, Homo sapiens
DGVNWGRIVAFFSFG

SEQ ID NO: 47295 - protein, 9 aa, Homo sapiens
VNWGRIVAF

SEQ ID NO: 47296 - protein, 15 aa, Homo sapiens
IPMAAVKQALREAGD

SEQ ID NO: 47297 - protein, 9 aa, Homo sapiens
IPMAAVKQA

SEQ ID NO: 47298 - protein, 15 aa, Homo sapiens
RRAFSDLTSQLHITP

SEQ ID NO: 47299 - protein, 9 aa, Homo sapiens
FSDLTSQLH

SEQ ID NO: 47300 - protein, 15 aa, Homo sapiens
RAFSDLTSQLHITPG

SEQ ID NO: 47301 - protein, 9 aa, Homo sapiens
FSDLTSQLH

SEQ ID NO: 47302 - protein, 15 aa, Homo sapiens
HLADSPAVNGATGHS

SEQ ID NO: 47303 - protein, 9 aa, Homo sapiens
LADSPAVNG

SEQ ID NO: 47304 - protein, 15 aa, Homo sapiens
GVNWGRIVAFFSFGG

SEQ ID NO: 47305 - protein, 9 aa, Homo sapiens
VNWGRIVAF

SEQ ID NO: 47306 - protein, 15 aa, Homo sapiens
IAAWMATYLNDHLEP

SEQ ID NO: 47307 - protein, 9 aa, Homo sapiens
IAAWMATYL

SEQ ID NO: 47308 - protein, 15 aa, Homo sapiens
AVNGATGHSSSLDAR

SEQ ID NO: 47309 - protein, 9 aa, Homo sapiens
VNGATGHSS

SEQ ID NO: 47310 - protein, 15 aa, Homo sapiens
VNWGRIVAFFSFGGA

SEQ ID NO: 47311 - protein, 9 aa, Homo sapiens
VNWGRIVAF

SEQ ID NO: 47312 - protein, 15 aa, Homo sapiens
ELVVDFLSYKLSQKG

SEQ ID NO: 47313 - protein, 9 aa, Homo sapiens
VVDFLSYKL

SEQ ID NO: 47314 - protein, 15 aa, Homo sapiens
ELFRDGVNWGRIVAF

SEQ ID NO: 47315 - protein, 9 aa, Homo sapiens
FRDGVNWGR

SEQ ID NO: 47316 - protein, 15 aa, Homo sapiens
VNGATGHSSSLDARE

SEQ ID NO: 47317 - protein, 9 aa, Homo sapiens
VNGATGHSS

SEQ ID NO: 47318 - protein, 15 aa, Homo sapiens
LFRDGVNWGRIVAFF

SEQ ID NO: 47319 - protein, 9 aa, Homo sapiens
VNWGRIVAF

SEQ ID NO: 47320 - protein, 15 aa, Homo sapiens
LVVDFLSYKLSQKGY

SEQ ID NO: 47321 - protein, 9 aa, Homo sapiens
LSYKLSQKG

SEQ ID NO: 47322 - protein, 15 aa, Homo sapiens
VVDFLSYKLSQKGYS

SEQ ID NO: 47323 - protein, 9 aa, Homo sapiens
LSYKLSQKG

SEQ ID NO: 47324 - protein, 15 aa, Homo sapiens
QERFNRWFLTGMTVA

SEQ ID NO: 47325 - protein, 9 aa, Homo sapiens
FNRWFLTGM

SEQ ID NO: 47326 - protein, 15 aa, Homo sapiens
ESEMETPSAINGNPS

SEQ ID NO: 47327 - protein, 9 aa, Homo sapiens
METPSAING

SEQ ID NO: 47328 - protein, 15 aa, Homo sapiens
GTESEMETPSAINGN

SEQ ID NO: 47329 - protein, 9 aa, Homo sapiens
METPSAING

SEQ ID NO: 47330 - protein, 15 aa, Homo sapiens
DLTSQLHITPGTAYQ

SEQ ID NO: 47331 - protein, 9 aa, Homo sapiens
LHITPGTAY

SEQ ID NO: 47332 - protein, 15 aa, Homo sapiens
EGTESEMETPSAING

SEQ ID NO: 47333 - protein, 9 aa, Homo sapiens
ESEMETPSA

SEQ ID NO: 47334 - protein, 15 aa, Homo sapiens
SEMETPSAINGNPSW

SEQ ID NO: 47335 - protein, 9 aa, Homo sapiens
METPSAING

SEQ ID NO: 47336 - protein, 15 aa, Homo sapiens
SDLTSQLHITPGTAY

SEQ ID NO: 47337 - protein, 9 aa, Homo sapiens
SQLHITPGT

SEQ ID NO: 47338 - protein, 15 aa, Homo sapiens
VDFLSYKLSQKGYSW

SEQ ID NO: 47339 - protein, 9 aa, Homo sapiens
LSYKLSQKG

SEQ ID NO: 47340 - protein, 15 aa, Homo sapiens
TESEMETPSAINGNP

SEQ ID NO: 47341 - protein, 9 aa, Homo sapiens
METPSAING

SEQ ID NO: 47342 - protein, 15 aa, Homo sapiens
AAWMATYLNDHLEPW

SEQ ID NO: 47343 - protein, 9 aa, Homo sapiens
AAWMATYLN

SEQ ID NO: 47344 - protein, 15 aa, Homo sapiens
DFLSYKLSQKGYSWS

SEQ ID NO: 47345 - protein, 9 aa, Homo sapiens
LSYKLSQKG

SEQ ID NO: 47346 - protein, 15 aa, Homo sapiens
AFSDLTSQLHITPGT

SEQ ID NO: 47347 - protein, 9 aa, Homo sapiens
FSDLTSQLH

SEQ ID NO: 47348 - protein, 15 aa, Homo sapiens
FSDLTSQLHITPGTA

SEQ ID NO: 47349 - protein, 9 aa, Homo sapiens
FSDLTSQLH

SEQ ID NO: 47350 - protein, 15 aa, Homo sapiens
WGRIVAFFSFGGALC

SEQ ID NO: 47351 - protein, 9 aa, Homo sapiens
IVAFFSFGG

SEQ ID NO: 47352 - protein, 15 aa, Homo sapiens
GQERFNRWFLTGMTV

SEQ ID NO: 47353 - protein, 9 aa, Homo sapiens
FNRWFLTGM

SEQ ID NO: 47354 - protein, 15 aa, Homo sapiens
LRYRRAFSDLTSQLH

SEQ ID NO: 47355 - protein, 9 aa, Homo sapiens
YRRAFSDLT

SEQ ID NO: 47356 - protein, 15 aa, Homo sapiens
FELRYRRAFSDLTSQ

SEQ ID NO: 47357 - protein, 9 aa, Homo sapiens
YRRAFSDLT

SEQ ID NO: 47358 - protein, 15 aa, Homo sapiens
EFELRYRRAFSDLTS

SEQ ID NO: 47359 - protein, 9 aa, Homo sapiens
YRRAFSDLT

SEQ ID NO: 47360 - protein, 15 aa, Homo sapiens
DEFELRYRRAFSDLT

SEQ ID NO: 47361 - protein, 9 aa, Homo sapiens
DEFELRYRR

SEQ ID NO: 47362 - protein, 15 aa, Homo sapiens
ELRYRRAFSDLTSQL

SEQ ID NO: 47363 - protein, 9 aa, Homo sapiens
YRRAFSDLT

SEQ ID NO: 47364 - protein, 15 aa, Homo sapiens
NGGWDTFVELYGNNA

SEQ ID NO: 47365 - protein, 9 aa, Homo sapiens
WDTFVELYG

SEQ ID NO: 47366 - protein, 15 aa, Homo sapiens
GGWDTFVELYGNNAA

SEQ ID NO: 47367 - protein, 9 aa, Homo sapiens
FVELYGNNA

SEQ ID NO: 47368 - protein, 15 aa, Homo sapiens
WDTFVELYGNNAAAE

SEQ ID NO: 47369 - protein, 9 aa, Homo sapiens
FVELYGNNA

SEQ ID NO: 47370 - protein, 15 aa, Homo sapiens
GWDTFVELYGNNAAA

SEQ ID NO: 47371 - protein, 9 aa, Homo sapiens
FVELYGNNA

SEQ ID NO: 47372 - protein, 15 aa, Homo sapiens
DTFVELYGNNAAAES

SEQ ID NO: 47373 - protein, 9 aa, Homo sapiens
FVELYGNNA

SEQ ID NO: 47374 - protein, 15 aa, Homo sapiens
RYRRAFSDLTSQLHI

SEQ ID NO: 47375 - protein, 9 aa, Homo sapiens
YRRAFSDLT

SEQ ID NO: 47376 - protein, 15 aa, Homo sapiens
YRRAFSDLTSQLHIT

SEQ ID NO: 47377 - protein, 9 aa, Homo sapiens
YRRAFSDLT

SEQ ID NO: 47378 - protein, 15 aa, Homo sapiens
ESVDKEMQVLVSRIA

SEQ ID NO: 47379 - protein, 9 aa, Homo sapiens
KEMQVLVSR

SEQ ID NO: 47380 - protein, 15 aa, Homo sapiens
VDKEMQVLVSRIAAW

SEQ ID NO: 47381 - protein, 9 aa, Homo sapiens
MQVLVSRIA

SEQ ID NO: 47382 - protein, 15 aa, Homo sapiens
ERFNRWFLTGMTVAG

SEQ ID NO: 47383 - protein, 9 aa, Homo sapiens
WFLTGMTVA

SEQ ID NO: 47384 - protein, 15 aa, Homo sapiens
SVDKEMQVLVSRIAA

SEQ ID NO: 47385 - protein, 9 aa, Homo sapiens
MQVLVSRIA

SEQ ID NO: 47386 - protein, 15 aa, Homo sapiens
RFNRWFLTGMTVAGV

SEQ ID NO: 47387 - protein, 9 aa, Homo sapiens
FLTGMTVAG

SEQ ID NO: 47388 - protein, 15 aa, Homo sapiens
FNRWFLTGMTVAGVV

SEQ ID NO: 47389 - protein, 9 aa, Homo sapiens
FLTGMTVAG

SEQ ID NO: 47390 - protein, 15 aa, Homo sapiens
KEMQVLVSRIAAWMA

SEQ ID NO: 47391 - protein, 9 aa, Homo sapiens
MQVLVSRIA

SEQ ID NO: 47392 - protein, 15 aa, Homo sapiens
DKEMQVLVSRIAAWM

SEQ ID NO: 47393 - protein, 9 aa, Homo sapiens
MQVLVSRIA

SEQ ID NO: 47394 - protein, 15 aa, Homo sapiens
NRWFLTGMTVAGVVL

SEQ ID NO: 47395 - protein, 9 aa, Homo sapiens
FLTGMTVAG

SEQ ID NO: 47396 - protein, 15 aa, Homo sapiens
AAWMATYLNDHLEPW

SEQ ID NO: 47397 - protein, 9 aa, Homo sapiens
WMATYLNDH

SEQ ID NO: 47398 - protein, 15 aa, Homo sapiens
SRIAAWMATYLNDHL

SEQ ID NO: 47399 - protein, 9 aa, Homo sapiens
WMATYLNDH

SEQ ID NO: 47400 - protein, 15 aa, Homo sapiens
RIAAWMATYLNDHLE

SEQ ID NO: 47401 - protein, 9 aa, Homo sapiens
WMATYLNDH

SEQ ID NO: 47402 - protein, 15 aa, Homo sapiens
IAAWMATYLNDHLEP

SEQ ID NO: 47403 - protein, 9 aa, Homo sapiens
WMATYLNDH

SEQ ID NO: 47404 - protein, 15 aa, Homo sapiens
VSRIAAWMATYLNDH

SEQ ID NO: 47405 - protein, 9 aa, Homo sapiens
AAWMATYLN

SEQ ID NO: 47406 - protein, 15 aa, Homo sapiens
TVAGVVLLGSLFSRK

SEQ ID NO: 47407 - protein, 9 aa, Homo sapiens
VVLLGSLFS

SEQ ID NO: 47408 - protein, 15 aa, Homo sapiens
RFNRWFLTGMTVAGV

SEQ ID NO: 47409 - protein, 9 aa, Homo sapiens
FLTGMTVAG

SEQ ID NO: 47410 - protein, 15 aa, Homo sapiens
FNRWFLTGMTVAGVV

SEQ ID NO: 47411 - protein, 9 aa, Homo sapiens
FLTGMTVAG

SEQ ID NO: 47412 - protein, 15 aa, Homo sapiens
NRWFLTGMTVAGVVL

SEQ ID NO: 47413 - protein, 9 aa, Homo sapiens
FLTGMTVAG

SEQ ID NO: 47414 - protein, 15 aa, Homo sapiens
ERFNRWFLTGMTVAG

SEQ ID NO: 47415 - protein, 9 aa, Homo sapiens
WFLTGMTVA

SEQ ID NO: 47416 - protein, 15 aa, Homo sapiens
AWMATYLNDHLEPWI

SEQ ID NO: 47417 - protein, 9 aa, Homo sapiens
WMATYLNDH

SEQ ID NO: 47418 - protein, 15 aa, Homo sapiens
RWFLTGMTVAGVVLL

SEQ ID NO: 47419 - protein, 9 aa, Homo sapiens
FLTGMTVAG

SEQ ID NO: 47420 - protein, 15 aa, Homo sapiens
DTFVELYGNNAAAES

SEQ ID NO: 47421 - protein, 9 aa, Homo sapiens
FVELYGNNA

SEQ ID NO: 47422 - protein, 15 aa, Homo sapiens
GWDTFVELYGNNAAA

SEQ ID NO: 47423 - protein, 9 aa, Homo sapiens
FVELYGNNA

SEQ ID NO: 47424 - protein, 15 aa, Homo sapiens
WMATYLNDHLEPWIQ

SEQ ID NO: 47425 - protein, 9 aa, Homo sapiens
WMATYLNDH

SEQ ID NO: 47426 - protein, 15 aa, Homo sapiens
WDTFVELYGNNAAAE

SEQ ID NO: 47427 - protein, 9 aa, Homo sapiens
FVELYGNNA

SEQ ID NO: 47428 - protein, 15 aa, Homo sapiens
GGWDTFVELYGNNAA

SEQ ID NO: 47429 - protein, 9 aa, Homo sapiens
FVELYGNNA

SEQ ID NO: 47430 - protein, 15 aa, Homo sapiens
NGGWDTFVELYGNNA

SEQ ID NO: 47431 - protein, 9 aa, Homo sapiens
GWDTFVELY

SEQ ID NO: 47432 - protein, 15 aa, Homo sapiens
TAYQSFEQVVNELFR

SEQ ID NO: 47433 - protein, 9 aa, Homo sapiens
YQSFEQVVN

SEQ ID NO: 47434 - protein, 15 aa, Homo sapiens
GTAYQSFEQVVNELF

SEQ ID NO: 47435 - protein, 9 aa, Homo sapiens
YQSFEQVVN

SEQ ID NO: 47436 - protein, 15 aa, Homo sapiens
TPGTAYQSFEQVVNE

SEQ ID NO: 47437 - protein, 9 aa, Homo sapiens
YQSFEQVVN

SEQ ID NO: 47438 - protein, 15 aa, Homo sapiens
PGTAYQSFEQVVNEL

SEQ ID NO: 47439 - protein, 9 aa, Homo sapiens
YQSFEQVVN

SEQ ID NO: 47440 - protein, 15 aa, Homo sapiens
ITPGTAYQSFEQVVN

SEQ ID NO: 47441 - protein, 9 aa, Homo sapiens
AYQSFEQVV

SEQ ID NO: 47442 - protein, 15 aa, Homo sapiens
VSRIAAWMATYLNDH

SEQ ID NO: 47443 - protein, 9 aa, Homo sapiens
AAWMATYLN

SEQ ID NO: 47444 - protein, 15 aa, Homo sapiens
LVSRIAAWMATYLND

SEQ ID NO: 47445 - protein, 9 aa, Homo sapiens
AAWMATYLN

SEQ ID NO: 47446 - protein, 15 aa, Homo sapiens
VLVSRIAAWMATYLN

SEQ ID NO: 47447 - protein, 9 aa, Homo sapiens
IAAWMATYL

SEQ ID NO: 47448 - protein, 15 aa, Homo sapiens
SRIAAWMATYLNDHL

SEQ ID NO: 47449 - protein, 9 aa, Homo sapiens
AAWMATYLN

SEQ ID NO: 47450 - protein, 15 aa, Homo sapiens
LRYRRAFSDLTSQLH

SEQ ID NO: 47451 - protein, 9 aa, Homo sapiens
YRRAFSDLT

SEQ ID NO: 47452 - protein, 15 aa, Homo sapiens
FELRYRRAFSDLTSQ

SEQ ID NO: 47453 - protein, 9 aa, Homo sapiens
YRRAFSDLT

SEQ ID NO: 47454 - protein, 15 aa, Homo sapiens
EFELRYRRAFSDLTS

SEQ ID NO: 47455 - protein, 9 aa, Homo sapiens
YRRAFSDLT

SEQ ID NO: 47456 - protein, 15 aa, Homo sapiens
RIAAWMATYLNDHLE

SEQ ID NO: 47457 - protein, 9 aa, Homo sapiens
AAWMATYLN

SEQ ID NO: 47458 - protein, 15 aa, Homo sapiens
AYQSFEQVVNELFRD

SEQ ID NO: 47459 - protein, 9 aa, Homo sapiens
YQSFEQVVN

SEQ ID NO: 47460 - protein, 15 aa, Homo sapiens
YQSFEQVVNELFRDG

SEQ ID NO: 47461 - protein, 9 aa, Homo sapiens
YQSFEQVVN

SEQ ID NO: 47462 - protein, 15 aa, Homo sapiens
ELRYRRAFSDLTSQL

SEQ ID NO: 47463 - protein, 9 aa, Homo sapiens
YRRAFSDLT

SEQ ID NO: 47464 - protein, 15 aa, Homo sapiens
SQKGYSWSQFSDVEE

SEQ ID NO: 47465 - protein, 9 aa, Homo sapiens
GYSWSQFSD

SEQ ID NO: 47466 - protein, 15 aa, Homo sapiens
DEFELRYRRAFSDLT

SEQ ID NO: 47467 - protein, 9 aa, Homo sapiens
LRYRRAFSD

SEQ ID NO: 47468 - protein, 15 aa, Homo sapiens
QKGYSWSQFSDVEEN

SEQ ID NO: 47469 - protein, 9 aa, Homo sapiens
WSQFSDVEE

SEQ ID NO: 47470 - protein, 15 aa, Homo sapiens
RYRRAFSDLTSQLHI

SEQ ID NO: 47471 - protein, 9 aa, Homo sapiens
YRRAFSDLT

SEQ ID NO: 47472 - protein, 15 aa, Homo sapiens
KGYSWSQFSDVEENR

SEQ ID NO: 47473 - protein, 9 aa, Homo sapiens
WSQFSDVEE

SEQ ID NO: 47474 - protein, 15 aa, Homo sapiens
IAAWMATYLNDHLEP

SEQ ID NO: 47475 - protein, 9 aa, Homo sapiens
AAWMATYLN

SEQ ID NO: 47476 - protein, 15 aa, Homo sapiens
GYSWSQFSDVEENRT

SEQ ID NO: 47477 - protein, 9 aa, Homo sapiens
WSQFSDVEE

SEQ ID NO: 47478 - protein, 15 aa, Homo sapiens
KEMQVLVSRIAAWMA

SEQ ID NO: 47479 - protein, 9 aa, Homo sapiens
VLVSRIAAW

SEQ ID NO: 47480 - protein, 15 aa, Homo sapiens
MQVLVSRIAAWMATY

SEQ ID NO: 47481 - protein, 9 aa, Homo sapiens
VLVSRIAAW

SEQ ID NO: 47482 - protein, 15 aa, Homo sapiens
EMQVLVSRIAAWMAT

SEQ ID NO: 47483 - protein, 9 aa, Homo sapiens
VLVSRIAAW

SEQ ID NO: 47484 - protein, 15 aa, Homo sapiens
DKEMQVLVSRIAAWM

SEQ ID NO: 47485 - protein, 9 aa, Homo sapiens
VLVSRIAAW

SEQ ID NO: 47486 - protein, 15 aa, Homo sapiens
QVLVSRIAAWMATYL

SEQ ID NO: 47487 - protein, 9 aa, Homo sapiens
VLVSRIAAW

SEQ ID NO: 47488 - protein, 15 aa, Homo sapiens
ETPSAINGNPSWHLA

SEQ ID NO: 47489 - protein, 9 aa, Homo sapiens
INGNPSWHL

SEQ ID NO: 47490 - protein, 15 aa, Homo sapiens
METPSAINGNPSWHL

SEQ ID NO: 47491 - protein, 9 aa, Homo sapiens
AINGNPSWH

SEQ ID NO: 47492 - protein, 15 aa, Homo sapiens
VDKEMQVLVSRIAAW

SEQ ID NO: 47493 - protein, 9 aa, Homo sapiens
MQVLVSRIA

SEQ ID NO: 47494 - protein, 15 aa, Homo sapiens
TPSAINGNPSWHLAD

SEQ ID NO: 47495 - protein, 9 aa, Homo sapiens
INGNPSWHL

SEQ ID NO: 47496 - protein, 15 aa, Homo sapiens
PSAINGNPSWHLADS

SEQ ID NO: 47497 - protein, 9 aa, Homo sapiens
INGNPSWHL

SEQ ID NO: 47498 - protein, 15 aa, Homo sapiens
VLVSRIAAWMATYLN

SEQ ID NO: 47499 - protein, 9 aa, Homo sapiens
VLVSRIAAW

SEQ ID NO: 47500 - protein, 15 aa, Homo sapiens
SAINGNPSWHLADSP

SEQ ID NO: 47501 - protein, 9 aa, Homo sapiens
INGNPSWHL

SEQ ID NO: 47502 - protein, 15 aa, Homo sapiens
LRYRRAFSDLTSQLH

SEQ ID NO: 47503 - protein, 9 aa, Homo sapiens
YRRAFSDLT

SEQ ID NO: 47504 - protein, 15 aa, Homo sapiens
RYRRAFSDLTSQLHI

SEQ ID NO: 47505 - protein, 9 aa, Homo sapiens
FSDLTSQLH

SEQ ID NO: 47506 - protein, 15 aa, Homo sapiens
YRRAFSDLTSQLHIT

SEQ ID NO: 47507 - protein, 9 aa, Homo sapiens
FSDLTSQLH

SEQ ID NO: 47508 - protein, 15 aa, Homo sapiens
INGNPSWHLADSPAV

SEQ ID NO: 47509 - protein, 9 aa, Homo sapiens
INGNPSWHL

SEQ ID NO: 47510 - protein, 15 aa, Homo sapiens
PSWHLADSPAVNGAT

SEQ ID NO: 47511 - protein, 9 aa, Homo sapiens
WHLADSPAV

SEQ ID NO: 47512 - protein, 15 aa, Homo sapiens
NPSWHLADSPAVNGA

SEQ ID NO: 47513 - protein, 9 aa, Homo sapiens
WHLADSPAV

SEQ ID NO: 47514 - protein, 15 aa, Homo sapiens
GNPSWHLADSPAVNG

SEQ ID NO: 47515 - protein, 9 aa, Homo sapiens
WHLADSPAV

SEQ ID NO: 47516 - protein, 15 aa, Homo sapiens
INGNPSWHLADSPAV

SEQ ID NO: 47517 - protein, 9 aa, Homo sapiens
SWHLADSPA

SEQ ID NO: 47518 - protein, 15 aa, Homo sapiens
NGNPSWHLADSPAVN

SEQ ID NO: 47519 - protein, 9 aa, Homo sapiens
WHLADSPAV

SEQ ID NO: 47520 - protein, 15 aa, Homo sapiens
SWHLADSPAVNGATG

SEQ ID NO: 47521 - protein, 9 aa, Homo sapiens
WHLADSPAV

SEQ ID NO: 47522 - protein, 15 aa, Homo sapiens
WHLADSPAVNGATGH

SEQ ID NO: 47523 - protein, 9 aa, Homo sapiens
WHLADSPAV

SEQ ID NO: 47524 - protein, 15 aa, Homo sapiens
RWFLTGMTVAGVVLL

SEQ ID NO: 47525 - protein, 9 aa, Homo sapiens
FLTGMTVAG

SEQ ID NO: 47526 - protein, 15 aa, Homo sapiens
WFLTGMTVAGVVLLG

SEQ ID NO: 47527 - protein, 9 aa, Homo sapiens
MTVAGVVLL

SEQ ID NO: 47528 - protein, 15 aa, Homo sapiens
FLTGMTVAGVVLLGS

SEQ ID NO: 47529 - protein, 9 aa, Homo sapiens
MTVAGVVLL

SEQ ID NO: 47530 - protein, 15 aa, Homo sapiens
KEMQVLVSRIAAWMA

SEQ ID NO: 47531 - protein, 9 aa, Homo sapiens
MQVLVSRIA

SEQ ID NO: 47532 - protein, 15 aa, Homo sapiens
FRDGVNWGRIVAFFS

SEQ ID NO: 47533 - protein, 9 aa, Homo sapiens
GVNWGRIVA

SEQ ID NO: 47534 - protein, 15 aa, Homo sapiens
DKEMQVLVSRIAAWM

SEQ ID NO: 47535 - protein, 9 aa, Homo sapiens
MQVLVSRIA

SEQ ID NO: 47536 - protein, 15 aa, Homo sapiens
VDKEMQVLVSRIAAW

SEQ ID NO: 47537 - protein, 9 aa, Homo sapiens
MQVLVSRIA

SEQ ID NO: 47538 - protein, 15 aa, Homo sapiens
RDGVNWGRIVAFFSF

SEQ ID NO: 47539 - protein, 9 aa, Homo sapiens
GVNWGRIVA

SEQ ID NO: 47540 - protein, 15 aa, Homo sapiens
SVDKEMQVLVSRIAA

SEQ ID NO: 47541 - protein, 9 aa, Homo sapiens
MQVLVSRIA

SEQ ID NO: 47542 - protein, 15 aa, Homo sapiens
MTVAGVVLLGSLFSR

SEQ ID NO: 47543 - protein, 9 aa, Homo sapiens
VVLLGSLFS

SEQ ID NO: 47544 - protein, 15 aa, Homo sapiens
TGMTVAGVVLLGSLF

SEQ ID NO: 47545 - protein, 9 aa, Homo sapiens
MTVAGVVLL

SEQ ID NO: 47546 - protein, 15 aa, Homo sapiens
FLTGMTVAGVVLLGS

SEQ ID NO: 47547 - protein, 9 aa, Homo sapiens
MTVAGVVLL

SEQ ID NO: 47548 - protein, 15 aa, Homo sapiens
GMTVAGVVLLGSLFS

SEQ ID NO: 47549 - protein, 9 aa, Homo sapiens
MTVAGVVLL

SEQ ID NO: 47550 - protein, 15 aa, Homo sapiens
RWFLTGMTVAGVVLL

SEQ ID NO: 47551 - protein, 9 aa, Homo sapiens
FLTGMTVAG

SEQ ID NO: 47552 - protein, 15 aa, Homo sapiens
LTGMTVAGVVLLGSL

SEQ ID NO: 47553 - protein, 9 aa, Homo sapiens
MTVAGVVLL

SEQ ID NO: 47554 - protein, 15 aa, Homo sapiens
WFLTGMTVAGVVLLG

SEQ ID NO: 47555 - protein, 9 aa, Homo sapiens
MTVAGVVLL

SEQ ID NO: 47556 - protein, 15 aa, Homo sapiens
DTFVELYGNNAAAES

SEQ ID NO: 47557 - protein, 9 aa, Homo sapiens
VELYGNNAA

SEQ ID NO: 47558 - protein, 15 aa, Homo sapiens
TFVELYGNNAAAESR

SEQ ID NO: 47559 - protein, 9 aa, Homo sapiens
YGNNAAAES

SEQ ID NO: 47560 - protein, 15 aa, Homo sapiens
FVELYGNNAAAESRK

SEQ ID NO: 47561 - protein, 9 aa, Homo sapiens
YGNNAAAES

SEQ ID NO: 47562 - protein, 15 aa, Homo sapiens
VELYGNNAAAESRKG

SEQ ID NO: 47563 - protein, 9 aa, Homo sapiens
YGNNAAAES

SEQ ID NO: 47564 - protein, 15 aa, Homo sapiens
TVAGVVLLGSLFSRK

SEQ ID NO: 47565 - protein, 9 aa, Homo sapiens
VVLLGSLFS

SEQ ID NO: 47566 - protein, 15 aa, Homo sapiens
ELYGNNAAAESRKGQ

SEQ ID NO: 47567 - protein, 9 aa, Homo sapiens
YGNNAAAES

SEQ ID NO: 47568 - protein, 15 aa, Homo sapiens
TVAGVVLLGSLFSRK

SEQ ID NO: 47569 - protein, 9 aa, Homo sapiens
VLLGSLFSR

SEQ ID NO: 47570 - protein, 15 aa, Homo sapiens
MTVAGVVLLGSLFSR

SEQ ID NO: 47571 - protein, 9 aa, Homo sapiens
VVLLGSLFS

SEQ ID NO: 47572 - protein, 15 aa, Homo sapiens
RELVVDFLSYKLSQK

SEQ ID NO: 47573 - protein, 9 aa, Homo sapiens
LVVDFLSYK

SEQ ID NO: 47574 - protein, 15 aa, Homo sapiens
ELVVDFLSYKLSQKG

SEQ ID NO: 47575 - protein, 9 aa, Homo sapiens
FLSYKLSQK

SEQ ID NO: 47576 - protein, 15 aa, Homo sapiens
KEMQVLVSRIAAWMA

SEQ ID NO: 47577 - protein, 9 aa, Homo sapiens
MQVLVSRIA

SEQ ID NO: 47578 - protein, 15 aa, Homo sapiens
DKEMQVLVSRIAAWM

SEQ ID NO: 47579 - protein, 9 aa, Homo sapiens
MQVLVSRIA

SEQ ID NO: 47580 - protein, 15 aa, Homo sapiens
RFNRWFLTGMTVAGV

SEQ ID NO: 47581 - protein, 9 aa, Homo sapiens
FNRWFLTGM

SEQ ID NO: 47582 - protein, 15 aa, Homo sapiens
SRIAAWMATYLNDHL

SEQ ID NO: 47583 - protein, 9 aa, Homo sapiens
WMATYLNDH

SEQ ID NO: 47584 - protein, 15 aa, Homo sapiens
FNRWFLTGMTVAGVV

SEQ ID NO: 47585 - protein, 9 aa, Homo sapiens
LTGMTVAGV

SEQ ID NO: 47586 - protein, 15 aa, Homo sapiens
LVVDFLSYKLSQKGY

SEQ ID NO: 47587 - protein, 9 aa, Homo sapiens
FLSYKLSQK

SEQ ID NO: 47588 - protein, 15 aa, Homo sapiens
NRELVVDFLSYKLSQ

SEQ ID NO: 47589 - protein, 9 aa, Homo sapiens
LVVDFLSYK

SEQ ID NO: 47590 - protein, 15 aa, Homo sapiens
VNWGRIVAFFSFGGA

SEQ ID NO: 47591 - protein, 9 aa, Homo sapiens
IVAFFSFGG

SEQ ID NO: 47592 - protein, 15 aa, Homo sapiens
SNRELVVDFLSYKLS

SEQ ID NO: 47593 - protein, 9 aa, Homo sapiens
LVVDFLSYK

SEQ ID NO: 47594 - protein, 15 aa, Homo sapiens
MQVLVSRIAAWMATY

SEQ ID NO: 47595 - protein, 9 aa, Homo sapiens
LVSRIAAWM

SEQ ID NO: 47596 - protein, 15 aa, Homo sapiens
VSRIAAWMATYLNDH

SEQ ID NO: 47597 - protein, 9 aa, Homo sapiens
IAAWMATYL

SEQ ID NO: 47598 - protein, 15 aa, Homo sapiens
EMQVLVSRIAAWMAT

SEQ ID NO: 47599 - protein, 9 aa, Homo sapiens
VLVSRIAAW

SEQ ID NO: 47600 - protein, 15 aa, Homo sapiens
RIAAWMATYLNDHLE

SEQ ID NO: 47601 - protein, 9 aa, Homo sapiens
WMATYLNDH

SEQ ID NO: 47602 - protein, 15 aa, Homo sapiens
NELFRDGVNWGRIVA

SEQ ID NO: 47603 - protein, 9 aa, Homo sapiens
LFRDGVNWG

SEQ ID NO: 47604 - protein, 15 aa, Homo sapiens
QVVNELFRDGVNWGR

SEQ ID NO: 47605 - protein, 9 aa, Homo sapiens
LFRDGVNWG

SEQ ID NO: 47606 - protein, 15 aa, Homo sapiens
VVNELFRDGVNWGRI

SEQ ID NO: 47607 - protein, 9 aa, Homo sapiens
LFRDGVNWG

SEQ ID NO: 47608 - protein, 15 aa, Homo sapiens
IAAWMATYLNDHLEP

SEQ ID NO: 47609 - protein, 9 aa, Homo sapiens
WMATYLNDH

SEQ ID NO: 47610 - protein, 15 aa, Homo sapiens
WGRIVAFFSFGGALC

SEQ ID NO: 47611 - protein, 9 aa, Homo sapiens
IVAFFSFGG

SEQ ID NO: 47612 - protein, 15 aa, Homo sapiens
NWGRIVAFFSFGGAL

SEQ ID NO: 47613 - protein, 9 aa, Homo sapiens
IVAFFSFGG

SEQ ID NO: 47614 - protein, 15 aa, Homo sapiens
QERFNRWFLTGMTVA

SEQ ID NO: 47615 - protein, 9 aa, Homo sapiens
FNRWFLTGM

SEQ ID NO: 47616 - protein, 15 aa, Homo sapiens
ERFNRWFLTGMTVAG

SEQ ID NO: 47617 - protein, 9 aa, Homo sapiens
FNRWFLTGM

SEQ ID NO: 47618 - protein, 15 aa, Homo sapiens
GRIVAFFSFGGALCV

SEQ ID NO: 47619 - protein, 9 aa, Homo sapiens
IVAFFSFGG

SEQ ID NO: 47620 - protein, 15 aa, Homo sapiens
VVDFLSYKLSQKGYS

SEQ ID NO: 47621 - protein, 9 aa, Homo sapiens
FLSYKLSQK

SEQ ID NO: 47622 - protein, 15 aa, Homo sapiens
VDKEMQVLVSRIAAW

SEQ ID NO: 47623 - protein, 9 aa, Homo sapiens
MQVLVSRIA

SEQ ID NO: 47624 - protein, 15 aa, Homo sapiens
AAWMATYLNDHLEPW

SEQ ID NO: 47625 - protein, 9 aa, Homo sapiens
WMATYLNDH

SEQ ID NO: 47626 - protein, 15 aa, Homo sapiens
QSNRELVVDFLSYKL

SEQ ID NO: 47627 - protein, 9 aa, Homo sapiens
LVVDFLSYK

SEQ ID NO: 47628 - protein, 15 aa, Homo sapiens
VNELFRDGVNWGRIV

SEQ ID NO: 47629 - protein, 9 aa, Homo sapiens
LFRDGVNWG

SEQ ID NO: 47630 - protein, 15 aa, Homo sapiens
GVNWGRIVAFFSFGG

SEQ ID NO: 47631 - protein, 9 aa, Homo sapiens
VNWGRIVAF

SEQ ID NO: 47632 - protein, 15 aa, Homo sapiens
ELFRDGVNWGRIVAF

SEQ ID NO: 47633 - protein, 9 aa, Homo sapiens
LFRDGVNWG

SEQ ID NO: 47634 - protein, 15 aa, Homo sapiens
GMTVAGVVLLGSLFS

SEQ ID NO: 47635 - protein, 9 aa, Homo sapiens
VAGVVLLGS

SEQ ID NO: 47636 - protein, 15 aa, Homo sapiens
EQVVNELFRDGVNWG

SEQ ID NO: 47637 - protein, 9 aa, Homo sapiens
VVNELFRDG

SEQ ID NO: 47638 - protein, 15 aa, Homo sapiens
RIVAFFSFGGALCVE

SEQ ID NO: 47639 - protein, 9 aa, Homo sapiens
IVAFFSFGG

SEQ ID NO: 47640 - protein, 15 aa, Homo sapiens
NRWFLTGMTVAGVVL

SEQ ID NO: 47641 - protein, 9 aa, Homo sapiens
LTGMTVAGV

SEQ ID NO: 47642 - protein, 15 aa, Homo sapiens
LRYRRAFSDLTSQLH

SEQ ID NO: 47643 - protein, 9 aa, Homo sapiens
YRRAFSDLT

SEQ ID NO: 47644 - protein, 15 aa, Homo sapiens
RYRRAFSDLTSQLHI

SEQ ID NO: 47645 - protein, 9 aa, Homo sapiens
FSDLTSQLH

SEQ ID NO: 47646 - protein, 8 aa, Homo sapiens
MGAPTLPP

SEQ ID NO: 47647 - protein, 8 aa, Homo sapiens
GAPTLPPA

SEQ ID NO: 47648 - protein, 8 aa, Homo sapiens
APTLPPAW

SEQ ID NO: 47649 - protein, 8 aa, Homo sapiens
PTLPPAWQ

SEQ ID NO: 47650 - protein, 8 aa, Homo sapiens
TLPPAWQP

SEQ ID NO: 47651 - protein, 8 aa, Homo sapiens
LPPAWQPF

SEQ ID NO: 47652 - protein, 8 aa, Homo sapiens
PPAWQPFL

SEQ ID NO: 47653 - protein, 8 aa, Homo sapiens
PAWQPFLK

SEQ ID NO: 47654 - protein, 8 aa, Homo sapiens
AWQPFLKD

SEQ ID NO: 47655 - protein, 8 aa, Homo sapiens
WQPFLKDH

SEQ ID NO: 47656 - protein, 8 aa, Homo sapiens
QPFLKDHR

SEQ ID NO: 47657 - protein, 8 aa, Homo sapiens
PFLKDHRI

SEQ ID NO: 47658 - protein, 8 aa, Homo sapiens
FLKDHRIS

SEQ ID NO: 47659 - protein, 8 aa, Homo sapiens
LKDHRIST

SEQ ID NO: 47660 - protein, 8 aa, Homo sapiens
KDHRISTF

SEQ ID NO: 47661 - protein, 8 aa, Homo sapiens
DHRISTFK

SEQ ID NO: 47662 - protein, 8 aa, Homo sapiens
HRISTFKN

SEQ ID NO: 47663 - protein, 8 aa, Homo sapiens
RISTFKNW

SEQ ID NO: 47664 - protein, 8 aa, Homo sapiens
ISTFKNWP

SEQ ID NO: 47665 - protein, 8 aa, Homo sapiens
STFKNWPF

SEQ ID NO: 47666 - protein, 8 aa, Homo sapiens
TFKNWPFL

SEQ ID NO: 47667 - protein, 8 aa, Homo sapiens
FKNWPFLE

SEQ ID NO: 47668 - protein, 8 aa, Homo sapiens
KNWPFLEG

SEQ ID NO: 47669 - protein, 8 aa, Homo sapiens
NWPFLEGC

SEQ ID NO: 47670 - protein, 8 aa, Homo sapiens
WPFLEGCA

SEQ ID NO: 47671 - protein, 8 aa, Homo sapiens
PFLEGCAC

SEQ ID NO: 47672 - protein, 8 aa, Homo sapiens
FLEGCACT

SEQ ID NO: 47673 - protein, 8 aa, Homo sapiens
LEGCACTP

SEQ ID NO: 47674 - protein, 8 aa, Homo sapiens
EGCACTPE

SEQ ID NO: 47675 - protein, 8 aa, Homo sapiens
GCACTPER

SEQ ID NO: 47676 - protein, 8 aa, Homo sapiens
CACTPERM

SEQ ID NO: 47677 - protein, 8 aa, Homo sapiens
ACTPERMA

SEQ ID NO: 47678 - protein, 8 aa, Homo sapiens
CTPERMAE

SEQ ID NO: 47679 - protein, 8 aa, Homo sapiens
TPERMAEA

SEQ ID NO: 47680 - protein, 8 aa, Homo sapiens
PERMAEAG

SEQ ID NO: 47681 - protein, 8 aa, Homo sapiens
ERMAEAGF

SEQ ID NO: 47682 - protein, 8 aa, Homo sapiens
RMAEAGFI

SEQ ID NO: 47683 - protein, 8 aa, Homo sapiens
MAEAGFIH

SEQ ID NO: 47684 - protein, 8 aa, Homo sapiens
AEAGFIHC

SEQ ID NO: 47685 - protein, 8 aa, Homo sapiens
EAGFIHCP

SEQ ID NO: 47686 - protein, 8 aa, Homo sapiens
AGFIHCPT

SEQ ID NO: 47687 - protein, 8 aa, Homo sapiens
GFIHCPTE

SEQ ID NO: 47688 - protein, 8 aa, Homo sapiens
FIHCPTEN

SEQ ID NO: 47689 - protein, 8 aa, Homo sapiens
IHCPTENE

SEQ ID NO: 47690 - protein, 8 aa, Homo sapiens
HCPTENEP

SEQ ID NO: 47691 - protein, 8 aa, Homo sapiens
CPTENEPD

SEQ ID NO: 47692 - protein, 8 aa, Homo sapiens
PTENEPDL

SEQ ID NO: 47693 - protein, 8 aa, Homo sapiens
TENEPDLA

SEQ ID NO: 47694 - protein, 8 aa, Homo sapiens
ENEPDLAQ

SEQ ID NO: 47695 - protein, 8 aa, Homo sapiens
NEPDLAQC

SEQ ID NO: 47696 - protein, 8 aa, Homo sapiens
EPDLAQCF

SEQ ID NO: 47697 - protein, 8 aa, Homo sapiens
PDLAQCFF

SEQ ID NO: 47698 - protein, 8 aa, Homo sapiens
DLAQCFFC

SEQ ID NO: 47699 - protein, 8 aa, Homo sapiens
LAQCFFCF

SEQ ID NO: 47700 - protein, 8 aa, Homo sapiens
AQCFFCFK

SEQ ID NO: 47701 - protein, 8 aa, Homo sapiens
QCFFCFKE

SEQ ID NO: 47702 - protein, 8 aa, Homo sapiens
CFFCFKEL

SEQ ID NO: 47703 - protein, 8 aa, Homo sapiens
FFCFKELE

SEQ ID NO: 47704 - protein, 8 aa, Homo sapiens
FCFKELEG

SEQ ID NO: 47705 - protein, 8 aa, Homo sapiens
CFKELEGW

SEQ ID NO: 47706 - protein, 8 aa, Homo sapiens
FKELEGWE

SEQ ID NO: 47707 - protein, 8 aa, Homo sapiens
KELEGWEP

SEQ ID NO: 47708 - protein, 8 aa, Homo sapiens
ELEGWEPD

SEQ ID NO: 47709 - protein, 8 aa, Homo sapiens
LEGWEPDD

SEQ ID NO: 47710 - protein, 8 aa, Homo sapiens
EGWEPDDD

SEQ ID NO: 47711 - protein, 8 aa, Homo sapiens
GWEPDDDP

SEQ ID NO: 47712 - protein, 8 aa, Homo sapiens
WEPDDDPI

SEQ ID NO: 47713 - protein, 8 aa, Homo sapiens
EPDDDPIE

SEQ ID NO: 47714 - protein, 8 aa, Homo sapiens
PDDDPIEE

SEQ ID NO: 47715 - protein, 8 aa, Homo sapiens
DDDPIEEH

SEQ ID NO: 47716 - protein, 8 aa, Homo sapiens
DDPIEEHK

SEQ ID NO: 47717 - protein, 8 aa, Homo sapiens
DPIEEHKK

SEQ ID NO: 47718 - protein, 8 aa, Homo sapiens
PIEEHKKH

SEQ ID NO: 47719 - protein, 8 aa, Homo sapiens
IEEHKKHS

SEQ ID NO: 47720 - protein, 8 aa, Homo sapiens
EEHKKHSS

SEQ ID NO: 47721 - protein, 8 aa, Homo sapiens
EHKKHSSG

SEQ ID NO: 47722 - protein, 8 aa, Homo sapiens
HKKHSSGC

SEQ ID NO: 47723 - protein, 8 aa, Homo sapiens
KKHSSGCA

SEQ ID NO: 47724 - protein, 8 aa, Homo sapiens
KHSSGCAF

SEQ ID NO: 47725 - protein, 8 aa, Homo sapiens
HSSGCAFL

SEQ ID NO: 47726 - protein, 8 aa, Homo sapiens
SSGCAFLS

SEQ ID NO: 47727 - protein, 8 aa, Homo sapiens
SGCAFLSV

SEQ ID NO: 47728 - protein, 8 aa, Homo sapiens
GCAFLSVK

SEQ ID NO: 47729 - protein, 8 aa, Homo sapiens
CAFLSVKK

SEQ ID NO: 47730 - protein, 8 aa, Homo sapiens
AFLSVKKQ

SEQ ID NO: 47731 - protein, 8 aa, Homo sapiens
FLSVKKQF

SEQ ID NO: 47732 - protein, 8 aa, Homo sapiens
LSVKKQFE

SEQ ID NO: 47733 - protein, 8 aa, Homo sapiens
SVKKQFEE

SEQ ID NO: 47734 - protein, 8 aa, Homo sapiens
VKKQFEEL

SEQ ID NO: 47735 - protein, 8 aa, Homo sapiens
KKQFEELT

SEQ ID NO: 47736 - protein, 8 aa, Homo sapiens
KQFEELTL

SEQ ID NO: 47737 - protein, 8 aa, Homo sapiens
QFEELTLG

SEQ ID NO: 47738 - protein, 8 aa, Homo sapiens
FEELTLGE

SEQ ID NO: 47739 - protein, 8 aa, Homo sapiens
EELTLGEF

SEQ ID NO: 47740 - protein, 8 aa, Homo sapiens
ELTLGEFL

SEQ ID NO: 47741 - protein, 8 aa, Homo sapiens
LTLGEFLK

SEQ ID NO: 47742 - protein, 8 aa, Homo sapiens
TLGEFLKL

SEQ ID NO: 47743 - protein, 8 aa, Homo sapiens
LGEFLKLD

SEQ ID NO: 47744 - protein, 8 aa, Homo sapiens
GEFLKLDR

SEQ ID NO: 47745 - protein, 8 aa, Homo sapiens
EFLKLDRE

SEQ ID NO: 47746 - protein, 8 aa, Homo sapiens
FLKLDRER

SEQ ID NO: 47747 - protein, 8 aa, Homo sapiens
LKLDRERA

SEQ ID NO: 47748 - protein, 8 aa, Homo sapiens
KLDRERAK

SEQ ID NO: 47749 - protein, 8 aa, Homo sapiens
LDRERAKN

SEQ ID NO: 47750 - protein, 8 aa, Homo sapiens
DRERAKNK

SEQ ID NO: 47751 - protein, 8 aa, Homo sapiens
RERAKNKI

SEQ ID NO: 47752 - protein, 8 aa, Homo sapiens
ERAKNKIA

SEQ ID NO: 47753 - protein, 8 aa, Homo sapiens
RAKNKIAK

SEQ ID NO: 47754 - protein, 8 aa, Homo sapiens
AKNKIAKE

SEQ ID NO: 47755 - protein, 8 aa, Homo sapiens
KNKIAKET

SEQ ID NO: 47756 - protein, 8 aa, Homo sapiens
NKIAKETN

SEQ ID NO: 47757 - protein, 8 aa, Homo sapiens
KIAKETNN

SEQ ID NO: 47758 - protein, 8 aa, Homo sapiens
IAKETNNK

SEQ ID NO: 47759 - protein, 8 aa, Homo sapiens
AKETNNKK

SEQ ID NO: 47760 - protein, 8 aa, Homo sapiens
KETNNKKK

SEQ ID NO: 47761 - protein, 8 aa, Homo sapiens
ETNNKKKE

SEQ ID NO: 47762 - protein, 8 aa, Homo sapiens
TNNKKKEF

SEQ ID NO: 47763 - protein, 8 aa, Homo sapiens
NNKKKEFE

SEQ ID NO: 47764 - protein, 8 aa, Homo sapiens
NKKKEFEE

SEQ ID NO: 47765 - protein, 8 aa, Homo sapiens
KKKEFEET

SEQ ID NO: 47766 - protein, 8 aa, Homo sapiens
KKEFEETA

SEQ ID NO: 47767 - protein, 8 aa, Homo sapiens
KEFEETAK

SEQ ID NO: 47768 - protein, 8 aa, Homo sapiens
EFEETAKK

SEQ ID NO: 47769 - protein, 8 aa, Homo sapiens
FEETAKKV

SEQ ID NO: 47770 - protein, 8 aa, Homo sapiens
EETAKKVR

SEQ ID NO: 47771 - protein, 8 aa, Homo sapiens
ETAKKVRR

SEQ ID NO: 47772 - protein, 8 aa, Homo sapiens
TAKKVRRA

SEQ ID NO: 47773 - protein, 8 aa, Homo sapiens
AKKVRRAI

SEQ ID NO: 47774 - protein, 8 aa, Homo sapiens
KKVRRAIE

SEQ ID NO: 47775 - protein, 8 aa, Homo sapiens
KVRRAIEQ

SEQ ID NO: 47776 - protein, 8 aa, Homo sapiens
VRRAIEQL

SEQ ID NO: 47777 - protein, 8 aa, Homo sapiens
RRAIEQLA

SEQ ID NO: 47778 - protein, 8 aa, Homo sapiens
RAIEQLAA

SEQ ID NO: 47779 - protein, 8 aa, Homo sapiens
AIEQLAAM

SEQ ID NO: 47780 - protein, 8 aa, Homo sapiens
IEQLAAMD

SEQ ID NO: 47781 - protein, 7 aa, Homo sapiens
EQLAAMD

SEQ ID NO: 47782 - protein, 9 aa, Homo sapiens
MGAPTLPPA

SEQ ID NO: 47783 - protein, 9 aa, Homo sapiens
GAPTLPPAW

SEQ ID NO: 47784 - protein, 9 aa, Homo sapiens
APTLPPAWQ

SEQ ID NO: 47785 - protein, 9 aa, Homo sapiens
PTLPPAWQP

SEQ ID NO: 47786 - protein, 9 aa, Homo sapiens
TLPPAWQPF

SEQ ID NO: 47787 - protein, 9 aa, Homo sapiens
LPPAWQPFL

SEQ ID NO: 47788 - protein, 9 aa, Homo sapiens
PPAWQPFLK

SEQ ID NO: 47789 - protein, 9 aa, Homo sapiens
PAWQPFLKD

SEQ ID NO: 47790 - protein, 9 aa, Homo sapiens
AWQPFLKDH

SEQ ID NO: 47791 - protein, 9 aa, Homo sapiens
WQPFLKDHR

SEQ ID NO: 47792 - protein, 9 aa, Homo sapiens
QPFLKDHRI

SEQ ID NO: 47793 - protein, 9 aa, Homo sapiens
PFLKDHRIS

SEQ ID NO: 47794 - protein, 9 aa, Homo sapiens
FLKDHRIST

SEQ ID NO: 47795 - protein, 9 aa, Homo sapiens
LKDHRISTF

SEQ ID NO: 47796 - protein, 9 aa, Homo sapiens
KDHRISTFK

SEQ ID NO: 47797 - protein, 9 aa, Homo sapiens
DHRISTFKN

SEQ ID NO: 47798 - protein, 9 aa, Homo sapiens
HRISTFKNW

SEQ ID NO: 47799 - protein, 9 aa, Homo sapiens
RISTFKNWP

SEQ ID NO: 47800 - protein, 9 aa, Homo sapiens
ISTFKNWPF

SEQ ID NO: 47801 - protein, 9 aa, Homo sapiens
STFKNWPFL

SEQ ID NO: 47802 - protein, 9 aa, Homo sapiens
TFKNWPFLE

SEQ ID NO: 47803 - protein, 9 aa, Homo sapiens
FKNWPFLEG

SEQ ID NO: 47804 - protein, 9 aa, Homo sapiens
KNWPFLEGC

SEQ ID NO: 47805 - protein, 9 aa, Homo sapiens
NWPFLEGCA

SEQ ID NO: 47806 - protein, 9 aa, Homo sapiens
WPFLEGCAC

SEQ ID NO: 47807 - protein, 9 aa, Homo sapiens
PFLEGCACT

SEQ ID NO: 47808 - protein, 9 aa, Homo sapiens
FLEGCACTP

SEQ ID NO: 47809 - protein, 9 aa, Homo sapiens
LEGCACTPE

SEQ ID NO: 47810 - protein, 9 aa, Homo sapiens
EGCACTPER

SEQ ID NO: 47811 - protein, 9 aa, Homo sapiens
GCACTPERM

SEQ ID NO: 47812 - protein, 9 aa, Homo sapiens
CACTPERMA

SEQ ID NO: 47813 - protein, 9 aa, Homo sapiens
ACTPERMAE

SEQ ID NO: 47814 - protein, 9 aa, Homo sapiens
CTPERMAEA

SEQ ID NO: 47815 - protein, 9 aa, Homo sapiens
TPERMAEAG

SEQ ID NO: 47816 - protein, 9 aa, Homo sapiens
PERMAEAGF

SEQ ID NO: 47817 - protein, 9 aa, Homo sapiens
ERMAEAGFI

SEQ ID NO: 47818 - protein, 9 aa, Homo sapiens
RMAEAGFIH

SEQ ID NO: 47819 - protein, 9 aa, Homo sapiens
MAEAGFIHC

SEQ ID NO: 47820 - protein, 9 aa, Homo sapiens
AEAGFIHCP

SEQ ID NO: 47821 - protein, 9 aa, Homo sapiens
EAGFIHCPT

SEQ ID NO: 47822 - protein, 9 aa, Homo sapiens
AGFIHCPTE

SEQ ID NO: 47823 - protein, 9 aa, Homo sapiens
GFIHCPTEN

SEQ ID NO: 47824 - protein, 9 aa, Homo sapiens
FIHCPTENE

SEQ ID NO: 47825 - protein, 9 aa, Homo sapiens
IHCPTENEP

SEQ ID NO: 47826 - protein, 9 aa, Homo sapiens
HCPTENEPD

SEQ ID NO: 47827 - protein, 9 aa, Homo sapiens
CPTENEPDL

SEQ ID NO: 47828 - protein, 9 aa, Homo sapiens
PTENEPDLA

SEQ ID NO: 47829 - protein, 9 aa, Homo sapiens
TENEPDLAQ

SEQ ID NO: 47830 - protein, 9 aa, Homo sapiens
ENEPDLAQC

SEQ ID NO: 47831 - protein, 9 aa, Homo sapiens
NEPDLAQCF

SEQ ID NO: 47832 - protein, 9 aa, Homo sapiens
EPDLAQCFF

SEQ ID NO: 47833 - protein, 9 aa, Homo sapiens
PDLAQCFFC

SEQ ID NO: 47834 - protein, 9 aa, Homo sapiens
DLAQCFFCF

SEQ ID NO: 47835 - protein, 9 aa, Homo sapiens
LAQCFFCFK

SEQ ID NO: 47836 - protein, 9 aa, Homo sapiens
AQCFFCFKE

SEQ ID NO: 47837 - protein, 9 aa, Homo sapiens
QCFFCFKEL

SEQ ID NO: 47838 - protein, 9 aa, Homo sapiens
CFFCFKELE

SEQ ID NO: 47839 - protein, 9 aa, Homo sapiens
FFCFKELEG

SEQ ID NO: 47840 - protein, 9 aa, Homo sapiens
FCFKELEGW

SEQ ID NO: 47841 - protein, 9 aa, Homo sapiens
CFKELEGWE

SEQ ID NO: 47842 - protein, 9 aa, Homo sapiens
FKELEGWEP

SEQ ID NO: 47843 - protein, 9 aa, Homo sapiens
KELEGWEPD

SEQ ID NO: 47844 - protein, 9 aa, Homo sapiens
ELEGWEPDD

SEQ ID NO: 47845 - protein, 9 aa, Homo sapiens
LEGWEPDDD

SEQ ID NO: 47846 - protein, 9 aa, Homo sapiens
EGWEPDDDP

SEQ ID NO: 47847 - protein, 9 aa, Homo sapiens
GWEPDDDPI

SEQ ID NO: 47848 - protein, 9 aa, Homo sapiens
WEPDDDPIE

SEQ ID NO: 47849 - protein, 9 aa, Homo sapiens
EPDDDPIEE

SEQ ID NO: 47850 - protein, 9 aa, Homo sapiens
PDDDPIEEH

SEQ ID NO: 47851 - protein, 9 aa, Homo sapiens
DDDPIEEHK

SEQ ID NO: 47852 - protein, 9 aa, Homo sapiens
DDPIEEHKK

SEQ ID NO: 47853 - protein, 9 aa, Homo sapiens
DPIEEHKKH

SEQ ID NO: 47854 - protein, 9 aa, Homo sapiens
PIEEHKKHS

SEQ ID NO: 47855 - protein, 9 aa, Homo sapiens
IEEHKKHSS

SEQ ID NO: 47856 - protein, 9 aa, Homo sapiens
EEHKKHSSG

SEQ ID NO: 47857 - protein, 9 aa, Homo sapiens
EHKKHSSGC

SEQ ID NO: 47858 - protein, 9 aa, Homo sapiens
HKKHSSGCA

SEQ ID NO: 47859 - protein, 9 aa, Homo sapiens
KKHSSGCAF

SEQ ID NO: 47860 - protein, 9 aa, Homo sapiens
KHSSGCAFL

SEQ ID NO: 47861 - protein, 9 aa, Homo sapiens
HSSGCAFLS

SEQ ID NO: 47862 - protein, 9 aa, Homo sapiens
SSGCAFLSV

SEQ ID NO: 47863 - protein, 9 aa, Homo sapiens
SGCAFLSVK

SEQ ID NO: 47864 - protein, 9 aa, Homo sapiens
GCAFLSVKK

SEQ ID NO: 47865 - protein, 9 aa, Homo sapiens
CAFLSVKKQ

SEQ ID NO: 47866 - protein, 9 aa, Homo sapiens
AFLSVKKQF

SEQ ID NO: 47867 - protein, 9 aa, Homo sapiens
FLSVKKQFE

SEQ ID NO: 47868 - protein, 9 aa, Homo sapiens
LSVKKQFEE

SEQ ID NO: 47869 - protein, 9 aa, Homo sapiens
SVKKQFEEL

SEQ ID NO: 47870 - protein, 9 aa, Homo sapiens
VKKQFEELT

SEQ ID NO: 47871 - protein, 9 aa, Homo sapiens
KKQFEELTL

SEQ ID NO: 47872 - protein, 9 aa, Homo sapiens
KQFEELTLG

SEQ ID NO: 47873 - protein, 9 aa, Homo sapiens
QFEELTLGE

SEQ ID NO: 47874 - protein, 9 aa, Homo sapiens
FEELTLGEF

SEQ ID NO: 47875 - protein, 9 aa, Homo sapiens
EELTLGEFL

SEQ ID NO: 47876 - protein, 9 aa, Homo sapiens
ELTLGEFLK

SEQ ID NO: 47877 - protein, 9 aa, Homo sapiens
LTLGEFLKL

SEQ ID NO: 47878 - protein, 9 aa, Homo sapiens
TLGEFLKLD

SEQ ID NO: 47879 - protein, 9 aa, Homo sapiens
LGEFLKLDR

SEQ ID NO: 47880 - protein, 9 aa, Homo sapiens
GEFLKLDRE

SEQ ID NO: 47881 - protein, 9 aa, Homo sapiens
EFLKLDRER

SEQ ID NO: 47882 - protein, 9 aa, Homo sapiens
FLKLDRERA

SEQ ID NO: 47883 - protein, 9 aa, Homo sapiens
LKLDRERAK

SEQ ID NO: 47884 - protein, 9 aa, Homo sapiens
KLDRERAKN

SEQ ID NO: 47885 - protein, 9 aa, Homo sapiens
LDRERAKNK

SEQ ID NO: 47886 - protein, 9 aa, Homo sapiens
DRERAKNKI

SEQ ID NO: 47887 - protein, 9 aa, Homo sapiens
RERAKNKIA

SEQ ID NO: 47888 - protein, 9 aa, Homo sapiens
ERAKNKIAK

SEQ ID NO: 47889 - protein, 9 aa, Homo sapiens
RAKNKIAKE

SEQ ID NO: 47890 - protein, 9 aa, Homo sapiens
AKNKIAKET

SEQ ID NO: 47891 - protein, 9 aa, Homo sapiens
KNKIAKETN

SEQ ID NO: 47892 - protein, 9 aa, Homo sapiens
NKIAKETNN

SEQ ID NO: 47893 - protein, 9 aa, Homo sapiens
KIAKETNNK

SEQ ID NO: 47894 - protein, 9 aa, Homo sapiens
IAKETNNKK

SEQ ID NO: 47895 - protein, 9 aa, Homo sapiens
AKETNNKKK

SEQ ID NO: 47896 - protein, 9 aa, Homo sapiens
KETNNKKKE

SEQ ID NO: 47897 - protein, 9 aa, Homo sapiens
ETNNKKKEF

SEQ ID NO: 47898 - protein, 9 aa, Homo sapiens
TNNKKKEFE

SEQ ID NO: 47899 - protein, 9 aa, Homo sapiens
NNKKKEFEE

SEQ ID NO: 47900 - protein, 9 aa, Homo sapiens
NKKKEFEET

SEQ ID NO: 47901 - protein, 9 aa, Homo sapiens
KKKEFEETA

SEQ ID NO: 47902 - protein, 9 aa, Homo sapiens
KKEFEETAK

SEQ ID NO: 47903 - protein, 9 aa, Homo sapiens
KEFEETAKK

SEQ ID NO: 47904 - protein, 9 aa, Homo sapiens
EFEETAKKV

SEQ ID NO: 47905 - protein, 9 aa, Homo sapiens
FEETAKKVR

SEQ ID NO: 47906 - protein, 9 aa, Homo sapiens
EETAKKVRR

SEQ ID NO: 47907 - protein, 9 aa, Homo sapiens
ETAKKVRRA

SEQ ID NO: 47908 - protein, 9 aa, Homo sapiens
TAKKVRRAI

SEQ ID NO: 47909 - protein, 9 aa, Homo sapiens
AKKVRRAIE

SEQ ID NO: 47910 - protein, 9 aa, Homo sapiens
KKVRRAIEQ

SEQ ID NO: 47911 - protein, 9 aa, Homo sapiens
KVRRAIEQL

SEQ ID NO: 47912 - protein, 9 aa, Homo sapiens
VRRAIEQLA

SEQ ID NO: 47913 - protein, 9 aa, Homo sapiens
RRAIEQLAA

SEQ ID NO: 47914 - protein, 9 aa, Homo sapiens
RAIEQLAAM

SEQ ID NO: 47915 - protein, 9 aa, Homo sapiens
AIEQLAAMD

SEQ ID NO: 47916 - protein, 10 aa, Homo sapiens
MGAPTLPPAW

SEQ ID NO: 47917 - protein, 10 aa, Homo sapiens
GAPTLPPAWQ

SEQ ID NO: 47918 - protein, 10 aa, Homo sapiens
APTLPPAWQP

SEQ ID NO: 47919 - protein, 10 aa, Homo sapiens
PTLPPAWQPF

SEQ ID NO: 47920 - protein, 10 aa, Homo sapiens
TLPPAWQPFL

SEQ ID NO: 47921 - protein, 10 aa, Homo sapiens
LPPAWQPFLK

SEQ ID NO: 47922 - protein, 10 aa, Homo sapiens
PPAWQPFLKD

SEQ ID NO: 47923 - protein, 10 aa, Homo sapiens
PAWQPFLKDH

SEQ ID NO: 47924 - protein, 10 aa, Homo sapiens
AWQPFLKDHR

SEQ ID NO: 47925 - protein, 10 aa, Homo sapiens
WQPFLKDHRI

SEQ ID NO: 47926 - protein, 10 aa, Homo sapiens
QPFLKDHRIS

SEQ ID NO: 47927 - protein, 10 aa, Homo sapiens
PFLKDHRIST

SEQ ID NO: 47928 - protein, 10 aa, Homo sapiens
FLKDHRISTF

SEQ ID NO: 47929 - protein, 10 aa, Homo sapiens
LKDHRISTFK

SEQ ID NO: 47930 - protein, 10 aa, Homo sapiens
KDHRISTFKN

SEQ ID NO: 47931 - protein, 10 aa, Homo sapiens
DHRISTFKNW

SEQ ID NO: 47932 - protein, 10 aa, Homo sapiens
HRISTFKNWP

SEQ ID NO: 47933 - protein, 10 aa, Homo sapiens
RISTFKNWPF

SEQ ID NO: 47934 - protein, 10 aa, Homo sapiens
ISTFKNWPFL

SEQ ID NO: 47935 - protein, 10 aa, Homo sapiens
STFKNWPFLE

SEQ ID NO: 47936 - protein, 10 aa, Homo sapiens
TFKNWPFLEG

SEQ ID NO: 47937 - protein, 10 aa, Homo sapiens
FKNWPFLEGC

SEQ ID NO: 47938 - protein, 10 aa, Homo sapiens
KNWPFLEGCA

SEQ ID NO: 47939 - protein, 10 aa, Homo sapiens
NWPFLEGCAC

SEQ ID NO: 47940 - protein, 10 aa, Homo sapiens
WPFLEGCACT

SEQ ID NO: 47941 - protein, 10 aa, Homo sapiens
PFLEGCACTP

SEQ ID NO: 47942 - protein, 10 aa, Homo sapiens
FLEGCACTPE

SEQ ID NO: 47943 - protein, 10 aa, Homo sapiens
LEGCACTPER

SEQ ID NO: 47944 - protein, 10 aa, Homo sapiens
EGCACTPERM

SEQ ID NO: 47945 - protein, 10 aa, Homo sapiens
GCACTPERMA

SEQ ID NO: 47946 - protein, 10 aa, Homo sapiens
CACTPERMAE

SEQ ID NO: 47947 - protein, 10 aa, Homo sapiens
ACTPERMAEA

SEQ ID NO: 47948 - protein, 10 aa, Homo sapiens
CTPERMAEAG

SEQ ID NO: 47949 - protein, 10 aa, Homo sapiens
TPERMAEAGF

SEQ ID NO: 47950 - protein, 10 aa, Homo sapiens
PERMAEAGFI

SEQ ID NO: 47951 - protein, 10 aa, Homo sapiens
ERMAEAGFIH

SEQ ID NO: 47952 - protein, 10 aa, Homo sapiens
RMAEAGFIHC

SEQ ID NO: 47953 - protein, 10 aa, Homo sapiens
MAEAGFIHCP

SEQ ID NO: 47954 - protein, 10 aa, Homo sapiens
AEAGFIHCPT

SEQ ID NO: 47955 - protein, 10 aa, Homo sapiens
EAGFIHCPTE

SEQ ID NO: 47956 - protein, 10 aa, Homo sapiens
AGFIHCPTEN

SEQ ID NO: 47957 - protein, 10 aa, Homo sapiens
GFIHCPTENE

SEQ ID NO: 47958 - protein, 10 aa, Homo sapiens
FIHCPTENEP

SEQ ID NO: 47959 - protein, 10 aa, Homo sapiens
IHCPTENEPD

SEQ ID NO: 47960 - protein, 10 aa, Homo sapiens
HCPTENEPDL

SEQ ID NO: 47961 - protein, 10 aa, Homo sapiens
CPTENEPDLA

SEQ ID NO: 47962 - protein, 10 aa, Homo sapiens
PTENEPDLAQ

SEQ ID NO: 47963 - protein, 10 aa, Homo sapiens
TENEPDLAQC

SEQ ID NO: 47964 - protein, 10 aa, Homo sapiens
ENEPDLAQCF

SEQ ID NO: 47965 - protein, 10 aa, Homo sapiens
NEPDLAQCFF

SEQ ID NO: 47966 - protein, 10 aa, Homo sapiens
EPDLAQCFFC

SEQ ID NO: 47967 - protein, 10 aa, Homo sapiens
PDLAQCFFCF

SEQ ID NO: 47968 - protein, 10 aa, Homo sapiens
DLAQCFFCFK

SEQ ID NO: 47969 - protein, 10 aa, Homo sapiens
LAQCFFCFKE

SEQ ID NO: 47970 - protein, 10 aa, Homo sapiens
AQCFFCFKEL

SEQ ID NO: 47971 - protein, 10 aa, Homo sapiens
QCFFCFKELE

SEQ ID NO: 47972 - protein, 10 aa, Homo sapiens
CFFCFKELEG

SEQ ID NO: 47973 - protein, 10 aa, Homo sapiens
FFCFKELEGW

SEQ ID NO: 47974 - protein, 10 aa, Homo sapiens
FCFKELEGWE

SEQ ID NO: 47975 - protein, 10 aa, Homo sapiens
CFKELEGWEP

SEQ ID NO: 47976 - protein, 10 aa, Homo sapiens
FKELEGWEPD

SEQ ID NO: 47977 - protein, 10 aa, Homo sapiens
KELEGWEPDD

SEQ ID NO: 47978 - protein, 10 aa, Homo sapiens
ELEGWEPDDD

SEQ ID NO: 47979 - protein, 10 aa, Homo sapiens
LEGWEPDDDP

SEQ ID NO: 47980 - protein, 10 aa, Homo sapiens
EGWEPDDDPI

SEQ ID NO: 47981 - protein, 10 aa, Homo sapiens
GWEPDDDPIE

SEQ ID NO: 47982 - protein, 10 aa, Homo sapiens
WEPDDDPIEE

SEQ ID NO: 47983 - protein, 10 aa, Homo sapiens
EPDDDPIEEH

SEQ ID NO: 47984 - protein, 10 aa, Homo sapiens
PDDDPIEEHK

SEQ ID NO: 47985 - protein, 10 aa, Homo sapiens
DDDPIEEHKK

SEQ ID NO: 47986 - protein, 10 aa, Homo sapiens
DDPIEEHKKH

SEQ ID NO: 47987 - protein, 10 aa, Homo sapiens
DPIEEHKKHS

SEQ ID NO: 47988 - protein, 10 aa, Homo sapiens
PIEEHKKHSS

SEQ ID NO: 47989 - protein, 10 aa, Homo sapiens
IEEHKKHSSG

SEQ ID NO: 47990 - protein, 10 aa, Homo sapiens
EEHKKHSSGC

SEQ ID NO: 47991 - protein, 10 aa, Homo sapiens
EHKKHSSGCA

SEQ ID NO: 47992 - protein, 10 aa, Homo sapiens
HKKHSSGCAF

SEQ ID NO: 47993 - protein, 10 aa, Homo sapiens
KKHSSGCAFL

SEQ ID NO: 47994 - protein, 10 aa, Homo sapiens
KHSSGCAFLS

SEQ ID NO: 47995 - protein, 10 aa, Homo sapiens
HSSGCAFLSV

SEQ ID NO: 47996 - protein, 10 aa, Homo sapiens
SSGCAFLSVK

SEQ ID NO: 47997 - protein, 10 aa, Homo sapiens
SGCAFLSVKK

SEQ ID NO: 47998 - protein, 10 aa, Homo sapiens
GCAFLSVKKQ

SEQ ID NO: 47999 - protein, 10 aa, Homo sapiens
CAFLSVKKQF

SEQ ID NO: 48000 - protein, 10 aa, Homo sapiens
AFLSVKKQFE

SEQ ID NO: 48001 - protein, 10 aa, Homo sapiens
FLSVKKQFEE

SEQ ID NO: 48002 - protein, 10 aa, Homo sapiens
LSVKKQFEEL

SEQ ID NO: 48003 - protein, 10 aa, Homo sapiens
SVKKQFEELT

SEQ ID NO: 48004 - protein, 10 aa, Homo sapiens
VKKQFEELTL

SEQ ID NO: 48005 - protein, 10 aa, Homo sapiens
KKQFEELTLG

SEQ ID NO: 48006 - protein, 10 aa, Homo sapiens
KQFEELTLGE

SEQ ID NO: 48007 - protein, 10 aa, Homo sapiens
QFEELTLGEF

SEQ ID NO: 48008 - protein, 10 aa, Homo sapiens
FEELTLGEFL

SEQ ID NO: 48009 - protein, 10 aa, Homo sapiens
EELTLGEFLK

SEQ ID NO: 48010 - protein, 10 aa, Homo sapiens
ELTLGEFLKL

SEQ ID NO: 48011 - protein, 10 aa, Homo sapiens
LTLGEFLKLD

SEQ ID NO: 48012 - protein, 10 aa, Homo sapiens
TLGEFLKLDR

SEQ ID NO: 48013 - protein, 10 aa, Homo sapiens
LGEFLKLDRE

SEQ ID NO: 48014 - protein, 10 aa, Homo sapiens
GEFLKLDRER

SEQ ID NO: 48015 - protein, 10 aa, Homo sapiens
EFLKLDRERA

SEQ ID NO: 48016 - protein, 10 aa, Homo sapiens
FLKLDRERAK

SEQ ID NO: 48017 - protein, 10 aa, Homo sapiens
LKLDRERAKN

SEQ ID NO: 48018 - protein, 10 aa, Homo sapiens
KLDRERAKNK

SEQ ID NO: 48019 - protein, 10 aa, Homo sapiens
LDRERAKNKI

SEQ ID NO: 48020 - protein, 10 aa, Homo sapiens
DRERAKNKIA

SEQ ID NO: 48021 - protein, 10 aa, Homo sapiens
RERAKNKIAK

SEQ ID NO: 48022 - protein, 10 aa, Homo sapiens
ERAKNKIAKE

SEQ ID NO: 48023 - protein, 10 aa, Homo sapiens
RAKNKIAKET

SEQ ID NO: 48024 - protein, 10 aa, Homo sapiens
AKNKIAKETN

SEQ ID NO: 48025 - protein, 10 aa, Homo sapiens
KNKIAKETNN

SEQ ID NO: 48026 - protein, 10 aa, Homo sapiens
NKIAKETNNK

SEQ ID NO: 48027 - protein, 10 aa, Homo sapiens
KIAKETNNKK

SEQ ID NO: 48028 - protein, 10 aa, Homo sapiens
IAKETNNKKK

SEQ ID NO: 48029 - protein, 10 aa, Homo sapiens
AKETNNKKKE

SEQ ID NO: 48030 - protein, 10 aa, Homo sapiens
KETNNKKKEF

SEQ ID NO: 48031 - protein, 10 aa, Homo sapiens
ETNNKKKEFE

SEQ ID NO: 48032 - protein, 10 aa, Homo sapiens
TNNKKKEFEE

SEQ ID NO: 48033 - protein, 10 aa, Homo sapiens
NNKKKEFEET

SEQ ID NO: 48034 - protein, 10 aa, Homo sapiens
NKKKEFEETA

SEQ ID NO: 48035 - protein, 10 aa, Homo sapiens
KKKEFEETAK

SEQ ID NO: 48036 - protein, 10 aa, Homo sapiens
KKEFEETAKK

SEQ ID NO: 48037 - protein, 10 aa, Homo sapiens
KEFEETAKKV

SEQ ID NO: 48038 - protein, 10 aa, Homo sapiens
EFEETAKKVR

SEQ ID NO: 48039 - protein, 10 aa, Homo sapiens
FEETAKKVRR

SEQ ID NO: 48040 - protein, 10 aa, Homo sapiens
EETAKKVRRA

SEQ ID NO: 48041 - protein, 10 aa, Homo sapiens
ETAKKVRRAI

SEQ ID NO: 48042 - protein, 10 aa, Homo sapiens
TAKKVRRAIE

SEQ ID NO: 48043 - protein, 10 aa, Homo sapiens
AKKVRRAIEQ

SEQ ID NO: 48044 - protein, 10 aa, Homo sapiens
KKVRRAIEQL

SEQ ID NO: 48045 - protein, 10 aa, Homo sapiens
KVRRAIEQLA

SEQ ID NO: 48046 - protein, 10 aa, Homo sapiens
VRRAIEQLAA

SEQ ID NO: 48047 - protein, 10 aa, Homo sapiens
RRAIEQLAAM

SEQ ID NO: 48048 - protein, 10 aa, Homo sapiens
RAIEQLAAMD

SEQ ID NO: 48049 - protein, 11 aa, Homo sapiens
MGAPTLPPAWQ

SEQ ID NO: 48050 - protein, 11 aa, Homo sapiens
GAPTLPPAWQP

SEQ ID NO: 48051 - protein, 11 aa, Homo sapiens
APTLPPAWQPF

SEQ ID NO: 48052 - protein, 11 aa, Homo sapiens
PTLPPAWQPFL

SEQ ID NO: 48053 - protein, 11 aa, Homo sapiens
TLPPAWQPFLK

SEQ ID NO: 48054 - protein, 11 aa, Homo sapiens
LPPAWQPFLKD

SEQ ID NO: 48055 - protein, 11 aa, Homo sapiens
PPAWQPFLKDH

SEQ ID NO: 48056 - protein, 11 aa, Homo sapiens
PAWQPFLKDHR

SEQ ID NO: 48057 - protein, 11 aa, Homo sapiens
AWQPFLKDHRI

SEQ ID NO: 48058 - protein, 11 aa, Homo sapiens
WQPFLKDHRIS

SEQ ID NO: 48059 - protein, 11 aa, Homo sapiens
QPFLKDHRIST

SEQ ID NO: 48060 - protein, 11 aa, Homo sapiens
PFLKDHRISTF

SEQ ID NO: 48061 - protein, 11 aa, Homo sapiens
FLKDHRISTFK

SEQ ID NO: 48062 - protein, 11 aa, Homo sapiens
LKDHRISTFKN

SEQ ID NO: 48063 - protein, 11 aa, Homo sapiens
KDHRISTFKNW

SEQ ID NO: 48064 - protein, 11 aa, Homo sapiens
DHRISTFKNWP

SEQ ID NO: 48065 - protein, 11 aa, Homo sapiens
HRISTFKNWPF

SEQ ID NO: 48066 - protein, 11 aa, Homo sapiens
RISTFKNWPFL

SEQ ID NO: 48067 - protein, 11 aa, Homo sapiens
ISTFKNWPFLE

SEQ ID NO: 48068 - protein, 11 aa, Homo sapiens
STFKNWPFLEG

SEQ ID NO: 48069 - protein, 11 aa, Homo sapiens
TFKNWPFLEGC

SEQ ID NO: 48070 - protein, 11 aa, Homo sapiens
FKNWPFLEGCA

SEQ ID NO: 48071 - protein, 11 aa, Homo sapiens
KNWPFLEGCAC

SEQ ID NO: 48072 - protein, 11 aa, Homo sapiens
NWPFLEGCACT

SEQ ID NO: 48073 - protein, 11 aa, Homo sapiens
WPFLEGCACTP

SEQ ID NO: 48074 - protein, 11 aa, Homo sapiens
PFLEGCACTPE

SEQ ID NO: 48075 - protein, 11 aa, Homo sapiens
FLEGCACTPER

SEQ ID NO: 48076 - protein, 11 aa, Homo sapiens
LEGCACTPERM

SEQ ID NO: 48077 - protein, 11 aa, Homo sapiens
EGCACTPERMA

SEQ ID NO: 48078 - protein, 11 aa, Homo sapiens
GCACTPERMAE

SEQ ID NO: 48079 - protein, 11 aa, Homo sapiens
CACTPERMAEA

SEQ ID NO: 48080 - protein, 11 aa, Homo sapiens
ACTPERMAEAG

SEQ ID NO: 48081 - protein, 11 aa, Homo sapiens
CTPERMAEAGF

SEQ ID NO: 48082 - protein, 11 aa, Homo sapiens
TPERMAEAGFI

SEQ ID NO: 48083 - protein, 11 aa, Homo sapiens
PERMAEAGFIH

SEQ ID NO: 48084 - protein, 11 aa, Homo sapiens
ERMAEAGFIHC

SEQ ID NO: 48085 - protein, 11 aa, Homo sapiens
RMAEAGFIHCP

SEQ ID NO: 48086 - protein, 11 aa, Homo sapiens
MAEAGFIHCPT

SEQ ID NO: 48087 - protein, 11 aa, Homo sapiens
AEAGFIHCPTE

SEQ ID NO: 48088 - protein, 11 aa, Homo sapiens
EAGFIHCPTEN

SEQ ID NO: 48089 - protein, 11 aa, Homo sapiens
AGFIHCPTENE

SEQ ID NO: 48090 - protein, 11 aa, Homo sapiens
GFIHCPTENEP

SEQ ID NO: 48091 - protein, 11 aa, Homo sapiens
FIHCPTENEPD

SEQ ID NO: 48092 - protein, 11 aa, Homo sapiens
IHCPTENEPDL

SEQ ID NO: 48093 - protein, 11 aa, Homo sapiens
HCPTENEPDLA

SEQ ID NO: 48094 - protein, 11 aa, Homo sapiens
CPTENEPDLAQ

SEQ ID NO: 48095 - protein, 11 aa, Homo sapiens
PTENEPDLAQC

SEQ ID NO: 48096 - protein, 11 aa, Homo sapiens
TENEPDLAQCF

SEQ ID NO: 48097 - protein, 11 aa, Homo sapiens
ENEPDLAQCFF

SEQ ID NO: 48098 - protein, 11 aa, Homo sapiens
NEPDLAQCFFC

SEQ ID NO: 48099 - protein, 11 aa, Homo sapiens
EPDLAQCFFCF

SEQ ID NO: 48100 - protein, 11 aa, Homo sapiens
PDLAQCFFCFK

SEQ ID NO: 48101 - protein, 11 aa, Homo sapiens
DLAQCFFCFKE

SEQ ID NO: 48102 - protein, 11 aa, Homo sapiens
LAQCFFCFKEL

SEQ ID NO: 48103 - protein, 11 aa, Homo sapiens
AQCFFCFKELE

SEQ ID NO: 48104 - protein, 11 aa, Homo sapiens
QCFFCFKELEG

SEQ ID NO: 48105 - protein, 11 aa, Homo sapiens
CFFCFKELEGW

SEQ ID NO: 48106 - protein, 11 aa, Homo sapiens
FFCFKELEGWE

SEQ ID NO: 48107 - protein, 11 aa, Homo sapiens
FCFKELEGWEP

SEQ ID NO: 48108 - protein, 11 aa, Homo sapiens
CFKELEGWEPD

SEQ ID NO: 48109 - protein, 11 aa, Homo sapiens
FKELEGWEPDD

SEQ ID NO: 48110 - protein, 11 aa, Homo sapiens
KELEGWEPDDD

SEQ ID NO: 48111 - protein, 11 aa, Homo sapiens
ELEGWEPDDDP

SEQ ID NO: 48112 - protein, 11 aa, Homo sapiens
LEGWEPDDDPI

SEQ ID NO: 48113 - protein, 11 aa, Homo sapiens
EGWEPDDDPIE

SEQ ID NO: 48114 - protein, 11 aa, Homo sapiens
GWEPDDDPIEE

SEQ ID NO: 48115 - protein, 11 aa, Homo sapiens
WEPDDDPIEEH

SEQ ID NO: 48116 - protein, 11 aa, Homo sapiens
EPDDDPIEEHK

SEQ ID NO: 48117 - protein, 11 aa, Homo sapiens
PDDDPIEEHKK

SEQ ID NO: 48118 - protein, 11 aa, Homo sapiens
DDDPIEEHKKH

SEQ ID NO: 48119 - protein, 11 aa, Homo sapiens
DDPIEEHKKHS

SEQ ID NO: 48120 - protein, 11 aa, Homo sapiens
DPIEEHKKHSS

SEQ ID NO: 48121 - protein, 11 aa, Homo sapiens
PIEEHKKHSSG

SEQ ID NO: 48122 - protein, 11 aa, Homo sapiens
IEEHKKHSSGC

SEQ ID NO: 48123 - protein, 11 aa, Homo sapiens
EEHKKHSSGCA

SEQ ID NO: 48124 - protein, 11 aa, Homo sapiens
EHKKHSSGCAF

SEQ ID NO: 48125 - protein, 11 aa, Homo sapiens
HKKHSSGCAFL

SEQ ID NO: 48126 - protein, 11 aa, Homo sapiens
KKHSSGCAFLS

SEQ ID NO: 48127 - protein, 11 aa, Homo sapiens
KHSSGCAFLSV

SEQ ID NO: 48128 - protein, 11 aa, Homo sapiens
HSSGCAFLSVK

SEQ ID NO: 48129 - protein, 11 aa, Homo sapiens
SSGCAFLSVKK

SEQ ID NO: 48130 - protein, 11 aa, Homo sapiens
SGCAFLSVKKQ

SEQ ID NO: 48131 - protein, 11 aa, Homo sapiens
GCAFLSVKKQF

SEQ ID NO: 48132 - protein, 11 aa, Homo sapiens
CAFLSVKKQFE

SEQ ID NO: 48133 - protein, 11 aa, Homo sapiens
AFLSVKKQFEE

SEQ ID NO: 48134 - protein, 11 aa, Homo sapiens
FLSVKKQFEEL

SEQ ID NO: 48135 - protein, 11 aa, Homo sapiens
LSVKKQFEELT

SEQ ID NO: 48136 - protein, 11 aa, Homo sapiens
SVKKQFEELTL

SEQ ID NO: 48137 - protein, 11 aa, Homo sapiens
VKKQFEELTLG

SEQ ID NO: 48138 - protein, 11 aa, Homo sapiens
KKQFEELTLGE

SEQ ID NO: 48139 - protein, 11 aa, Homo sapiens
KQFEELTLGEF

SEQ ID NO: 48140 - protein, 11 aa, Homo sapiens
QFEELTLGEFL

SEQ ID NO: 48141 - protein, 11 aa, Homo sapiens
FEELTLGEFLK

SEQ ID NO: 48142 - protein, 11 aa, Homo sapiens
EELTLGEFLKL

SEQ ID NO: 48143 - protein, 11 aa, Homo sapiens
ELTLGEFLKLD

SEQ ID NO: 48144 - protein, 11 aa, Homo sapiens
LTLGEFLKLDR

SEQ ID NO: 48145 - protein, 11 aa, Homo sapiens
TLGEFLKLDRE

SEQ ID NO: 48146 - protein, 11 aa, Homo sapiens
LGEFLKLDRER

SEQ ID NO: 48147 - protein, 11 aa, Homo sapiens
GEFLKLDRERA

SEQ ID NO: 48148 - protein, 11 aa, Homo sapiens
EFLKLDRERAK

SEQ ID NO: 48149 - protein, 11 aa, Homo sapiens
FLKLDRERAKN

SEQ ID NO: 48150 - protein, 11 aa, Homo sapiens
LKLDRERAKNK

SEQ ID NO: 48151 - protein, 11 aa, Homo sapiens
KLDRERAKNKI

SEQ ID NO: 48152 - protein, 11 aa, Homo sapiens
LDRERAKNKIA

SEQ ID NO: 48153 - protein, 11 aa, Homo sapiens
DRERAKNKIAK

SEQ ID NO: 48154 - protein, 11 aa, Homo sapiens
RERAKNKIAKE

SEQ ID NO: 48155 - protein, 11 aa, Homo sapiens
ERAKNKIAKET

SEQ ID NO: 48156 - protein, 11 aa, Homo sapiens
RAKNKIAKETN

SEQ ID NO: 48157 - protein, 11 aa, Homo sapiens
AKNKIAKETNN

SEQ ID NO: 48158 - protein, 11 aa, Homo sapiens
KNKIAKETNNK

SEQ ID NO: 48159 - protein, 11 aa, Homo sapiens
NKIAKETNNKK

SEQ ID NO: 48160 - protein, 11 aa, Homo sapiens
KIAKETNNKKK

SEQ ID NO: 48161 - protein, 11 aa, Homo sapiens
IAKETNNKKKE

SEQ ID NO: 48162 - protein, 11 aa, Homo sapiens
AKETNNKKKEF

SEQ ID NO: 48163 - protein, 11 aa, Homo sapiens
KETNNKKKEFE

SEQ ID NO: 48164 - protein, 11 aa, Homo sapiens
ETNNKKKEFEE

SEQ ID NO: 48165 - protein, 11 aa, Homo sapiens
TNNKKKEFEET

SEQ ID NO: 48166 - protein, 11 aa, Homo sapiens
NNKKKEFEETA

SEQ ID NO: 48167 - protein, 11 aa, Homo sapiens
NKKKEFEETAK

SEQ ID NO: 48168 - protein, 11 aa, Homo sapiens
KKKEFEETAKK

SEQ ID NO: 48169 - protein, 11 aa, Homo sapiens
KKEFEETAKKV

SEQ ID NO: 48170 - protein, 11 aa, Homo sapiens
KEFEETAKKVR

SEQ ID NO: 48171 - protein, 11 aa, Homo sapiens
EFEETAKKVRR

SEQ ID NO: 48172 - protein, 11 aa, Homo sapiens
FEETAKKVRRA

SEQ ID NO: 48173 - protein, 11 aa, Homo sapiens
EETAKKVRRAI

SEQ ID NO: 48174 - protein, 11 aa, Homo sapiens
ETAKKVRRAIE

SEQ ID NO: 48175 - protein, 11 aa, Homo sapiens
TAKKVRRAIEQ

SEQ ID NO: 48176 - protein, 11 aa, Homo sapiens
AKKVRRAIEQL

SEQ ID NO: 48177 - protein, 11 aa, Homo sapiens
KKVRRAIEQLA

SEQ ID NO: 48178 - protein, 11 aa, Homo sapiens
KVRRAIEQLAA

SEQ ID NO: 48179 - protein, 11 aa, Homo sapiens
VRRAIEQLAAM

SEQ ID NO: 48180 - protein, 11 aa, Homo sapiens
RRAIEQLAAMD

SEQ ID NO: 48181 - protein, 13 aa, Homo sapiens
MFGLKRNAVIGLN

SEQ ID NO: 48182 - protein, 13 aa, Homo sapiens
FGLKRNAVIGLNL

SEQ ID NO: 48183 - protein, 13 aa, Homo sapiens
GLKRNAVIGLNLY

SEQ ID NO: 48184 - protein, 13 aa, Homo sapiens
LKRNAVIGLNLYC

SEQ ID NO: 48185 - protein, 13 aa, Homo sapiens
KRNAVIGLNLYCG

SEQ ID NO: 48186 - protein, 13 aa, Homo sapiens
RNAVIGLNLYCGG

SEQ ID NO: 48187 - protein, 13 aa, Homo sapiens
NAVIGLNLYCGGA

SEQ ID NO: 48188 - protein, 13 aa, Homo sapiens
AVIGLNLYCGGAG

SEQ ID NO: 48189 - protein, 13 aa, Homo sapiens
VIGLNLYCGGAGL

SEQ ID NO: 48190 - protein, 13 aa, Homo sapiens
IGLNLYCGGAGLG

SEQ ID NO: 48191 - protein, 13 aa, Homo sapiens
GLNLYCGGAGLGA

SEQ ID NO: 48192 - protein, 13 aa, Homo sapiens
LNLYCGGAGLGAG

SEQ ID NO: 48193 - protein, 13 aa, Homo sapiens
NLYCGGAGLGAGS

SEQ ID NO: 48194 - protein, 13 aa, Homo sapiens
LYCGGAGLGAGSG

SEQ ID NO: 48195 - protein, 13 aa, Homo sapiens
YCGGAGLGAGSGG

SEQ ID NO: 48196 - protein, 13 aa, Homo sapiens
CGGAGLGAGSGGA

SEQ ID NO: 48197 - protein, 13 aa, Homo sapiens
GGAGLGAGSGGAT

SEQ ID NO: 48198 - protein, 13 aa, Homo sapiens
GAGLGAGSGGATR

SEQ ID NO: 48199 - protein, 13 aa, Homo sapiens
AGLGAGSGGATRP

SEQ ID NO: 48200 - protein, 13 aa, Homo sapiens
GLGAGSGGATRPG

SEQ ID NO: 48201 - protein, 13 aa, Homo sapiens
LGAGSGGATRPGG

SEQ ID NO: 48202 - protein, 13 aa, Homo sapiens
GAGSGGATRPGGR

SEQ ID NO: 48203 - protein, 13 aa, Homo sapiens
AGSGGATRPGGRL

SEQ ID NO: 48204 - protein, 13 aa, Homo sapiens
GSGGATRPGGRLL

SEQ ID NO: 48205 - protein, 13 aa, Homo sapiens
SGGATRPGGRLLA

SEQ ID NO: 48206 - protein, 13 aa, Homo sapiens
GGATRPGGRLLAT

SEQ ID NO: 48207 - protein, 13 aa, Homo sapiens
GATRPGGRLLATE

SEQ ID NO: 48208 - protein, 13 aa, Homo sapiens
ATRPGGRLLATEK

SEQ ID NO: 48209 - protein, 13 aa, Homo sapiens
TRPGGRLLATEKE

SEQ ID NO: 48210 - protein, 13 aa, Homo sapiens
RPGGRLLATEKEA

SEQ ID NO: 48211 - protein, 13 aa, Homo sapiens
PGGRLLATEKEAS

SEQ ID NO: 48212 - protein, 13 aa, Homo sapiens
GGRLLATEKEASA

SEQ ID NO: 48213 - protein, 13 aa, Homo sapiens
GRLLATEKEASAR

SEQ ID NO: 48214 - protein, 13 aa, Homo sapiens
RLLATEKEASARR

SEQ ID NO: 48215 - protein, 13 aa, Homo sapiens
LLATEKEASARRE

SEQ ID NO: 48216 - protein, 13 aa, Homo sapiens
LATEKEASARREI

SEQ ID NO: 48217 - protein, 13 aa, Homo sapiens
ATEKEASARREIG

SEQ ID NO: 48218 - protein, 13 aa, Homo sapiens
TEKEASARREIGG

SEQ ID NO: 48219 - protein, 13 aa, Homo sapiens
EKEASARREIGGG

SEQ ID NO: 48220 - protein, 13 aa, Homo sapiens
KEASARREIGGGE

SEQ ID NO: 48221 - protein, 13 aa, Homo sapiens
EASARREIGGGEA

SEQ ID NO: 48222 - protein, 13 aa, Homo sapiens
ASARREIGGGEAG

SEQ ID NO: 48223 - protein, 13 aa, Homo sapiens
SARREIGGGEAGA

SEQ ID NO: 48224 - protein, 13 aa, Homo sapiens
ARREIGGGEAGAV

SEQ ID NO: 48225 - protein, 13 aa, Homo sapiens
RREIGGGEAGAVI

SEQ ID NO: 48226 - protein, 13 aa, Homo sapiens
REIGGGEAGAVIG

SEQ ID NO: 48227 - protein, 13 aa, Homo sapiens
EIGGGEAGAVIGG

SEQ ID NO: 48228 - protein, 13 aa, Homo sapiens
IGGGEAGAVIGGS

SEQ ID NO: 48229 - protein, 13 aa, Homo sapiens
GGGEAGAVIGGSA

SEQ ID NO: 48230 - protein, 13 aa, Homo sapiens
GGEAGAVIGGSAG

SEQ ID NO: 48231 - protein, 13 aa, Homo sapiens
GEAGAVIGGSAGA

SEQ ID NO: 48232 - protein, 13 aa, Homo sapiens
EAGAVIGGSAGAS

SEQ ID NO: 48233 - protein, 13 aa, Homo sapiens
AGAVIGGSAGASP

SEQ ID NO: 48234 - protein, 13 aa, Homo sapiens
GAVIGGSAGASPP

SEQ ID NO: 48235 - protein, 13 aa, Homo sapiens
AVIGGSAGASPPS

SEQ ID NO: 48236 - protein, 13 aa, Homo sapiens
VIGGSAGASPPST

SEQ ID NO: 48237 - protein, 13 aa, Homo sapiens
IGGSAGASPPSTL

SEQ ID NO: 48238 - protein, 13 aa, Homo sapiens
GGSAGASPPSTLT

SEQ ID NO: 48239 - protein, 13 aa, Homo sapiens
GSAGASPPSTLTP

SEQ ID NO: 48240 - protein, 13 aa, Homo sapiens
SAGASPPSTLTPD

SEQ ID NO: 48241 - protein, 13 aa, Homo sapiens
AGASPPSTLTPDS

SEQ ID NO: 48242 - protein, 13 aa, Homo sapiens
GASPPSTLTPDSR

SEQ ID NO: 48243 - protein, 13 aa, Homo sapiens
ASPPSTLTPDSRR

SEQ ID NO: 48244 - protein, 13 aa, Homo sapiens
SPPSTLTPDSRRV

SEQ ID NO: 48245 - protein, 13 aa, Homo sapiens
PPSTLTPDSRRVA

SEQ ID NO: 48246 - protein, 13 aa, Homo sapiens
PSTLTPDSRRVAR

SEQ ID NO: 48247 - protein, 13 aa, Homo sapiens
STLTPDSRRVARP

SEQ ID NO: 48248 - protein, 13 aa, Homo sapiens
TLTPDSRRVARPP

SEQ ID NO: 48249 - protein, 13 aa, Homo sapiens
LTPDSRRVARPPP

SEQ ID NO: 48250 - protein, 13 aa, Homo sapiens
TPDSRRVARPPPI

SEQ ID NO: 48251 - protein, 13 aa, Homo sapiens
PDSRRVARPPPIG

SEQ ID NO: 48252 - protein, 13 aa, Homo sapiens
DSRRVARPPPIGA

SEQ ID NO: 48253 - protein, 13 aa, Homo sapiens
SRRVARPPPIGAE

SEQ ID NO: 48254 - protein, 13 aa, Homo sapiens
RRVARPPPIGAEV

SEQ ID NO: 48255 - protein, 13 aa, Homo sapiens
RVARPPPIGAEVP

SEQ ID NO: 48256 - protein, 13 aa, Homo sapiens
VARPPPIGAEVPD

SEQ ID NO: 48257 - protein, 13 aa, Homo sapiens
ARPPPIGAEVPDV

SEQ ID NO: 48258 - protein, 13 aa, Homo sapiens
RPPPIGAEVPDVT

SEQ ID NO: 48259 - protein, 13 aa, Homo sapiens
PPPIGAEVPDVTA

SEQ ID NO: 48260 - protein, 13 aa, Homo sapiens
PPIGAEVPDVTAT

SEQ ID NO: 48261 - protein, 13 aa, Homo sapiens
PIGAEVPDVTATP

SEQ ID NO: 48262 - protein, 13 aa, Homo sapiens
IGAEVPDVTATPA

SEQ ID NO: 48263 - protein, 13 aa, Homo sapiens
GAEVPDVTATPAR

SEQ ID NO: 48264 - protein, 13 aa, Homo sapiens
AEVPDVTATPARL

SEQ ID NO: 48265 - protein, 13 aa, Homo sapiens
EVPDVTATPARLL

SEQ ID NO: 48266 - protein, 13 aa, Homo sapiens
VPDVTATPARLLF

SEQ ID NO: 48267 - protein, 13 aa, Homo sapiens
PDVTATPARLLFF

SEQ ID NO: 48268 - protein, 13 aa, Homo sapiens
DVTATPARLLFFA

SEQ ID NO: 48269 - protein, 13 aa, Homo sapiens
VTATPARLLFFAP

SEQ ID NO: 48270 - protein, 13 aa, Homo sapiens
TATPARLLFFAPT

SEQ ID NO: 48271 - protein, 13 aa, Homo sapiens
ATPARLLFFAPTR

SEQ ID NO: 48272 - protein, 13 aa, Homo sapiens
TPARLLFFAPTRR

SEQ ID NO: 48273 - protein, 13 aa, Homo sapiens
PARLLFFAPTRRA

SEQ ID NO: 48274 - protein, 13 aa, Homo sapiens
ARLLFFAPTRRAA

SEQ ID NO: 48275 - protein, 13 aa, Homo sapiens
RLLFFAPTRRAAP

SEQ ID NO: 48276 - protein, 13 aa, Homo sapiens
LLFFAPTRRAAPL

SEQ ID NO: 48277 - protein, 13 aa, Homo sapiens
LFFAPTRRAAPLE

SEQ ID NO: 48278 - protein, 13 aa, Homo sapiens
FFAPTRRAAPLEE

SEQ ID NO: 48279 - protein, 13 aa, Homo sapiens
FAPTRRAAPLEEM

SEQ ID NO: 48280 - protein, 13 aa, Homo sapiens
APTRRAAPLEEME

SEQ ID NO: 48281 - protein, 13 aa, Homo sapiens
PTRRAAPLEEMEA

SEQ ID NO: 48282 - protein, 13 aa, Homo sapiens
TRRAAPLEEMEAP

SEQ ID NO: 48283 - protein, 13 aa, Homo sapiens
RRAAPLEEMEAPA

SEQ ID NO: 48284 - protein, 13 aa, Homo sapiens
RAAPLEEMEAPAA

SEQ ID NO: 48285 - protein, 13 aa, Homo sapiens
AAPLEEMEAPAAD

SEQ ID NO: 48286 - protein, 13 aa, Homo sapiens
APLEEMEAPAADA

SEQ ID NO: 48287 - protein, 13 aa, Homo sapiens
PLEEMEAPAADAI

SEQ ID NO: 48288 - protein, 13 aa, Homo sapiens
LEEMEAPAADAIM

SEQ ID NO: 48289 - protein, 13 aa, Homo sapiens
EEMEAPAADAIMS

SEQ ID NO: 48290 - protein, 13 aa, Homo sapiens
EMEAPAADAIMSP

SEQ ID NO: 48291 - protein, 13 aa, Homo sapiens
MEAPAADAIMSPE

SEQ ID NO: 48292 - protein, 13 aa, Homo sapiens
EAPAADAIMSPEE

SEQ ID NO: 48293 - protein, 13 aa, Homo sapiens
APAADAIMSPEEE

SEQ ID NO: 48294 - protein, 13 aa, Homo sapiens
PAADAIMSPEEEL

SEQ ID NO: 48295 - protein, 13 aa, Homo sapiens
AADAIMSPEEELD

SEQ ID NO: 48296 - protein, 13 aa, Homo sapiens
ADAIMSPEEELDG

SEQ ID NO: 48297 - protein, 13 aa, Homo sapiens
DAIMSPEEELDGY

SEQ ID NO: 48298 - protein, 13 aa, Homo sapiens
AIMSPEEELDGYE

SEQ ID NO: 48299 - protein, 13 aa, Homo sapiens
IMSPEEELDGYEP

SEQ ID NO: 48300 - protein, 13 aa, Homo sapiens
MSPEEELDGYEPE

SEQ ID NO: 48301 - protein, 13 aa, Homo sapiens
SPEEELDGYEPEP

SEQ ID NO: 48302 - protein, 13 aa, Homo sapiens
PEEELDGYEPEPL

SEQ ID NO: 48303 - protein, 13 aa, Homo sapiens
EEELDGYEPEPLG

SEQ ID NO: 48304 - protein, 13 aa, Homo sapiens
EELDGYEPEPLGK

SEQ ID NO: 48305 - protein, 13 aa, Homo sapiens
ELDGYEPEPLGKR

SEQ ID NO: 48306 - protein, 13 aa, Homo sapiens
LDGYEPEPLGKRP

SEQ ID NO: 48307 - protein, 13 aa, Homo sapiens
DGYEPEPLGKRPA

SEQ ID NO: 48308 - protein, 13 aa, Homo sapiens
GYEPEPLGKRPAV

SEQ ID NO: 48309 - protein, 13 aa, Homo sapiens
YEPEPLGKRPAVL

SEQ ID NO: 48310 - protein, 13 aa, Homo sapiens
EPEPLGKRPAVLP

SEQ ID NO: 48311 - protein, 13 aa, Homo sapiens
PEPLGKRPAVLPL

SEQ ID NO: 48312 - protein, 13 aa, Homo sapiens
EPLGKRPAVLPLL

SEQ ID NO: 48313 - protein, 13 aa, Homo sapiens
PLGKRPAVLPLLE

SEQ ID NO: 48314 - protein, 13 aa, Homo sapiens
LGKRPAVLPLLEL

SEQ ID NO: 48315 - protein, 13 aa, Homo sapiens
GKRPAVLPLLELV

SEQ ID NO: 48316 - protein, 13 aa, Homo sapiens
KRPAVLPLLELVG

SEQ ID NO: 48317 - protein, 13 aa, Homo sapiens
RPAVLPLLELVGE

SEQ ID NO: 48318 - protein, 13 aa, Homo sapiens
PAVLPLLELVGES

SEQ ID NO: 48319 - protein, 13 aa, Homo sapiens
AVLPLLELVGESG

SEQ ID NO: 48320 - protein, 13 aa, Homo sapiens
VLPLLELVGESGN

SEQ ID NO: 48321 - protein, 13 aa, Homo sapiens
LPLLELVGESGNN

SEQ ID NO: 48322 - protein, 13 aa, Homo sapiens
PLLELVGESGNNT

SEQ ID NO: 48323 - protein, 13 aa, Homo sapiens
LLELVGESGNNTS

SEQ ID NO: 48324 - protein, 13 aa, Homo sapiens
LELVGESGNNTST

SEQ ID NO: 48325 - protein, 13 aa, Homo sapiens
ELVGESGNNTSTD

SEQ ID NO: 48326 - protein, 13 aa, Homo sapiens
LVGESGNNTSTDG

SEQ ID NO: 48327 - protein, 13 aa, Homo sapiens
VGESGNNTSTDGS

SEQ ID NO: 48328 - protein, 13 aa, Homo sapiens
GESGNNTSTDGSL

SEQ ID NO: 48329 - protein, 13 aa, Homo sapiens
ESGNNTSTDGSLP

SEQ ID NO: 48330 - protein, 13 aa, Homo sapiens
SGNNTSTDGSLPS

SEQ ID NO: 48331 - protein, 13 aa, Homo sapiens
GNNTSTDGSLPST

SEQ ID NO: 48332 - protein, 13 aa, Homo sapiens
NNTSTDGSLPSTP

SEQ ID NO: 48333 - protein, 13 aa, Homo sapiens
NTSTDGSLPSTPP

SEQ ID NO: 48334 - protein, 13 aa, Homo sapiens
TSTDGSLPSTPPP

SEQ ID NO: 48335 - protein, 13 aa, Homo sapiens
STDGSLPSTPPPA

SEQ ID NO: 48336 - protein, 13 aa, Homo sapiens
TDGSLPSTPPPAE

SEQ ID NO: 48337 - protein, 13 aa, Homo sapiens
DGSLPSTPPPAEE

SEQ ID NO: 48338 - protein, 13 aa, Homo sapiens
GSLPSTPPPAEEE

SEQ ID NO: 48339 - protein, 13 aa, Homo sapiens
SLPSTPPPAEEEE

SEQ ID NO: 48340 - protein, 13 aa, Homo sapiens
LPSTPPPAEEEED

SEQ ID NO: 48341 - protein, 13 aa, Homo sapiens
PSTPPPAEEEEDD

SEQ ID NO: 48342 - protein, 13 aa, Homo sapiens
STPPPAEEEEDDL

SEQ ID NO: 48343 - protein, 13 aa, Homo sapiens
TPPPAEEEEDDLY

SEQ ID NO: 48344 - protein, 13 aa, Homo sapiens
PPPAEEEEDDLYR

SEQ ID NO: 48345 - protein, 13 aa, Homo sapiens
PPAEEEEDDLYRQ

SEQ ID NO: 48346 - protein, 13 aa, Homo sapiens
PAEEEEDDLYRQS

SEQ ID NO: 48347 - protein, 13 aa, Homo sapiens
AEEEEDDLYRQSL

SEQ ID NO: 48348 - protein, 13 aa, Homo sapiens
EEEEDDLYRQSLE

SEQ ID NO: 48349 - protein, 13 aa, Homo sapiens
EEEDDLYRQSLEI

SEQ ID NO: 48350 - protein, 13 aa, Homo sapiens
EEDDLYRQSLEII

SEQ ID NO: 48351 - protein, 13 aa, Homo sapiens
EDDLYRQSLEIIS

SEQ ID NO: 48352 - protein, 13 aa, Homo sapiens
DDLYRQSLEIISR

SEQ ID NO: 48353 - protein, 13 aa, Homo sapiens
DLYRQSLEIISRY

SEQ ID NO: 48354 - protein, 13 aa, Homo sapiens
LYRQSLEIISRYL

SEQ ID NO: 48355 - protein, 13 aa, Homo sapiens
YRQSLEIISRYLR

SEQ ID NO: 48356 - protein, 13 aa, Homo sapiens
RQSLEIISRYLRE

SEQ ID NO: 48357 - protein, 13 aa, Homo sapiens
QSLEIISRYLREQ

SEQ ID NO: 48358 - protein, 13 aa, Homo sapiens
SLEIISRYLREQA

SEQ ID NO: 48359 - protein, 13 aa, Homo sapiens
LEIISRYLREQAT

SEQ ID NO: 48360 - protein, 13 aa, Homo sapiens
EIISRYLREQATG

SEQ ID NO: 48361 - protein, 13 aa, Homo sapiens
IISRYLREQATGA

SEQ ID NO: 48362 - protein, 13 aa, Homo sapiens
ISRYLREQATGAK

SEQ ID NO: 48363 - protein, 13 aa, Homo sapiens
SRYLREQATGAKD

SEQ ID NO: 48364 - protein, 13 aa, Homo sapiens
RYLREQATGAKDT

SEQ ID NO: 48365 - protein, 13 aa, Homo sapiens
YLREQATGAKDTK

SEQ ID NO: 48366 - protein, 13 aa, Homo sapiens
LREQATGAKDTKP

SEQ ID NO: 48367 - protein, 13 aa, Homo sapiens
REQATGAKDTKPM

SEQ ID NO: 48368 - protein, 13 aa, Homo sapiens
EQATGAKDTKPMG

SEQ ID NO: 48369 - protein, 13 aa, Homo sapiens
QATGAKDTKPMGR

SEQ ID NO: 48370 - protein, 13 aa, Homo sapiens
ATGAKDTKPMGRS

SEQ ID NO: 48371 - protein, 13 aa, Homo sapiens
TGAKDTKPMGRSG

SEQ ID NO: 48372 - protein, 13 aa, Homo sapiens
GAKDTKPMGRSGA

SEQ ID NO: 48373 - protein, 13 aa, Homo sapiens
AKDTKPMGRSGAT

SEQ ID NO: 48374 - protein, 13 aa, Homo sapiens
KDTKPMGRSGATS

SEQ ID NO: 48375 - protein, 13 aa, Homo sapiens
DTKPMGRSGATSR

SEQ ID NO: 48376 - protein, 13 aa, Homo sapiens
TKPMGRSGATSRK

SEQ ID NO: 48377 - protein, 13 aa, Homo sapiens
KPMGRSGATSRKA

SEQ ID NO: 48378 - protein, 13 aa, Homo sapiens
PMGRSGATSRKAL

SEQ ID NO: 48379 - protein, 13 aa, Homo sapiens
MGRSGATSRKALE

SEQ ID NO: 48380 - protein, 13 aa, Homo sapiens
GRSGATSRKALET

SEQ ID NO: 48381 - protein, 13 aa, Homo sapiens
RSGATSRKALETL

SEQ ID NO: 48382 - protein, 13 aa, Homo sapiens
SGATSRKALETLR

SEQ ID NO: 48383 - protein, 13 aa, Homo sapiens
GATSRKALETLRR

SEQ ID NO: 48384 - protein, 13 aa, Homo sapiens
ATSRKALETLRRV

SEQ ID NO: 48385 - protein, 13 aa, Homo sapiens
TSRKALETLRRVG

SEQ ID NO: 48386 - protein, 13 aa, Homo sapiens
SRKALETLRRVGD

SEQ ID NO: 48387 - protein, 13 aa, Homo sapiens
RKALETLRRVGDG

SEQ ID NO: 48388 - protein, 13 aa, Homo sapiens
KALETLRRVGDGV

SEQ ID NO: 48389 - protein, 13 aa, Homo sapiens
ALETLRRVGDGVQ

SEQ ID NO: 48390 - protein, 13 aa, Homo sapiens
LETLRRVGDGVQR

SEQ ID NO: 48391 - protein, 13 aa, Homo sapiens
ETLRRVGDGVQRN

SEQ ID NO: 48392 - protein, 13 aa, Homo sapiens
TLRRVGDGVQRNH

SEQ ID NO: 48393 - protein, 13 aa, Homo sapiens
LRRVGDGVQRNHE

SEQ ID NO: 48394 - protein, 13 aa, Homo sapiens
RRVGDGVQRNHET

SEQ ID NO: 48395 - protein, 13 aa, Homo sapiens
RVGDGVQRNHETA

SEQ ID NO: 48396 - protein, 13 aa, Homo sapiens
VGDGVQRNHETAF

SEQ ID NO: 48397 - protein, 13 aa, Homo sapiens
GDGVQRNHETAFQ

SEQ ID NO: 48398 - protein, 13 aa, Homo sapiens
DGVQRNHETAFQG

SEQ ID NO: 48399 - protein, 13 aa, Homo sapiens
GVQRNHETAFQGM

SEQ ID NO: 48400 - protein, 13 aa, Homo sapiens
VQRNHETAFQGML

SEQ ID NO: 48401 - protein, 13 aa, Homo sapiens
QRNHETAFQGMLR

SEQ ID NO: 48402 - protein, 13 aa, Homo sapiens
RNHETAFQGMLRK

SEQ ID NO: 48403 - protein, 13 aa, Homo sapiens
NHETAFQGMLRKL

SEQ ID NO: 48404 - protein, 13 aa, Homo sapiens
HETAFQGMLRKLD

SEQ ID NO: 48405 - protein, 13 aa, Homo sapiens
ETAFQGMLRKLDI

SEQ ID NO: 48406 - protein, 13 aa, Homo sapiens
TAFQGMLRKLDIK

SEQ ID NO: 48407 - protein, 13 aa, Homo sapiens
AFQGMLRKLDIKN

SEQ ID NO: 48408 - protein, 13 aa, Homo sapiens
FQGMLRKLDIKNE

SEQ ID NO: 48409 - protein, 13 aa, Homo sapiens
QGMLRKLDIKNED

SEQ ID NO: 48410 - protein, 13 aa, Homo sapiens
GMLRKLDIKNEDD

SEQ ID NO: 48411 - protein, 13 aa, Homo sapiens
MLRKLDIKNEDDV

SEQ ID NO: 48412 - protein, 13 aa, Homo sapiens
LRKLDIKNEDDVK

SEQ ID NO: 48413 - protein, 13 aa, Homo sapiens
RKLDIKNEDDVKS

SEQ ID NO: 48414 - protein, 13 aa, Homo sapiens
KLDIKNEDDVKSL

SEQ ID NO: 48415 - protein, 13 aa, Homo sapiens
LDIKNEDDVKSLS

SEQ ID NO: 48416 - protein, 13 aa, Homo sapiens
DIKNEDDVKSLSR

SEQ ID NO: 48417 - protein, 13 aa, Homo sapiens
IKNEDDVKSLSRV

SEQ ID NO: 48418 - protein, 13 aa, Homo sapiens
KNEDDVKSLSRVM

SEQ ID NO: 48419 - protein, 13 aa, Homo sapiens
NEDDVKSLSRVMI

SEQ ID NO: 48420 - protein, 13 aa, Homo sapiens
EDDVKSLSRVMIH

SEQ ID NO: 48421 - protein, 13 aa, Homo sapiens
DDVKSLSRVMIHV

SEQ ID NO: 48422 - protein, 13 aa, Homo sapiens
DVKSLSRVMIHVF

SEQ ID NO: 48423 - protein, 13 aa, Homo sapiens
VKSLSRVMIHVFS

SEQ ID NO: 48424 - protein, 13 aa, Homo sapiens
KSLSRVMIHVFSD

SEQ ID NO: 48425 - protein, 13 aa, Homo sapiens
SLSRVMIHVFSDG

SEQ ID NO: 48426 - protein, 13 aa, Homo sapiens
LSRVMIHVFSDGV

SEQ ID NO: 48427 - protein, 13 aa, Homo sapiens
SRVMIHVFSDGVT

SEQ ID NO: 48428 - protein, 13 aa, Homo sapiens
RVMIHVFSDGVTN

SEQ ID NO: 48429 - protein, 13 aa, Homo sapiens
VMIHVFSDGVTNW

SEQ ID NO: 48430 - protein, 13 aa, Homo sapiens
MIHVFSDGVTNWG

SEQ ID NO: 48431 - protein, 13 aa, Homo sapiens
IHVFSDGVTNWGR

SEQ ID NO: 48432 - protein, 13 aa, Homo sapiens
HVFSDGVTNWGRI

SEQ ID NO: 48433 - protein, 13 aa, Homo sapiens
VFSDGVTNWGRIV

SEQ ID NO: 48434 - protein, 13 aa, Homo sapiens
FSDGVTNWGRIVT

SEQ ID NO: 48435 - protein, 13 aa, Homo sapiens
SDGVTNWGRIVTL

SEQ ID NO: 48436 - protein, 13 aa, Homo sapiens
DGVTNWGRIVTLI

SEQ ID NO: 48437 - protein, 13 aa, Homo sapiens
GVTNWGRIVTLIS

SEQ ID NO: 48438 - protein, 13 aa, Homo sapiens
VTNWGRIVTLISF

SEQ ID NO: 48439 - protein, 13 aa, Homo sapiens
TNWGRIVTLISFG

SEQ ID NO: 48440 - protein, 13 aa, Homo sapiens
NWGRIVTLISFGA

SEQ ID NO: 48441 - protein, 13 aa, Homo sapiens
WGRIVTLISFGAF

SEQ ID NO: 48442 - protein, 13 aa, Homo sapiens
GRIVTLISFGAFV

SEQ ID NO: 48443 - protein, 13 aa, Homo sapiens
RIVTLISFGAFVA

SEQ ID NO: 48444 - protein, 13 aa, Homo sapiens
IVTLISFGAFVAK

SEQ ID NO: 48445 - protein, 13 aa, Homo sapiens
VTLISFGAFVAKH

SEQ ID NO: 48446 - protein, 13 aa, Homo sapiens
TLISFGAFVAKHL

SEQ ID NO: 48447 - protein, 13 aa, Homo sapiens
LISFGAFVAKHLK

SEQ ID NO: 48448 - protein, 13 aa, Homo sapiens
ISFGAFVAKHLKT

SEQ ID NO: 48449 - protein, 13 aa, Homo sapiens
SFGAFVAKHLKTI

SEQ ID NO: 48450 - protein, 13 aa, Homo sapiens
FGAFVAKHLKTIN

SEQ ID NO: 48451 - protein, 13 aa, Homo sapiens
GAFVAKHLKTINQ

SEQ ID NO: 48452 - protein, 13 aa, Homo sapiens
AFVAKHLKTINQE

SEQ ID NO: 48453 - protein, 13 aa, Homo sapiens
FVAKHLKTINQES

SEQ ID NO: 48454 - protein, 13 aa, Homo sapiens
VAKHLKTINQESC

SEQ ID NO: 48455 - protein, 13 aa, Homo sapiens
AKHLKTINQESCI

SEQ ID NO: 48456 - protein, 13 aa, Homo sapiens
KHLKTINQESCIE

SEQ ID NO: 48457 - protein, 13 aa, Homo sapiens
HLKTINQESCIEP

SEQ ID NO: 48458 - protein, 13 aa, Homo sapiens
LKTINQESCIEPL

SEQ ID NO: 48459 - protein, 13 aa, Homo sapiens
KTINQESCIEPLA

SEQ ID NO: 48460 - protein, 13 aa, Homo sapiens
TINQESCIEPLAE

SEQ ID NO: 48461 - protein, 13 aa, Homo sapiens
INQESCIEPLAES

SEQ ID NO: 48462 - protein, 13 aa, Homo sapiens
NQESCIEPLAESI

SEQ ID NO: 48463 - protein, 13 aa, Homo sapiens
QESCIEPLAESIT

SEQ ID NO: 48464 - protein, 13 aa, Homo sapiens
ESCIEPLAESITD

SEQ ID NO: 48465 - protein, 13 aa, Homo sapiens
SCIEPLAESITDV

SEQ ID NO: 48466 - protein, 13 aa, Homo sapiens
CIEPLAESITDVL

SEQ ID NO: 48467 - protein, 13 aa, Homo sapiens
IEPLAESITDVLV

SEQ ID NO: 48468 - protein, 13 aa, Homo sapiens
EPLAESITDVLVR

SEQ ID NO: 48469 - protein, 13 aa, Homo sapiens
PLAESITDVLVRT

SEQ ID NO: 48470 - protein, 13 aa, Homo sapiens
LAESITDVLVRTK

SEQ ID NO: 48471 - protein, 13 aa, Homo sapiens
AESITDVLVRTKR

SEQ ID NO: 48472 - protein, 13 aa, Homo sapiens
ESITDVLVRTKRD

SEQ ID NO: 48473 - protein, 13 aa, Homo sapiens
SITDVLVRTKRDW

SEQ ID NO: 48474 - protein, 13 aa, Homo sapiens
ITDVLVRTKRDWL

SEQ ID NO: 48475 - protein, 13 aa, Homo sapiens
TDVLVRTKRDWLV

SEQ ID NO: 48476 - protein, 13 aa, Homo sapiens
DVLVRTKRDWLVK

SEQ ID NO: 48477 - protein, 13 aa, Homo sapiens
VLVRTKRDWLVKQ

SEQ ID NO: 48478 - protein, 13 aa, Homo sapiens
LVRTKRDWLVKQR

SEQ ID NO: 48479 - protein, 13 aa, Homo sapiens
VRTKRDWLVKQRG

SEQ ID NO: 48480 - protein, 13 aa, Homo sapiens
RTKRDWLVKQRGW

SEQ ID NO: 48481 - protein, 13 aa, Homo sapiens
TKRDWLVKQRGWD

SEQ ID NO: 48482 - protein, 13 aa, Homo sapiens
KRDWLVKQRGWDG

SEQ ID NO: 48483 - protein, 13 aa, Homo sapiens
RDWLVKQRGWDGF

SEQ ID NO: 48484 - protein, 13 aa, Homo sapiens
DWLVKQRGWDGFV

SEQ ID NO: 48485 - protein, 13 aa, Homo sapiens
WLVKQRGWDGFVE

SEQ ID NO: 48486 - protein, 13 aa, Homo sapiens
LVKQRGWDGFVEF

SEQ ID NO: 48487 - protein, 13 aa, Homo sapiens
VKQRGWDGFVEFF

SEQ ID NO: 48488 - protein, 13 aa, Homo sapiens
KQRGWDGFVEFFH

SEQ ID NO: 48489 - protein, 13 aa, Homo sapiens
QRGWDGFVEFFHV

SEQ ID NO: 48490 - protein, 13 aa, Homo sapiens
RGWDGFVEFFHVE

SEQ ID NO: 48491 - protein, 13 aa, Homo sapiens
GWDGFVEFFHVED

SEQ ID NO: 48492 - protein, 13 aa, Homo sapiens
WDGFVEFFHVEDL

SEQ ID NO: 48493 - protein, 13 aa, Homo sapiens
DGFVEFFHVEDLE

SEQ ID NO: 48494 - protein, 13 aa, Homo sapiens
GFVEFFHVEDLEG

SEQ ID NO: 48495 - protein, 13 aa, Homo sapiens
FVEFFHVEDLEGG

SEQ ID NO: 48496 - protein, 13 aa, Homo sapiens
VEFFHVEDLEGGI

SEQ ID NO: 48497 - protein, 13 aa, Homo sapiens
EFFHVEDLEGGIR

SEQ ID NO: 48498 - protein, 13 aa, Homo sapiens
FFHVEDLEGGIRN

SEQ ID NO: 48499 - protein, 13 aa, Homo sapiens
FHVEDLEGGIRNV

SEQ ID NO: 48500 - protein, 13 aa, Homo sapiens
HVEDLEGGIRNVL

SEQ ID NO: 48501 - protein, 13 aa, Homo sapiens
VEDLEGGIRNVLL

SEQ ID NO: 48502 - protein, 13 aa, Homo sapiens
EDLEGGIRNVLLA

SEQ ID NO: 48503 - protein, 13 aa, Homo sapiens
DLEGGIRNVLLAF

SEQ ID NO: 48504 - protein, 13 aa, Homo sapiens
LEGGIRNVLLAFA

SEQ ID NO: 48505 - protein, 13 aa, Homo sapiens
EGGIRNVLLAFAG

SEQ ID NO: 48506 - protein, 13 aa, Homo sapiens
GGIRNVLLAFAGV

SEQ ID NO: 48507 - protein, 13 aa, Homo sapiens
GIRNVLLAFAGVA

SEQ ID NO: 48508 - protein, 13 aa, Homo sapiens
IRNVLLAFAGVAG

SEQ ID NO: 48509 - protein, 13 aa, Homo sapiens
RNVLLAFAGVAGV

SEQ ID NO: 48510 - protein, 13 aa, Homo sapiens
NVLLAFAGVAGVG

SEQ ID NO: 48511 - protein, 13 aa, Homo sapiens
VLLAFAGVAGVGA

SEQ ID NO: 48512 - protein, 13 aa, Homo sapiens
LLAFAGVAGVGAG

SEQ ID NO: 48513 - protein, 13 aa, Homo sapiens
LAFAGVAGVGAGL

SEQ ID NO: 48514 - protein, 13 aa, Homo sapiens
AFAGVAGVGAGLA

SEQ ID NO: 48515 - protein, 13 aa, Homo sapiens
FAGVAGVGAGLAY

SEQ ID NO: 48516 - protein, 13 aa, Homo sapiens
AGVAGVGAGLAYL

SEQ ID NO: 48517 - protein, 13 aa, Homo sapiens
GVAGVGAGLAYLI

SEQ ID NO: 48518 - protein, 13 aa, Homo sapiens
VAGVGAGLAYLIR

SEQ ID NO: 48519 - protein, 14 aa, Homo sapiens
MFGLKRNAVIGLNL

SEQ ID NO: 48520 - protein, 14 aa, Homo sapiens
FGLKRNAVIGLNLY

SEQ ID NO: 48521 - protein, 14 aa, Homo sapiens
GLKRNAVIGLNLYC

SEQ ID NO: 48522 - protein, 14 aa, Homo sapiens
LKRNAVIGLNLYCG

SEQ ID NO: 48523 - protein, 14 aa, Homo sapiens
KRNAVIGLNLYCGG

SEQ ID NO: 48524 - protein, 14 aa, Homo sapiens
RNAVIGLNLYCGGA

SEQ ID NO: 48525 - protein, 14 aa, Homo sapiens
NAVIGLNLYCGGAG

SEQ ID NO: 48526 - protein, 14 aa, Homo sapiens
AVIGLNLYCGGAGL

SEQ ID NO: 48527 - protein, 14 aa, Homo sapiens
VIGLNLYCGGAGLG

SEQ ID NO: 48528 - protein, 14 aa, Homo sapiens
IGLNLYCGGAGLGA

SEQ ID NO: 48529 - protein, 14 aa, Homo sapiens
GLNLYCGGAGLGAG

SEQ ID NO: 48530 - protein, 14 aa, Homo sapiens
LNLYCGGAGLGAGS

SEQ ID NO: 48531 - protein, 14 aa, Homo sapiens
NLYCGGAGLGAGSG

SEQ ID NO: 48532 - protein, 14 aa, Homo sapiens
LYCGGAGLGAGSGG

SEQ ID NO: 48533 - protein, 14 aa, Homo sapiens
YCGGAGLGAGSGGA

SEQ ID NO: 48534 - protein, 14 aa, Homo sapiens
CGGAGLGAGSGGAT

SEQ ID NO: 48535 - protein, 14 aa, Homo sapiens
GGAGLGAGSGGATR

SEQ ID NO: 48536 - protein, 14 aa, Homo sapiens
GAGLGAGSGGATRP

SEQ ID NO: 48537 - protein, 14 aa, Homo sapiens
AGLGAGSGGATRPG

SEQ ID NO: 48538 - protein, 14 aa, Homo sapiens
GLGAGSGGATRPGG

SEQ ID NO: 48539 - protein, 14 aa, Homo sapiens
LGAGSGGATRPGGR

SEQ ID NO: 48540 - protein, 14 aa, Homo sapiens
GAGSGGATRPGGRL

SEQ ID NO: 48541 - protein, 14 aa, Homo sapiens
AGSGGATRPGGRLL

SEQ ID NO: 48542 - protein, 14 aa, Homo sapiens
GSGGATRPGGRLLA

SEQ ID NO: 48543 - protein, 14 aa, Homo sapiens
SGGATRPGGRLLAT

SEQ ID NO: 48544 - protein, 14 aa, Homo sapiens
GGATRPGGRLLATE

SEQ ID NO: 48545 - protein, 14 aa, Homo sapiens
GATRPGGRLLATEK

SEQ ID NO: 48546 - protein, 14 aa, Homo sapiens
ATRPGGRLLATEKE

SEQ ID NO: 48547 - protein, 14 aa, Homo sapiens
TRPGGRLLATEKEA

SEQ ID NO: 48548 - protein, 14 aa, Homo sapiens
RPGGRLLATEKEAS

SEQ ID NO: 48549 - protein, 14 aa, Homo sapiens
PGGRLLATEKEASA

SEQ ID NO: 48550 - protein, 14 aa, Homo sapiens
GGRLLATEKEASAR

SEQ ID NO: 48551 - protein, 14 aa, Homo sapiens
GRLLATEKEASARR

SEQ ID NO: 48552 - protein, 14 aa, Homo sapiens
RLLATEKEASARRE

SEQ ID NO: 48553 - protein, 14 aa, Homo sapiens
LLATEKEASARREI

SEQ ID NO: 48554 - protein, 14 aa, Homo sapiens
LATEKEASARREIG

SEQ ID NO: 48555 - protein, 14 aa, Homo sapiens
ATEKEASARREIGG

SEQ ID NO: 48556 - protein, 14 aa, Homo sapiens
TEKEASARREIGGG

SEQ ID NO: 48557 - protein, 14 aa, Homo sapiens
EKEASARREIGGGE

SEQ ID NO: 48558 - protein, 14 aa, Homo sapiens
KEASARREIGGGEA

SEQ ID NO: 48559 - protein, 14 aa, Homo sapiens
EASARREIGGGEAG

SEQ ID NO: 48560 - protein, 14 aa, Homo sapiens
ASARREIGGGEAGA

SEQ ID NO: 48561 - protein, 14 aa, Homo sapiens
SARREIGGGEAGAV

SEQ ID NO: 48562 - protein, 14 aa, Homo sapiens
ARREIGGGEAGAVI

SEQ ID NO: 48563 - protein, 14 aa, Homo sapiens
RREIGGGEAGAVIG

SEQ ID NO: 48564 - protein, 14 aa, Homo sapiens
REIGGGEAGAVIGG

SEQ ID NO: 48565 - protein, 14 aa, Homo sapiens
EIGGGEAGAVIGGS

SEQ ID NO: 48566 - protein, 14 aa, Homo sapiens
IGGGEAGAVIGGSA

SEQ ID NO: 48567 - protein, 14 aa, Homo sapiens
GGGEAGAVIGGSAG

SEQ ID NO: 48568 - protein, 14 aa, Homo sapiens
GGEAGAVIGGSAGA

SEQ ID NO: 48569 - protein, 14 aa, Homo sapiens
GEAGAVIGGSAGAS

SEQ ID NO: 48570 - protein, 14 aa, Homo sapiens
EAGAVIGGSAGASP

SEQ ID NO: 48571 - protein, 14 aa, Homo sapiens
AGAVIGGSAGASPP

SEQ ID NO: 48572 - protein, 14 aa, Homo sapiens
GAVIGGSAGASPPS

SEQ ID NO: 48573 - protein, 14 aa, Homo sapiens
AVIGGSAGASPPST

SEQ ID NO: 48574 - protein, 14 aa, Homo sapiens
VIGGSAGASPPSTL

SEQ ID NO: 48575 - protein, 14 aa, Homo sapiens
IGGSAGASPPSTLT

SEQ ID NO: 48576 - protein, 14 aa, Homo sapiens
GGSAGASPPSTLTP

SEQ ID NO: 48577 - protein, 14 aa, Homo sapiens
GSAGASPPSTLTPD

SEQ ID NO: 48578 - protein, 14 aa, Homo sapiens
SAGASPPSTLTPDS

SEQ ID NO: 48579 - protein, 14 aa, Homo sapiens
AGASPPSTLTPDSR

SEQ ID NO: 48580 - protein, 14 aa, Homo sapiens
GASPPSTLTPDSRR

SEQ ID NO: 48581 - protein, 14 aa, Homo sapiens
ASPPSTLTPDSRRV

SEQ ID NO: 48582 - protein, 14 aa, Homo sapiens
SPPSTLTPDSRRVA

SEQ ID NO: 48583 - protein, 14 aa, Homo sapiens
PPSTLTPDSRRVAR

SEQ ID NO: 48584 - protein, 14 aa, Homo sapiens
PSTLTPDSRRVARP

SEQ ID NO: 48585 - protein, 14 aa, Homo sapiens
STLTPDSRRVARPP

SEQ ID NO: 48586 - protein, 14 aa, Homo sapiens
TLTPDSRRVARPPP

SEQ ID NO: 48587 - protein, 14 aa, Homo sapiens
LTPDSRRVARPPPI

SEQ ID NO: 48588 - protein, 14 aa, Homo sapiens
TPDSRRVARPPPIG

SEQ ID NO: 48589 - protein, 14 aa, Homo sapiens
PDSRRVARPPPIGA

SEQ ID NO: 48590 - protein, 14 aa, Homo sapiens
DSRRVARPPPIGAE

SEQ ID NO: 48591 - protein, 14 aa, Homo sapiens
SRRVARPPPIGAEV

SEQ ID NO: 48592 - protein, 14 aa, Homo sapiens
RRVARPPPIGAEVP

SEQ ID NO: 48593 - protein, 14 aa, Homo sapiens
RVARPPPIGAEVPD

SEQ ID NO: 48594 - protein, 14 aa, Homo sapiens
VARPPPIGAEVPDV

SEQ ID NO: 48595 - protein, 14 aa, Homo sapiens
ARPPPIGAEVPDVT

SEQ ID NO: 48596 - protein, 14 aa, Homo sapiens
RPPPIGAEVPDVTA

SEQ ID NO: 48597 - protein, 14 aa, Homo sapiens
PPPIGAEVPDVTAT

SEQ ID NO: 48598 - protein, 14 aa, Homo sapiens
PPIGAEVPDVTATP

SEQ ID NO: 48599 - protein, 14 aa, Homo sapiens
PIGAEVPDVTATPA

SEQ ID NO: 48600 - protein, 14 aa, Homo sapiens
IGAEVPDVTATPAR

SEQ ID NO: 48601 - protein, 14 aa, Homo sapiens
GAEVPDVTATPARL

SEQ ID NO: 48602 - protein, 14 aa, Homo sapiens
AEVPDVTATPARLL

SEQ ID NO: 48603 - protein, 14 aa, Homo sapiens
EVPDVTATPARLLF

SEQ ID NO: 48604 - protein, 14 aa, Homo sapiens
VPDVTATPARLLFF

SEQ ID NO: 48605 - protein, 14 aa, Homo sapiens
PDVTATPARLLFFA

SEQ ID NO: 48606 - protein, 14 aa, Homo sapiens
DVTATPARLLFFAP

SEQ ID NO: 48607 - protein, 14 aa, Homo sapiens
VTATPARLLFFAPT

SEQ ID NO: 48608 - protein, 14 aa, Homo sapiens
TATPARLLFFAPTR

SEQ ID NO: 48609 - protein, 14 aa, Homo sapiens
ATPARLLFFAPTRR

SEQ ID NO: 48610 - protein, 14 aa, Homo sapiens
TPARLLFFAPTRRA

SEQ ID NO: 48611 - protein, 14 aa, Homo sapiens
PARLLFFAPTRRAA

SEQ ID NO: 48612 - protein, 14 aa, Homo sapiens
ARLLFFAPTRRAAP

SEQ ID NO: 48613 - protein, 14 aa, Homo sapiens
RLLFFAPTRRAAPL

SEQ ID NO: 48614 - protein, 14 aa, Homo sapiens
LLFFAPTRRAAPLE

SEQ ID NO: 48615 - protein, 14 aa, Homo sapiens
LFFAPTRRAAPLEE

SEQ ID NO: 48616 - protein, 14 aa, Homo sapiens
FFAPTRRAAPLEEM

SEQ ID NO: 48617 - protein, 14 aa, Homo sapiens
FAPTRRAAPLEEME

SEQ ID NO: 48618 - protein, 14 aa, Homo sapiens
APTRRAAPLEEMEA

SEQ ID NO: 48619 - protein, 14 aa, Homo sapiens
PTRRAAPLEEMEAP

SEQ ID NO: 48620 - protein, 14 aa, Homo sapiens
TRRAAPLEEMEAPA

SEQ ID NO: 48621 - protein, 14 aa, Homo sapiens
RRAAPLEEMEAPAA

SEQ ID NO: 48622 - protein, 14 aa, Homo sapiens
RAAPLEEMEAPAAD

SEQ ID NO: 48623 - protein, 14 aa, Homo sapiens
AAPLEEMEAPAADA

SEQ ID NO: 48624 - protein, 14 aa, Homo sapiens
APLEEMEAPAADAI

SEQ ID NO: 48625 - protein, 14 aa, Homo sapiens
PLEEMEAPAADAIM

SEQ ID NO: 48626 - protein, 14 aa, Homo sapiens
LEEMEAPAADAIMS

SEQ ID NO: 48627 - protein, 14 aa, Homo sapiens
EEMEAPAADAIMSP

SEQ ID NO: 48628 - protein, 14 aa, Homo sapiens
EMEAPAADAIMSPE

SEQ ID NO: 48629 - protein, 14 aa, Homo sapiens
MEAPAADAIMSPEE

SEQ ID NO: 48630 - protein, 14 aa, Homo sapiens
EAPAADAIMSPEEE

SEQ ID NO: 48631 - protein, 14 aa, Homo sapiens
APAADAIMSPEEEL

SEQ ID NO: 48632 - protein, 14 aa, Homo sapiens
PAADAIMSPEEELD

SEQ ID NO: 48633 - protein, 14 aa, Homo sapiens
AADAIMSPEEELDG

SEQ ID NO: 48634 - protein, 14 aa, Homo sapiens
ADAIMSPEEELDGY

SEQ ID NO: 48635 - protein, 14 aa, Homo sapiens
DAIMSPEEELDGYE

SEQ ID NO: 48636 - protein, 14 aa, Homo sapiens
AIMSPEEELDGYEP

SEQ ID NO: 48637 - protein, 14 aa, Homo sapiens
IMSPEEELDGYEPE

SEQ ID NO: 48638 - protein, 14 aa, Homo sapiens
MSPEEELDGYEPEP

SEQ ID NO: 48639 - protein, 14 aa, Homo sapiens
SPEEELDGYEPEPL

SEQ ID NO: 48640 - protein, 14 aa, Homo sapiens
PEEELDGYEPEPLG

SEQ ID NO: 48641 - protein, 14 aa, Homo sapiens
EEELDGYEPEPLGK

SEQ ID NO: 48642 - protein, 14 aa, Homo sapiens
EELDGYEPEPLGKR

SEQ ID NO: 48643 - protein, 14 aa, Homo sapiens
ELDGYEPEPLGKRP

SEQ ID NO: 48644 - protein, 14 aa, Homo sapiens
LDGYEPEPLGKRPA

SEQ ID NO: 48645 - protein, 14 aa, Homo sapiens
DGYEPEPLGKRPAV

SEQ ID NO: 48646 - protein, 14 aa, Homo sapiens
GYEPEPLGKRPAVL

SEQ ID NO: 48647 - protein, 14 aa, Homo sapiens
YEPEPLGKRPAVLP

SEQ ID NO: 48648 - protein, 14 aa, Homo sapiens
EPEPLGKRPAVLPL

SEQ ID NO: 48649 - protein, 14 aa, Homo sapiens
PEPLGKRPAVLPLL

SEQ ID NO: 48650 - protein, 14 aa, Homo sapiens
EPLGKRPAVLPLLE

SEQ ID NO: 48651 - protein, 14 aa, Homo sapiens
PLGKRPAVLPLLEL

SEQ ID NO: 48652 - protein, 14 aa, Homo sapiens
LGKRPAVLPLLELV

SEQ ID NO: 48653 - protein, 14 aa, Homo sapiens
GKRPAVLPLLELVG

SEQ ID NO: 48654 - protein, 14 aa, Homo sapiens
KRPAVLPLLELVGE

SEQ ID NO: 48655 - protein, 14 aa, Homo sapiens
RPAVLPLLELVGES

SEQ ID NO: 48656 - protein, 14 aa, Homo sapiens
PAVLPLLELVGESG

SEQ ID NO: 48657 - protein, 14 aa, Homo sapiens
AVLPLLELVGESGN

SEQ ID NO: 48658 - protein, 14 aa, Homo sapiens
VLPLLELVGESGNN

SEQ ID NO: 48659 - protein, 14 aa, Homo sapiens
LPLLELVGESGNNT

SEQ ID NO: 48660 - protein, 14 aa, Homo sapiens
PLLELVGESGNNTS

SEQ ID NO: 48661 - protein, 14 aa, Homo sapiens
LLELVGESGNNTST

SEQ ID NO: 48662 - protein, 14 aa, Homo sapiens
LELVGESGNNTSTD

SEQ ID NO: 48663 - protein, 14 aa, Homo sapiens
ELVGESGNNTSTDG

SEQ ID NO: 48664 - protein, 14 aa, Homo sapiens
LVGESGNNTSTDGS

SEQ ID NO: 48665 - protein, 14 aa, Homo sapiens
VGESGNNTSTDGSL

SEQ ID NO: 48666 - protein, 14 aa, Homo sapiens
GESGNNTSTDGSLP

SEQ ID NO: 48667 - protein, 14 aa, Homo sapiens
ESGNNTSTDGSLPS

SEQ ID NO: 48668 - protein, 14 aa, Homo sapiens
SGNNTSTDGSLPST

SEQ ID NO: 48669 - protein, 14 aa, Homo sapiens
GNNTSTDGSLPSTP

SEQ ID NO: 48670 - protein, 14 aa, Homo sapiens
NNTSTDGSLPSTPP

SEQ ID NO: 48671 - protein, 14 aa, Homo sapiens
NTSTDGSLPSTPPP

SEQ ID NO: 48672 - protein, 14 aa, Homo sapiens
TSTDGSLPSTPPPA

SEQ ID NO: 48673 - protein, 14 aa, Homo sapiens
STDGSLPSTPPPAE

SEQ ID NO: 48674 - protein, 14 aa, Homo sapiens
TDGSLPSTPPPAEE

SEQ ID NO: 48675 - protein, 14 aa, Homo sapiens
DGSLPSTPPPAEEE

SEQ ID NO: 48676 - protein, 14 aa, Homo sapiens
GSLPSTPPPAEEEE

SEQ ID NO: 48677 - protein, 14 aa, Homo sapiens
SLPSTPPPAEEEED

SEQ ID NO: 48678 - protein, 14 aa, Homo sapiens
LPSTPPPAEEEEDD

SEQ ID NO: 48679 - protein, 14 aa, Homo sapiens
PSTPPPAEEEEDDL

SEQ ID NO: 48680 - protein, 14 aa, Homo sapiens
STPPPAEEEEDDLY

SEQ ID NO: 48681 - protein, 14 aa, Homo sapiens
TPPPAEEEEDDLYR

SEQ ID NO: 48682 - protein, 14 aa, Homo sapiens
PPPAEEEEDDLYRQ

SEQ ID NO: 48683 - protein, 14 aa, Homo sapiens
PPAEEEEDDLYRQS

SEQ ID NO: 48684 - protein, 14 aa, Homo sapiens
PAEEEEDDLYRQSL

SEQ ID NO: 48685 - protein, 14 aa, Homo sapiens
AEEEEDDLYRQSLE

SEQ ID NO: 48686 - protein, 14 aa, Homo sapiens
EEEEDDLYRQSLEI

SEQ ID NO: 48687 - protein, 14 aa, Homo sapiens
EEEDDLYRQSLEII

SEQ ID NO: 48688 - protein, 14 aa, Homo sapiens
EEDDLYRQSLEIIS

SEQ ID NO: 48689 - protein, 14 aa, Homo sapiens
EDDLYRQSLEIISR

SEQ ID NO: 48690 - protein, 14 aa, Homo sapiens
DDLYRQSLEIISRY

SEQ ID NO: 48691 - protein, 14 aa, Homo sapiens
DLYRQSLEIISRYL

SEQ ID NO: 48692 - protein, 14 aa, Homo sapiens
LYRQSLEIISRYLR

SEQ ID NO: 48693 - protein, 14 aa, Homo sapiens
YRQSLEIISRYLRE

SEQ ID NO: 48694 - protein, 14 aa, Homo sapiens
RQSLEIISRYLREQ

SEQ ID NO: 48695 - protein, 14 aa, Homo sapiens
QSLEIISRYLREQA

SEQ ID NO: 48696 - protein, 14 aa, Homo sapiens
SLEIISRYLREQAT

SEQ ID NO: 48697 - protein, 14 aa, Homo sapiens
LEIISRYLREQATG

SEQ ID NO: 48698 - protein, 14 aa, Homo sapiens
EIISRYLREQATGA

SEQ ID NO: 48699 - protein, 14 aa, Homo sapiens
IISRYLREQATGAK

SEQ ID NO: 48700 - protein, 14 aa, Homo sapiens
ISRYLREQATGAKD

SEQ ID NO: 48701 - protein, 14 aa, Homo sapiens
SRYLREQATGAKDT

SEQ ID NO: 48702 - protein, 14 aa, Homo sapiens
RYLREQATGAKDTK

SEQ ID NO: 48703 - protein, 14 aa, Homo sapiens
YLREQATGAKDTKP

SEQ ID NO: 48704 - protein, 14 aa, Homo sapiens
LREQATGAKDTKPM

SEQ ID NO: 48705 - protein, 14 aa, Homo sapiens
REQATGAKDTKPMG

SEQ ID NO: 48706 - protein, 14 aa, Homo sapiens
EQATGAKDTKPMGR

SEQ ID NO: 48707 - protein, 14 aa, Homo sapiens
QATGAKDTKPMGRS

SEQ ID NO: 48708 - protein, 14 aa, Homo sapiens
ATGAKDTKPMGRSG

SEQ ID NO: 48709 - protein, 14 aa, Homo sapiens
TGAKDTKPMGRSGA

SEQ ID NO: 48710 - protein, 14 aa, Homo sapiens
GAKDTKPMGRSGAT

SEQ ID NO: 48711 - protein, 14 aa, Homo sapiens
AKDTKPMGRSGATS

SEQ ID NO: 48712 - protein, 14 aa, Homo sapiens
KDTKPMGRSGATSR

SEQ ID NO: 48713 - protein, 14 aa, Homo sapiens
DTKPMGRSGATSRK

SEQ ID NO: 48714 - protein, 14 aa, Homo sapiens
TKPMGRSGATSRKA

SEQ ID NO: 48715 - protein, 14 aa, Homo sapiens
KPMGRSGATSRKAL

SEQ ID NO: 48716 - protein, 14 aa, Homo sapiens
PMGRSGATSRKALE

SEQ ID NO: 48717 - protein, 14 aa, Homo sapiens
MGRSGATSRKALET

SEQ ID NO: 48718 - protein, 14 aa, Homo sapiens
GRSGATSRKALETL

SEQ ID NO: 48719 - protein, 14 aa, Homo sapiens
RSGATSRKALETLR

SEQ ID NO: 48720 - protein, 14 aa, Homo sapiens
SGATSRKALETLRR

SEQ ID NO: 48721 - protein, 14 aa, Homo sapiens
GATSRKALETLRRV

SEQ ID NO: 48722 - protein, 14 aa, Homo sapiens
ATSRKALETLRRVG

SEQ ID NO: 48723 - protein, 14 aa, Homo sapiens
TSRKALETLRRVGD

SEQ ID NO: 48724 - protein, 14 aa, Homo sapiens
SRKALETLRRVGDG

SEQ ID NO: 48725 - protein, 14 aa, Homo sapiens
RKALETLRRVGDGV

SEQ ID NO: 48726 - protein, 14 aa, Homo sapiens
KALETLRRVGDGVQ

SEQ ID NO: 48727 - protein, 14 aa, Homo sapiens
ALETLRRVGDGVQR

SEQ ID NO: 48728 - protein, 14 aa, Homo sapiens
LETLRRVGDGVQRN

SEQ ID NO: 48729 - protein, 14 aa, Homo sapiens
ETLRRVGDGVQRNH

SEQ ID NO: 48730 - protein, 14 aa, Homo sapiens
TLRRVGDGVQRNHE

SEQ ID NO: 48731 - protein, 14 aa, Homo sapiens
LRRVGDGVQRNHET

SEQ ID NO: 48732 - protein, 14 aa, Homo sapiens
RRVGDGVQRNHETA

SEQ ID NO: 48733 - protein, 14 aa, Homo sapiens
RVGDGVQRNHETAF

SEQ ID NO: 48734 - protein, 14 aa, Homo sapiens
VGDGVQRNHETAFQ

SEQ ID NO: 48735 - protein, 14 aa, Homo sapiens
GDGVQRNHETAFQG

SEQ ID NO: 48736 - protein, 14 aa, Homo sapiens
DGVQRNHETAFQGM

SEQ ID NO: 48737 - protein, 14 aa, Homo sapiens
GVQRNHETAFQGML

SEQ ID NO: 48738 - protein, 14 aa, Homo sapiens
VQRNHETAFQGMLR

SEQ ID NO: 48739 - protein, 14 aa, Homo sapiens
QRNHETAFQGMLRK

SEQ ID NO: 48740 - protein, 14 aa, Homo sapiens
RNHETAFQGMLRKL

SEQ ID NO: 48741 - protein, 14 aa, Homo sapiens
NHETAFQGMLRKLD

SEQ ID NO: 48742 - protein, 14 aa, Homo sapiens
HETAFQGMLRKLDI

SEQ ID NO: 48743 - protein, 14 aa, Homo sapiens
ETAFQGMLRKLDIK

SEQ ID NO: 48744 - protein, 14 aa, Homo sapiens
TAFQGMLRKLDIKN

SEQ ID NO: 48745 - protein, 14 aa, Homo sapiens
AFQGMLRKLDIKNE

SEQ ID NO: 48746 - protein, 14 aa, Homo sapiens
FQGMLRKLDIKNED

SEQ ID NO: 48747 - protein, 14 aa, Homo sapiens
QGMLRKLDIKNEDD

SEQ ID NO: 48748 - protein, 14 aa, Homo sapiens
GMLRKLDIKNEDDV

SEQ ID NO: 48749 - protein, 14 aa, Homo sapiens
MLRKLDIKNEDDVK

SEQ ID NO: 48750 - protein, 14 aa, Homo sapiens
LRKLDIKNEDDVKS

SEQ ID NO: 48751 - protein, 14 aa, Homo sapiens
RKLDIKNEDDVKSL

SEQ ID NO: 48752 - protein, 14 aa, Homo sapiens
KLDIKNEDDVKSLS

SEQ ID NO: 48753 - protein, 14 aa, Homo sapiens
LDIKNEDDVKSLSR

SEQ ID NO: 48754 - protein, 14 aa, Homo sapiens
DIKNEDDVKSLSRV

SEQ ID NO: 48755 - protein, 14 aa, Homo sapiens
IKNEDDVKSLSRVM

SEQ ID NO: 48756 - protein, 14 aa, Homo sapiens
KNEDDVKSLSRVMI

SEQ ID NO: 48757 - protein, 14 aa, Homo sapiens
NEDDVKSLSRVMIH

SEQ ID NO: 48758 - protein, 14 aa, Homo sapiens
EDDVKSLSRVMIHV

SEQ ID NO: 48759 - protein, 14 aa, Homo sapiens
DDVKSLSRVMIHVF

SEQ ID NO: 48760 - protein, 14 aa, Homo sapiens
DVKSLSRVMIHVFS

SEQ ID NO: 48761 - protein, 14 aa, Homo sapiens
VKSLSRVMIHVFSD

SEQ ID NO: 48762 - protein, 14 aa, Homo sapiens
KSLSRVMIHVFSDG

SEQ ID NO: 48763 - protein, 14 aa, Homo sapiens
SLSRVMIHVFSDGV

SEQ ID NO: 48764 - protein, 14 aa, Homo sapiens
LSRVMIHVFSDGVT

SEQ ID NO: 48765 - protein, 14 aa, Homo sapiens
SRVMIHVFSDGVTN

SEQ ID NO: 48766 - protein, 14 aa, Homo sapiens
RVMIHVFSDGVTNW

SEQ ID NO: 48767 - protein, 14 aa, Homo sapiens
VMIHVFSDGVTNWG

SEQ ID NO: 48768 - protein, 14 aa, Homo sapiens
MIHVFSDGVTNWGR

SEQ ID NO: 48769 - protein, 14 aa, Homo sapiens
IHVFSDGVTNWGRI

SEQ ID NO: 48770 - protein, 14 aa, Homo sapiens
HVFSDGVTNWGRIV

SEQ ID NO: 48771 - protein, 14 aa, Homo sapiens
VFSDGVTNWGRIVT

SEQ ID NO: 48772 - protein, 14 aa, Homo sapiens
FSDGVTNWGRIVTL

SEQ ID NO: 48773 - protein, 14 aa, Homo sapiens
SDGVTNWGRIVTLI

SEQ ID NO: 48774 - protein, 14 aa, Homo sapiens
DGVTNWGRIVTLIS

SEQ ID NO: 48775 - protein, 14 aa, Homo sapiens
GVTNWGRIVTLISF

SEQ ID NO: 48776 - protein, 14 aa, Homo sapiens
VTNWGRIVTLISFG

SEQ ID NO: 48777 - protein, 14 aa, Homo sapiens
TNWGRIVTLISFGA

SEQ ID NO: 48778 - protein, 14 aa, Homo sapiens
NWGRIVTLISFGAF

SEQ ID NO: 48779 - protein, 14 aa, Homo sapiens
WGRIVTLISFGAFV

SEQ ID NO: 48780 - protein, 14 aa, Homo sapiens
GRIVTLISFGAFVA

SEQ ID NO: 48781 - protein, 14 aa, Homo sapiens
RIVTLISFGAFVAK

SEQ ID NO: 48782 - protein, 14 aa, Homo sapiens
IVTLISFGAFVAKH

SEQ ID NO: 48783 - protein, 14 aa, Homo sapiens
VTLISFGAFVAKHL

SEQ ID NO: 48784 - protein, 14 aa, Homo sapiens
TLISFGAFVAKHLK

SEQ ID NO: 48785 - protein, 14 aa, Homo sapiens
LISFGAFVAKHLKT

SEQ ID NO: 48786 - protein, 14 aa, Homo sapiens
ISFGAFVAKHLKTI

SEQ ID NO: 48787 - protein, 14 aa, Homo sapiens
SFGAFVAKHLKTIN

SEQ ID NO: 48788 - protein, 14 aa, Homo sapiens
FGAFVAKHLKTINQ

SEQ ID NO: 48789 - protein, 14 aa, Homo sapiens
GAFVAKHLKTINQE

SEQ ID NO: 48790 - protein, 14 aa, Homo sapiens
AFVAKHLKTINQES

SEQ ID NO: 48791 - protein, 14 aa, Homo sapiens
FVAKHLKTINQESC

SEQ ID NO: 48792 - protein, 14 aa, Homo sapiens
VAKHLKTINQESCI

SEQ ID NO: 48793 - protein, 14 aa, Homo sapiens
AKHLKTINQESCIE

SEQ ID NO: 48794 - protein, 14 aa, Homo sapiens
KHLKTINQESCIEP

SEQ ID NO: 48795 - protein, 14 aa, Homo sapiens
HLKTINQESCIEPL

SEQ ID NO: 48796 - protein, 14 aa, Homo sapiens
LKTINQESCIEPLA

SEQ ID NO: 48797 - protein, 14 aa, Homo sapiens
KTINQESCIEPLAE

SEQ ID NO: 48798 - protein, 14 aa, Homo sapiens
TINQESCIEPLAES

SEQ ID NO: 48799 - protein, 14 aa, Homo sapiens
INQESCIEPLAESI

SEQ ID NO: 48800 - protein, 14 aa, Homo sapiens
NQESCIEPLAESIT

SEQ ID NO: 48801 - protein, 14 aa, Homo sapiens
QESCIEPLAESITD

SEQ ID NO: 48802 - protein, 14 aa, Homo sapiens
ESCIEPLAESITDV

SEQ ID NO: 48803 - protein, 14 aa, Homo sapiens
SCIEPLAESITDVL

SEQ ID NO: 48804 - protein, 14 aa, Homo sapiens
CIEPLAESITDVLV

SEQ ID NO: 48805 - protein, 14 aa, Homo sapiens
IEPLAESITDVLVR

SEQ ID NO: 48806 - protein, 14 aa, Homo sapiens
EPLAESITDVLVRT

SEQ ID NO: 48807 - protein, 14 aa, Homo sapiens
PLAESITDVLVRTK

SEQ ID NO: 48808 - protein, 14 aa, Homo sapiens
LAESITDVLVRTKR

SEQ ID NO: 48809 - protein, 14 aa, Homo sapiens
AESITDVLVRTKRD

SEQ ID NO: 48810 - protein, 14 aa, Homo sapiens
ESITDVLVRTKRDW

SEQ ID NO: 48811 - protein, 14 aa, Homo sapiens
SITDVLVRTKRDWL

SEQ ID NO: 48812 - protein, 14 aa, Homo sapiens
ITDVLVRTKRDWLV

SEQ ID NO: 48813 - protein, 14 aa, Homo sapiens
TDVLVRTKRDWLVK

SEQ ID NO: 48814 - protein, 14 aa, Homo sapiens
DVLVRTKRDWLVKQ

SEQ ID NO: 48815 - protein, 14 aa, Homo sapiens
VLVRTKRDWLVKQR

SEQ ID NO: 48816 - protein, 14 aa, Homo sapiens
LVRTKRDWLVKQRG

SEQ ID NO: 48817 - protein, 14 aa, Homo sapiens
VRTKRDWLVKQRGW

SEQ ID NO: 48818 - protein, 14 aa, Homo sapiens
RTKRDWLVKQRGWD

SEQ ID NO: 48819 - protein, 14 aa, Homo sapiens
TKRDWLVKQRGWDG

SEQ ID NO: 48820 - protein, 14 aa, Homo sapiens
KRDWLVKQRGWDGF

SEQ ID NO: 48821 - protein, 14 aa, Homo sapiens
RDWLVKQRGWDGFV

SEQ ID NO: 48822 - protein, 14 aa, Homo sapiens
DWLVKQRGWDGFVE

SEQ ID NO: 48823 - protein, 14 aa, Homo sapiens
WLVKQRGWDGFVEF

SEQ ID NO: 48824 - protein, 14 aa, Homo sapiens
LVKQRGWDGFVEFF

SEQ ID NO: 48825 - protein, 14 aa, Homo sapiens
VKQRGWDGFVEFFH

SEQ ID NO: 48826 - protein, 14 aa, Homo sapiens
KQRGWDGFVEFFHV

SEQ ID NO: 48827 - protein, 14 aa, Homo sapiens
QRGWDGFVEFFHVE

SEQ ID NO: 48828 - protein, 14 aa, Homo sapiens
RGWDGFVEFFHVED

SEQ ID NO: 48829 - protein, 14 aa, Homo sapiens
GWDGFVEFFHVEDL

SEQ ID NO: 48830 - protein, 14 aa, Homo sapiens
WDGFVEFFHVEDLE

SEQ ID NO: 48831 - protein, 14 aa, Homo sapiens
DGFVEFFHVEDLEG

SEQ ID NO: 48832 - protein, 14 aa, Homo sapiens
GFVEFFHVEDLEGG

SEQ ID NO: 48833 - protein, 14 aa, Homo sapiens
FVEFFHVEDLEGGI

SEQ ID NO: 48834 - protein, 14 aa, Homo sapiens
VEFFHVEDLEGGIR

SEQ ID NO: 48835 - protein, 14 aa, Homo sapiens
EFFHVEDLEGGIRN

SEQ ID NO: 48836 - protein, 14 aa, Homo sapiens
FFHVEDLEGGIRNV

SEQ ID NO: 48837 - protein, 14 aa, Homo sapiens
FHVEDLEGGIRNVL

SEQ ID NO: 48838 - protein, 14 aa, Homo sapiens
HVEDLEGGIRNVLL

SEQ ID NO: 48839 - protein, 14 aa, Homo sapiens
VEDLEGGIRNVLLA

SEQ ID NO: 48840 - protein, 14 aa, Homo sapiens
EDLEGGIRNVLLAF

SEQ ID NO: 48841 - protein, 14 aa, Homo sapiens
DLEGGIRNVLLAFA

SEQ ID NO: 48842 - protein, 14 aa, Homo sapiens
LEGGIRNVLLAFAG

SEQ ID NO: 48843 - protein, 14 aa, Homo sapiens
EGGIRNVLLAFAGV

SEQ ID NO: 48844 - protein, 14 aa, Homo sapiens
GGIRNVLLAFAGVA

SEQ ID NO: 48845 - protein, 14 aa, Homo sapiens
GIRNVLLAFAGVAG

SEQ ID NO: 48846 - protein, 14 aa, Homo sapiens
IRNVLLAFAGVAGV

SEQ ID NO: 48847 - protein, 14 aa, Homo sapiens
RNVLLAFAGVAGVG

SEQ ID NO: 48848 - protein, 14 aa, Homo sapiens
NVLLAFAGVAGVGA

SEQ ID NO: 48849 - protein, 14 aa, Homo sapiens
VLLAFAGVAGVGAG

SEQ ID NO: 48850 - protein, 14 aa, Homo sapiens
LLAFAGVAGVGAGL

SEQ ID NO: 48851 - protein, 14 aa, Homo sapiens
LAFAGVAGVGAGLA

SEQ ID NO: 48852 - protein, 14 aa, Homo sapiens
AFAGVAGVGAGLAY

SEQ ID NO: 48853 - protein, 14 aa, Homo sapiens
FAGVAGVGAGLAYL

SEQ ID NO: 48854 - protein, 14 aa, Homo sapiens
AGVAGVGAGLAYLI

SEQ ID NO: 48855 - protein, 14 aa, Homo sapiens
GVAGVGAGLAYLIR

SEQ ID NO: 48856 - protein, 15 aa, Homo sapiens
MFGLKRNAVIGLNLY

SEQ ID NO: 48857 - protein, 15 aa, Homo sapiens
FGLKRNAVIGLNLYC

SEQ ID NO: 48858 - protein, 15 aa, Homo sapiens
GLKRNAVIGLNLYCG

SEQ ID NO: 48859 - protein, 15 aa, Homo sapiens
LKRNAVIGLNLYCGG

SEQ ID NO: 48860 - protein, 15 aa, Homo sapiens
KRNAVIGLNLYCGGA

SEQ ID NO: 48861 - protein, 15 aa, Homo sapiens
RNAVIGLNLYCGGAG

SEQ ID NO: 48862 - protein, 15 aa, Homo sapiens
NAVIGLNLYCGGAGL

SEQ ID NO: 48863 - protein, 15 aa, Homo sapiens
AVIGLNLYCGGAGLG

SEQ ID NO: 48864 - protein, 15 aa, Homo sapiens
VIGLNLYCGGAGLGA

SEQ ID NO: 48865 - protein, 15 aa, Homo sapiens
IGLNLYCGGAGLGAG

SEQ ID NO: 48866 - protein, 15 aa, Homo sapiens
GLNLYCGGAGLGAGS

SEQ ID NO: 48867 - protein, 15 aa, Homo sapiens
LNLYCGGAGLGAGSG

SEQ ID NO: 48868 - protein, 15 aa, Homo sapiens
NLYCGGAGLGAGSGG

SEQ ID NO: 48869 - protein, 15 aa, Homo sapiens
LYCGGAGLGAGSGGA

SEQ ID NO: 48870 - protein, 15 aa, Homo sapiens
YCGGAGLGAGSGGAT

SEQ ID NO: 48871 - protein, 15 aa, Homo sapiens
CGGAGLGAGSGGATR

SEQ ID NO: 48872 - protein, 15 aa, Homo sapiens
GGAGLGAGSGGATRP

SEQ ID NO: 48873 - protein, 15 aa, Homo sapiens
GAGLGAGSGGATRPG

SEQ ID NO: 48874 - protein, 15 aa, Homo sapiens
AGLGAGSGGATRPGG

SEQ ID NO: 48875 - protein, 15 aa, Homo sapiens
GLGAGSGGATRPGGR

SEQ ID NO: 48876 - protein, 15 aa, Homo sapiens
LGAGSGGATRPGGRL

SEQ ID NO: 48877 - protein, 15 aa, Homo sapiens
GAGSGGATRPGGRLL

SEQ ID NO: 48878 - protein, 15 aa, Homo sapiens
AGSGGATRPGGRLLA

SEQ ID NO: 48879 - protein, 15 aa, Homo sapiens
GSGGATRPGGRLLAT

SEQ ID NO: 48880 - protein, 15 aa, Homo sapiens
SGGATRPGGRLLATE

SEQ ID NO: 48881 - protein, 15 aa, Homo sapiens
GGATRPGGRLLATEK

SEQ ID NO: 48882 - protein, 15 aa, Homo sapiens
GATRPGGRLLATEKE

SEQ ID NO: 48883 - protein, 15 aa, Homo sapiens
ATRPGGRLLATEKEA

SEQ ID NO: 48884 - protein, 15 aa, Homo sapiens
TRPGGRLLATEKEAS

SEQ ID NO: 48885 - protein, 15 aa, Homo sapiens
RPGGRLLATEKEASA

SEQ ID NO: 48886 - protein, 15 aa, Homo sapiens
PGGRLLATEKEASAR

SEQ ID NO: 48887 - protein, 15 aa, Homo sapiens
GGRLLATEKEASARR

SEQ ID NO: 48888 - protein, 15 aa, Homo sapiens
GRLLATEKEASARRE

SEQ ID NO: 48889 - protein, 15 aa, Homo sapiens
RLLATEKEASARREI

SEQ ID NO: 48890 - protein, 15 aa, Homo sapiens
LLATEKEASARREIG

SEQ ID NO: 48891 - protein, 15 aa, Homo sapiens
LATEKEASARREIGG

SEQ ID NO: 48892 - protein, 15 aa, Homo sapiens
ATEKEASARREIGGG

SEQ ID NO: 48893 - protein, 15 aa, Homo sapiens
TEKEASARREIGGGE

SEQ ID NO: 48894 - protein, 15 aa, Homo sapiens
EKEASARREIGGGEA

SEQ ID NO: 48895 - protein, 15 aa, Homo sapiens
KEASARREIGGGEAG

SEQ ID NO: 48896 - protein, 15 aa, Homo sapiens
EASARREIGGGEAGA

SEQ ID NO: 48897 - protein, 15 aa, Homo sapiens
ASARREIGGGEAGAV

SEQ ID NO: 48898 - protein, 15 aa, Homo sapiens
SARREIGGGEAGAVI

SEQ ID NO: 48899 - protein, 15 aa, Homo sapiens
ARREIGGGEAGAVIG

SEQ ID NO: 48900 - protein, 15 aa, Homo sapiens
RREIGGGEAGAVIGG

SEQ ID NO: 48901 - protein, 15 aa, Homo sapiens
REIGGGEAGAVIGGS

SEQ ID NO: 48902 - protein, 15 aa, Homo sapiens
EIGGGEAGAVIGGSA

SEQ ID NO: 48903 - protein, 15 aa, Homo sapiens
IGGGEAGAVIGGSAG

SEQ ID NO: 48904 - protein, 15 aa, Homo sapiens
GGGEAGAVIGGSAGA

SEQ ID NO: 48905 - protein, 15 aa, Homo sapiens
GGEAGAVIGGSAGAS

SEQ ID NO: 48906 - protein, 15 aa, Homo sapiens
GEAGAVIGGSAGASP

SEQ ID NO: 48907 - protein, 15 aa, Homo sapiens
EAGAVIGGSAGASPP

SEQ ID NO: 48908 - protein, 15 aa, Homo sapiens
AGAVIGGSAGASPPS

SEQ ID NO: 48909 - protein, 15 aa, Homo sapiens
GAVIGGSAGASPPST

SEQ ID NO: 48910 - protein, 15 aa, Homo sapiens
AVIGGSAGASPPSTL

SEQ ID NO: 48911 - protein, 15 aa, Homo sapiens
VIGGSAGASPPSTLT

SEQ ID NO: 48912 - protein, 15 aa, Homo sapiens
IGGSAGASPPSTLTP

SEQ ID NO: 48913 - protein, 15 aa, Homo sapiens
GGSAGASPPSTLTPD

SEQ ID NO: 48914 - protein, 15 aa, Homo sapiens
GSAGASPPSTLTPDS

SEQ ID NO: 48915 - protein, 15 aa, Homo sapiens
SAGASPPSTLTPDSR

SEQ ID NO: 48916 - protein, 15 aa, Homo sapiens
AGASPPSTLTPDSRR

SEQ ID NO: 48917 - protein, 15 aa, Homo sapiens
GASPPSTLTPDSRRV

SEQ ID NO: 48918 - protein, 15 aa, Homo sapiens
ASPPSTLTPDSRRVA

SEQ ID NO: 48919 - protein, 15 aa, Homo sapiens
SPPSTLTPDSRRVAR

SEQ ID NO: 48920 - protein, 15 aa, Homo sapiens
PPSTLTPDSRRVARP

SEQ ID NO: 48921 - protein, 15 aa, Homo sapiens
PSTLTPDSRRVARPP

SEQ ID NO: 48922 - protein, 15 aa, Homo sapiens
STLTPDSRRVARPPP

SEQ ID NO: 48923 - protein, 15 aa, Homo sapiens
TLTPDSRRVARPPPI

SEQ ID NO: 48924 - protein, 15 aa, Homo sapiens
LTPDSRRVARPPPIG

SEQ ID NO: 48925 - protein, 15 aa, Homo sapiens
TPDSRRVARPPPIGA

SEQ ID NO: 48926 - protein, 15 aa, Homo sapiens
PDSRRVARPPPIGAE

SEQ ID NO: 48927 - protein, 15 aa, Homo sapiens
DSRRVARPPPIGAEV

SEQ ID NO: 48928 - protein, 15 aa, Homo sapiens
SRRVARPPPIGAEVP

SEQ ID NO: 48929 - protein, 15 aa, Homo sapiens
RRVARPPPIGAEVPD

SEQ ID NO: 48930 - protein, 15 aa, Homo sapiens
RVARPPPIGAEVPDV

SEQ ID NO: 48931 - protein, 15 aa, Homo sapiens
VARPPPIGAEVPDVT

SEQ ID NO: 48932 - protein, 15 aa, Homo sapiens
ARPPPIGAEVPDVTA

SEQ ID NO: 48933 - protein, 15 aa, Homo sapiens
RPPPIGAEVPDVTAT

SEQ ID NO: 48934 - protein, 15 aa, Homo sapiens
PPPIGAEVPDVTATP

SEQ ID NO: 48935 - protein, 15 aa, Homo sapiens
PPIGAEVPDVTATPA

SEQ ID NO: 48936 - protein, 15 aa, Homo sapiens
PIGAEVPDVTATPAR

SEQ ID NO: 48937 - protein, 15 aa, Homo sapiens
IGAEVPDVTATPARL

SEQ ID NO: 48938 - protein, 15 aa, Homo sapiens
GAEVPDVTATPARLL

SEQ ID NO: 48939 - protein, 15 aa, Homo sapiens
AEVPDVTATPARLLF

SEQ ID NO: 48940 - protein, 15 aa, Homo sapiens
EVPDVTATPARLLFF

SEQ ID NO: 48941 - protein, 15 aa, Homo sapiens
VPDVTATPARLLFFA

SEQ ID NO: 48942 - protein, 15 aa, Homo sapiens
PDVTATPARLLFFAP

SEQ ID NO: 48943 - protein, 15 aa, Homo sapiens
DVTATPARLLFFAPT

SEQ ID NO: 48944 - protein, 15 aa, Homo sapiens
VTATPARLLFFAPTR

SEQ ID NO: 48945 - protein, 15 aa, Homo sapiens
TATPARLLFFAPTRR

SEQ ID NO: 48946 - protein, 15 aa, Homo sapiens
ATPARLLFFAPTRRA

SEQ ID NO: 48947 - protein, 15 aa, Homo sapiens
TPARLLFFAPTRRAA

SEQ ID NO: 48948 - protein, 15 aa, Homo sapiens
PARLLFFAPTRRAAP

SEQ ID NO: 48949 - protein, 15 aa, Homo sapiens
ARLLFFAPTRRAAPL

SEQ ID NO: 48950 - protein, 15 aa, Homo sapiens
RLLFFAPTRRAAPLE

SEQ ID NO: 48951 - protein, 15 aa, Homo sapiens
LLFFAPTRRAAPLEE

SEQ ID NO: 48952 - protein, 15 aa, Homo sapiens
LFFAPTRRAAPLEEM

SEQ ID NO: 48953 - protein, 15 aa, Homo sapiens
FFAPTRRAAPLEEME

SEQ ID NO: 48954 - protein, 15 aa, Homo sapiens
FAPTRRAAPLEEMEA

SEQ ID NO: 48955 - protein, 15 aa, Homo sapiens
APTRRAAPLEEMEAP

SEQ ID NO: 48956 - protein, 15 aa, Homo sapiens
PTRRAAPLEEMEAPA

SEQ ID NO: 48957 - protein, 15 aa, Homo sapiens
TRRAAPLEEMEAPAA

SEQ ID NO: 48958 - protein, 15 aa, Homo sapiens
RRAAPLEEMEAPAAD

SEQ ID NO: 48959 - protein, 15 aa, Homo sapiens
RAAPLEEMEAPAADA

SEQ ID NO: 48960 - protein, 15 aa, Homo sapiens
AAPLEEMEAPAADAI

SEQ ID NO: 48961 - protein, 15 aa, Homo sapiens
APLEEMEAPAADAIM

SEQ ID NO: 48962 - protein, 15 aa, Homo sapiens
PLEEMEAPAADAIMS

SEQ ID NO: 48963 - protein, 15 aa, Homo sapiens
LEEMEAPAADAIMSP

SEQ ID NO: 48964 - protein, 15 aa, Homo sapiens
EEMEAPAADAIMSPE

SEQ ID NO: 48965 - protein, 15 aa, Homo sapiens
EMEAPAADAIMSPEE

SEQ ID NO: 48966 - protein, 15 aa, Homo sapiens
MEAPAADAIMSPEEE

SEQ ID NO: 48967 - protein, 15 aa, Homo sapiens
EAPAADAIMSPEEEL

SEQ ID NO: 48968 - protein, 15 aa, Homo sapiens
APAADAIMSPEEELD

SEQ ID NO: 48969 - protein, 15 aa, Homo sapiens
PAADAIMSPEEELDG

SEQ ID NO: 48970 - protein, 15 aa, Homo sapiens
AADAIMSPEEELDGY

SEQ ID NO: 48971 - protein, 15 aa, Homo sapiens
ADAIMSPEEELDGYE

SEQ ID NO: 48972 - protein, 15 aa, Homo sapiens
DAIMSPEEELDGYEP

SEQ ID NO: 48973 - protein, 15 aa, Homo sapiens
AIMSPEEELDGYEPE

SEQ ID NO: 48974 - protein, 15 aa, Homo sapiens
IMSPEEELDGYEPEP

SEQ ID NO: 48975 - protein, 15 aa, Homo sapiens
MSPEEELDGYEPEPL

SEQ ID NO: 48976 - protein, 15 aa, Homo sapiens
SPEEELDGYEPEPLG

SEQ ID NO: 48977 - protein, 15 aa, Homo sapiens
PEEELDGYEPEPLGK

SEQ ID NO: 48978 - protein, 15 aa, Homo sapiens
EEELDGYEPEPLGKR

SEQ ID NO: 48979 - protein, 15 aa, Homo sapiens
EELDGYEPEPLGKRP

SEQ ID NO: 48980 - protein, 15 aa, Homo sapiens
ELDGYEPEPLGKRPA

SEQ ID NO: 48981 - protein, 15 aa, Homo sapiens
LDGYEPEPLGKRPAV

SEQ ID NO: 48982 - protein, 15 aa, Homo sapiens
DGYEPEPLGKRPAVL

SEQ ID NO: 48983 - protein, 15 aa, Homo sapiens
GYEPEPLGKRPAVLP

SEQ ID NO: 48984 - protein, 15 aa, Homo sapiens
YEPEPLGKRPAVLPL

SEQ ID NO: 48985 - protein, 15 aa, Homo sapiens
EPEPLGKRPAVLPLL

SEQ ID NO: 48986 - protein, 15 aa, Homo sapiens
PEPLGKRPAVLPLLE

SEQ ID NO: 48987 - protein, 15 aa, Homo sapiens
EPLGKRPAVLPLLEL

SEQ ID NO: 48988 - protein, 15 aa, Homo sapiens
PLGKRPAVLPLLELV

SEQ ID NO: 48989 - protein, 15 aa, Homo sapiens
LGKRPAVLPLLELVG

SEQ ID NO: 48990 - protein, 15 aa, Homo sapiens
GKRPAVLPLLELVGE

SEQ ID NO: 48991 - protein, 15 aa, Homo sapiens
KRPAVLPLLELVGES

SEQ ID NO: 48992 - protein, 15 aa, Homo sapiens
RPAVLPLLELVGESG

SEQ ID NO: 48993 - protein, 15 aa, Homo sapiens
PAVLPLLELVGESGN

SEQ ID NO: 48994 - protein, 15 aa, Homo sapiens
AVLPLLELVGESGNN

SEQ ID NO: 48995 - protein, 15 aa, Homo sapiens
VLPLLELVGESGNNT

SEQ ID NO: 48996 - protein, 15 aa, Homo sapiens
LPLLELVGESGNNTS

SEQ ID NO: 48997 - protein, 15 aa, Homo sapiens
PLLELVGESGNNTST

SEQ ID NO: 48998 - protein, 15 aa, Homo sapiens
LLELVGESGNNTSTD

SEQ ID NO: 48999 - protein, 15 aa, Homo sapiens
LELVGESGNNTSTDG

SEQ ID NO: 49000 - protein, 15 aa, Homo sapiens
ELVGESGNNTSTDGS

SEQ ID NO: 49001 - protein, 15 aa, Homo sapiens
LVGESGNNTSTDGSL

SEQ ID NO: 49002 - protein, 15 aa, Homo sapiens
VGESGNNTSTDGSLP

SEQ ID NO: 49003 - protein, 15 aa, Homo sapiens
GESGNNTSTDGSLPS

SEQ ID NO: 49004 - protein, 15 aa, Homo sapiens
ESGNNTSTDGSLPST

SEQ ID NO: 49005 - protein, 15 aa, Homo sapiens
SGNNTSTDGSLPSTP

SEQ ID NO: 49006 - protein, 15 aa, Homo sapiens
GNNTSTDGSLPSTPP

SEQ ID NO: 49007 - protein, 15 aa, Homo sapiens
NNTSTDGSLPSTPPP

SEQ ID NO: 49008 - protein, 15 aa, Homo sapiens
NTSTDGSLPSTPPPA

SEQ ID NO: 49009 - protein, 15 aa, Homo sapiens
TSTDGSLPSTPPPAE

SEQ ID NO: 49010 - protein, 15 aa, Homo sapiens
STDGSLPSTPPPAEE

SEQ ID NO: 49011 - protein, 15 aa, Homo sapiens
TDGSLPSTPPPAEEE

SEQ ID NO: 49012 - protein, 15 aa, Homo sapiens
DGSLPSTPPPAEEEE

SEQ ID NO: 49013 - protein, 15 aa, Homo sapiens
GSLPSTPPPAEEEED

SEQ ID NO: 49014 - protein, 15 aa, Homo sapiens
SLPSTPPPAEEEEDD

SEQ ID NO: 49015 - protein, 15 aa, Homo sapiens
LPSTPPPAEEEEDDL

SEQ ID NO: 49016 - protein, 15 aa, Homo sapiens
PSTPPPAEEEEDDLY

SEQ ID NO: 49017 - protein, 15 aa, Homo sapiens
STPPPAEEEEDDLYR

SEQ ID NO: 49018 - protein, 15 aa, Homo sapiens
TPPPAEEEEDDLYRQ

SEQ ID NO: 49019 - protein, 15 aa, Homo sapiens
PPPAEEEEDDLYRQS

SEQ ID NO: 49020 - protein, 15 aa, Homo sapiens
PPAEEEEDDLYRQSL

SEQ ID NO: 49021 - protein, 15 aa, Homo sapiens
PAEEEEDDLYRQSLE

SEQ ID NO: 49022 - protein, 15 aa, Homo sapiens
AEEEEDDLYRQSLEI

SEQ ID NO: 49023 - protein, 15 aa, Homo sapiens
EEEEDDLYRQSLEII

SEQ ID NO: 49024 - protein, 15 aa, Homo sapiens
EEEDDLYRQSLEIIS

SEQ ID NO: 49025 - protein, 15 aa, Homo sapiens
EEDDLYRQSLEIISR

SEQ ID NO: 49026 - protein, 15 aa, Homo sapiens
EDDLYRQSLEIISRY

SEQ ID NO: 49027 - protein, 15 aa, Homo sapiens
DDLYRQSLEIISRYL

SEQ ID NO: 49028 - protein, 15 aa, Homo sapiens
DLYRQSLEIISRYLR

SEQ ID NO: 49029 - protein, 15 aa, Homo sapiens
LYRQSLEIISRYLRE

SEQ ID NO: 49030 - protein, 15 aa, Homo sapiens
YRQSLEIISRYLREQ

SEQ ID NO: 49031 - protein, 15 aa, Homo sapiens
RQSLEIISRYLREQA

SEQ ID NO: 49032 - protein, 15 aa, Homo sapiens
QSLEIISRYLREQAT

SEQ ID NO: 49033 - protein, 15 aa, Homo sapiens
SLEIISRYLREQATG

SEQ ID NO: 49034 - protein, 15 aa, Homo sapiens
LEIISRYLREQATGA

SEQ ID NO: 49035 - protein, 15 aa, Homo sapiens
EIISRYLREQATGAK

SEQ ID NO: 49036 - protein, 15 aa, Homo sapiens
IISRYLREQATGAKD

SEQ ID NO: 49037 - protein, 15 aa, Homo sapiens
ISRYLREQATGAKDT

SEQ ID NO: 49038 - protein, 15 aa, Homo sapiens
SRYLREQATGAKDTK

SEQ ID NO: 49039 - protein, 15 aa, Homo sapiens
RYLREQATGAKDTKP

SEQ ID NO: 49040 - protein, 15 aa, Homo sapiens
YLREQATGAKDTKPM

SEQ ID NO: 49041 - protein, 15 aa, Homo sapiens
LREQATGAKDTKPMG

SEQ ID NO: 49042 - protein, 15 aa, Homo sapiens
REQATGAKDTKPMGR

SEQ ID NO: 49043 - protein, 15 aa, Homo sapiens
EQATGAKDTKPMGRS

SEQ ID NO: 49044 - protein, 15 aa, Homo sapiens
QATGAKDTKPMGRSG

SEQ ID NO: 49045 - protein, 15 aa, Homo sapiens
ATGAKDTKPMGRSGA

SEQ ID NO: 49046 - protein, 15 aa, Homo sapiens
TGAKDTKPMGRSGAT

SEQ ID NO: 49047 - protein, 15 aa, Homo sapiens
GAKDTKPMGRSGATS

SEQ ID NO: 49048 - protein, 15 aa, Homo sapiens
AKDTKPMGRSGATSR

SEQ ID NO: 49049 - protein, 15 aa, Homo sapiens
KDTKPMGRSGATSRK

SEQ ID NO: 49050 - protein, 15 aa, Homo sapiens
DTKPMGRSGATSRKA

SEQ ID NO: 49051 - protein, 15 aa, Homo sapiens
TKPMGRSGATSRKAL

SEQ ID NO: 49052 - protein, 15 aa, Homo sapiens
KPMGRSGATSRKALE

SEQ ID NO: 49053 - protein, 15 aa, Homo sapiens
PMGRSGATSRKALET

SEQ ID NO: 49054 - protein, 15 aa, Homo sapiens
MGRSGATSRKALETL

SEQ ID NO: 49055 - protein, 15 aa, Homo sapiens
GRSGATSRKALETLR

SEQ ID NO: 49056 - protein, 15 aa, Homo sapiens
RSGATSRKALETLRR

SEQ ID NO: 49057 - protein, 15 aa, Homo sapiens
SGATSRKALETLRRV

SEQ ID NO: 49058 - protein, 15 aa, Homo sapiens
GATSRKALETLRRVG

SEQ ID NO: 49059 - protein, 15 aa, Homo sapiens
ATSRKALETLRRVGD

SEQ ID NO: 49060 - protein, 15 aa, Homo sapiens
TSRKALETLRRVGDG

SEQ ID NO: 49061 - protein, 15 aa, Homo sapiens
SRKALETLRRVGDGV

SEQ ID NO: 49062 - protein, 15 aa, Homo sapiens
RKALETLRRVGDGVQ

SEQ ID NO: 49063 - protein, 15 aa, Homo sapiens
KALETLRRVGDGVQR

SEQ ID NO: 49064 - protein, 15 aa, Homo sapiens
ALETLRRVGDGVQRN

SEQ ID NO: 49065 - protein, 15 aa, Homo sapiens
LETLRRVGDGVQRNH

SEQ ID NO: 49066 - protein, 15 aa, Homo sapiens
ETLRRVGDGVQRNHE

SEQ ID NO: 49067 - protein, 15 aa, Homo sapiens
TLRRVGDGVQRNHET

SEQ ID NO: 49068 - protein, 15 aa, Homo sapiens
LRRVGDGVQRNHETA

SEQ ID NO: 49069 - protein, 15 aa, Homo sapiens
RRVGDGVQRNHETAF

SEQ ID NO: 49070 - protein, 15 aa, Homo sapiens
RVGDGVQRNHETAFQ

SEQ ID NO: 49071 - protein, 15 aa, Homo sapiens
VGDGVQRNHETAFQG

SEQ ID NO: 49072 - protein, 15 aa, Homo sapiens
GDGVQRNHETAFQGM

SEQ ID NO: 49073 - protein, 15 aa, Homo sapiens
DGVQRNHETAFQGML

SEQ ID NO: 49074 - protein, 15 aa, Homo sapiens
GVQRNHETAFQGMLR

SEQ ID NO: 49075 - protein, 15 aa, Homo sapiens
VQRNHETAFQGMLRK

SEQ ID NO: 49076 - protein, 15 aa, Homo sapiens
QRNHETAFQGMLRKL

SEQ ID NO: 49077 - protein, 15 aa, Homo sapiens
RNHETAFQGMLRKLD

SEQ ID NO: 49078 - protein, 15 aa, Homo sapiens
NHETAFQGMLRKLDI

SEQ ID NO: 49079 - protein, 15 aa, Homo sapiens
HETAFQGMLRKLDIK

SEQ ID NO: 49080 - protein, 15 aa, Homo sapiens
ETAFQGMLRKLDIKN

SEQ ID NO: 49081 - protein, 15 aa, Homo sapiens
TAFQGMLRKLDIKNE

SEQ ID NO: 49082 - protein, 15 aa, Homo sapiens
AFQGMLRKLDIKNED

SEQ ID NO: 49083 - protein, 15 aa, Homo sapiens
FQGMLRKLDIKNEDD

SEQ ID NO: 49084 - protein, 15 aa, Homo sapiens
QGMLRKLDIKNEDDV

SEQ ID NO: 49085 - protein, 15 aa, Homo sapiens
GMLRKLDIKNEDDVK

SEQ ID NO: 49086 - protein, 15 aa, Homo sapiens
MLRKLDIKNEDDVKS

SEQ ID NO: 49087 - protein, 15 aa, Homo sapiens
LRKLDIKNEDDVKSL

SEQ ID NO: 49088 - protein, 15 aa, Homo sapiens
RKLDIKNEDDVKSLS

SEQ ID NO: 49089 - protein, 15 aa, Homo sapiens
KLDIKNEDDVKSLSR

SEQ ID NO: 49090 - protein, 15 aa, Homo sapiens
LDIKNEDDVKSLSRV

SEQ ID NO: 49091 - protein, 15 aa, Homo sapiens
DIKNEDDVKSLSRVM

SEQ ID NO: 49092 - protein, 15 aa, Homo sapiens
IKNEDDVKSLSRVMI

SEQ ID NO: 49093 - protein, 15 aa, Homo sapiens
KNEDDVKSLSRVMIH

SEQ ID NO: 49094 - protein, 15 aa, Homo sapiens
NEDDVKSLSRVMIHV

SEQ ID NO: 49095 - protein, 15 aa, Homo sapiens
EDDVKSLSRVMIHVF

SEQ ID NO: 49096 - protein, 15 aa, Homo sapiens
DDVKSLSRVMIHVFS

SEQ ID NO: 49097 - protein, 15 aa, Homo sapiens
DVKSLSRVMIHVFSD

SEQ ID NO: 49098 - protein, 15 aa, Homo sapiens
VKSLSRVMIHVFSDG

SEQ ID NO: 49099 - protein, 15 aa, Homo sapiens
KSLSRVMIHVFSDGV

SEQ ID NO: 49100 - protein, 15 aa, Homo sapiens
SLSRVMIHVFSDGVT

SEQ ID NO: 49101 - protein, 15 aa, Homo sapiens
LSRVMIHVFSDGVTN

SEQ ID NO: 49102 - protein, 15 aa, Homo sapiens
SRVMIHVFSDGVTNW

SEQ ID NO: 49103 - protein, 15 aa, Homo sapiens
RVMIHVFSDGVTNWG

SEQ ID NO: 49104 - protein, 15 aa, Homo sapiens
VMIHVFSDGVTNWGR

SEQ ID NO: 49105 - protein, 15 aa, Homo sapiens
MIHVFSDGVTNWGRI

SEQ ID NO: 49106 - protein, 15 aa, Homo sapiens
IHVFSDGVTNWGRIV

SEQ ID NO: 49107 - protein, 15 aa, Homo sapiens
HVFSDGVTNWGRIVT

SEQ ID NO: 49108 - protein, 15 aa, Homo sapiens
VFSDGVTNWGRIVTL

SEQ ID NO: 49109 - protein, 15 aa, Homo sapiens
FSDGVTNWGRIVTLI

SEQ ID NO: 49110 - protein, 15 aa, Homo sapiens
SDGVTNWGRIVTLIS

SEQ ID NO: 49111 - protein, 15 aa, Homo sapiens
DGVTNWGRIVTLISF

SEQ ID NO: 49112 - protein, 15 aa, Homo sapiens
GVTNWGRIVTLISFG

SEQ ID NO: 49113 - protein, 15 aa, Homo sapiens
VTNWGRIVTLISFGA

SEQ ID NO: 49114 - protein, 15 aa, Homo sapiens
TNWGRIVTLISFGAF

SEQ ID NO: 49115 - protein, 15 aa, Homo sapiens
NWGRIVTLISFGAFV

SEQ ID NO: 49116 - protein, 15 aa, Homo sapiens
WGRIVTLISFGAFVA

SEQ ID NO: 49117 - protein, 15 aa, Homo sapiens
GRIVTLISFGAFVAK

SEQ ID NO: 49118 - protein, 15 aa, Homo sapiens
RIVTLISFGAFVAKH

SEQ ID NO: 49119 - protein, 15 aa, Homo sapiens
IVTLISFGAFVAKHL

SEQ ID NO: 49120 - protein, 15 aa, Homo sapiens
VTLISFGAFVAKHLK

SEQ ID NO: 49121 - protein, 15 aa, Homo sapiens
TLISFGAFVAKHLKT

SEQ ID NO: 49122 - protein, 15 aa, Homo sapiens
LISFGAFVAKHLKTI

SEQ ID NO: 49123 - protein, 15 aa, Homo sapiens
ISFGAFVAKHLKTIN

SEQ ID NO: 49124 - protein, 15 aa, Homo sapiens
SFGAFVAKHLKTINQ

SEQ ID NO: 49125 - protein, 15 aa, Homo sapiens
FGAFVAKHLKTINQE

SEQ ID NO: 49126 - protein, 15 aa, Homo sapiens
GAFVAKHLKTINQES

SEQ ID NO: 49127 - protein, 15 aa, Homo sapiens
AFVAKHLKTINQESC

SEQ ID NO: 49128 - protein, 15 aa, Homo sapiens
FVAKHLKTINQESCI

SEQ ID NO: 49129 - protein, 15 aa, Homo sapiens
VAKHLKTINQESCIE

SEQ ID NO: 49130 - protein, 15 aa, Homo sapiens
AKHLKTINQESCIEP

SEQ ID NO: 49131 - protein, 15 aa, Homo sapiens
KHLKTINQESCIEPL

SEQ ID NO: 49132 - protein, 15 aa, Homo sapiens
HLKTINQESCIEPLA

SEQ ID NO: 49133 - protein, 15 aa, Homo sapiens
LKTINQESCIEPLAE

SEQ ID NO: 49134 - protein, 15 aa, Homo sapiens
KTINQESCIEPLAES

SEQ ID NO: 49135 - protein, 15 aa, Homo sapiens
TINQESCIEPLAESI

SEQ ID NO: 49136 - protein, 15 aa, Homo sapiens
INQESCIEPLAESIT

SEQ ID NO: 49137 - protein, 15 aa, Homo sapiens
NQESCIEPLAESITD

SEQ ID NO: 49138 - protein, 15 aa, Homo sapiens
QESCIEPLAESITDV

SEQ ID NO: 49139 - protein, 15 aa, Homo sapiens
ESCIEPLAESITDVL

SEQ ID NO: 49140 - protein, 15 aa, Homo sapiens
SCIEPLAESITDVLV

SEQ ID NO: 49141 - protein, 15 aa, Homo sapiens
CIEPLAESITDVLVR

SEQ ID NO: 49142 - protein, 15 aa, Homo sapiens
IEPLAESITDVLVRT

SEQ ID NO: 49143 - protein, 15 aa, Homo sapiens
EPLAESITDVLVRTK

SEQ ID NO: 49144 - protein, 15 aa, Homo sapiens
PLAESITDVLVRTKR

SEQ ID NO: 49145 - protein, 15 aa, Homo sapiens
LAESITDVLVRTKRD

SEQ ID NO: 49146 - protein, 15 aa, Homo sapiens
AESITDVLVRTKRDW

SEQ ID NO: 49147 - protein, 15 aa, Homo sapiens
ESITDVLVRTKRDWL

SEQ ID NO: 49148 - protein, 15 aa, Homo sapiens
SITDVLVRTKRDWLV

SEQ ID NO: 49149 - protein, 15 aa, Homo sapiens
ITDVLVRTKRDWLVK

SEQ ID NO: 49150 - protein, 15 aa, Homo sapiens
TDVLVRTKRDWLVKQ

SEQ ID NO: 49151 - protein, 15 aa, Homo sapiens
DVLVRTKRDWLVKQR

SEQ ID NO: 49152 - protein, 15 aa, Homo sapiens
VLVRTKRDWLVKQRG

SEQ ID NO: 49153 - protein, 15 aa, Homo sapiens
LVRTKRDWLVKQRGW

SEQ ID NO: 49154 - protein, 15 aa, Homo sapiens
VRTKRDWLVKQRGWD

SEQ ID NO: 49155 - protein, 15 aa, Homo sapiens
RTKRDWLVKQRGWDG

SEQ ID NO: 49156 - protein, 15 aa, Homo sapiens
TKRDWLVKQRGWDGF

SEQ ID NO: 49157 - protein, 15 aa, Homo sapiens
KRDWLVKQRGWDGFV

SEQ ID NO: 49158 - protein, 15 aa, Homo sapiens
RDWLVKQRGWDGFVE

SEQ ID NO: 49159 - protein, 15 aa, Homo sapiens
DWLVKQRGWDGFVEF

SEQ ID NO: 49160 - protein, 15 aa, Homo sapiens
WLVKQRGWDGFVEFF

SEQ ID NO: 49161 - protein, 15 aa, Homo sapiens
LVKQRGWDGFVEFFH

SEQ ID NO: 49162 - protein, 15 aa, Homo sapiens
VKQRGWDGFVEFFHV

SEQ ID NO: 49163 - protein, 15 aa, Homo sapiens
KQRGWDGFVEFFHVE

SEQ ID NO: 49164 - protein, 15 aa, Homo sapiens
QRGWDGFVEFFHVED

SEQ ID NO: 49165 - protein, 15 aa, Homo sapiens
RGWDGFVEFFHVEDL

SEQ ID NO: 49166 - protein, 15 aa, Homo sapiens
GWDGFVEFFHVEDLE

SEQ ID NO: 49167 - protein, 15 aa, Homo sapiens
WDGFVEFFHVEDLEG

SEQ ID NO: 49168 - protein, 15 aa, Homo sapiens
DGFVEFFHVEDLEGG

SEQ ID NO: 49169 - protein, 15 aa, Homo sapiens
GFVEFFHVEDLEGGI

SEQ ID NO: 49170 - protein, 15 aa, Homo sapiens
FVEFFHVEDLEGGIR

SEQ ID NO: 49171 - protein, 15 aa, Homo sapiens
VEFFHVEDLEGGIRN

SEQ ID NO: 49172 - protein, 15 aa, Homo sapiens
EFFHVEDLEGGIRNV

SEQ ID NO: 49173 - protein, 15 aa, Homo sapiens
FFHVEDLEGGIRNVL

SEQ ID NO: 49174 - protein, 15 aa, Homo sapiens
FHVEDLEGGIRNVLL

SEQ ID NO: 49175 - protein, 15 aa, Homo sapiens
HVEDLEGGIRNVLLA

SEQ ID NO: 49176 - protein, 15 aa, Homo sapiens
VEDLEGGIRNVLLAF

SEQ ID NO: 49177 - protein, 15 aa, Homo sapiens
EDLEGGIRNVLLAFA

SEQ ID NO: 49178 - protein, 15 aa, Homo sapiens
DLEGGIRNVLLAFAG

SEQ ID NO: 49179 - protein, 15 aa, Homo sapiens
LEGGIRNVLLAFAGV

SEQ ID NO: 49180 - protein, 15 aa, Homo sapiens
EGGIRNVLLAFAGVA

SEQ ID NO: 49181 - protein, 15 aa, Homo sapiens
GGIRNVLLAFAGVAG

SEQ ID NO: 49182 - protein, 15 aa, Homo sapiens
GIRNVLLAFAGVAGV

SEQ ID NO: 49183 - protein, 15 aa, Homo sapiens
IRNVLLAFAGVAGVG

SEQ ID NO: 49184 - protein, 15 aa, Homo sapiens
RNVLLAFAGVAGVGA

SEQ ID NO: 49185 - protein, 15 aa, Homo sapiens
NVLLAFAGVAGVGAG

SEQ ID NO: 49186 - protein, 15 aa, Homo sapiens
VLLAFAGVAGVGAGL

SEQ ID NO: 49187 - protein, 15 aa, Homo sapiens
LLAFAGVAGVGAGLA

SEQ ID NO: 49188 - protein, 15 aa, Homo sapiens
LAFAGVAGVGAGLAY

SEQ ID NO: 49189 - protein, 15 aa, Homo sapiens
AFAGVAGVGAGLAYL

SEQ ID NO: 49190 - protein, 15 aa, Homo sapiens
FAGVAGVGAGLAYLI

SEQ ID NO: 49191 - protein, 15 aa, Homo sapiens
AGVAGVGAGLAYLIR

SEQ ID NO: 49192 - protein, 16 aa, Homo sapiens
MFGLKRNAVIGLNLYC

SEQ ID NO: 49193 - protein, 16 aa, Homo sapiens
FGLKRNAVIGLNLYCG

SEQ ID NO: 49194 - protein, 16 aa, Homo sapiens
GLKRNAVIGLNLYCGG

SEQ ID NO: 49195 - protein, 16 aa, Homo sapiens
LKRNAVIGLNLYCGGA

SEQ ID NO: 49196 - protein, 16 aa, Homo sapiens
KRNAVIGLNLYCGGAG

SEQ ID NO: 49197 - protein, 16 aa, Homo sapiens
RNAVIGLNLYCGGAGL

SEQ ID NO: 49198 - protein, 16 aa, Homo sapiens
NAVIGLNLYCGGAGLG

SEQ ID NO: 49199 - protein, 16 aa, Homo sapiens
AVIGLNLYCGGAGLGA

SEQ ID NO: 49200 - protein, 16 aa, Homo sapiens
VIGLNLYCGGAGLGAG

SEQ ID NO: 49201 - protein, 16 aa, Homo sapiens
IGLNLYCGGAGLGAGS

SEQ ID NO: 49202 - protein, 16 aa, Homo sapiens
GLNLYCGGAGLGAGSG

SEQ ID NO: 49203 - protein, 16 aa, Homo sapiens
LNLYCGGAGLGAGSGG

SEQ ID NO: 49204 - protein, 16 aa, Homo sapiens
NLYCGGAGLGAGSGGA

SEQ ID NO: 49205 - protein, 16 aa, Homo sapiens
LYCGGAGLGAGSGGAT

SEQ ID NO: 49206 - protein, 16 aa, Homo sapiens
YCGGAGLGAGSGGATR

SEQ ID NO: 49207 - protein, 16 aa, Homo sapiens
CGGAGLGAGSGGATRP

SEQ ID NO: 49208 - protein, 16 aa, Homo sapiens
GGAGLGAGSGGATRPG

SEQ ID NO: 49209 - protein, 16 aa, Homo sapiens
GAGLGAGSGGATRPGG

SEQ ID NO: 49210 - protein, 16 aa, Homo sapiens
AGLGAGSGGATRPGGR

SEQ ID NO: 49211 - protein, 16 aa, Homo sapiens
GLGAGSGGATRPGGRL

SEQ ID NO: 49212 - protein, 16 aa, Homo sapiens
LGAGSGGATRPGGRLL

SEQ ID NO: 49213 - protein, 16 aa, Homo sapiens
GAGSGGATRPGGRLLA

SEQ ID NO: 49214 - protein, 16 aa, Homo sapiens
AGSGGATRPGGRLLAT

SEQ ID NO: 49215 - protein, 16 aa, Homo sapiens
GSGGATRPGGRLLATE

SEQ ID NO: 49216 - protein, 16 aa, Homo sapiens
SGGATRPGGRLLATEK

SEQ ID NO: 49217 - protein, 16 aa, Homo sapiens
GGATRPGGRLLATEKE

SEQ ID NO: 49218 - protein, 16 aa, Homo sapiens
GATRPGGRLLATEKEA

SEQ ID NO: 49219 - protein, 16 aa, Homo sapiens
ATRPGGRLLATEKEAS

SEQ ID NO: 49220 - protein, 16 aa, Homo sapiens
TRPGGRLLATEKEASA

SEQ ID NO: 49221 - protein, 16 aa, Homo sapiens
RPGGRLLATEKEASAR

SEQ ID NO: 49222 - protein, 16 aa, Homo sapiens
PGGRLLATEKEASARR

SEQ ID NO: 49223 - protein, 16 aa, Homo sapiens
GGRLLATEKEASARRE

SEQ ID NO: 49224 - protein, 16 aa, Homo sapiens
GRLLATEKEASARREI

SEQ ID NO: 49225 - protein, 16 aa, Homo sapiens
RLLATEKEASARREIG

SEQ ID NO: 49226 - protein, 16 aa, Homo sapiens
LLATEKEASARREIGG

SEQ ID NO: 49227 - protein, 16 aa, Homo sapiens
LATEKEASARREIGGG

SEQ ID NO: 49228 - protein, 16 aa, Homo sapiens
ATEKEASARREIGGGE

SEQ ID NO: 49229 - protein, 16 aa, Homo sapiens
TEKEASARREIGGGEA

SEQ ID NO: 49230 - protein, 16 aa, Homo sapiens
EKEASARREIGGGEAG

SEQ ID NO: 49231 - protein, 16 aa, Homo sapiens
KEASARREIGGGEAGA

SEQ ID NO: 49232 - protein, 16 aa, Homo sapiens
EASARREIGGGEAGAV

SEQ ID NO: 49233 - protein, 16 aa, Homo sapiens
ASARREIGGGEAGAVI

SEQ ID NO: 49234 - protein, 16 aa, Homo sapiens
SARREIGGGEAGAVIG

SEQ ID NO: 49235 - protein, 16 aa, Homo sapiens
ARREIGGGEAGAVIGG

SEQ ID NO: 49236 - protein, 16 aa, Homo sapiens
RREIGGGEAGAVIGGS

SEQ ID NO: 49237 - protein, 16 aa, Homo sapiens
REIGGGEAGAVIGGSA

SEQ ID NO: 49238 - protein, 16 aa, Homo sapiens
EIGGGEAGAVIGGSAG

SEQ ID NO: 49239 - protein, 16 aa, Homo sapiens
IGGGEAGAVIGGSAGA

SEQ ID NO: 49240 - protein, 16 aa, Homo sapiens
GGGEAGAVIGGSAGAS

SEQ ID NO: 49241 - protein, 16 aa, Homo sapiens
GGEAGAVIGGSAGASP

SEQ ID NO: 49242 - protein, 16 aa, Homo sapiens
GEAGAVIGGSAGASPP

SEQ ID NO: 49243 - protein, 16 aa, Homo sapiens
EAGAVIGGSAGASPPS

SEQ ID NO: 49244 - protein, 16 aa, Homo sapiens
AGAVIGGSAGASPPST

SEQ ID NO: 49245 - protein, 16 aa, Homo sapiens
GAVIGGSAGASPPSTL

SEQ ID NO: 49246 - protein, 16 aa, Homo sapiens
AVIGGSAGASPPSTLT

SEQ ID NO: 49247 - protein, 16 aa, Homo sapiens
VIGGSAGASPPSTLTP

SEQ ID NO: 49248 - protein, 16 aa, Homo sapiens
IGGSAGASPPSTLTPD

SEQ ID NO: 49249 - protein, 16 aa, Homo sapiens
GGSAGASPPSTLTPDS

SEQ ID NO: 49250 - protein, 16 aa, Homo sapiens
GSAGASPPSTLTPDSR

SEQ ID NO: 49251 - protein, 16 aa, Homo sapiens
SAGASPPSTLTPDSRR

SEQ ID NO: 49252 - protein, 16 aa, Homo sapiens
AGASPPSTLTPDSRRV

SEQ ID NO: 49253 - protein, 16 aa, Homo sapiens
GASPPSTLTPDSRRVA

SEQ ID NO: 49254 - protein, 16 aa, Homo sapiens
ASPPSTLTPDSRRVAR

SEQ ID NO: 49255 - protein, 16 aa, Homo sapiens
SPPSTLTPDSRRVARP

SEQ ID NO: 49256 - protein, 16 aa, Homo sapiens
PPSTLTPDSRRVARPP

SEQ ID NO: 49257 - protein, 16 aa, Homo sapiens
PSTLTPDSRRVARPPP

SEQ ID NO: 49258 - protein, 16 aa, Homo sapiens
STLTPDSRRVARPPPI

SEQ ID NO: 49259 - protein, 16 aa, Homo sapiens
TLTPDSRRVARPPPIG

SEQ ID NO: 49260 - protein, 16 aa, Homo sapiens
LTPDSRRVARPPPIGA

SEQ ID NO: 49261 - protein, 16 aa, Homo sapiens
TPDSRRVARPPPIGAE

SEQ ID NO: 49262 - protein, 16 aa, Homo sapiens
PDSRRVARPPPIGAEV

SEQ ID NO: 49263 - protein, 16 aa, Homo sapiens
DSRRVARPPPIGAEVP

SEQ ID NO: 49264 - protein, 16 aa, Homo sapiens
SRRVARPPPIGAEVPD

SEQ ID NO: 49265 - protein, 16 aa, Homo sapiens
RRVARPPPIGAEVPDV

SEQ ID NO: 49266 - protein, 16 aa, Homo sapiens
RVARPPPIGAEVPDVT

SEQ ID NO: 49267 - protein, 16 aa, Homo sapiens
VARPPPIGAEVPDVTA

SEQ ID NO: 49268 - protein, 16 aa, Homo sapiens
ARPPPIGAEVPDVTAT

SEQ ID NO: 49269 - protein, 16 aa, Homo sapiens
RPPPIGAEVPDVTATP

SEQ ID NO: 49270 - protein, 16 aa, Homo sapiens
PPPIGAEVPDVTATPA

SEQ ID NO: 49271 - protein, 16 aa, Homo sapiens
PPIGAEVPDVTATPAR

SEQ ID NO: 49272 - protein, 16 aa, Homo sapiens
PIGAEVPDVTATPARL

SEQ ID NO: 49273 - protein, 16 aa, Homo sapiens
IGAEVPDVTATPARLL

SEQ ID NO: 49274 - protein, 16 aa, Homo sapiens
GAEVPDVTATPARLLF

SEQ ID NO: 49275 - protein, 16 aa, Homo sapiens
AEVPDVTATPARLLFF

SEQ ID NO: 49276 - protein, 16 aa, Homo sapiens
EVPDVTATPARLLFFA

SEQ ID NO: 49277 - protein, 16 aa, Homo sapiens
VPDVTATPARLLFFAP

SEQ ID NO: 49278 - protein, 16 aa, Homo sapiens
PDVTATPARLLFFAPT

SEQ ID NO: 49279 - protein, 16 aa, Homo sapiens
DVTATPARLLFFAPTR

SEQ ID NO: 49280 - protein, 16 aa, Homo sapiens
VTATPARLLFFAPTRR

SEQ ID NO: 49281 - protein, 16 aa, Homo sapiens
TATPARLLFFAPTRRA

SEQ ID NO: 49282 - protein, 16 aa, Homo sapiens
ATPARLLFFAPTRRAA

SEQ ID NO: 49283 - protein, 16 aa, Homo sapiens
TPARLLFFAPTRRAAP

SEQ ID NO: 49284 - protein, 16 aa, Homo sapiens
PARLLFFAPTRRAAPL

SEQ ID NO: 49285 - protein, 16 aa, Homo sapiens
ARLLFFAPTRRAAPLE

SEQ ID NO: 49286 - protein, 16 aa, Homo sapiens
RLLFFAPTRRAAPLEE

SEQ ID NO: 49287 - protein, 16 aa, Homo sapiens
LLFFAPTRRAAPLEEM

SEQ ID NO: 49288 - protein, 16 aa, Homo sapiens
LFFAPTRRAAPLEEME

SEQ ID NO: 49289 - protein, 16 aa, Homo sapiens
FFAPTRRAAPLEEMEA

SEQ ID NO: 49290 - protein, 16 aa, Homo sapiens
FAPTRRAAPLEEMEAP

SEQ ID NO: 49291 - protein, 16 aa, Homo sapiens
APTRRAAPLEEMEAPA

SEQ ID NO: 49292 - protein, 16 aa, Homo sapiens
PTRRAAPLEEMEAPAA

SEQ ID NO: 49293 - protein, 16 aa, Homo sapiens
TRRAAPLEEMEAPAAD

SEQ ID NO: 49294 - protein, 16 aa, Homo sapiens
RRAAPLEEMEAPAADA

SEQ ID NO: 49295 - protein, 16 aa, Homo sapiens
RAAPLEEMEAPAADAI

SEQ ID NO: 49296 - protein, 16 aa, Homo sapiens
AAPLEEMEAPAADAIM

SEQ ID NO: 49297 - protein, 16 aa, Homo sapiens
APLEEMEAPAADAIMS

SEQ ID NO: 49298 - protein, 16 aa, Homo sapiens
PLEEMEAPAADAIMSP

SEQ ID NO: 49299 - protein, 16 aa, Homo sapiens
LEEMEAPAADAIMSPE

SEQ ID NO: 49300 - protein, 16 aa, Homo sapiens
EEMEAPAADAIMSPEE

SEQ ID NO: 49301 - protein, 16 aa, Homo sapiens
EMEAPAADAIMSPEEE

SEQ ID NO: 49302 - protein, 16 aa, Homo sapiens
MEAPAADAIMSPEEEL

SEQ ID NO: 49303 - protein, 16 aa, Homo sapiens
EAPAADAIMSPEEELD

SEQ ID NO: 49304 - protein, 16 aa, Homo sapiens
APAADAIMSPEEELDG

SEQ ID NO: 49305 - protein, 16 aa, Homo sapiens
PAADAIMSPEEELDGY

SEQ ID NO: 49306 - protein, 16 aa, Homo sapiens
AADAIMSPEEELDGYE

SEQ ID NO: 49307 - protein, 16 aa, Homo sapiens
ADAIMSPEEELDGYEP

SEQ ID NO: 49308 - protein, 16 aa, Homo sapiens
DAIMSPEEELDGYEPE

SEQ ID NO: 49309 - protein, 16 aa, Homo sapiens
AIMSPEEELDGYEPEP

SEQ ID NO: 49310 - protein, 16 aa, Homo sapiens
IMSPEEELDGYEPEPL

SEQ ID NO: 49311 - protein, 16 aa, Homo sapiens
MSPEEELDGYEPEPLG

SEQ ID NO: 49312 - protein, 16 aa, Homo sapiens
SPEEELDGYEPEPLGK

SEQ ID NO: 49313 - protein, 16 aa, Homo sapiens
PEEELDGYEPEPLGKR

SEQ ID NO: 49314 - protein, 16 aa, Homo sapiens
EEELDGYEPEPLGKRP

SEQ ID NO: 49315 - protein, 16 aa, Homo sapiens
EELDGYEPEPLGKRPA

SEQ ID NO: 49316 - protein, 16 aa, Homo sapiens
ELDGYEPEPLGKRPAV

SEQ ID NO: 49317 - protein, 16 aa, Homo sapiens
LDGYEPEPLGKRPAVL

SEQ ID NO: 49318 - protein, 16 aa, Homo sapiens
DGYEPEPLGKRPAVLP

SEQ ID NO: 49319 - protein, 16 aa, Homo sapiens
GYEPEPLGKRPAVLPL

SEQ ID NO: 49320 - protein, 16 aa, Homo sapiens
YEPEPLGKRPAVLPLL

SEQ ID NO: 49321 - protein, 16 aa, Homo sapiens
EPEPLGKRPAVLPLLE

SEQ ID NO: 49322 - protein, 16 aa, Homo sapiens
PEPLGKRPAVLPLLEL

SEQ ID NO: 49323 - protein, 16 aa, Homo sapiens
EPLGKRPAVLPLLELV

SEQ ID NO: 49324 - protein, 16 aa, Homo sapiens
PLGKRPAVLPLLELVG

SEQ ID NO: 49325 - protein, 16 aa, Homo sapiens
LGKRPAVLPLLELVGE

SEQ ID NO: 49326 - protein, 16 aa, Homo sapiens
GKRPAVLPLLELVGES

SEQ ID NO: 49327 - protein, 16 aa, Homo sapiens
KRPAVLPLLELVGESG

SEQ ID NO: 49328 - protein, 16 aa, Homo sapiens
RPAVLPLLELVGESGN

SEQ ID NO: 49329 - protein, 16 aa, Homo sapiens
PAVLPLLELVGESGNN

SEQ ID NO: 49330 - protein, 16 aa, Homo sapiens
AVLPLLELVGESGNNT

SEQ ID NO: 49331 - protein, 16 aa, Homo sapiens
VLPLLELVGESGNNTS

SEQ ID NO: 49332 - protein, 16 aa, Homo sapiens
LPLLELVGESGNNTST

SEQ ID NO: 49333 - protein, 16 aa, Homo sapiens
PLLELVGESGNNTSTD

SEQ ID NO: 49334 - protein, 16 aa, Homo sapiens
LLELVGESGNNTSTDG

SEQ ID NO: 49335 - protein, 16 aa, Homo sapiens
LELVGESGNNTSTDGS

SEQ ID NO: 49336 - protein, 16 aa, Homo sapiens
ELVGESGNNTSTDGSL

SEQ ID NO: 49337 - protein, 16 aa, Homo sapiens
LVGESGNNTSTDGSLP

SEQ ID NO: 49338 - protein, 16 aa, Homo sapiens
VGESGNNTSTDGSLPS

SEQ ID NO: 49339 - protein, 16 aa, Homo sapiens
GESGNNTSTDGSLPST

SEQ ID NO: 49340 - protein, 16 aa, Homo sapiens
ESGNNTSTDGSLPSTP

SEQ ID NO: 49341 - protein, 16 aa, Homo sapiens
SGNNTSTDGSLPSTPP

SEQ ID NO: 49342 - protein, 16 aa, Homo sapiens
GNNTSTDGSLPSTPPP

SEQ ID NO: 49343 - protein, 16 aa, Homo sapiens
NNTSTDGSLPSTPPPA

SEQ ID NO: 49344 - protein, 16 aa, Homo sapiens
NTSTDGSLPSTPPPAE

SEQ ID NO: 49345 - protein, 16 aa, Homo sapiens
TSTDGSLPSTPPPAEE

SEQ ID NO: 49346 - protein, 16 aa, Homo sapiens
STDGSLPSTPPPAEEE

SEQ ID NO: 49347 - protein, 16 aa, Homo sapiens
TDGSLPSTPPPAEEEE

SEQ ID NO: 49348 - protein, 16 aa, Homo sapiens
DGSLPSTPPPAEEEED

SEQ ID NO: 49349 - protein, 16 aa, Homo sapiens
GSLPSTPPPAEEEEDD

SEQ ID NO: 49350 - protein, 16 aa, Homo sapiens
SLPSTPPPAEEEEDDL

SEQ ID NO: 49351 - protein, 16 aa, Homo sapiens
LPSTPPPAEEEEDDLY

SEQ ID NO: 49352 - protein, 16 aa, Homo sapiens
PSTPPPAEEEEDDLYR

SEQ ID NO: 49353 - protein, 16 aa, Homo sapiens
STPPPAEEEEDDLYRQ

SEQ ID NO: 49354 - protein, 16 aa, Homo sapiens
TPPPAEEEEDDLYRQS

SEQ ID NO: 49355 - protein, 16 aa, Homo sapiens
PPPAEEEEDDLYRQSL

SEQ ID NO: 49356 - protein, 16 aa, Homo sapiens
PPAEEEEDDLYRQSLE

SEQ ID NO: 49357 - protein, 16 aa, Homo sapiens
PAEEEEDDLYRQSLEI

SEQ ID NO: 49358 - protein, 16 aa, Homo sapiens
AEEEEDDLYRQSLEII

SEQ ID NO: 49359 - protein, 16 aa, Homo sapiens
EEEEDDLYRQSLEIIS

SEQ ID NO: 49360 - protein, 16 aa, Homo sapiens
EEEDDLYRQSLEIISR

SEQ ID NO: 49361 - protein, 16 aa, Homo sapiens
EEDDLYRQSLEIISRY

SEQ ID NO: 49362 - protein, 16 aa, Homo sapiens
EDDLYRQSLEIISRYL

SEQ ID NO: 49363 - protein, 16 aa, Homo sapiens
DDLYRQSLEIISRYLR

SEQ ID NO: 49364 - protein, 16 aa, Homo sapiens
DLYRQSLEIISRYLRE

SEQ ID NO: 49365 - protein, 16 aa, Homo sapiens
LYRQSLEIISRYLREQ

SEQ ID NO: 49366 - protein, 16 aa, Homo sapiens
YRQSLEIISRYLREQA

SEQ ID NO: 49367 - protein, 16 aa, Homo sapiens
RQSLEIISRYLREQAT

SEQ ID NO: 49368 - protein, 16 aa, Homo sapiens
QSLEIISRYLREQATG

SEQ ID NO: 49369 - protein, 16 aa, Homo sapiens
SLEIISRYLREQATGA

SEQ ID NO: 49370 - protein, 16 aa, Homo sapiens
LEIISRYLREQATGAK

SEQ ID NO: 49371 - protein, 16 aa, Homo sapiens
EIISRYLREQATGAKD

SEQ ID NO: 49372 - protein, 16 aa, Homo sapiens
IISRYLREQATGAKDT

SEQ ID NO: 49373 - protein, 16 aa, Homo sapiens
ISRYLREQATGAKDTK

SEQ ID NO: 49374 - protein, 16 aa, Homo sapiens
SRYLREQATGAKDTKP

SEQ ID NO: 49375 - protein, 16 aa, Homo sapiens
RYLREQATGAKDTKPM

SEQ ID NO: 49376 - protein, 16 aa, Homo sapiens
YLREQATGAKDTKPMG

SEQ ID NO: 49377 - protein, 16 aa, Homo sapiens
LREQATGAKDTKPMGR

SEQ ID NO: 49378 - protein, 16 aa, Homo sapiens
REQATGAKDTKPMGRS

SEQ ID NO: 49379 - protein, 16 aa, Homo sapiens
EQATGAKDTKPMGRSG

SEQ ID NO: 49380 - protein, 16 aa, Homo sapiens
QATGAKDTKPMGRSGA

SEQ ID NO: 49381 - protein, 16 aa, Homo sapiens
ATGAKDTKPMGRSGAT

SEQ ID NO: 49382 - protein, 16 aa, Homo sapiens
TGAKDTKPMGRSGATS

SEQ ID NO: 49383 - protein, 16 aa, Homo sapiens
GAKDTKPMGRSGATSR

SEQ ID NO: 49384 - protein, 16 aa, Homo sapiens
AKDTKPMGRSGATSRK

SEQ ID NO: 49385 - protein, 16 aa, Homo sapiens
KDTKPMGRSGATSRKA

SEQ ID NO: 49386 - protein, 16 aa, Homo sapiens
DTKPMGRSGATSRKAL

SEQ ID NO: 49387 - protein, 16 aa, Homo sapiens
TKPMGRSGATSRKALE

SEQ ID NO: 49388 - protein, 16 aa, Homo sapiens
KPMGRSGATSRKALET

SEQ ID NO: 49389 - protein, 16 aa, Homo sapiens
PMGRSGATSRKALETL

SEQ ID NO: 49390 - protein, 16 aa, Homo sapiens
MGRSGATSRKALETLR

SEQ ID NO: 49391 - protein, 16 aa, Homo sapiens
GRSGATSRKALETLRR

SEQ ID NO: 49392 - protein, 16 aa, Homo sapiens
RSGATSRKALETLRRV

SEQ ID NO: 49393 - protein, 16 aa, Homo sapiens
SGATSRKALETLRRVG

SEQ ID NO: 49394 - protein, 16 aa, Homo sapiens
GATSRKALETLRRVGD

SEQ ID NO: 49395 - protein, 16 aa, Homo sapiens
ATSRKALETLRRVGDG

SEQ ID NO: 49396 - protein, 16 aa, Homo sapiens
TSRKALETLRRVGDGV

SEQ ID NO: 49397 - protein, 16 aa, Homo sapiens
SRKALETLRRVGDGVQ

SEQ ID NO: 49398 - protein, 16 aa, Homo sapiens
RKALETLRRVGDGVQR

SEQ ID NO: 49399 - protein, 16 aa, Homo sapiens
KALETLRRVGDGVQRN

SEQ ID NO: 49400 - protein, 16 aa, Homo sapiens
ALETLRRVGDGVQRNH

SEQ ID NO: 49401 - protein, 16 aa, Homo sapiens
LETLRRVGDGVQRNHE

SEQ ID NO: 49402 - protein, 16 aa, Homo sapiens
ETLRRVGDGVQRNHET

SEQ ID NO: 49403 - protein, 16 aa, Homo sapiens
TLRRVGDGVQRNHETA

SEQ ID NO: 49404 - protein, 16 aa, Homo sapiens
LRRVGDGVQRNHETAF

SEQ ID NO: 49405 - protein, 16 aa, Homo sapiens
RRVGDGVQRNHETAFQ

SEQ ID NO: 49406 - protein, 16 aa, Homo sapiens
RVGDGVQRNHETAFQG

SEQ ID NO: 49407 - protein, 16 aa, Homo sapiens
VGDGVQRNHETAFQGM

SEQ ID NO: 49408 - protein, 16 aa, Homo sapiens
GDGVQRNHETAFQGML

SEQ ID NO: 49409 - protein, 16 aa, Homo sapiens
DGVQRNHETAFQGMLR

SEQ ID NO: 49410 - protein, 16 aa, Homo sapiens
GVQRNHETAFQGMLRK

SEQ ID NO: 49411 - protein, 16 aa, Homo sapiens
VQRNHETAFQGMLRKL

SEQ ID NO: 49412 - protein, 16 aa, Homo sapiens
QRNHETAFQGMLRKLD

SEQ ID NO: 49413 - protein, 16 aa, Homo sapiens
RNHETAFQGMLRKLDI

SEQ ID NO: 49414 - protein, 16 aa, Homo sapiens
NHETAFQGMLRKLDIK

SEQ ID NO: 49415 - protein, 16 aa, Homo sapiens
HETAFQGMLRKLDIKN

SEQ ID NO: 49416 - protein, 16 aa, Homo sapiens
ETAFQGMLRKLDIKNE

SEQ ID NO: 49417 - protein, 16 aa, Homo sapiens
TAFQGMLRKLDIKNED

SEQ ID NO: 49418 - protein, 16 aa, Homo sapiens
AFQGMLRKLDIKNEDD

SEQ ID NO: 49419 - protein, 16 aa, Homo sapiens
FQGMLRKLDIKNEDDV

SEQ ID NO: 49420 - protein, 16 aa, Homo sapiens
QGMLRKLDIKNEDDVK

SEQ ID NO: 49421 - protein, 16 aa, Homo sapiens
GMLRKLDIKNEDDVKS

SEQ ID NO: 49422 - protein, 16 aa, Homo sapiens
MLRKLDIKNEDDVKSL

SEQ ID NO: 49423 - protein, 16 aa, Homo sapiens
LRKLDIKNEDDVKSLS

SEQ ID NO: 49424 - protein, 16 aa, Homo sapiens
RKLDIKNEDDVKSLSR

SEQ ID NO: 49425 - protein, 16 aa, Homo sapiens
KLDIKNEDDVKSLSRV

SEQ ID NO: 49426 - protein, 16 aa, Homo sapiens
LDIKNEDDVKSLSRVM

SEQ ID NO: 49427 - protein, 16 aa, Homo sapiens
DIKNEDDVKSLSRVMI

SEQ ID NO: 49428 - protein, 16 aa, Homo sapiens
IKNEDDVKSLSRVMIH

SEQ ID NO: 49429 - protein, 16 aa, Homo sapiens
KNEDDVKSLSRVMIHV

SEQ ID NO: 49430 - protein, 16 aa, Homo sapiens
NEDDVKSLSRVMIHVF

SEQ ID NO: 49431 - protein, 16 aa, Homo sapiens
EDDVKSLSRVMIHVFS

SEQ ID NO: 49432 - protein, 16 aa, Homo sapiens
DDVKSLSRVMIHVFSD

SEQ ID NO: 49433 - protein, 16 aa, Homo sapiens
DVKSLSRVMIHVFSDG

SEQ ID NO: 49434 - protein, 16 aa, Homo sapiens
VKSLSRVMIHVFSDGV

SEQ ID NO: 49435 - protein, 16 aa, Homo sapiens
KSLSRVMIHVFSDGVT

SEQ ID NO: 49436 - protein, 16 aa, Homo sapiens
SLSRVMIHVFSDGVTN

SEQ ID NO: 49437 - protein, 16 aa, Homo sapiens
LSRVMIHVFSDGVTNW

SEQ ID NO: 49438 - protein, 16 aa, Homo sapiens
SRVMIHVFSDGVTNWG

SEQ ID NO: 49439 - protein, 16 aa, Homo sapiens
RVMIHVFSDGVTNWGR

SEQ ID NO: 49440 - protein, 16 aa, Homo sapiens
VMIHVFSDGVTNWGRI

SEQ ID NO: 49441 - protein, 16 aa, Homo sapiens
MIHVFSDGVTNWGRIV

SEQ ID NO: 49442 - protein, 16 aa, Homo sapiens
IHVFSDGVTNWGRIVT

SEQ ID NO: 49443 - protein, 16 aa, Homo sapiens
HVFSDGVTNWGRIVTL

SEQ ID NO: 49444 - protein, 16 aa, Homo sapiens
VFSDGVTNWGRIVTLI

SEQ ID NO: 49445 - protein, 16 aa, Homo sapiens
FSDGVTNWGRIVTLIS

SEQ ID NO: 49446 - protein, 16 aa, Homo sapiens
SDGVTNWGRIVTLISF

SEQ ID NO: 49447 - protein, 16 aa, Homo sapiens
DGVTNWGRIVTLISFG

SEQ ID NO: 49448 - protein, 16 aa, Homo sapiens
GVTNWGRIVTLISFGA

SEQ ID NO: 49449 - protein, 16 aa, Homo sapiens
VTNWGRIVTLISFGAF

SEQ ID NO: 49450 - protein, 16 aa, Homo sapiens
TNWGRIVTLISFGAFV

SEQ ID NO: 49451 - protein, 16 aa, Homo sapiens
NWGRIVTLISFGAFVA

SEQ ID NO: 49452 - protein, 16 aa, Homo sapiens
WGRIVTLISFGAFVAK

SEQ ID NO: 49453 - protein, 16 aa, Homo sapiens
GRIVTLISFGAFVAKH

SEQ ID NO: 49454 - protein, 16 aa, Homo sapiens
RIVTLISFGAFVAKHL

SEQ ID NO: 49455 - protein, 16 aa, Homo sapiens
IVTLISFGAFVAKHLK

SEQ ID NO: 49456 - protein, 16 aa, Homo sapiens
VTLISFGAFVAKHLKT

SEQ ID NO: 49457 - protein, 16 aa, Homo sapiens
TLISFGAFVAKHLKTI

SEQ ID NO: 49458 - protein, 16 aa, Homo sapiens
LISFGAFVAKHLKTIN

SEQ ID NO: 49459 - protein, 16 aa, Homo sapiens
ISFGAFVAKHLKTINQ

SEQ ID NO: 49460 - protein, 16 aa, Homo sapiens
SFGAFVAKHLKTINQE

SEQ ID NO: 49461 - protein, 16 aa, Homo sapiens
FGAFVAKHLKTINQES

SEQ ID NO: 49462 - protein, 16 aa, Homo sapiens
GAFVAKHLKTINQESC

SEQ ID NO: 49463 - protein, 16 aa, Homo sapiens
AFVAKHLKTINQESCI

SEQ ID NO: 49464 - protein, 16 aa, Homo sapiens
FVAKHLKTINQESCIE

SEQ ID NO: 49465 - protein, 16 aa, Homo sapiens
VAKHLKTINQESCIEP

SEQ ID NO: 49466 - protein, 16 aa, Homo sapiens
AKHLKTINQESCIEPL

SEQ ID NO: 49467 - protein, 16 aa, Homo sapiens
KHLKTINQESCIEPLA

SEQ ID NO: 49468 - protein, 16 aa, Homo sapiens
HLKTINQESCIEPLAE

SEQ ID NO: 49469 - protein, 16 aa, Homo sapiens
LKTINQESCIEPLAES

SEQ ID NO: 49470 - protein, 16 aa, Homo sapiens
KTINQESCIEPLAESI

SEQ ID NO: 49471 - protein, 16 aa, Homo sapiens
TINQESCIEPLAESIT

SEQ ID NO: 49472 - protein, 16 aa, Homo sapiens
INQESCIEPLAESITD

SEQ ID NO: 49473 - protein, 16 aa, Homo sapiens
NQESCIEPLAESITDV

SEQ ID NO: 49474 - protein, 16 aa, Homo sapiens
QESCIEPLAESITDVL

SEQ ID NO: 49475 - protein, 16 aa, Homo sapiens
ESCIEPLAESITDVLV

SEQ ID NO: 49476 - protein, 16 aa, Homo sapiens
SCIEPLAESITDVLVR

SEQ ID NO: 49477 - protein, 16 aa, Homo sapiens
CIEPLAESITDVLVRT

SEQ ID NO: 49478 - protein, 16 aa, Homo sapiens
IEPLAESITDVLVRTK

SEQ ID NO: 49479 - protein, 16 aa, Homo sapiens
EPLAESITDVLVRTKR

SEQ ID NO: 49480 - protein, 16 aa, Homo sapiens
PLAESITDVLVRTKRD

SEQ ID NO: 49481 - protein, 16 aa, Homo sapiens
LAESITDVLVRTKRDW

SEQ ID NO: 49482 - protein, 16 aa, Homo sapiens
AESITDVLVRTKRDWL

SEQ ID NO: 49483 - protein, 16 aa, Homo sapiens
ESITDVLVRTKRDWLV

SEQ ID NO: 49484 - protein, 16 aa, Homo sapiens
SITDVLVRTKRDWLVK

SEQ ID NO: 49485 - protein, 16 aa, Homo sapiens
ITDVLVRTKRDWLVKQ

SEQ ID NO: 49486 - protein, 16 aa, Homo sapiens
TDVLVRTKRDWLVKQR

SEQ ID NO: 49487 - protein, 16 aa, Homo sapiens
DVLVRTKRDWLVKQRG

SEQ ID NO: 49488 - protein, 16 aa, Homo sapiens
VLVRTKRDWLVKQRGW

SEQ ID NO: 49489 - protein, 16 aa, Homo sapiens
LVRTKRDWLVKQRGWD

SEQ ID NO: 49490 - protein, 16 aa, Homo sapiens
VRTKRDWLVKQRGWDG

SEQ ID NO: 49491 - protein, 16 aa, Homo sapiens
RTKRDWLVKQRGWDGF

SEQ ID NO: 49492 - protein, 16 aa, Homo sapiens
TKRDWLVKQRGWDGFV

SEQ ID NO: 49493 - protein, 16 aa, Homo sapiens
KRDWLVKQRGWDGFVE

SEQ ID NO: 49494 - protein, 16 aa, Homo sapiens
RDWLVKQRGWDGFVEF

SEQ ID NO: 49495 - protein, 16 aa, Homo sapiens
DWLVKQRGWDGFVEFF

SEQ ID NO: 49496 - protein, 16 aa, Homo sapiens
WLVKQRGWDGFVEFFH

SEQ ID NO: 49497 - protein, 16 aa, Homo sapiens
LVKQRGWDGFVEFFHV

SEQ ID NO: 49498 - protein, 16 aa, Homo sapiens
VKQRGWDGFVEFFHVE

SEQ ID NO: 49499 - protein, 16 aa, Homo sapiens
KQRGWDGFVEFFHVED

SEQ ID NO: 49500 - protein, 16 aa, Homo sapiens
QRGWDGFVEFFHVEDL

SEQ ID NO: 49501 - protein, 16 aa, Homo sapiens
RGWDGFVEFFHVEDLE

SEQ ID NO: 49502 - protein, 16 aa, Homo sapiens
GWDGFVEFFHVEDLEG

SEQ ID NO: 49503 - protein, 16 aa, Homo sapiens
WDGFVEFFHVEDLEGG

SEQ ID NO: 49504 - protein, 16 aa, Homo sapiens
DGFVEFFHVEDLEGGI

SEQ ID NO: 49505 - protein, 16 aa, Homo sapiens
GFVEFFHVEDLEGGIR

SEQ ID NO: 49506 - protein, 16 aa, Homo sapiens
FVEFFHVEDLEGGIRN

SEQ ID NO: 49507 - protein, 16 aa, Homo sapiens
VEFFHVEDLEGGIRNV

SEQ ID NO: 49508 - protein, 16 aa, Homo sapiens
EFFHVEDLEGGIRNVL

SEQ ID NO: 49509 - protein, 16 aa, Homo sapiens
FFHVEDLEGGIRNVLL

SEQ ID NO: 49510 - protein, 16 aa, Homo sapiens
FHVEDLEGGIRNVLLA

SEQ ID NO: 49511 - protein, 16 aa, Homo sapiens
HVEDLEGGIRNVLLAF

SEQ ID NO: 49512 - protein, 16 aa, Homo sapiens
VEDLEGGIRNVLLAFA

SEQ ID NO: 49513 - protein, 16 aa, Homo sapiens
EDLEGGIRNVLLAFAG

SEQ ID NO: 49514 - protein, 16 aa, Homo sapiens
DLEGGIRNVLLAFAGV

SEQ ID NO: 49515 - protein, 16 aa, Homo sapiens
LEGGIRNVLLAFAGVA

SEQ ID NO: 49516 - protein, 16 aa, Homo sapiens
EGGIRNVLLAFAGVAG

SEQ ID NO: 49517 - protein, 16 aa, Homo sapiens
GGIRNVLLAFAGVAGV

SEQ ID NO: 49518 - protein, 16 aa, Homo sapiens
GIRNVLLAFAGVAGVG

SEQ ID NO: 49519 - protein, 16 aa, Homo sapiens
IRNVLLAFAGVAGVGA

SEQ ID NO: 49520 - protein, 16 aa, Homo sapiens
RNVLLAFAGVAGVGAG

SEQ ID NO: 49521 - protein, 16 aa, Homo sapiens
NVLLAFAGVAGVGAGL

SEQ ID NO: 49522 - protein, 16 aa, Homo sapiens
VLLAFAGVAGVGAGLA

SEQ ID NO: 49523 - protein, 16 aa, Homo sapiens
LLAFAGVAGVGAGLAY

SEQ ID NO: 49524 - protein, 16 aa, Homo sapiens
LAFAGVAGVGAGLAYL

SEQ ID NO: 49525 - protein, 16 aa, Homo sapiens
AFAGVAGVGAGLAYLI

SEQ ID NO: 49526 - protein, 16 aa, Homo sapiens
FAGVAGVGAGLAYLIR

SEQ ID NO: 49527 - protein, 8 aa, Borrelia afzelii
MKKNTLSA

SEQ ID NO: 49528 - protein, 8 aa, Borrelia afzelii
KKNTLSAI

SEQ ID NO: 49529 - protein, 8 aa, Borrelia afzelii
KNTLSAIL

SEQ ID NO: 49530 - protein, 8 aa, Borrelia afzelii
NTLSAILM

SEQ ID NO: 49531 - protein, 8 aa, Borrelia afzelii
TLSAILMT

SEQ ID NO: 49532 - protein, 8 aa, Borrelia afzelii
LSAILMTL

SEQ ID NO: 49533 - protein, 8 aa, Borrelia afzelii
SAILMTLF

SEQ ID NO: 49534 - protein, 8 aa, Borrelia afzelii
AILMTLFL

SEQ ID NO: 49535 - protein, 8 aa, Borrelia afzelii
ILMTLFLF

SEQ ID NO: 49536 - protein, 8 aa, Borrelia afzelii
LMTLFLFI

SEQ ID NO: 49537 - protein, 8 aa, Borrelia afzelii
MTLFLFIS

SEQ ID NO: 49538 - protein, 8 aa, Borrelia afzelii
TLFLFISC

SEQ ID NO: 49539 - protein, 8 aa, Borrelia afzelii
LFLFISCN

SEQ ID NO: 49540 - protein, 8 aa, Borrelia afzelii
FLFISCNN

SEQ ID NO: 49541 - protein, 8 aa, Borrelia afzelii
LFISCNNS

SEQ ID NO: 49542 - protein, 8 aa, Borrelia afzelii
FISCNNSG

SEQ ID NO: 49543 - protein, 8 aa, Borrelia afzelii
ISCNNSGK

SEQ ID NO: 49544 - protein, 8 aa, Borrelia afzelii
SCNNSGKG

SEQ ID NO: 49545 - protein, 8 aa, Borrelia afzelii
CNNSGKGG

SEQ ID NO: 49546 - protein, 8 aa, Borrelia afzelii
NNSGKGGD

SEQ ID NO: 49547 - protein, 8 aa, Borrelia afzelii
NSGKGGDS

SEQ ID NO: 49548 - protein, 8 aa, Borrelia afzelii
SGKGGDSA

SEQ ID NO: 49549 - protein, 8 aa, Borrelia afzelii
GKGGDSAS

SEQ ID NO: 49550 - protein, 8 aa, Borrelia afzelii
KGGDSAST

SEQ ID NO: 49551 - protein, 8 aa, Borrelia afzelii
GGDSASTN

SEQ ID NO: 49552 - protein, 8 aa, Borrelia afzelii
GDSASTNP

SEQ ID NO: 49553 - protein, 8 aa, Borrelia afzelii
DSASTNPA

SEQ ID NO: 49554 - protein, 8 aa, Borrelia afzelii
SASTNPAD

SEQ ID NO: 49555 - protein, 8 aa, Borrelia afzelii
ASTNPADE

SEQ ID NO: 49556 - protein, 8 aa, Borrelia afzelii
STNPADES

SEQ ID NO: 49557 - protein, 8 aa, Borrelia afzelii
TNPADESA

SEQ ID NO: 49558 - protein, 8 aa, Borrelia afzelii
NPADESAK

SEQ ID NO: 49559 - protein, 8 aa, Borrelia afzelii
PADESAKG

SEQ ID NO: 49560 - protein, 8 aa, Borrelia afzelii
ADESAKGP

SEQ ID NO: 49561 - protein, 8 aa, Borrelia afzelii
DESAKGPN

SEQ ID NO: 49562 - protein, 8 aa, Borrelia afzelii
ESAKGPNL

SEQ ID NO: 49563 - protein, 8 aa, Borrelia afzelii
SAKGPNLT

SEQ ID NO: 49564 - protein, 8 aa, Borrelia afzelii
AKGPNLTE

SEQ ID NO: 49565 - protein, 8 aa, Borrelia afzelii
KGPNLTEI

SEQ ID NO: 49566 - protein, 8 aa, Borrelia afzelii
GPNLTEIS

SEQ ID NO: 49567 - protein, 8 aa, Borrelia afzelii
PNLTEISK

SEQ ID NO: 49568 - protein, 8 aa, Borrelia afzelii
NLTEISKK

SEQ ID NO: 49569 - protein, 8 aa, Borrelia afzelii
LTEISKKI

SEQ ID NO: 49570 - protein, 8 aa, Borrelia afzelii
TEISKKIT

SEQ ID NO: 49571 - protein, 8 aa, Borrelia afzelii
EISKKITD

SEQ ID NO: 49572 - protein, 8 aa, Borrelia afzelii
ISKKITDS

SEQ ID NO: 49573 - protein, 8 aa, Borrelia afzelii
SKKITDSN

SEQ ID NO: 49574 - protein, 8 aa, Borrelia afzelii
KKITDSNA

SEQ ID NO: 49575 - protein, 8 aa, Borrelia afzelii
KITDSNAF

SEQ ID NO: 49576 - protein, 8 aa, Borrelia afzelii
ITDSNAFV

SEQ ID NO: 49577 - protein, 8 aa, Borrelia afzelii
TDSNAFVL

SEQ ID NO: 49578 - protein, 8 aa, Borrelia afzelii
DSNAFVLA

SEQ ID NO: 49579 - protein, 8 aa, Borrelia afzelii
SNAFVLAV

SEQ ID NO: 49580 - protein, 8 aa, Borrelia afzelii
NAFVLAVK

SEQ ID NO: 49581 - protein, 8 aa, Borrelia afzelii
AFVLAVKE

SEQ ID NO: 49582 - protein, 8 aa, Borrelia afzelii
FVLAVKEV

SEQ ID NO: 49583 - protein, 8 aa, Borrelia afzelii
VLAVKEVE

SEQ ID NO: 49584 - protein, 8 aa, Borrelia afzelii
LAVKEVET

SEQ ID NO: 49585 - protein, 8 aa, Borrelia afzelii
AVKEVETL

SEQ ID NO: 49586 - protein, 8 aa, Borrelia afzelii
VKEVETLV

SEQ ID NO: 49587 - protein, 8 aa, Borrelia afzelii
KEVETLVS

SEQ ID NO: 49588 - protein, 8 aa, Borrelia afzelii
EVETLVSS

SEQ ID NO: 49589 - protein, 8 aa, Borrelia afzelii
VETLVSSI

SEQ ID NO: 49590 - protein, 8 aa, Borrelia afzelii
ETLVSSID

SEQ ID NO: 49591 - protein, 8 aa, Borrelia afzelii
TLVSSIDE

SEQ ID NO: 49592 - protein, 8 aa, Borrelia afzelii
LVSSIDEL

SEQ ID NO: 49593 - protein, 8 aa, Borrelia afzelii
VSSIDELA

SEQ ID NO: 49594 - protein, 8 aa, Borrelia afzelii
SSIDELAN

SEQ ID NO: 49595 - protein, 8 aa, Borrelia afzelii
SIDELANK

SEQ ID NO: 49596 - protein, 8 aa, Borrelia afzelii
IDELANKA

SEQ ID NO: 49597 - protein, 8 aa, Borrelia afzelii
DELANKAI

SEQ ID NO: 49598 - protein, 8 aa, Borrelia afzelii
ELANKAIG

SEQ ID NO: 49599 - protein, 8 aa, Borrelia afzelii
LANKAIGK

SEQ ID NO: 49600 - protein, 8 aa, Borrelia afzelii
ANKAIGKK

SEQ ID NO: 49601 - protein, 8 aa, Borrelia afzelii
NKAIGKKI

SEQ ID NO: 49602 - protein, 8 aa, Borrelia afzelii
KAIGKKIQ

SEQ ID NO: 49603 - protein, 8 aa, Borrelia afzelii
AIGKKIQQ

SEQ ID NO: 49604 - protein, 8 aa, Borrelia afzelii
IGKKIQQN

SEQ ID NO: 49605 - protein, 8 aa, Borrelia afzelii
GKKIQQNG

SEQ ID NO: 49606 - protein, 8 aa, Borrelia afzelii
KKIQQNGL

SEQ ID NO: 49607 - protein, 8 aa, Borrelia afzelii
KIQQNGLG

SEQ ID NO: 49608 - protein, 8 aa, Borrelia afzelii
IQQNGLGA

SEQ ID NO: 49609 - protein, 8 aa, Borrelia afzelii
QQNGLGAE

SEQ ID NO: 49610 - protein, 8 aa, Borrelia afzelii
QNGLGAEA

SEQ ID NO: 49611 - protein, 8 aa, Borrelia afzelii
NGLGAEAN

SEQ ID NO: 49612 - protein, 8 aa, Borrelia afzelii
GLGAEANR

SEQ ID NO: 49613 - protein, 8 aa, Borrelia afzelii
LGAEANRN

SEQ ID NO: 49614 - protein, 8 aa, Borrelia afzelii
GAEANRNE

SEQ ID NO: 49615 - protein, 8 aa, Borrelia afzelii
AEANRNES

SEQ ID NO: 49616 - protein, 8 aa, Borrelia afzelii
EANRNESL

SEQ ID NO: 49617 - protein, 8 aa, Borrelia afzelii
ANRNESLL

SEQ ID NO: 49618 - protein, 8 aa, Borrelia afzelii
NRNESLLA

SEQ ID NO: 49619 - protein, 8 aa, Borrelia afzelii
RNESLLAG

SEQ ID NO: 49620 - protein, 8 aa, Borrelia afzelii
NESLLAGV

SEQ ID NO: 49621 - protein, 8 aa, Borrelia afzelii
ESLLAGVH

SEQ ID NO: 49622 - protein, 8 aa, Borrelia afzelii
SLLAGVHE

SEQ ID NO: 49623 - protein, 8 aa, Borrelia afzelii
LLAGVHEI

SEQ ID NO: 49624 - protein, 8 aa, Borrelia afzelii
LAGVHEIS

SEQ ID NO: 49625 - protein, 8 aa, Borrelia afzelii
AGVHEIST

SEQ ID NO: 49626 - protein, 8 aa, Borrelia afzelii
GVHEISTL

SEQ ID NO: 49627 - protein, 8 aa, Borrelia afzelii
VHEISTLI

SEQ ID NO: 49628 - protein, 8 aa, Borrelia afzelii
HEISTLIT

SEQ ID NO: 49629 - protein, 8 aa, Borrelia afzelii
EISTLITE

SEQ ID NO: 49630 - protein, 8 aa, Borrelia afzelii
ISTLITEK

SEQ ID NO: 49631 - protein, 8 aa, Borrelia afzelii
STLITEKL

SEQ ID NO: 49632 - protein, 8 aa, Borrelia afzelii
TLITEKLS

SEQ ID NO: 49633 - protein, 8 aa, Borrelia afzelii
LITEKLSK

SEQ ID NO: 49634 - protein, 8 aa, Borrelia afzelii
ITEKLSKL

SEQ ID NO: 49635 - protein, 8 aa, Borrelia afzelii
TEKLSKLK

SEQ ID NO: 49636 - protein, 8 aa, Borrelia afzelii
EKLSKLKN

SEQ ID NO: 49637 - protein, 8 aa, Borrelia afzelii
KLSKLKNS

SEQ ID NO: 49638 - protein, 8 aa, Borrelia afzelii
LSKLKNSG

SEQ ID NO: 49639 - protein, 8 aa, Borrelia afzelii
SKLKNSGE

SEQ ID NO: 49640 - protein, 8 aa, Borrelia afzelii
KLKNSGEL

SEQ ID NO: 49641 - protein, 8 aa, Borrelia afzelii
LKNSGELK

SEQ ID NO: 49642 - protein, 8 aa, Borrelia afzelii
KNSGELKA

SEQ ID NO: 49643 - protein, 8 aa, Borrelia afzelii
NSGELKAK

SEQ ID NO: 49644 - protein, 8 aa, Borrelia afzelii
SGELKAKI

SEQ ID NO: 49645 - protein, 8 aa, Borrelia afzelii
GELKAKIE

SEQ ID NO: 49646 - protein, 8 aa, Borrelia afzelii
ELKAKIED

SEQ ID NO: 49647 - protein, 8 aa, Borrelia afzelii
LKAKIEDA

SEQ ID NO: 49648 - protein, 8 aa, Borrelia afzelii
KAKIEDAK

SEQ ID NO: 49649 - protein, 8 aa, Borrelia afzelii
AKIEDAKK

SEQ ID NO: 49650 - protein, 8 aa, Borrelia afzelii
KIEDAKKC

SEQ ID NO: 49651 - protein, 8 aa, Borrelia afzelii
IEDAKKCS

SEQ ID NO: 49652 - protein, 8 aa, Borrelia afzelii
EDAKKCSE

SEQ ID NO: 49653 - protein, 8 aa, Borrelia afzelii
DAKKCSEE

SEQ ID NO: 49654 - protein, 8 aa, Borrelia afzelii
AKKCSEEF

SEQ ID NO: 49655 - protein, 8 aa, Borrelia afzelii
KKCSEEFT

SEQ ID NO: 49656 - protein, 8 aa, Borrelia afzelii
KCSEEFTN

SEQ ID NO: 49657 - protein, 8 aa, Borrelia afzelii
CSEEFTNK

SEQ ID NO: 49658 - protein, 8 aa, Borrelia afzelii
SEEFTNKL

SEQ ID NO: 49659 - protein, 8 aa, Borrelia afzelii
EEFTNKLR

SEQ ID NO: 49660 - protein, 8 aa, Borrelia afzelii
EFTNKLRV

SEQ ID NO: 49661 - protein, 8 aa, Borrelia afzelii
FTNKLRVS

SEQ ID NO: 49662 - protein, 8 aa, Borrelia afzelii
TNKLRVSH

SEQ ID NO: 49663 - protein, 8 aa, Borrelia afzelii
NKLRVSHA

SEQ ID NO: 49664 - protein, 8 aa, Borrelia afzelii
KLRVSHAD

SEQ ID NO: 49665 - protein, 8 aa, Borrelia afzelii
LRVSHADL

SEQ ID NO: 49666 - protein, 8 aa, Borrelia afzelii
RVSHADLG

SEQ ID NO: 49667 - protein, 8 aa, Borrelia afzelii
VSHADLGK

SEQ ID NO: 49668 - protein, 8 aa, Borrelia afzelii
SHADLGKQ

SEQ ID NO: 49669 - protein, 8 aa, Borrelia afzelii
HADLGKQG

SEQ ID NO: 49670 - protein, 8 aa, Borrelia afzelii
ADLGKQGV

SEQ ID NO: 49671 - protein, 8 aa, Borrelia afzelii
DLGKQGVN

SEQ ID NO: 49672 - protein, 8 aa, Borrelia afzelii
LGKQGVND

SEQ ID NO: 49673 - protein, 8 aa, Borrelia afzelii
GKQGVNDD

SEQ ID NO: 49674 - protein, 8 aa, Borrelia afzelii
KQGVNDDD

SEQ ID NO: 49675 - protein, 8 aa, Borrelia afzelii
QGVNDDDA

SEQ ID NO: 49676 - protein, 8 aa, Borrelia afzelii
GVNDDDAK

SEQ ID NO: 49677 - protein, 8 aa, Borrelia afzelii
VNDDDAKK

SEQ ID NO: 49678 - protein, 8 aa, Borrelia afzelii
NDDDAKKA

SEQ ID NO: 49679 - protein, 8 aa, Borrelia afzelii
DDDAKKAI

SEQ ID NO: 49680 - protein, 8 aa, Borrelia afzelii
DDAKKAIL

SEQ ID NO: 49681 - protein, 8 aa, Borrelia afzelii
DAKKAILK

SEQ ID NO: 49682 - protein, 8 aa, Borrelia afzelii
AKKAILKT

SEQ ID NO: 49683 - protein, 8 aa, Borrelia afzelii
KKAILKTN

SEQ ID NO: 49684 - protein, 8 aa, Borrelia afzelii
KAILKTNA

SEQ ID NO: 49685 - protein, 8 aa, Borrelia afzelii
AILKTNAD

SEQ ID NO: 49686 - protein, 8 aa, Borrelia afzelii
ILKTNADK

SEQ ID NO: 49687 - protein, 8 aa, Borrelia afzelii
LKTNADKT

SEQ ID NO: 49688 - protein, 8 aa, Borrelia afzelii
KTNADKTK

SEQ ID NO: 49689 - protein, 8 aa, Borrelia afzelii
TNADKTKG

SEQ ID NO: 49690 - protein, 8 aa, Borrelia afzelii
NADKTKGA

SEQ ID NO: 49691 - protein, 8 aa, Borrelia afzelii
ADKTKGAE

SEQ ID NO: 49692 - protein, 8 aa, Borrelia afzelii
DKTKGAEE

SEQ ID NO: 49693 - protein, 8 aa, Borrelia afzelii
KTKGAEEL

SEQ ID NO: 49694 - protein, 8 aa, Borrelia afzelii
TKGAEELG

SEQ ID NO: 49695 - protein, 8 aa, Borrelia afzelii
KGAEELGK

SEQ ID NO: 49696 - protein, 8 aa, Borrelia afzelii
GAEELGKL

SEQ ID NO: 49697 - protein, 8 aa, Borrelia afzelii
AEELGKLF

SEQ ID NO: 49698 - protein, 8 aa, Borrelia afzelii
EELGKLFK

SEQ ID NO: 49699 - protein, 8 aa, Borrelia afzelii
ELGKLFKS

SEQ ID NO: 49700 - protein, 8 aa, Borrelia afzelii
LGKLFKSV

SEQ ID NO: 49701 - protein, 8 aa, Borrelia afzelii
GKLFKSVE

SEQ ID NO: 49702 - protein, 8 aa, Borrelia afzelii
KLFKSVEG

SEQ ID NO: 49703 - protein, 8 aa, Borrelia afzelii
LFKSVEGL

SEQ ID NO: 49704 - protein, 8 aa, Borrelia afzelii
FKSVEGLV

SEQ ID NO: 49705 - protein, 8 aa, Borrelia afzelii
KSVEGLVK

SEQ ID NO: 49706 - protein, 8 aa, Borrelia afzelii
SVEGLVKA

SEQ ID NO: 49707 - protein, 8 aa, Borrelia afzelii
VEGLVKAA

SEQ ID NO: 49708 - protein, 8 aa, Borrelia afzelii
EGLVKAAQ

SEQ ID NO: 49709 - protein, 8 aa, Borrelia afzelii
GLVKAAQE

SEQ ID NO: 49710 - protein, 8 aa, Borrelia afzelii
LVKAAQEA

SEQ ID NO: 49711 - protein, 8 aa, Borrelia afzelii
VKAAQEAL

SEQ ID NO: 49712 - protein, 8 aa, Borrelia afzelii
KAAQEALT

SEQ ID NO: 49713 - protein, 8 aa, Borrelia afzelii
AAQEALTN

SEQ ID NO: 49714 - protein, 8 aa, Borrelia afzelii
AQEALTNS

SEQ ID NO: 49715 - protein, 8 aa, Borrelia afzelii
QEALTNSV

SEQ ID NO: 49716 - protein, 8 aa, Borrelia afzelii
EALTNSVK

SEQ ID NO: 49717 - protein, 8 aa, Borrelia afzelii
ALTNSVKE

SEQ ID NO: 49718 - protein, 8 aa, Borrelia afzelii
LTNSVKEL

SEQ ID NO: 49719 - protein, 8 aa, Borrelia afzelii
TNSVKELT

SEQ ID NO: 49720 - protein, 8 aa, Borrelia afzelii
NSVKELTS

SEQ ID NO: 49721 - protein, 8 aa, Borrelia afzelii
SVKELTSP

SEQ ID NO: 49722 - protein, 8 aa, Borrelia afzelii
VKELTSPV

SEQ ID NO: 49723 - protein, 8 aa, Borrelia afzelii
KELTSPVV

SEQ ID NO: 49724 - protein, 8 aa, Borrelia afzelii
ELTSPVVA

SEQ ID NO: 49725 - protein, 8 aa, Borrelia afzelii
LTSPVVAE

SEQ ID NO: 49726 - protein, 8 aa, Borrelia afzelii
TSPVVAES

SEQ ID NO: 49727 - protein, 8 aa, Borrelia afzelii
SPVVAESP

SEQ ID NO: 49728 - protein, 8 aa, Borrelia afzelii
PVVAESPK

SEQ ID NO: 49729 - protein, 8 aa, Borrelia afzelii
VVAESPKK

SEQ ID NO: 49730 - protein, 8 aa, Borrelia afzelii
VAESPKKP

SEQ ID NO: 49731 - protein, 9 aa, Borrelia afzelii
MKKNTLSAI

SEQ ID NO: 49732 - protein, 9 aa, Borrelia afzelii
KKNTLSAIL

SEQ ID NO: 49733 - protein, 9 aa, Borrelia afzelii
KNTLSAILM

SEQ ID NO: 49734 - protein, 9 aa, Borrelia afzelii
NTLSAILMT

SEQ ID NO: 49735 - protein, 9 aa, Borrelia afzelii
TLSAILMTL

SEQ ID NO: 49736 - protein, 9 aa, Borrelia afzelii
LSAILMTLF

SEQ ID NO: 49737 - protein, 9 aa, Borrelia afzelii
SAILMTLFL

SEQ ID NO: 49738 - protein, 9 aa, Borrelia afzelii
AILMTLFLF

SEQ ID NO: 49739 - protein, 9 aa, Borrelia afzelii
ILMTLFLFI

SEQ ID NO: 49740 - protein, 9 aa, Borrelia afzelii
LMTLFLFIS

SEQ ID NO: 49741 - protein, 9 aa, Borrelia afzelii
MTLFLFISC

SEQ ID NO: 49742 - protein, 9 aa, Borrelia afzelii
TLFLFISCN

SEQ ID NO: 49743 - protein, 9 aa, Borrelia afzelii
LFLFISCNN

SEQ ID NO: 49744 - protein, 9 aa, Borrelia afzelii
FLFISCNNS

SEQ ID NO: 49745 - protein, 9 aa, Borrelia afzelii
LFISCNNSG

SEQ ID NO: 49746 - protein, 9 aa, Borrelia afzelii
FISCNNSGK

SEQ ID NO: 49747 - protein, 9 aa, Borrelia afzelii
ISCNNSGKG

SEQ ID NO: 49748 - protein, 9 aa, Borrelia afzelii
SCNNSGKGG

SEQ ID NO: 49749 - protein, 9 aa, Borrelia afzelii
CNNSGKGGD

SEQ ID NO: 49750 - protein, 9 aa, Borrelia afzelii
NNSGKGGDS

SEQ ID NO: 49751 - protein, 9 aa, Borrelia afzelii
NSGKGGDSA

SEQ ID NO: 49752 - protein, 9 aa, Borrelia afzelii
SGKGGDSAS

SEQ ID NO: 49753 - protein, 9 aa, Borrelia afzelii
GKGGDSAST

SEQ ID NO: 49754 - protein, 9 aa, Borrelia afzelii
KGGDSASTN

SEQ ID NO: 49755 - protein, 9 aa, Borrelia afzelii
GGDSASTNP

SEQ ID NO: 49756 - protein, 9 aa, Borrelia afzelii
GDSASTNPA

SEQ ID NO: 49757 - protein, 9 aa, Borrelia afzelii
DSASTNPAD

SEQ ID NO: 49758 - protein, 9 aa, Borrelia afzelii
SASTNPADE

SEQ ID NO: 49759 - protein, 9 aa, Borrelia afzelii
ASTNPADES

SEQ ID NO: 49760 - protein, 9 aa, Borrelia afzelii
STNPADESA

SEQ ID NO: 49761 - protein, 9 aa, Borrelia afzelii
TNPADESAK

SEQ ID NO: 49762 - protein, 9 aa, Borrelia afzelii
NPADESAKG

SEQ ID NO: 49763 - protein, 9 aa, Borrelia afzelii
PADESAKGP

SEQ ID NO: 49764 - protein, 9 aa, Borrelia afzelii
ADESAKGPN

SEQ ID NO: 49765 - protein, 9 aa, Borrelia afzelii
DESAKGPNL

SEQ ID NO: 49766 - protein, 9 aa, Borrelia afzelii
ESAKGPNLT

SEQ ID NO: 49767 - protein, 9 aa, Borrelia afzelii
SAKGPNLTE

SEQ ID NO: 49768 - protein, 9 aa, Borrelia afzelii
AKGPNLTEI

SEQ ID NO: 49769 - protein, 9 aa, Borrelia afzelii
KGPNLTEIS

SEQ ID NO: 49770 - protein, 9 aa, Borrelia afzelii
GPNLTEISK

SEQ ID NO: 49771 - protein, 9 aa, Borrelia afzelii
PNLTEISKK

SEQ ID NO: 49772 - protein, 9 aa, Borrelia afzelii
NLTEISKKI

SEQ ID NO: 49773 - protein, 9 aa, Borrelia afzelii
LTEISKKIT

SEQ ID NO: 49774 - protein, 9 aa, Borrelia afzelii
TEISKKITD

SEQ ID NO: 49775 - protein, 9 aa, Borrelia afzelii
EISKKITDS

SEQ ID NO: 49776 - protein, 9 aa, Borrelia afzelii
ISKKITDSN

SEQ ID NO: 49777 - protein, 9 aa, Borrelia afzelii
SKKITDSNA

SEQ ID NO: 49778 - protein, 9 aa, Borrelia afzelii
KKITDSNAF

SEQ ID NO: 49779 - protein, 9 aa, Borrelia afzelii
KITDSNAFV

SEQ ID NO: 49780 - protein, 9 aa, Borrelia afzelii
ITDSNAFVL

SEQ ID NO: 49781 - protein, 9 aa, Borrelia afzelii
TDSNAFVLA

SEQ ID NO: 49782 - protein, 9 aa, Borrelia afzelii
DSNAFVLAV

SEQ ID NO: 49783 - protein, 9 aa, Borrelia afzelii
SNAFVLAVK

SEQ ID NO: 49784 - protein, 9 aa, Borrelia afzelii
NAFVLAVKE

SEQ ID NO: 49785 - protein, 9 aa, Borrelia afzelii
AFVLAVKEV

SEQ ID NO: 49786 - protein, 9 aa, Borrelia afzelii
FVLAVKEVE

SEQ ID NO: 49787 - protein, 9 aa, Borrelia afzelii
VLAVKEVET

SEQ ID NO: 49788 - protein, 9 aa, Borrelia afzelii
LAVKEVETL

SEQ ID NO: 49789 - protein, 9 aa, Borrelia afzelii
AVKEVETLV

SEQ ID NO: 49790 - protein, 9 aa, Borrelia afzelii
VKEVETLVS

SEQ ID NO: 49791 - protein, 9 aa, Borrelia afzelii
KEVETLVSS

SEQ ID NO: 49792 - protein, 9 aa, Borrelia afzelii
EVETLVSSI

SEQ ID NO: 49793 - protein, 9 aa, Borrelia afzelii
VETLVSSID

SEQ ID NO: 49794 - protein, 9 aa, Borrelia afzelii
ETLVSSIDE

SEQ ID NO: 49795 - protein, 9 aa, Borrelia afzelii
TLVSSIDEL

SEQ ID NO: 49796 - protein, 9 aa, Borrelia afzelii
LVSSIDELA

SEQ ID NO: 49797 - protein, 9 aa, Borrelia afzelii
VSSIDELAN

SEQ ID NO: 49798 - protein, 9 aa, Borrelia afzelii
SSIDELANK

SEQ ID NO: 49799 - protein, 9 aa, Borrelia afzelii
SIDELANKA

SEQ ID NO: 49800 - protein, 9 aa, Borrelia afzelii
IDELANKAI

SEQ ID NO: 49801 - protein, 9 aa, Borrelia afzelii
DELANKAIG

SEQ ID NO: 49802 - protein, 9 aa, Borrelia afzelii
ELANKAIGK

SEQ ID NO: 49803 - protein, 9 aa, Borrelia afzelii
LANKAIGKK

SEQ ID NO: 49804 - protein, 9 aa, Borrelia afzelii
ANKAIGKKI

SEQ ID NO: 49805 - protein, 9 aa, Borrelia afzelii
NKAIGKKIQ

SEQ ID NO: 49806 - protein, 9 aa, Borrelia afzelii
KAIGKKIQQ

SEQ ID NO: 49807 - protein, 9 aa, Borrelia afzelii
AIGKKIQQN

SEQ ID NO: 49808 - protein, 9 aa, Borrelia afzelii
IGKKIQQNG

SEQ ID NO: 49809 - protein, 9 aa, Borrelia afzelii
GKKIQQNGL

SEQ ID NO: 49810 - protein, 9 aa, Borrelia afzelii
KKIQQNGLG

SEQ ID NO: 49811 - protein, 9 aa, Borrelia afzelii
KIQQNGLGA

SEQ ID NO: 49812 - protein, 9 aa, Borrelia afzelii
IQQNGLGAE

SEQ ID NO: 49813 - protein, 9 aa, Borrelia afzelii
QQNGLGAEA

SEQ ID NO: 49814 - protein, 9 aa, Borrelia afzelii
QNGLGAEAN

SEQ ID NO: 49815 - protein, 9 aa, Borrelia afzelii
NGLGAEANR

SEQ ID NO: 49816 - protein, 9 aa, Borrelia afzelii
GLGAEANRN

SEQ ID NO: 49817 - protein, 9 aa, Borrelia afzelii
LGAEANRNE

SEQ ID NO: 49818 - protein, 9 aa, Borrelia afzelii
GAEANRNES

SEQ ID NO: 49819 - protein, 9 aa, Borrelia afzelii
AEANRNESL

SEQ ID NO: 49820 - protein, 9 aa, Borrelia afzelii
EANRNESLL

SEQ ID NO: 49821 - protein, 9 aa, Borrelia afzelii
ANRNESLLA

SEQ ID NO: 49822 - protein, 9 aa, Borrelia afzelii
NRNESLLAG

SEQ ID NO: 49823 - protein, 9 aa, Borrelia afzelii
RNESLLAGV

SEQ ID NO: 49824 - protein, 9 aa, Borrelia afzelii
NESLLAGVH

SEQ ID NO: 49825 - protein, 9 aa, Borrelia afzelii
ESLLAGVHE

SEQ ID NO: 49826 - protein, 9 aa, Borrelia afzelii
SLLAGVHEI

SEQ ID NO: 49827 - protein, 9 aa, Borrelia afzelii
LLAGVHEIS

SEQ ID NO: 49828 - protein, 9 aa, Borrelia afzelii
LAGVHEIST

SEQ ID NO: 49829 - protein, 9 aa, Borrelia afzelii
AGVHEISTL

SEQ ID NO: 49830 - protein, 9 aa, Borrelia afzelii
GVHEISTLI

SEQ ID NO: 49831 - protein, 9 aa, Borrelia afzelii
VHEISTLIT

SEQ ID NO: 49832 - protein, 9 aa, Borrelia afzelii
HEISTLITE

SEQ ID NO: 49833 - protein, 9 aa, Borrelia afzelii
EISTLITEK

SEQ ID NO: 49834 - protein, 9 aa, Borrelia afzelii
ISTLITEKL

SEQ ID NO: 49835 - protein, 9 aa, Borrelia afzelii
STLITEKLS

SEQ ID NO: 49836 - protein, 9 aa, Borrelia afzelii
TLITEKLSK

SEQ ID NO: 49837 - protein, 9 aa, Borrelia afzelii
LITEKLSKL

SEQ ID NO: 49838 - protein, 9 aa, Borrelia afzelii
ITEKLSKLK

SEQ ID NO: 49839 - protein, 9 aa, Borrelia afzelii
TEKLSKLKN

SEQ ID NO: 49840 - protein, 9 aa, Borrelia afzelii
EKLSKLKNS

SEQ ID NO: 49841 - protein, 9 aa, Borrelia afzelii
KLSKLKNSG

SEQ ID NO: 49842 - protein, 9 aa, Borrelia afzelii
LSKLKNSGE

SEQ ID NO: 49843 - protein, 9 aa, Borrelia afzelii
SKLKNSGEL

SEQ ID NO: 49844 - protein, 9 aa, Borrelia afzelii
KLKNSGELK

SEQ ID NO: 49845 - protein, 9 aa, Borrelia afzelii
LKNSGELKA

SEQ ID NO: 49846 - protein, 9 aa, Borrelia afzelii
KNSGELKAK

SEQ ID NO: 49847 - protein, 9 aa, Borrelia afzelii
NSGELKAKI

SEQ ID NO: 49848 - protein, 9 aa, Borrelia afzelii
SGELKAKIE

SEQ ID NO: 49849 - protein, 9 aa, Borrelia afzelii
GELKAKIED

SEQ ID NO: 49850 - protein, 9 aa, Borrelia afzelii
ELKAKIEDA

SEQ ID NO: 49851 - protein, 9 aa, Borrelia afzelii
LKAKIEDAK

SEQ ID NO: 49852 - protein, 9 aa, Borrelia afzelii
KAKIEDAKK

SEQ ID NO: 49853 - protein, 9 aa, Borrelia afzelii
AKIEDAKKC

SEQ ID NO: 49854 - protein, 9 aa, Borrelia afzelii
KIEDAKKCS

SEQ ID NO: 49855 - protein, 9 aa, Borrelia afzelii
IEDAKKCSE

SEQ ID NO: 49856 - protein, 9 aa, Borrelia afzelii
EDAKKCSEE

SEQ ID NO: 49857 - protein, 9 aa, Borrelia afzelii
DAKKCSEEF

SEQ ID NO: 49858 - protein, 9 aa, Borrelia afzelii
AKKCSEEFT

SEQ ID NO: 49859 - protein, 9 aa, Borrelia afzelii
KKCSEEFTN

SEQ ID NO: 49860 - protein, 9 aa, Borrelia afzelii
KCSEEFTNK

SEQ ID NO: 49861 - protein, 9 aa, Borrelia afzelii
CSEEFTNKL

SEQ ID NO: 49862 - protein, 9 aa, Borrelia afzelii
SEEFTNKLR

SEQ ID NO: 49863 - protein, 9 aa, Borrelia afzelii
EEFTNKLRV

SEQ ID NO: 49864 - protein, 9 aa, Borrelia afzelii
EFTNKLRVS

SEQ ID NO: 49865 - protein, 9 aa, Borrelia afzelii
FTNKLRVSH

SEQ ID NO: 49866 - protein, 9 aa, Borrelia afzelii
TNKLRVSHA

SEQ ID NO: 49867 - protein, 9 aa, Borrelia afzelii
NKLRVSHAD

SEQ ID NO: 49868 - protein, 9 aa, Borrelia afzelii
KLRVSHADL

SEQ ID NO: 49869 - protein, 9 aa, Borrelia afzelii
LRVSHADLG

SEQ ID NO: 49870 - protein, 9 aa, Borrelia afzelii
RVSHADLGK

SEQ ID NO: 49871 - protein, 9 aa, Borrelia afzelii
VSHADLGKQ

SEQ ID NO: 49872 - protein, 9 aa, Borrelia afzelii
SHADLGKQG

SEQ ID NO: 49873 - protein, 9 aa, Borrelia afzelii
HADLGKQGV

SEQ ID NO: 49874 - protein, 9 aa, Borrelia afzelii
ADLGKQGVN

SEQ ID NO: 49875 - protein, 9 aa, Borrelia afzelii
DLGKQGVND

SEQ ID NO: 49876 - protein, 9 aa, Borrelia afzelii
LGKQGVNDD

SEQ ID NO: 49877 - protein, 9 aa, Borrelia afzelii
GKQGVNDDD

SEQ ID NO: 49878 - protein, 9 aa, Borrelia afzelii
KQGVNDDDA

SEQ ID NO: 49879 - protein, 9 aa, Borrelia afzelii
QGVNDDDAK

SEQ ID NO: 49880 - protein, 9 aa, Borrelia afzelii
GVNDDDAKK

SEQ ID NO: 49881 - protein, 9 aa, Borrelia afzelii
VNDDDAKKA

SEQ ID NO: 49882 - protein, 9 aa, Borrelia afzelii
NDDDAKKAI

SEQ ID NO: 49883 - protein, 9 aa, Borrelia afzelii
DDDAKKAIL

SEQ ID NO: 49884 - protein, 9 aa, Borrelia afzelii
DDAKKAILK

SEQ ID NO: 49885 - protein, 9 aa, Borrelia afzelii
DAKKAILKT

SEQ ID NO: 49886 - protein, 9 aa, Borrelia afzelii
AKKAILKTN

SEQ ID NO: 49887 - protein, 9 aa, Borrelia afzelii
KKAILKTNA

SEQ ID NO: 49888 - protein, 9 aa, Borrelia afzelii
KAILKTNAD

SEQ ID NO: 49889 - protein, 9 aa, Borrelia afzelii
AILKTNADK

SEQ ID NO: 49890 - protein, 9 aa, Borrelia afzelii
ILKTNADKT

SEQ ID NO: 49891 - protein, 9 aa, Borrelia afzelii
LKTNADKTK

SEQ ID NO: 49892 - protein, 9 aa, Borrelia afzelii
KTNADKTKG

SEQ ID NO: 49893 - protein, 9 aa, Borrelia afzelii
TNADKTKGA

SEQ ID NO: 49894 - protein, 9 aa, Borrelia afzelii
NADKTKGAE

SEQ ID NO: 49895 - protein, 9 aa, Borrelia afzelii
ADKTKGAEE

SEQ ID NO: 49896 - protein, 9 aa, Borrelia afzelii
DKTKGAEEL

SEQ ID NO: 49897 - protein, 9 aa, Borrelia afzelii
KTKGAEELG

SEQ ID NO: 49898 - protein, 9 aa, Borrelia afzelii
TKGAEELGK

SEQ ID NO: 49899 - protein, 9 aa, Borrelia afzelii
KGAEELGKL

SEQ ID NO: 49900 - protein, 9 aa, Borrelia afzelii
GAEELGKLF

SEQ ID NO: 49901 - protein, 9 aa, Borrelia afzelii
AEELGKLFK

SEQ ID NO: 49902 - protein, 9 aa, Borrelia afzelii
EELGKLFKS

SEQ ID NO: 49903 - protein, 9 aa, Borrelia afzelii
ELGKLFKSV

SEQ ID NO: 49904 - protein, 9 aa, Borrelia afzelii
LGKLFKSVE

SEQ ID NO: 49905 - protein, 9 aa, Borrelia afzelii
GKLFKSVEG

SEQ ID NO: 49906 - protein, 9 aa, Borrelia afzelii
KLFKSVEGL

SEQ ID NO: 49907 - protein, 9 aa, Borrelia afzelii
LFKSVEGLV

SEQ ID NO: 49908 - protein, 9 aa, Borrelia afzelii
FKSVEGLVK

SEQ ID NO: 49909 - protein, 9 aa, Borrelia afzelii
KSVEGLVKA

SEQ ID NO: 49910 - protein, 9 aa, Borrelia afzelii
SVEGLVKAA

SEQ ID NO: 49911 - protein, 9 aa, Borrelia afzelii
VEGLVKAAQ

SEQ ID NO: 49912 - protein, 9 aa, Borrelia afzelii
EGLVKAAQE

SEQ ID NO: 49913 - protein, 9 aa, Borrelia afzelii
GLVKAAQEA

SEQ ID NO: 49914 - protein, 9 aa, Borrelia afzelii
LVKAAQEAL

SEQ ID NO: 49915 - protein, 9 aa, Borrelia afzelii
VKAAQEALT

SEQ ID NO: 49916 - protein, 9 aa, Borrelia afzelii
KAAQEALTN

SEQ ID NO: 49917 - protein, 9 aa, Borrelia afzelii
AAQEALTNS

SEQ ID NO: 49918 - protein, 9 aa, Borrelia afzelii
AQEALTNSV

SEQ ID NO: 49919 - protein, 9 aa, Borrelia afzelii
QEALTNSVK

SEQ ID NO: 49920 - protein, 9 aa, Borrelia afzelii
EALTNSVKE

SEQ ID NO: 49921 - protein, 9 aa, Borrelia afzelii
ALTNSVKEL

SEQ ID NO: 49922 - protein, 9 aa, Borrelia afzelii
LTNSVKELT

SEQ ID NO: 49923 - protein, 9 aa, Borrelia afzelii
TNSVKELTS

SEQ ID NO: 49924 - protein, 9 aa, Borrelia afzelii
NSVKELTSP

SEQ ID NO: 49925 - protein, 9 aa, Borrelia afzelii
SVKELTSPV

SEQ ID NO: 49926 - protein, 9 aa, Borrelia afzelii
VKELTSPVV

SEQ ID NO: 49927 - protein, 9 aa, Borrelia afzelii
KELTSPVVA

SEQ ID NO: 49928 - protein, 9 aa, Borrelia afzelii
ELTSPVVAE

SEQ ID NO: 49929 - protein, 9 aa, Borrelia afzelii
LTSPVVAES

SEQ ID NO: 49930 - protein, 9 aa, Borrelia afzelii
TSPVVAESP

SEQ ID NO: 49931 - protein, 9 aa, Borrelia afzelii
SPVVAESPK

SEQ ID NO: 49932 - protein, 9 aa, Borrelia afzelii
PVVAESPKK

SEQ ID NO: 49933 - protein, 9 aa, Borrelia afzelii
VVAESPKKP

SEQ ID NO: 49934 - protein, 10 aa, Borrelia afzelii
MKKNTLSAIL

SEQ ID NO: 49935 - protein, 10 aa, Borrelia afzelii
KKNTLSAILM

SEQ ID NO: 49936 - protein, 10 aa, Borrelia afzelii
KNTLSAILMT

SEQ ID NO: 49937 - protein, 10 aa, Borrelia afzelii
NTLSAILMTL

SEQ ID NO: 49938 - protein, 10 aa, Borrelia afzelii
TLSAILMTLF

SEQ ID NO: 49939 - protein, 10 aa, Borrelia afzelii
LSAILMTLFL

SEQ ID NO: 49940 - protein, 10 aa, Borrelia afzelii
SAILMTLFLF

SEQ ID NO: 49941 - protein, 10 aa, Borrelia afzelii
AILMTLFLFI

SEQ ID NO: 49942 - protein, 10 aa, Borrelia afzelii
ILMTLFLFIS

SEQ ID NO: 49943 - protein, 10 aa, Borrelia afzelii
LMTLFLFISC

SEQ ID NO: 49944 - protein, 10 aa, Borrelia afzelii
MTLFLFISCN

SEQ ID NO: 49945 - protein, 10 aa, Borrelia afzelii
TLFLFISCNN

SEQ ID NO: 49946 - protein, 10 aa, Borrelia afzelii
LFLFISCNNS

SEQ ID NO: 49947 - protein, 10 aa, Borrelia afzelii
FLFISCNNSG

SEQ ID NO: 49948 - protein, 10 aa, Borrelia afzelii
LFISCNNSGK

SEQ ID NO: 49949 - protein, 10 aa, Borrelia afzelii
FISCNNSGKG

SEQ ID NO: 49950 - protein, 10 aa, Borrelia afzelii
ISCNNSGKGG

SEQ ID NO: 49951 - protein, 10 aa, Borrelia afzelii
SCNNSGKGGD

SEQ ID NO: 49952 - protein, 10 aa, Borrelia afzelii
CNNSGKGGDS

SEQ ID NO: 49953 - protein, 10 aa, Borrelia afzelii
NNSGKGGDSA

SEQ ID NO: 49954 - protein, 10 aa, Borrelia afzelii
NSGKGGDSAS

SEQ ID NO: 49955 - protein, 10 aa, Borrelia afzelii
SGKGGDSAST

SEQ ID NO: 49956 - protein, 10 aa, Borrelia afzelii
GKGGDSASTN

SEQ ID NO: 49957 - protein, 10 aa, Borrelia afzelii
KGGDSASTNP

SEQ ID NO: 49958 - protein, 10 aa, Borrelia afzelii
GGDSASTNPA

SEQ ID NO: 49959 - protein, 10 aa, Borrelia afzelii
GDSASTNPAD

SEQ ID NO: 49960 - protein, 10 aa, Borrelia afzelii
DSASTNPADE

SEQ ID NO: 49961 - protein, 10 aa, Borrelia afzelii
SASTNPADES

SEQ ID NO: 49962 - protein, 10 aa, Borrelia afzelii
ASTNPADESA

SEQ ID NO: 49963 - protein, 10 aa, Borrelia afzelii
STNPADESAK

SEQ ID NO: 49964 - protein, 10 aa, Borrelia afzelii
TNPADESAKG

SEQ ID NO: 49965 - protein, 10 aa, Borrelia afzelii
NPADESAKGP

SEQ ID NO: 49966 - protein, 10 aa, Borrelia afzelii
PADESAKGPN

SEQ ID NO: 49967 - protein, 10 aa, Borrelia afzelii
ADESAKGPNL

SEQ ID NO: 49968 - protein, 10 aa, Borrelia afzelii
DESAKGPNLT

SEQ ID NO: 49969 - protein, 10 aa, Borrelia afzelii
ESAKGPNLTE

SEQ ID NO: 49970 - protein, 10 aa, Borrelia afzelii
SAKGPNLTEI

SEQ ID NO: 49971 - protein, 10 aa, Borrelia afzelii
AKGPNLTEIS

SEQ ID NO: 49972 - protein, 10 aa, Borrelia afzelii
KGPNLTEISK

SEQ ID NO: 49973 - protein, 10 aa, Borrelia afzelii
GPNLTEISKK

SEQ ID NO: 49974 - protein, 10 aa, Borrelia afzelii
PNLTEISKKI

SEQ ID NO: 49975 - protein, 10 aa, Borrelia afzelii
NLTEISKKIT

SEQ ID NO: 49976 - protein, 10 aa, Borrelia afzelii
LTEISKKITD

SEQ ID NO: 49977 - protein, 10 aa, Borrelia afzelii
TEISKKITDS

SEQ ID NO: 49978 - protein, 10 aa, Borrelia afzelii
EISKKITDSN

SEQ ID NO: 49979 - protein, 10 aa, Borrelia afzelii
ISKKITDSNA

SEQ ID NO: 49980 - protein, 10 aa, Borrelia afzelii
SKKITDSNAF

SEQ ID NO: 49981 - protein, 10 aa, Borrelia afzelii
KKITDSNAFV

SEQ ID NO: 49982 - protein, 10 aa, Borrelia afzelii
KITDSNAFVL

SEQ ID NO: 49983 - protein, 10 aa, Borrelia afzelii
ITDSNAFVLA

SEQ ID NO: 49984 - protein, 10 aa, Borrelia afzelii
TDSNAFVLAV

SEQ ID NO: 49985 - protein, 10 aa, Borrelia afzelii
DSNAFVLAVK

SEQ ID NO: 49986 - protein, 10 aa, Borrelia afzelii
SNAFVLAVKE

SEQ ID NO: 49987 - protein, 10 aa, Borrelia afzelii
NAFVLAVKEV

SEQ ID NO: 49988 - protein, 10 aa, Borrelia afzelii
AFVLAVKEVE

SEQ ID NO: 49989 - protein, 10 aa, Borrelia afzelii
FVLAVKEVET

SEQ ID NO: 49990 - protein, 10 aa, Borrelia afzelii
VLAVKEVETL

SEQ ID NO: 49991 - protein, 10 aa, Borrelia afzelii
LAVKEVETLV

SEQ ID NO: 49992 - protein, 10 aa, Borrelia afzelii
AVKEVETLVS

SEQ ID NO: 49993 - protein, 10 aa, Borrelia afzelii
VKEVETLVSS

SEQ ID NO: 49994 - protein, 10 aa, Borrelia afzelii
KEVETLVSSI

SEQ ID NO: 49995 - protein, 10 aa, Borrelia afzelii
EVETLVSSID

SEQ ID NO: 49996 - protein, 10 aa, Borrelia afzelii
VETLVSSIDE

SEQ ID NO: 49997 - protein, 10 aa, Borrelia afzelii
ETLVSSIDEL

SEQ ID NO: 49998 - protein, 10 aa, Borrelia afzelii
TLVSSIDELA

SEQ ID NO: 49999 - protein, 10 aa, Borrelia afzelii
LVSSIDELAN

SEQ ID NO: 50000 - protein, 10 aa, Borrelia afzelii
VSSIDELANK

SEQ ID NO: 50001 - protein, 10 aa, Borrelia afzelii
SSIDELANKA

SEQ ID NO: 50002 - protein, 10 aa, Borrelia afzelii
SIDELANKAI

SEQ ID NO: 50003 - protein, 10 aa, Borrelia afzelii
IDELANKAIG

SEQ ID NO: 50004 - protein, 10 aa, Borrelia afzelii
DELANKAIGK

SEQ ID NO: 50005 - protein, 10 aa, Borrelia afzelii
ELANKAIGKK

SEQ ID NO: 50006 - protein, 10 aa, Borrelia afzelii
LANKAIGKKI

SEQ ID NO: 50007 - protein, 10 aa, Borrelia afzelii
ANKAIGKKIQ

SEQ ID NO: 50008 - protein, 10 aa, Borrelia afzelii
NKAIGKKIQQ

SEQ ID NO: 50009 - protein, 10 aa, Borrelia afzelii
KAIGKKIQQN

SEQ ID NO: 50010 - protein, 10 aa, Borrelia afzelii
AIGKKIQQNG

SEQ ID NO: 50011 - protein, 10 aa, Borrelia afzelii
IGKKIQQNGL

SEQ ID NO: 50012 - protein, 10 aa, Borrelia afzelii
GKKIQQNGLG

SEQ ID NO: 50013 - protein, 10 aa, Borrelia afzelii
KKIQQNGLGA

SEQ ID NO: 50014 - protein, 10 aa, Borrelia afzelii
KIQQNGLGAE

SEQ ID NO: 50015 - protein, 10 aa, Borrelia afzelii
IQQNGLGAEA

SEQ ID NO: 50016 - protein, 10 aa, Borrelia afzelii
QQNGLGAEAN

SEQ ID NO: 50017 - protein, 10 aa, Borrelia afzelii
QNGLGAEANR

SEQ ID NO: 50018 - protein, 10 aa, Borrelia afzelii
NGLGAEANRN

SEQ ID NO: 50019 - protein, 10 aa, Borrelia afzelii
GLGAEANRNE

SEQ ID NO: 50020 - protein, 10 aa, Borrelia afzelii
LGAEANRNES

SEQ ID NO: 50021 - protein, 10 aa, Borrelia afzelii
GAEANRNESL

SEQ ID NO: 50022 - protein, 10 aa, Borrelia afzelii
AEANRNESLL

SEQ ID NO: 50023 - protein, 10 aa, Borrelia afzelii
EANRNESLLA

SEQ ID NO: 50024 - protein, 10 aa, Borrelia afzelii
ANRNESLLAG

SEQ ID NO: 50025 - protein, 10 aa, Borrelia afzelii
NRNESLLAGV

SEQ ID NO: 50026 - protein, 10 aa, Borrelia afzelii
RNESLLAGVH

SEQ ID NO: 50027 - protein, 10 aa, Borrelia afzelii
NESLLAGVHE

SEQ ID NO: 50028 - protein, 10 aa, Borrelia afzelii
ESLLAGVHEI

SEQ ID NO: 50029 - protein, 10 aa, Borrelia afzelii
SLLAGVHEIS

SEQ ID NO: 50030 - protein, 10 aa, Borrelia afzelii
LLAGVHEIST

SEQ ID NO: 50031 - protein, 10 aa, Borrelia afzelii
LAGVHEISTL

SEQ ID NO: 50032 - protein, 10 aa, Borrelia afzelii
AGVHEISTLI

SEQ ID NO: 50033 - protein, 10 aa, Borrelia afzelii
GVHEISTLIT

SEQ ID NO: 50034 - protein, 10 aa, Borrelia afzelii
VHEISTLITE

SEQ ID NO: 50035 - protein, 10 aa, Borrelia afzelii
HEISTLITEK

SEQ ID NO: 50036 - protein, 10 aa, Borrelia afzelii
EISTLITEKL

SEQ ID NO: 50037 - protein, 10 aa, Borrelia afzelii
ISTLITEKLS

SEQ ID NO: 50038 - protein, 10 aa, Borrelia afzelii
STLITEKLSK

SEQ ID NO: 50039 - protein, 10 aa, Borrelia afzelii
TLITEKLSKL

SEQ ID NO: 50040 - protein, 10 aa, Borrelia afzelii
LITEKLSKLK

SEQ ID NO: 50041 - protein, 10 aa, Borrelia afzelii
ITEKLSKLKN

SEQ ID NO: 50042 - protein, 10 aa, Borrelia afzelii
TEKLSKLKNS

SEQ ID NO: 50043 - protein, 10 aa, Borrelia afzelii
EKLSKLKNSG

SEQ ID NO: 50044 - protein, 10 aa, Borrelia afzelii
KLSKLKNSGE

SEQ ID NO: 50045 - protein, 10 aa, Borrelia afzelii
LSKLKNSGEL

SEQ ID NO: 50046 - protein, 10 aa, Borrelia afzelii
SKLKNSGELK

SEQ ID NO: 50047 - protein, 10 aa, Borrelia afzelii
KLKNSGELKA

SEQ ID NO: 50048 - protein, 10 aa, Borrelia afzelii
LKNSGELKAK

SEQ ID NO: 50049 - protein, 10 aa, Borrelia afzelii
KNSGELKAKI

SEQ ID NO: 50050 - protein, 10 aa, Borrelia afzelii
NSGELKAKIE

SEQ ID NO: 50051 - protein, 10 aa, Borrelia afzelii
SGELKAKIED

SEQ ID NO: 50052 - protein, 10 aa, Borrelia afzelii
GELKAKIEDA

SEQ ID NO: 50053 - protein, 10 aa, Borrelia afzelii
ELKAKIEDAK

SEQ ID NO: 50054 - protein, 10 aa, Borrelia afzelii
LKAKIEDAKK

SEQ ID NO: 50055 - protein, 10 aa, Borrelia afzelii
KAKIEDAKKC

SEQ ID NO: 50056 - protein, 10 aa, Borrelia afzelii
AKIEDAKKCS

SEQ ID NO: 50057 - protein, 10 aa, Borrelia afzelii
KIEDAKKCSE

SEQ ID NO: 50058 - protein, 10 aa, Borrelia afzelii
IEDAKKCSEE

SEQ ID NO: 50059 - protein, 10 aa, Borrelia afzelii
EDAKKCSEEF

SEQ ID NO: 50060 - protein, 10 aa, Borrelia afzelii
DAKKCSEEFT

SEQ ID NO: 50061 - protein, 10 aa, Borrelia afzelii
AKKCSEEFTN

SEQ ID NO: 50062 - protein, 10 aa, Borrelia afzelii
KKCSEEFTNK

SEQ ID NO: 50063 - protein, 10 aa, Borrelia afzelii
KCSEEFTNKL

SEQ ID NO: 50064 - protein, 10 aa, Borrelia afzelii
CSEEFTNKLR

SEQ ID NO: 50065 - protein, 10 aa, Borrelia afzelii
SEEFTNKLRV

SEQ ID NO: 50066 - protein, 10 aa, Borrelia afzelii
EEFTNKLRVS

SEQ ID NO: 50067 - protein, 10 aa, Borrelia afzelii
EFTNKLRVSH

SEQ ID NO: 50068 - protein, 10 aa, Borrelia afzelii
FTNKLRVSHA

SEQ ID NO: 50069 - protein, 10 aa, Borrelia afzelii
TNKLRVSHAD

SEQ ID NO: 50070 - protein, 10 aa, Borrelia afzelii
NKLRVSHADL

SEQ ID NO: 50071 - protein, 10 aa, Borrelia afzelii
KLRVSHADLG

SEQ ID NO: 50072 - protein, 10 aa, Borrelia afzelii
LRVSHADLGK

SEQ ID NO: 50073 - protein, 10 aa, Borrelia afzelii
RVSHADLGKQ

SEQ ID NO: 50074 - protein, 10 aa, Borrelia afzelii
VSHADLGKQG

SEQ ID NO: 50075 - protein, 10 aa, Borrelia afzelii
SHADLGKQGV

SEQ ID NO: 50076 - protein, 10 aa, Borrelia afzelii
HADLGKQGVN

SEQ ID NO: 50077 - protein, 10 aa, Borrelia afzelii
ADLGKQGVND

SEQ ID NO: 50078 - protein, 10 aa, Borrelia afzelii
DLGKQGVNDD

SEQ ID NO: 50079 - protein, 10 aa, Borrelia afzelii
LGKQGVNDDD

SEQ ID NO: 50080 - protein, 10 aa, Borrelia afzelii
GKQGVNDDDA

SEQ ID NO: 50081 - protein, 10 aa, Borrelia afzelii
KQGVNDDDAK

SEQ ID NO: 50082 - protein, 10 aa, Borrelia afzelii
QGVNDDDAKK

SEQ ID NO: 50083 - protein, 10 aa, Borrelia afzelii
GVNDDDAKKA

SEQ ID NO: 50084 - protein, 10 aa, Borrelia afzelii
VNDDDAKKAI

SEQ ID NO: 50085 - protein, 10 aa, Borrelia afzelii
NDDDAKKAIL

SEQ ID NO: 50086 - protein, 10 aa, Borrelia afzelii
DDDAKKAILK

SEQ ID NO: 50087 - protein, 10 aa, Borrelia afzelii
DDAKKAILKT

SEQ ID NO: 50088 - protein, 10 aa, Borrelia afzelii
DAKKAILKTN

SEQ ID NO: 50089 - protein, 10 aa, Borrelia afzelii
AKKAILKTNA

SEQ ID NO: 50090 - protein, 10 aa, Borrelia afzelii
KKAILKTNAD

SEQ ID NO: 50091 - protein, 10 aa, Borrelia afzelii
KAILKTNADK

SEQ ID NO: 50092 - protein, 10 aa, Borrelia afzelii
AILKTNADKT

SEQ ID NO: 50093 - protein, 10 aa, Borrelia afzelii
ILKTNADKTK

SEQ ID NO: 50094 - protein, 10 aa, Borrelia afzelii
LKTNADKTKG

SEQ ID NO: 50095 - protein, 10 aa, Borrelia afzelii
KTNADKTKGA

SEQ ID NO: 50096 - protein, 10 aa, Borrelia afzelii
TNADKTKGAE

SEQ ID NO: 50097 - protein, 10 aa, Borrelia afzelii
NADKTKGAEE

SEQ ID NO: 50098 - protein, 10 aa, Borrelia afzelii
ADKTKGAEEL

SEQ ID NO: 50099 - protein, 10 aa, Borrelia afzelii
DKTKGAEELG

SEQ ID NO: 50100 - protein, 10 aa, Borrelia afzelii
KTKGAEELGK

SEQ ID NO: 50101 - protein, 10 aa, Borrelia afzelii
TKGAEELGKL

SEQ ID NO: 50102 - protein, 10 aa, Borrelia afzelii
KGAEELGKLF

SEQ ID NO: 50103 - protein, 10 aa, Borrelia afzelii
GAEELGKLFK

SEQ ID NO: 50104 - protein, 10 aa, Borrelia afzelii
AEELGKLFKS

SEQ ID NO: 50105 - protein, 10 aa, Borrelia afzelii
EELGKLFKSV

SEQ ID NO: 50106 - protein, 10 aa, Borrelia afzelii
ELGKLFKSVE

SEQ ID NO: 50107 - protein, 10 aa, Borrelia afzelii
LGKLFKSVEG

SEQ ID NO: 50108 - protein, 10 aa, Borrelia afzelii
GKLFKSVEGL

SEQ ID NO: 50109 - protein, 10 aa, Borrelia afzelii
KLFKSVEGLV

SEQ ID NO: 50110 - protein, 10 aa, Borrelia afzelii
LFKSVEGLVK

SEQ ID NO: 50111 - protein, 10 aa, Borrelia afzelii
FKSVEGLVKA

SEQ ID NO: 50112 - protein, 10 aa, Borrelia afzelii
KSVEGLVKAA

SEQ ID NO: 50113 - protein, 10 aa, Borrelia afzelii
SVEGLVKAAQ

SEQ ID NO: 50114 - protein, 10 aa, Borrelia afzelii
VEGLVKAAQE

SEQ ID NO: 50115 - protein, 10 aa, Borrelia afzelii
EGLVKAAQEA

SEQ ID NO: 50116 - protein, 10 aa, Borrelia afzelii
GLVKAAQEAL

SEQ ID NO: 50117 - protein, 10 aa, Borrelia afzelii
LVKAAQEALT

SEQ ID NO: 50118 - protein, 10 aa, Borrelia afzelii
VKAAQEALTN

SEQ ID NO: 50119 - protein, 10 aa, Borrelia afzelii
KAAQEALTNS

SEQ ID NO: 50120 - protein, 10 aa, Borrelia afzelii
AAQEALTNSV

SEQ ID NO: 50121 - protein, 10 aa, Borrelia afzelii
AQEALTNSVK

SEQ ID NO: 50122 - protein, 10 aa, Borrelia afzelii
QEALTNSVKE

SEQ ID NO: 50123 - protein, 10 aa, Borrelia afzelii
EALTNSVKEL

SEQ ID NO: 50124 - protein, 10 aa, Borrelia afzelii
ALTNSVKELT

SEQ ID NO: 50125 - protein, 10 aa, Borrelia afzelii
LTNSVKELTS

SEQ ID NO: 50126 - protein, 10 aa, Borrelia afzelii
TNSVKELTSP

SEQ ID NO: 50127 - protein, 10 aa, Borrelia afzelii
NSVKELTSPV

SEQ ID NO: 50128 - protein, 10 aa, Borrelia afzelii
SVKELTSPVV

SEQ ID NO: 50129 - protein, 10 aa, Borrelia afzelii
VKELTSPVVA

SEQ ID NO: 50130 - protein, 10 aa, Borrelia afzelii
KELTSPVVAE

SEQ ID NO: 50131 - protein, 10 aa, Borrelia afzelii
ELTSPVVAES

SEQ ID NO: 50132 - protein, 10 aa, Borrelia afzelii
LTSPVVAESP

SEQ ID NO: 50133 - protein, 10 aa, Borrelia afzelii
TSPVVAESPK

SEQ ID NO: 50134 - protein, 10 aa, Borrelia afzelii
SPVVAESPKK

SEQ ID NO: 50135 - protein, 10 aa, Borrelia afzelii
PVVAESPKKP

SEQ ID NO: 50136 - protein, 11 aa, Borrelia afzelii
MKKNTLSAILM

SEQ ID NO: 50137 - protein, 11 aa, Borrelia afzelii
KKNTLSAILMT

SEQ ID NO: 50138 - protein, 11 aa, Borrelia afzelii
KNTLSAILMTL

SEQ ID NO: 50139 - protein, 11 aa, Borrelia afzelii
NTLSAILMTLF

SEQ ID NO: 50140 - protein, 11 aa, Borrelia afzelii
TLSAILMTLFL

SEQ ID NO: 50141 - protein, 11 aa, Borrelia afzelii
LSAILMTLFLF

SEQ ID NO: 50142 - protein, 11 aa, Borrelia afzelii
SAILMTLFLFI

SEQ ID NO: 50143 - protein, 11 aa, Borrelia afzelii
AILMTLFLFIS

SEQ ID NO: 50144 - protein, 11 aa, Borrelia afzelii
ILMTLFLFISC

SEQ ID NO: 50145 - protein, 11 aa, Borrelia afzelii
LMTLFLFISCN

SEQ ID NO: 50146 - protein, 11 aa, Borrelia afzelii
MTLFLFISCNN

SEQ ID NO: 50147 - protein, 11 aa, Borrelia afzelii
TLFLFISCNNS

SEQ ID NO: 50148 - protein, 11 aa, Borrelia afzelii
LFLFISCNNSG

SEQ ID NO: 50149 - protein, 11 aa, Borrelia afzelii
FLFISCNNSGK

SEQ ID NO: 50150 - protein, 11 aa, Borrelia afzelii
LFISCNNSGKG

SEQ ID NO: 50151 - protein, 11 aa, Borrelia afzelii
FISCNNSGKGG

SEQ ID NO: 50152 - protein, 11 aa, Borrelia afzelii
ISCNNSGKGGD

SEQ ID NO: 50153 - protein, 11 aa, Borrelia afzelii
SCNNSGKGGDS

SEQ ID NO: 50154 - protein, 11 aa, Borrelia afzelii
CNNSGKGGDSA

SEQ ID NO: 50155 - protein, 11 aa, Borrelia afzelii
NNSGKGGDSAS

SEQ ID NO: 50156 - protein, 11 aa, Borrelia afzelii
NSGKGGDSAST

SEQ ID NO: 50157 - protein, 11 aa, Borrelia afzelii
SGKGGDSASTN

SEQ ID NO: 50158 - protein, 11 aa, Borrelia afzelii
GKGGDSASTNP

SEQ ID NO: 50159 - protein, 11 aa, Borrelia afzelii
KGGDSASTNPA

SEQ ID NO: 50160 - protein, 11 aa, Borrelia afzelii
GGDSASTNPAD

SEQ ID NO: 50161 - protein, 11 aa, Borrelia afzelii
GDSASTNPADE

SEQ ID NO: 50162 - protein, 11 aa, Borrelia afzelii
DSASTNPADES

SEQ ID NO: 50163 - protein, 11 aa, Borrelia afzelii
SASTNPADESA

SEQ ID NO: 50164 - protein, 11 aa, Borrelia afzelii
ASTNPADESAK

SEQ ID NO: 50165 - protein, 11 aa, Borrelia afzelii
STNPADESAKG

SEQ ID NO: 50166 - protein, 11 aa, Borrelia afzelii
TNPADESAKGP

SEQ ID NO: 50167 - protein, 11 aa, Borrelia afzelii
NPADESAKGPN

SEQ ID NO: 50168 - protein, 11 aa, Borrelia afzelii
PADESAKGPNL

SEQ ID NO: 50169 - protein, 11 aa, Borrelia afzelii
ADESAKGPNLT

SEQ ID NO: 50170 - protein, 11 aa, Borrelia afzelii
DESAKGPNLTE

SEQ ID NO: 50171 - protein, 11 aa, Borrelia afzelii
ESAKGPNLTEI

SEQ ID NO: 50172 - protein, 11 aa, Borrelia afzelii
SAKGPNLTEIS

SEQ ID NO: 50173 - protein, 11 aa, Borrelia afzelii
AKGPNLTEISK

SEQ ID NO: 50174 - protein, 11 aa, Borrelia afzelii
KGPNLTEISKK

SEQ ID NO: 50175 - protein, 11 aa, Borrelia afzelii
GPNLTEISKKI

SEQ ID NO: 50176 - protein, 11 aa, Borrelia afzelii
PNLTEISKKIT

SEQ ID NO: 50177 - protein, 11 aa, Borrelia afzelii
NLTEISKKITD

SEQ ID NO: 50178 - protein, 11 aa, Borrelia afzelii
LTEISKKITDS

SEQ ID NO: 50179 - protein, 11 aa, Borrelia afzelii
TEISKKITDSN

SEQ ID NO: 50180 - protein, 11 aa, Borrelia afzelii
EISKKITDSNA

SEQ ID NO: 50181 - protein, 11 aa, Borrelia afzelii
ISKKITDSNAF

SEQ ID NO: 50182 - protein, 11 aa, Borrelia afzelii
SKKITDSNAFV

SEQ ID NO: 50183 - protein, 11 aa, Borrelia afzelii
KKITDSNAFVL

SEQ ID NO: 50184 - protein, 11 aa, Borrelia afzelii
KITDSNAFVLA

SEQ ID NO: 50185 - protein, 11 aa, Borrelia afzelii
ITDSNAFVLAV

SEQ ID NO: 50186 - protein, 11 aa, Borrelia afzelii
TDSNAFVLAVK

SEQ ID NO: 50187 - protein, 11 aa, Borrelia afzelii
DSNAFVLAVKE

SEQ ID NO: 50188 - protein, 11 aa, Borrelia afzelii
SNAFVLAVKEV

SEQ ID NO: 50189 - protein, 11 aa, Borrelia afzelii
NAFVLAVKEVE

SEQ ID NO: 50190 - protein, 11 aa, Borrelia afzelii
AFVLAVKEVET

SEQ ID NO: 50191 - protein, 11 aa, Borrelia afzelii
FVLAVKEVETL

SEQ ID NO: 50192 - protein, 11 aa, Borrelia afzelii
VLAVKEVETLV

SEQ ID NO: 50193 - protein, 11 aa, Borrelia afzelii
LAVKEVETLVS

SEQ ID NO: 50194 - protein, 11 aa, Borrelia afzelii
AVKEVETLVSS

SEQ ID NO: 50195 - protein, 11 aa, Borrelia afzelii
VKEVETLVSSI

SEQ ID NO: 50196 - protein, 11 aa, Borrelia afzelii
KEVETLVSSID

SEQ ID NO: 50197 - protein, 11 aa, Borrelia afzelii
EVETLVSSIDE

SEQ ID NO: 50198 - protein, 11 aa, Borrelia afzelii
VETLVSSIDEL

SEQ ID NO: 50199 - protein, 11 aa, Borrelia afzelii
ETLVSSIDELA

SEQ ID NO: 50200 - protein, 11 aa, Borrelia afzelii
TLVSSIDELAN

SEQ ID NO: 50201 - protein, 11 aa, Borrelia afzelii
LVSSIDELANK

SEQ ID NO: 50202 - protein, 11 aa, Borrelia afzelii
VSSIDELANKA

SEQ ID NO: 50203 - protein, 11 aa, Borrelia afzelii
SSIDELANKAI

SEQ ID NO: 50204 - protein, 11 aa, Borrelia afzelii
SIDELANKAIG

SEQ ID NO: 50205 - protein, 11 aa, Borrelia afzelii
IDELANKAIGK

SEQ ID NO: 50206 - protein, 11 aa, Borrelia afzelii
DELANKAIGKK

SEQ ID NO: 50207 - protein, 11 aa, Borrelia afzelii
ELANKAIGKKI

SEQ ID NO: 50208 - protein, 11 aa, Borrelia afzelii
LANKAIGKKIQ

SEQ ID NO: 50209 - protein, 11 aa, Borrelia afzelii
ANKAIGKKIQQ

SEQ ID NO: 50210 - protein, 11 aa, Borrelia afzelii
NKAIGKKIQQN

SEQ ID NO: 50211 - protein, 11 aa, Borrelia afzelii
KAIGKKIQQNG

SEQ ID NO: 50212 - protein, 11 aa, Borrelia afzelii
AIGKKIQQNGL

SEQ ID NO: 50213 - protein, 11 aa, Borrelia afzelii
IGKKIQQNGLG

SEQ ID NO: 50214 - protein, 11 aa, Borrelia afzelii
GKKIQQNGLGA

SEQ ID NO: 50215 - protein, 11 aa, Borrelia afzelii
KKIQQNGLGAE

SEQ ID NO: 50216 - protein, 11 aa, Borrelia afzelii
KIQQNGLGAEA

SEQ ID NO: 50217 - protein, 11 aa, Borrelia afzelii
IQQNGLGAEAN

SEQ ID NO: 50218 - protein, 11 aa, Borrelia afzelii
QQNGLGAEANR

SEQ ID NO: 50219 - protein, 11 aa, Borrelia afzelii
QNGLGAEANRN

SEQ ID NO: 50220 - protein, 11 aa, Borrelia afzelii
NGLGAEANRNE

SEQ ID NO: 50221 - protein, 11 aa, Borrelia afzelii
GLGAEANRNES

SEQ ID NO: 50222 - protein, 11 aa, Borrelia afzelii
LGAEANRNESL

SEQ ID NO: 50223 - protein, 11 aa, Borrelia afzelii
GAEANRNESLL

SEQ ID NO: 50224 - protein, 11 aa, Borrelia afzelii
AEANRNESLLA

SEQ ID NO: 50225 - protein, 11 aa, Borrelia afzelii
EANRNESLLAG

SEQ ID NO: 50226 - protein, 11 aa, Borrelia afzelii
ANRNESLLAGV

SEQ ID NO: 50227 - protein, 11 aa, Borrelia afzelii
NRNESLLAGVH

SEQ ID NO: 50228 - protein, 11 aa, Borrelia afzelii
RNESLLAGVHE

SEQ ID NO: 50229 - protein, 11 aa, Borrelia afzelii
NESLLAGVHEI

SEQ ID NO: 50230 - protein, 11 aa, Borrelia afzelii
ESLLAGVHEIS

SEQ ID NO: 50231 - protein, 11 aa, Borrelia afzelii
SLLAGVHEIST

SEQ ID NO: 50232 - protein, 11 aa, Borrelia afzelii
LLAGVHEISTL

SEQ ID NO: 50233 - protein, 11 aa, Borrelia afzelii
LAGVHEISTLI

SEQ ID NO: 50234 - protein, 11 aa, Borrelia afzelii
AGVHEISTLIT

SEQ ID NO: 50235 - protein, 11 aa, Borrelia afzelii
GVHEISTLITE

SEQ ID NO: 50236 - protein, 11 aa, Borrelia afzelii
VHEISTLITEK

SEQ ID NO: 50237 - protein, 11 aa, Borrelia afzelii
HEISTLITEKL

SEQ ID NO: 50238 - protein, 11 aa, Borrelia afzelii
EISTLITEKLS

SEQ ID NO: 50239 - protein, 11 aa, Borrelia afzelii
ISTLITEKLSK

SEQ ID NO: 50240 - protein, 11 aa, Borrelia afzelii
STLITEKLSKL

SEQ ID NO: 50241 - protein, 11 aa, Borrelia afzelii
TLITEKLSKLK

SEQ ID NO: 50242 - protein, 11 aa, Borrelia afzelii
LITEKLSKLKN

SEQ ID NO: 50243 - protein, 11 aa, Borrelia afzelii
ITEKLSKLKNS

SEQ ID NO: 50244 - protein, 11 aa, Borrelia afzelii
TEKLSKLKNSG

SEQ ID NO: 50245 - protein, 11 aa, Borrelia afzelii
EKLSKLKNSGE

SEQ ID NO: 50246 - protein, 11 aa, Borrelia afzelii
KLSKLKNSGEL

SEQ ID NO: 50247 - protein, 11 aa, Borrelia afzelii
LSKLKNSGELK

SEQ ID NO: 50248 - protein, 11 aa, Borrelia afzelii
SKLKNSGELKA

SEQ ID NO: 50249 - protein, 11 aa, Borrelia afzelii
KLKNSGELKAK

SEQ ID NO: 50250 - protein, 11 aa, Borrelia afzelii
LKNSGELKAKI

SEQ ID NO: 50251 - protein, 11 aa, Borrelia afzelii
KNSGELKAKIE

SEQ ID NO: 50252 - protein, 11 aa, Borrelia afzelii
NSGELKAKIED

SEQ ID NO: 50253 - protein, 11 aa, Borrelia afzelii
SGELKAKIEDA

SEQ ID NO: 50254 - protein, 11 aa, Borrelia afzelii
GELKAKIEDAK

SEQ ID NO: 50255 - protein, 11 aa, Borrelia afzelii
ELKAKIEDAKK

SEQ ID NO: 50256 - protein, 11 aa, Borrelia afzelii
LKAKIEDAKKC

SEQ ID NO: 50257 - protein, 11 aa, Borrelia afzelii
KAKIEDAKKCS

SEQ ID NO: 50258 - protein, 11 aa, Borrelia afzelii
AKIEDAKKCSE

SEQ ID NO: 50259 - protein, 11 aa, Borrelia afzelii
KIEDAKKCSEE

SEQ ID NO: 50260 - protein, 11 aa, Borrelia afzelii
IEDAKKCSEEF

SEQ ID NO: 50261 - protein, 11 aa, Borrelia afzelii
EDAKKCSEEFT

SEQ ID NO: 50262 - protein, 11 aa, Borrelia afzelii
DAKKCSEEFTN

SEQ ID NO: 50263 - protein, 11 aa, Borrelia afzelii
AKKCSEEFTNK

SEQ ID NO: 50264 - protein, 11 aa, Borrelia afzelii
KKCSEEFTNKL

SEQ ID NO: 50265 - protein, 11 aa, Borrelia afzelii
KCSEEFTNKLR

SEQ ID NO: 50266 - protein, 11 aa, Borrelia afzelii
CSEEFTNKLRV

SEQ ID NO: 50267 - protein, 11 aa, Borrelia afzelii
SEEFTNKLRVS

SEQ ID NO: 50268 - protein, 11 aa, Borrelia afzelii
EEFTNKLRVSH

SEQ ID NO: 50269 - protein, 11 aa, Borrelia afzelii
EFTNKLRVSHA

SEQ ID NO: 50270 - protein, 11 aa, Borrelia afzelii
FTNKLRVSHAD

SEQ ID NO: 50271 - protein, 11 aa, Borrelia afzelii
TNKLRVSHADL

SEQ ID NO: 50272 - protein, 11 aa, Borrelia afzelii
NKLRVSHADLG

SEQ ID NO: 50273 - protein, 11 aa, Borrelia afzelii
KLRVSHADLGK

SEQ ID NO: 50274 - protein, 11 aa, Borrelia afzelii
LRVSHADLGKQ

SEQ ID NO: 50275 - protein, 11 aa, Borrelia afzelii
RVSHADLGKQG

SEQ ID NO: 50276 - protein, 11 aa, Borrelia afzelii
VSHADLGKQGV

SEQ ID NO: 50277 - protein, 11 aa, Borrelia afzelii
SHADLGKQGVN

SEQ ID NO: 50278 - protein, 11 aa, Borrelia afzelii
HADLGKQGVND

SEQ ID NO: 50279 - protein, 11 aa, Borrelia afzelii
ADLGKQGVNDD

SEQ ID NO: 50280 - protein, 11 aa, Borrelia afzelii
DLGKQGVNDDD

SEQ ID NO: 50281 - protein, 11 aa, Borrelia afzelii
LGKQGVNDDDA

SEQ ID NO: 50282 - protein, 11 aa, Borrelia afzelii
GKQGVNDDDAK

SEQ ID NO: 50283 - protein, 11 aa, Borrelia afzelii
KQGVNDDDAKK

SEQ ID NO: 50284 - protein, 11 aa, Borrelia afzelii
QGVNDDDAKKA

SEQ ID NO: 50285 - protein, 11 aa, Borrelia afzelii
GVNDDDAKKAI

SEQ ID NO: 50286 - protein, 11 aa, Borrelia afzelii
VNDDDAKKAIL

SEQ ID NO: 50287 - protein, 11 aa, Borrelia afzelii
NDDDAKKAILK

SEQ ID NO: 50288 - protein, 11 aa, Borrelia afzelii
DDDAKKAILKT

SEQ ID NO: 50289 - protein, 11 aa, Borrelia afzelii
DDAKKAILKTN

SEQ ID NO: 50290 - protein, 11 aa, Borrelia afzelii
DAKKAILKTNA

SEQ ID NO: 50291 - protein, 11 aa, Borrelia afzelii
AKKAILKTNAD

SEQ ID NO: 50292 - protein, 11 aa, Borrelia afzelii
KKAILKTNADK

SEQ ID NO: 50293 - protein, 11 aa, Borrelia afzelii
KAILKTNADKT

SEQ ID NO: 50294 - protein, 11 aa, Borrelia afzelii
AILKTNADKTK

SEQ ID NO: 50295 - protein, 11 aa, Borrelia afzelii
ILKTNADKTKG

SEQ ID NO: 50296 - protein, 11 aa, Borrelia afzelii
LKTNADKTKGA

SEQ ID NO: 50297 - protein, 11 aa, Borrelia afzelii
KTNADKTKGAE

SEQ ID NO: 50298 - protein, 11 aa, Borrelia afzelii
TNADKTKGAEE

SEQ ID NO: 50299 - protein, 11 aa, Borrelia afzelii
NADKTKGAEEL

SEQ ID NO: 50300 - protein, 11 aa, Borrelia afzelii
ADKTKGAEELG

SEQ ID NO: 50301 - protein, 11 aa, Borrelia afzelii
DKTKGAEELGK

SEQ ID NO: 50302 - protein, 11 aa, Borrelia afzelii
KTKGAEELGKL

SEQ ID NO: 50303 - protein, 11 aa, Borrelia afzelii
TKGAEELGKLF

SEQ ID NO: 50304 - protein, 11 aa, Borrelia afzelii
KGAEELGKLFK

SEQ ID NO: 50305 - protein, 11 aa, Borrelia afzelii
GAEELGKLFKS

SEQ ID NO: 50306 - protein, 11 aa, Borrelia afzelii
AEELGKLFKSV

SEQ ID NO: 50307 - protein, 11 aa, Borrelia afzelii
EELGKLFKSVE

SEQ ID NO: 50308 - protein, 11 aa, Borrelia afzelii
ELGKLFKSVEG

SEQ ID NO: 50309 - protein, 11 aa, Borrelia afzelii
LGKLFKSVEGL

SEQ ID NO: 50310 - protein, 11 aa, Borrelia afzelii
GKLFKSVEGLV

SEQ ID NO: 50311 - protein, 11 aa, Borrelia afzelii
KLFKSVEGLVK

SEQ ID NO: 50312 - protein, 11 aa, Borrelia afzelii
LFKSVEGLVKA

SEQ ID NO: 50313 - protein, 11 aa, Borrelia afzelii
FKSVEGLVKAA

SEQ ID NO: 50314 - protein, 11 aa, Borrelia afzelii
KSVEGLVKAAQ

SEQ ID NO: 50315 - protein, 11 aa, Borrelia afzelii
SVEGLVKAAQE

SEQ ID NO: 50316 - protein, 11 aa, Borrelia afzelii
VEGLVKAAQEA

SEQ ID NO: 50317 - protein, 11 aa, Borrelia afzelii
EGLVKAAQEAL

SEQ ID NO: 50318 - protein, 11 aa, Borrelia afzelii
GLVKAAQEALT

SEQ ID NO: 50319 - protein, 11 aa, Borrelia afzelii
LVKAAQEALTN

SEQ ID NO: 50320 - protein, 11 aa, Borrelia afzelii
VKAAQEALTNS

SEQ ID NO: 50321 - protein, 11 aa, Borrelia afzelii
KAAQEALTNSV

SEQ ID NO: 50322 - protein, 11 aa, Borrelia afzelii
AAQEALTNSVK

SEQ ID NO: 50323 - protein, 11 aa, Borrelia afzelii
AQEALTNSVKE

SEQ ID NO: 50324 - protein, 11 aa, Borrelia afzelii
QEALTNSVKEL

SEQ ID NO: 50325 - protein, 11 aa, Borrelia afzelii
EALTNSVKELT

SEQ ID NO: 50326 - protein, 11 aa, Borrelia afzelii
ALTNSVKELTS

SEQ ID NO: 50327 - protein, 11 aa, Borrelia afzelii
LTNSVKELTSP

SEQ ID NO: 50328 - protein, 11 aa, Borrelia afzelii
TNSVKELTSPV

SEQ ID NO: 50329 - protein, 11 aa, Borrelia afzelii
NSVKELTSPVV

SEQ ID NO: 50330 - protein, 11 aa, Borrelia afzelii
SVKELTSPVVA

SEQ ID NO: 50331 - protein, 11 aa, Borrelia afzelii
VKELTSPVVAE

SEQ ID NO: 50332 - protein, 11 aa, Borrelia afzelii
KELTSPVVAES

SEQ ID NO: 50333 - protein, 11 aa, Borrelia afzelii
ELTSPVVAESP

SEQ ID NO: 50334 - protein, 11 aa, Borrelia afzelii
LTSPVVAESPK

SEQ ID NO: 50335 - protein, 11 aa, Borrelia afzelii
TSPVVAESPKK

SEQ ID NO: 50336 - protein, 11 aa, Borrelia afzelii
SPVVAESPKKP

SEQ ID NO: 50337 - protein, 13 aa, Borrelia afzelii
MKKNTLSAILMTL

SEQ ID NO: 50338 - protein, 13 aa, Borrelia afzelii
KKNTLSAILMTLF

SEQ ID NO: 50339 - protein, 13 aa, Borrelia afzelii
KNTLSAILMTLFL

SEQ ID NO: 50340 - protein, 13 aa, Borrelia afzelii
NTLSAILMTLFLF

SEQ ID NO: 50341 - protein, 13 aa, Borrelia afzelii
TLSAILMTLFLFI

SEQ ID NO: 50342 - protein, 13 aa, Borrelia afzelii
LSAILMTLFLFIS

SEQ ID NO: 50343 - protein, 13 aa, Borrelia afzelii
SAILMTLFLFISC

SEQ ID NO: 50344 - protein, 13 aa, Borrelia afzelii
AILMTLFLFISCN

SEQ ID NO: 50345 - protein, 13 aa, Borrelia afzelii
ILMTLFLFISCNN

SEQ ID NO: 50346 - protein, 13 aa, Borrelia afzelii
LMTLFLFISCNNS

SEQ ID NO: 50347 - protein, 13 aa, Borrelia afzelii
MTLFLFISCNNSG

SEQ ID NO: 50348 - protein, 13 aa, Borrelia afzelii
TLFLFISCNNSGK

SEQ ID NO: 50349 - protein, 13 aa, Borrelia afzelii
LFLFISCNNSGKG

SEQ ID NO: 50350 - protein, 13 aa, Borrelia afzelii
FLFISCNNSGKGG

SEQ ID NO: 50351 - protein, 13 aa, Borrelia afzelii
LFISCNNSGKGGD

SEQ ID NO: 50352 - protein, 13 aa, Borrelia afzelii
FISCNNSGKGGDS

SEQ ID NO: 50353 - protein, 13 aa, Borrelia afzelii
ISCNNSGKGGDSA

SEQ ID NO: 50354 - protein, 13 aa, Borrelia afzelii
SCNNSGKGGDSAS

SEQ ID NO: 50355 - protein, 13 aa, Borrelia afzelii
CNNSGKGGDSAST

SEQ ID NO: 50356 - protein, 13 aa, Borrelia afzelii
NNSGKGGDSASTN

SEQ ID NO: 50357 - protein, 13 aa, Borrelia afzelii
NSGKGGDSASTNP

SEQ ID NO: 50358 - protein, 13 aa, Borrelia afzelii
SGKGGDSASTNPA

SEQ ID NO: 50359 - protein, 13 aa, Borrelia afzelii
GKGGDSASTNPAD

SEQ ID NO: 50360 - protein, 13 aa, Borrelia afzelii
KGGDSASTNPADE

SEQ ID NO: 50361 - protein, 13 aa, Borrelia afzelii
GGDSASTNPADES

SEQ ID NO: 50362 - protein, 13 aa, Borrelia afzelii
GDSASTNPADESA

SEQ ID NO: 50363 - protein, 13 aa, Borrelia afzelii
DSASTNPADESAK

SEQ ID NO: 50364 - protein, 13 aa, Borrelia afzelii
SASTNPADESAKG

SEQ ID NO: 50365 - protein, 13 aa, Borrelia afzelii
ASTNPADESAKGP

SEQ ID NO: 50366 - protein, 13 aa, Borrelia afzelii
STNPADESAKGPN

SEQ ID NO: 50367 - protein, 13 aa, Borrelia afzelii
TNPADESAKGPNL

SEQ ID NO: 50368 - protein, 13 aa, Borrelia afzelii
NPADESAKGPNLT

SEQ ID NO: 50369 - protein, 13 aa, Borrelia afzelii
PADESAKGPNLTE

SEQ ID NO: 50370 - protein, 13 aa, Borrelia afzelii
ADESAKGPNLTEI

SEQ ID NO: 50371 - protein, 13 aa, Borrelia afzelii
DESAKGPNLTEIS

SEQ ID NO: 50372 - protein, 13 aa, Borrelia afzelii
ESAKGPNLTEISK

SEQ ID NO: 50373 - protein, 13 aa, Borrelia afzelii
SAKGPNLTEISKK

SEQ ID NO: 50374 - protein, 13 aa, Borrelia afzelii
AKGPNLTEISKKI

SEQ ID NO: 50375 - protein, 13 aa, Borrelia afzelii
KGPNLTEISKKIT

SEQ ID NO: 50376 - protein, 13 aa, Borrelia afzelii
GPNLTEISKKITD

SEQ ID NO: 50377 - protein, 13 aa, Borrelia afzelii
PNLTEISKKITDS

SEQ ID NO: 50378 - protein, 13 aa, Borrelia afzelii
NLTEISKKITDSN

SEQ ID NO: 50379 - protein, 13 aa, Borrelia afzelii
LTEISKKITDSNA

SEQ ID NO: 50380 - protein, 13 aa, Borrelia afzelii
TEISKKITDSNAF

SEQ ID NO: 50381 - protein, 13 aa, Borrelia afzelii
EISKKITDSNAFV

SEQ ID NO: 50382 - protein, 13 aa, Borrelia afzelii
ISKKITDSNAFVL

SEQ ID NO: 50383 - protein, 13 aa, Borrelia afzelii
SKKITDSNAFVLA

SEQ ID NO: 50384 - protein, 13 aa, Borrelia afzelii
KKITDSNAFVLAV

SEQ ID NO: 50385 - protein, 13 aa, Borrelia afzelii
KITDSNAFVLAVK

SEQ ID NO: 50386 - protein, 13 aa, Borrelia afzelii
ITDSNAFVLAVKE

SEQ ID NO: 50387 - protein, 13 aa, Borrelia afzelii
TDSNAFVLAVKEV

SEQ ID NO: 50388 - protein, 13 aa, Borrelia afzelii
DSNAFVLAVKEVE

SEQ ID NO: 50389 - protein, 13 aa, Borrelia afzelii
SNAFVLAVKEVET

SEQ ID NO: 50390 - protein, 13 aa, Borrelia afzelii
NAFVLAVKEVETL

SEQ ID NO: 50391 - protein, 13 aa, Borrelia afzelii
AFVLAVKEVETLV

SEQ ID NO: 50392 - protein, 13 aa, Borrelia afzelii
FVLAVKEVETLVS

SEQ ID NO: 50393 - protein, 13 aa, Borrelia afzelii
VLAVKEVETLVSS

SEQ ID NO: 50394 - protein, 13 aa, Borrelia afzelii
LAVKEVETLVSSI

SEQ ID NO: 50395 - protein, 13 aa, Borrelia afzelii
AVKEVETLVSSID

SEQ ID NO: 50396 - protein, 13 aa, Borrelia afzelii
VKEVETLVSSIDE

SEQ ID NO: 50397 - protein, 13 aa, Borrelia afzelii
KEVETLVSSIDEL

SEQ ID NO: 50398 - protein, 13 aa, Borrelia afzelii
EVETLVSSIDELA

SEQ ID NO: 50399 - protein, 13 aa, Borrelia afzelii
VETLVSSIDELAN

SEQ ID NO: 50400 - protein, 13 aa, Borrelia afzelii
ETLVSSIDELANK

SEQ ID NO: 50401 - protein, 13 aa, Borrelia afzelii
TLVSSIDELANKA

SEQ ID NO: 50402 - protein, 13 aa, Borrelia afzelii
LVSSIDELANKAI

SEQ ID NO: 50403 - protein, 13 aa, Borrelia afzelii
VSSIDELANKAIG

SEQ ID NO: 50404 - protein, 13 aa, Borrelia afzelii
SSIDELANKAIGK

SEQ ID NO: 50405 - protein, 13 aa, Borrelia afzelii
SIDELANKAIGKK

SEQ ID NO: 50406 - protein, 13 aa, Borrelia afzelii
IDELANKAIGKKI

SEQ ID NO: 50407 - protein, 13 aa, Borrelia afzelii
DELANKAIGKKIQ

SEQ ID NO: 50408 - protein, 13 aa, Borrelia afzelii
ELANKAIGKKIQQ

SEQ ID NO: 50409 - protein, 13 aa, Borrelia afzelii
LANKAIGKKIQQN

SEQ ID NO: 50410 - protein, 13 aa, Borrelia afzelii
ANKAIGKKIQQNG

SEQ ID NO: 50411 - protein, 13 aa, Borrelia afzelii
NKAIGKKIQQNGL

SEQ ID NO: 50412 - protein, 13 aa, Borrelia afzelii
KAIGKKIQQNGLG

SEQ ID NO: 50413 - protein, 13 aa, Borrelia afzelii
AIGKKIQQNGLGA

SEQ ID NO: 50414 - protein, 13 aa, Borrelia afzelii
IGKKIQQNGLGAE

SEQ ID NO: 50415 - protein, 13 aa, Borrelia afzelii
GKKIQQNGLGAEA

SEQ ID NO: 50416 - protein, 13 aa, Borrelia afzelii
KKIQQNGLGAEAN

SEQ ID NO: 50417 - protein, 13 aa, Borrelia afzelii
KIQQNGLGAEANR

SEQ ID NO: 50418 - protein, 13 aa, Borrelia afzelii
IQQNGLGAEANRN

SEQ ID NO: 50419 - protein, 13 aa, Borrelia afzelii
QQNGLGAEANRNE

SEQ ID NO: 50420 - protein, 13 aa, Borrelia afzelii
QNGLGAEANRNES

SEQ ID NO: 50421 - protein, 13 aa, Borrelia afzelii
NGLGAEANRNESL

SEQ ID NO: 50422 - protein, 13 aa, Borrelia afzelii
GLGAEANRNESLL

SEQ ID NO: 50423 - protein, 13 aa, Borrelia afzelii
LGAEANRNESLLA

SEQ ID NO: 50424 - protein, 13 aa, Borrelia afzelii
GAEANRNESLLAG

SEQ ID NO: 50425 - protein, 13 aa, Borrelia afzelii
AEANRNESLLAGV

SEQ ID NO: 50426 - protein, 13 aa, Borrelia afzelii
EANRNESLLAGVH

SEQ ID NO: 50427 - protein, 13 aa, Borrelia afzelii
ANRNESLLAGVHE

SEQ ID NO: 50428 - protein, 13 aa, Borrelia afzelii
NRNESLLAGVHEI

SEQ ID NO: 50429 - protein, 13 aa, Borrelia afzelii
RNESLLAGVHEIS

SEQ ID NO: 50430 - protein, 13 aa, Borrelia afzelii
NESLLAGVHEIST

SEQ ID NO: 50431 - protein, 13 aa, Borrelia afzelii
ESLLAGVHEISTL

SEQ ID NO: 50432 - protein, 13 aa, Borrelia afzelii
SLLAGVHEISTLI

SEQ ID NO: 50433 - protein, 13 aa, Borrelia afzelii
LLAGVHEISTLIT

SEQ ID NO: 50434 - protein, 13 aa, Borrelia afzelii
LAGVHEISTLITE

SEQ ID NO: 50435 - protein, 13 aa, Borrelia afzelii
AGVHEISTLITEK

SEQ ID NO: 50436 - protein, 13 aa, Borrelia afzelii
GVHEISTLITEKL

SEQ ID NO: 50437 - protein, 13 aa, Borrelia afzelii
VHEISTLITEKLS

SEQ ID NO: 50438 - protein, 13 aa, Borrelia afzelii
HEISTLITEKLSK

SEQ ID NO: 50439 - protein, 13 aa, Borrelia afzelii
EISTLITEKLSKL

SEQ ID NO: 50440 - protein, 13 aa, Borrelia afzelii
ISTLITEKLSKLK

SEQ ID NO: 50441 - protein, 13 aa, Borrelia afzelii
STLITEKLSKLKN

SEQ ID NO: 50442 - protein, 13 aa, Borrelia afzelii
TLITEKLSKLKNS

SEQ ID NO: 50443 - protein, 13 aa, Borrelia afzelii
LITEKLSKLKNSG

SEQ ID NO: 50444 - protein, 13 aa, Borrelia afzelii
ITEKLSKLKNSGE

SEQ ID NO: 50445 - protein, 13 aa, Borrelia afzelii
TEKLSKLKNSGEL

SEQ ID NO: 50446 - protein, 13 aa, Borrelia afzelii
EKLSKLKNSGELK

SEQ ID NO: 50447 - protein, 13 aa, Borrelia afzelii
KLSKLKNSGELKA

SEQ ID NO: 50448 - protein, 13 aa, Borrelia afzelii
LSKLKNSGELKAK

SEQ ID NO: 50449 - protein, 13 aa, Borrelia afzelii
SKLKNSGELKAKI

SEQ ID NO: 50450 - protein, 13 aa, Borrelia afzelii
KLKNSGELKAKIE

SEQ ID NO: 50451 - protein, 13 aa, Borrelia afzelii
LKNSGELKAKIED

SEQ ID NO: 50452 - protein, 13 aa, Borrelia afzelii
KNSGELKAKIEDA

SEQ ID NO: 50453 - protein, 13 aa, Borrelia afzelii
NSGELKAKIEDAK

SEQ ID NO: 50454 - protein, 13 aa, Borrelia afzelii
SGELKAKIEDAKK

SEQ ID NO: 50455 - protein, 13 aa, Borrelia afzelii
GELKAKIEDAKKC

SEQ ID NO: 50456 - protein, 13 aa, Borrelia afzelii
ELKAKIEDAKKCS

SEQ ID NO: 50457 - protein, 13 aa, Borrelia afzelii
LKAKIEDAKKCSE

SEQ ID NO: 50458 - protein, 13 aa, Borrelia afzelii
KAKIEDAKKCSEE

SEQ ID NO: 50459 - protein, 13 aa, Borrelia afzelii
AKIEDAKKCSEEF

SEQ ID NO: 50460 - protein, 13 aa, Borrelia afzelii
KIEDAKKCSEEFT

SEQ ID NO: 50461 - protein, 13 aa, Borrelia afzelii
IEDAKKCSEEFTN

SEQ ID NO: 50462 - protein, 13 aa, Borrelia afzelii
EDAKKCSEEFTNK

SEQ ID NO: 50463 - protein, 13 aa, Borrelia afzelii
DAKKCSEEFTNKL

SEQ ID NO: 50464 - protein, 13 aa, Borrelia afzelii
AKKCSEEFTNKLR

SEQ ID NO: 50465 - protein, 13 aa, Borrelia afzelii
KKCSEEFTNKLRV

SEQ ID NO: 50466 - protein, 13 aa, Borrelia afzelii
KCSEEFTNKLRVS

SEQ ID NO: 50467 - protein, 13 aa, Borrelia afzelii
CSEEFTNKLRVSH

SEQ ID NO: 50468 - protein, 13 aa, Borrelia afzelii
SEEFTNKLRVSHA

SEQ ID NO: 50469 - protein, 13 aa, Borrelia afzelii
EEFTNKLRVSHAD

SEQ ID NO: 50470 - protein, 13 aa, Borrelia afzelii
EFTNKLRVSHADL

SEQ ID NO: 50471 - protein, 13 aa, Borrelia afzelii
FTNKLRVSHADLG

SEQ ID NO: 50472 - protein, 13 aa, Borrelia afzelii
TNKLRVSHADLGK

SEQ ID NO: 50473 - protein, 13 aa, Borrelia afzelii
NKLRVSHADLGKQ

SEQ ID NO: 50474 - protein, 13 aa, Borrelia afzelii
KLRVSHADLGKQG

SEQ ID NO: 50475 - protein, 13 aa, Borrelia afzelii
LRVSHADLGKQGV

SEQ ID NO: 50476 - protein, 13 aa, Borrelia afzelii
RVSHADLGKQGVN

SEQ ID NO: 50477 - protein, 13 aa, Borrelia afzelii
VSHADLGKQGVND

SEQ ID NO: 50478 - protein, 13 aa, Borrelia afzelii
SHADLGKQGVNDD

SEQ ID NO: 50479 - protein, 13 aa, Borrelia afzelii
HADLGKQGVNDDD

SEQ ID NO: 50480 - protein, 13 aa, Borrelia afzelii
ADLGKQGVNDDDA

SEQ ID NO: 50481 - protein, 13 aa, Borrelia afzelii
DLGKQGVNDDDAK

SEQ ID NO: 50482 - protein, 13 aa, Borrelia afzelii
LGKQGVNDDDAKK

SEQ ID NO: 50483 - protein, 13 aa, Borrelia afzelii
GKQGVNDDDAKKA

SEQ ID NO: 50484 - protein, 13 aa, Borrelia afzelii
KQGVNDDDAKKAI

SEQ ID NO: 50485 - protein, 13 aa, Borrelia afzelii
QGVNDDDAKKAIL

SEQ ID NO: 50486 - protein, 13 aa, Borrelia afzelii
GVNDDDAKKAILK

SEQ ID NO: 50487 - protein, 13 aa, Borrelia afzelii
VNDDDAKKAILKT

SEQ ID NO: 50488 - protein, 13 aa, Borrelia afzelii
NDDDAKKAILKTN

SEQ ID NO: 50489 - protein, 13 aa, Borrelia afzelii
DDDAKKAILKTNA

SEQ ID NO: 50490 - protein, 13 aa, Borrelia afzelii
DDAKKAILKTNAD

SEQ ID NO: 50491 - protein, 13 aa, Borrelia afzelii
DAKKAILKTNADK

SEQ ID NO: 50492 - protein, 13 aa, Borrelia afzelii
AKKAILKTNADKT

SEQ ID NO: 50493 - protein, 13 aa, Borrelia afzelii
KKAILKTNADKTK

SEQ ID NO: 50494 - protein, 13 aa, Borrelia afzelii
KAILKTNADKTKG

SEQ ID NO: 50495 - protein, 13 aa, Borrelia afzelii
AILKTNADKTKGA

SEQ ID NO: 50496 - protein, 13 aa, Borrelia afzelii
ILKTNADKTKGAE

SEQ ID NO: 50497 - protein, 13 aa, Borrelia afzelii
LKTNADKTKGAEE

SEQ ID NO: 50498 - protein, 13 aa, Borrelia afzelii
KTNADKTKGAEEL

SEQ ID NO: 50499 - protein, 13 aa, Borrelia afzelii
TNADKTKGAEELG

SEQ ID NO: 50500 - protein, 13 aa, Borrelia afzelii
NADKTKGAEELGK

SEQ ID NO: 50501 - protein, 13 aa, Borrelia afzelii
ADKTKGAEELGKL

SEQ ID NO: 50502 - protein, 13 aa, Borrelia afzelii
DKTKGAEELGKLF

SEQ ID NO: 50503 - protein, 13 aa, Borrelia afzelii
KTKGAEELGKLFK

SEQ ID NO: 50504 - protein, 13 aa, Borrelia afzelii
TKGAEELGKLFKS

SEQ ID NO: 50505 - protein, 13 aa, Borrelia afzelii
KGAEELGKLFKSV

SEQ ID NO: 50506 - protein, 13 aa, Borrelia afzelii
GAEELGKLFKSVE

SEQ ID NO: 50507 - protein, 13 aa, Borrelia afzelii
AEELGKLFKSVEG

SEQ ID NO: 50508 - protein, 13 aa, Borrelia afzelii
EELGKLFKSVEGL

SEQ ID NO: 50509 - protein, 13 aa, Borrelia afzelii
ELGKLFKSVEGLV

SEQ ID NO: 50510 - protein, 13 aa, Borrelia afzelii
LGKLFKSVEGLVK

SEQ ID NO: 50511 - protein, 13 aa, Borrelia afzelii
GKLFKSVEGLVKA

SEQ ID NO: 50512 - protein, 13 aa, Borrelia afzelii
KLFKSVEGLVKAA

SEQ ID NO: 50513 - protein, 13 aa, Borrelia afzelii
LFKSVEGLVKAAQ

SEQ ID NO: 50514 - protein, 13 aa, Borrelia afzelii
FKSVEGLVKAAQE

SEQ ID NO: 50515 - protein, 13 aa, Borrelia afzelii
KSVEGLVKAAQEA

SEQ ID NO: 50516 - protein, 13 aa, Borrelia afzelii
SVEGLVKAAQEAL

SEQ ID NO: 50517 - protein, 13 aa, Borrelia afzelii
VEGLVKAAQEALT

SEQ ID NO: 50518 - protein, 13 aa, Borrelia afzelii
EGLVKAAQEALTN

SEQ ID NO: 50519 - protein, 13 aa, Borrelia afzelii
GLVKAAQEALTNS

SEQ ID NO: 50520 - protein, 13 aa, Borrelia afzelii
LVKAAQEALTNSV

SEQ ID NO: 50521 - protein, 13 aa, Borrelia afzelii
VKAAQEALTNSVK

SEQ ID NO: 50522 - protein, 13 aa, Borrelia afzelii
KAAQEALTNSVKE

SEQ ID NO: 50523 - protein, 13 aa, Borrelia afzelii
AAQEALTNSVKEL

SEQ ID NO: 50524 - protein, 13 aa, Borrelia afzelii
AQEALTNSVKELT

SEQ ID NO: 50525 - protein, 13 aa, Borrelia afzelii
QEALTNSVKELTS

SEQ ID NO: 50526 - protein, 13 aa, Borrelia afzelii
EALTNSVKELTSP

SEQ ID NO: 50527 - protein, 13 aa, Borrelia afzelii
ALTNSVKELTSPV

SEQ ID NO: 50528 - protein, 13 aa, Borrelia afzelii
LTNSVKELTSPVV

SEQ ID NO: 50529 - protein, 13 aa, Borrelia afzelii
TNSVKELTSPVVA

SEQ ID NO: 50530 - protein, 13 aa, Borrelia afzelii
NSVKELTSPVVAE

SEQ ID NO: 50531 - protein, 13 aa, Borrelia afzelii
SVKELTSPVVAES

SEQ ID NO: 50532 - protein, 13 aa, Borrelia afzelii
VKELTSPVVAESP

SEQ ID NO: 50533 - protein, 13 aa, Borrelia afzelii
KELTSPVVAESPK

SEQ ID NO: 50534 - protein, 13 aa, Borrelia afzelii
ELTSPVVAESPKK

SEQ ID NO: 50535 - protein, 13 aa, Borrelia afzelii
LTSPVVAESPKKP

SEQ ID NO: 50536 - protein, 14 aa, Borrelia afzelii
MKKNTLSAILMTLF

SEQ ID NO: 50537 - protein, 14 aa, Borrelia afzelii
KKNTLSAILMTLFL

SEQ ID NO: 50538 - protein, 14 aa, Borrelia afzelii
KNTLSAILMTLFLF

SEQ ID NO: 50539 - protein, 14 aa, Borrelia afzelii
NTLSAILMTLFLFI

SEQ ID NO: 50540 - protein, 14 aa, Borrelia afzelii
TLSAILMTLFLFIS

SEQ ID NO: 50541 - protein, 14 aa, Borrelia afzelii
LSAILMTLFLFISC

SEQ ID NO: 50542 - protein, 14 aa, Borrelia afzelii
SAILMTLFLFISCN

SEQ ID NO: 50543 - protein, 14 aa, Borrelia afzelii
AILMTLFLFISCNN

SEQ ID NO: 50544 - protein, 14 aa, Borrelia afzelii
ILMTLFLFISCNNS

SEQ ID NO: 50545 - protein, 14 aa, Borrelia afzelii
LMTLFLFISCNNSG

SEQ ID NO: 50546 - protein, 14 aa, Borrelia afzelii
MTLFLFISCNNSGK

SEQ ID NO: 50547 - protein, 14 aa, Borrelia afzelii
TLFLFISCNNSGKG

SEQ ID NO: 50548 - protein, 14 aa, Borrelia afzelii
LFLFISCNNSGKGG

SEQ ID NO: 50549 - protein, 14 aa, Borrelia afzelii
FLFISCNNSGKGGD

SEQ ID NO: 50550 - protein, 14 aa, Borrelia afzelii
LFISCNNSGKGGDS

SEQ ID NO: 50551 - protein, 14 aa, Borrelia afzelii
FISCNNSGKGGDSA

SEQ ID NO: 50552 - protein, 14 aa, Borrelia afzelii
ISCNNSGKGGDSAS

SEQ ID NO: 50553 - protein, 14 aa, Borrelia afzelii
SCNNSGKGGDSAST

SEQ ID NO: 50554 - protein, 14 aa, Borrelia afzelii
CNNSGKGGDSASTN

SEQ ID NO: 50555 - protein, 14 aa, Borrelia afzelii
NNSGKGGDSASTNP

SEQ ID NO: 50556 - protein, 14 aa, Borrelia afzelii
NSGKGGDSASTNPA

SEQ ID NO: 50557 - protein, 14 aa, Borrelia afzelii
SGKGGDSASTNPAD

SEQ ID NO: 50558 - protein, 14 aa, Borrelia afzelii
GKGGDSASTNPADE

SEQ ID NO: 50559 - protein, 14 aa, Borrelia afzelii
KGGDSASTNPADES

SEQ ID NO: 50560 - protein, 14 aa, Borrelia afzelii
GGDSASTNPADESA

SEQ ID NO: 50561 - protein, 14 aa, Borrelia afzelii
GDSASTNPADESAK

SEQ ID NO: 50562 - protein, 14 aa, Borrelia afzelii
DSASTNPADESAKG

SEQ ID NO: 50563 - protein, 14 aa, Borrelia afzelii
SASTNPADESAKGP

SEQ ID NO: 50564 - protein, 14 aa, Borrelia afzelii
ASTNPADESAKGPN

SEQ ID NO: 50565 - protein, 14 aa, Borrelia afzelii
STNPADESAKGPNL

SEQ ID NO: 50566 - protein, 14 aa, Borrelia afzelii
TNPADESAKGPNLT

SEQ ID NO: 50567 - protein, 14 aa, Borrelia afzelii
NPADESAKGPNLTE

SEQ ID NO: 50568 - protein, 14 aa, Borrelia afzelii
PADESAKGPNLTEI

SEQ ID NO: 50569 - protein, 14 aa, Borrelia afzelii
ADESAKGPNLTEIS

SEQ ID NO: 50570 - protein, 14 aa, Borrelia afzelii
DESAKGPNLTEISK

SEQ ID NO: 50571 - protein, 14 aa, Borrelia afzelii
ESAKGPNLTEISKK

SEQ ID NO: 50572 - protein, 14 aa, Borrelia afzelii
SAKGPNLTEISKKI

SEQ ID NO: 50573 - protein, 14 aa, Borrelia afzelii
AKGPNLTEISKKIT

SEQ ID NO: 50574 - protein, 14 aa, Borrelia afzelii
KGPNLTEISKKITD

SEQ ID NO: 50575 - protein, 14 aa, Borrelia afzelii
GPNLTEISKKITDS

SEQ ID NO: 50576 - protein, 14 aa, Borrelia afzelii
PNLTEISKKITDSN

SEQ ID NO: 50577 - protein, 14 aa, Borrelia afzelii
NLTEISKKITDSNA

SEQ ID NO: 50578 - protein, 14 aa, Borrelia afzelii
LTEISKKITDSNAF

SEQ ID NO: 50579 - protein, 14 aa, Borrelia afzelii
TEISKKITDSNAFV

SEQ ID NO: 50580 - protein, 14 aa, Borrelia afzelii
EISKKITDSNAFVL

SEQ ID NO: 50581 - protein, 14 aa, Borrelia afzelii
ISKKITDSNAFVLA

SEQ ID NO: 50582 - protein, 14 aa, Borrelia afzelii
SKKITDSNAFVLAV

SEQ ID NO: 50583 - protein, 14 aa, Borrelia afzelii
KKITDSNAFVLAVK

SEQ ID NO: 50584 - protein, 14 aa, Borrelia afzelii
KITDSNAFVLAVKE

SEQ ID NO: 50585 - protein, 14 aa, Borrelia afzelii
ITDSNAFVLAVKEV

SEQ ID NO: 50586 - protein, 14 aa, Borrelia afzelii
TDSNAFVLAVKEVE

SEQ ID NO: 50587 - protein, 14 aa, Borrelia afzelii
DSNAFVLAVKEVET

SEQ ID NO: 50588 - protein, 14 aa, Borrelia afzelii
SNAFVLAVKEVETL

SEQ ID NO: 50589 - protein, 14 aa, Borrelia afzelii
NAFVLAVKEVETLV

SEQ ID NO: 50590 - protein, 14 aa, Borrelia afzelii
AFVLAVKEVETLVS

SEQ ID NO: 50591 - protein, 14 aa, Borrelia afzelii
FVLAVKEVETLVSS

SEQ ID NO: 50592 - protein, 14 aa, Borrelia afzelii
VLAVKEVETLVSSI

SEQ ID NO: 50593 - protein, 14 aa, Borrelia afzelii
LAVKEVETLVSSID

SEQ ID NO: 50594 - protein, 14 aa, Borrelia afzelii
AVKEVETLVSSIDE

SEQ ID NO: 50595 - protein, 14 aa, Borrelia afzelii
VKEVETLVSSIDEL

SEQ ID NO: 50596 - protein, 14 aa, Borrelia afzelii
KEVETLVSSIDELA

SEQ ID NO: 50597 - protein, 14 aa, Borrelia afzelii
EVETLVSSIDELAN

SEQ ID NO: 50598 - protein, 14 aa, Borrelia afzelii
VETLVSSIDELANK

SEQ ID NO: 50599 - protein, 14 aa, Borrelia afzelii
ETLVSSIDELANKA

SEQ ID NO: 50600 - protein, 14 aa, Borrelia afzelii
TLVSSIDELANKAI

SEQ ID NO: 50601 - protein, 14 aa, Borrelia afzelii
LVSSIDELANKAIG

SEQ ID NO: 50602 - protein, 14 aa, Borrelia afzelii
VSSIDELANKAIGK

SEQ ID NO: 50603 - protein, 14 aa, Borrelia afzelii
SSIDELANKAIGKK

SEQ ID NO: 50604 - protein, 14 aa, Borrelia afzelii
SIDELANKAIGKKI

SEQ ID NO: 50605 - protein, 14 aa, Borrelia afzelii
IDELANKAIGKKIQ

SEQ ID NO: 50606 - protein, 14 aa, Borrelia afzelii
DELANKAIGKKIQQ

SEQ ID NO: 50607 - protein, 14 aa, Borrelia afzelii
ELANKAIGKKIQQN

SEQ ID NO: 50608 - protein, 14 aa, Borrelia afzelii
LANKAIGKKIQQNG

SEQ ID NO: 50609 - protein, 14 aa, Borrelia afzelii
ANKAIGKKIQQNGL

SEQ ID NO: 50610 - protein, 14 aa, Borrelia afzelii
NKAIGKKIQQNGLG

SEQ ID NO: 50611 - protein, 14 aa, Borrelia afzelii
KAIGKKIQQNGLGA

SEQ ID NO: 50612 - protein, 14 aa, Borrelia afzelii
AIGKKIQQNGLGAE

SEQ ID NO: 50613 - protein, 14 aa, Borrelia afzelii
IGKKIQQNGLGAEA

SEQ ID NO: 50614 - protein, 14 aa, Borrelia afzelii
GKKIQQNGLGAEAN

SEQ ID NO: 50615 - protein, 14 aa, Borrelia afzelii
KKIQQNGLGAEANR

SEQ ID NO: 50616 - protein, 14 aa, Borrelia afzelii
KIQQNGLGAEANRN

SEQ ID NO: 50617 - protein, 14 aa, Borrelia afzelii
IQQNGLGAEANRNE

SEQ ID NO: 50618 - protein, 14 aa, Borrelia afzelii
QQNGLGAEANRNES

SEQ ID NO: 50619 - protein, 14 aa, Borrelia afzelii
QNGLGAEANRNESL

SEQ ID NO: 50620 - protein, 14 aa, Borrelia afzelii
NGLGAEANRNESLL

SEQ ID NO: 50621 - protein, 14 aa, Borrelia afzelii
GLGAEANRNESLLA

SEQ ID NO: 50622 - protein, 14 aa, Borrelia afzelii
LGAEANRNESLLAG

SEQ ID NO: 50623 - protein, 14 aa, Borrelia afzelii
GAEANRNESLLAGV

SEQ ID NO: 50624 - protein, 14 aa, Borrelia afzelii
AEANRNESLLAGVH

SEQ ID NO: 50625 - protein, 14 aa, Borrelia afzelii
EANRNESLLAGVHE

SEQ ID NO: 50626 - protein, 14 aa, Borrelia afzelii
ANRNESLLAGVHEI

SEQ ID NO: 50627 - protein, 14 aa, Borrelia afzelii
NRNESLLAGVHEIS

SEQ ID NO: 50628 - protein, 14 aa, Borrelia afzelii
RNESLLAGVHEIST

SEQ ID NO: 50629 - protein, 14 aa, Borrelia afzelii
NESLLAGVHEISTL

SEQ ID NO: 50630 - protein, 14 aa, Borrelia afzelii
ESLLAGVHEISTLI

SEQ ID NO: 50631 - protein, 14 aa, Borrelia afzelii
SLLAGVHEISTLIT

SEQ ID NO: 50632 - protein, 14 aa, Borrelia afzelii
LLAGVHEISTLITE

SEQ ID NO: 50633 - protein, 14 aa, Borrelia afzelii
LAGVHEISTLITEK

SEQ ID NO: 50634 - protein, 14 aa, Borrelia afzelii
AGVHEISTLITEKL

SEQ ID NO: 50635 - protein, 14 aa, Borrelia afzelii
GVHEISTLITEKLS

SEQ ID NO: 50636 - protein, 14 aa, Borrelia afzelii
VHEISTLITEKLSK

SEQ ID NO: 50637 - protein, 14 aa, Borrelia afzelii
HEISTLITEKLSKL

SEQ ID NO: 50638 - protein, 14 aa, Borrelia afzelii
EISTLITEKLSKLK

SEQ ID NO: 50639 - protein, 14 aa, Borrelia afzelii
ISTLITEKLSKLKN

SEQ ID NO: 50640 - protein, 14 aa, Borrelia afzelii
STLITEKLSKLKNS

SEQ ID NO: 50641 - protein, 14 aa, Borrelia afzelii
TLITEKLSKLKNSG

SEQ ID NO: 50642 - protein, 14 aa, Borrelia afzelii
LITEKLSKLKNSGE

SEQ ID NO: 50643 - protein, 14 aa, Borrelia afzelii
ITEKLSKLKNSGEL

SEQ ID NO: 50644 - protein, 14 aa, Borrelia afzelii
TEKLSKLKNSGELK

SEQ ID NO: 50645 - protein, 14 aa, Borrelia afzelii
EKLSKLKNSGELKA

SEQ ID NO: 50646 - protein, 14 aa, Borrelia afzelii
KLSKLKNSGELKAK

SEQ ID NO: 50647 - protein, 14 aa, Borrelia afzelii
LSKLKNSGELKAKI

SEQ ID NO: 50648 - protein, 14 aa, Borrelia afzelii
SKLKNSGELKAKIE

SEQ ID NO: 50649 - protein, 14 aa, Borrelia afzelii
KLKNSGELKAKIED

SEQ ID NO: 50650 - protein, 14 aa, Borrelia afzelii
LKNSGELKAKIEDA

SEQ ID NO: 50651 - protein, 14 aa, Borrelia afzelii
KNSGELKAKIEDAK

SEQ ID NO: 50652 - protein, 14 aa, Borrelia afzelii
NSGELKAKIEDAKK

SEQ ID NO: 50653 - protein, 14 aa, Borrelia afzelii
SGELKAKIEDAKKC

SEQ ID NO: 50654 - protein, 14 aa, Borrelia afzelii
GELKAKIEDAKKCS

SEQ ID NO: 50655 - protein, 14 aa, Borrelia afzelii
ELKAKIEDAKKCSE

SEQ ID NO: 50656 - protein, 14 aa, Borrelia afzelii
LKAKIEDAKKCSEE

SEQ ID NO: 50657 - protein, 14 aa, Borrelia afzelii
KAKIEDAKKCSEEF

SEQ ID NO: 50658 - protein, 14 aa, Borrelia afzelii
AKIEDAKKCSEEFT

SEQ ID NO: 50659 - protein, 14 aa, Borrelia afzelii
KIEDAKKCSEEFTN

SEQ ID NO: 50660 - protein, 14 aa, Borrelia afzelii
IEDAKKCSEEFTNK

SEQ ID NO: 50661 - protein, 14 aa, Borrelia afzelii
EDAKKCSEEFTNKL

SEQ ID NO: 50662 - protein, 14 aa, Borrelia afzelii
DAKKCSEEFTNKLR

SEQ ID NO: 50663 - protein, 14 aa, Borrelia afzelii
AKKCSEEFTNKLRV

SEQ ID NO: 50664 - protein, 14 aa, Borrelia afzelii
KKCSEEFTNKLRVS

SEQ ID NO: 50665 - protein, 14 aa, Borrelia afzelii
KCSEEFTNKLRVSH

SEQ ID NO: 50666 - protein, 14 aa, Borrelia afzelii
CSEEFTNKLRVSHA

SEQ ID NO: 50667 - protein, 14 aa, Borrelia afzelii
SEEFTNKLRVSHAD

SEQ ID NO: 50668 - protein, 14 aa, Borrelia afzelii
EEFTNKLRVSHADL

SEQ ID NO: 50669 - protein, 14 aa, Borrelia afzelii
EFTNKLRVSHADLG

SEQ ID NO: 50670 - protein, 14 aa, Borrelia afzelii
FTNKLRVSHADLGK

SEQ ID NO: 50671 - protein, 14 aa, Borrelia afzelii
TNKLRVSHADLGKQ

SEQ ID NO: 50672 - protein, 14 aa, Borrelia afzelii
NKLRVSHADLGKQG

SEQ ID NO: 50673 - protein, 14 aa, Borrelia afzelii
KLRVSHADLGKQGV

SEQ ID NO: 50674 - protein, 14 aa, Borrelia afzelii
LRVSHADLGKQGVN

SEQ ID NO: 50675 - protein, 14 aa, Borrelia afzelii
RVSHADLGKQGVND

SEQ ID NO: 50676 - protein, 14 aa, Borrelia afzelii
VSHADLGKQGVNDD

SEQ ID NO: 50677 - protein, 14 aa, Borrelia afzelii
SHADLGKQGVNDDD

SEQ ID NO: 50678 - protein, 14 aa, Borrelia afzelii
HADLGKQGVNDDDA

SEQ ID NO: 50679 - protein, 14 aa, Borrelia afzelii
ADLGKQGVNDDDAK

SEQ ID NO: 50680 - protein, 14 aa, Borrelia afzelii
DLGKQGVNDDDAKK

SEQ ID NO: 50681 - protein, 14 aa, Borrelia afzelii
LGKQGVNDDDAKKA

SEQ ID NO: 50682 - protein, 14 aa, Borrelia afzelii
GKQGVNDDDAKKAI

SEQ ID NO: 50683 - protein, 14 aa, Borrelia afzelii
KQGVNDDDAKKAIL

SEQ ID NO: 50684 - protein, 14 aa, Borrelia afzelii
QGVNDDDAKKAILK

SEQ ID NO: 50685 - protein, 14 aa, Borrelia afzelii
GVNDDDAKKAILKT

SEQ ID NO: 50686 - protein, 14 aa, Borrelia afzelii
VNDDDAKKAILKTN

SEQ ID NO: 50687 - protein, 14 aa, Borrelia afzelii
NDDDAKKAILKTNA

SEQ ID NO: 50688 - protein, 14 aa, Borrelia afzelii
DDDAKKAILKTNAD

SEQ ID NO: 50689 - protein, 14 aa, Borrelia afzelii
DDAKKAILKTNADK

SEQ ID NO: 50690 - protein, 14 aa, Borrelia afzelii
DAKKAILKTNADKT

SEQ ID NO: 50691 - protein, 14 aa, Borrelia afzelii
AKKAILKTNADKTK

SEQ ID NO: 50692 - protein, 14 aa, Borrelia afzelii
KKAILKTNADKTKG

SEQ ID NO: 50693 - protein, 14 aa, Borrelia afzelii
KAILKTNADKTKGA

SEQ ID NO: 50694 - protein, 14 aa, Borrelia afzelii
AILKTNADKTKGAE

SEQ ID NO: 50695 - protein, 14 aa, Borrelia afzelii
ILKTNADKTKGAEE

SEQ ID NO: 50696 - protein, 14 aa, Borrelia afzelii
LKTNADKTKGAEEL

SEQ ID NO: 50697 - protein, 14 aa, Borrelia afzelii
KTNADKTKGAEELG

SEQ ID NO: 50698 - protein, 14 aa, Borrelia afzelii
TNADKTKGAEELGK

SEQ ID NO: 50699 - protein, 14 aa, Borrelia afzelii
NADKTKGAEELGKL

SEQ ID NO: 50700 - protein, 14 aa, Borrelia afzelii
ADKTKGAEELGKLF

SEQ ID NO: 50701 - protein, 14 aa, Borrelia afzelii
DKTKGAEELGKLFK

SEQ ID NO: 50702 - protein, 14 aa, Borrelia afzelii
KTKGAEELGKLFKS

SEQ ID NO: 50703 - protein, 14 aa, Borrelia afzelii
TKGAEELGKLFKSV

SEQ ID NO: 50704 - protein, 14 aa, Borrelia afzelii
KGAEELGKLFKSVE

SEQ ID NO: 50705 - protein, 14 aa, Borrelia afzelii
GAEELGKLFKSVEG

SEQ ID NO: 50706 - protein, 14 aa, Borrelia afzelii
AEELGKLFKSVEGL

SEQ ID NO: 50707 - protein, 14 aa, Borrelia afzelii
EELGKLFKSVEGLV

SEQ ID NO: 50708 - protein, 14 aa, Borrelia afzelii
ELGKLFKSVEGLVK

SEQ ID NO: 50709 - protein, 14 aa, Borrelia afzelii
LGKLFKSVEGLVKA

SEQ ID NO: 50710 - protein, 14 aa, Borrelia afzelii
GKLFKSVEGLVKAA

SEQ ID NO: 50711 - protein, 14 aa, Borrelia afzelii
KLFKSVEGLVKAAQ

SEQ ID NO: 50712 - protein, 14 aa, Borrelia afzelii
LFKSVEGLVKAAQE

SEQ ID NO: 50713 - protein, 14 aa, Borrelia afzelii
FKSVEGLVKAAQEA

SEQ ID NO: 50714 - protein, 14 aa, Borrelia afzelii
KSVEGLVKAAQEAL

SEQ ID NO: 50715 - protein, 14 aa, Borrelia afzelii
SVEGLVKAAQEALT

SEQ ID NO: 50716 - protein, 14 aa, Borrelia afzelii
VEGLVKAAQEALTN

SEQ ID NO: 50717 - protein, 14 aa, Borrelia afzelii
EGLVKAAQEALTNS

SEQ ID NO: 50718 - protein, 14 aa, Borrelia afzelii
GLVKAAQEALTNSV

SEQ ID NO: 50719 - protein, 14 aa, Borrelia afzelii
LVKAAQEALTNSVK

SEQ ID NO: 50720 - protein, 14 aa, Borrelia afzelii
VKAAQEALTNSVKE

SEQ ID NO: 50721 - protein, 14 aa, Borrelia afzelii
KAAQEALTNSVKEL

SEQ ID NO: 50722 - protein, 14 aa, Borrelia afzelii
AAQEALTNSVKELT

SEQ ID NO: 50723 - protein, 14 aa, Borrelia afzelii
AQEALTNSVKELTS

SEQ ID NO: 50724 - protein, 14 aa, Borrelia afzelii
QEALTNSVKELTSP

SEQ ID NO: 50725 - protein, 14 aa, Borrelia afzelii
EALTNSVKELTSPV

SEQ ID NO: 50726 - protein, 14 aa, Borrelia afzelii
ALTNSVKELTSPVV

SEQ ID NO: 50727 - protein, 14 aa, Borrelia afzelii
LTNSVKELTSPVVA

SEQ ID NO: 50728 - protein, 14 aa, Borrelia afzelii
TNSVKELTSPVVAE

SEQ ID NO: 50729 - protein, 14 aa, Borrelia afzelii
NSVKELTSPVVAES

SEQ ID NO: 50730 - protein, 14 aa, Borrelia afzelii
SVKELTSPVVAESP

SEQ ID NO: 50731 - protein, 14 aa, Borrelia afzelii
VKELTSPVVAESPK

SEQ ID NO: 50732 - protein, 14 aa, Borrelia afzelii
KELTSPVVAESPKK

SEQ ID NO: 50733 - protein, 14 aa, Borrelia afzelii
ELTSPVVAESPKKP

SEQ ID NO: 50734 - protein, 15 aa, Borrelia afzelii
MKKNTLSAILMTLFL

SEQ ID NO: 50735 - protein, 15 aa, Borrelia afzelii
KKNTLSAILMTLFLF

SEQ ID NO: 50736 - protein, 15 aa, Borrelia afzelii
KNTLSAILMTLFLFI

SEQ ID NO: 50737 - protein, 15 aa, Borrelia afzelii
NTLSAILMTLFLFIS

SEQ ID NO: 50738 - protein, 15 aa, Borrelia afzelii
TLSAILMTLFLFISC

SEQ ID NO: 50739 - protein, 15 aa, Borrelia afzelii
LSAILMTLFLFISCN

SEQ ID NO: 50740 - protein, 15 aa, Borrelia afzelii
SAILMTLFLFISCNN

SEQ ID NO: 50741 - protein, 15 aa, Borrelia afzelii
AILMTLFLFISCNNS

SEQ ID NO: 50742 - protein, 15 aa, Borrelia afzelii
ILMTLFLFISCNNSG

SEQ ID NO: 50743 - protein, 15 aa, Borrelia afzelii
LMTLFLFISCNNSGK

SEQ ID NO: 50744 - protein, 15 aa, Borrelia afzelii
MTLFLFISCNNSGKG

SEQ ID NO: 50745 - protein, 15 aa, Borrelia afzelii
TLFLFISCNNSGKGG

SEQ ID NO: 50746 - protein, 15 aa, Borrelia afzelii
LFLFISCNNSGKGGD

SEQ ID NO: 50747 - protein, 15 aa, Borrelia afzelii
FLFISCNNSGKGGDS

SEQ ID NO: 50748 - protein, 15 aa, Borrelia afzelii
LFISCNNSGKGGDSA

SEQ ID NO: 50749 - protein, 15 aa, Borrelia afzelii
FISCNNSGKGGDSAS

SEQ ID NO: 50750 - protein, 15 aa, Borrelia afzelii
ISCNNSGKGGDSAST

SEQ ID NO: 50751 - protein, 15 aa, Borrelia afzelii
SCNNSGKGGDSASTN

SEQ ID NO: 50752 - protein, 15 aa, Borrelia afzelii
CNNSGKGGDSASTNP

SEQ ID NO: 50753 - protein, 15 aa, Borrelia afzelii
NNSGKGGDSASTNPA

SEQ ID NO: 50754 - protein, 15 aa, Borrelia afzelii
NSGKGGDSASTNPAD

SEQ ID NO: 50755 - protein, 15 aa, Borrelia afzelii
SGKGGDSASTNPADE

SEQ ID NO: 50756 - protein, 15 aa, Borrelia afzelii
GKGGDSASTNPADES

SEQ ID NO: 50757 - protein, 15 aa, Borrelia afzelii
KGGDSASTNPADESA

SEQ ID NO: 50758 - protein, 15 aa, Borrelia afzelii
GGDSASTNPADESAK

SEQ ID NO: 50759 - protein, 15 aa, Borrelia afzelii
GDSASTNPADESAKG

SEQ ID NO: 50760 - protein, 15 aa, Borrelia afzelii
DSASTNPADESAKGP

SEQ ID NO: 50761 - protein, 15 aa, Borrelia afzelii
SASTNPADESAKGPN

SEQ ID NO: 50762 - protein, 15 aa, Borrelia afzelii
ASTNPADESAKGPNL

SEQ ID NO: 50763 - protein, 15 aa, Borrelia afzelii
STNPADESAKGPNLT

SEQ ID NO: 50764 - protein, 15 aa, Borrelia afzelii
TNPADESAKGPNLTE

SEQ ID NO: 50765 - protein, 15 aa, Borrelia afzelii
NPADESAKGPNLTEI

SEQ ID NO: 50766 - protein, 15 aa, Borrelia afzelii
PADESAKGPNLTEIS

SEQ ID NO: 50767 - protein, 15 aa, Borrelia afzelii
ADESAKGPNLTEISK

SEQ ID NO: 50768 - protein, 15 aa, Borrelia afzelii
DESAKGPNLTEISKK

SEQ ID NO: 50769 - protein, 15 aa, Borrelia afzelii
ESAKGPNLTEISKKI

SEQ ID NO: 50770 - protein, 15 aa, Borrelia afzelii
SAKGPNLTEISKKIT

SEQ ID NO: 50771 - protein, 15 aa, Borrelia afzelii
AKGPNLTEISKKITD

SEQ ID NO: 50772 - protein, 15 aa, Borrelia afzelii
KGPNLTEISKKITDS

SEQ ID NO: 50773 - protein, 15 aa, Borrelia afzelii
GPNLTEISKKITDSN

SEQ ID NO: 50774 - protein, 15 aa, Borrelia afzelii
PNLTEISKKITDSNA

SEQ ID NO: 50775 - protein, 15 aa, Borrelia afzelii
NLTEISKKITDSNAF

SEQ ID NO: 50776 - protein, 15 aa, Borrelia afzelii
LTEISKKITDSNAFV

SEQ ID NO: 50777 - protein, 15 aa, Borrelia afzelii
TEISKKITDSNAFVL

SEQ ID NO: 50778 - protein, 15 aa, Borrelia afzelii
EISKKITDSNAFVLA

SEQ ID NO: 50779 - protein, 15 aa, Borrelia afzelii
ISKKITDSNAFVLAV

SEQ ID NO: 50780 - protein, 15 aa, Borrelia afzelii
SKKITDSNAFVLAVK

SEQ ID NO: 50781 - protein, 15 aa, Borrelia afzelii
KKITDSNAFVLAVKE

SEQ ID NO: 50782 - protein, 15 aa, Borrelia afzelii
KITDSNAFVLAVKEV

SEQ ID NO: 50783 - protein, 15 aa, Borrelia afzelii
ITDSNAFVLAVKEVE

SEQ ID NO: 50784 - protein, 15 aa, Borrelia afzelii
TDSNAFVLAVKEVET

SEQ ID NO: 50785 - protein, 15 aa, Borrelia afzelii
DSNAFVLAVKEVETL

SEQ ID NO: 50786 - protein, 15 aa, Borrelia afzelii
SNAFVLAVKEVETLV

SEQ ID NO: 50787 - protein, 15 aa, Borrelia afzelii
NAFVLAVKEVETLVS

SEQ ID NO: 50788 - protein, 15 aa, Borrelia afzelii
AFVLAVKEVETLVSS

SEQ ID NO: 50789 - protein, 15 aa, Borrelia afzelii
FVLAVKEVETLVSSI

SEQ ID NO: 50790 - protein, 15 aa, Borrelia afzelii
VLAVKEVETLVSSID

SEQ ID NO: 50791 - protein, 15 aa, Borrelia afzelii
LAVKEVETLVSSIDE

SEQ ID NO: 50792 - protein, 15 aa, Borrelia afzelii
AVKEVETLVSSIDEL

SEQ ID NO: 50793 - protein, 15 aa, Borrelia afzelii
VKEVETLVSSIDELA

SEQ ID NO: 50794 - protein, 15 aa, Borrelia afzelii
KEVETLVSSIDELAN

SEQ ID NO: 50795 - protein, 15 aa, Borrelia afzelii
EVETLVSSIDELANK

SEQ ID NO: 50796 - protein, 15 aa, Borrelia afzelii
VETLVSSIDELANKA

SEQ ID NO: 50797 - protein, 15 aa, Borrelia afzelii
ETLVSSIDELANKAI

SEQ ID NO: 50798 - protein, 15 aa, Borrelia afzelii
TLVSSIDELANKAIG

SEQ ID NO: 50799 - protein, 15 aa, Borrelia afzelii
LVSSIDELANKAIGK

SEQ ID NO: 50800 - protein, 15 aa, Borrelia afzelii
VSSIDELANKAIGKK

SEQ ID NO: 50801 - protein, 15 aa, Borrelia afzelii
SSIDELANKAIGKKI

SEQ ID NO: 50802 - protein, 15 aa, Borrelia afzelii
SIDELANKAIGKKIQ

SEQ ID NO: 50803 - protein, 15 aa, Borrelia afzelii
IDELANKAIGKKIQQ

SEQ ID NO: 50804 - protein, 15 aa, Borrelia afzelii
DELANKAIGKKIQQN

SEQ ID NO: 50805 - protein, 15 aa, Borrelia afzelii
ELANKAIGKKIQQNG

SEQ ID NO: 50806 - protein, 15 aa, Borrelia afzelii
LANKAIGKKIQQNGL

SEQ ID NO: 50807 - protein, 15 aa, Borrelia afzelii
ANKAIGKKIQQNGLG

SEQ ID NO: 50808 - protein, 15 aa, Borrelia afzelii
NKAIGKKIQQNGLGA

SEQ ID NO: 50809 - protein, 15 aa, Borrelia afzelii
KAIGKKIQQNGLGAE

SEQ ID NO: 50810 - protein, 15 aa, Borrelia afzelii
AIGKKIQQNGLGAEA

SEQ ID NO: 50811 - protein, 15 aa, Borrelia afzelii
IGKKIQQNGLGAEAN

SEQ ID NO: 50812 - protein, 15 aa, Borrelia afzelii
GKKIQQNGLGAEANR

SEQ ID NO: 50813 - protein, 15 aa, Borrelia afzelii
KKIQQNGLGAEANRN

SEQ ID NO: 50814 - protein, 15 aa, Borrelia afzelii
KIQQNGLGAEANRNE

SEQ ID NO: 50815 - protein, 15 aa, Borrelia afzelii
IQQNGLGAEANRNES

SEQ ID NO: 50816 - protein, 15 aa, Borrelia afzelii
QQNGLGAEANRNESL

SEQ ID NO: 50817 - protein, 15 aa, Borrelia afzelii
QNGLGAEANRNESLL

SEQ ID NO: 50818 - protein, 15 aa, Borrelia afzelii
NGLGAEANRNESLLA

SEQ ID NO: 50819 - protein, 15 aa, Borrelia afzelii
GLGAEANRNESLLAG

SEQ ID NO: 50820 - protein, 15 aa, Borrelia afzelii
LGAEANRNESLLAGV

SEQ ID NO: 50821 - protein, 15 aa, Borrelia afzelii
GAEANRNESLLAGVH

SEQ ID NO: 50822 - protein, 15 aa, Borrelia afzelii
AEANRNESLLAGVHE

SEQ ID NO: 50823 - protein, 15 aa, Borrelia afzelii
EANRNESLLAGVHEI

SEQ ID NO: 50824 - protein, 15 aa, Borrelia afzelii
ANRNESLLAGVHEIS

SEQ ID NO: 50825 - protein, 15 aa, Borrelia afzelii
NRNESLLAGVHEIST

SEQ ID NO: 50826 - protein, 15 aa, Borrelia afzelii
RNESLLAGVHEISTL

SEQ ID NO: 50827 - protein, 15 aa, Borrelia afzelii
NESLLAGVHEISTLI

SEQ ID NO: 50828 - protein, 15 aa, Borrelia afzelii
ESLLAGVHEISTLIT

SEQ ID NO: 50829 - protein, 15 aa, Borrelia afzelii
SLLAGVHEISTLITE

SEQ ID NO: 50830 - protein, 15 aa, Borrelia afzelii
LLAGVHEISTLITEK

SEQ ID NO: 50831 - protein, 15 aa, Borrelia afzelii
LAGVHEISTLITEKL

SEQ ID NO: 50832 - protein, 15 aa, Borrelia afzelii
AGVHEISTLITEKLS

SEQ ID NO: 50833 - protein, 15 aa, Borrelia afzelii
GVHEISTLITEKLSK

SEQ ID NO: 50834 - protein, 15 aa, Borrelia afzelii
VHEISTLITEKLSKL

SEQ ID NO: 50835 - protein, 15 aa, Borrelia afzelii
HEISTLITEKLSKLK

SEQ ID NO: 50836 - protein, 15 aa, Borrelia afzelii
EISTLITEKLSKLKN

SEQ ID NO: 50837 - protein, 15 aa, Borrelia afzelii
ISTLITEKLSKLKNS

SEQ ID NO: 50838 - protein, 15 aa, Borrelia afzelii
STLITEKLSKLKNSG

SEQ ID NO: 50839 - protein, 15 aa, Borrelia afzelii
TLITEKLSKLKNSGE

SEQ ID NO: 50840 - protein, 15 aa, Borrelia afzelii
LITEKLSKLKNSGEL

SEQ ID NO: 50841 - protein, 15 aa, Borrelia afzelii
ITEKLSKLKNSGELK

SEQ ID NO: 50842 - protein, 15 aa, Borrelia afzelii
TEKLSKLKNSGELKA

SEQ ID NO: 50843 - protein, 15 aa, Borrelia afzelii
EKLSKLKNSGELKAK

SEQ ID NO: 50844 - protein, 15 aa, Borrelia afzelii
KLSKLKNSGELKAKI

SEQ ID NO: 50845 - protein, 15 aa, Borrelia afzelii
LSKLKNSGELKAKIE

SEQ ID NO: 50846 - protein, 15 aa, Borrelia afzelii
SKLKNSGELKAKIED

SEQ ID NO: 50847 - protein, 15 aa, Borrelia afzelii
KLKNSGELKAKIEDA

SEQ ID NO: 50848 - protein, 15 aa, Borrelia afzelii
LKNSGELKAKIEDAK

SEQ ID NO: 50849 - protein, 15 aa, Borrelia afzelii
KNSGELKAKIEDAKK

SEQ ID NO: 50850 - protein, 15 aa, Borrelia afzelii
NSGELKAKIEDAKKC

SEQ ID NO: 50851 - protein, 15 aa, Borrelia afzelii
SGELKAKIEDAKKCS

SEQ ID NO: 50852 - protein, 15 aa, Borrelia afzelii
GELKAKIEDAKKCSE

SEQ ID NO: 50853 - protein, 15 aa, Borrelia afzelii
ELKAKIEDAKKCSEE

SEQ ID NO: 50854 - protein, 15 aa, Borrelia afzelii
LKAKIEDAKKCSEEF

SEQ ID NO: 50855 - protein, 15 aa, Borrelia afzelii
KAKIEDAKKCSEEFT

SEQ ID NO: 50856 - protein, 15 aa, Borrelia afzelii
AKIEDAKKCSEEFTN

SEQ ID NO: 50857 - protein, 15 aa, Borrelia afzelii
KIEDAKKCSEEFTNK

SEQ ID NO: 50858 - protein, 15 aa, Borrelia afzelii
IEDAKKCSEEFTNKL

SEQ ID NO: 50859 - protein, 15 aa, Borrelia afzelii
EDAKKCSEEFTNKLR

SEQ ID NO: 50860 - protein, 15 aa, Borrelia afzelii
DAKKCSEEFTNKLRV

SEQ ID NO: 50861 - protein, 15 aa, Borrelia afzelii
AKKCSEEFTNKLRVS

SEQ ID NO: 50862 - protein, 15 aa, Borrelia afzelii
KKCSEEFTNKLRVSH

SEQ ID NO: 50863 - protein, 15 aa, Borrelia afzelii
KCSEEFTNKLRVSHA

SEQ ID NO: 50864 - protein, 15 aa, Borrelia afzelii
CSEEFTNKLRVSHAD

SEQ ID NO: 50865 - protein, 15 aa, Borrelia afzelii
SEEFTNKLRVSHADL

SEQ ID NO: 50866 - protein, 15 aa, Borrelia afzelii
EEFTNKLRVSHADLG

SEQ ID NO: 50867 - protein, 15 aa, Borrelia afzelii
EFTNKLRVSHADLGK

SEQ ID NO: 50868 - protein, 15 aa, Borrelia afzelii
FTNKLRVSHADLGKQ

SEQ ID NO: 50869 - protein, 15 aa, Borrelia afzelii
TNKLRVSHADLGKQG

SEQ ID NO: 50870 - protein, 15 aa, Borrelia afzelii
NKLRVSHADLGKQGV

SEQ ID NO: 50871 - protein, 15 aa, Borrelia afzelii
KLRVSHADLGKQGVN

SEQ ID NO: 50872 - protein, 15 aa, Borrelia afzelii
LRVSHADLGKQGVND

SEQ ID NO: 50873 - protein, 15 aa, Borrelia afzelii
RVSHADLGKQGVNDD

SEQ ID NO: 50874 - protein, 15 aa, Borrelia afzelii
VSHADLGKQGVNDDD

SEQ ID NO: 50875 - protein, 15 aa, Borrelia afzelii
SHADLGKQGVNDDDA

SEQ ID NO: 50876 - protein, 15 aa, Borrelia afzelii
HADLGKQGVNDDDAK

SEQ ID NO: 50877 - protein, 15 aa, Borrelia afzelii
ADLGKQGVNDDDAKK

SEQ ID NO: 50878 - protein, 15 aa, Borrelia afzelii
DLGKQGVNDDDAKKA

SEQ ID NO: 50879 - protein, 15 aa, Borrelia afzelii
LGKQGVNDDDAKKAI

SEQ ID NO: 50880 - protein, 15 aa, Borrelia afzelii
GKQGVNDDDAKKAIL

SEQ ID NO: 50881 - protein, 15 aa, Borrelia afzelii
KQGVNDDDAKKAILK

SEQ ID NO: 50882 - protein, 15 aa, Borrelia afzelii
QGVNDDDAKKAILKT

SEQ ID NO: 50883 - protein, 15 aa, Borrelia afzelii
GVNDDDAKKAILKTN

SEQ ID NO: 50884 - protein, 15 aa, Borrelia afzelii
VNDDDAKKAILKTNA

SEQ ID NO: 50885 - protein, 15 aa, Borrelia afzelii
NDDDAKKAILKTNAD

SEQ ID NO: 50886 - protein, 15 aa, Borrelia afzelii
DDDAKKAILKTNADK

SEQ ID NO: 50887 - protein, 15 aa, Borrelia afzelii
DDAKKAILKTNADKT

SEQ ID NO: 50888 - protein, 15 aa, Borrelia afzelii
DAKKAILKTNADKTK

SEQ ID NO: 50889 - protein, 15 aa, Borrelia afzelii
AKKAILKTNADKTKG

SEQ ID NO: 50890 - protein, 15 aa, Borrelia afzelii
KKAILKTNADKTKGA

SEQ ID NO: 50891 - protein, 15 aa, Borrelia afzelii
KAILKTNADKTKGAE

SEQ ID NO: 50892 - protein, 15 aa, Borrelia afzelii
AILKTNADKTKGAEE

SEQ ID NO: 50893 - protein, 15 aa, Borrelia afzelii
ILKTNADKTKGAEEL

SEQ ID NO: 50894 - protein, 15 aa, Borrelia afzelii
LKTNADKTKGAEELG

SEQ ID NO: 50895 - protein, 15 aa, Borrelia afzelii
KTNADKTKGAEELGK

SEQ ID NO: 50896 - protein, 15 aa, Borrelia afzelii
TNADKTKGAEELGKL

SEQ ID NO: 50897 - protein, 15 aa, Borrelia afzelii
NADKTKGAEELGKLF

SEQ ID NO: 50898 - protein, 15 aa, Borrelia afzelii
ADKTKGAEELGKLFK

SEQ ID NO: 50899 - protein, 15 aa, Borrelia afzelii
DKTKGAEELGKLFKS

SEQ ID NO: 50900 - protein, 15 aa, Borrelia afzelii
KTKGAEELGKLFKSV

SEQ ID NO: 50901 - protein, 15 aa, Borrelia afzelii
TKGAEELGKLFKSVE

SEQ ID NO: 50902 - protein, 15 aa, Borrelia afzelii
KGAEELGKLFKSVEG

SEQ ID NO: 50903 - protein, 15 aa, Borrelia afzelii
GAEELGKLFKSVEGL

SEQ ID NO: 50904 - protein, 15 aa, Borrelia afzelii
AEELGKLFKSVEGLV

SEQ ID NO: 50905 - protein, 15 aa, Borrelia afzelii
EELGKLFKSVEGLVK

SEQ ID NO: 50906 - protein, 15 aa, Borrelia afzelii
ELGKLFKSVEGLVKA

SEQ ID NO: 50907 - protein, 15 aa, Borrelia afzelii
LGKLFKSVEGLVKAA

SEQ ID NO: 50908 - protein, 15 aa, Borrelia afzelii
GKLFKSVEGLVKAAQ

SEQ ID NO: 50909 - protein, 15 aa, Borrelia afzelii
KLFKSVEGLVKAAQE

SEQ ID NO: 50910 - protein, 15 aa, Borrelia afzelii
LFKSVEGLVKAAQEA

SEQ ID NO: 50911 - protein, 15 aa, Borrelia afzelii
FKSVEGLVKAAQEAL

SEQ ID NO: 50912 - protein, 15 aa, Borrelia afzelii
KSVEGLVKAAQEALT

SEQ ID NO: 50913 - protein, 15 aa, Borrelia afzelii
SVEGLVKAAQEALTN

SEQ ID NO: 50914 - protein, 15 aa, Borrelia afzelii
VEGLVKAAQEALTNS

SEQ ID NO: 50915 - protein, 15 aa, Borrelia afzelii
EGLVKAAQEALTNSV

SEQ ID NO: 50916 - protein, 15 aa, Borrelia afzelii
GLVKAAQEALTNSVK

SEQ ID NO: 50917 - protein, 15 aa, Borrelia afzelii
LVKAAQEALTNSVKE

SEQ ID NO: 50918 - protein, 15 aa, Borrelia afzelii
VKAAQEALTNSVKEL

SEQ ID NO: 50919 - protein, 15 aa, Borrelia afzelii
KAAQEALTNSVKELT

SEQ ID NO: 50920 - protein, 15 aa, Borrelia afzelii
AAQEALTNSVKELTS

SEQ ID NO: 50921 - protein, 15 aa, Borrelia afzelii
AQEALTNSVKELTSP

SEQ ID NO: 50922 - protein, 15 aa, Borrelia afzelii
QEALTNSVKELTSPV

SEQ ID NO: 50923 - protein, 15 aa, Borrelia afzelii
EALTNSVKELTSPVV

SEQ ID NO: 50924 - protein, 15 aa, Borrelia afzelii
ALTNSVKELTSPVVA

SEQ ID NO: 50925 - protein, 15 aa, Borrelia afzelii
LTNSVKELTSPVVAE

SEQ ID NO: 50926 - protein, 15 aa, Borrelia afzelii
TNSVKELTSPVVAES

SEQ ID NO: 50927 - protein, 15 aa, Borrelia afzelii
NSVKELTSPVVAESP

SEQ ID NO: 50928 - protein, 15 aa, Borrelia afzelii
SVKELTSPVVAESPK

SEQ ID NO: 50929 - protein, 15 aa, Borrelia afzelii
VKELTSPVVAESPKK

SEQ ID NO: 50930 - protein, 15 aa, Borrelia afzelii
KELTSPVVAESPKKP

SEQ ID NO: 50931 - protein, 16 aa, Borrelia afzelii
MKKNTLSAILMTLFLF

SEQ ID NO: 50932 - protein, 16 aa, Borrelia afzelii
KKNTLSAILMTLFLFI

SEQ ID NO: 50933 - protein, 16 aa, Borrelia afzelii
KNTLSAILMTLFLFIS

SEQ ID NO: 50934 - protein, 16 aa, Borrelia afzelii
NTLSAILMTLFLFISC

SEQ ID NO: 50935 - protein, 16 aa, Borrelia afzelii
TLSAILMTLFLFISCN

SEQ ID NO: 50936 - protein, 16 aa, Borrelia afzelii
LSAILMTLFLFISCNN

SEQ ID NO: 50937 - protein, 16 aa, Borrelia afzelii
SAILMTLFLFISCNNS

SEQ ID NO: 50938 - protein, 16 aa, Borrelia afzelii
AILMTLFLFISCNNSG

SEQ ID NO: 50939 - protein, 16 aa, Borrelia afzelii
ILMTLFLFISCNNSGK

SEQ ID NO: 50940 - protein, 16 aa, Borrelia afzelii
LMTLFLFISCNNSGKG

SEQ ID NO: 50941 - protein, 16 aa, Borrelia afzelii
MTLFLFISCNNSGKGG

SEQ ID NO: 50942 - protein, 16 aa, Borrelia afzelii
TLFLFISCNNSGKGGD

SEQ ID NO: 50943 - protein, 16 aa, Borrelia afzelii
LFLFISCNNSGKGGDS

SEQ ID NO: 50944 - protein, 16 aa, Borrelia afzelii
FLFISCNNSGKGGDSA

SEQ ID NO: 50945 - protein, 16 aa, Borrelia afzelii
LFISCNNSGKGGDSAS

SEQ ID NO: 50946 - protein, 16 aa, Borrelia afzelii
FISCNNSGKGGDSAST

SEQ ID NO: 50947 - protein, 16 aa, Borrelia afzelii
ISCNNSGKGGDSASTN

SEQ ID NO: 50948 - protein, 16 aa, Borrelia afzelii
SCNNSGKGGDSASTNP

SEQ ID NO: 50949 - protein, 16 aa, Borrelia afzelii
CNNSGKGGDSASTNPA

SEQ ID NO: 50950 - protein, 16 aa, Borrelia afzelii
NNSGKGGDSASTNPAD

SEQ ID NO: 50951 - protein, 16 aa, Borrelia afzelii
NSGKGGDSASTNPADE

SEQ ID NO: 50952 - protein, 16 aa, Borrelia afzelii
SGKGGDSASTNPADES

SEQ ID NO: 50953 - protein, 16 aa, Borrelia afzelii
GKGGDSASTNPADESA

SEQ ID NO: 50954 - protein, 16 aa, Borrelia afzelii
KGGDSASTNPADESAK

SEQ ID NO: 50955 - protein, 16 aa, Borrelia afzelii
GGDSASTNPADESAKG

SEQ ID NO: 50956 - protein, 16 aa, Borrelia afzelii
GDSASTNPADESAKGP

SEQ ID NO: 50957 - protein, 16 aa, Borrelia afzelii
DSASTNPADESAKGPN

SEQ ID NO: 50958 - protein, 16 aa, Borrelia afzelii
SASTNPADESAKGPNL

SEQ ID NO: 50959 - protein, 16 aa, Borrelia afzelii
ASTNPADESAKGPNLT

SEQ ID NO: 50960 - protein, 16 aa, Borrelia afzelii
STNPADESAKGPNLTE

SEQ ID NO: 50961 - protein, 16 aa, Borrelia afzelii
TNPADESAKGPNLTEI

SEQ ID NO: 50962 - protein, 16 aa, Borrelia afzelii
NPADESAKGPNLTEIS

SEQ ID NO: 50963 - protein, 16 aa, Borrelia afzelii
PADESAKGPNLTEISK

SEQ ID NO: 50964 - protein, 16 aa, Borrelia afzelii
ADESAKGPNLTEISKK

SEQ ID NO: 50965 - protein, 16 aa, Borrelia afzelii
DESAKGPNLTEISKKI

SEQ ID NO: 50966 - protein, 16 aa, Borrelia afzelii
ESAKGPNLTEISKKIT

SEQ ID NO: 50967 - protein, 16 aa, Borrelia afzelii
SAKGPNLTEISKKITD

SEQ ID NO: 50968 - protein, 16 aa, Borrelia afzelii
AKGPNLTEISKKITDS

SEQ ID NO: 50969 - protein, 16 aa, Borrelia afzelii
KGPNLTEISKKITDSN

SEQ ID NO: 50970 - protein, 16 aa, Borrelia afzelii
GPNLTEISKKITDSNA

SEQ ID NO: 50971 - protein, 16 aa, Borrelia afzelii
PNLTEISKKITDSNAF

SEQ ID NO: 50972 - protein, 16 aa, Borrelia afzelii
NLTEISKKITDSNAFV

SEQ ID NO: 50973 - protein, 16 aa, Borrelia afzelii
LTEISKKITDSNAFVL

SEQ ID NO: 50974 - protein, 16 aa, Borrelia afzelii
TEISKKITDSNAFVLA

SEQ ID NO: 50975 - protein, 16 aa, Borrelia afzelii
EISKKITDSNAFVLAV

SEQ ID NO: 50976 - protein, 16 aa, Borrelia afzelii
ISKKITDSNAFVLAVK

SEQ ID NO: 50977 - protein, 16 aa, Borrelia afzelii
SKKITDSNAFVLAVKE

SEQ ID NO: 50978 - protein, 16 aa, Borrelia afzelii
KKITDSNAFVLAVKEV

SEQ ID NO: 50979 - protein, 16 aa, Borrelia afzelii
KITDSNAFVLAVKEVE

SEQ ID NO: 50980 - protein, 16 aa, Borrelia afzelii
ITDSNAFVLAVKEVET

SEQ ID NO: 50981 - protein, 16 aa, Borrelia afzelii
TDSNAFVLAVKEVETL

SEQ ID NO: 50982 - protein, 16 aa, Borrelia afzelii
DSNAFVLAVKEVETLV

SEQ ID NO: 50983 - protein, 16 aa, Borrelia afzelii
SNAFVLAVKEVETLVS

SEQ ID NO: 50984 - protein, 16 aa, Borrelia afzelii
NAFVLAVKEVETLVSS

SEQ ID NO: 50985 - protein, 16 aa, Borrelia afzelii
AFVLAVKEVETLVSSI

SEQ ID NO: 50986 - protein, 16 aa, Borrelia afzelii
FVLAVKEVETLVSSID

SEQ ID NO: 50987 - protein, 16 aa, Borrelia afzelii
VLAVKEVETLVSSIDE

SEQ ID NO: 50988 - protein, 16 aa, Borrelia afzelii
LAVKEVETLVSSIDEL

SEQ ID NO: 50989 - protein, 16 aa, Borrelia afzelii
AVKEVETLVSSIDELA

SEQ ID NO: 50990 - protein, 16 aa, Borrelia afzelii
VKEVETLVSSIDELAN

SEQ ID NO: 50991 - protein, 16 aa, Borrelia afzelii
KEVETLVSSIDELANK

SEQ ID NO: 50992 - protein, 16 aa, Borrelia afzelii
EVETLVSSIDELANKA

SEQ ID NO: 50993 - protein, 16 aa, Borrelia afzelii
VETLVSSIDELANKAI

SEQ ID NO: 50994 - protein, 16 aa, Borrelia afzelii
ETLVSSIDELANKAIG

SEQ ID NO: 50995 - protein, 16 aa, Borrelia afzelii
TLVSSIDELANKAIGK

SEQ ID NO: 50996 - protein, 16 aa, Borrelia afzelii
LVSSIDELANKAIGKK

SEQ ID NO: 50997 - protein, 16 aa, Borrelia afzelii
VSSIDELANKAIGKKI

SEQ ID NO: 50998 - protein, 16 aa, Borrelia afzelii
SSIDELANKAIGKKIQ

SEQ ID NO: 50999 - protein, 16 aa, Borrelia afzelii
SIDELANKAIGKKIQQ

SEQ ID NO: 51000 - protein, 16 aa, Borrelia afzelii
IDELANKAIGKKIQQN

SEQ ID NO: 51001 - protein, 16 aa, Borrelia afzelii
DELANKAIGKKIQQNG

SEQ ID NO: 51002 - protein, 16 aa, Borrelia afzelii
ELANKAIGKKIQQNGL

SEQ ID NO: 51003 - protein, 16 aa, Borrelia afzelii
LANKAIGKKIQQNGLG

SEQ ID NO: 51004 - protein, 16 aa, Borrelia afzelii
ANKAIGKKIQQNGLGA

SEQ ID NO: 51005 - protein, 16 aa, Borrelia afzelii
NKAIGKKIQQNGLGAE

SEQ ID NO: 51006 - protein, 16 aa, Borrelia afzelii
KAIGKKIQQNGLGAEA

SEQ ID NO: 51007 - protein, 16 aa, Borrelia afzelii
AIGKKIQQNGLGAEAN

SEQ ID NO: 51008 - protein, 16 aa, Borrelia afzelii
IGKKIQQNGLGAEANR

SEQ ID NO: 51009 - protein, 16 aa, Borrelia afzelii
GKKIQQNGLGAEANRN

SEQ ID NO: 51010 - protein, 16 aa, Borrelia afzelii
KKIQQNGLGAEANRNE

SEQ ID NO: 51011 - protein, 16 aa, Borrelia afzelii
KIQQNGLGAEANRNES

SEQ ID NO: 51012 - protein, 16 aa, Borrelia afzelii
IQQNGLGAEANRNESL

SEQ ID NO: 51013 - protein, 16 aa, Borrelia afzelii
QQNGLGAEANRNESLL

SEQ ID NO: 51014 - protein, 16 aa, Borrelia afzelii
QNGLGAEANRNESLLA

SEQ ID NO: 51015 - protein, 16 aa, Borrelia afzelii
NGLGAEANRNESLLAG

SEQ ID NO: 51016 - protein, 16 aa, Borrelia afzelii
GLGAEANRNESLLAGV

SEQ ID NO: 51017 - protein, 16 aa, Borrelia afzelii
LGAEANRNESLLAGVH

SEQ ID NO: 51018 - protein, 16 aa, Borrelia afzelii
GAEANRNESLLAGVHE

SEQ ID NO: 51019 - protein, 16 aa, Borrelia afzelii
AEANRNESLLAGVHEI

SEQ ID NO: 51020 - protein, 16 aa, Borrelia afzelii
EANRNESLLAGVHEIS

SEQ ID NO: 51021 - protein, 16 aa, Borrelia afzelii
ANRNESLLAGVHEIST

SEQ ID NO: 51022 - protein, 16 aa, Borrelia afzelii
NRNESLLAGVHEISTL

SEQ ID NO: 51023 - protein, 16 aa, Borrelia afzelii
RNESLLAGVHEISTLI

SEQ ID NO: 51024 - protein, 16 aa, Borrelia afzelii
NESLLAGVHEISTLIT

SEQ ID NO: 51025 - protein, 16 aa, Borrelia afzelii
ESLLAGVHEISTLITE

SEQ ID NO: 51026 - protein, 16 aa, Borrelia afzelii
SLLAGVHEISTLITEK

SEQ ID NO: 51027 - protein, 16 aa, Borrelia afzelii
LLAGVHEISTLITEKL

SEQ ID NO: 51028 - protein, 16 aa, Borrelia afzelii
LAGVHEISTLITEKLS

SEQ ID NO: 51029 - protein, 16 aa, Borrelia afzelii
AGVHEISTLITEKLSK

SEQ ID NO: 51030 - protein, 16 aa, Borrelia afzelii
GVHEISTLITEKLSKL

SEQ ID NO: 51031 - protein, 16 aa, Borrelia afzelii
VHEISTLITEKLSKLK

SEQ ID NO: 51032 - protein, 16 aa, Borrelia afzelii
HEISTLITEKLSKLKN

SEQ ID NO: 51033 - protein, 16 aa, Borrelia afzelii
EISTLITEKLSKLKNS

SEQ ID NO: 51034 - protein, 16 aa, Borrelia afzelii
ISTLITEKLSKLKNSG

SEQ ID NO: 51035 - protein, 16 aa, Borrelia afzelii
STLITEKLSKLKNSGE

SEQ ID NO: 51036 - protein, 16 aa, Borrelia afzelii
TLITEKLSKLKNSGEL

SEQ ID NO: 51037 - protein, 16 aa, Borrelia afzelii
LITEKLSKLKNSGELK

SEQ ID NO: 51038 - protein, 16 aa, Borrelia afzelii
ITEKLSKLKNSGELKA

SEQ ID NO: 51039 - protein, 16 aa, Borrelia afzelii
TEKLSKLKNSGELKAK

SEQ ID NO: 51040 - protein, 16 aa, Borrelia afzelii
EKLSKLKNSGELKAKI

SEQ ID NO: 51041 - protein, 16 aa, Borrelia afzelii
KLSKLKNSGELKAKIE

SEQ ID NO: 51042 - protein, 16 aa, Borrelia afzelii
LSKLKNSGELKAKIED

SEQ ID NO: 51043 - protein, 16 aa, Borrelia afzelii
SKLKNSGELKAKIEDA

SEQ ID NO: 51044 - protein, 16 aa, Borrelia afzelii
KLKNSGELKAKIEDAK

SEQ ID NO: 51045 - protein, 16 aa, Borrelia afzelii
LKNSGELKAKIEDAKK

SEQ ID NO: 51046 - protein, 16 aa, Borrelia afzelii
KNSGELKAKIEDAKKC

SEQ ID NO: 51047 - protein, 16 aa, Borrelia afzelii
NSGELKAKIEDAKKCS

SEQ ID NO: 51048 - protein, 16 aa, Borrelia afzelii
SGELKAKIEDAKKCSE

SEQ ID NO: 51049 - protein, 16 aa, Borrelia afzelii
GELKAKIEDAKKCSEE

SEQ ID NO: 51050 - protein, 16 aa, Borrelia afzelii
ELKAKIEDAKKCSEEF

SEQ ID NO: 51051 - protein, 16 aa, Borrelia afzelii
LKAKIEDAKKCSEEFT

SEQ ID NO: 51052 - protein, 16 aa, Borrelia afzelii
KAKIEDAKKCSEEFTN

SEQ ID NO: 51053 - protein, 16 aa, Borrelia afzelii
AKIEDAKKCSEEFTNK

SEQ ID NO: 51054 - protein, 16 aa, Borrelia afzelii
KIEDAKKCSEEFTNKL

SEQ ID NO: 51055 - protein, 16 aa, Borrelia afzelii
IEDAKKCSEEFTNKLR

SEQ ID NO: 51056 - protein, 16 aa, Borrelia afzelii
EDAKKCSEEFTNKLRV

SEQ ID NO: 51057 - protein, 16 aa, Borrelia afzelii
DAKKCSEEFTNKLRVS

SEQ ID NO: 51058 - protein, 16 aa, Borrelia afzelii
AKKCSEEFTNKLRVSH

SEQ ID NO: 51059 - protein, 16 aa, Borrelia afzelii
KKCSEEFTNKLRVSHA

SEQ ID NO: 51060 - protein, 16 aa, Borrelia afzelii
KCSEEFTNKLRVSHAD

SEQ ID NO: 51061 - protein, 16 aa, Borrelia afzelii
CSEEFTNKLRVSHADL

SEQ ID NO: 51062 - protein, 16 aa, Borrelia afzelii
SEEFTNKLRVSHADLG

SEQ ID NO: 51063 - protein, 16 aa, Borrelia afzelii
EEFTNKLRVSHADLGK

SEQ ID NO: 51064 - protein, 16 aa, Borrelia afzelii
EFTNKLRVSHADLGKQ

SEQ ID NO: 51065 - protein, 16 aa, Borrelia afzelii
FTNKLRVSHADLGKQG

SEQ ID NO: 51066 - protein, 16 aa, Borrelia afzelii
TNKLRVSHADLGKQGV

SEQ ID NO: 51067 - protein, 16 aa, Borrelia afzelii
NKLRVSHADLGKQGVN

SEQ ID NO: 51068 - protein, 16 aa, Borrelia afzelii
KLRVSHADLGKQGVND

SEQ ID NO: 51069 - protein, 16 aa, Borrelia afzelii
LRVSHADLGKQGVNDD

SEQ ID NO: 51070 - protein, 16 aa, Borrelia afzelii
RVSHADLGKQGVNDDD

SEQ ID NO: 51071 - protein, 16 aa, Borrelia afzelii
VSHADLGKQGVNDDDA

SEQ ID NO: 51072 - protein, 16 aa, Borrelia afzelii
SHADLGKQGVNDDDAK

SEQ ID NO: 51073 - protein, 16 aa, Borrelia afzelii
HADLGKQGVNDDDAKK

SEQ ID NO: 51074 - protein, 16 aa, Borrelia afzelii
ADLGKQGVNDDDAKKA

SEQ ID NO: 51075 - protein, 16 aa, Borrelia afzelii
DLGKQGVNDDDAKKAI

SEQ ID NO: 51076 - protein, 16 aa, Borrelia afzelii
LGKQGVNDDDAKKAIL

SEQ ID NO: 51077 - protein, 16 aa, Borrelia afzelii
GKQGVNDDDAKKAILK

SEQ ID NO: 51078 - protein, 16 aa, Borrelia afzelii
KQGVNDDDAKKAILKT

SEQ ID NO: 51079 - protein, 16 aa, Borrelia afzelii
QGVNDDDAKKAILKTN

SEQ ID NO: 51080 - protein, 16 aa, Borrelia afzelii
GVNDDDAKKAILKTNA

SEQ ID NO: 51081 - protein, 16 aa, Borrelia afzelii
VNDDDAKKAILKTNAD

SEQ ID NO: 51082 - protein, 16 aa, Borrelia afzelii
NDDDAKKAILKTNADK

SEQ ID NO: 51083 - protein, 16 aa, Borrelia afzelii
DDDAKKAILKTNADKT

SEQ ID NO: 51084 - protein, 16 aa, Borrelia afzelii
DDAKKAILKTNADKTK

SEQ ID NO: 51085 - protein, 16 aa, Borrelia afzelii
DAKKAILKTNADKTKG

SEQ ID NO: 51086 - protein, 16 aa, Borrelia afzelii
AKKAILKTNADKTKGA

SEQ ID NO: 51087 - protein, 16 aa, Borrelia afzelii
KKAILKTNADKTKGAE

SEQ ID NO: 51088 - protein, 16 aa, Borrelia afzelii
KAILKTNADKTKGAEE

SEQ ID NO: 51089 - protein, 16 aa, Borrelia afzelii
AILKTNADKTKGAEEL

SEQ ID NO: 51090 - protein, 16 aa, Borrelia afzelii
ILKTNADKTKGAEELG

SEQ ID NO: 51091 - protein, 16 aa, Borrelia afzelii
LKTNADKTKGAEELGK

SEQ ID NO: 51092 - protein, 16 aa, Borrelia afzelii
KTNADKTKGAEELGKL

SEQ ID NO: 51093 - protein, 16 aa, Borrelia afzelii
TNADKTKGAEELGKLF

SEQ ID NO: 51094 - protein, 16 aa, Borrelia afzelii
NADKTKGAEELGKLFK

SEQ ID NO: 51095 - protein, 16 aa, Borrelia afzelii
ADKTKGAEELGKLFKS

SEQ ID NO: 51096 - protein, 16 aa, Borrelia afzelii
DKTKGAEELGKLFKSV

SEQ ID NO: 51097 - protein, 16 aa, Borrelia afzelii
KTKGAEELGKLFKSVE

SEQ ID NO: 51098 - protein, 16 aa, Borrelia afzelii
TKGAEELGKLFKSVEG

SEQ ID NO: 51099 - protein, 16 aa, Borrelia afzelii
KGAEELGKLFKSVEGL

SEQ ID NO: 51100 - protein, 16 aa, Borrelia afzelii
GAEELGKLFKSVEGLV

SEQ ID NO: 51101 - protein, 16 aa, Borrelia afzelii
AEELGKLFKSVEGLVK

SEQ ID NO: 51102 - protein, 16 aa, Borrelia afzelii
EELGKLFKSVEGLVKA

SEQ ID NO: 51103 - protein, 16 aa, Borrelia afzelii
ELGKLFKSVEGLVKAA

SEQ ID NO: 51104 - protein, 16 aa, Borrelia afzelii
LGKLFKSVEGLVKAAQ

SEQ ID NO: 51105 - protein, 16 aa, Borrelia afzelii
GKLFKSVEGLVKAAQE

SEQ ID NO: 51106 - protein, 16 aa, Borrelia afzelii
KLFKSVEGLVKAAQEA

SEQ ID NO: 51107 - protein, 16 aa, Borrelia afzelii
LFKSVEGLVKAAQEAL

SEQ ID NO: 51108 - protein, 16 aa, Borrelia afzelii
FKSVEGLVKAAQEALT

SEQ ID NO: 51109 - protein, 16 aa, Borrelia afzelii
KSVEGLVKAAQEALTN

SEQ ID NO: 51110 - protein, 16 aa, Borrelia afzelii
SVEGLVKAAQEALTNS

SEQ ID NO: 51111 - protein, 16 aa, Borrelia afzelii
VEGLVKAAQEALTNSV

SEQ ID NO: 51112 - protein, 16 aa, Borrelia afzelii
EGLVKAAQEALTNSVK

SEQ ID NO: 51113 - protein, 16 aa, Borrelia afzelii
GLVKAAQEALTNSVKE

SEQ ID NO: 51114 - protein, 16 aa, Borrelia afzelii
LVKAAQEALTNSVKEL

SEQ ID NO: 51115 - protein, 16 aa, Borrelia afzelii
VKAAQEALTNSVKELT

SEQ ID NO: 51116 - protein, 16 aa, Borrelia afzelii
KAAQEALTNSVKELTS

SEQ ID NO: 51117 - protein, 16 aa, Borrelia afzelii
AAQEALTNSVKELTSP

SEQ ID NO: 51118 - protein, 16 aa, Borrelia afzelii
AQEALTNSVKELTSPV

SEQ ID NO: 51119 - protein, 16 aa, Borrelia afzelii
QEALTNSVKELTSPVV

SEQ ID NO: 51120 - protein, 16 aa, Borrelia afzelii
EALTNSVKELTSPVVA

SEQ ID NO: 51121 - protein, 16 aa, Borrelia afzelii
ALTNSVKELTSPVVAE

SEQ ID NO: 51122 - protein, 16 aa, Borrelia afzelii
LTNSVKELTSPVVAES

SEQ ID NO: 51123 - protein, 16 aa, Borrelia afzelii
TNSVKELTSPVVAESP

SEQ ID NO: 51124 - protein, 16 aa, Borrelia afzelii
NSVKELTSPVVAESPK

SEQ ID NO: 51125 - protein, 16 aa, Borrelia afzelii
SVKELTSPVVAESPKK

SEQ ID NO: 51126 - protein, 16 aa, Borrelia afzelii
VKELTSPVVAESPKKP

SEQ ID NO: 51127 - protein, 9 aa, Borrelia burgdorferi
YLLGIGLIL

SEQ ID NO: 51128 - protein, 9 aa, Borrelia burgdorferi
FTLEGTLAA

SEQ ID NO: 51129 - protein, 9 aa, Borrelia burgdorferi
KTSTLTISV

SEQ ID NO: 51130 - protein, 9 aa, Borrelia burgdorferi
FTKEDTITV

SEQ ID NO: 51131 - protein, 9 aa, Borrelia burgdorferi
ALIACKQNV

SEQ ID NO: 51132 - protein, 9 aa, Borrelia burgdorferi
LLGIGLILA

SEQ ID NO: 51133 - protein, 9 aa, Borrelia burgdorferi
SLEATVDKL

SEQ ID NO: 51134 - protein, 9 aa, Borrelia burgdorferi
ILKSGEITV

SEQ ID NO: 51135 - protein, 9 aa, Borrelia burgdorferi
KVTEGTVVL

SEQ ID NO: 51136 - protein, 9 aa, Borrelia burgdorferi
STLDEKNSV

SEQ ID NO: 51137 - protein, 9 aa, Borrelia burgdorferi
TLVSKKVTL

SEQ ID NO: 51138 - protein, 9 aa, Borrelia burgdorferi
GIGLILALI

SEQ ID NO: 51139 - protein, 10 aa, Borrelia burgdorferi
YLLGIGLILA

SEQ ID NO: 51140 - protein, 10 aa, Borrelia burgdorferi
TLDEKNSVSV

SEQ ID NO: 51141 - protein, 10 aa, Borrelia burgdorferi
ALDDSDTTQA

SEQ ID NO: 51142 - protein, 10 aa, Borrelia burgdorferi
LLGIGLILAL

SEQ ID NO: 51143 - protein, 10 aa, Borrelia burgdorferi
NILKSGEITV

SEQ ID NO: 51144 - protein, 10 aa, Borrelia burgdorferi
TLAADGKTTL

SEQ ID NO: 51145 - protein, 10 aa, Borrelia burgdorferi
VLKDFTLEGT

SEQ ID NO: 51146 - protein, 10 aa, Borrelia burgdorferi
YSLEATVDKL

SEQ ID NO: 51147 - protein, 11 aa, Borrelia burgdorferi
YLLGIGLILAL

SEQ ID NO: 51148 - protein, 11 aa, Borrelia burgdorferi
LVFTKEDTITV

SEQ ID NO: 51149 - protein, 11 aa, Borrelia burgdorferi
LLGIGLILALI

SEQ ID NO: 51150 - protein, 11 aa, Borrelia burgdorferi
ILALIACKQNV

SEQ ID NO: 51151 - protein, 11 aa, Borrelia burgdorferi
STLDEKNSVSV

SEQ ID NO: 51152 - protein, 11 aa, Borrelia burgdorferi
ALDDSDTTQAT

SEQ ID NO: 51153 - protein, 11 aa, Borrelia burgdorferi
VLKDFTLEGTL

SEQ ID NO: 51154 - protein, 11 aa, Borrelia burgdorferi
SLEATVDKLEL

SEQ ID NO: 51155 - protein, 11 aa, Borrelia burgdorferi
ILKSGEITVAL

SEQ ID NO: 51156 - protein, 11 aa, Borrelia burgdorferi
ALIACKQNVST

SEQ ID NO: 51157 - protein, 11 aa, Borrelia burgdorferi
TTLKVTEGTVV

SEQ ID NO: 51158 - protein, 11 aa, Borrelia burgdorferi
LAADGKTTLKV

SEQ ID NO: 51159 - protein, 11 aa, Borrelia burgdorferi
LIACKQNVSTL

SEQ ID NO: 51160 - protein, 9 aa, Borrelia burgdorferi
VVLSKNILK

SEQ ID NO: 51161 - protein, 9 aa, Borrelia burgdorferi
KTKNLVFTK

SEQ ID NO: 51162 - protein, 9 aa, Borrelia burgdorferi
LVSKKVTLK

SEQ ID NO: 51163 - protein, 9 aa, Borrelia burgdorferi
LILALIACK

SEQ ID NO: 51164 - protein, 9 aa, Borrelia burgdorferi
LTISVNSQK

SEQ ID NO: 51165 - protein, 9 aa, Borrelia burgdorferi
KAVEITTLK

SEQ ID NO: 51166 - protein, 9 aa, Borrelia burgdorferi
AADGKTTLK

SEQ ID NO: 51167 - protein, 9 aa, Borrelia burgdorferi
ISVNSQKTK

SEQ ID NO: 51168 - protein, 9 aa, Borrelia burgdorferi
RANGTRLEY

SEQ ID NO: 51169 - protein, 9 aa, Borrelia burgdorferi
SQTKFEIFK

SEQ ID NO: 51170 - protein, 9 aa, Borrelia burgdorferi
KSDGSGKAK

SEQ ID NO: 51171 - protein, 9 aa, Borrelia burgdorferi
TQATKKTGK

SEQ ID NO: 51172 - protein, 9 aa, Borrelia burgdorferi
MTELVSKEK

SEQ ID NO: 51173 - protein, 10 aa, Borrelia burgdorferi
TLVSKKVTLK

SEQ ID NO: 51174 - protein, 10 aa, Borrelia burgdorferi
TLTISVNSQK

SEQ ID NO: 51175 - protein, 10 aa, Borrelia burgdorferi
TVVLSKNILK

SEQ ID NO: 51176 - protein, 10 aa, Borrelia burgdorferi
GLILALIACK

SEQ ID NO: 51177 - protein, 10 aa, Borrelia burgdorferi
TLKELKNALK

SEQ ID NO: 51178 - protein, 10 aa, Borrelia burgdorferi
LSQTKFEIFK

SEQ ID NO: 51179 - protein, 10 aa, Borrelia burgdorferi
LAADGKTTLK

SEQ ID NO: 51180 - protein, 10 aa, Borrelia burgdorferi
VTEGTVVLSK

SEQ ID NO: 51181 - protein, 10 aa, Borrelia burgdorferi
KLELKGTSDK

SEQ ID NO: 51182 - protein, 10 aa, Borrelia burgdorferi
TTQATKKTGK

SEQ ID NO: 51183 - protein, 10 aa, Borrelia burgdorferi
GMTELVSKEK

SEQ ID NO: 51184 - protein, 10 aa, Borrelia burgdorferi
KYSLEATVDK

SEQ ID NO: 51185 - protein, 10 aa, Borrelia burgdorferi
KQNVSTLDEK

SEQ ID NO: 51186 - protein, 10 aa, Borrelia burgdorferi
TIADDLSQTK

SEQ ID NO: 51187 - protein, 10 aa, Borrelia burgdorferi
TISVNSQKTK

SEQ ID NO: 51188 - protein, 10 aa, Borrelia burgdorferi
KEDAKTLVSK

SEQ ID NO: 51189 - protein, 10 aa, Borrelia burgdorferi
GSGKAKEVLK

SEQ ID NO: 51190 - protein, 10 aa, Borrelia burgdorferi
KTIVRANGTR

SEQ ID NO: 51191 - protein, 10 aa, Borrelia burgdorferi
GTLEGEKTDK

SEQ ID NO: 51192 - protein, 10 aa, Borrelia burgdorferi
GKAVEITTLK

SEQ ID NO: 51193 - protein, 10 aa, Borrelia burgdorferi
GTRLEYTDIK

SEQ ID NO: 51194 - protein, 10 aa, Borrelia burgdorferi
VSKKVTLKDK

SEQ ID NO: 51195 - protein, 10 aa, Borrelia burgdorferi
IKSDGSGKAK

SEQ ID NO: 51196 - protein, 11 aa, Borrelia burgdorferi
TLAADGKTTLK

SEQ ID NO: 51197 - protein, 11 aa, Borrelia burgdorferi
STLTISVNSQK

SEQ ID NO: 51198 - protein, 11 aa, Borrelia burgdorferi
KTLVSKKVTLK

SEQ ID NO: 51199 - protein, 11 aa, Borrelia burgdorferi
KVTEGTVVLSK

SEQ ID NO: 51200 - protein, 11 aa, Borrelia burgdorferi
TTLKELKNALK

SEQ ID NO: 51201 - protein, 11 aa, Borrelia burgdorferi
LTISVNSQKTK

SEQ ID NO: 51202 - protein, 11 aa, Borrelia burgdorferi
GTVVLSKNILK

SEQ ID NO: 51203 - protein, 11 aa, Borrelia burgdorferi
FTKEDTITVQK

SEQ ID NO: 51204 - protein, 11 aa, Borrelia burgdorferi
IVRANGTRLEY

SEQ ID NO: 51205 - protein, 11 aa, Borrelia burgdorferi
TLKDKSSTEEK

SEQ ID NO: 51206 - protein, 11 aa, Borrelia burgdorferi
LVSKKVTLKDK

SEQ ID NO: 51207 - protein, 11 aa, Borrelia burgdorferi
KFNEKGETSEK

SEQ ID NO: 51208 - protein, 11 aa, Borrelia burgdorferi
LTIADDLSQTK

SEQ ID NO: 51209 - protein, 11 aa, Borrelia burgdorferi
SQKTKNLVFTK

SEQ ID NO: 51210 - protein, 11 aa, Borrelia burgdorferi
KSSTEEKFNEK

SEQ ID NO: 51211 - protein, 11 aa, Borrelia burgdorferi
ATKKTGKWDSK

SEQ ID NO: 51212 - protein, 9 aa, Borrelia burgdorferi
VVLSKNILK

SEQ ID NO: 51213 - protein, 9 aa, Borrelia burgdorferi
KTKNLVFTK

SEQ ID NO: 51214 - protein, 9 aa, Borrelia burgdorferi
SQTKFEIFK

SEQ ID NO: 51215 - protein, 9 aa, Borrelia burgdorferi
LTISVNSQK

SEQ ID NO: 51216 - protein, 9 aa, Borrelia burgdorferi
ATVDKLELK

SEQ ID NO: 51217 - protein, 9 aa, Borrelia burgdorferi
LILALIACK

SEQ ID NO: 51218 - protein, 9 aa, Borrelia burgdorferi
STEEKFNEK

SEQ ID NO: 51219 - protein, 9 aa, Borrelia burgdorferi
KAVEITTLK

SEQ ID NO: 51220 - protein, 9 aa, Borrelia burgdorferi
LVSKKVTLK

SEQ ID NO: 51221 - protein, 9 aa, Borrelia burgdorferi
MTELVSKEK

SEQ ID NO: 51222 - protein, 9 aa, Borrelia burgdorferi
AADGKTTLK

SEQ ID NO: 51223 - protein, 9 aa, Borrelia burgdorferi
SAGTNLEGK

SEQ ID NO: 51224 - protein, 9 aa, Borrelia burgdorferi
YSLEATVDK

SEQ ID NO: 51225 - protein, 9 aa, Borrelia burgdorferi
GSGTLEGEK

SEQ ID NO: 51226 - protein, 9 aa, Borrelia burgdorferi
TQATKKTGK

SEQ ID NO: 51227 - protein, 9 aa, Borrelia burgdorferi
RANGTRLEY

SEQ ID NO: 51228 - protein, 9 aa, Borrelia burgdorferi
IADDLSQTK

SEQ ID NO: 51229 - protein, 9 aa, Borrelia burgdorferi
ISVNSQKTK

SEQ ID NO: 51230 - protein, 9 aa, Borrelia burgdorferi
KSDGSGKAK

SEQ ID NO: 51231 - protein, 9 aa, Borrelia burgdorferi
GGMTELVSK

SEQ ID NO: 51232 - protein, 9 aa, Borrelia burgdorferi
TEGTVVLSK

SEQ ID NO: 51233 - protein, 9 aa, Borrelia burgdorferi
EITTLKELK

SEQ ID NO: 51234 - protein, 9 aa, Borrelia burgdorferi
TIVRANGTR

SEQ ID NO: 51235 - protein, 10 aa, Borrelia burgdorferi
TVVLSKNILK

SEQ ID NO: 51236 - protein, 10 aa, Borrelia burgdorferi
TTQATKKTGK

SEQ ID NO: 51237 - protein, 10 aa, Borrelia burgdorferi
TIADDLSQTK

SEQ ID NO: 51238 - protein, 10 aa, Borrelia burgdorferi
VTEGTVVLSK

SEQ ID NO: 51239 - protein, 10 aa, Borrelia burgdorferi
LSQTKFEIFK

SEQ ID NO: 51240 - protein, 10 aa, Borrelia burgdorferi
SSTEEKFNEK

SEQ ID NO: 51241 - protein, 10 aa, Borrelia burgdorferi
GLILALIACK

SEQ ID NO: 51242 - protein, 10 aa, Borrelia burgdorferi
KQNVSTLDEK

SEQ ID NO: 51243 - protein, 10 aa, Borrelia burgdorferi
TLTISVNSQK

SEQ ID NO: 51244 - protein, 10 aa, Borrelia burgdorferi
TLVSKKVTLK

SEQ ID NO: 51245 - protein, 10 aa, Borrelia burgdorferi
TISVNSQKTK

SEQ ID NO: 51246 - protein, 10 aa, Borrelia burgdorferi
LAADGKTTLK

SEQ ID NO: 51247 - protein, 10 aa, Borrelia burgdorferi
GMTELVSKEK

SEQ ID NO: 51248 - protein, 10 aa, Borrelia burgdorferi
TLKELKNALK

SEQ ID NO: 51249 - protein, 10 aa, Borrelia burgdorferi
KTIVRANGTR

SEQ ID NO: 51250 - protein, 10 aa, Borrelia burgdorferi
GSGKAKEVLK

SEQ ID NO: 51251 - protein, 10 aa, Borrelia burgdorferi
GTLEGEKTDK

SEQ ID NO: 51252 - protein, 10 aa, Borrelia burgdorferi
VSKKVTLKDK

SEQ ID NO: 51253 - protein, 10 aa, Borrelia burgdorferi
GTRLEYTDIK

SEQ ID NO: 51254 - protein, 10 aa, Borrelia burgdorferi
KLELKGTSDK

SEQ ID NO: 51255 - protein, 10 aa, Borrelia burgdorferi
DSAGTNLEGK

SEQ ID NO: 51256 - protein, 11 aa, Borrelia burgdorferi
STLTISVNSQK

SEQ ID NO: 51257 - protein, 11 aa, Borrelia burgdorferi
TTLKELKNALK

SEQ ID NO: 51258 - protein, 11 aa, Borrelia burgdorferi
KVTEGTVVLSK

SEQ ID NO: 51259 - protein, 11 aa, Borrelia burgdorferi
KTLVSKKVTLK

SEQ ID NO: 51260 - protein, 11 aa, Borrelia burgdorferi
GTVVLSKNILK

SEQ ID NO: 51261 - protein, 11 aa, Borrelia burgdorferi
LTIADDLSQTK

SEQ ID NO: 51262 - protein, 11 aa, Borrelia burgdorferi
TLAADGKTTLK

SEQ ID NO: 51263 - protein, 11 aa, Borrelia burgdorferi
AVEITTLKELK

SEQ ID NO: 51264 - protein, 11 aa, Borrelia burgdorferi
LTISVNSQKTK

SEQ ID NO: 51265 - protein, 11 aa, Borrelia burgdorferi
SQKTKNLVFTK

SEQ ID NO: 51266 - protein, 11 aa, Borrelia burgdorferi
KSSTEEKFNEK

SEQ ID NO: 51267 - protein, 11 aa, Borrelia burgdorferi
ATKKTGKWDSK

SEQ ID NO: 51268 - protein, 11 aa, Borrelia burgdorferi
TLKDKSSTEEK

SEQ ID NO: 51269 - protein, 11 aa, Borrelia burgdorferi
FTKEDTITVQK

SEQ ID NO: 51270 - protein, 11 aa, Borrelia burgdorferi
TLEGTLAADGK

SEQ ID NO: 51271 - protein, 11 aa, Borrelia burgdorferi
LVSKKVTLKDK

SEQ ID NO: 51272 - protein, 11 aa, Borrelia burgdorferi
MTELVSKEKDK

SEQ ID NO: 51273 - protein, 11 aa, Borrelia burgdorferi
DLSQTKFEIFK

SEQ ID NO: 51274 - protein, 11 aa, Borrelia burgdorferi
YTDIKSDGSGK

SEQ ID NO: 51275 - protein, 11 aa, Borrelia burgdorferi
LVSKEKDKDGK

SEQ ID NO: 51276 - protein, 11 aa, Borrelia burgdorferi
KFNEKGETSEK

SEQ ID NO: 51277 - protein, 11 aa, Borrelia burgdorferi
IGLILALIACK

SEQ ID NO: 51278 - protein, 9 aa, Borrelia burgdorferi
KYLLGIGLI

SEQ ID NO: 51279 - protein, 9 aa, Borrelia burgdorferi
KWDSKTSTL

SEQ ID NO: 51280 - protein, 9 aa, Borrelia burgdorferi
KYDSAGTNL

SEQ ID NO: 51281 - protein, 10 aa, Borrelia burgdorferi
KYLLGIGLIL

SEQ ID NO: 51282 - protein, 11 aa, Borrelia burgdorferi
KWDSKTSTLTI

SEQ ID NO: 51283 - protein, 11 aa, Borrelia burgdorferi
KYSLEATVDKL

SEQ ID NO: 51284 - protein, 11 aa, Borrelia burgdorferi
IVRANGTRLEY

SEQ ID NO: 51285 - protein, 11 aa, Borrelia burgdorferi
TIADDLSQTKF

SEQ ID NO: 51286 - protein, 9 aa, Borrelia burgdorferi
LTISVNSQK

SEQ ID NO: 51287 - protein, 9 aa, Borrelia burgdorferi
ETSEKTIVR

SEQ ID NO: 51288 - protein, 9 aa, Borrelia burgdorferi
MTELVSKEK

SEQ ID NO: 51289 - protein, 9 aa, Borrelia burgdorferi
EITTLKELK

SEQ ID NO: 51290 - protein, 9 aa, Borrelia burgdorferi
TIVRANGTR

SEQ ID NO: 51291 - protein, 9 aa, Borrelia burgdorferi
KAVEITTLK

SEQ ID NO: 51292 - protein, 9 aa, Borrelia burgdorferi
DAKTLVSKK

SEQ ID NO: 51293 - protein, 9 aa, Borrelia burgdorferi
KTKNLVFTK

SEQ ID NO: 51294 - protein, 9 aa, Borrelia burgdorferi
STEEKFNEK

SEQ ID NO: 51295 - protein, 9 aa, Borrelia burgdorferi
ATVDKLELK

SEQ ID NO: 51296 - protein, 9 aa, Borrelia burgdorferi
LVSKKVTLK

SEQ ID NO: 51297 - protein, 9 aa, Borrelia burgdorferi
SQTKFEIFK

SEQ ID NO: 51298 - protein, 9 aa, Borrelia burgdorferi
YSLEATVDK

SEQ ID NO: 51299 - protein, 9 aa, Borrelia burgdorferi
EGTLAADGK

SEQ ID NO: 51300 - protein, 9 aa, Borrelia burgdorferi
ISVNSQKTK

SEQ ID NO: 51301 - protein, 9 aa, Borrelia burgdorferi
LILALIACK

SEQ ID NO: 51302 - protein, 9 aa, Borrelia burgdorferi
DIKSDGSGK

SEQ ID NO: 51303 - protein, 9 aa, Borrelia burgdorferi
VVLSKNILK

SEQ ID NO: 51304 - protein, 9 aa, Borrelia burgdorferi
EDAKTLVSK

SEQ ID NO: 51305 - protein, 9 aa, Borrelia burgdorferi
DSDTTQATK

SEQ ID NO: 51306 - protein, 9 aa, Borrelia burgdorferi
SAGTNLEGK

SEQ ID NO: 51307 - protein, 10 aa, Borrelia burgdorferi
TVVLSKNILK

SEQ ID NO: 51308 - protein, 10 aa, Borrelia burgdorferi
TLTISVNSQK

SEQ ID NO: 51309 - protein, 10 aa, Borrelia burgdorferi
EATVDKLELK

SEQ ID NO: 51310 - protein, 10 aa, Borrelia burgdorferi
TIADDLSQTK

SEQ ID NO: 51311 - protein, 10 aa, Borrelia burgdorferi
DSAGTNLEGK

SEQ ID NO: 51312 - protein, 10 aa, Borrelia burgdorferi
TTQATKKTGK

SEQ ID NO: 51313 - protein, 10 aa, Borrelia burgdorferi
LAADGKTTLK

SEQ ID NO: 51314 - protein, 10 aa, Borrelia burgdorferi
KTIVRANGTR

SEQ ID NO: 51315 - protein, 10 aa, Borrelia burgdorferi
TISVNSQKTK

SEQ ID NO: 51316 - protein, 10 aa, Borrelia burgdorferi
TLVSKKVTLK

SEQ ID NO: 51317 - protein, 10 aa, Borrelia burgdorferi
SSTEEKFNEK

SEQ ID NO: 51318 - protein, 10 aa, Borrelia burgdorferi
TLKELKNALK

SEQ ID NO: 51319 - protein, 10 aa, Borrelia burgdorferi
LSQTKFEIFK

SEQ ID NO: 51320 - protein, 10 aa, Borrelia burgdorferi
VTEGTVVLSK

SEQ ID NO: 51321 - protein, 10 aa, Borrelia burgdorferi
EDAKTLVSKK

SEQ ID NO: 51322 - protein, 10 aa, Borrelia burgdorferi
DSDTTQATKK

SEQ ID NO: 51323 - protein, 10 aa, Borrelia burgdorferi
GLILALIACK

SEQ ID NO: 51324 - protein, 9 aa, Borrelia burgdorferi
IVRANGTRL

SEQ ID NO: 51325 - protein, 9 aa, Borrelia burgdorferi
KVTEGTVVL

SEQ ID NO: 51326 - protein, 9 aa, Borrelia burgdorferi
LAADGKTTL

SEQ ID NO: 51327 - protein, 9 aa, Borrelia burgdorferi
LPGGMTELV

SEQ ID NO: 51328 - protein, 9 aa, Borrelia burgdorferi
TVVLSKNIL

SEQ ID NO: 51329 - protein, 11 aa, Borrelia burgdorferi
KAVEITTLKEL

SEQ ID NO: 51330 - protein, 9 aa, Borrelia burgdorferi
TLKELKNAL

SEQ ID NO: 51331 - protein, 11 aa, Borrelia burgdorferi
ILKSGEITVAL

SEQ ID NO: 51332 - protein, 11 aa, Borrelia burgdorferi
YLLGIGLILAL

SEQ ID NO: 51333 - protein, 11 aa, Borrelia burgdorferi
TLKVTEGTVVL

SEQ ID NO: 51334 - protein, 9 aa, Borrelia burgdorferi
SQKTKNLVF

SEQ ID NO: 51335 - protein, 9 aa, Borrelia burgdorferi
RANGTRLEY

SEQ ID NO: 51336 - protein, 9 aa, Borrelia burgdorferi
YLLGIGLIL

SEQ ID NO: 51337 - protein, 9 aa, Borrelia burgdorferi
KVTEGTVVL

SEQ ID NO: 51338 - protein, 9 aa, Borrelia burgdorferi
TLKELKNAL

SEQ ID NO: 51339 - protein, 9 aa, Borrelia burgdorferi
KAKEVLKDF

SEQ ID NO: 51340 - protein, 9 aa, Borrelia burgdorferi
IVRANGTRL

SEQ ID NO: 51341 - protein, 9 aa, Borrelia burgdorferi
LGIGLILAL

SEQ ID NO: 51342 - protein, 10 aa, Borrelia burgdorferi
TLAADGKTTL

SEQ ID NO: 51343 - protein, 11 aa, Borrelia burgdorferi
IVRANGTRLEY

SEQ ID NO: 51344 - protein, 11 aa, Borrelia burgdorferi
YLLGIGLILAL

SEQ ID NO: 51345 - protein, 11 aa, Borrelia burgdorferi
VQKYDSAGTNL

SEQ ID NO: 51346 - protein, 11 aa, Borrelia burgdorferi
ILKSGEITVAL

SEQ ID NO: 51347 - protein, 11 aa, Borrelia burgdorferi
VSKEKDKDGKY

SEQ ID NO: 51348 - protein, 11 aa, Borrelia burgdorferi
VLKDFTLEGTL

SEQ ID NO: 51349 - protein, 11 aa, Borrelia burgdorferi
TLKVTEGTVVL

SEQ ID NO: 51350 - protein, 11 aa, Borrelia burgdorferi
VNSQKTKNLVF

SEQ ID NO: 51351 - protein, 9 aa, Borrelia burgdorferi
KKYLLGIGL

SEQ ID NO: 51352 - protein, 10 aa, Borrelia burgdorferi
VRANGTRLEY

SEQ ID NO: 51353 - protein, 10 aa, Borrelia burgdorferi
GKWDSKTSTL

SEQ ID NO: 51354 - protein, 11 aa, Borrelia burgdorferi
KKYLLGIGLIL

SEQ ID NO: 51355 - protein, 9 aa, Borrelia burgdorferi
LAADGKTTL

SEQ ID NO: 51356 - protein, 9 aa, Borrelia burgdorferi
RANGTRLEY

SEQ ID NO: 51357 - protein, 9 aa, Borrelia burgdorferi
FTLEGTLAA

SEQ ID NO: 51358 - protein, 9 aa, Borrelia burgdorferi
TVVLSKNIL

SEQ ID NO: 51359 - protein, 9 aa, Borrelia burgdorferi
VALDDSDTT

SEQ ID NO: 51360 - protein, 9 aa, Borrelia burgdorferi
YLLGIGLIL

SEQ ID NO: 51361 - protein, 9 aa, Borrelia burgdorferi
LPGGMTELV

SEQ ID NO: 51362 - protein, 10 aa, Borrelia burgdorferi
IADDLSQTKF

SEQ ID NO: 51363 - protein, 10 aa, Borrelia burgdorferi
LPGGMTELVS

SEQ ID NO: 51364 - protein, 10 aa, Borrelia burgdorferi
LKVTEGTVVL

SEQ ID NO: 51365 - protein, 10 aa, Borrelia burgdorferi
YSLEATVDKL

SEQ ID NO: 51366 - protein, 11 aa, Borrelia burgdorferi
YLLGIGLILAL

SEQ ID NO: 51367 - protein, 11 aa, Borrelia burgdorferi
NSVSVDLPGGM

SEQ ID NO: 51368 - protein, 11 aa, Borrelia burgdorferi
IVRANGTRLEY

SEQ ID NO: 51369 - protein, 11 aa, Borrelia burgdorferi
TIADDLSQTKF

SEQ ID NO: 51370 - protein, 11 aa, Borrelia burgdorferi
KAVEITTLKEL

SEQ ID NO: 51371 - protein, 9 aa, Borrelia burgdorferi
KEVLKDFTL

SEQ ID NO: 51372 - protein, 9 aa, Borrelia burgdorferi
GEITVALDD

SEQ ID NO: 51373 - protein, 9 aa, Borrelia burgdorferi
KEKDKDGKY

SEQ ID NO: 51374 - protein, 9 aa, Borrelia burgdorferi
KEDAKTLVS

SEQ ID NO: 51375 - protein, 10 aa, Borrelia burgdorferi
GEITVALDDS

SEQ ID NO: 51376 - protein, 10 aa, Borrelia burgdorferi
KEDTITVQKY

SEQ ID NO: 51377 - protein, 11 aa, Borrelia burgdorferi
GEITVALDDSD

SEQ ID NO: 51378 - protein, 11 aa, Borrelia burgdorferi
KEVLKDFTLEG

SEQ ID NO: 51379 - protein, 9 aa, Borrelia burgdorferi
LPGGMTELV

SEQ ID NO: 51380 - protein, 11 aa, Borrelia burgdorferi
TTQATKKTGKW

SEQ ID NO: 51381 - protein, 11 aa, Borrelia garinii
NQDEAIAVNIY

SEQ ID NO: 51382 - protein, 11 aa, Borrelia garinii
ELAVQSGNGTY

SEQ ID NO: 51383 - protein, 9 aa, Borrelia garinii
SQASWTLRV

SEQ ID NO: 51384 - protein, 9 aa, Borrelia garinii
QLTDEINRI

SEQ ID NO: 51385 - protein, 9 aa, Borrelia garinii
AQAAQTAPV

SEQ ID NO: 51386 - protein, 9 aa, Borrelia garinii
AIAVNIYAA

SEQ ID NO: 51387 - protein, 9 aa, Borrelia garinii
SLAKIENAI

SEQ ID NO: 51388 - protein, 9 aa, Borrelia garinii
AVNIYAANV

SEQ ID NO: 51389 - protein, 9 aa, Borrelia garinii
AQYNQMHML

SEQ ID NO: 51390 - protein, 9 aa, Borrelia garinii
TTVDANTSL

SEQ ID NO: 51391 - protein, 9 aa, Borrelia garinii
SQGGVNSPV

SEQ ID NO: 51392 - protein, 9 aa, Borrelia garinii
QTAPVQEGV

SEQ ID NO: 51393 - protein, 10 aa, Borrelia garinii
NIYAANVANL

SEQ ID NO: 51394 - protein, 10 aa, Borrelia garinii
NLNEVEKVLV

SEQ ID NO: 51395 - protein, 10 aa, Borrelia garinii
VLVRMKELAV

SEQ ID NO: 51396 - protein, 10 aa, Borrelia garinii
QLTDEINRIA

SEQ ID NO: 51397 - protein, 10 aa, Borrelia garinii
NLFSGEGAQA

SEQ ID NO: 51398 - protein, 10 aa, Borrelia garinii
IAVNIYAANV

SEQ ID NO: 51399 - protein, 11 aa, Borrelia garinii
SLSGSQASWTL

SEQ ID NO: 51400 - protein, 11 aa, Borrelia garinii
MLSNKSASQNV

SEQ ID NO: 51401 - protein, 11 aa, Borrelia garinii
AIAVNIYAANV

SEQ ID NO: 51402 - protein, 11 aa, Borrelia garinii
SQASWTLRVHV

SEQ ID NO: 51403 - protein, 11 aa, Borrelia garinii
GMQPAKINTPA

SEQ ID NO: 51404 - protein, 11 aa, Borrelia garinii
KVLVRMKELAV

SEQ ID NO: 51405 - protein, 11 aa, Borrelia garinii
SLAKIENAIRM

SEQ ID NO: 51406 - protein, 11 aa, Borrelia garinii
NLFSGEGAQAA

SEQ ID NO: 51407 - protein, 9 aa, Borrelia garinii
NQMHMLSNK

SEQ ID NO: 51408 - protein, 9 aa, Borrelia garinii
GSQASWTLR

SEQ ID NO: 51409 - protein, 10 aa, Borrelia garinii
TVDANTSLAK

SEQ ID NO: 51410 - protein, 10 aa, Borrelia garinii
YNQMHMLSNK

SEQ ID NO: 51411 - protein, 11 aa, Borrelia garinii
LSGSQASWTLR

SEQ ID NO: 51412 - protein, 11 aa, Borrelia garinii
TTVDANTSLAK

SEQ ID NO: 51413 - protein, 11 aa, Borrelia garinii
LSNKSASQNVR

SEQ ID NO: 51414 - protein, 9 aa, Borrelia garinii
NQMHMLSNK

SEQ ID NO: 51415 - protein, 9 aa, Borrelia garinii
GSQASWTLR

SEQ ID NO: 51416 - protein, 9 aa, Borrelia garinii
AVQSGNGTY

SEQ ID NO: 51417 - protein, 10 aa, Borrelia garinii
TVDANTSLAK

SEQ ID NO: 51418 - protein, 10 aa, Borrelia garinii
YNQMHMLSNK

SEQ ID NO: 51419 - protein, 10 aa, Borrelia garinii
EVEKVLVRMK

SEQ ID NO: 51420 - protein, 11 aa, Borrelia garinii
TTVDANTSLAK

SEQ ID NO: 51421 - protein, 11 aa, Borrelia garinii
TTEGNLNEVEK

SEQ ID NO: 51422 - protein, 11 aa, Borrelia garinii
TAEELGMQPAK

SEQ ID NO: 51423 - protein, 11 aa, Borrelia garinii
TSLAKIENAIR

SEQ ID NO: 51424 - protein, 11 aa, Borrelia garinii
QYNQMHMLSNK

SEQ ID NO: 51425 - protein, 11 aa, Borrelia garinii
LSGSQASWTLR

SEQ ID NO: 51426 - protein, 11 aa, Borrelia garinii
LSNKSASQNVR

SEQ ID NO: 51427 - protein, 9 aa, Borrelia garinii
IYAANVANL

SEQ ID NO: 51428 - protein, 9 aa, Borrelia garinii
YAANVANLF

SEQ ID NO: 51429 - protein, 10 aa, Borrelia garinii
IYAANVANLF

SEQ ID NO: 51430 - protein, 10 aa, Borrelia garinii
TYSDADRGSI

SEQ ID NO: 51431 - protein, 11 aa, Borrelia garinii
IYAANVANLFS

SEQ ID NO: 51432 - protein, 9 aa, Borrelia garinii
AVQSGNGTY

SEQ ID NO: 51433 - protein, 9 aa, Borrelia garinii
YAANVANLF

SEQ ID NO: 51434 - protein, 11 aa, Borrelia garinii
ELAVQSGNGTY

SEQ ID NO: 51435 - protein, 11 aa, Borrelia garinii
EINRIADQAQY

SEQ ID NO: 51436 - protein, 9 aa, Borrelia garinii
LAKIENAIR

SEQ ID NO: 51437 - protein, 9 aa, Borrelia garinii
EGNLNEVEK

SEQ ID NO: 51438 - protein, 9 aa, Borrelia garinii
YAANVANLF

SEQ ID NO: 51439 - protein, 9 aa, Borrelia garinii
NGTYSDADR

SEQ ID NO: 51440 - protein, 9 aa, Borrelia garinii
GSQASWTLR

SEQ ID NO: 51441 - protein, 9 aa, Borrelia garinii
NQMHMLSNK

SEQ ID NO: 51442 - protein, 9 aa, Borrelia garinii
TSKAINFIQ

SEQ ID NO: 51443 - protein, 9 aa, Borrelia garinii
NKSASQNVR

SEQ ID NO: 51444 - protein, 10 aa, Borrelia garinii
EVEKVLVRMK

SEQ ID NO: 51445 - protein, 10 aa, Borrelia garinii
SLAKIENAIR

SEQ ID NO: 51446 - protein, 10 aa, Borrelia garinii
TVDANTSLAK

SEQ ID NO: 51447 - protein, 10 aa, Borrelia garinii
NTSKAINFIQ

SEQ ID NO: 51448 - protein, 10 aa, Borrelia garinii
SGSQASWTLR

SEQ ID NO: 51449 - protein, 10 aa, Borrelia garinii
TTVDANTSLA

SEQ ID NO: 51450 - protein, 11 aa, Borrelia garinii
TTVDANTSLAK

SEQ ID NO: 51451 - protein, 11 aa, Borrelia garinii
TTEGNLNEVEK

SEQ ID NO: 51452 - protein, 11 aa, Borrelia garinii
EIEQLTDEINR

SEQ ID NO: 51453 - protein, 11 aa, Borrelia garinii
LSNKSASQNVR

SEQ ID NO: 51454 - protein, 11 aa, Borrelia garinii
TSLAKIENAIR

SEQ ID NO: 51455 - protein, 11 aa, Borrelia garinii
EINRIADQAQY

SEQ ID NO: 51456 - protein, 11 aa, Borrelia garinii
NLNEVEKVLVR

SEQ ID NO: 51457 - protein, 11 aa, Borrelia garinii
LSGSQASWTLR

SEQ ID NO: 51458 - protein, 11 aa, Borrelia garinii
TAEELGMQPAK

SEQ ID NO: 51459 - protein, 11 aa, Borrelia garinii
QYNQMHMLSNK

SEQ ID NO: 51460 - protein, 11 aa, Borrelia garinii
NIYAANVANLF

SEQ ID NO: 51461 - protein, 11 aa, Borrelia garinii
QTAPVQEGVQQ

SEQ ID NO: 51462 - protein, 9 aa, Borrelia garinii
SPVNVTTTV

SEQ ID NO: 51463 - protein, 9 aa, Borrelia garinii
QPAKINTPA

SEQ ID NO: 51464 - protein, 9 aa, Borrelia garinii
QPAPATAPS

SEQ ID NO: 51465 - protein, 9 aa, Borrelia garinii
LVRMKELAV

SEQ ID NO: 51466 - protein, 9 aa, Borrelia garinii
TPASLSGSQ

SEQ ID NO: 51467 - protein, 9 aa, Borrelia garinii
APSQGGVNS

SEQ ID NO: 51468 - protein, 9 aa, Borrelia garinii
APATAPSQG

SEQ ID NO: 51469 - protein, 9 aa, Borrelia garinii
APVQEGVQQ

SEQ ID NO: 51470 - protein, 10 aa, Borrelia garinii
TPASLSGSQA

SEQ ID NO: 51471 - protein, 10 aa, Borrelia garinii
SPVNVTTTVD

SEQ ID NO: 51472 - protein, 10 aa, Borrelia garinii
APSQGGVNSP

SEQ ID NO: 51473 - protein, 10 aa, Borrelia garinii
QPAKINTPAS

SEQ ID NO: 51474 - protein, 11 aa, Borrelia garinii
APSQGGVNSPV

SEQ ID NO: 51475 - protein, 11 aa, Borrelia garinii
QPAKINTPASL

SEQ ID NO: 51476 - protein, 11 aa, Borrelia garinii
APATAPSQGGV

SEQ ID NO: 51477 - protein, 11 aa, Borrelia garinii
SPVNVTTTVDA

SEQ ID NO: 51478 - protein, 11 aa, Borrelia garinii
TPASLSGSQAS

SEQ ID NO: 51479 - protein, 9 aa, Borrelia garinii
KVLVRMKEL

SEQ ID NO: 51480 - protein, 11 aa, Borrelia garinii
VEKVLVRMKEL

SEQ ID NO: 51481 - protein, 9 aa, Borrelia garinii
YAANVANLF

SEQ ID NO: 51482 - protein, 9 aa, Borrelia garinii
AVQSGNGTY

SEQ ID NO: 51483 - protein, 9 aa, Borrelia garinii
AQAAQTAPV

SEQ ID NO: 51484 - protein, 9 aa, Borrelia garinii
AQYNQMHML

SEQ ID NO: 51485 - protein, 9 aa, Borrelia garinii
SQGGVNSPV

SEQ ID NO: 51486 - protein, 9 aa, Borrelia garinii
SLSGSQASW

SEQ ID NO: 51487 - protein, 9 aa, Borrelia garinii
SQASWTLRV

SEQ ID NO: 51488 - protein, 9 aa, Borrelia garinii
IQIEIEQLT

SEQ ID NO: 51489 - protein, 10 aa, Borrelia garinii
LAVQSGNGTY

SEQ ID NO: 51490 - protein, 10 aa, Borrelia garinii
SQASWTLRVH

SEQ ID NO: 51491 - protein, 10 aa, Borrelia garinii
SQNVRTAEEL

SEQ ID NO: 51492 - protein, 10 aa, Borrelia garinii
VQQEGAQQPA

SEQ ID NO: 51493 - protein, 10 aa, Borrelia garinii
INRIADQAQY

SEQ ID NO: 51494 - protein, 10 aa, Borrelia garinii
AQAAQTAPVQ

SEQ ID NO: 51495 - protein, 10 aa, Borrelia garinii
MQPAKINTPA

SEQ ID NO: 51496 - protein, 11 aa, Borrelia garinii
ELAVQSGNGTY

SEQ ID NO: 51497 - protein, 11 aa, Borrelia garinii
NIYAANVANLF

SEQ ID NO: 51498 - protein, 11 aa, Borrelia garinii
NQDEAIAVNIY

SEQ ID NO: 51499 - protein, 11 aa, Borrelia garinii
SLSGSQASWTL

SEQ ID NO: 51500 - protein, 9 aa, Borrelia garinii
NRIADQAQY

SEQ ID NO: 51501 - protein, 9 aa, Borrelia garinii
YAANVANLF

SEQ ID NO: 51502 - protein, 9 aa, Borrelia garinii
QPAPATAPS

SEQ ID NO: 51503 - protein, 9 aa, Borrelia garinii
SPVNVTTTV

SEQ ID NO: 51504 - protein, 9 aa, Borrelia garinii
DEAIAVNIY

SEQ ID NO: 51505 - protein, 9 aa, Borrelia garinii
TTVDANTSL

SEQ ID NO: 51506 - protein, 9 aa, Borrelia garinii
LAVQSGNGT

SEQ ID NO: 51507 - protein, 9 aa, Borrelia garinii
QPAKINTPA

SEQ ID NO: 51508 - protein, 9 aa, Borrelia garinii
AVQSGNGTY

SEQ ID NO: 51509 - protein, 9 aa, Borrelia garinii
QASWTLRVH

SEQ ID NO: 51510 - protein, 9 aa, Borrelia garinii
IAVNIYAAN

SEQ ID NO: 51511 - protein, 10 aa, Borrelia garinii
LAVQSGNGTY

SEQ ID NO: 51512 - protein, 10 aa, Borrelia garinii
IADQAQYNQM

SEQ ID NO: 51513 - protein, 10 aa, Borrelia garinii
QPAKINTPAS

SEQ ID NO: 51514 - protein, 10 aa, Borrelia garinii
LAKIENAIRM

SEQ ID NO: 51515 - protein, 10 aa, Borrelia garinii
QPAPATAPSQ

SEQ ID NO: 51516 - protein, 10 aa, Borrelia garinii
YAANVANLFS

SEQ ID NO: 51517 - protein, 10 aa, Borrelia garinii
TAEELGMQPA

SEQ ID NO: 51518 - protein, 10 aa, Borrelia garinii
EAIAVNIYAA

SEQ ID NO: 51519 - protein, 10 aa, Borrelia garinii
QAQYNQMHML

SEQ ID NO: 51520 - protein, 10 aa, Borrelia garinii
TPASLSGSQA

SEQ ID NO: 51521 - protein, 10 aa, Borrelia garinii
SPVNVTTTVD

SEQ ID NO: 51522 - protein, 11 aa, Borrelia garinii
TPASLSGSQAS

SEQ ID NO: 51523 - protein, 11 aa, Borrelia garinii
ELAVQSGNGTY

SEQ ID NO: 51524 - protein, 11 aa, Borrelia garinii
NQDEAIAVNIY

SEQ ID NO: 51525 - protein, 11 aa, Borrelia garinii
QPAKINTPASL

SEQ ID NO: 51526 - protein, 11 aa, Borrelia garinii
IAVNIYAANVA

SEQ ID NO: 51527 - protein, 11 aa, Borrelia garinii
NIYAANVANLF

SEQ ID NO: 51528 - protein, 11 aa, Borrelia garinii
SPVNVTTTVDA

SEQ ID NO: 51529 - protein, 11 aa, Borrelia garinii
EINRIADQAQY

SEQ ID NO: 51530 - protein, 11 aa, Borrelia garinii
IADQAQYNQMH

SEQ ID NO: 51531 - protein, 11 aa, Borrelia garinii
APSQGGVNSPV

SEQ ID NO: 51532 - protein, 11 aa, Borrelia garinii
LAVQSGNGTYS

SEQ ID NO: 51533 - protein, 10 aa, Borrelia garinii
EELGMQPAKI

SEQ ID NO: 51534 - protein, 10 aa, Borrelia garinii
NEVEKVLVRM

SEQ ID NO: 51535 - protein, 10 aa, Borrelia garinii
DEINRIADQA

SEQ ID NO: 51536 - protein, 11 aa, Borrelia garinii
DEINRIADQAQ

SEQ ID NO: 51537 - protein, 9 aa, Borrelia garinii
SPVNVTTTV

SEQ ID NO: 51538 - protein, 11 aa, Borrelia garinii
APATAPSQGGV

SEQ ID NO: 51539 - protein, 11 aa, Borrelia garinii
APSQGGVNSPV

SEQ ID NO: 51540 - protein, 10 aa, Borrelia garinii
ASLSGSQASW

SEQ ID NO: 51541 - protein, 8 aa, Mycobacterium tuberculosis
MAEMKTDA

SEQ ID NO: 51542 - protein, 8 aa, Mycobacterium tuberculosis
AEMKTDAA

SEQ ID NO: 51543 - protein, 8 aa, Mycobacterium tuberculosis
EMKTDAAT

SEQ ID NO: 51544 - protein, 8 aa, Mycobacterium tuberculosis
MKTDAATL

SEQ ID NO: 51545 - protein, 8 aa, Mycobacterium tuberculosis
KTDAATLA

SEQ ID NO: 51546 - protein, 8 aa, Mycobacterium tuberculosis
TDAATLAQ

SEQ ID NO: 51547 - protein, 8 aa, Mycobacterium tuberculosis
DAATLAQE

SEQ ID NO: 51548 - protein, 8 aa, Mycobacterium tuberculosis
AATLAQEA

SEQ ID NO: 51549 - protein, 8 aa, Mycobacterium tuberculosis
ATLAQEAG

SEQ ID NO: 51550 - protein, 8 aa, Mycobacterium tuberculosis
TLAQEAGN

SEQ ID NO: 51551 - protein, 8 aa, Mycobacterium tuberculosis
LAQEAGNF

SEQ ID NO: 51552 - protein, 8 aa, Mycobacterium tuberculosis
AQEAGNFE

SEQ ID NO: 51553 - protein, 8 aa, Mycobacterium tuberculosis
QEAGNFER

SEQ ID NO: 51554 - protein, 8 aa, Mycobacterium tuberculosis
EAGNFERI

SEQ ID NO: 51555 - protein, 8 aa, Mycobacterium tuberculosis
AGNFERIS

SEQ ID NO: 51556 - protein, 8 aa, Mycobacterium tuberculosis
GNFERISG

SEQ ID NO: 51557 - protein, 8 aa, Mycobacterium tuberculosis
NFERISGD

SEQ ID NO: 51558 - protein, 8 aa, Mycobacterium tuberculosis
FERISGDL

SEQ ID NO: 51559 - protein, 8 aa, Mycobacterium tuberculosis
ERISGDLK

SEQ ID NO: 51560 - protein, 8 aa, Mycobacterium tuberculosis
RISGDLKT

SEQ ID NO: 51561 - protein, 8 aa, Mycobacterium tuberculosis
ISGDLKTQ

SEQ ID NO: 51562 - protein, 8 aa, Mycobacterium tuberculosis
SGDLKTQI

SEQ ID NO: 51563 - protein, 8 aa, Mycobacterium tuberculosis
GDLKTQID

SEQ ID NO: 51564 - protein, 8 aa, Mycobacterium tuberculosis
DLKTQIDQ

SEQ ID NO: 51565 - protein, 8 aa, Mycobacterium tuberculosis
LKTQIDQV

SEQ ID NO: 51566 - protein, 8 aa, Mycobacterium tuberculosis
KTQIDQVE

SEQ ID NO: 51567 - protein, 8 aa, Mycobacterium tuberculosis
TQIDQVES

SEQ ID NO: 51568 - protein, 8 aa, Mycobacterium tuberculosis
QIDQVEST

SEQ ID NO: 51569 - protein, 8 aa, Mycobacterium tuberculosis
IDQVESTA

SEQ ID NO: 51570 - protein, 8 aa, Mycobacterium tuberculosis
DQVESTAG

SEQ ID NO: 51571 - protein, 8 aa, Mycobacterium tuberculosis
QVESTAGS

SEQ ID NO: 51572 - protein, 8 aa, Mycobacterium tuberculosis
VESTAGSL

SEQ ID NO: 51573 - protein, 8 aa, Mycobacterium tuberculosis
ESTAGSLQ

SEQ ID NO: 51574 - protein, 8 aa, Mycobacterium tuberculosis
STAGSLQG

SEQ ID NO: 51575 - protein, 8 aa, Mycobacterium tuberculosis
TAGSLQGQ

SEQ ID NO: 51576 - protein, 8 aa, Mycobacterium tuberculosis
AGSLQGQW

SEQ ID NO: 51577 - protein, 8 aa, Mycobacterium tuberculosis
GSLQGQWR

SEQ ID NO: 51578 - protein, 8 aa, Mycobacterium tuberculosis
SLQGQWRG

SEQ ID NO: 51579 - protein, 8 aa, Mycobacterium tuberculosis
LQGQWRGA

SEQ ID NO: 51580 - protein, 8 aa, Mycobacterium tuberculosis
QGQWRGAA

SEQ ID NO: 51581 - protein, 8 aa, Mycobacterium tuberculosis
GQWRGAAG

SEQ ID NO: 51582 - protein, 8 aa, Mycobacterium tuberculosis
QWRGAAGT

SEQ ID NO: 51583 - protein, 8 aa, Mycobacterium tuberculosis
WRGAAGTA

SEQ ID NO: 51584 - protein, 8 aa, Mycobacterium tuberculosis
RGAAGTAA

SEQ ID NO: 51585 - protein, 8 aa, Mycobacterium tuberculosis
GAAGTAAQ

SEQ ID NO: 51586 - protein, 8 aa, Mycobacterium tuberculosis
AAGTAAQA

SEQ ID NO: 51587 - protein, 8 aa, Mycobacterium tuberculosis
AGTAAQAA

SEQ ID NO: 51588 - protein, 8 aa, Mycobacterium tuberculosis
GTAAQAAV

SEQ ID NO: 51589 - protein, 8 aa, Mycobacterium tuberculosis
TAAQAAVV

SEQ ID NO: 51590 - protein, 8 aa, Mycobacterium tuberculosis
AAQAAVVR

SEQ ID NO: 51591 - protein, 8 aa, Mycobacterium tuberculosis
AQAAVVRF

SEQ ID NO: 51592 - protein, 8 aa, Mycobacterium tuberculosis
QAAVVRFQ

SEQ ID NO: 51593 - protein, 8 aa, Mycobacterium tuberculosis
AAVVRFQE

SEQ ID NO: 51594 - protein, 8 aa, Mycobacterium tuberculosis
AVVRFQEA

SEQ ID NO: 51595 - protein, 8 aa, Mycobacterium tuberculosis
VVRFQEAA

SEQ ID NO: 51596 - protein, 8 aa, Mycobacterium tuberculosis
VRFQEAAN

SEQ ID NO: 51597 - protein, 8 aa, Mycobacterium tuberculosis
RFQEAANK

SEQ ID NO: 51598 - protein, 8 aa, Mycobacterium tuberculosis
FQEAANKQ

SEQ ID NO: 51599 - protein, 8 aa, Mycobacterium tuberculosis
QEAANKQK

SEQ ID NO: 51600 - protein, 8 aa, Mycobacterium tuberculosis
EAANKQKQ

SEQ ID NO: 51601 - protein, 8 aa, Mycobacterium tuberculosis
AANKQKQE

SEQ ID NO: 51602 - protein, 8 aa, Mycobacterium tuberculosis
ANKQKQEL

SEQ ID NO: 51603 - protein, 8 aa, Mycobacterium tuberculosis
NKQKQELD

SEQ ID NO: 51604 - protein, 8 aa, Mycobacterium tuberculosis
KQKQELDE

SEQ ID NO: 51605 - protein, 8 aa, Mycobacterium tuberculosis
QKQELDEI

SEQ ID NO: 51606 - protein, 8 aa, Mycobacterium tuberculosis
KQELDEIS

SEQ ID NO: 51607 - protein, 8 aa, Mycobacterium tuberculosis
QELDEIST

SEQ ID NO: 51608 - protein, 8 aa, Mycobacterium tuberculosis
ELDEISTN

SEQ ID NO: 51609 - protein, 8 aa, Mycobacterium tuberculosis
LDEISTNI

SEQ ID NO: 51610 - protein, 8 aa, Mycobacterium tuberculosis
DEISTNIR

SEQ ID NO: 51611 - protein, 8 aa, Mycobacterium tuberculosis
EISTNIRQ

SEQ ID NO: 51612 - protein, 8 aa, Mycobacterium tuberculosis
ISTNIRQA

SEQ ID NO: 51613 - protein, 8 aa, Mycobacterium tuberculosis
STNIRQAG

SEQ ID NO: 51614 - protein, 8 aa, Mycobacterium tuberculosis
TNIRQAGV

SEQ ID NO: 51615 - protein, 8 aa, Mycobacterium tuberculosis
NIRQAGVQ

SEQ ID NO: 51616 - protein, 8 aa, Mycobacterium tuberculosis
IRQAGVQY

SEQ ID NO: 51617 - protein, 8 aa, Mycobacterium tuberculosis
RQAGVQYS

SEQ ID NO: 51618 - protein, 8 aa, Mycobacterium tuberculosis
QAGVQYSR

SEQ ID NO: 51619 - protein, 8 aa, Mycobacterium tuberculosis
AGVQYSRA

SEQ ID NO: 51620 - protein, 8 aa, Mycobacterium tuberculosis
GVQYSRAD

SEQ ID NO: 51621 - protein, 8 aa, Mycobacterium tuberculosis
VQYSRADE

SEQ ID NO: 51622 - protein, 8 aa, Mycobacterium tuberculosis
QYSRADEE

SEQ ID NO: 51623 - protein, 8 aa, Mycobacterium tuberculosis
YSRADEEQ

SEQ ID NO: 51624 - protein, 8 aa, Mycobacterium tuberculosis
SRADEEQQ

SEQ ID NO: 51625 - protein, 8 aa, Mycobacterium tuberculosis
RADEEQQQ

SEQ ID NO: 51626 - protein, 8 aa, Mycobacterium tuberculosis
ADEEQQQA

SEQ ID NO: 51627 - protein, 8 aa, Mycobacterium tuberculosis
DEEQQQAL

SEQ ID NO: 51628 - protein, 8 aa, Mycobacterium tuberculosis
EEQQQALS

SEQ ID NO: 51629 - protein, 8 aa, Mycobacterium tuberculosis
EQQQALSS

SEQ ID NO: 51630 - protein, 8 aa, Mycobacterium tuberculosis
QQQALSSQ

SEQ ID NO: 51631 - protein, 8 aa, Mycobacterium tuberculosis
QQALSSQM

SEQ ID NO: 51632 - protein, 8 aa, Mycobacterium tuberculosis
QALSSQMG

SEQ ID NO: 51633 - protein, 8 aa, Mycobacterium tuberculosis
ALSSQMGF

SEQ ID NO: 51634 - protein, 9 aa, Mycobacterium tuberculosis
MAEMKTDAA

SEQ ID NO: 51635 - protein, 9 aa, Mycobacterium tuberculosis
AEMKTDAAT

SEQ ID NO: 51636 - protein, 9 aa, Mycobacterium tuberculosis
EMKTDAATL

SEQ ID NO: 51637 - protein, 9 aa, Mycobacterium tuberculosis
MKTDAATLA

SEQ ID NO: 51638 - protein, 9 aa, Mycobacterium tuberculosis
KTDAATLAQ

SEQ ID NO: 51639 - protein, 9 aa, Mycobacterium tuberculosis
TDAATLAQE

SEQ ID NO: 51640 - protein, 9 aa, Mycobacterium tuberculosis
DAATLAQEA

SEQ ID NO: 51641 - protein, 9 aa, Mycobacterium tuberculosis
AATLAQEAG

SEQ ID NO: 51642 - protein, 9 aa, Mycobacterium tuberculosis
ATLAQEAGN

SEQ ID NO: 51643 - protein, 9 aa, Mycobacterium tuberculosis
TLAQEAGNF

SEQ ID NO: 51644 - protein, 9 aa, Mycobacterium tuberculosis
LAQEAGNFE

SEQ ID NO: 51645 - protein, 9 aa, Mycobacterium tuberculosis
AQEAGNFER

SEQ ID NO: 51646 - protein, 9 aa, Mycobacterium tuberculosis
QEAGNFERI

SEQ ID NO: 51647 - protein, 9 aa, Mycobacterium tuberculosis
EAGNFERIS

SEQ ID NO: 51648 - protein, 9 aa, Mycobacterium tuberculosis
AGNFERISG

SEQ ID NO: 51649 - protein, 9 aa, Mycobacterium tuberculosis
GNFERISGD

SEQ ID NO: 51650 - protein, 9 aa, Mycobacterium tuberculosis
NFERISGDL

SEQ ID NO: 51651 - protein, 9 aa, Mycobacterium tuberculosis
FERISGDLK

SEQ ID NO: 51652 - protein, 9 aa, Mycobacterium tuberculosis
ERISGDLKT

SEQ ID NO: 51653 - protein, 9 aa, Mycobacterium tuberculosis
RISGDLKTQ

SEQ ID NO: 51654 - protein, 9 aa, Mycobacterium tuberculosis
ISGDLKTQI

SEQ ID NO: 51655 - protein, 9 aa, Mycobacterium tuberculosis
SGDLKTQID

SEQ ID NO: 51656 - protein, 9 aa, Mycobacterium tuberculosis
GDLKTQIDQ

SEQ ID NO: 51657 - protein, 9 aa, Mycobacterium tuberculosis
DLKTQIDQV

SEQ ID NO: 51658 - protein, 9 aa, Mycobacterium tuberculosis
LKTQIDQVE

SEQ ID NO: 51659 - protein, 9 aa, Mycobacterium tuberculosis
KTQIDQVES

SEQ ID NO: 51660 - protein, 9 aa, Mycobacterium tuberculosis
TQIDQVEST

SEQ ID NO: 51661 - protein, 9 aa, Mycobacterium tuberculosis
QIDQVESTA

SEQ ID NO: 51662 - protein, 9 aa, Mycobacterium tuberculosis
IDQVESTAG

SEQ ID NO: 51663 - protein, 9 aa, Mycobacterium tuberculosis
DQVESTAGS

SEQ ID NO: 51664 - protein, 9 aa, Mycobacterium tuberculosis
QVESTAGSL

SEQ ID NO: 51665 - protein, 9 aa, Mycobacterium tuberculosis
VESTAGSLQ

SEQ ID NO: 51666 - protein, 9 aa, Mycobacterium tuberculosis
ESTAGSLQG

SEQ ID NO: 51667 - protein, 9 aa, Mycobacterium tuberculosis
STAGSLQGQ

SEQ ID NO: 51668 - protein, 9 aa, Mycobacterium tuberculosis
TAGSLQGQW

SEQ ID NO: 51669 - protein, 9 aa, Mycobacterium tuberculosis
AGSLQGQWR

SEQ ID NO: 51670 - protein, 9 aa, Mycobacterium tuberculosis
GSLQGQWRG

SEQ ID NO: 51671 - protein, 9 aa, Mycobacterium tuberculosis
SLQGQWRGA

SEQ ID NO: 51672 - protein, 9 aa, Mycobacterium tuberculosis
LQGQWRGAA

SEQ ID NO: 51673 - protein, 9 aa, Mycobacterium tuberculosis
QGQWRGAAG

SEQ ID NO: 51674 - protein, 9 aa, Mycobacterium tuberculosis
GQWRGAAGT

SEQ ID NO: 51675 - protein, 9 aa, Mycobacterium tuberculosis
QWRGAAGTA

SEQ ID NO: 51676 - protein, 9 aa, Mycobacterium tuberculosis
WRGAAGTAA

SEQ ID NO: 51677 - protein, 9 aa, Mycobacterium tuberculosis
RGAAGTAAQ

SEQ ID NO: 51678 - protein, 9 aa, Mycobacterium tuberculosis
GAAGTAAQA

SEQ ID NO: 51679 - protein, 9 aa, Mycobacterium tuberculosis
AAGTAAQAA

SEQ ID NO: 51680 - protein, 9 aa, Mycobacterium tuberculosis
AGTAAQAAV

SEQ ID NO: 51681 - protein, 9 aa, Mycobacterium tuberculosis
GTAAQAAVV

SEQ ID NO: 51682 - protein, 9 aa, Mycobacterium tuberculosis
TAAQAAVVR

SEQ ID NO: 51683 - protein, 9 aa, Mycobacterium tuberculosis
AAQAAVVRF

SEQ ID NO: 51684 - protein, 9 aa, Mycobacterium tuberculosis
AQAAVVRFQ

SEQ ID NO: 51685 - protein, 9 aa, Mycobacterium tuberculosis
QAAVVRFQE

SEQ ID NO: 51686 - protein, 9 aa, Mycobacterium tuberculosis
AAVVRFQEA

SEQ ID NO: 51687 - protein, 9 aa, Mycobacterium tuberculosis
AVVRFQEAA

SEQ ID NO: 51688 - protein, 9 aa, Mycobacterium tuberculosis
VVRFQEAAN

SEQ ID NO: 51689 - protein, 9 aa, Mycobacterium tuberculosis
VRFQEAANK

SEQ ID NO: 51690 - protein, 9 aa, Mycobacterium tuberculosis
RFQEAANKQ

SEQ ID NO: 51691 - protein, 9 aa, Mycobacterium tuberculosis
FQEAANKQK

SEQ ID NO: 51692 - protein, 9 aa, Mycobacterium tuberculosis
QEAANKQKQ

SEQ ID NO: 51693 - protein, 9 aa, Mycobacterium tuberculosis
EAANKQKQE

SEQ ID NO: 51694 - protein, 9 aa, Mycobacterium tuberculosis
AANKQKQEL

SEQ ID NO: 51695 - protein, 9 aa, Mycobacterium tuberculosis
ANKQKQELD

SEQ ID NO: 51696 - protein, 9 aa, Mycobacterium tuberculosis
NKQKQELDE

SEQ ID NO: 51697 - protein, 9 aa, Mycobacterium tuberculosis
KQKQELDEI

SEQ ID NO: 51698 - protein, 9 aa, Mycobacterium tuberculosis
QKQELDEIS

SEQ ID NO: 51699 - protein, 9 aa, Mycobacterium tuberculosis
KQELDEIST

SEQ ID NO: 51700 - protein, 9 aa, Mycobacterium tuberculosis
QELDEISTN

SEQ ID NO: 51701 - protein, 9 aa, Mycobacterium tuberculosis
ELDEISTNI

SEQ ID NO: 51702 - protein, 9 aa, Mycobacterium tuberculosis
LDEISTNIR

SEQ ID NO: 51703 - protein, 9 aa, Mycobacterium tuberculosis
DEISTNIRQ

SEQ ID NO: 51704 - protein, 9 aa, Mycobacterium tuberculosis
EISTNIRQA

SEQ ID NO: 51705 - protein, 9 aa, Mycobacterium tuberculosis
ISTNIRQAG

SEQ ID NO: 51706 - protein, 9 aa, Mycobacterium tuberculosis
STNIRQAGV

SEQ ID NO: 51707 - protein, 9 aa, Mycobacterium tuberculosis
TNIRQAGVQ

SEQ ID NO: 51708 - protein, 9 aa, Mycobacterium tuberculosis
NIRQAGVQY

SEQ ID NO: 51709 - protein, 9 aa, Mycobacterium tuberculosis
IRQAGVQYS

SEQ ID NO: 51710 - protein, 9 aa, Mycobacterium tuberculosis
RQAGVQYSR

SEQ ID NO: 51711 - protein, 9 aa, Mycobacterium tuberculosis
QAGVQYSRA

SEQ ID NO: 51712 - protein, 9 aa, Mycobacterium tuberculosis
AGVQYSRAD

SEQ ID NO: 51713 - protein, 9 aa, Mycobacterium tuberculosis
GVQYSRADE

SEQ ID NO: 51714 - protein, 9 aa, Mycobacterium tuberculosis
VQYSRADEE

SEQ ID NO: 51715 - protein, 9 aa, Mycobacterium tuberculosis
QYSRADEEQ

SEQ ID NO: 51716 - protein, 9 aa, Mycobacterium tuberculosis
YSRADEEQQ

SEQ ID NO: 51717 - protein, 9 aa, Mycobacterium tuberculosis
SRADEEQQQ

SEQ ID NO: 51718 - protein, 9 aa, Mycobacterium tuberculosis
RADEEQQQA

SEQ ID NO: 51719 - protein, 9 aa, Mycobacterium tuberculosis
ADEEQQQAL

SEQ ID NO: 51720 - protein, 9 aa, Mycobacterium tuberculosis
DEEQQQALS

SEQ ID NO: 51721 - protein, 9 aa, Mycobacterium tuberculosis
EEQQQALSS

SEQ ID NO: 51722 - protein, 9 aa, Mycobacterium tuberculosis
EQQQALSSQ

SEQ ID NO: 51723 - protein, 9 aa, Mycobacterium tuberculosis
QQQALSSQM

SEQ ID NO: 51724 - protein, 9 aa, Mycobacterium tuberculosis
QQALSSQMG

SEQ ID NO: 51725 - protein, 9 aa, Mycobacterium tuberculosis
QALSSQMGF

SEQ ID NO: 51726 - protein, 10 aa, Mycobacterium tuberculosis
MAEMKTDAAT

SEQ ID NO: 51727 - protein, 10 aa, Mycobacterium tuberculosis
AEMKTDAATL

SEQ ID NO: 51728 - protein, 10 aa, Mycobacterium tuberculosis
EMKTDAATLA

SEQ ID NO: 51729 - protein, 10 aa, Mycobacterium tuberculosis
MKTDAATLAQ

SEQ ID NO: 51730 - protein, 10 aa, Mycobacterium tuberculosis
KTDAATLAQE

SEQ ID NO: 51731 - protein, 10 aa, Mycobacterium tuberculosis
TDAATLAQEA

SEQ ID NO: 51732 - protein, 10 aa, Mycobacterium tuberculosis
DAATLAQEAG

SEQ ID NO: 51733 - protein, 10 aa, Mycobacterium tuberculosis
AATLAQEAGN

SEQ ID NO: 51734 - protein, 10 aa, Mycobacterium tuberculosis
ATLAQEAGNF

SEQ ID NO: 51735 - protein, 10 aa, Mycobacterium tuberculosis
TLAQEAGNFE

SEQ ID NO: 51736 - protein, 10 aa, Mycobacterium tuberculosis
LAQEAGNFER

SEQ ID NO: 51737 - protein, 10 aa, Mycobacterium tuberculosis
AQEAGNFERI

SEQ ID NO: 51738 - protein, 10 aa, Mycobacterium tuberculosis
QEAGNFERIS

SEQ ID NO: 51739 - protein, 10 aa, Mycobacterium tuberculosis
EAGNFERISG

SEQ ID NO: 51740 - protein, 10 aa, Mycobacterium tuberculosis
AGNFERISGD

SEQ ID NO: 51741 - protein, 10 aa, Mycobacterium tuberculosis
GNFERISGDL

SEQ ID NO: 51742 - protein, 10 aa, Mycobacterium tuberculosis
NFERISGDLK

SEQ ID NO: 51743 - protein, 10 aa, Mycobacterium tuberculosis
FERISGDLKT

SEQ ID NO: 51744 - protein, 10 aa, Mycobacterium tuberculosis
ERISGDLKTQ

SEQ ID NO: 51745 - protein, 10 aa, Mycobacterium tuberculosis
RISGDLKTQI

SEQ ID NO: 51746 - protein, 10 aa, Mycobacterium tuberculosis
ISGDLKTQID

SEQ ID NO: 51747 - protein, 10 aa, Mycobacterium tuberculosis
SGDLKTQIDQ

SEQ ID NO: 51748 - protein, 10 aa, Mycobacterium tuberculosis
GDLKTQIDQV

SEQ ID NO: 51749 - protein, 10 aa, Mycobacterium tuberculosis
DLKTQIDQVE

SEQ ID NO: 51750 - protein, 10 aa, Mycobacterium tuberculosis
LKTQIDQVES

SEQ ID NO: 51751 - protein, 10 aa, Mycobacterium tuberculosis
KTQIDQVEST

SEQ ID NO: 51752 - protein, 10 aa, Mycobacterium tuberculosis
TQIDQVESTA

SEQ ID NO: 51753 - protein, 10 aa, Mycobacterium tuberculosis
QIDQVESTAG

SEQ ID NO: 51754 - protein, 10 aa, Mycobacterium tuberculosis
IDQVESTAGS

SEQ ID NO: 51755 - protein, 10 aa, Mycobacterium tuberculosis
DQVESTAGSL

SEQ ID NO: 51756 - protein, 10 aa, Mycobacterium tuberculosis
QVESTAGSLQ

SEQ ID NO: 51757 - protein, 10 aa, Mycobacterium tuberculosis
VESTAGSLQG

SEQ ID NO: 51758 - protein, 10 aa, Mycobacterium tuberculosis
ESTAGSLQGQ

SEQ ID NO: 51759 - protein, 10 aa, Mycobacterium tuberculosis
STAGSLQGQW

SEQ ID NO: 51760 - protein, 10 aa, Mycobacterium tuberculosis
TAGSLQGQWR

SEQ ID NO: 51761 - protein, 10 aa, Mycobacterium tuberculosis
AGSLQGQWRG

SEQ ID NO: 51762 - protein, 10 aa, Mycobacterium tuberculosis
GSLQGQWRGA

SEQ ID NO: 51763 - protein, 10 aa, Mycobacterium tuberculosis
SLQGQWRGAA

SEQ ID NO: 51764 - protein, 10 aa, Mycobacterium tuberculosis
LQGQWRGAAG

SEQ ID NO: 51765 - protein, 10 aa, Mycobacterium tuberculosis
QGQWRGAAGT

SEQ ID NO: 51766 - protein, 10 aa, Mycobacterium tuberculosis
GQWRGAAGTA

SEQ ID NO: 51767 - protein, 10 aa, Mycobacterium tuberculosis
QWRGAAGTAA

SEQ ID NO: 51768 - protein, 10 aa, Mycobacterium tuberculosis
WRGAAGTAAQ

SEQ ID NO: 51769 - protein, 10 aa, Mycobacterium tuberculosis
RGAAGTAAQA

SEQ ID NO: 51770 - protein, 10 aa, Mycobacterium tuberculosis
GAAGTAAQAA

SEQ ID NO: 51771 - protein, 10 aa, Mycobacterium tuberculosis
AAGTAAQAAV

SEQ ID NO: 51772 - protein, 10 aa, Mycobacterium tuberculosis
AGTAAQAAVV

SEQ ID NO: 51773 - protein, 10 aa, Mycobacterium tuberculosis
GTAAQAAVVR

SEQ ID NO: 51774 - protein, 10 aa, Mycobacterium tuberculosis
TAAQAAVVRF

SEQ ID NO: 51775 - protein, 10 aa, Mycobacterium tuberculosis
AAQAAVVRFQ

SEQ ID NO: 51776 - protein, 10 aa, Mycobacterium tuberculosis
AQAAVVRFQE

SEQ ID NO: 51777 - protein, 10 aa, Mycobacterium tuberculosis
QAAVVRFQEA

SEQ ID NO: 51778 - protein, 10 aa, Mycobacterium tuberculosis
AAVVRFQEAA

SEQ ID NO: 51779 - protein, 10 aa, Mycobacterium tuberculosis
AVVRFQEAAN

SEQ ID NO: 51780 - protein, 10 aa, Mycobacterium tuberculosis
VVRFQEAANK

SEQ ID NO: 51781 - protein, 10 aa, Mycobacterium tuberculosis
VRFQEAANKQ

SEQ ID NO: 51782 - protein, 10 aa, Mycobacterium tuberculosis
RFQEAANKQK

SEQ ID NO: 51783 - protein, 10 aa, Mycobacterium tuberculosis
FQEAANKQKQ

SEQ ID NO: 51784 - protein, 10 aa, Mycobacterium tuberculosis
QEAANKQKQE

SEQ ID NO: 51785 - protein, 10 aa, Mycobacterium tuberculosis
EAANKQKQEL

SEQ ID NO: 51786 - protein, 10 aa, Mycobacterium tuberculosis
AANKQKQELD

SEQ ID NO: 51787 - protein, 10 aa, Mycobacterium tuberculosis
ANKQKQELDE

SEQ ID NO: 51788 - protein, 10 aa, Mycobacterium tuberculosis
NKQKQELDEI

SEQ ID NO: 51789 - protein, 10 aa, Mycobacterium tuberculosis
KQKQELDEIS

SEQ ID NO: 51790 - protein, 10 aa, Mycobacterium tuberculosis
QKQELDEIST

SEQ ID NO: 51791 - protein, 10 aa, Mycobacterium tuberculosis
KQELDEISTN

SEQ ID NO: 51792 - protein, 10 aa, Mycobacterium tuberculosis
QELDEISTNI

SEQ ID NO: 51793 - protein, 10 aa, Mycobacterium tuberculosis
ELDEISTNIR

SEQ ID NO: 51794 - protein, 10 aa, Mycobacterium tuberculosis
LDEISTNIRQ

SEQ ID NO: 51795 - protein, 10 aa, Mycobacterium tuberculosis
DEISTNIRQA

SEQ ID NO: 51796 - protein, 10 aa, Mycobacterium tuberculosis
EISTNIRQAG

SEQ ID NO: 51797 - protein, 10 aa, Mycobacterium tuberculosis
ISTNIRQAGV

SEQ ID NO: 51798 - protein, 10 aa, Mycobacterium tuberculosis
STNIRQAGVQ

SEQ ID NO: 51799 - protein, 10 aa, Mycobacterium tuberculosis
TNIRQAGVQY

SEQ ID NO: 51800 - protein, 10 aa, Mycobacterium tuberculosis
NIRQAGVQYS

SEQ ID NO: 51801 - protein, 10 aa, Mycobacterium tuberculosis
IRQAGVQYSR

SEQ ID NO: 51802 - protein, 10 aa, Mycobacterium tuberculosis
RQAGVQYSRA

SEQ ID NO: 51803 - protein, 10 aa, Mycobacterium tuberculosis
QAGVQYSRAD

SEQ ID NO: 51804 - protein, 10 aa, Mycobacterium tuberculosis
AGVQYSRADE

SEQ ID NO: 51805 - protein, 10 aa, Mycobacterium tuberculosis
GVQYSRADEE

SEQ ID NO: 51806 - protein, 10 aa, Mycobacterium tuberculosis
VQYSRADEEQ

SEQ ID NO: 51807 - protein, 10 aa, Mycobacterium tuberculosis
QYSRADEEQQ

SEQ ID NO: 51808 - protein, 10 aa, Mycobacterium tuberculosis
YSRADEEQQQ

SEQ ID NO: 51809 - protein, 10 aa, Mycobacterium tuberculosis
SRADEEQQQA

SEQ ID NO: 51810 - protein, 10 aa, Mycobacterium tuberculosis
RADEEQQQAL

SEQ ID NO: 51811 - protein, 10 aa, Mycobacterium tuberculosis
ADEEQQQALS

SEQ ID NO: 51812 - protein, 10 aa, Mycobacterium tuberculosis
DEEQQQALSS

SEQ ID NO: 51813 - protein, 10 aa, Mycobacterium tuberculosis
EEQQQALSSQ

SEQ ID NO: 51814 - protein, 10 aa, Mycobacterium tuberculosis
EQQQALSSQM

SEQ ID NO: 51815 - protein, 10 aa, Mycobacterium tuberculosis
QQQALSSQMG

SEQ ID NO: 51816 - protein, 10 aa, Mycobacterium tuberculosis
QQALSSQMGF

SEQ ID NO: 51817 - protein, 11 aa, Mycobacterium tuberculosis
MAEMKTDAATL

SEQ ID NO: 51818 - protein, 11 aa, Mycobacterium tuberculosis
AEMKTDAATLA

SEQ ID NO: 51819 - protein, 11 aa, Mycobacterium tuberculosis
EMKTDAATLAQ

SEQ ID NO: 51820 - protein, 11 aa, Mycobacterium tuberculosis
MKTDAATLAQE

SEQ ID NO: 51821 - protein, 11 aa, Mycobacterium tuberculosis
KTDAATLAQEA

SEQ ID NO: 51822 - protein, 11 aa, Mycobacterium tuberculosis
TDAATLAQEAG

SEQ ID NO: 51823 - protein, 11 aa, Mycobacterium tuberculosis
DAATLAQEAGN

SEQ ID NO: 51824 - protein, 11 aa, Mycobacterium tuberculosis
AATLAQEAGNF

SEQ ID NO: 51825 - protein, 11 aa, Mycobacterium tuberculosis
ATLAQEAGNFE

SEQ ID NO: 51826 - protein, 11 aa, Mycobacterium tuberculosis
TLAQEAGNFER

SEQ ID NO: 51827 - protein, 11 aa, Mycobacterium tuberculosis
LAQEAGNFERI

SEQ ID NO: 51828 - protein, 11 aa, Mycobacterium tuberculosis
AQEAGNFERIS

SEQ ID NO: 51829 - protein, 11 aa, Mycobacterium tuberculosis
QEAGNFERISG

SEQ ID NO: 51830 - protein, 11 aa, Mycobacterium tuberculosis
EAGNFERISGD

SEQ ID NO: 51831 - protein, 11 aa, Mycobacterium tuberculosis
AGNFERISGDL

SEQ ID NO: 51832 - protein, 11 aa, Mycobacterium tuberculosis
GNFERISGDLK

SEQ ID NO: 51833 - protein, 11 aa, Mycobacterium tuberculosis
NFERISGDLKT

SEQ ID NO: 51834 - protein, 11 aa, Mycobacterium tuberculosis
FERISGDLKTQ

SEQ ID NO: 51835 - protein, 11 aa, Mycobacterium tuberculosis
ERISGDLKTQI

SEQ ID NO: 51836 - protein, 11 aa, Mycobacterium tuberculosis
RISGDLKTQID

SEQ ID NO: 51837 - protein, 11 aa, Mycobacterium tuberculosis
ISGDLKTQIDQ

SEQ ID NO: 51838 - protein, 11 aa, Mycobacterium tuberculosis
SGDLKTQIDQV

SEQ ID NO: 51839 - protein, 11 aa, Mycobacterium tuberculosis
GDLKTQIDQVE

SEQ ID NO: 51840 - protein, 11 aa, Mycobacterium tuberculosis
DLKTQIDQVES

SEQ ID NO: 51841 - protein, 11 aa, Mycobacterium tuberculosis
LKTQIDQVEST

SEQ ID NO: 51842 - protein, 11 aa, Mycobacterium tuberculosis
KTQIDQVESTA

SEQ ID NO: 51843 - protein, 11 aa, Mycobacterium tuberculosis
TQIDQVESTAG

SEQ ID NO: 51844 - protein, 11 aa, Mycobacterium tuberculosis
QIDQVESTAGS

SEQ ID NO: 51845 - protein, 11 aa, Mycobacterium tuberculosis
IDQVESTAGSL

SEQ ID NO: 51846 - protein, 11 aa, Mycobacterium tuberculosis
DQVESTAGSLQ

SEQ ID NO: 51847 - protein, 11 aa, Mycobacterium tuberculosis
QVESTAGSLQG

SEQ ID NO: 51848 - protein, 11 aa, Mycobacterium tuberculosis
VESTAGSLQGQ

SEQ ID NO: 51849 - protein, 11 aa, Mycobacterium tuberculosis
ESTAGSLQGQW

SEQ ID NO: 51850 - protein, 11 aa, Mycobacterium tuberculosis
STAGSLQGQWR

SEQ ID NO: 51851 - protein, 11 aa, Mycobacterium tuberculosis
TAGSLQGQWRG

SEQ ID NO: 51852 - protein, 11 aa, Mycobacterium tuberculosis
AGSLQGQWRGA

SEQ ID NO: 51853 - protein, 11 aa, Mycobacterium tuberculosis
GSLQGQWRGAA

SEQ ID NO: 51854 - protein, 11 aa, Mycobacterium tuberculosis
SLQGQWRGAAG

SEQ ID NO: 51855 - protein, 11 aa, Mycobacterium tuberculosis
LQGQWRGAAGT

SEQ ID NO: 51856 - protein, 11 aa, Mycobacterium tuberculosis
QGQWRGAAGTA

SEQ ID NO: 51857 - protein, 11 aa, Mycobacterium tuberculosis
GQWRGAAGTAA

SEQ ID NO: 51858 - protein, 11 aa, Mycobacterium tuberculosis
QWRGAAGTAAQ

SEQ ID NO: 51859 - protein, 11 aa, Mycobacterium tuberculosis
WRGAAGTAAQA

SEQ ID NO: 51860 - protein, 11 aa, Mycobacterium tuberculosis
RGAAGTAAQAA

SEQ ID NO: 51861 - protein, 11 aa, Mycobacterium tuberculosis
GAAGTAAQAAV

SEQ ID NO: 51862 - protein, 11 aa, Mycobacterium tuberculosis
AAGTAAQAAVV

SEQ ID NO: 51863 - protein, 11 aa, Mycobacterium tuberculosis
AGTAAQAAVVR

SEQ ID NO: 51864 - protein, 11 aa, Mycobacterium tuberculosis
GTAAQAAVVRF

SEQ ID NO: 51865 - protein, 11 aa, Mycobacterium tuberculosis
TAAQAAVVRFQ

SEQ ID NO: 51866 - protein, 11 aa, Mycobacterium tuberculosis
AAQAAVVRFQE

SEQ ID NO: 51867 - protein, 11 aa, Mycobacterium tuberculosis
AQAAVVRFQEA

SEQ ID NO: 51868 - protein, 11 aa, Mycobacterium tuberculosis
QAAVVRFQEAA

SEQ ID NO: 51869 - protein, 11 aa, Mycobacterium tuberculosis
AAVVRFQEAAN

SEQ ID NO: 51870 - protein, 11 aa, Mycobacterium tuberculosis
AVVRFQEAANK

SEQ ID NO: 51871 - protein, 11 aa, Mycobacterium tuberculosis
VVRFQEAANKQ

SEQ ID NO: 51872 - protein, 11 aa, Mycobacterium tuberculosis
VRFQEAANKQK

SEQ ID NO: 51873 - protein, 11 aa, Mycobacterium tuberculosis
RFQEAANKQKQ

SEQ ID NO: 51874 - protein, 11 aa, Mycobacterium tuberculosis
FQEAANKQKQE

SEQ ID NO: 51875 - protein, 11 aa, Mycobacterium tuberculosis
QEAANKQKQEL

SEQ ID NO: 51876 - protein, 11 aa, Mycobacterium tuberculosis
EAANKQKQELD

SEQ ID NO: 51877 - protein, 11 aa, Mycobacterium tuberculosis
AANKQKQELDE

SEQ ID NO: 51878 - protein, 11 aa, Mycobacterium tuberculosis
ANKQKQELDEI

SEQ ID NO: 51879 - protein, 11 aa, Mycobacterium tuberculosis
NKQKQELDEIS

SEQ ID NO: 51880 - protein, 11 aa, Mycobacterium tuberculosis
KQKQELDEIST

SEQ ID NO: 51881 - protein, 11 aa, Mycobacterium tuberculosis
QKQELDEISTN

SEQ ID NO: 51882 - protein, 11 aa, Mycobacterium tuberculosis
KQELDEISTNI

SEQ ID NO: 51883 - protein, 11 aa, Mycobacterium tuberculosis
QELDEISTNIR

SEQ ID NO: 51884 - protein, 11 aa, Mycobacterium tuberculosis
ELDEISTNIRQ

SEQ ID NO: 51885 - protein, 11 aa, Mycobacterium tuberculosis
LDEISTNIRQA

SEQ ID NO: 51886 - protein, 11 aa, Mycobacterium tuberculosis
DEISTNIRQAG

SEQ ID NO: 51887 - protein, 11 aa, Mycobacterium tuberculosis
EISTNIRQAGV

SEQ ID NO: 51888 - protein, 11 aa, Mycobacterium tuberculosis
ISTNIRQAGVQ

SEQ ID NO: 51889 - protein, 11 aa, Mycobacterium tuberculosis
STNIRQAGVQY

SEQ ID NO: 51890 - protein, 11 aa, Mycobacterium tuberculosis
TNIRQAGVQYS

SEQ ID NO: 51891 - protein, 11 aa, Mycobacterium tuberculosis
NIRQAGVQYSR

SEQ ID NO: 51892 - protein, 11 aa, Mycobacterium tuberculosis
IRQAGVQYSRA

SEQ ID NO: 51893 - protein, 11 aa, Mycobacterium tuberculosis
RQAGVQYSRAD

SEQ ID NO: 51894 - protein, 11 aa, Mycobacterium tuberculosis
QAGVQYSRADE

SEQ ID NO: 51895 - protein, 11 aa, Mycobacterium tuberculosis
AGVQYSRADEE

SEQ ID NO: 51896 - protein, 11 aa, Mycobacterium tuberculosis
GVQYSRADEEQ

SEQ ID NO: 51897 - protein, 11 aa, Mycobacterium tuberculosis
VQYSRADEEQQ

SEQ ID NO: 51898 - protein, 11 aa, Mycobacterium tuberculosis
QYSRADEEQQQ

SEQ ID NO: 51899 - protein, 11 aa, Mycobacterium tuberculosis
YSRADEEQQQA

SEQ ID NO: 51900 - protein, 11 aa, Mycobacterium tuberculosis
SRADEEQQQAL

SEQ ID NO: 51901 - protein, 11 aa, Mycobacterium tuberculosis
RADEEQQQALS

SEQ ID NO: 51902 - protein, 11 aa, Mycobacterium tuberculosis
ADEEQQQALSS

SEQ ID NO: 51903 - protein, 11 aa, Mycobacterium tuberculosis
DEEQQQALSSQ

SEQ ID NO: 51904 - protein, 11 aa, Mycobacterium tuberculosis
EEQQQALSSQM

SEQ ID NO: 51905 - protein, 11 aa, Mycobacterium tuberculosis
EQQQALSSQMG

SEQ ID NO: 51906 - protein, 11 aa, Mycobacterium tuberculosis
QQQALSSQMGF

SEQ ID NO: 51907 - protein, 13 aa, Mycobacterium tuberculosis
MAEMKTDAATLAQ

SEQ ID NO: 51908 - protein, 13 aa, Mycobacterium tuberculosis
AEMKTDAATLAQE

SEQ ID NO: 51909 - protein, 13 aa, Mycobacterium tuberculosis
EMKTDAATLAQEA

SEQ ID NO: 51910 - protein, 13 aa, Mycobacterium tuberculosis
MKTDAATLAQEAG

SEQ ID NO: 51911 - protein, 13 aa, Mycobacterium tuberculosis
KTDAATLAQEAGN

SEQ ID NO: 51912 - protein, 13 aa, Mycobacterium tuberculosis
TDAATLAQEAGNF

SEQ ID NO: 51913 - protein, 13 aa, Mycobacterium tuberculosis
DAATLAQEAGNFE

SEQ ID NO: 51914 - protein, 13 aa, Mycobacterium tuberculosis
AATLAQEAGNFER

SEQ ID NO: 51915 - protein, 13 aa, Mycobacterium tuberculosis
ATLAQEAGNFERI

SEQ ID NO: 51916 - protein, 13 aa, Mycobacterium tuberculosis
TLAQEAGNFERIS

SEQ ID NO: 51917 - protein, 13 aa, Mycobacterium tuberculosis
LAQEAGNFERISG

SEQ ID NO: 51918 - protein, 13 aa, Mycobacterium tuberculosis
AQEAGNFERISGD

SEQ ID NO: 51919 - protein, 13 aa, Mycobacterium tuberculosis
QEAGNFERISGDL

SEQ ID NO: 51920 - protein, 13 aa, Mycobacterium tuberculosis
EAGNFERISGDLK

SEQ ID NO: 51921 - protein, 13 aa, Mycobacterium tuberculosis
AGNFERISGDLKT

SEQ ID NO: 51922 - protein, 13 aa, Mycobacterium tuberculosis
GNFERISGDLKTQ

SEQ ID NO: 51923 - protein, 13 aa, Mycobacterium tuberculosis
NFERISGDLKTQI

SEQ ID NO: 51924 - protein, 13 aa, Mycobacterium tuberculosis
FERISGDLKTQID

SEQ ID NO: 51925 - protein, 13 aa, Mycobacterium tuberculosis
ERISGDLKTQIDQ

SEQ ID NO: 51926 - protein, 13 aa, Mycobacterium tuberculosis
RISGDLKTQIDQV

SEQ ID NO: 51927 - protein, 13 aa, Mycobacterium tuberculosis
ISGDLKTQIDQVE

SEQ ID NO: 51928 - protein, 13 aa, Mycobacterium tuberculosis
SGDLKTQIDQVES

SEQ ID NO: 51929 - protein, 13 aa, Mycobacterium tuberculosis
GDLKTQIDQVEST

SEQ ID NO: 51930 - protein, 13 aa, Mycobacterium tuberculosis
DLKTQIDQVESTA

SEQ ID NO: 51931 - protein, 13 aa, Mycobacterium tuberculosis
LKTQIDQVESTAG

SEQ ID NO: 51932 - protein, 13 aa, Mycobacterium tuberculosis
KTQIDQVESTAGS

SEQ ID NO: 51933 - protein, 13 aa, Mycobacterium tuberculosis
TQIDQVESTAGSL

SEQ ID NO: 51934 - protein, 13 aa, Mycobacterium tuberculosis
QIDQVESTAGSLQ

SEQ ID NO: 51935 - protein, 13 aa, Mycobacterium tuberculosis
IDQVESTAGSLQG

SEQ ID NO: 51936 - protein, 13 aa, Mycobacterium tuberculosis
DQVESTAGSLQGQ

SEQ ID NO: 51937 - protein, 13 aa, Mycobacterium tuberculosis
QVESTAGSLQGQW

SEQ ID NO: 51938 - protein, 13 aa, Mycobacterium tuberculosis
VESTAGSLQGQWR

SEQ ID NO: 51939 - protein, 13 aa, Mycobacterium tuberculosis
ESTAGSLQGQWRG

SEQ ID NO: 51940 - protein, 13 aa, Mycobacterium tuberculosis
STAGSLQGQWRGA

SEQ ID NO: 51941 - protein, 13 aa, Mycobacterium tuberculosis
TAGSLQGQWRGAA

SEQ ID NO: 51942 - protein, 13 aa, Mycobacterium tuberculosis
AGSLQGQWRGAAG

SEQ ID NO: 51943 - protein, 13 aa, Mycobacterium tuberculosis
GSLQGQWRGAAGT

SEQ ID NO: 51944 - protein, 13 aa, Mycobacterium tuberculosis
SLQGQWRGAAGTA

SEQ ID NO: 51945 - protein, 13 aa, Mycobacterium tuberculosis
LQGQWRGAAGTAA

SEQ ID NO: 51946 - protein, 13 aa, Mycobacterium tuberculosis
QGQWRGAAGTAAQ

SEQ ID NO: 51947 - protein, 13 aa, Mycobacterium tuberculosis
GQWRGAAGTAAQA

SEQ ID NO: 51948 - protein, 13 aa, Mycobacterium tuberculosis
QWRGAAGTAAQAA

SEQ ID NO: 51949 - protein, 13 aa, Mycobacterium tuberculosis
WRGAAGTAAQAAV

SEQ ID NO: 51950 - protein, 13 aa, Mycobacterium tuberculosis
RGAAGTAAQAAVV

SEQ ID NO: 51951 - protein, 13 aa, Mycobacterium tuberculosis
GAAGTAAQAAVVR

SEQ ID NO: 51952 - protein, 13 aa, Mycobacterium tuberculosis
AAGTAAQAAVVRF

SEQ ID NO: 51953 - protein, 13 aa, Mycobacterium tuberculosis
AGTAAQAAVVRFQ

SEQ ID NO: 51954 - protein, 13 aa, Mycobacterium tuberculosis
GTAAQAAVVRFQE

SEQ ID NO: 51955 - protein, 13 aa, Mycobacterium tuberculosis
TAAQAAVVRFQEA

SEQ ID NO: 51956 - protein, 13 aa, Mycobacterium tuberculosis
AAQAAVVRFQEAA

SEQ ID NO: 51957 - protein, 13 aa, Mycobacterium tuberculosis
AQAAVVRFQEAAN

SEQ ID NO: 51958 - protein, 13 aa, Mycobacterium tuberculosis
QAAVVRFQEAANK

SEQ ID NO: 51959 - protein, 13 aa, Mycobacterium tuberculosis
AAVVRFQEAANKQ

SEQ ID NO: 51960 - protein, 13 aa, Mycobacterium tuberculosis
AVVRFQEAANKQK

SEQ ID NO: 51961 - protein, 13 aa, Mycobacterium tuberculosis
VVRFQEAANKQKQ

SEQ ID NO: 51962 - protein, 13 aa, Mycobacterium tuberculosis
VRFQEAANKQKQE

SEQ ID NO: 51963 - protein, 13 aa, Mycobacterium tuberculosis
RFQEAANKQKQEL

SEQ ID NO: 51964 - protein, 13 aa, Mycobacterium tuberculosis
FQEAANKQKQELD

SEQ ID NO: 51965 - protein, 13 aa, Mycobacterium tuberculosis
QEAANKQKQELDE

SEQ ID NO: 51966 - protein, 13 aa, Mycobacterium tuberculosis
EAANKQKQELDEI

SEQ ID NO: 51967 - protein, 13 aa, Mycobacterium tuberculosis
AANKQKQELDEIS

SEQ ID NO: 51968 - protein, 13 aa, Mycobacterium tuberculosis
ANKQKQELDEIST

SEQ ID NO: 51969 - protein, 13 aa, Mycobacterium tuberculosis
NKQKQELDEISTN

SEQ ID NO: 51970 - protein, 13 aa, Mycobacterium tuberculosis
KQKQELDEISTNI

SEQ ID NO: 51971 - protein, 13 aa, Mycobacterium tuberculosis
QKQELDEISTNIR

SEQ ID NO: 51972 - protein, 13 aa, Mycobacterium tuberculosis
KQELDEISTNIRQ

SEQ ID NO: 51973 - protein, 13 aa, Mycobacterium tuberculosis
QELDEISTNIRQA

SEQ ID NO: 51974 - protein, 13 aa, Mycobacterium tuberculosis
ELDEISTNIRQAG

SEQ ID NO: 51975 - protein, 13 aa, Mycobacterium tuberculosis
LDEISTNIRQAGV

SEQ ID NO: 51976 - protein, 13 aa, Mycobacterium tuberculosis
DEISTNIRQAGVQ

SEQ ID NO: 51977 - protein, 13 aa, Mycobacterium tuberculosis
EISTNIRQAGVQY

SEQ ID NO: 51978 - protein, 13 aa, Mycobacterium tuberculosis
ISTNIRQAGVQYS

SEQ ID NO: 51979 - protein, 13 aa, Mycobacterium tuberculosis
STNIRQAGVQYSR

SEQ ID NO: 51980 - protein, 13 aa, Mycobacterium tuberculosis
TNIRQAGVQYSRA

SEQ ID NO: 51981 - protein, 13 aa, Mycobacterium tuberculosis
NIRQAGVQYSRAD

SEQ ID NO: 51982 - protein, 13 aa, Mycobacterium tuberculosis
IRQAGVQYSRADE

SEQ ID NO: 51983 - protein, 13 aa, Mycobacterium tuberculosis
RQAGVQYSRADEE

SEQ ID NO: 51984 - protein, 13 aa, Mycobacterium tuberculosis
QAGVQYSRADEEQ

SEQ ID NO: 51985 - protein, 13 aa, Mycobacterium tuberculosis
AGVQYSRADEEQQ

SEQ ID NO: 51986 - protein, 13 aa, Mycobacterium tuberculosis
GVQYSRADEEQQQ

SEQ ID NO: 51987 - protein, 13 aa, Mycobacterium tuberculosis
VQYSRADEEQQQA

SEQ ID NO: 51988 - protein, 13 aa, Mycobacterium tuberculosis
QYSRADEEQQQAL

SEQ ID NO: 51989 - protein, 13 aa, Mycobacterium tuberculosis
YSRADEEQQQALS

SEQ ID NO: 51990 - protein, 13 aa, Mycobacterium tuberculosis
SRADEEQQQALSS

SEQ ID NO: 51991 - protein, 13 aa, Mycobacterium tuberculosis
RADEEQQQALSSQ

SEQ ID NO: 51992 - protein, 13 aa, Mycobacterium tuberculosis
ADEEQQQALSSQM

SEQ ID NO: 51993 - protein, 13 aa, Mycobacterium tuberculosis
DEEQQQALSSQMG

SEQ ID NO: 51994 - protein, 13 aa, Mycobacterium tuberculosis
EEQQQALSSQMGF

SEQ ID NO: 51995 - protein, 14 aa, Mycobacterium tuberculosis
MAEMKTDAATLAQE

SEQ ID NO: 51996 - protein, 14 aa, Mycobacterium tuberculosis
AEMKTDAATLAQEA

SEQ ID NO: 51997 - protein, 14 aa, Mycobacterium tuberculosis
EMKTDAATLAQEAG

SEQ ID NO: 51998 - protein, 14 aa, Mycobacterium tuberculosis
MKTDAATLAQEAGN

SEQ ID NO: 51999 - protein, 14 aa, Mycobacterium tuberculosis
KTDAATLAQEAGNF

SEQ ID NO: 52000 - protein, 14 aa, Mycobacterium tuberculosis
TDAATLAQEAGNFE

SEQ ID NO: 52001 - protein, 14 aa, Mycobacterium tuberculosis
DAATLAQEAGNFER

SEQ ID NO: 52002 - protein, 14 aa, Mycobacterium tuberculosis
AATLAQEAGNFERI

SEQ ID NO: 52003 - protein, 14 aa, Mycobacterium tuberculosis
ATLAQEAGNFERIS

SEQ ID NO: 52004 - protein, 14 aa, Mycobacterium tuberculosis
TLAQEAGNFERISG

SEQ ID NO: 52005 - protein, 14 aa, Mycobacterium tuberculosis
LAQEAGNFERISGD

SEQ ID NO: 52006 - protein, 14 aa, Mycobacterium tuberculosis
AQEAGNFERISGDL

SEQ ID NO: 52007 - protein, 14 aa, Mycobacterium tuberculosis
QEAGNFERISGDLK

SEQ ID NO: 52008 - protein, 14 aa, Mycobacterium tuberculosis
EAGNFERISGDLKT

SEQ ID NO: 52009 - protein, 14 aa, Mycobacterium tuberculosis
AGNFERISGDLKTQ

SEQ ID NO: 52010 - protein, 14 aa, Mycobacterium tuberculosis
GNFERISGDLKTQI

SEQ ID NO: 52011 - protein, 14 aa, Mycobacterium tuberculosis
NFERISGDLKTQID

SEQ ID NO: 52012 - protein, 14 aa, Mycobacterium tuberculosis
FERISGDLKTQIDQ

SEQ ID NO: 52013 - protein, 14 aa, Mycobacterium tuberculosis
ERISGDLKTQIDQV

SEQ ID NO: 52014 - protein, 14 aa, Mycobacterium tuberculosis
RISGDLKTQIDQVE

SEQ ID NO: 52015 - protein, 14 aa, Mycobacterium tuberculosis
ISGDLKTQIDQVES

SEQ ID NO: 52016 - protein, 14 aa, Mycobacterium tuberculosis
SGDLKTQIDQVEST

SEQ ID NO: 52017 - protein, 14 aa, Mycobacterium tuberculosis
GDLKTQIDQVESTA

SEQ ID NO: 52018 - protein, 14 aa, Mycobacterium tuberculosis
DLKTQIDQVESTAG

SEQ ID NO: 52019 - protein, 14 aa, Mycobacterium tuberculosis
LKTQIDQVESTAGS

SEQ ID NO: 52020 - protein, 14 aa, Mycobacterium tuberculosis
KTQIDQVESTAGSL

SEQ ID NO: 52021 - protein, 14 aa, Mycobacterium tuberculosis
TQIDQVESTAGSLQ

SEQ ID NO: 52022 - protein, 14 aa, Mycobacterium tuberculosis
QIDQVESTAGSLQG

SEQ ID NO: 52023 - protein, 14 aa, Mycobacterium tuberculosis
IDQVESTAGSLQGQ

SEQ ID NO: 52024 - protein, 14 aa, Mycobacterium tuberculosis
DQVESTAGSLQGQW

SEQ ID NO: 52025 - protein, 14 aa, Mycobacterium tuberculosis
QVESTAGSLQGQWR

SEQ ID NO: 52026 - protein, 14 aa, Mycobacterium tuberculosis
VESTAGSLQGQWRG

SEQ ID NO: 52027 - protein, 14 aa, Mycobacterium tuberculosis
ESTAGSLQGQWRGA

SEQ ID NO: 52028 - protein, 14 aa, Mycobacterium tuberculosis
STAGSLQGQWRGAA

SEQ ID NO: 52029 - protein, 14 aa, Mycobacterium tuberculosis
TAGSLQGQWRGAAG

SEQ ID NO: 52030 - protein, 14 aa, Mycobacterium tuberculosis
AGSLQGQWRGAAGT

SEQ ID NO: 52031 - protein, 14 aa, Mycobacterium tuberculosis
GSLQGQWRGAAGTA

SEQ ID NO: 52032 - protein, 14 aa, Mycobacterium tuberculosis
SLQGQWRGAAGTAA

SEQ ID NO: 52033 - protein, 14 aa, Mycobacterium tuberculosis
LQGQWRGAAGTAAQ

SEQ ID NO: 52034 - protein, 14 aa, Mycobacterium tuberculosis
QGQWRGAAGTAAQA

SEQ ID NO: 52035 - protein, 14 aa, Mycobacterium tuberculosis
GQWRGAAGTAAQAA

SEQ ID NO: 52036 - protein, 14 aa, Mycobacterium tuberculosis
QWRGAAGTAAQAAV

SEQ ID NO: 52037 - protein, 14 aa, Mycobacterium tuberculosis
WRGAAGTAAQAAVV

SEQ ID NO: 52038 - protein, 14 aa, Mycobacterium tuberculosis
RGAAGTAAQAAVVR

SEQ ID NO: 52039 - protein, 14 aa, Mycobacterium tuberculosis
GAAGTAAQAAVVRF

SEQ ID NO: 52040 - protein, 14 aa, Mycobacterium tuberculosis
AAGTAAQAAVVRFQ

SEQ ID NO: 52041 - protein, 14 aa, Mycobacterium tuberculosis
AGTAAQAAVVRFQE

SEQ ID NO: 52042 - protein, 14 aa, Mycobacterium tuberculosis
GTAAQAAVVRFQEA

SEQ ID NO: 52043 - protein, 14 aa, Mycobacterium tuberculosis
TAAQAAVVRFQEAA

SEQ ID NO: 52044 - protein, 14 aa, Mycobacterium tuberculosis
AAQAAVVRFQEAAN

SEQ ID NO: 52045 - protein, 14 aa, Mycobacterium tuberculosis
AQAAVVRFQEAANK

SEQ ID NO: 52046 - protein, 14 aa, Mycobacterium tuberculosis
QAAVVRFQEAANKQ

SEQ ID NO: 52047 - protein, 14 aa, Mycobacterium tuberculosis
AAVVRFQEAANKQK

SEQ ID NO: 52048 - protein, 14 aa, Mycobacterium tuberculosis
AVVRFQEAANKQKQ

SEQ ID NO: 52049 - protein, 14 aa, Mycobacterium tuberculosis
VVRFQEAANKQKQE

SEQ ID NO: 52050 - protein, 14 aa, Mycobacterium tuberculosis
VRFQEAANKQKQEL

SEQ ID NO: 52051 - protein, 14 aa, Mycobacterium tuberculosis
RFQEAANKQKQELD

SEQ ID NO: 52052 - protein, 14 aa, Mycobacterium tuberculosis
FQEAANKQKQELDE

SEQ ID NO: 52053 - protein, 14 aa, Mycobacterium tuberculosis
QEAANKQKQELDEI

SEQ ID NO: 52054 - protein, 14 aa, Mycobacterium tuberculosis
EAANKQKQELDEIS

SEQ ID NO: 52055 - protein, 14 aa, Mycobacterium tuberculosis
AANKQKQELDEIST

SEQ ID NO: 52056 - protein, 14 aa, Mycobacterium tuberculosis
ANKQKQELDEISTN

SEQ ID NO: 52057 - protein, 14 aa, Mycobacterium tuberculosis
NKQKQELDEISTNI

SEQ ID NO: 52058 - protein, 14 aa, Mycobacterium tuberculosis
KQKQELDEISTNIR

SEQ ID NO: 52059 - protein, 14 aa, Mycobacterium tuberculosis
QKQELDEISTNIRQ

SEQ ID NO: 52060 - protein, 14 aa, Mycobacterium tuberculosis
KQELDEISTNIRQA

SEQ ID NO: 52061 - protein, 14 aa, Mycobacterium tuberculosis
QELDEISTNIRQAG

SEQ ID NO: 52062 - protein, 14 aa, Mycobacterium tuberculosis
ELDEISTNIRQAGV

SEQ ID NO: 52063 - protein, 14 aa, Mycobacterium tuberculosis
LDEISTNIRQAGVQ

SEQ ID NO: 52064 - protein, 14 aa, Mycobacterium tuberculosis
DEISTNIRQAGVQY

SEQ ID NO: 52065 - protein, 14 aa, Mycobacterium tuberculosis
EISTNIRQAGVQYS

SEQ ID NO: 52066 - protein, 14 aa, Mycobacterium tuberculosis
ISTNIRQAGVQYSR

SEQ ID NO: 52067 - protein, 14 aa, Mycobacterium tuberculosis
STNIRQAGVQYSRA

SEQ ID NO: 52068 - protein, 14 aa, Mycobacterium tuberculosis
TNIRQAGVQYSRAD

SEQ ID NO: 52069 - protein, 14 aa, Mycobacterium tuberculosis
NIRQAGVQYSRADE

SEQ ID NO: 52070 - protein, 14 aa, Mycobacterium tuberculosis
IRQAGVQYSRADEE

SEQ ID NO: 52071 - protein, 14 aa, Mycobacterium tuberculosis
RQAGVQYSRADEEQ

SEQ ID NO: 52072 - protein, 14 aa, Mycobacterium tuberculosis
QAGVQYSRADEEQQ

SEQ ID NO: 52073 - protein, 14 aa, Mycobacterium tuberculosis
AGVQYSRADEEQQQ

SEQ ID NO: 52074 - protein, 14 aa, Mycobacterium tuberculosis
GVQYSRADEEQQQA

SEQ ID NO: 52075 - protein, 14 aa, Mycobacterium tuberculosis
VQYSRADEEQQQAL

SEQ ID NO: 52076 - protein, 14 aa, Mycobacterium tuberculosis
QYSRADEEQQQALS

SEQ ID NO: 52077 - protein, 14 aa, Mycobacterium tuberculosis
YSRADEEQQQALSS

SEQ ID NO: 52078 - protein, 14 aa, Mycobacterium tuberculosis
SRADEEQQQALSSQ

SEQ ID NO: 52079 - protein, 14 aa, Mycobacterium tuberculosis
RADEEQQQALSSQM

SEQ ID NO: 52080 - protein, 14 aa, Mycobacterium tuberculosis
ADEEQQQALSSQMG

SEQ ID NO: 52081 - protein, 14 aa, Mycobacterium tuberculosis
DEEQQQALSSQMGF

SEQ ID NO: 52082 - protein, 15 aa, Mycobacterium tuberculosis
MAEMKTDAATLAQEA

SEQ ID NO: 52083 - protein, 15 aa, Mycobacterium tuberculosis
AEMKTDAATLAQEAG

SEQ ID NO: 52084 - protein, 15 aa, Mycobacterium tuberculosis
EMKTDAATLAQEAGN

SEQ ID NO: 52085 - protein, 15 aa, Mycobacterium tuberculosis
MKTDAATLAQEAGNF

SEQ ID NO: 52086 - protein, 15 aa, Mycobacterium tuberculosis
KTDAATLAQEAGNFE

SEQ ID NO: 52087 - protein, 15 aa, Mycobacterium tuberculosis
TDAATLAQEAGNFER

SEQ ID NO: 52088 - protein, 15 aa, Mycobacterium tuberculosis
DAATLAQEAGNFERI

SEQ ID NO: 52089 - protein, 15 aa, Mycobacterium tuberculosis
AATLAQEAGNFERIS

SEQ ID NO: 52090 - protein, 15 aa, Mycobacterium tuberculosis
ATLAQEAGNFERISG

SEQ ID NO: 52091 - protein, 15 aa, Mycobacterium tuberculosis
TLAQEAGNFERISGD

SEQ ID NO: 52092 - protein, 15 aa, Mycobacterium tuberculosis
LAQEAGNFERISGDL

SEQ ID NO: 52093 - protein, 15 aa, Mycobacterium tuberculosis
AQEAGNFERISGDLK

SEQ ID NO: 52094 - protein, 15 aa, Mycobacterium tuberculosis
QEAGNFERISGDLKT

SEQ ID NO: 52095 - protein, 15 aa, Mycobacterium tuberculosis
EAGNFERISGDLKTQ

SEQ ID NO: 52096 - protein, 15 aa, Mycobacterium tuberculosis
AGNFERISGDLKTQI

SEQ ID NO: 52097 - protein, 15 aa, Mycobacterium tuberculosis
GNFERISGDLKTQID

SEQ ID NO: 52098 - protein, 15 aa, Mycobacterium tuberculosis
NFERISGDLKTQIDQ

SEQ ID NO: 52099 - protein, 15 aa, Mycobacterium tuberculosis
FERISGDLKTQIDQV

SEQ ID NO: 52100 - protein, 15 aa, Mycobacterium tuberculosis
ERISGDLKTQIDQVE

SEQ ID NO: 52101 - protein, 15 aa, Mycobacterium tuberculosis
RISGDLKTQIDQVES

SEQ ID NO: 52102 - protein, 15 aa, Mycobacterium tuberculosis
ISGDLKTQIDQVEST

SEQ ID NO: 52103 - protein, 15 aa, Mycobacterium tuberculosis
SGDLKTQIDQVESTA

SEQ ID NO: 52104 - protein, 15 aa, Mycobacterium tuberculosis
GDLKTQIDQVESTAG

SEQ ID NO: 52105 - protein, 15 aa, Mycobacterium tuberculosis
DLKTQIDQVESTAGS

SEQ ID NO: 52106 - protein, 15 aa, Mycobacterium tuberculosis
LKTQIDQVESTAGSL

SEQ ID NO: 52107 - protein, 15 aa, Mycobacterium tuberculosis
KTQIDQVESTAGSLQ

SEQ ID NO: 52108 - protein, 15 aa, Mycobacterium tuberculosis
TQIDQVESTAGSLQG

SEQ ID NO: 52109 - protein, 15 aa, Mycobacterium tuberculosis
QIDQVESTAGSLQGQ

SEQ ID NO: 52110 - protein, 15 aa, Mycobacterium tuberculosis
IDQVESTAGSLQGQW

SEQ ID NO: 52111 - protein, 15 aa, Mycobacterium tuberculosis
DQVESTAGSLQGQWR

SEQ ID NO: 52112 - protein, 15 aa, Mycobacterium tuberculosis
QVESTAGSLQGQWRG

SEQ ID NO: 52113 - protein, 15 aa, Mycobacterium tuberculosis
VESTAGSLQGQWRGA

SEQ ID NO: 52114 - protein, 15 aa, Mycobacterium tuberculosis
ESTAGSLQGQWRGAA

SEQ ID NO: 52115 - protein, 15 aa, Mycobacterium tuberculosis
STAGSLQGQWRGAAG

SEQ ID NO: 52116 - protein, 15 aa, Mycobacterium tuberculosis
TAGSLQGQWRGAAGT

SEQ ID NO: 52117 - protein, 15 aa, Mycobacterium tuberculosis
AGSLQGQWRGAAGTA

SEQ ID NO: 52118 - protein, 15 aa, Mycobacterium tuberculosis
GSLQGQWRGAAGTAA

SEQ ID NO: 52119 - protein, 15 aa, Mycobacterium tuberculosis
SLQGQWRGAAGTAAQ

SEQ ID NO: 52120 - protein, 15 aa, Mycobacterium tuberculosis
LQGQWRGAAGTAAQA

SEQ ID NO: 52121 - protein, 15 aa, Mycobacterium tuberculosis
QGQWRGAAGTAAQAA

SEQ ID NO: 52122 - protein, 15 aa, Mycobacterium tuberculosis
GQWRGAAGTAAQAAV

SEQ ID NO: 52123 - protein, 15 aa, Mycobacterium tuberculosis
QWRGAAGTAAQAAVV

SEQ ID NO: 52124 - protein, 15 aa, Mycobacterium tuberculosis
WRGAAGTAAQAAVVR

SEQ ID NO: 52125 - protein, 15 aa, Mycobacterium tuberculosis
RGAAGTAAQAAVVRF

SEQ ID NO: 52126 - protein, 15 aa, Mycobacterium tuberculosis
GAAGTAAQAAVVRFQ

SEQ ID NO: 52127 - protein, 15 aa, Mycobacterium tuberculosis
AAGTAAQAAVVRFQE

SEQ ID NO: 52128 - protein, 15 aa, Mycobacterium tuberculosis
AGTAAQAAVVRFQEA

SEQ ID NO: 52129 - protein, 15 aa, Mycobacterium tuberculosis
GTAAQAAVVRFQEAA

SEQ ID NO: 52130 - protein, 15 aa, Mycobacterium tuberculosis
TAAQAAVVRFQEAAN

SEQ ID NO: 52131 - protein, 15 aa, Mycobacterium tuberculosis
AAQAAVVRFQEAANK

SEQ ID NO: 52132 - protein, 15 aa, Mycobacterium tuberculosis
AQAAVVRFQEAANKQ

SEQ ID NO: 52133 - protein, 15 aa, Mycobacterium tuberculosis
QAAVVRFQEAANKQK

SEQ ID NO: 52134 - protein, 15 aa, Mycobacterium tuberculosis
AAVVRFQEAANKQKQ

SEQ ID NO: 52135 - protein, 15 aa, Mycobacterium tuberculosis
AVVRFQEAANKQKQE

SEQ ID NO: 52136 - protein, 15 aa, Mycobacterium tuberculosis
VVRFQEAANKQKQEL

SEQ ID NO: 52137 - protein, 15 aa, Mycobacterium tuberculosis
VRFQEAANKQKQELD

SEQ ID NO: 52138 - protein, 15 aa, Mycobacterium tuberculosis
RFQEAANKQKQELDE

SEQ ID NO: 52139 - protein, 15 aa, Mycobacterium tuberculosis
FQEAANKQKQELDEI

SEQ ID NO: 52140 - protein, 15 aa, Mycobacterium tuberculosis
QEAANKQKQELDEIS

SEQ ID NO: 52141 - protein, 15 aa, Mycobacterium tuberculosis
EAANKQKQELDEIST

SEQ ID NO: 52142 - protein, 15 aa, Mycobacterium tuberculosis
AANKQKQELDEISTN

SEQ ID NO: 52143 - protein, 15 aa, Mycobacterium tuberculosis
ANKQKQELDEISTNI

SEQ ID NO: 52144 - protein, 15 aa, Mycobacterium tuberculosis
NKQKQELDEISTNIR

SEQ ID NO: 52145 - protein, 15 aa, Mycobacterium tuberculosis
KQKQELDEISTNIRQ

SEQ ID NO: 52146 - protein, 15 aa, Mycobacterium tuberculosis
QKQELDEISTNIRQA

SEQ ID NO: 52147 - protein, 15 aa, Mycobacterium tuberculosis
KQELDEISTNIRQAG

SEQ ID NO: 52148 - protein, 15 aa, Mycobacterium tuberculosis
QELDEISTNIRQAGV

SEQ ID NO: 52149 - protein, 15 aa, Mycobacterium tuberculosis
ELDEISTNIRQAGVQ

SEQ ID NO: 52150 - protein, 15 aa, Mycobacterium tuberculosis
LDEISTNIRQAGVQY

SEQ ID NO: 52151 - protein, 15 aa, Mycobacterium tuberculosis
DEISTNIRQAGVQYS

SEQ ID NO: 52152 - protein, 15 aa, Mycobacterium tuberculosis
EISTNIRQAGVQYSR

SEQ ID NO: 52153 - protein, 15 aa, Mycobacterium tuberculosis
ISTNIRQAGVQYSRA

SEQ ID NO: 52154 - protein, 15 aa, Mycobacterium tuberculosis
STNIRQAGVQYSRAD

SEQ ID NO: 52155 - protein, 15 aa, Mycobacterium tuberculosis
TNIRQAGVQYSRADE

SEQ ID NO: 52156 - protein, 15 aa, Mycobacterium tuberculosis
NIRQAGVQYSRADEE

SEQ ID NO: 52157 - protein, 15 aa, Mycobacterium tuberculosis
IRQAGVQYSRADEEQ

SEQ ID NO: 52158 - protein, 15 aa, Mycobacterium tuberculosis
RQAGVQYSRADEEQQ

SEQ ID NO: 52159 - protein, 15 aa, Mycobacterium tuberculosis
QAGVQYSRADEEQQQ

SEQ ID NO: 52160 - protein, 15 aa, Mycobacterium tuberculosis
AGVQYSRADEEQQQA

SEQ ID NO: 52161 - protein, 15 aa, Mycobacterium tuberculosis
GVQYSRADEEQQQAL

SEQ ID NO: 52162 - protein, 15 aa, Mycobacterium tuberculosis
VQYSRADEEQQQALS

SEQ ID NO: 52163 - protein, 15 aa, Mycobacterium tuberculosis
QYSRADEEQQQALSS

SEQ ID NO: 52164 - protein, 15 aa, Mycobacterium tuberculosis
YSRADEEQQQALSSQ

SEQ ID NO: 52165 - protein, 15 aa, Mycobacterium tuberculosis
SRADEEQQQALSSQM

SEQ ID NO: 52166 - protein, 15 aa, Mycobacterium tuberculosis
RADEEQQQALSSQMG

SEQ ID NO: 52167 - protein, 15 aa, Mycobacterium tuberculosis
ADEEQQQALSSQMGF

SEQ ID NO: 52168 - protein, 16 aa, Mycobacterium tuberculosis
MAEMKTDAATLAQEAG

SEQ ID NO: 52169 - protein, 16 aa, Mycobacterium tuberculosis
AEMKTDAATLAQEAGN

SEQ ID NO: 52170 - protein, 16 aa, Mycobacterium tuberculosis
EMKTDAATLAQEAGNF

SEQ ID NO: 52171 - protein, 16 aa, Mycobacterium tuberculosis
MKTDAATLAQEAGNFE

SEQ ID NO: 52172 - protein, 16 aa, Mycobacterium tuberculosis
KTDAATLAQEAGNFER

SEQ ID NO: 52173 - protein, 16 aa, Mycobacterium tuberculosis
TDAATLAQEAGNFERI

SEQ ID NO: 52174 - protein, 16 aa, Mycobacterium tuberculosis
DAATLAQEAGNFERIS

SEQ ID NO: 52175 - protein, 16 aa, Mycobacterium tuberculosis
AATLAQEAGNFERISG

SEQ ID NO: 52176 - protein, 16 aa, Mycobacterium tuberculosis
ATLAQEAGNFERISGD

SEQ ID NO: 52177 - protein, 16 aa, Mycobacterium tuberculosis
TLAQEAGNFERISGDL

SEQ ID NO: 52178 - protein, 16 aa, Mycobacterium tuberculosis
LAQEAGNFERISGDLK

SEQ ID NO: 52179 - protein, 16 aa, Mycobacterium tuberculosis
AQEAGNFERISGDLKT

SEQ ID NO: 52180 - protein, 16 aa, Mycobacterium tuberculosis
QEAGNFERISGDLKTQ

SEQ ID NO: 52181 - protein, 16 aa, Mycobacterium tuberculosis
EAGNFERISGDLKTQI

SEQ ID NO: 52182 - protein, 16 aa, Mycobacterium tuberculosis
AGNFERISGDLKTQID

SEQ ID NO: 52183 - protein, 16 aa, Mycobacterium tuberculosis
GNFERISGDLKTQIDQ

SEQ ID NO: 52184 - protein, 16 aa, Mycobacterium tuberculosis
NFERISGDLKTQIDQV

SEQ ID NO: 52185 - protein, 16 aa, Mycobacterium tuberculosis
FERISGDLKTQIDQVE

SEQ ID NO: 52186 - protein, 16 aa, Mycobacterium tuberculosis
ERISGDLKTQIDQVES

SEQ ID NO: 52187 - protein, 16 aa, Mycobacterium tuberculosis
RISGDLKTQIDQVEST

SEQ ID NO: 52188 - protein, 16 aa, Mycobacterium tuberculosis
ISGDLKTQIDQVESTA

SEQ ID NO: 52189 - protein, 16 aa, Mycobacterium tuberculosis
SGDLKTQIDQVESTAG

SEQ ID NO: 52190 - protein, 16 aa, Mycobacterium tuberculosis
GDLKTQIDQVESTAGS

SEQ ID NO: 52191 - protein, 16 aa, Mycobacterium tuberculosis
DLKTQIDQVESTAGSL

SEQ ID NO: 52192 - protein, 16 aa, Mycobacterium tuberculosis
LKTQIDQVESTAGSLQ

SEQ ID NO: 52193 - protein, 16 aa, Mycobacterium tuberculosis
KTQIDQVESTAGSLQG

SEQ ID NO: 52194 - protein, 16 aa, Mycobacterium tuberculosis
TQIDQVESTAGSLQGQ

SEQ ID NO: 52195 - protein, 16 aa, Mycobacterium tuberculosis
QIDQVESTAGSLQGQW

SEQ ID NO: 52196 - protein, 16 aa, Mycobacterium tuberculosis
IDQVESTAGSLQGQWR

SEQ ID NO: 52197 - protein, 16 aa, Mycobacterium tuberculosis
DQVESTAGSLQGQWRG

SEQ ID NO: 52198 - protein, 16 aa, Mycobacterium tuberculosis
QVESTAGSLQGQWRGA

SEQ ID NO: 52199 - protein, 16 aa, Mycobacterium tuberculosis
VESTAGSLQGQWRGAA

SEQ ID NO: 52200 - protein, 16 aa, Mycobacterium tuberculosis
ESTAGSLQGQWRGAAG

SEQ ID NO: 52201 - protein, 16 aa, Mycobacterium tuberculosis
STAGSLQGQWRGAAGT

SEQ ID NO: 52202 - protein, 16 aa, Mycobacterium tuberculosis
TAGSLQGQWRGAAGTA

SEQ ID NO: 52203 - protein, 16 aa, Mycobacterium tuberculosis
AGSLQGQWRGAAGTAA

SEQ ID NO: 52204 - protein, 16 aa, Mycobacterium tuberculosis
GSLQGQWRGAAGTAAQ

SEQ ID NO: 52205 - protein, 16 aa, Mycobacterium tuberculosis
SLQGQWRGAAGTAAQA

SEQ ID NO: 52206 - protein, 16 aa, Mycobacterium tuberculosis
LQGQWRGAAGTAAQAA

SEQ ID NO: 52207 - protein, 16 aa, Mycobacterium tuberculosis
QGQWRGAAGTAAQAAV

SEQ ID NO: 52208 - protein, 16 aa, Mycobacterium tuberculosis
GQWRGAAGTAAQAAVV

SEQ ID NO: 52209 - protein, 16 aa, Mycobacterium tuberculosis
QWRGAAGTAAQAAVVR

SEQ ID NO: 52210 - protein, 16 aa, Mycobacterium tuberculosis
WRGAAGTAAQAAVVRF

SEQ ID NO: 52211 - protein, 16 aa, Mycobacterium tuberculosis
RGAAGTAAQAAVVRFQ

SEQ ID NO: 52212 - protein, 16 aa, Mycobacterium tuberculosis
GAAGTAAQAAVVRFQE

SEQ ID NO: 52213 - protein, 16 aa, Mycobacterium tuberculosis
AAGTAAQAAVVRFQEA

SEQ ID NO: 52214 - protein, 16 aa, Mycobacterium tuberculosis
AGTAAQAAVVRFQEAA

SEQ ID NO: 52215 - protein, 16 aa, Mycobacterium tuberculosis
GTAAQAAVVRFQEAAN

SEQ ID NO: 52216 - protein, 16 aa, Mycobacterium tuberculosis
TAAQAAVVRFQEAANK

SEQ ID NO: 52217 - protein, 16 aa, Mycobacterium tuberculosis
AAQAAVVRFQEAANKQ

SEQ ID NO: 52218 - protein, 16 aa, Mycobacterium tuberculosis
AQAAVVRFQEAANKQK

SEQ ID NO: 52219 - protein, 16 aa, Mycobacterium tuberculosis
QAAVVRFQEAANKQKQ

SEQ ID NO: 52220 - protein, 16 aa, Mycobacterium tuberculosis
AAVVRFQEAANKQKQE

SEQ ID NO: 52221 - protein, 16 aa, Mycobacterium tuberculosis
AVVRFQEAANKQKQEL

SEQ ID NO: 52222 - protein, 16 aa, Mycobacterium tuberculosis
VVRFQEAANKQKQELD

SEQ ID NO: 52223 - protein, 16 aa, Mycobacterium tuberculosis
VRFQEAANKQKQELDE

SEQ ID NO: 52224 - protein, 16 aa, Mycobacterium tuberculosis
RFQEAANKQKQELDEI

SEQ ID NO: 52225 - protein, 16 aa, Mycobacterium tuberculosis
FQEAANKQKQELDEIS

SEQ ID NO: 52226 - protein, 16 aa, Mycobacterium tuberculosis
QEAANKQKQELDEIST

SEQ ID NO: 52227 - protein, 16 aa, Mycobacterium tuberculosis
EAANKQKQELDEISTN

SEQ ID NO: 52228 - protein, 16 aa, Mycobacterium tuberculosis
AANKQKQELDEISTNI

SEQ ID NO: 52229 - protein, 16 aa, Mycobacterium tuberculosis
ANKQKQELDEISTNIR

SEQ ID NO: 52230 - protein, 16 aa, Mycobacterium tuberculosis
NKQKQELDEISTNIRQ

SEQ ID NO: 52231 - protein, 16 aa, Mycobacterium tuberculosis
KQKQELDEISTNIRQA

SEQ ID NO: 52232 - protein, 16 aa, Mycobacterium tuberculosis
QKQELDEISTNIRQAG

SEQ ID NO: 52233 - protein, 16 aa, Mycobacterium tuberculosis
KQELDEISTNIRQAGV

SEQ ID NO: 52234 - protein, 16 aa, Mycobacterium tuberculosis
QELDEISTNIRQAGVQ

SEQ ID NO: 52235 - protein, 16 aa, Mycobacterium tuberculosis
ELDEISTNIRQAGVQY

SEQ ID NO: 52236 - protein, 16 aa, Mycobacterium tuberculosis
LDEISTNIRQAGVQYS

SEQ ID NO: 52237 - protein, 16 aa, Mycobacterium tuberculosis
DEISTNIRQAGVQYSR

SEQ ID NO: 52238 - protein, 16 aa, Mycobacterium tuberculosis
EISTNIRQAGVQYSRA

SEQ ID NO: 52239 - protein, 16 aa, Mycobacterium tuberculosis
ISTNIRQAGVQYSRAD

SEQ ID NO: 52240 - protein, 16 aa, Mycobacterium tuberculosis
STNIRQAGVQYSRADE

SEQ ID NO: 52241 - protein, 16 aa, Mycobacterium tuberculosis
TNIRQAGVQYSRADEE

SEQ ID NO: 52242 - protein, 16 aa, Mycobacterium tuberculosis
NIRQAGVQYSRADEEQ

SEQ ID NO: 52243 - protein, 16 aa, Mycobacterium tuberculosis
IRQAGVQYSRADEEQQ

SEQ ID NO: 52244 - protein, 16 aa, Mycobacterium tuberculosis
RQAGVQYSRADEEQQQ

SEQ ID NO: 52245 - protein, 16 aa, Mycobacterium tuberculosis
QAGVQYSRADEEQQQA

SEQ ID NO: 52246 - protein, 16 aa, Mycobacterium tuberculosis
AGVQYSRADEEQQQAL

SEQ ID NO: 52247 - protein, 16 aa, Mycobacterium tuberculosis
GVQYSRADEEQQQALS

SEQ ID NO: 52248 - protein, 16 aa, Mycobacterium tuberculosis
VQYSRADEEQQQALSS

SEQ ID NO: 52249 - protein, 16 aa, Mycobacterium tuberculosis
QYSRADEEQQQALSSQ

SEQ ID NO: 52250 - protein, 16 aa, Mycobacterium tuberculosis
YSRADEEQQQALSSQM

SEQ ID NO: 52251 - protein, 16 aa, Mycobacterium tuberculosis
SRADEEQQQALSSQMG

SEQ ID NO: 52252 - protein, 16 aa, Mycobacterium tuberculosis
RADEEQQQALSSQMGF

SEQ ID NO: 52253 - protein, 8 aa, BK virus
KVSTVGLY

SEQ ID NO: 52254 - protein, 8 aa, BK virus
FVNNIQYL

SEQ ID NO: 52255 - protein, 8 aa, BK virus
FAALIQTV

SEQ ID NO: 52256 - protein, 8 aa, BK virus
FLEETTWT

SEQ ID NO: 52257 - protein, 8 aa, BK virus
ALLGDLVA

SEQ ID NO: 52258 - protein, 8 aa, BK virus
SLATVEGI

SEQ ID NO: 52259 - protein, 8 aa, BK virus
MLPLLLGL

SEQ ID NO: 52260 - protein, 8 aa, BK virus
QIASLATV

SEQ ID NO: 52261 - protein, 8 aa, BK virus
GLTPQTYA

SEQ ID NO: 52262 - protein, 8 aa, BK virus
LLLGLYGT

SEQ ID NO: 52263 - protein, 8 aa, BK virus
AIAGFAAL

SEQ ID NO: 52264 - protein, 8 aa, BK virus
GISSLAQV

SEQ ID NO: 52265 - protein, 8 aa, BK virus
LLGLYGTV

SEQ ID NO: 52266 - protein, 8 aa, BK virus
ILFPGVNT

SEQ ID NO: 52267 - protein, 8 aa, BK virus
FVNNIQYL

SEQ ID NO: 52268 - protein, 8 aa, BK virus
MLPLLLGL

SEQ ID NO: 52269 - protein, 8 aa, BK virus
FAALIQTV

SEQ ID NO: 52270 - protein, 8 aa, BK virus
SLATVEGI

SEQ ID NO: 52271 - protein, 8 aa, BK virus
GLTPQTYA

SEQ ID NO: 52272 - protein, 8 aa, BK virus
FLEETTWT

SEQ ID NO: 52273 - protein, 8 aa, BK virus
AIAGFAAL

SEQ ID NO: 52274 - protein, 8 aa, BK virus
GISSLAQV

SEQ ID NO: 52275 - protein, 8 aa, BK virus
ALALLGDL

SEQ ID NO: 52276 - protein, 8 aa, BK virus
LLGLYGTV

SEQ ID NO: 52277 - protein, 8 aa, BK virus
QIASLATV

SEQ ID NO: 52278 - protein, 8 aa, BK virus
MGAALALL

SEQ ID NO: 52279 - protein, 8 aa, BK virus
GLYQQSGM

SEQ ID NO: 52280 - protein, 8 aa, BK virus
RTAPQWML

SEQ ID NO: 52281 - protein, 8 aa, BK virus
LLGDLVAS

SEQ ID NO: 52282 - protein, 8 aa, BK virus
FATISQAL

SEQ ID NO: 52283 - protein, 8 aa, BK virus
LVASVSEA

SEQ ID NO: 52284 - protein, 8 aa, BK virus
LLLGLYGT

SEQ ID NO: 52285 - protein, 8 aa, BK virus
SLFATISQ

SEQ ID NO: 52286 - protein, 8 aa, BK virus
TVTGISSL

SEQ ID NO: 52287 - protein, 8 aa, BK virus
LTPQTYAV

SEQ ID NO: 52288 - protein, 8 aa, BK virus
YQQSGMAL

SEQ ID NO: 52289 - protein, 8 aa, BK virus
SVSEAAAA

SEQ ID NO: 52290 - protein, 8 aa, BK virus
AAATGFSV

SEQ ID NO: 52291 - protein, 8 aa, BK virus
ILFPGVNT

SEQ ID NO: 52292 - protein, 8 aa, BK virus
SLATVEGI

SEQ ID NO: 52293 - protein, 8 aa, BK virus
FVNNIQYL

SEQ ID NO: 52294 - protein, 8 aa, BK virus
LLGLYGTV

SEQ ID NO: 52295 - protein, 8 aa, BK virus
QIASLATV

SEQ ID NO: 52296 - protein, 8 aa, BK virus
FAALIQTV

SEQ ID NO: 52297 - protein, 8 aa, BK virus
GLTPQTYA

SEQ ID NO: 52298 - protein, 8 aa, BK virus
GISSLAQV

SEQ ID NO: 52299 - protein, 8 aa, BK virus
AIAGFAAL

SEQ ID NO: 52300 - protein, 8 aa, BK virus
LIQTVTGI

SEQ ID NO: 52301 - protein, 8 aa, BK virus
AAATGFSV

SEQ ID NO: 52302 - protein, 8 aa, BK virus
ALALLGDL

SEQ ID NO: 52303 - protein, 8 aa, BK virus
GLYQQSGM

SEQ ID NO: 52304 - protein, 8 aa, BK virus
LVASVSEA

SEQ ID NO: 52305 - protein, 8 aa, BK virus
YQQSGMAL

SEQ ID NO: 52306 - protein, 8 aa, BK virus
LLLGLYGT

SEQ ID NO: 52307 - protein, 8 aa, BK virus
FLEETTWT

SEQ ID NO: 52308 - protein, 8 aa, BK virus
ILFPGVNT

SEQ ID NO: 52309 - protein, 8 aa, BK virus
LTPQTYAV

SEQ ID NO: 52310 - protein, 8 aa, BK virus
VIAGAPGA

SEQ ID NO: 52311 - protein, 8 aa, BK virus
SQALWHVI

SEQ ID NO: 52312 - protein, 8 aa, BK virus
TVTGISSL

SEQ ID NO: 52313 - protein, 8 aa, BK virus
ALLGDLVA

SEQ ID NO: 52314 - protein, 8 aa, BK virus
SVSEAAAA

SEQ ID NO: 52315 - protein, 8 aa, BK virus
SVHSGEFI

SEQ ID NO: 52316 - protein, 8 aa, BK virus
VIRDDIPA

SEQ ID NO: 52317 - protein, 8 aa, BK virus
LLGLYGTV

SEQ ID NO: 52318 - protein, 8 aa, BK virus
SLATVEGI

SEQ ID NO: 52319 - protein, 8 aa, BK virus
FVNNIQYL

SEQ ID NO: 52320 - protein, 8 aa, BK virus
FAALIQTV

SEQ ID NO: 52321 - protein, 8 aa, BK virus
RTAPQWML

SEQ ID NO: 52322 - protein, 8 aa, BK virus
YQQSGMAL

SEQ ID NO: 52323 - protein, 8 aa, BK virus
FAALIQTV

SEQ ID NO: 52324 - protein, 8 aa, BK virus
AAATGFSV

SEQ ID NO: 52325 - protein, 8 aa, BK virus
FVNNIQYL

SEQ ID NO: 52326 - protein, 8 aa, BK virus
VQIASLAT

SEQ ID NO: 52327 - protein, 8 aa, BK virus
SQALWHVI

SEQ ID NO: 52328 - protein, 8 aa, BK virus
QIASLATV

SEQ ID NO: 52329 - protein, 8 aa, BK virus
GAIAGFAA

SEQ ID NO: 52330 - protein, 8 aa, BK virus
AIAGFAAL

SEQ ID NO: 52331 - protein, 8 aa, BK virus
MLPLLLGL

SEQ ID NO: 52332 - protein, 8 aa, BK virus
AQVGYRFF

SEQ ID NO: 52333 - protein, 8 aa, BK virus
LTPQTYAV

SEQ ID NO: 52334 - protein, 8 aa, BK virus
IQDYYSNL

SEQ ID NO: 52335 - protein, 8 aa, BK virus
WTIVNAPI

SEQ ID NO: 52336 - protein, 8 aa, BK virus
FLEETTWT

SEQ ID NO: 52337 - protein, 8 aa, BK virus
LLLGLYGT

SEQ ID NO: 52338 - protein, 8 aa, BK virus
GISSLAQV

SEQ ID NO: 52339 - protein, 8 aa, BK virus
ALLGDLVA

SEQ ID NO: 52340 - protein, 8 aa, BK virus
FATISQAL

SEQ ID NO: 52341 - protein, 8 aa, BK virus
SVSEAAAA

SEQ ID NO: 52342 - protein, 8 aa, BK virus
RTAPQWML

SEQ ID NO: 52343 - protein, 8 aa, BK virus
GLTPQTYA

SEQ ID NO: 52344 - protein, 8 aa, BK virus
FSVAEIAA

SEQ ID NO: 52345 - protein, 8 aa, BK virus
LLGLYGTV

SEQ ID NO: 52346 - protein, 8 aa, BK virus
ATVEGITT

SEQ ID NO: 52347 - protein, 8 aa, BK virus
LALLGDLV

SEQ ID NO: 52348 - protein, 8 aa, BK virus
FSDWDHKV

SEQ ID NO: 52349 - protein, 8 aa, BK virus
LVASVSEA

SEQ ID NO: 52350 - protein, 8 aa, BK virus
ILFPGVNT

SEQ ID NO: 52351 - protein, 8 aa, BK virus
SIDNADSI

SEQ ID NO: 52352 - protein, 8 aa, BK virus
TVTPALEA

SEQ ID NO: 52353 - protein, 8 aa, BK virus
SLATVEGI

SEQ ID NO: 52354 - protein, 8 aa, BK virus
AAIEVQIA

SEQ ID NO: 52355 - protein, 8 aa, BK virus
ALLGDLVA

SEQ ID NO: 52356 - protein, 8 aa, BK virus
MLPLLLGL

SEQ ID NO: 52357 - protein, 8 aa, BK virus
GLTPQTYA

SEQ ID NO: 52358 - protein, 8 aa, BK virus
LLGLYGTV

SEQ ID NO: 52359 - protein, 8 aa, BK virus
YLDPRHWG

SEQ ID NO: 52360 - protein, 8 aa, BK virus
GISSLAQV

SEQ ID NO: 52361 - protein, 8 aa, BK virus
SLFATISQ

SEQ ID NO: 52362 - protein, 8 aa, BK virus
AIAGFAAL

SEQ ID NO: 52363 - protein, 8 aa, BK virus
SLATVEGI

SEQ ID NO: 52364 - protein, 8 aa, BK virus
QIASLATV

SEQ ID NO: 52365 - protein, 8 aa, BK virus
LLLGLYGT

SEQ ID NO: 52366 - protein, 8 aa, BK virus
FVNNIQYL

SEQ ID NO: 52367 - protein, 8 aa, BK virus
ILFPGVNT

SEQ ID NO: 52368 - protein, 8 aa, BK virus
FAALIQTV

SEQ ID NO: 52369 - protein, 8 aa, BK virus
FLEETTWT

SEQ ID NO: 52370 - protein, 8 aa, BK virus
TVTGISSL

SEQ ID NO: 52371 - protein, 8 aa, BK virus
FSDWDHKV

SEQ ID NO: 52372 - protein, 8 aa, BK virus
LTPQTYAV

SEQ ID NO: 52373 - protein, 8 aa, BK virus
AAATGFSV

SEQ ID NO: 52374 - protein, 8 aa, BK virus
GLYQQSGM

SEQ ID NO: 52375 - protein, 8 aa, BK virus
RTAPQWML

SEQ ID NO: 52376 - protein, 8 aa, BK virus
SIDNADSI

SEQ ID NO: 52377 - protein, 8 aa, BK virus
NADSIEEV

SEQ ID NO: 52378 - protein, 8 aa, BK virus
DLRNKESV

SEQ ID NO: 52379 - protein, 8 aa, BK virus
GLYGTVTP

SEQ ID NO: 52380 - protein, 8 aa, BK virus
LLGDLVAS

SEQ ID NO: 52381 - protein, 8 aa, BK virus
WMLPLLLG

SEQ ID NO: 52382 - protein, 8 aa, BK virus
SVHSGEFI

SEQ ID NO: 52383 - protein, 8 aa, BK virus
TVTPALEA

SEQ ID NO: 52384 - protein, 8 aa, BK virus
ALALLGDL

SEQ ID NO: 52385 - protein, 8 aa, BK virus
EAAAAIEV

SEQ ID NO: 52386 - protein, 8 aa, BK virus
SLARFLEE

SEQ ID NO: 52387 - protein, 8 aa, BK virus
SVSEAAAA

SEQ ID NO: 52388 - protein, 8 aa, BK virus
VIAGAPGA

SEQ ID NO: 52389 - protein, 8 aa, BK virus
LALLGDLV

SEQ ID NO: 52390 - protein, 8 aa, BK virus
VIRDDIPA

SEQ ID NO: 52391 - protein, 8 aa, BK virus
MLPLLLGL

SEQ ID NO: 52392 - protein, 8 aa, BK virus
LLGLYGTV

SEQ ID NO: 52393 - protein, 8 aa, BK virus
ALLGDLVA

SEQ ID NO: 52394 - protein, 8 aa, BK virus
AIAGFAAL

SEQ ID NO: 52395 - protein, 8 aa, BK virus
YLDPRHWG

SEQ ID NO: 52396 - protein, 8 aa, BK virus
SLATVEGI

SEQ ID NO: 52397 - protein, 8 aa, BK virus
LLLGLYGT

SEQ ID NO: 52398 - protein, 8 aa, BK virus
FVNNIQYL

SEQ ID NO: 52399 - protein, 8 aa, BK virus
QIASLATV

SEQ ID NO: 52400 - protein, 8 aa, BK virus
GLYQQSGM

SEQ ID NO: 52401 - protein, 8 aa, BK virus
ILFPGVNT

SEQ ID NO: 52402 - protein, 8 aa, BK virus
FAALIQTV

SEQ ID NO: 52403 - protein, 8 aa, BK virus
SLFATISQ

SEQ ID NO: 52404 - protein, 8 aa, BK virus
LTPQTYAV

SEQ ID NO: 52405 - protein, 8 aa, BK virus
GLTPQTYA

SEQ ID NO: 52406 - protein, 8 aa, BK virus
FLEETTWT

SEQ ID NO: 52407 - protein, 8 aa, BK virus
GISSLAQV

SEQ ID NO: 52408 - protein, 8 aa, BK virus
DLRNKESV

SEQ ID NO: 52409 - protein, 8 aa, BK virus
LLGDLVAS

SEQ ID NO: 52410 - protein, 8 aa, BK virus
YQQSGMAL

SEQ ID NO: 52411 - protein, 8 aa, BK virus
VIAGAPGA

SEQ ID NO: 52412 - protein, 8 aa, BK virus
FSDWDHKV

SEQ ID NO: 52413 - protein, 8 aa, BK virus
AAATGFSV

SEQ ID NO: 52414 - protein, 8 aa, BK virus
RTAPQWML

SEQ ID NO: 52415 - protein, 8 aa, BK virus
GLYGTVTP

SEQ ID NO: 52416 - protein, 8 aa, BK virus
ALALLGDL

SEQ ID NO: 52417 - protein, 8 aa, BK virus
YIQDYYSN

SEQ ID NO: 52418 - protein, 8 aa, BK virus
LLGLYGTV

SEQ ID NO: 52419 - protein, 8 aa, BK virus
GLTPQTYA

SEQ ID NO: 52420 - protein, 8 aa, BK virus
GISSLAQV

SEQ ID NO: 52421 - protein, 8 aa, BK virus
QIASLATV

SEQ ID NO: 52422 - protein, 8 aa, BK virus
DLRNKESV

SEQ ID NO: 52423 - protein, 8 aa, BK virus
AIAGFAAL

SEQ ID NO: 52424 - protein, 8 aa, BK virus
SLFATISQ

SEQ ID NO: 52425 - protein, 8 aa, BK virus
FVNNIQYL

SEQ ID NO: 52426 - protein, 8 aa, BK virus
MLPLLLGL

SEQ ID NO: 52427 - protein, 8 aa, BK virus
ALLGDLVA

SEQ ID NO: 52428 - protein, 8 aa, BK virus
FAALIQTV

SEQ ID NO: 52429 - protein, 8 aa, BK virus
FLEETTWT

SEQ ID NO: 52430 - protein, 8 aa, BK virus
SLATVEGI

SEQ ID NO: 52431 - protein, 8 aa, BK virus
AAATGFSV

SEQ ID NO: 52432 - protein, 8 aa, BK virus
TVTGISSL

SEQ ID NO: 52433 - protein, 8 aa, BK virus
GLYQQSGM

SEQ ID NO: 52434 - protein, 8 aa, BK virus
ILFPGVNT

SEQ ID NO: 52435 - protein, 8 aa, BK virus
LTPQTYAV

SEQ ID NO: 52436 - protein, 8 aa, BK virus
NADSIEEV

SEQ ID NO: 52437 - protein, 8 aa, BK virus
LLLGLYGT

SEQ ID NO: 52438 - protein, 8 aa, BK virus
YLDPRHWG

SEQ ID NO: 52439 - protein, 8 aa, BK virus
EAAAAIEV

SEQ ID NO: 52440 - protein, 8 aa, BK virus
SIDNADSI

SEQ ID NO: 52441 - protein, 8 aa, BK virus
SVHSGEFI

SEQ ID NO: 52442 - protein, 8 aa, BK virus
NADSIEEV

SEQ ID NO: 52443 - protein, 8 aa, BK virus
QIASLATV

SEQ ID NO: 52444 - protein, 8 aa, BK virus
AAATGFSV

SEQ ID NO: 52445 - protein, 8 aa, BK virus
MLPLLLGL

SEQ ID NO: 52446 - protein, 8 aa, BK virus
SLATVEGI

SEQ ID NO: 52447 - protein, 8 aa, BK virus
YLDPRHWG

SEQ ID NO: 52448 - protein, 8 aa, BK virus
FAALIQTV

SEQ ID NO: 52449 - protein, 8 aa, BK virus
LLLGLYGT

SEQ ID NO: 52450 - protein, 8 aa, BK virus
FVNNIQYL

SEQ ID NO: 52451 - protein, 8 aa, BK virus
GISSLAQV

SEQ ID NO: 52452 - protein, 8 aa, BK virus
LLGLYGTV

SEQ ID NO: 52453 - protein, 8 aa, BK virus
GLTPQTYA

SEQ ID NO: 52454 - protein, 8 aa, BK virus
AIAGFAAL

SEQ ID NO: 52455 - protein, 8 aa, BK virus
ALLGDLVA

SEQ ID NO: 52456 - protein, 8 aa, BK virus
LTPQTYAV

SEQ ID NO: 52457 - protein, 8 aa, BK virus
TVTGISSL

SEQ ID NO: 52458 - protein, 8 aa, BK virus
FLEETTWT

SEQ ID NO: 52459 - protein, 8 aa, BK virus
EAAAAIEV

SEQ ID NO: 52460 - protein, 8 aa, BK virus
ILFPGVNT

SEQ ID NO: 52461 - protein, 8 aa, BK virus
YQQSGMAL

SEQ ID NO: 52462 - protein, 8 aa, BK virus
DLRNKESV

SEQ ID NO: 52463 - protein, 8 aa, BK virus
KVSTVGLY

SEQ ID NO: 52464 - protein, 8 aa, BK virus
VSRGSSQK

SEQ ID NO: 52465 - protein, 8 aa, BK virus
ASAKTTNK

SEQ ID NO: 52466 - protein, 8 aa, BK virus
HVNFGHTY

SEQ ID NO: 52467 - protein, 8 aa, BK virus
ASAKTTNK

SEQ ID NO: 52468 - protein, 8 aa, BK virus
HSGEFIEK

SEQ ID NO: 52469 - protein, 8 aa, BK virus
VTQRMDLR

SEQ ID NO: 52470 - protein, 8 aa, BK virus
KVSTVGLY

SEQ ID NO: 52471 - protein, 8 aa, BK virus
TTNKRRSR

SEQ ID NO: 52472 - protein, 8 aa, BK virus
SLAQVGYR

SEQ ID NO: 52473 - protein, 8 aa, BK virus
ITSQELQR

SEQ ID NO: 52474 - protein, 8 aa, BK virus
SSLAQVGY

SEQ ID NO: 52475 - protein, 8 aa, BK virus
VSRGSSQK

SEQ ID NO: 52476 - protein, 8 aa, BK virus
TSQELQRR

SEQ ID NO: 52477 - protein, 8 aa, BK virus
GYRFFSDW

SEQ ID NO: 52478 - protein, 8 aa, BK virus
QYLDPRHW

SEQ ID NO: 52479 - protein, 8 aa, BK virus
LFPGVNTF

SEQ ID NO: 52480 - protein, 8 aa, BK virus
FFSDWDHK

SEQ ID NO: 52481 - protein, 8 aa, BK virus
YYSNLSPI

SEQ ID NO: 52482 - protein, 8 aa, BK virus
RFLEETTW

SEQ ID NO: 52483 - protein, 8 aa, BK virus
YYSNLSPI

SEQ ID NO: 52484 - protein, 8 aa, BK virus
LFPGVNTF

SEQ ID NO: 52485 - protein, 8 aa, BK virus
QWMLPLLL

SEQ ID NO: 52486 - protein, 8 aa, BK virus
GYRFFSDW

SEQ ID NO: 52487 - protein, 8 aa, BK virus
RFLEETTW

SEQ ID NO: 52488 - protein, 8 aa, BK virus
YYSNLSPI

SEQ ID NO: 52489 - protein, 8 aa, BK virus
LFPGVNTF

SEQ ID NO: 52490 - protein, 8 aa, BK virus
QYLDPRHW

SEQ ID NO: 52491 - protein, 8 aa, BK virus
VTPALEAY

SEQ ID NO: 52492 - protein, 8 aa, BK virus
EVTQRMDL

SEQ ID NO: 52493 - protein, 8 aa, BK virus
ELFNPDEY

SEQ ID NO: 52494 - protein, 8 aa, BK virus
RTAPQWML

SEQ ID NO: 52495 - protein, 8 aa, BK virus
HVNFGHTY

SEQ ID NO: 52496 - protein, 8 aa, BK virus
KVSTVGLY

SEQ ID NO: 52497 - protein, 8 aa, BK virus
AIAGFAAL

SEQ ID NO: 52498 - protein, 8 aa, BK virus
ESVHSGEF

SEQ ID NO: 52499 - protein, 8 aa, BK virus
ATISQALW

SEQ ID NO: 52500 - protein, 8 aa, BK virus
FVNNIQYL

SEQ ID NO: 52501 - protein, 8 aa, BK virus
FYNYIQDY

SEQ ID NO: 52502 - protein, 8 aa, BK virus
HVNFGHTY

SEQ ID NO: 52503 - protein, 8 aa, BK virus
LFNPDEYY

SEQ ID NO: 52504 - protein, 8 aa, BK virus
TFVNNIQY

SEQ ID NO: 52505 - protein, 8 aa, BK virus
ELFNPDEY

SEQ ID NO: 52506 - protein, 8 aa, BK virus
YNYIQDYY

SEQ ID NO: 52507 - protein, 8 aa, BK virus
KVSTVGLY

SEQ ID NO: 52508 - protein, 8 aa, BK virus
VNAPINFY

SEQ ID NO: 52509 - protein, 8 aa, BK virus
VSRGSSQK

SEQ ID NO: 52510 - protein, 8 aa, BK virus
KGTRASAK

SEQ ID NO: 52511 - protein, 8 aa, BK virus
MVRQVAER

SEQ ID NO: 52512 - protein, 8 aa, BK virus
KRRSRSSR

SEQ ID NO: 52513 - protein, 8 aa, BK virus
ASAKTTNK

SEQ ID NO: 52514 - protein, 8 aa, BK virus
RGSSQKAK

SEQ ID NO: 52515 - protein, 8 aa, BK virus
KVSTVGLY

SEQ ID NO: 52516 - protein, 8 aa, BK virus
FYNYIQDY

SEQ ID NO: 52517 - protein, 8 aa, BK virus
TTNKRRSR

SEQ ID NO: 52518 - protein, 8 aa, BK virus
MVRQVAER

SEQ ID NO: 52519 - protein, 8 aa, BK virus
SQKAKGTR

SEQ ID NO: 52520 - protein, 8 aa, BK virus
VTQRMDLR

SEQ ID NO: 52521 - protein, 8 aa, BK virus
SAKTTNKR

SEQ ID NO: 52522 - protein, 8 aa, BK virus
FFRDSLAR

SEQ ID NO: 52523 - protein, 8 aa, BK virus
SLAQVGYR

SEQ ID NO: 52524 - protein, 8 aa, BK virus
YSNLSPIR

SEQ ID NO: 52525 - protein, 8 aa, BK virus
QALWHVIR

SEQ ID NO: 52526 - protein, 8 aa, BK virus
TSQELQRR

SEQ ID NO: 52527 - protein, 8 aa, BK virus
ELQRRTER

SEQ ID NO: 52528 - protein, 8 aa, BK virus
RRTERFFR

SEQ ID NO: 52529 - protein, 8 aa, BK virus
NIQYLDPR

SEQ ID NO: 52530 - protein, 8 aa, BK virus
ELQRRTER

SEQ ID NO: 52531 - protein, 8 aa, BK virus
MVRQVAER

SEQ ID NO: 52532 - protein, 8 aa, BK virus
FFRDSLAR

SEQ ID NO: 52533 - protein, 8 aa, BK virus
TTNKRRSR

SEQ ID NO: 52534 - protein, 8 aa, BK virus
NIQYLDPR

SEQ ID NO: 52535 - protein, 8 aa, BK virus
MVRQVAER

SEQ ID NO: 52536 - protein, 8 aa, BK virus
TTNKRRSR

SEQ ID NO: 52537 - protein, 8 aa, BK virus
ITSQELQR

SEQ ID NO: 52538 - protein, 8 aa, BK virus
SLAQVGYR

SEQ ID NO: 52539 - protein, 8 aa, BK virus
YSNLSPIR

SEQ ID NO: 52540 - protein, 8 aa, BK virus
SIEEVTQR

SEQ ID NO: 52541 - protein, 8 aa, BK virus
NIQYLDPR

SEQ ID NO: 52542 - protein, 8 aa, BK virus
QALWHVIR

SEQ ID NO: 52543 - protein, 8 aa, BK virus
ELQRRTER

SEQ ID NO: 52544 - protein, 8 aa, BK virus
VTQRMDLR

SEQ ID NO: 52545 - protein, 8 aa, BK virus
SAKTTNKR

SEQ ID NO: 52546 - protein, 8 aa, BK virus
TSQELQRR

SEQ ID NO: 52547 - protein, 8 aa, BK virus
HSGEFIEK

SEQ ID NO: 52548 - protein, 8 aa, BK virus
HVNFGHTY

SEQ ID NO: 52549 - protein, 8 aa, BK virus
NTFVNNIQ

SEQ ID NO: 52550 - protein, 8 aa, BK virus
ELFNPDEY

SEQ ID NO: 52551 - protein, 8 aa, BK virus
FFSDWDHK

SEQ ID NO: 52552 - protein, 8 aa, BK virus
EAAAAIEV

SEQ ID NO: 52553 - protein, 8 aa, BK virus
FAALIQTV

SEQ ID NO: 52554 - protein, 8 aa, BK virus
TVTGISSL

SEQ ID NO: 52555 - protein, 8 aa, BK virus
WTIVNAPI

SEQ ID NO: 52556 - protein, 8 aa, BK virus
EAIAAIGL

SEQ ID NO: 52557 - protein, 8 aa, BK virus
FVNNIQYL

SEQ ID NO: 52558 - protein, 8 aa, BK virus
TTWTIVNA

SEQ ID NO: 52559 - protein, 8 aa, BK virus
LTPQTYAV

SEQ ID NO: 52560 - protein, 8 aa, BK virus
HTYSIDNA

SEQ ID NO: 52561 - protein, 8 aa, BK virus
RTAPQWML

SEQ ID NO: 52562 - protein, 8 aa, BK virus
QIASLATV

SEQ ID NO: 52563 - protein, 8 aa, BK virus
MGAALALL

SEQ ID NO: 52564 - protein, 8 aa, BK virus
TTSEAIAA

SEQ ID NO: 52565 - protein, 8 aa, BK virus
EIAAGEAA

SEQ ID NO: 52566 - protein, 8 aa, BK virus
TGFSVAEI

SEQ ID NO: 52567 - protein, 8 aa, BK virus
LVASVSEA

SEQ ID NO: 52568 - protein, 8 aa, BK virus
AAATGFSV

SEQ ID NO: 52569 - protein, 8 aa, BK virus
AIAGFAAL

SEQ ID NO: 52570 - protein, 8 aa, BK virus
TSEAIAAI

SEQ ID NO: 52571 - protein, 8 aa, BK virus
TVTPALEA

SEQ ID NO: 52572 - protein, 8 aa, BK virus
ERFFRDSL

SEQ ID NO: 52573 - protein, 8 aa, BK virus
EVTQRMDL

SEQ ID NO: 52574 - protein, 8 aa, BK virus
FATISQAL

SEQ ID NO: 52575 - protein, 8 aa, BK virus
FSVAEIAA

SEQ ID NO: 52576 - protein, 8 aa, BK virus
SVSEAAAA

SEQ ID NO: 52577 - protein, 8 aa, BK virus
EVQIASLA

SEQ ID NO: 52578 - protein, 8 aa, BK virus
SLATVEGI

SEQ ID NO: 52579 - protein, 8 aa, BK virus
NADSIEEV

SEQ ID NO: 52580 - protein, 8 aa, BK virus
EAAAAIEV

SEQ ID NO: 52581 - protein, 8 aa, BK virus
TTWTIVNA

SEQ ID NO: 52582 - protein, 8 aa, BK virus
WTIVNAPI

SEQ ID NO: 52583 - protein, 8 aa, BK virus
QIASLATV

SEQ ID NO: 52584 - protein, 8 aa, BK virus
EAIAAIGL

SEQ ID NO: 52585 - protein, 8 aa, BK virus
FPGVNTFV

SEQ ID NO: 52586 - protein, 8 aa, BK virus
FAALIQTV

SEQ ID NO: 52587 - protein, 8 aa, BK virus
FSDWDHKV

SEQ ID NO: 52588 - protein, 8 aa, BK virus
EIAAGEAA

SEQ ID NO: 52589 - protein, 8 aa, BK virus
LTPQTYAV

SEQ ID NO: 52590 - protein, 8 aa, BK virus
FVNNIQYL

SEQ ID NO: 52591 - protein, 8 aa, BK virus
HTYSIDNA

SEQ ID NO: 52592 - protein, 8 aa, BK virus
NADSIEEV

SEQ ID NO: 52593 - protein, 8 aa, BK virus
TTSEAIAA

SEQ ID NO: 52594 - protein, 8 aa, BK virus
AAATGFSV

SEQ ID NO: 52595 - protein, 8 aa, BK virus
RTAPQWML

SEQ ID NO: 52596 - protein, 8 aa, BK virus
SPIRPSMV

SEQ ID NO: 52597 - protein, 8 aa, BK virus
APQWMLPL

SEQ ID NO: 52598 - protein, 8 aa, BK virus
RPSMVRQV

SEQ ID NO: 52599 - protein, 8 aa, BK virus
SPIRPSMV

SEQ ID NO: 52600 - protein, 8 aa, BK virus
GPSLFATI

SEQ ID NO: 52601 - protein, 8 aa, BK virus
FPGVNTFV

SEQ ID NO: 52602 - protein, 8 aa, BK virus
TPQTYAVI

SEQ ID NO: 52603 - protein, 8 aa, BK virus
APGAIAGF

SEQ ID NO: 52604 - protein, 8 aa, BK virus
YQQSGMAL

SEQ ID NO: 52605 - protein, 8 aa, BK virus
LQRRTERF

SEQ ID NO: 52606 - protein, 8 aa, BK virus
AQVGYRFF

SEQ ID NO: 52607 - protein, 8 aa, BK virus
HVNFGHTY

SEQ ID NO: 52608 - protein, 8 aa, BK virus
IVNAPINF

SEQ ID NO: 52609 - protein, 8 aa, BK virus
VQIASLAT

SEQ ID NO: 52610 - protein, 8 aa, BK virus
KVSTVGLY

SEQ ID NO: 52611 - protein, 8 aa, BK virus
SQALWHVI

SEQ ID NO: 52612 - protein, 8 aa, BK virus
DEYYDILF

SEQ ID NO: 52613 - protein, 8 aa, BK virus
IEVQIASL

SEQ ID NO: 52614 - protein, 8 aa, BK virus
AEREGTHV

SEQ ID NO: 52615 - protein, 8 aa, BK virus
RRTERFFR

SEQ ID NO: 52616 - protein, 8 aa, BK virus
KRRSRSSR

SEQ ID NO: 52617 - protein, 8 aa, BK virus
QRMDLRNK

SEQ ID NO: 52618 - protein, 8 aa, BK virus
RRVSRGSS

SEQ ID NO: 52619 - protein, 8 aa, BK virus
LPLLLGLY

SEQ ID NO: 52620 - protein, 8 aa, BK virus
EAAAATGF

SEQ ID NO: 52621 - protein, 8 aa, BK virus
HVNFGHTY

SEQ ID NO: 52622 - protein, 8 aa, BK virus
APINFYNY

SEQ ID NO: 52623 - protein, 8 aa, BK virus
FATISQAL

SEQ ID NO: 52624 - protein, 8 aa, BK virus
APQWMLPL

SEQ ID NO: 52625 - protein, 8 aa, BK virus
TFVNNIQY

SEQ ID NO: 52626 - protein, 8 aa, BK virus
LAQVGYRF

SEQ ID NO: 52627 - protein, 8 aa, BK virus
LFNPDEYY

SEQ ID NO: 52628 - protein, 8 aa, BK virus
APGAIAGF

SEQ ID NO: 52629 - protein, 8 aa, BK virus
YQQSGMAL

SEQ ID NO: 52630 - protein, 8 aa, BK virus
IEVQIASL

SEQ ID NO: 52631 - protein, 8 aa, BK virus
GEFIEKTI

SEQ ID NO: 52632 - protein, 8 aa, BK virus
DEYYDILF

SEQ ID NO: 52633 - protein, 8 aa, BK virus
REGTHVNF

SEQ ID NO: 52634 - protein, 8 aa, BK virus
AEREGTHV

SEQ ID NO: 52635 - protein, 8 aa, BK virus
REGTHVNF

SEQ ID NO: 52636 - protein, 8 aa, BK virus
EETTWTIV

SEQ ID NO: 52637 - protein, 8 aa, BK virus
GEFIEKTI

SEQ ID NO: 52638 - protein, 8 aa, BK virus
AEIAAGEA

SEQ ID NO: 52639 - protein, 8 aa, BK virus
REGTHVNF

SEQ ID NO: 52640 - protein, 8 aa, BK virus
AEIAAGEA

SEQ ID NO: 52641 - protein, 8 aa, BK virus
AEREGTHV

SEQ ID NO: 52642 - protein, 8 aa, BK virus
EETTWTIV

SEQ ID NO: 52643 - protein, 8 aa, BK virus
GPSLFATI

SEQ ID NO: 52644 - protein, 8 aa, BK virus
TPQTYAVI

SEQ ID NO: 52645 - protein, 8 aa, BK virus
LPLLLGLY

SEQ ID NO: 52646 - protein, 8 aa, BK virus
FPGVNTFV

SEQ ID NO: 52647 - protein, 8 aa, BK virus
SPIRPSMV

SEQ ID NO: 52648 - protein, 8 aa, BK virus
APINFYNY

SEQ ID NO: 52649 - protein, 8 aa, BK virus
FPGVNTFV

SEQ ID NO: 52650 - protein, 8 aa, BK virus
TPQTYAVI

SEQ ID NO: 52651 - protein, 8 aa, BK virus
GPSLFATI

SEQ ID NO: 52652 - protein, 8 aa, BK virus
FPGVNTFV

SEQ ID NO: 52653 - protein, 8 aa, BK virus
LPLLLGLY

SEQ ID NO: 52654 - protein, 8 aa, BK virus
FAALIQTV

SEQ ID NO: 52655 - protein, 8 aa, BK virus
ATISQALW

SEQ ID NO: 52656 - protein, 8 aa, BK virus
RFLEETTW

SEQ ID NO: 52657 - protein, 8 aa, BK virus
RTAPQWML

SEQ ID NO: 52658 - protein, 8 aa, BK virus
IVNAPINF

SEQ ID NO: 52659 - protein, 9 aa, BK virus
NTFVNNIQY

SEQ ID NO: 52660 - protein, 9 aa, BK virus
FLEETTWTI

SEQ ID NO: 52661 - protein, 9 aa, BK virus
LLGDLVASV

SEQ ID NO: 52662 - protein, 9 aa, BK virus
WMLPLLLGL

SEQ ID NO: 52663 - protein, 9 aa, BK virus
YIQDYYSNL

SEQ ID NO: 52664 - protein, 9 aa, BK virus
GLTPQTYAV

SEQ ID NO: 52665 - protein, 9 aa, BK virus
ALIQTVTGI

SEQ ID NO: 52666 - protein, 9 aa, BK virus
GLYGTVTPA

SEQ ID NO: 52667 - protein, 9 aa, BK virus
TISQALWHV

SEQ ID NO: 52668 - protein, 9 aa, BK virus
VQIASLATV

SEQ ID NO: 52669 - protein, 9 aa, BK virus
LLLGLYGTV

SEQ ID NO: 52670 - protein, 9 aa, BK virus
SLFATISQA

SEQ ID NO: 52671 - protein, 9 aa, BK virus
ALALLGDLV

SEQ ID NO: 52672 - protein, 9 aa, BK virus
AIAGFAALI

SEQ ID NO: 52673 - protein, 9 aa, BK virus
AAAATGFSV

SEQ ID NO: 52674 - protein, 9 aa, BK virus
FFSDWDHKV

SEQ ID NO: 52675 - protein, 9 aa, BK virus
SLARFLEET

SEQ ID NO: 52676 - protein, 9 aa, BK virus
GLTPQTYAV

SEQ ID NO: 52677 - protein, 9 aa, BK virus
LLGDLVASV

SEQ ID NO: 52678 - protein, 9 aa, BK virus
FLEETTWTI

SEQ ID NO: 52679 - protein, 9 aa, BK virus
ALALLGDLV

SEQ ID NO: 52680 - protein, 9 aa, BK virus
YIQDYYSNL

SEQ ID NO: 52681 - protein, 9 aa, BK virus
TISQALWHV

SEQ ID NO: 52682 - protein, 9 aa, BK virus
SLFATISQA

SEQ ID NO: 52683 - protein, 9 aa, BK virus
WMLPLLLGL

SEQ ID NO: 52684 - protein, 9 aa, BK virus
GLYGTVTPA

SEQ ID NO: 52685 - protein, 9 aa, BK virus
ALIQTVTGI

SEQ ID NO: 52686 - protein, 9 aa, BK virus
SLARFLEET

SEQ ID NO: 52687 - protein, 9 aa, BK virus
LVASVSEAA

SEQ ID NO: 52688 - protein, 9 aa, BK virus
TTSEAIAAI

SEQ ID NO: 52689 - protein, 9 aa, BK virus
AIAGFAALI

SEQ ID NO: 52690 - protein, 9 aa, BK virus
LLLGLYGTV

SEQ ID NO: 52691 - protein, 9 aa, BK virus
VQIASLATV

SEQ ID NO: 52692 - protein, 9 aa, BK virus
AAAAIEVQI

SEQ ID NO: 52693 - protein, 9 aa, BK virus
NLSPIRPSM

SEQ ID NO: 52694 - protein, 9 aa, BK virus
FAALIQTVT

SEQ ID NO: 52695 - protein, 9 aa, BK virus
GLYQQSGMA

SEQ ID NO: 52696 - protein, 9 aa, BK virus
GAIAGFAAL

SEQ ID NO: 52697 - protein, 9 aa, BK virus
AAAATGFSV

SEQ ID NO: 52698 - protein, 9 aa, BK virus
QTYAVIAGA

SEQ ID NO: 52699 - protein, 9 aa, BK virus
AIEVQIASL

SEQ ID NO: 52700 - protein, 9 aa, BK virus
GVNTFVNNI

SEQ ID NO: 52701 - protein, 9 aa, BK virus
ILFPGVNTF

SEQ ID NO: 52702 - protein, 9 aa, BK virus
FFSDWDHKV

SEQ ID NO: 52703 - protein, 9 aa, BK virus
LLGDLVASV

SEQ ID NO: 52704 - protein, 9 aa, BK virus
GLYGTVTPA

SEQ ID NO: 52705 - protein, 9 aa, BK virus
GLTPQTYAV

SEQ ID NO: 52706 - protein, 9 aa, BK virus
ALIQTVTGI

SEQ ID NO: 52707 - protein, 9 aa, BK virus
VQIASLATV

SEQ ID NO: 52708 - protein, 9 aa, BK virus
YIQDYYSNL

SEQ ID NO: 52709 - protein, 9 aa, BK virus
WMLPLLLGL

SEQ ID NO: 52710 - protein, 9 aa, BK virus
LLLGLYGTV

SEQ ID NO: 52711 - protein, 9 aa, BK virus
FLEETTWTI

SEQ ID NO: 52712 - protein, 9 aa, BK virus
GLYQQSGMA

SEQ ID NO: 52713 - protein, 9 aa, BK virus
SLFATISQA

SEQ ID NO: 52714 - protein, 9 aa, BK virus
QTYAVIAGA

SEQ ID NO: 52715 - protein, 9 aa, BK virus
ALALLGDLV

SEQ ID NO: 52716 - protein, 9 aa, BK virus
VIAGAPGAI

SEQ ID NO: 52717 - protein, 9 aa, BK virus
GVNTFVNNI

SEQ ID NO: 52718 - protein, 9 aa, BK virus
AIAGFAALI

SEQ ID NO: 52719 - protein, 9 aa, BK virus
SLARFLEET

SEQ ID NO: 52720 - protein, 9 aa, BK virus
TISQALWHV

SEQ ID NO: 52721 - protein, 9 aa, BK virus
QTVTGISSL

SEQ ID NO: 52722 - protein, 9 aa, BK virus
TTSEAIAAI

SEQ ID NO: 52723 - protein, 9 aa, BK virus
VIRDDIPAI

SEQ ID NO: 52724 - protein, 9 aa, BK virus
AAAATGFSV

SEQ ID NO: 52725 - protein, 9 aa, BK virus
GAIAGFAAL

SEQ ID NO: 52726 - protein, 9 aa, BK virus
LVASVSEAA

SEQ ID NO: 52727 - protein, 9 aa, BK virus
AAATGFSVA

SEQ ID NO: 52728 - protein, 9 aa, BK virus
ATGFSVAEI

SEQ ID NO: 52729 - protein, 9 aa, BK virus
GFAALIQTV

SEQ ID NO: 52730 - protein, 9 aa, BK virus
NLSPIRPSM

SEQ ID NO: 52731 - protein, 9 aa, BK virus
LLGDLVASV

SEQ ID NO: 52732 - protein, 9 aa, BK virus
FLEETTWTI

SEQ ID NO: 52733 - protein, 9 aa, BK virus
GLTPQTYAV

SEQ ID NO: 52734 - protein, 9 aa, BK virus
ALIQTVTGI

SEQ ID NO: 52735 - protein, 9 aa, BK virus
SLFATISQA

SEQ ID NO: 52736 - protein, 9 aa, BK virus
LLLGLYGTV

SEQ ID NO: 52737 - protein, 9 aa, BK virus
FFSDWDHKV

SEQ ID NO: 52738 - protein, 9 aa, BK virus
AAAATGFSV

SEQ ID NO: 52739 - protein, 9 aa, BK virus
WMLPLLLGL

SEQ ID NO: 52740 - protein, 9 aa, BK virus
YIQDYYSNL

SEQ ID NO: 52741 - protein, 9 aa, BK virus
GLYGTVTPA

SEQ ID NO: 52742 - protein, 9 aa, BK virus
TISQALWHV

SEQ ID NO: 52743 - protein, 9 aa, BK virus
SLARFLEET

SEQ ID NO: 52744 - protein, 9 aa, BK virus
VQIASLATV

SEQ ID NO: 52745 - protein, 9 aa, BK virus
WMLPLLLGL

SEQ ID NO: 52746 - protein, 9 aa, BK virus
FLEETTWTI

SEQ ID NO: 52747 - protein, 9 aa, BK virus
GLTPQTYAV

SEQ ID NO: 52748 - protein, 9 aa, BK virus
TISQALWHV

SEQ ID NO: 52749 - protein, 9 aa, BK virus
LLGDLVASV

SEQ ID NO: 52750 - protein, 9 aa, BK virus
GAIAGFAAL

SEQ ID NO: 52751 - protein, 9 aa, BK virus
AVIAGAPGA

SEQ ID NO: 52752 - protein, 9 aa, BK virus
AAAATGFSV

SEQ ID NO: 52753 - protein, 9 aa, BK virus
ALIQTVTGI

SEQ ID NO: 52754 - protein, 9 aa, BK virus
LLLGLYGTV

SEQ ID NO: 52755 - protein, 9 aa, BK virus
ATVEGITTT

SEQ ID NO: 52756 - protein, 9 aa, BK virus
AQVGYRFFS

SEQ ID NO: 52757 - protein, 9 aa, BK virus
YLDPRHWGP

SEQ ID NO: 52758 - protein, 9 aa, BK virus
YIQDYYSNL

SEQ ID NO: 52759 - protein, 9 aa, BK virus
TTSEAIAAI

SEQ ID NO: 52760 - protein, 9 aa, BK virus
LVASVSEAA

SEQ ID NO: 52761 - protein, 9 aa, BK virus
YYDILFPGV

SEQ ID NO: 52762 - protein, 9 aa, BK virus
TAPQWMLPL

SEQ ID NO: 52763 - protein, 9 aa, BK virus
YQQSGMALE

SEQ ID NO: 52764 - protein, 9 aa, BK virus
YSIDNADSI

SEQ ID NO: 52765 - protein, 9 aa, BK virus
AAATGFSVA

SEQ ID NO: 52766 - protein, 9 aa, BK virus
GLYGTVTPA

SEQ ID NO: 52767 - protein, 9 aa, BK virus
QTVTGISSL

SEQ ID NO: 52768 - protein, 9 aa, BK virus
AIAGFAALI

SEQ ID NO: 52769 - protein, 9 aa, BK virus
AAGEAAAAI

SEQ ID NO: 52770 - protein, 9 aa, BK virus
ILFPGVNTF

SEQ ID NO: 52771 - protein, 9 aa, BK virus
RQVAEREGT

SEQ ID NO: 52772 - protein, 9 aa, BK virus
ALALLGDLV

SEQ ID NO: 52773 - protein, 9 aa, BK virus
QTYAVIAGA

SEQ ID NO: 52774 - protein, 9 aa, BK virus
ALLGDLVAS

SEQ ID NO: 52775 - protein, 9 aa, BK virus
VIRDDIPAI

SEQ ID NO: 52776 - protein, 9 aa, BK virus
QQSGMALEL

SEQ ID NO: 52777 - protein, 9 aa, BK virus
GLTPQTYAV

SEQ ID NO: 52778 - protein, 9 aa, BK virus
LLGDLVASV

SEQ ID NO: 52779 - protein, 9 aa, BK virus
LLLGLYGTV

SEQ ID NO: 52780 - protein, 9 aa, BK virus
WMLPLLLGL

SEQ ID NO: 52781 - protein, 9 aa, BK virus
FLEETTWTI

SEQ ID NO: 52782 - protein, 9 aa, BK virus
TISQALWHV

SEQ ID NO: 52783 - protein, 9 aa, BK virus
SLFATISQA

SEQ ID NO: 52784 - protein, 9 aa, BK virus
GLYGTVTPA

SEQ ID NO: 52785 - protein, 9 aa, BK virus
FFSDWDHKV

SEQ ID NO: 52786 - protein, 9 aa, BK virus
YLDPRHWGP

SEQ ID NO: 52787 - protein, 9 aa, BK virus
ALALLGDLV

SEQ ID NO: 52788 - protein, 9 aa, BK virus
YIQDYYSNL

SEQ ID NO: 52789 - protein, 9 aa, BK virus
NLSPIRPSM

SEQ ID NO: 52790 - protein, 9 aa, BK virus
ILFPGVNTF

SEQ ID NO: 52791 - protein, 9 aa, BK virus
AIAGFAALI

SEQ ID NO: 52792 - protein, 9 aa, BK virus
SLARFLEET

SEQ ID NO: 52793 - protein, 9 aa, BK virus
ALIQTVTGI

SEQ ID NO: 52794 - protein, 9 aa, BK virus
YYDILFPGV

SEQ ID NO: 52795 - protein, 9 aa, BK virus
SLAQVGYRF

SEQ ID NO: 52796 - protein, 9 aa, BK virus
GFAALIQTV

SEQ ID NO: 52797 - protein, 9 aa, BK virus
ALLGDLVAS

SEQ ID NO: 52798 - protein, 9 aa, BK virus
GLYQQSGMA

SEQ ID NO: 52799 - protein, 9 aa, BK virus
AAAATGFSV

SEQ ID NO: 52800 - protein, 9 aa, BK virus
PLLLGLYGT

SEQ ID NO: 52801 - protein, 9 aa, BK virus
LFPGVNTFV

SEQ ID NO: 52802 - protein, 9 aa, BK virus
VIRDDIPAI

SEQ ID NO: 52803 - protein, 9 aa, BK virus
SIEEVTQRM

SEQ ID NO: 52804 - protein, 9 aa, BK virus
TVTGISSLA

SEQ ID NO: 52805 - protein, 9 aa, BK virus
TAPQWMLPL

SEQ ID NO: 52806 - protein, 9 aa, BK virus
EIAAGEAAA

SEQ ID NO: 52807 - protein, 9 aa, BK virus
LLGDLVASV

SEQ ID NO: 52808 - protein, 9 aa, BK virus
GLTPQTYAV

SEQ ID NO: 52809 - protein, 9 aa, BK virus
LLLGLYGTV

SEQ ID NO: 52810 - protein, 9 aa, BK virus
WMLPLLLGL

SEQ ID NO: 52811 - protein, 9 aa, BK virus
YIQDYYSNL

SEQ ID NO: 52812 - protein, 9 aa, BK virus
FLEETTWTI

SEQ ID NO: 52813 - protein, 9 aa, BK virus
YLDPRHWGP

SEQ ID NO: 52814 - protein, 9 aa, BK virus
FFSDWDHKV

SEQ ID NO: 52815 - protein, 9 aa, BK virus
GLYGTVTPA

SEQ ID NO: 52816 - protein, 9 aa, BK virus
TISQALWHV

SEQ ID NO: 52817 - protein, 9 aa, BK virus
ILFPGVNTF

SEQ ID NO: 52818 - protein, 9 aa, BK virus
VIRDDIPAI

SEQ ID NO: 52819 - protein, 9 aa, BK virus
SLFATISQA

SEQ ID NO: 52820 - protein, 9 aa, BK virus
ALIQTVTGI

SEQ ID NO: 52821 - protein, 9 aa, BK virus
SLARFLEET

SEQ ID NO: 52822 - protein, 9 aa, BK virus
ALALLGDLV

SEQ ID NO: 52823 - protein, 9 aa, BK virus
YYDILFPGV

SEQ ID NO: 52824 - protein, 9 aa, BK virus
NLSPIRPSM

SEQ ID NO: 52825 - protein, 9 aa, BK virus
ALLGDLVAS

SEQ ID NO: 52826 - protein, 9 aa, BK virus
GFAALIQTV

SEQ ID NO: 52827 - protein, 9 aa, BK virus
LFPGVNTFV

SEQ ID NO: 52828 - protein, 9 aa, BK virus
PLLLGLYGT

SEQ ID NO: 52829 - protein, 9 aa, BK virus
EIAAGEAAA

SEQ ID NO: 52830 - protein, 9 aa, BK virus
AAAATGFSV

SEQ ID NO: 52831 - protein, 9 aa, BK virus
AIAGFAALI

SEQ ID NO: 52832 - protein, 9 aa, BK virus
SIEEVTQRM

SEQ ID NO: 52833 - protein, 9 aa, BK virus
LLGDLVASV

SEQ ID NO: 52834 - protein, 9 aa, BK virus
GLTPQTYAV

SEQ ID NO: 52835 - protein, 9 aa, BK virus
LLLGLYGTV

SEQ ID NO: 52836 - protein, 9 aa, BK virus
TISQALWHV

SEQ ID NO: 52837 - protein, 9 aa, BK virus
FLEETTWTI

SEQ ID NO: 52838 - protein, 9 aa, BK virus
SLFATISQA

SEQ ID NO: 52839 - protein, 9 aa, BK virus
GLYGTVTPA

SEQ ID NO: 52840 - protein, 9 aa, BK virus
YIQDYYSNL

SEQ ID NO: 52841 - protein, 9 aa, BK virus
FFSDWDHKV

SEQ ID NO: 52842 - protein, 9 aa, BK virus
LFPGVNTFV

SEQ ID NO: 52843 - protein, 9 aa, BK virus
WMLPLLLGL

SEQ ID NO: 52844 - protein, 9 aa, BK virus
ALALLGDLV

SEQ ID NO: 52845 - protein, 9 aa, BK virus
SLARFLEET

SEQ ID NO: 52846 - protein, 9 aa, BK virus
ALIQTVTGI

SEQ ID NO: 52847 - protein, 9 aa, BK virus
NLSPIRPSM

SEQ ID NO: 52848 - protein, 9 aa, BK virus
AIAGFAALI

SEQ ID NO: 52849 - protein, 9 aa, BK virus
AAAATGFSV

SEQ ID NO: 52850 - protein, 9 aa, BK virus
ILFPGVNTF

SEQ ID NO: 52851 - protein, 9 aa, BK virus
GLYQQSGMA

SEQ ID NO: 52852 - protein, 9 aa, BK virus
SLAQVGYRF

SEQ ID NO: 52853 - protein, 9 aa, BK virus
GFAALIQTV

SEQ ID NO: 52854 - protein, 9 aa, BK virus
LLGDLVASV

SEQ ID NO: 52855 - protein, 9 aa, BK virus
WMLPLLLGL

SEQ ID NO: 52856 - protein, 9 aa, BK virus
GLTPQTYAV

SEQ ID NO: 52857 - protein, 9 aa, BK virus
FLEETTWTI

SEQ ID NO: 52858 - protein, 9 aa, BK virus
TISQALWHV

SEQ ID NO: 52859 - protein, 9 aa, BK virus
FFSDWDHKV

SEQ ID NO: 52860 - protein, 9 aa, BK virus
YIQDYYSNL

SEQ ID NO: 52861 - protein, 9 aa, BK virus
LLLGLYGTV

SEQ ID NO: 52862 - protein, 9 aa, BK virus
YLDPRHWGP

SEQ ID NO: 52863 - protein, 9 aa, BK virus
ALIQTVTGI

SEQ ID NO: 52864 - protein, 9 aa, BK virus
AAAATGFSV

SEQ ID NO: 52865 - protein, 9 aa, BK virus
SLFATISQA

SEQ ID NO: 52866 - protein, 9 aa, BK virus
GLYGTVTPA

SEQ ID NO: 52867 - protein, 9 aa, BK virus
PLLLGLYGT

SEQ ID NO: 52868 - protein, 9 aa, BK virus
YYDILFPGV

SEQ ID NO: 52869 - protein, 9 aa, BK virus
NLSPIRPSM

SEQ ID NO: 52870 - protein, 9 aa, BK virus
VIRDDIPAI

SEQ ID NO: 52871 - protein, 9 aa, BK virus
ILFPGVNTF

SEQ ID NO: 52872 - protein, 9 aa, BK virus
ALALLGDLV

SEQ ID NO: 52873 - protein, 9 aa, BK virus
RVSRGSSQK

SEQ ID NO: 52874 - protein, 9 aa, BK virus
RASAKTTNK

SEQ ID NO: 52875 - protein, 9 aa, BK virus
IVNAPINFY

SEQ ID NO: 52876 - protein, 9 aa, BK virus
MLPLLLGLY

SEQ ID NO: 52877 - protein, 9 aa, BK virus
RASAKTTNK

SEQ ID NO: 52878 - protein, 9 aa, BK virus
RVSRGSSQK

SEQ ID NO: 52879 - protein, 9 aa, BK virus
SSLAQVGYR

SEQ ID NO: 52880 - protein, 9 aa, BK virus
IVNAPINFY

SEQ ID NO: 52881 - protein, 9 aa, BK virus
RFFSDWDHK

SEQ ID NO: 52882 - protein, 9 aa, BK virus
ATISQALWH

SEQ ID NO: 52883 - protein, 9 aa, BK virus
SQALWHVIR

SEQ ID NO: 52884 - protein, 9 aa, BK virus
AITSQELQR

SEQ ID NO: 52885 - protein, 9 aa, BK virus
TFVNNIQYL

SEQ ID NO: 52886 - protein, 9 aa, BK virus
FFRDSLARF

SEQ ID NO: 52887 - protein, 9 aa, BK virus
LYQQSGMAL

SEQ ID NO: 52888 - protein, 9 aa, BK virus
ILFPGVNTF

SEQ ID NO: 52889 - protein, 9 aa, BK virus
LYGTVTPAL

SEQ ID NO: 52890 - protein, 9 aa, BK virus
DYYSNLSPI

SEQ ID NO: 52891 - protein, 9 aa, BK virus
AYEDGPNQK

SEQ ID NO: 52892 - protein, 9 aa, BK virus
TIVNAPINF

SEQ ID NO: 52893 - protein, 9 aa, BK virus
RFFSDWDHK

SEQ ID NO: 52894 - protein, 9 aa, BK virus
SLAQVGYRF

SEQ ID NO: 52895 - protein, 9 aa, BK virus
LYGTVTPAL

SEQ ID NO: 52896 - protein, 9 aa, BK virus
DYYSNLSPI

SEQ ID NO: 52897 - protein, 9 aa, BK virus
LFATISQAL

SEQ ID NO: 52898 - protein, 9 aa, BK virus
LYQQSGMAL

SEQ ID NO: 52899 - protein, 9 aa, BK virus
TWTIVNAPI

SEQ ID NO: 52900 - protein, 9 aa, BK virus
LYQQSGMAL

SEQ ID NO: 52901 - protein, 9 aa, BK virus
TFVNNIQYL

SEQ ID NO: 52902 - protein, 9 aa, BK virus
FFRDSLARF

SEQ ID NO: 52903 - protein, 9 aa, BK virus
LYGTVTPAL

SEQ ID NO: 52904 - protein, 9 aa, BK virus
WMLPLLLGL

SEQ ID NO: 52905 - protein, 9 aa, BK virus
ELFNPDEYY

SEQ ID NO: 52906 - protein, 9 aa, BK virus
TVTPALEAY

SEQ ID NO: 52907 - protein, 9 aa, BK virus
IVNAPINFY

SEQ ID NO: 52908 - protein, 9 aa, BK virus
ELFNPDEYY

SEQ ID NO: 52909 - protein, 9 aa, BK virus
QTVTGISSL

SEQ ID NO: 52910 - protein, 9 aa, BK virus
YIQDYYSNL

SEQ ID NO: 52911 - protein, 9 aa, BK virus
MLPLLLGLY

SEQ ID NO: 52912 - protein, 9 aa, BK virus
ELQRRTERF

SEQ ID NO: 52913 - protein, 9 aa, BK virus
AIEVQIASL

SEQ ID NO: 52914 - protein, 9 aa, BK virus
NTFVNNIQY

SEQ ID NO: 52915 - protein, 9 aa, BK virus
FFRDSLARF

SEQ ID NO: 52916 - protein, 9 aa, BK virus
TIVNAPINF

SEQ ID NO: 52917 - protein, 9 aa, BK virus
LTPQTYAVI

SEQ ID NO: 52918 - protein, 9 aa, BK virus
FYNYIQDYY

SEQ ID NO: 52919 - protein, 9 aa, BK virus
ELFNPDEYY

SEQ ID NO: 52920 - protein, 9 aa, BK virus
NTFVNNIQY

SEQ ID NO: 52921 - protein, 9 aa, BK virus
IVNAPINFY

SEQ ID NO: 52922 - protein, 9 aa, BK virus
NFYNYIQDY

SEQ ID NO: 52923 - protein, 9 aa, BK virus
MLPLLLGLY

SEQ ID NO: 52924 - protein, 9 aa, BK virus
RFFSDWDHK

SEQ ID NO: 52925 - protein, 9 aa, BK virus
RVSRGSSQK

SEQ ID NO: 52926 - protein, 9 aa, BK virus
RASAKTTNK

SEQ ID NO: 52927 - protein, 9 aa, BK virus
RFFRDSLAR

SEQ ID NO: 52928 - protein, 9 aa, BK virus
KAKGTRASA

SEQ ID NO: 52929 - protein, 9 aa, BK virus
FYNYIQDYY

SEQ ID NO: 52930 - protein, 9 aa, BK virus
IVNAPINFY

SEQ ID NO: 52931 - protein, 9 aa, BK virus
MLPLLLGLY

SEQ ID NO: 52932 - protein, 9 aa, BK virus
KTTNKRRSR

SEQ ID NO: 52933 - protein, 9 aa, BK virus
NQKKRRVSR

SEQ ID NO: 52934 - protein, 9 aa, BK virus
SMVRQVAER

SEQ ID NO: 52935 - protein, 9 aa, BK virus
RFFRDSLAR

SEQ ID NO: 52936 - protein, 9 aa, BK virus
SSLAQVGYR

SEQ ID NO: 52937 - protein, 9 aa, BK virus
SQALWHVIR

SEQ ID NO: 52938 - protein, 9 aa, BK virus
SSQKAKGTR

SEQ ID NO: 52939 - protein, 9 aa, BK virus
RASAKTTNK

SEQ ID NO: 52940 - protein, 9 aa, BK virus
YYSNLSPIR

SEQ ID NO: 52941 - protein, 9 aa, BK virus
SAKTTNKRR

SEQ ID NO: 52942 - protein, 9 aa, BK virus
RFFSDWDHK

SEQ ID NO: 52943 - protein, 9 aa, BK virus
ASAKTTNKR

SEQ ID NO: 52944 - protein, 9 aa, BK virus
RVSRGSSQK

SEQ ID NO: 52945 - protein, 9 aa, BK virus
EVTQRMDLR

SEQ ID NO: 52946 - protein, 9 aa, BK virus
NQKKRRVSR

SEQ ID NO: 52947 - protein, 9 aa, BK virus
DSIEEVTQR

SEQ ID NO: 52948 - protein, 9 aa, BK virus
NKRRSRSSR

SEQ ID NO: 52949 - protein, 9 aa, BK virus
EVTQRMDLR

SEQ ID NO: 52950 - protein, 9 aa, BK virus
DSIEEVTQR

SEQ ID NO: 52951 - protein, 9 aa, BK virus
NTFVNNIQY

SEQ ID NO: 52952 - protein, 9 aa, BK virus
ITSQELQRR

SEQ ID NO: 52953 - protein, 9 aa, BK virus
IAPGGANQR

SEQ ID NO: 52954 - protein, 9 aa, BK virus
YYSNLSPIR

SEQ ID NO: 52955 - protein, 9 aa, BK virus
SSLAQVGYR

SEQ ID NO: 52956 - protein, 9 aa, BK virus
SMVRQVAER

SEQ ID NO: 52957 - protein, 9 aa, BK virus
ASAKTTNKR

SEQ ID NO: 52958 - protein, 9 aa, BK virus
ELFNPDEYY

SEQ ID NO: 52959 - protein, 9 aa, BK virus
FYNYIQDYY

SEQ ID NO: 52960 - protein, 9 aa, BK virus
AITSQELQR

SEQ ID NO: 52961 - protein, 9 aa, BK virus
NNIQYLDPR

SEQ ID NO: 52962 - protein, 9 aa, BK virus
SSQKAKGTR

SEQ ID NO: 52963 - protein, 9 aa, BK virus
RVSRGSSQK

SEQ ID NO: 52964 - protein, 9 aa, BK virus
TVTPALEAY

SEQ ID NO: 52965 - protein, 9 aa, BK virus
SQALWHVIR

SEQ ID NO: 52966 - protein, 9 aa, BK virus
IVNAPINFY

SEQ ID NO: 52967 - protein, 9 aa, BK virus
KTTNKRRSR

SEQ ID NO: 52968 - protein, 9 aa, BK virus
SAKTTNKRR

SEQ ID NO: 52969 - protein, 9 aa, BK virus
QTYAVIAGA

SEQ ID NO: 52970 - protein, 9 aa, BK virus
TTSEAIAAI

SEQ ID NO: 52971 - protein, 9 aa, BK virus
TVTGISSLA

SEQ ID NO: 52972 - protein, 9 aa, BK virus
LVASVSEAA

SEQ ID NO: 52973 - protein, 9 aa, BK virus
ETTWTIVNA

SEQ ID NO: 52974 - protein, 9 aa, BK virus
QTVTGISSL

SEQ ID NO: 52975 - protein, 9 aa, BK virus
EAAAATGFS

SEQ ID NO: 52976 - protein, 9 aa, BK virus
ESVHSGEFI

SEQ ID NO: 52977 - protein, 9 aa, BK virus
EIAAGEAAA

SEQ ID NO: 52978 - protein, 9 aa, BK virus
AAAATGFSV

SEQ ID NO: 52979 - protein, 9 aa, BK virus
DNADSIEEV

SEQ ID NO: 52980 - protein, 9 aa, BK virus
HVIRDDIPA

SEQ ID NO: 52981 - protein, 9 aa, BK virus
TISQALWHV

SEQ ID NO: 52982 - protein, 9 aa, BK virus
TGISSLAQV

SEQ ID NO: 52983 - protein, 9 aa, BK virus
EGITTTSEA

SEQ ID NO: 52984 - protein, 9 aa, BK virus
YSIDNADSI

SEQ ID NO: 52985 - protein, 9 aa, BK virus
AIAGFAALI

SEQ ID NO: 52986 - protein, 9 aa, BK virus
EAIAAIGLT

SEQ ID NO: 52987 - protein, 9 aa, BK virus
FAALIQTVT

SEQ ID NO: 52988 - protein, 9 aa, BK virus
WGPSLFATI

SEQ ID NO: 52989 - protein, 9 aa, BK virus
AAAAIEVQI

SEQ ID NO: 52990 - protein, 9 aa, BK virus
TAPQWMLPL

SEQ ID NO: 52991 - protein, 9 aa, BK virus
TTTSEAIAA

SEQ ID NO: 52992 - protein, 9 aa, BK virus
QTYAVIAGA

SEQ ID NO: 52993 - protein, 9 aa, BK virus
ETTWTIVNA

SEQ ID NO: 52994 - protein, 9 aa, BK virus
TTSEAIAAI

SEQ ID NO: 52995 - protein, 9 aa, BK virus
TISQALWHV

SEQ ID NO: 52996 - protein, 9 aa, BK virus
WMLPLLLGL

SEQ ID NO: 52997 - protein, 9 aa, BK virus
AAAATGFSV

SEQ ID NO: 52998 - protein, 9 aa, BK virus
EIAAGEAAA

SEQ ID NO: 52999 - protein, 9 aa, BK virus
FLEETTWTI

SEQ ID NO: 53000 - protein, 9 aa, BK virus
TAPQWMLPL

SEQ ID NO: 53001 - protein, 9 aa, BK virus
LLGDLVASV

SEQ ID NO: 53002 - protein, 9 aa, BK virus
LLLGLYGTV

SEQ ID NO: 53003 - protein, 9 aa, BK virus
FFSDWDHKV

SEQ ID NO: 53004 - protein, 9 aa, BK virus
RPSMVRQVA

SEQ ID NO: 53005 - protein, 9 aa, BK virus
IPAITSQEL

SEQ ID NO: 53006 - protein, 9 aa, BK virus
DPRHWGPSL

SEQ ID NO: 53007 - protein, 9 aa, BK virus
APQWMLPLL

SEQ ID NO: 53008 - protein, 9 aa, BK virus
GPNQKKRRV

SEQ ID NO: 53009 - protein, 9 aa, BK virus
APINFYNYI

SEQ ID NO: 53010 - protein, 9 aa, BK virus
ILFPGVNTF

SEQ ID NO: 53011 - protein, 9 aa, BK virus
IVNAPINFY

SEQ ID NO: 53012 - protein, 9 aa, BK virus
LQRRTERFF

SEQ ID NO: 53013 - protein, 9 aa, BK virus
QQSGMALEL

SEQ ID NO: 53014 - protein, 9 aa, BK virus
VQIASLATV

SEQ ID NO: 53015 - protein, 9 aa, BK virus
ELFNPDEYY

SEQ ID NO: 53016 - protein, 9 aa, BK virus
SLAQVGYRF

SEQ ID NO: 53017 - protein, 9 aa, BK virus
TERFFRDSL

SEQ ID NO: 53018 - protein, 9 aa, BK virus
WMLPLLLGL

SEQ ID NO: 53019 - protein, 9 aa, BK virus
DPRHWGPSL

SEQ ID NO: 53020 - protein, 9 aa, BK virus
SEAIAAIGL

SEQ ID NO: 53021 - protein, 9 aa, BK virus
EEVTQRMDL

SEQ ID NO: 53022 - protein, 9 aa, BK virus
SEAAAATGF

SEQ ID NO: 53023 - protein, 9 aa, BK virus
RRVSRGSSQ

SEQ ID NO: 53024 - protein, 9 aa, BK virus
TVTPALEAY

SEQ ID NO: 53025 - protein, 9 aa, BK virus
IPAITSQEL

SEQ ID NO: 53026 - protein, 9 aa, BK virus
NPDEYYDIL

SEQ ID NO: 53027 - protein, 9 aa, BK virus
THVNFGHTY

SEQ ID NO: 53028 - protein, 9 aa, BK virus
LFATISQAL

SEQ ID NO: 53029 - protein, 9 aa, BK virus
YAVIAGAPG

SEQ ID NO: 53030 - protein, 9 aa, BK virus
TAPQWMLPL

SEQ ID NO: 53031 - protein, 9 aa, BK virus
APQWMLPLL

SEQ ID NO: 53032 - protein, 9 aa, BK virus
ILFPGVNTF

SEQ ID NO: 53033 - protein, 9 aa, BK virus
FAALIQTVT

SEQ ID NO: 53034 - protein, 9 aa, BK virus
TPQTYAVIA

SEQ ID NO: 53035 - protein, 9 aa, BK virus
IAAGEAAAA

SEQ ID NO: 53036 - protein, 9 aa, BK virus
FPGVNTFVN

SEQ ID NO: 53037 - protein, 9 aa, BK virus
NAPINFYNY

SEQ ID NO: 53038 - protein, 9 aa, BK virus
SVSEAAAAT

SEQ ID NO: 53039 - protein, 9 aa, BK virus
GAIAGFAAL

SEQ ID NO: 53040 - protein, 9 aa, BK virus
SEAIAAIGL

SEQ ID NO: 53041 - protein, 9 aa, BK virus
GEAAAAIEV

SEQ ID NO: 53042 - protein, 9 aa, BK virus
EEVTQRMDL

SEQ ID NO: 53043 - protein, 9 aa, BK virus
SEAAAATGF

SEQ ID NO: 53044 - protein, 9 aa, BK virus
TERFFRDSL

SEQ ID NO: 53045 - protein, 9 aa, BK virus
KESVHSGEF

SEQ ID NO: 53046 - protein, 9 aa, BK virus
EEVTQRMDL

SEQ ID NO: 53047 - protein, 9 aa, BK virus
GEFIEKTIA

SEQ ID NO: 53048 - protein, 9 aa, BK virus
SEAAAATGF

SEQ ID NO: 53049 - protein, 9 aa, BK virus
SEAIAAIGL

SEQ ID NO: 53050 - protein, 9 aa, BK virus
SEAIAAIGL

SEQ ID NO: 53051 - protein, 9 aa, BK virus
SEAAAATGF

SEQ ID NO: 53052 - protein, 9 aa, BK virus
AEIAAGEAA

SEQ ID NO: 53053 - protein, 9 aa, BK virus
AEIAAGEAA

SEQ ID NO: 53054 - protein, 9 aa, BK virus
EEVTQRMDL

SEQ ID NO: 53055 - protein, 9 aa, BK virus
GEAAAAIEV

SEQ ID NO: 53056 - protein, 9 aa, BK virus
EETTWTIVN

SEQ ID NO: 53057 - protein, 9 aa, BK virus
APINFYNYI

SEQ ID NO: 53058 - protein, 9 aa, BK virus
LPLLLGLYG

SEQ ID NO: 53059 - protein, 9 aa, BK virus
APINFYNYI

SEQ ID NO: 53060 - protein, 9 aa, BK virus
APQWMLPLL

SEQ ID NO: 53061 - protein, 9 aa, BK virus
FATISQALW

SEQ ID NO: 53062 - protein, 9 aa, BK virus
APINFYNYI

SEQ ID NO: 53063 - protein, 9 aa, BK virus
APGAIAGFA

SEQ ID NO: 53064 - protein, 9 aa, BK virus
MALELFNPD

SEQ ID NO: 53065 - protein, 9 aa, BK virus
FPGVNTFVN

SEQ ID NO: 53066 - protein, 9 aa, BK virus
LPLLLGLYG

SEQ ID NO: 53067 - protein, 9 aa, BK virus
TPQTYAVIA

SEQ ID NO: 53068 - protein, 9 aa, BK virus
FAALIQTVT

SEQ ID NO: 53069 - protein, 9 aa, BK virus
FATISQALW

SEQ ID NO: 53070 - protein, 9 aa, BK virus
ISSLAQVGY

SEQ ID NO: 53071 - protein, 9 aa, BK virus
VGYRFFSDW

SEQ ID NO: 53072 - protein, 10 aa, BK virus
GTHVNFGHTY

SEQ ID NO: 53073 - protein, 10 aa, BK virus
ALLGDLVASV

SEQ ID NO: 53074 - protein, 10 aa, BK virus
ILFPGVNTFV

SEQ ID NO: 53075 - protein, 10 aa, BK virus
GLYGTVTPAL

SEQ ID NO: 53076 - protein, 10 aa, BK virus
FLEETTWTIV

SEQ ID NO: 53077 - protein, 10 aa, BK virus
SLFATISQAL

SEQ ID NO: 53078 - protein, 10 aa, BK virus
YQQSGMALEL

SEQ ID NO: 53079 - protein, 10 aa, BK virus
ATISQALWHV

SEQ ID NO: 53080 - protein, 10 aa, BK virus
TTWTIVNAPI

SEQ ID NO: 53081 - protein, 10 aa, BK virus
GLTPQTYAVI

SEQ ID NO: 53082 - protein, 10 aa, BK virus
GLYQQSGMAL

SEQ ID NO: 53083 - protein, 10 aa, BK virus
RMDLRNKESV

SEQ ID NO: 53084 - protein, 10 aa, BK virus
NLSPIRPSMV

SEQ ID NO: 53085 - protein, 10 aa, BK virus
ALWHVIRDDI

SEQ ID NO: 53086 - protein, 10 aa, BK virus
ILFPGVNTFV

SEQ ID NO: 53087 - protein, 10 aa, BK virus
ALLGDLVASV

SEQ ID NO: 53088 - protein, 10 aa, BK virus
SLFATISQAL

SEQ ID NO: 53089 - protein, 10 aa, BK virus
GLYGTVTPAL

SEQ ID NO: 53090 - protein, 10 aa, BK virus
GLYQQSGMAL

SEQ ID NO: 53091 - protein, 10 aa, BK virus
FLEETTWTIV

SEQ ID NO: 53092 - protein, 10 aa, BK virus
ALALLGDLVA

SEQ ID NO: 53093 - protein, 10 aa, BK virus
SLARFLEETT

SEQ ID NO: 53094 - protein, 10 aa, BK virus
YQQSGMALEL

SEQ ID NO: 53095 - protein, 10 aa, BK virus
LLLGLYGTVT

SEQ ID NO: 53096 - protein, 10 aa, BK virus
NTFVNNIQYL

SEQ ID NO: 53097 - protein, 10 aa, BK virus
NLSPIRPSMV

SEQ ID NO: 53098 - protein, 10 aa, BK virus
ATISQALWHV

SEQ ID NO: 53099 - protein, 10 aa, BK virus
LVASVSEAAA

SEQ ID NO: 53100 - protein, 10 aa, BK virus
GLTPQTYAVI

SEQ ID NO: 53101 - protein, 10 aa, BK virus
FNPDEYYDIL

SEQ ID NO: 53102 - protein, 10 aa, BK virus
PLLLGLYGTV

SEQ ID NO: 53103 - protein, 10 aa, BK virus
RMDLRNKESV

SEQ ID NO: 53104 - protein, 10 aa, BK virus
MLPLLLGLYG

SEQ ID NO: 53105 - protein, 10 aa, BK virus
AALALLGDLV

SEQ ID NO: 53106 - protein, 10 aa, BK virus
ILFPGVNTFV

SEQ ID NO: 53107 - protein, 10 aa, BK virus
ALLGDLVASV

SEQ ID NO: 53108 - protein, 10 aa, BK virus
FLEETTWTIV

SEQ ID NO: 53109 - protein, 10 aa, BK virus
GLYGTVTPAL

SEQ ID NO: 53110 - protein, 10 aa, BK virus
NLSPIRPSMV

SEQ ID NO: 53111 - protein, 10 aa, BK virus
GLYQQSGMAL

SEQ ID NO: 53112 - protein, 10 aa, BK virus
GLTPQTYAVI

SEQ ID NO: 53113 - protein, 10 aa, BK virus
SLFATISQAL

SEQ ID NO: 53114 - protein, 10 aa, BK virus
HVNFGHTYSI

SEQ ID NO: 53115 - protein, 10 aa, BK virus
RTAPQWMLPL

SEQ ID NO: 53116 - protein, 10 aa, BK virus
RMDLRNKESV

SEQ ID NO: 53117 - protein, 10 aa, BK virus
SLARFLEETT

SEQ ID NO: 53118 - protein, 10 aa, BK virus
AVIAGAPGAI

SEQ ID NO: 53119 - protein, 10 aa, BK virus
ATISQALWHV

SEQ ID NO: 53120 - protein, 10 aa, BK virus
SVAEIAAGEA

SEQ ID NO: 53121 - protein, 10 aa, BK virus
YQQSGMALEL

SEQ ID NO: 53122 - protein, 10 aa, BK virus
AAIEVQIASL

SEQ ID NO: 53123 - protein, 10 aa, BK virus
PLLLGLYGTV

SEQ ID NO: 53124 - protein, 10 aa, BK virus
VIAGAPGAIA

SEQ ID NO: 53125 - protein, 10 aa, BK virus
ALALLGDLVA

SEQ ID NO: 53126 - protein, 10 aa, BK virus
LVASVSEAAA

SEQ ID NO: 53127 - protein, 10 aa, BK virus
GAIAGFAALI

SEQ ID NO: 53128 - protein, 10 aa, BK virus
QTVTGISSLA

SEQ ID NO: 53129 - protein, 10 aa, BK virus
SLATVEGITT

SEQ ID NO: 53130 - protein, 10 aa, BK virus
ILFPGVNTFV

SEQ ID NO: 53131 - protein, 10 aa, BK virus
FLEETTWTIV

SEQ ID NO: 53132 - protein, 10 aa, BK virus
ALLGDLVASV

SEQ ID NO: 53133 - protein, 10 aa, BK virus
SLFATISQAL

SEQ ID NO: 53134 - protein, 10 aa, BK virus
ATISQALWHV

SEQ ID NO: 53135 - protein, 10 aa, BK virus
GLYGTVTPAL

SEQ ID NO: 53136 - protein, 10 aa, BK virus
GLYQQSGMAL

SEQ ID NO: 53137 - protein, 10 aa, BK virus
RTAPQWMLPL

SEQ ID NO: 53138 - protein, 10 aa, BK virus
ALLGDLVASV

SEQ ID NO: 53139 - protein, 10 aa, BK virus
FLEETTWTIV

SEQ ID NO: 53140 - protein, 10 aa, BK virus
ILFPGVNTFV

SEQ ID NO: 53141 - protein, 10 aa, BK virus
YQQSGMALEL

SEQ ID NO: 53142 - protein, 10 aa, BK virus
ATISQALWHV

SEQ ID NO: 53143 - protein, 10 aa, BK virus
AAIEVQIASL

SEQ ID NO: 53144 - protein, 10 aa, BK virus
GAIAGFAALI

SEQ ID NO: 53145 - protein, 10 aa, BK virus
RTAPQWMLPL

SEQ ID NO: 53146 - protein, 10 aa, BK virus
GLYGTVTPAL

SEQ ID NO: 53147 - protein, 10 aa, BK virus
AVIAGAPGAI

SEQ ID NO: 53148 - protein, 10 aa, BK virus
YAVIAGAPGA

SEQ ID NO: 53149 - protein, 10 aa, BK virus
IQTVTGISSL

SEQ ID NO: 53150 - protein, 10 aa, BK virus
AALALLGDLV

SEQ ID NO: 53151 - protein, 10 aa, BK virus
AQVGYRFFSD

SEQ ID NO: 53152 - protein, 10 aa, BK virus
YLDPRHWGPS

SEQ ID NO: 53153 - protein, 10 aa, BK virus
RMDLRNKESV

SEQ ID NO: 53154 - protein, 10 aa, BK virus
HVIRDDIPAI

SEQ ID NO: 53155 - protein, 10 aa, BK virus
TAPQWMLPLL

SEQ ID NO: 53156 - protein, 10 aa, BK virus
SLFATISQAL

SEQ ID NO: 53157 - protein, 10 aa, BK virus
VQIASLATVE

SEQ ID NO: 53158 - protein, 10 aa, BK virus
SVAEIAAGEA

SEQ ID NO: 53159 - protein, 10 aa, BK virus
RFLEETTWTI

SEQ ID NO: 53160 - protein, 10 aa, BK virus
LVASVSEAAA

SEQ ID NO: 53161 - protein, 10 aa, BK virus
GLYQQSGMAL

SEQ ID NO: 53162 - protein, 10 aa, BK virus
NLSPIRPSMV

SEQ ID NO: 53163 - protein, 10 aa, BK virus
TISQALWHVI

SEQ ID NO: 53164 - protein, 10 aa, BK virus
AAAATGFSVA

SEQ ID NO: 53165 - protein, 10 aa, BK virus
ATVEGITTTS

SEQ ID NO: 53166 - protein, 10 aa, BK virus
QVAEREGTHV

SEQ ID NO: 53167 - protein, 10 aa, BK virus
AGFAALIQTV

SEQ ID NO: 53168 - protein, 10 aa, BK virus
QQSGMALELF

SEQ ID NO: 53169 - protein, 10 aa, BK virus
AALIQTVTGI

SEQ ID NO: 53170 - protein, 10 aa, BK virus
GLTPQTYAVI

SEQ ID NO: 53171 - protein, 10 aa, BK virus
ILFPGVNTFV

SEQ ID NO: 53172 - protein, 10 aa, BK virus
ALLGDLVASV

SEQ ID NO: 53173 - protein, 10 aa, BK virus
SLFATISQAL

SEQ ID NO: 53174 - protein, 10 aa, BK virus
GLYGTVTPAL

SEQ ID NO: 53175 - protein, 10 aa, BK virus
FLEETTWTIV

SEQ ID NO: 53176 - protein, 10 aa, BK virus
RMDLRNKESV

SEQ ID NO: 53177 - protein, 10 aa, BK virus
NLSPIRPSMV

SEQ ID NO: 53178 - protein, 10 aa, BK virus
PLLLGLYGTV

SEQ ID NO: 53179 - protein, 10 aa, BK virus
GLYQQSGMAL

SEQ ID NO: 53180 - protein, 10 aa, BK virus
GLTPQTYAVI

SEQ ID NO: 53181 - protein, 10 aa, BK virus
YLDPRHWGPS

SEQ ID NO: 53182 - protein, 10 aa, BK virus
SLARFLEETT

SEQ ID NO: 53183 - protein, 10 aa, BK virus
EYYDILFPGV

SEQ ID NO: 53184 - protein, 10 aa, BK virus
TISQALWHVI

SEQ ID NO: 53185 - protein, 10 aa, BK virus
SDWDHKVSTV

SEQ ID NO: 53186 - protein, 10 aa, BK virus
WMLPLLLGLY

SEQ ID NO: 53187 - protein, 10 aa, BK virus
ALWHVIRDDI

SEQ ID NO: 53188 - protein, 10 aa, BK virus
ALALLGDLVA

SEQ ID NO: 53189 - protein, 10 aa, BK virus
SLAQVGYRFF

SEQ ID NO: 53190 - protein, 10 aa, BK virus
ATISQALWHV

SEQ ID NO: 53191 - protein, 10 aa, BK virus
RFFSDWDHKV

SEQ ID NO: 53192 - protein, 10 aa, BK virus
RTAPQWMLPL

SEQ ID NO: 53193 - protein, 10 aa, BK virus
AGFAALIQTV

SEQ ID NO: 53194 - protein, 10 aa, BK virus
SLATVEGITT

SEQ ID NO: 53195 - protein, 10 aa, BK virus
PIRPSMVRQV

SEQ ID NO: 53196 - protein, 10 aa, BK virus
LLLGLYGTVT

SEQ ID NO: 53197 - protein, 10 aa, BK virus
EVQIASLATV

SEQ ID NO: 53198 - protein, 10 aa, BK virus
YQQSGMALEL

SEQ ID NO: 53199 - protein, 10 aa, BK virus
RFLEETTWTI

SEQ ID NO: 53200 - protein, 10 aa, BK virus
HVNFGHTYSI

SEQ ID NO: 53201 - protein, 10 aa, BK virus
SVAEIAAGEA

SEQ ID NO: 53202 - protein, 10 aa, BK virus
DIPAITSQEL

SEQ ID NO: 53203 - protein, 10 aa, BK virus
QVAEREGTHV

SEQ ID NO: 53204 - protein, 10 aa, BK virus
TAPQWMLPLL

SEQ ID NO: 53205 - protein, 10 aa, BK virus
EAAAATGFSV

SEQ ID NO: 53206 - protein, 10 aa, BK virus
VTGISSLAQV

SEQ ID NO: 53207 - protein, 10 aa, BK virus
LLGDLVASVS

SEQ ID NO: 53208 - protein, 10 aa, BK virus
AAIEVQIASL

SEQ ID NO: 53209 - protein, 10 aa, BK virus
ILFPGVNTFV

SEQ ID NO: 53210 - protein, 10 aa, BK virus
ALLGDLVASV

SEQ ID NO: 53211 - protein, 10 aa, BK virus
FLEETTWTIV

SEQ ID NO: 53212 - protein, 10 aa, BK virus
GLYGTVTPAL

SEQ ID NO: 53213 - protein, 10 aa, BK virus
SLFATISQAL

SEQ ID NO: 53214 - protein, 10 aa, BK virus
RMDLRNKESV

SEQ ID NO: 53215 - protein, 10 aa, BK virus
NLSPIRPSMV

SEQ ID NO: 53216 - protein, 10 aa, BK virus
GLYQQSGMAL

SEQ ID NO: 53217 - protein, 10 aa, BK virus
PLLLGLYGTV

SEQ ID NO: 53218 - protein, 10 aa, BK virus
SLARFLEETT

SEQ ID NO: 53219 - protein, 10 aa, BK virus
GLTPQTYAVI

SEQ ID NO: 53220 - protein, 10 aa, BK virus
ALWHVIRDDI

SEQ ID NO: 53221 - protein, 10 aa, BK virus
EYYDILFPGV

SEQ ID NO: 53222 - protein, 10 aa, BK virus
YLDPRHWGPS

SEQ ID NO: 53223 - protein, 10 aa, BK virus
YQQSGMALEL

SEQ ID NO: 53224 - protein, 10 aa, BK virus
LLLGLYGTVT

SEQ ID NO: 53225 - protein, 10 aa, BK virus
SDWDHKVSTV

SEQ ID NO: 53226 - protein, 10 aa, BK virus
QVAEREGTHV

SEQ ID NO: 53227 - protein, 10 aa, BK virus
WMLPLLLGLY

SEQ ID NO: 53228 - protein, 10 aa, BK virus
ATISQALWHV

SEQ ID NO: 53229 - protein, 10 aa, BK virus
RFFSDWDHKV

SEQ ID NO: 53230 - protein, 10 aa, BK virus
YIQDYYSNLS

SEQ ID NO: 53231 - protein, 10 aa, BK virus
ILFPGVNTFV

SEQ ID NO: 53232 - protein, 10 aa, BK virus
ALLGDLVASV

SEQ ID NO: 53233 - protein, 10 aa, BK virus
GLYGTVTPAL

SEQ ID NO: 53234 - protein, 10 aa, BK virus
FLEETTWTIV

SEQ ID NO: 53235 - protein, 10 aa, BK virus
NLSPIRPSMV

SEQ ID NO: 53236 - protein, 10 aa, BK virus
SLFATISQAL

SEQ ID NO: 53237 - protein, 10 aa, BK virus
PLLLGLYGTV

SEQ ID NO: 53238 - protein, 10 aa, BK virus
RMDLRNKESV

SEQ ID NO: 53239 - protein, 10 aa, BK virus
GLYQQSGMAL

SEQ ID NO: 53240 - protein, 10 aa, BK virus
GLTPQTYAVI

SEQ ID NO: 53241 - protein, 10 aa, BK virus
SLARFLEETT

SEQ ID NO: 53242 - protein, 10 aa, BK virus
ATISQALWHV

SEQ ID NO: 53243 - protein, 10 aa, BK virus
SDWDHKVSTV

SEQ ID NO: 53244 - protein, 10 aa, BK virus
ALWHVIRDDI

SEQ ID NO: 53245 - protein, 10 aa, BK virus
QVAEREGTHV

SEQ ID NO: 53246 - protein, 10 aa, BK virus
EYYDILFPGV

SEQ ID NO: 53247 - protein, 10 aa, BK virus
EVQIASLATV

SEQ ID NO: 53248 - protein, 10 aa, BK virus
PIRPSMVRQV

SEQ ID NO: 53249 - protein, 10 aa, BK virus
SLATVEGITT

SEQ ID NO: 53250 - protein, 10 aa, BK virus
RFFSDWDHKV

SEQ ID NO: 53251 - protein, 10 aa, BK virus
DIPAITSQEL

SEQ ID NO: 53252 - protein, 10 aa, BK virus
VTGISSLAQV

SEQ ID NO: 53253 - protein, 10 aa, BK virus
EAAAATGFSV

SEQ ID NO: 53254 - protein, 10 aa, BK virus
YQQSGMALEL

SEQ ID NO: 53255 - protein, 10 aa, BK virus
AGFAALIQTV

SEQ ID NO: 53256 - protein, 10 aa, BK virus
ALALLGDLVA

SEQ ID NO: 53257 - protein, 10 aa, BK virus
AIGLTPQTYA

SEQ ID NO: 53258 - protein, 10 aa, BK virus
LLLGLYGTVT

SEQ ID NO: 53259 - protein, 10 aa, BK virus
ALLGDLVASV

SEQ ID NO: 53260 - protein, 10 aa, BK virus
FLEETTWTIV

SEQ ID NO: 53261 - protein, 10 aa, BK virus
GLYGTVTPAL

SEQ ID NO: 53262 - protein, 10 aa, BK virus
NLSPIRPSMV

SEQ ID NO: 53263 - protein, 10 aa, BK virus
SLFATISQAL

SEQ ID NO: 53264 - protein, 10 aa, BK virus
RMDLRNKESV

SEQ ID NO: 53265 - protein, 10 aa, BK virus
PLLLGLYGTV

SEQ ID NO: 53266 - protein, 10 aa, BK virus
GLTPQTYAVI

SEQ ID NO: 53267 - protein, 10 aa, BK virus
YQQSGMALEL

SEQ ID NO: 53268 - protein, 10 aa, BK virus
EYYDILFPGV

SEQ ID NO: 53269 - protein, 10 aa, BK virus
TISQALWHVI

SEQ ID NO: 53270 - protein, 10 aa, BK virus
EAAAATGFSV

SEQ ID NO: 53271 - protein, 10 aa, BK virus
GLYQQSGMAL

SEQ ID NO: 53272 - protein, 10 aa, BK virus
ATISQALWHV

SEQ ID NO: 53273 - protein, 10 aa, BK virus
SVHSGEFIEK

SEQ ID NO: 53274 - protein, 10 aa, BK virus
KAKGTRASAK

SEQ ID NO: 53275 - protein, 10 aa, BK virus
RRVSRGSSQK

SEQ ID NO: 53276 - protein, 10 aa, BK virus
TIVNAPINFY

SEQ ID NO: 53277 - protein, 10 aa, BK virus
WMLPLLLGLY

SEQ ID NO: 53278 - protein, 10 aa, BK virus
SVHSGEFIEK

SEQ ID NO: 53279 - protein, 10 aa, BK virus
VTQRMDLRNK

SEQ ID NO: 53280 - protein, 10 aa, BK virus
ISQALWHVIR

SEQ ID NO: 53281 - protein, 10 aa, BK virus
KAKGTRASAK

SEQ ID NO: 53282 - protein, 10 aa, BK virus
TIVNAPINFY

SEQ ID NO: 53283 - protein, 10 aa, BK virus
ISSLAQVGYR

SEQ ID NO: 53284 - protein, 10 aa, BK virus
NYIQDYYSNL

SEQ ID NO: 53285 - protein, 10 aa, BK virus
RFFRDSLARF

SEQ ID NO: 53286 - protein, 10 aa, BK virus
RFLEETTWTI

SEQ ID NO: 53287 - protein, 10 aa, BK virus
WTIVNAPINF

SEQ ID NO: 53288 - protein, 10 aa, BK virus
AYEDGPNQKK

SEQ ID NO: 53289 - protein, 10 aa, BK virus
TYSIDNADSI

SEQ ID NO: 53290 - protein, 10 aa, BK virus
SSLAQVGYRF

SEQ ID NO: 53291 - protein, 10 aa, BK virus
ELQRRTERFF

SEQ ID NO: 53292 - protein, 10 aa, BK virus
NYIQDYYSNL

SEQ ID NO: 53293 - protein, 10 aa, BK virus
RFLEETTWTI

SEQ ID NO: 53294 - protein, 10 aa, BK virus
HWGPSLFATI

SEQ ID NO: 53295 - protein, 10 aa, BK virus
TYSIDNADSI

SEQ ID NO: 53296 - protein, 10 aa, BK virus
RFFRDSLARF

SEQ ID NO: 53297 - protein, 10 aa, BK virus
LFATISQALW

SEQ ID NO: 53298 - protein, 10 aa, BK virus
RFLEETTWTI

SEQ ID NO: 53299 - protein, 10 aa, BK virus
RFFRDSLARF

SEQ ID NO: 53300 - protein, 10 aa, BK virus
NYIQDYYSNL

SEQ ID NO: 53301 - protein, 10 aa, BK virus
TYSIDNADSI

SEQ ID NO: 53302 - protein, 10 aa, BK virus
QWMLPLLLGL

SEQ ID NO: 53303 - protein, 10 aa, BK virus
TIVNAPINFY

SEQ ID NO: 53304 - protein, 10 aa, BK virus
DSIEEVTQRM

SEQ ID NO: 53305 - protein, 10 aa, BK virus
TIVNAPINFY

SEQ ID NO: 53306 - protein, 10 aa, BK virus
GTVTPALEAY

SEQ ID NO: 53307 - protein, 10 aa, BK virus
RTAPQWMLPL

SEQ ID NO: 53308 - protein, 10 aa, BK virus
WTIVNAPINF

SEQ ID NO: 53309 - protein, 10 aa, BK virus
ELQRRTERFF

SEQ ID NO: 53310 - protein, 10 aa, BK virus
DIPAITSQEL

SEQ ID NO: 53311 - protein, 10 aa, BK virus
HVIRDDIPAI

SEQ ID NO: 53312 - protein, 10 aa, BK virus
DILFPGVNTF

SEQ ID NO: 53313 - protein, 10 aa, BK virus
EVQIASLATV

SEQ ID NO: 53314 - protein, 10 aa, BK virus
NFYNYIQDYY

SEQ ID NO: 53315 - protein, 10 aa, BK virus
VNAPINFYNY

SEQ ID NO: 53316 - protein, 10 aa, BK virus
WMLPLLLGLY

SEQ ID NO: 53317 - protein, 10 aa, BK virus
KAKGTRASAK

SEQ ID NO: 53318 - protein, 10 aa, BK virus
VSRGSSQKAK

SEQ ID NO: 53319 - protein, 10 aa, BK virus
SVHSGEFIEK

SEQ ID NO: 53320 - protein, 10 aa, BK virus
LQRRTERFFR

SEQ ID NO: 53321 - protein, 10 aa, BK virus
GTHVNFGHTY

SEQ ID NO: 53322 - protein, 10 aa, BK virus
GISSLAQVGY

SEQ ID NO: 53323 - protein, 10 aa, BK virus
WMLPLLLGLY

SEQ ID NO: 53324 - protein, 10 aa, BK virus
NFYNYIQDYY

SEQ ID NO: 53325 - protein, 10 aa, BK virus
TIVNAPINFY

SEQ ID NO: 53326 - protein, 10 aa, BK virus
LQRRTERFFR

SEQ ID NO: 53327 - protein, 10 aa, BK virus
RASAKTTNKR

SEQ ID NO: 53328 - protein, 10 aa, BK virus
AKTTNKRRSR

SEQ ID NO: 53329 - protein, 10 aa, BK virus
ISQALWHVIR

SEQ ID NO: 53330 - protein, 10 aa, BK virus
AITSQELQRR

SEQ ID NO: 53331 - protein, 10 aa, BK virus
SQELQRRTER

SEQ ID NO: 53332 - protein, 10 aa, BK virus
KAKGTRASAK

SEQ ID NO: 53333 - protein, 10 aa, BK virus
ISSLAQVGYR

SEQ ID NO: 53334 - protein, 10 aa, BK virus
TNKRRSRSSR

SEQ ID NO: 53335 - protein, 10 aa, BK virus
PSMVRQVAER

SEQ ID NO: 53336 - protein, 10 aa, BK virus
ASAKTTNKRR

SEQ ID NO: 53337 - protein, 10 aa, BK virus
PNQKKRRVSR

SEQ ID NO: 53338 - protein, 10 aa, BK virus
DYYSNLSPIR

SEQ ID NO: 53339 - protein, 10 aa, BK virus
LQRRTERFFR

SEQ ID NO: 53340 - protein, 10 aa, BK virus
ISQALWHVIR

SEQ ID NO: 53341 - protein, 10 aa, BK virus
TIAPGGANQR

SEQ ID NO: 53342 - protein, 10 aa, BK virus
EAYEDGPNQK

SEQ ID NO: 53343 - protein, 10 aa, BK virus
ISSLAQVGYR

SEQ ID NO: 53344 - protein, 10 aa, BK virus
DYYSNLSPIR

SEQ ID NO: 53345 - protein, 10 aa, BK virus
SVHSGEFIEK

SEQ ID NO: 53346 - protein, 10 aa, BK virus
ERFFRDSLAR

SEQ ID NO: 53347 - protein, 10 aa, BK virus
RASAKTTNKR

SEQ ID NO: 53348 - protein, 10 aa, BK virus
TIVNAPINFY

SEQ ID NO: 53349 - protein, 10 aa, BK virus
ISQALWHVIR

SEQ ID NO: 53350 - protein, 10 aa, BK virus
EEVTQRMDLR

SEQ ID NO: 53351 - protein, 10 aa, BK virus
NFYNYIQDYY

SEQ ID NO: 53352 - protein, 10 aa, BK virus
LSPIRPSMVR

SEQ ID NO: 53353 - protein, 10 aa, BK virus
EAAAATGFSV

SEQ ID NO: 53354 - protein, 10 aa, BK virus
TTWTIVNAPI

SEQ ID NO: 53355 - protein, 10 aa, BK virus
EAAAAIEVQI

SEQ ID NO: 53356 - protein, 10 aa, BK virus
NTFVNNIQYL

SEQ ID NO: 53357 - protein, 10 aa, BK virus
HVNFGHTYSI

SEQ ID NO: 53358 - protein, 10 aa, BK virus
RTAPQWMLPL

SEQ ID NO: 53359 - protein, 10 aa, BK virus
SVAEIAAGEA

SEQ ID NO: 53360 - protein, 10 aa, BK virus
TTTSEAIAAI

SEQ ID NO: 53361 - protein, 10 aa, BK virus
NAPINFYNYI

SEQ ID NO: 53362 - protein, 10 aa, BK virus
EIAAGEAAAA

SEQ ID NO: 53363 - protein, 10 aa, BK virus
EGITTTSEAI

SEQ ID NO: 53364 - protein, 10 aa, BK virus
QTVTGISSLA

SEQ ID NO: 53365 - protein, 10 aa, BK virus
EVQIASLATV

SEQ ID NO: 53366 - protein, 10 aa, BK virus
DIPAITSQEL

SEQ ID NO: 53367 - protein, 10 aa, BK virus
LVASVSEAAA

SEQ ID NO: 53368 - protein, 10 aa, BK virus
EYYDILFPGV

SEQ ID NO: 53369 - protein, 10 aa, BK virus
NLSPIRPSMV

SEQ ID NO: 53370 - protein, 10 aa, BK virus
ILFPGVNTFV

SEQ ID NO: 53371 - protein, 10 aa, BK virus
HVIRDDIPAI

SEQ ID NO: 53372 - protein, 10 aa, BK virus
SLFATISQAL

SEQ ID NO: 53373 - protein, 10 aa, BK virus
TISQALWHVI

SEQ ID NO: 53374 - protein, 10 aa, BK virus
IAAGEAAAAI

SEQ ID NO: 53375 - protein, 10 aa, BK virus
QVAEREGTHV

SEQ ID NO: 53376 - protein, 10 aa, BK virus
ATISQALWHV

SEQ ID NO: 53377 - protein, 10 aa, BK virus
IASLATVEGI

SEQ ID NO: 53378 - protein, 10 aa, BK virus
EAAAATGFSV

SEQ ID NO: 53379 - protein, 10 aa, BK virus
TTWTIVNAPI

SEQ ID NO: 53380 - protein, 10 aa, BK virus
EYYDILFPGV

SEQ ID NO: 53381 - protein, 10 aa, BK virus
EVQIASLATV

SEQ ID NO: 53382 - protein, 10 aa, BK virus
NTFVNNIQYL

SEQ ID NO: 53383 - protein, 10 aa, BK virus
ATISQALWHV

SEQ ID NO: 53384 - protein, 10 aa, BK virus
EAAAAIEVQI

SEQ ID NO: 53385 - protein, 10 aa, BK virus
EIAAGEAAAA

SEQ ID NO: 53386 - protein, 10 aa, BK virus
HVNFGHTYSI

SEQ ID NO: 53387 - protein, 10 aa, BK virus
RTAPQWMLPL

SEQ ID NO: 53388 - protein, 10 aa, BK virus
HVIRDDIPAI

SEQ ID NO: 53389 - protein, 10 aa, BK virus
ILFPGVNTFV

SEQ ID NO: 53390 - protein, 10 aa, BK virus
QVAEREGTHV

SEQ ID NO: 53391 - protein, 10 aa, BK virus
ALLGDLVASV

SEQ ID NO: 53392 - protein, 10 aa, BK virus
TTTSEAIAAI

SEQ ID NO: 53393 - protein, 10 aa, BK virus
VTGISSLAQV

SEQ ID NO: 53394 - protein, 10 aa, BK virus
TAPQWMLPLL

SEQ ID NO: 53395 - protein, 10 aa, BK virus
SVAEIAAGEA

SEQ ID NO: 53396 - protein, 10 aa, BK virus
APQWMLPLLL

SEQ ID NO: 53397 - protein, 10 aa, BK virus
RPSMVRQVAE

SEQ ID NO: 53398 - protein, 10 aa, BK virus
DPRHWGPSLF

SEQ ID NO: 53399 - protein, 10 aa, BK virus
APGAIAGFAA

SEQ ID NO: 53400 - protein, 10 aa, BK virus
WMLPLLLGLY

SEQ ID NO: 53401 - protein, 10 aa, BK virus
QQSGMALELF

SEQ ID NO: 53402 - protein, 10 aa, BK virus
YQQSGMALEL

SEQ ID NO: 53403 - protein, 10 aa, BK virus
IQTVTGISSL

SEQ ID NO: 53404 - protein, 10 aa, BK virus
SLFATISQAL

SEQ ID NO: 53405 - protein, 10 aa, BK virus
RQVAEREGTH

SEQ ID NO: 53406 - protein, 10 aa, BK virus
SLAQVGYRFF

SEQ ID NO: 53407 - protein, 10 aa, BK virus
AAIGLTPQTY

SEQ ID NO: 53408 - protein, 10 aa, BK virus
GTHVNFGHTY

SEQ ID NO: 53409 - protein, 10 aa, BK virus
GLYGTVTPAL

SEQ ID NO: 53410 - protein, 10 aa, BK virus
WTIVNAPINF

SEQ ID NO: 53411 - protein, 10 aa, BK virus
AEREGTHVNF

SEQ ID NO: 53412 - protein, 10 aa, BK virus
LELFNPDEYY

SEQ ID NO: 53413 - protein, 10 aa, BK virus
QELQRRTERF

SEQ ID NO: 53414 - protein, 10 aa, BK virus
IEVQIASLAT

SEQ ID NO: 53415 - protein, 10 aa, BK virus
DPRHWGPSLF

SEQ ID NO: 53416 - protein, 10 aa, BK virus
WMLPLLLGLY

SEQ ID NO: 53417 - protein, 10 aa, BK virus
RRVSRGSSQK

SEQ ID NO: 53418 - protein, 10 aa, BK virus
YRFFSDWDHK

SEQ ID NO: 53419 - protein, 10 aa, BK virus
NPDEYYDILF

SEQ ID NO: 53420 - protein, 10 aa, BK virus
AAIGLTPQTY

SEQ ID NO: 53421 - protein, 10 aa, BK virus
DPRHWGPSLF

SEQ ID NO: 53422 - protein, 10 aa, BK virus
IAAGEAAAAI

SEQ ID NO: 53423 - protein, 10 aa, BK virus
TIVNAPINFY

SEQ ID NO: 53424 - protein, 10 aa, BK virus
YAVIAGAPGA

SEQ ID NO: 53425 - protein, 10 aa, BK virus
WMLPLLLGLY

SEQ ID NO: 53426 - protein, 10 aa, BK virus
NFYNYIQDYY

SEQ ID NO: 53427 - protein, 10 aa, BK virus
YQQSGMALEL

SEQ ID NO: 53428 - protein, 10 aa, BK virus
AEREGTHVNF

SEQ ID NO: 53429 - protein, 10 aa, BK virus
IEEVTQRMDL

SEQ ID NO: 53430 - protein, 10 aa, BK virus
KESVHSGEFI

SEQ ID NO: 53431 - protein, 10 aa, BK virus
AEREGTHVNF

SEQ ID NO: 53432 - protein, 10 aa, BK virus
AEIAAGEAAA

SEQ ID NO: 53433 - protein, 10 aa, BK virus
AEIAAGEAAA

SEQ ID NO: 53434 - protein, 10 aa, BK virus
EETTWTIVNA

SEQ ID NO: 53435 - protein, 10 aa, BK virus
AEREGTHVNF

SEQ ID NO: 53436 - protein, 10 aa, BK virus
LPLLLGLYGT

SEQ ID NO: 53437 - protein, 10 aa, BK virus
APQWMLPLLL

SEQ ID NO: 53438 - protein, 10 aa, BK virus
NPDEYYDILF

SEQ ID NO: 53439 - protein, 10 aa, BK virus
LPLLLGLYGT

SEQ ID NO: 53440 - protein, 10 aa, BK virus
APGAIAGFAA

SEQ ID NO: 53441 - protein, 10 aa, BK virus
FPGVNTFVNN

SEQ ID NO: 53442 - protein, 10 aa, BK virus
LARFLEETTW

SEQ ID NO: 53443 - protein, 10 aa, BK virus
GANQRTAPQW

SEQ ID NO: 53444 - protein, 10 aa, BK virus
LARFLEETTW

SEQ ID NO: 53445 - protein, 10 aa, BK virus
WTIVNAPINF

SEQ ID NO: 53446 - protein, 10 aa, BK virus
LFATISQALW

SEQ ID NO: 53447 - protein, 10 aa, BK virus
RTAPQWMLPL

SEQ ID NO: 53448 - protein, 10 aa, BK virus
SSLAQVGYRF

SEQ ID NO: 53449 - protein, 11 aa, BK virus
WTIVNAPINFY

SEQ ID NO: 53450 - protein, 11 aa, BK virus
YLDPRHWGPSL

SEQ ID NO: 53451 - protein, 11 aa, BK virus
SIDNADSIEEV

SEQ ID NO: 53452 - protein, 11 aa, BK virus
FATISQALWHV

SEQ ID NO: 53453 - protein, 11 aa, BK virus
LLGLYGTVTPA

SEQ ID NO: 53454 - protein, 11 aa, BK virus
GLTPQTYAVIA

SEQ ID NO: 53455 - protein, 11 aa, BK virus
FAALIQTVTGI

SEQ ID NO: 53456 - protein, 11 aa, BK virus
YLDPRHWGPSL

SEQ ID NO: 53457 - protein, 11 aa, BK virus
LLGLYGTVTPA

SEQ ID NO: 53458 - protein, 11 aa, BK virus
MLPLLLGLYGT

SEQ ID NO: 53459 - protein, 11 aa, BK virus
GLTPQTYAVIA

SEQ ID NO: 53460 - protein, 11 aa, BK virus
SVAEIAAGEAA

SEQ ID NO: 53461 - protein, 11 aa, BK virus
FATISQALWHV

SEQ ID NO: 53462 - protein, 11 aa, BK virus
TTSEAIAAIGL

SEQ ID NO: 53463 - protein, 11 aa, BK virus
QIASLATVEGI

SEQ ID NO: 53464 - protein, 11 aa, BK virus
RTAPQWMLPLL

SEQ ID NO: 53465 - protein, 11 aa, BK virus
SIDNADSIEEV

SEQ ID NO: 53466 - protein, 11 aa, BK virus
SLAQVGYRFFS

SEQ ID NO: 53467 - protein, 11 aa, BK virus
LVASVSEAAAA

SEQ ID NO: 53468 - protein, 11 aa, BK virus
AIGLTPQTYAV

SEQ ID NO: 53469 - protein, 11 aa, BK virus
TVTGISSLAQV

SEQ ID NO: 53470 - protein, 11 aa, BK virus
SLATVEGITTT

SEQ ID NO: 53471 - protein, 11 aa, BK virus
ALALLGDLVAS

SEQ ID NO: 53472 - protein, 11 aa, BK virus
AAAIEVQIASL

SEQ ID NO: 53473 - protein, 11 aa, BK virus
LIQTVTGISSL

SEQ ID NO: 53474 - protein, 11 aa, BK virus
GAALALLGDLV

SEQ ID NO: 53475 - protein, 11 aa, BK virus
HTYSIDNADSI

SEQ ID NO: 53476 - protein, 11 aa, BK virus
SLFATISQALW

SEQ ID NO: 53477 - protein, 11 aa, BK virus
FIEKTIAPGGA

SEQ ID NO: 53478 - protein, 11 aa, BK virus
FVNNIQYLDPR

SEQ ID NO: 53479 - protein, 11 aa, BK virus
YLDPRHWGPSL

SEQ ID NO: 53480 - protein, 11 aa, BK virus
LLGLYGTVTPA

SEQ ID NO: 53481 - protein, 11 aa, BK virus
LIQTVTGISSL

SEQ ID NO: 53482 - protein, 11 aa, BK virus
MLPLLLGLYGT

SEQ ID NO: 53483 - protein, 11 aa, BK virus
FAALIQTVTGI

SEQ ID NO: 53484 - protein, 11 aa, BK virus
SLATVEGITTT

SEQ ID NO: 53485 - protein, 11 aa, BK virus
AIGLTPQTYAV

SEQ ID NO: 53486 - protein, 11 aa, BK virus
GLTPQTYAVIA

SEQ ID NO: 53487 - protein, 11 aa, BK virus
AAATGFSVAEI

SEQ ID NO: 53488 - protein, 11 aa, BK virus
QIASLATVEGI

SEQ ID NO: 53489 - protein, 11 aa, BK virus
TVTGISSLAQV

SEQ ID NO: 53490 - protein, 11 aa, BK virus
RTAPQWMLPLL

SEQ ID NO: 53491 - protein, 11 aa, BK virus
FIEKTIAPGGA

SEQ ID NO: 53492 - protein, 11 aa, BK virus
LVASVSEAAAA

SEQ ID NO: 53493 - protein, 11 aa, BK virus
LALLGDLVASV

SEQ ID NO: 53494 - protein, 11 aa, BK virus
SVAEIAAGEAA

SEQ ID NO: 53495 - protein, 11 aa, BK virus
AAAIEVQIASL

SEQ ID NO: 53496 - protein, 11 aa, BK virus
SQKAKGTRASA

SEQ ID NO: 53497 - protein, 11 aa, BK virus
SIDNADSIEEV

SEQ ID NO: 53498 - protein, 11 aa, BK virus
FATISQALWHV

SEQ ID NO: 53499 - protein, 11 aa, BK virus
FSDWDHKVSTV

SEQ ID NO: 53500 - protein, 11 aa, BK virus
YAVIAGAPGAI

SEQ ID NO: 53501 - protein, 11 aa, BK virus
YLDPRHWGPSL

SEQ ID NO: 53502 - protein, 11 aa, BK virus
AAGEAAAAIEV

SEQ ID NO: 53503 - protein, 11 aa, BK virus
AIGLTPQTYAV

SEQ ID NO: 53504 - protein, 11 aa, BK virus
LLGLYGTVTPA

SEQ ID NO: 53505 - protein, 11 aa, BK virus
SIDNADSIEEV

SEQ ID NO: 53506 - protein, 11 aa, BK virus
SLATVEGITTT

SEQ ID NO: 53507 - protein, 11 aa, BK virus
YLDPRHWGPSL

SEQ ID NO: 53508 - protein, 11 aa, BK virus
IQDYYSNLSPI

SEQ ID NO: 53509 - protein, 11 aa, BK virus
RQVAEREGTHV

SEQ ID NO: 53510 - protein, 11 aa, BK virus
FATISQALWHV

SEQ ID NO: 53511 - protein, 11 aa, BK virus
YQQSGMALELF

SEQ ID NO: 53512 - protein, 11 aa, BK virus
SIDNADSIEEV

SEQ ID NO: 53513 - protein, 11 aa, BK virus
AAGEAAAAIEV

SEQ ID NO: 53514 - protein, 11 aa, BK virus
RTAPQWMLPLL

SEQ ID NO: 53515 - protein, 11 aa, BK virus
FAALIQTVTGI

SEQ ID NO: 53516 - protein, 11 aa, BK virus
AAIEVQIASLA

SEQ ID NO: 53517 - protein, 11 aa, BK virus
IEVQIASLATV

SEQ ID NO: 53518 - protein, 11 aa, BK virus
SVAEIAAGEAA

SEQ ID NO: 53519 - protein, 11 aa, BK virus
LALLGDLVASV

SEQ ID NO: 53520 - protein, 11 aa, BK virus
FSDWDHKVSTV

SEQ ID NO: 53521 - protein, 11 aa, BK virus
SEAAAATGFSV

SEQ ID NO: 53522 - protein, 11 aa, BK virus
TVTGISSLAQV

SEQ ID NO: 53523 - protein, 11 aa, BK virus
AIGLTPQTYAV

SEQ ID NO: 53524 - protein, 11 aa, BK virus
MLPLLLGLYGT

SEQ ID NO: 53525 - protein, 11 aa, BK virus
AAIGLTPQTYA

SEQ ID NO: 53526 - protein, 11 aa, BK virus
LVASVSEAAAA

SEQ ID NO: 53527 - protein, 11 aa, BK virus
AAATGFSVAEI

SEQ ID NO: 53528 - protein, 11 aa, BK virus
AVIAGAPGAIA

SEQ ID NO: 53529 - protein, 11 aa, BK virus
IQTVTGISSLA

SEQ ID NO: 53530 - protein, 11 aa, BK virus
TTSEAIAAIGL

SEQ ID NO: 53531 - protein, 11 aa, BK virus
GAALALLGDLV

SEQ ID NO: 53532 - protein, 11 aa, BK virus
LLGLYGTVTPA

SEQ ID NO: 53533 - protein, 11 aa, BK virus
SVSEAAAATGF

SEQ ID NO: 53534 - protein, 11 aa, BK virus
ATVEGITTTSE

SEQ ID NO: 53535 - protein, 11 aa, BK virus
YLDPRHWGPSL

SEQ ID NO: 53536 - protein, 11 aa, BK virus
SIDNADSIEEV

SEQ ID NO: 53537 - protein, 11 aa, BK virus
TVTGISSLAQV

SEQ ID NO: 53538 - protein, 11 aa, BK virus
GLTPQTYAVIA

SEQ ID NO: 53539 - protein, 11 aa, BK virus
SLAQVGYRFFS

SEQ ID NO: 53540 - protein, 11 aa, BK virus
AIGLTPQTYAV

SEQ ID NO: 53541 - protein, 11 aa, BK virus
ELFNPDEYYDI

SEQ ID NO: 53542 - protein, 11 aa, BK virus
SLATVEGITTT

SEQ ID NO: 53543 - protein, 11 aa, BK virus
AAGEAAAAIEV

SEQ ID NO: 53544 - protein, 11 aa, BK virus
LALLGDLVASV

SEQ ID NO: 53545 - protein, 11 aa, BK virus
RTAPQWMLPLL

SEQ ID NO: 53546 - protein, 11 aa, BK virus
DILFPGVNTFV

SEQ ID NO: 53547 - protein, 11 aa, BK virus
FSDWDHKVSTV

SEQ ID NO: 53548 - protein, 11 aa, BK virus
FATISQALWHV

SEQ ID NO: 53549 - protein, 11 aa, BK virus
MLPLLLGLYGT

SEQ ID NO: 53550 - protein, 11 aa, BK virus
ILFPGVNTFVN

SEQ ID NO: 53551 - protein, 11 aa, BK virus
LLGLYGTVTPA

SEQ ID NO: 53552 - protein, 11 aa, BK virus
AIAGFAALIQT

SEQ ID NO: 53553 - protein, 11 aa, BK virus
WMLPLLLGLYG

SEQ ID NO: 53554 - protein, 11 aa, BK virus
SVAEIAAGEAA

SEQ ID NO: 53555 - protein, 11 aa, BK virus
SIEEVTQRMDL

SEQ ID NO: 53556 - protein, 11 aa, BK virus
LLLGLYGTVTP

SEQ ID NO: 53557 - protein, 11 aa, BK virus
YRFFSDWDHKV

SEQ ID NO: 53558 - protein, 11 aa, BK virus
LLGDLVASVSE

SEQ ID NO: 53559 - protein, 11 aa, BK virus
EIAAGEAAAAI

SEQ ID NO: 53560 - protein, 11 aa, BK virus
RFLEETTWTIV

SEQ ID NO: 53561 - protein, 11 aa, BK virus
SLFATISQALW

SEQ ID NO: 53562 - protein, 11 aa, BK virus
ALLGDLVASVS

SEQ ID NO: 53563 - protein, 11 aa, BK virus
LIQTVTGISSL

SEQ ID NO: 53564 - protein, 11 aa, BK virus
IAGFAALIQTV

SEQ ID NO: 53565 - protein, 11 aa, BK virus
TIAPGGANQRT

SEQ ID NO: 53566 - protein, 11 aa, BK virus
SLARFLEETTW

SEQ ID NO: 53567 - protein, 11 aa, BK virus
GLYGTVTPALE

SEQ ID NO: 53568 - protein, 11 aa, BK virus
YLDPRHWGPSL

SEQ ID NO: 53569 - protein, 11 aa, BK virus
SIDNADSIEEV

SEQ ID NO: 53570 - protein, 11 aa, BK virus
AIGLTPQTYAV

SEQ ID NO: 53571 - protein, 11 aa, BK virus
GLTPQTYAVIA

SEQ ID NO: 53572 - protein, 11 aa, BK virus
SLATVEGITTT

SEQ ID NO: 53573 - protein, 11 aa, BK virus
ELFNPDEYYDI

SEQ ID NO: 53574 - protein, 11 aa, BK virus
LALLGDLVASV

SEQ ID NO: 53575 - protein, 11 aa, BK virus
MLPLLLGLYGT

SEQ ID NO: 53576 - protein, 11 aa, BK virus
LLGDLVASVSE

SEQ ID NO: 53577 - protein, 11 aa, BK virus
LIQTVTGISSL

SEQ ID NO: 53578 - protein, 11 aa, BK virus
SIEEVTQRMDL

SEQ ID NO: 53579 - protein, 11 aa, BK virus
WMLPLLLGLYG

SEQ ID NO: 53580 - protein, 11 aa, BK virus
SLAQVGYRFFS

SEQ ID NO: 53581 - protein, 11 aa, BK virus
TVTGISSLAQV

SEQ ID NO: 53582 - protein, 11 aa, BK virus
FATISQALWHV

SEQ ID NO: 53583 - protein, 11 aa, BK virus
ILFPGVNTFVN

SEQ ID NO: 53584 - protein, 11 aa, BK virus
YIQDYYSNLSP

SEQ ID NO: 53585 - protein, 11 aa, BK virus
YRFFSDWDHKV

SEQ ID NO: 53586 - protein, 11 aa, BK virus
LLLGLYGTVTP

SEQ ID NO: 53587 - protein, 11 aa, BK virus
YLDPRHWGPSL

SEQ ID NO: 53588 - protein, 11 aa, BK virus
SIDNADSIEEV

SEQ ID NO: 53589 - protein, 11 aa, BK virus
TVTGISSLAQV

SEQ ID NO: 53590 - protein, 11 aa, BK virus
AIGLTPQTYAV

SEQ ID NO: 53591 - protein, 11 aa, BK virus
AAGEAAAAIEV

SEQ ID NO: 53592 - protein, 11 aa, BK virus
SLAQVGYRFFS

SEQ ID NO: 53593 - protein, 11 aa, BK virus
DILFPGVNTFV

SEQ ID NO: 53594 - protein, 11 aa, BK virus
SLATVEGITTT

SEQ ID NO: 53595 - protein, 11 aa, BK virus
GLTPQTYAVIA

SEQ ID NO: 53596 - protein, 11 aa, BK virus
LLGLYGTVTPA

SEQ ID NO: 53597 - protein, 11 aa, BK virus
LIQTVTGISSL

SEQ ID NO: 53598 - protein, 11 aa, BK virus
FATISQALWHV

SEQ ID NO: 53599 - protein, 11 aa, BK virus
ELFNPDEYYDI

SEQ ID NO: 53600 - protein, 11 aa, BK virus
LALLGDLVASV

SEQ ID NO: 53601 - protein, 11 aa, BK virus
IAGFAALIQTV

SEQ ID NO: 53602 - protein, 11 aa, BK virus
AIAGFAALIQT

SEQ ID NO: 53603 - protein, 11 aa, BK virus
YLDPRHWGPSL

SEQ ID NO: 53604 - protein, 11 aa, BK virus
SIDNADSIEEV

SEQ ID NO: 53605 - protein, 11 aa, BK virus
TVTGISSLAQV

SEQ ID NO: 53606 - protein, 11 aa, BK virus
AIGLTPQTYAV

SEQ ID NO: 53607 - protein, 11 aa, BK virus
LALLGDLVASV

SEQ ID NO: 53608 - protein, 11 aa, BK virus
FATISQALWHV

SEQ ID NO: 53609 - protein, 11 aa, BK virus
LIQTVTGISSL

SEQ ID NO: 53610 - protein, 11 aa, BK virus
GTRASAKTTNK

SEQ ID NO: 53611 - protein, 11 aa, BK virus
RVSRGSSQKAK

SEQ ID NO: 53612 - protein, 11 aa, BK virus
IVNAPINFYNY

SEQ ID NO: 53613 - protein, 11 aa, BK virus
TTNKRRSRSSR

SEQ ID NO: 53614 - protein, 11 aa, BK virus
IVNAPINFYNY

SEQ ID NO: 53615 - protein, 11 aa, BK virus
TTNKRRSRSSR

SEQ ID NO: 53616 - protein, 11 aa, BK virus
KTIAPGGANQR

SEQ ID NO: 53617 - protein, 11 aa, BK virus
RVSRGSSQKAK

SEQ ID NO: 53618 - protein, 11 aa, BK virus
GTRASAKTTNK

SEQ ID NO: 53619 - protein, 11 aa, BK virus
GISSLAQVGYR

SEQ ID NO: 53620 - protein, 11 aa, BK virus
GVNTFVNNIQY

SEQ ID NO: 53621 - protein, 11 aa, BK virus
TISQALWHVIR

SEQ ID NO: 53622 - protein, 11 aa, BK virus
TSQELQRRTER

SEQ ID NO: 53623 - protein, 11 aa, BK virus
FVNNIQYLDPR

SEQ ID NO: 53624 - protein, 11 aa, BK virus
ESVHSGEFIEK

SEQ ID NO: 53625 - protein, 11 aa, BK virus
TWTIVNAPINF

SEQ ID NO: 53626 - protein, 11 aa, BK virus
GYRFFSDWDHK

SEQ ID NO: 53627 - protein, 11 aa, BK virus
LYQQSGMALEL

SEQ ID NO: 53628 - protein, 11 aa, BK virus
RFFRDSLARFL

SEQ ID NO: 53629 - protein, 11 aa, BK virus
TWTIVNAPINF

SEQ ID NO: 53630 - protein, 11 aa, BK virus
LYQQSGMALEL

SEQ ID NO: 53631 - protein, 11 aa, BK virus
LYQQSGMALEL

SEQ ID NO: 53632 - protein, 11 aa, BK virus
RFFRDSLARFL

SEQ ID NO: 53633 - protein, 11 aa, BK virus
SSLAQVGYRFF

SEQ ID NO: 53634 - protein, 11 aa, BK virus
WTIVNAPINFY

SEQ ID NO: 53635 - protein, 11 aa, BK virus
STVGLYQQSGM

SEQ ID NO: 53636 - protein, 11 aa, BK virus
WTIVNAPINFY

SEQ ID NO: 53637 - protein, 11 aa, BK virus
STVGLYQQSGM

SEQ ID NO: 53638 - protein, 11 aa, BK virus
EIAAGEAAAAI

SEQ ID NO: 53639 - protein, 11 aa, BK virus
RTAPQWMLPLL

SEQ ID NO: 53640 - protein, 11 aa, BK virus
IVNAPINFYNY

SEQ ID NO: 53641 - protein, 11 aa, BK virus
SVSEAAAATGF

SEQ ID NO: 53642 - protein, 11 aa, BK virus
TGISSLAQVGY

SEQ ID NO: 53643 - protein, 11 aa, BK virus
QWMLPLLLGLY

SEQ ID NO: 53644 - protein, 11 aa, BK virus
IVNAPINFYNY

SEQ ID NO: 53645 - protein, 11 aa, BK virus
EGTHVNFGHTY

SEQ ID NO: 53646 - protein, 11 aa, BK virus
INFYNYIQDYY

SEQ ID NO: 53647 - protein, 11 aa, BK virus
GVNTFVNNIQY

SEQ ID NO: 53648 - protein, 11 aa, BK virus
KRRVSRGSSQK

SEQ ID NO: 53649 - protein, 11 aa, BK virus
GTRASAKTTNK

SEQ ID NO: 53650 - protein, 11 aa, BK virus
GYRFFSDWDHK

SEQ ID NO: 53651 - protein, 11 aa, BK virus
RVSRGSSQKAK

SEQ ID NO: 53652 - protein, 11 aa, BK virus
IVNAPINFYNY

SEQ ID NO: 53653 - protein, 11 aa, BK virus
TTNKRRSRSSR

SEQ ID NO: 53654 - protein, 11 aa, BK virus
KTIAPGGANQR

SEQ ID NO: 53655 - protein, 11 aa, BK virus
RASAKTTNKRR

SEQ ID NO: 53656 - protein, 11 aa, BK virus
SAKTTNKRRSR

SEQ ID NO: 53657 - protein, 11 aa, BK virus
FVNNIQYLDPR

SEQ ID NO: 53658 - protein, 11 aa, BK virus
TSQELQRRTER

SEQ ID NO: 53659 - protein, 11 aa, BK virus
ELQRRTERFFR

SEQ ID NO: 53660 - protein, 11 aa, BK virus
RPSMVRQVAER

SEQ ID NO: 53661 - protein, 11 aa, BK virus
RGSSQKAKGTR

SEQ ID NO: 53662 - protein, 11 aa, BK virus
GISSLAQVGYR

SEQ ID NO: 53663 - protein, 11 aa, BK virus
TISQALWHVIR

SEQ ID NO: 53664 - protein, 11 aa, BK virus
GTRASAKTTNK

SEQ ID NO: 53665 - protein, 11 aa, BK virus
NLSPIRPSMVR

SEQ ID NO: 53666 - protein, 11 aa, BK virus
ELQRRTERFFR

SEQ ID NO: 53667 - protein, 11 aa, BK virus
TTNKRRSRSSR

SEQ ID NO: 53668 - protein, 11 aa, BK virus
FVNNIQYLDPR

SEQ ID NO: 53669 - protein, 11 aa, BK virus
TSQELQRRTER

SEQ ID NO: 53670 - protein, 11 aa, BK virus
NLSPIRPSMVR

SEQ ID NO: 53671 - protein, 11 aa, BK virus
TISQALWHVIR

SEQ ID NO: 53672 - protein, 11 aa, BK virus
TTNKRRSRSSR

SEQ ID NO: 53673 - protein, 11 aa, BK virus
FVNNIQYLDPR

SEQ ID NO: 53674 - protein, 11 aa, BK virus
TISQALWHVIR

SEQ ID NO: 53675 - protein, 11 aa, BK virus
EVTQRMDLRNK

SEQ ID NO: 53676 - protein, 11 aa, BK virus
ELQRRTERFFR

SEQ ID NO: 53677 - protein, 11 aa, BK virus
EAYEDGPNQKK

SEQ ID NO: 53678 - protein, 11 aa, BK virus
ESVHSGEFIEK

SEQ ID NO: 53679 - protein, 11 aa, BK virus
NLSPIRPSMVR

SEQ ID NO: 53680 - protein, 11 aa, BK virus
NADSIEEVTQR

SEQ ID NO: 53681 - protein, 11 aa, BK virus
TSQELQRRTER

SEQ ID NO: 53682 - protein, 11 aa, BK virus
WTIVNAPINFY

SEQ ID NO: 53683 - protein, 11 aa, BK virus
GISSLAQVGYR

SEQ ID NO: 53684 - protein, 11 aa, BK virus
KTIAPGGANQR

SEQ ID NO: 53685 - protein, 11 aa, BK virus
IPAITSQELQR

SEQ ID NO: 53686 - protein, 11 aa, BK virus
RPSMVRQVAER

SEQ ID NO: 53687 - protein, 11 aa, BK virus
QDYYSNLSPIR

SEQ ID NO: 53688 - protein, 11 aa, BK virus
ETTWTIVNAPI

SEQ ID NO: 53689 - protein, 11 aa, BK virus
TVTGISSLAQV

SEQ ID NO: 53690 - protein, 11 aa, BK virus
EAAAATGFSVA

SEQ ID NO: 53691 - protein, 11 aa, BK virus
FAALIQTVTGI

SEQ ID NO: 53692 - protein, 11 aa, BK virus
EIAAGEAAAAI

SEQ ID NO: 53693 - protein, 11 aa, BK virus
HTYSIDNADSI

SEQ ID NO: 53694 - protein, 11 aa, BK virus
TTSEAIAAIGL

SEQ ID NO: 53695 - protein, 11 aa, BK virus
SVAEIAAGEAA

SEQ ID NO: 53696 - protein, 11 aa, BK virus
QIASLATVEGI

SEQ ID NO: 53697 - protein, 11 aa, BK virus
EAAAAIEVQIA

SEQ ID NO: 53698 - protein, 11 aa, BK virus
LVASVSEAAAA

SEQ ID NO: 53699 - protein, 11 aa, BK virus
DILFPGVNTFV

SEQ ID NO: 53700 - protein, 11 aa, BK virus
RTAPQWMLPLL

SEQ ID NO: 53701 - protein, 11 aa, BK virus
QRMDLRNKESV

SEQ ID NO: 53702 - protein, 11 aa, BK virus
ELFNPDEYYDI

SEQ ID NO: 53703 - protein, 11 aa, BK virus
TVEGITTTSEA

SEQ ID NO: 53704 - protein, 11 aa, BK virus
FATISQALWHV

SEQ ID NO: 53705 - protein, 11 aa, BK virus
STVGLYQQSGM

SEQ ID NO: 53706 - protein, 11 aa, BK virus
VNAPINFYNYI

SEQ ID NO: 53707 - protein, 11 aa, BK virus
AAATGFSVAEI

SEQ ID NO: 53708 - protein, 11 aa, BK virus
FSVAEIAAGEA

SEQ ID NO: 53709 - protein, 11 aa, BK virus
SEAAAATGFSV

SEQ ID NO: 53710 - protein, 11 aa, BK virus
YRFFSDWDHKV

SEQ ID NO: 53711 - protein, 11 aa, BK virus
ITTTSEAIAAI

SEQ ID NO: 53712 - protein, 11 aa, BK virus
YAVIAGAPGAI

SEQ ID NO: 53713 - protein, 11 aa, BK virus
MGAALALLGDL

SEQ ID NO: 53714 - protein, 11 aa, BK virus
ETTWTIVNAPI

SEQ ID NO: 53715 - protein, 11 aa, BK virus
EIAAGEAAAAI

SEQ ID NO: 53716 - protein, 11 aa, BK virus
DILFPGVNTFV

SEQ ID NO: 53717 - protein, 11 aa, BK virus
FATISQALWHV

SEQ ID NO: 53718 - protein, 11 aa, BK virus
TTSEAIAAIGL

SEQ ID NO: 53719 - protein, 11 aa, BK virus
HTYSIDNADSI

SEQ ID NO: 53720 - protein, 11 aa, BK virus
TVTGISSLAQV

SEQ ID NO: 53721 - protein, 11 aa, BK virus
SVAEIAAGEAA

SEQ ID NO: 53722 - protein, 11 aa, BK virus
YAVIAGAPGAI

SEQ ID NO: 53723 - protein, 11 aa, BK virus
YLDPRHWGPSL

SEQ ID NO: 53724 - protein, 11 aa, BK virus
AAGEAAAAIEV

SEQ ID NO: 53725 - protein, 11 aa, BK virus
FSDWDHKVSTV

SEQ ID NO: 53726 - protein, 11 aa, BK virus
LPLLLGLYGTV

SEQ ID NO: 53727 - protein, 11 aa, BK virus
QIASLATVEGI

SEQ ID NO: 53728 - protein, 11 aa, BK virus
RTAPQWMLPLL

SEQ ID NO: 53729 - protein, 11 aa, BK virus
APGAIAGFAAL

SEQ ID NO: 53730 - protein, 11 aa, BK virus
SPIRPSMVRQV

SEQ ID NO: 53731 - protein, 11 aa, BK virus
YAVIAGAPGAI

SEQ ID NO: 53732 - protein, 11 aa, BK virus
YQQSGMALELF

SEQ ID NO: 53733 - protein, 11 aa, BK virus
WTIVNAPINFY

SEQ ID NO: 53734 - protein, 11 aa, BK virus
IVNAPINFYNY

SEQ ID NO: 53735 - protein, 11 aa, BK virus
SVSEAAAATGF

SEQ ID NO: 53736 - protein, 11 aa, BK virus
RNKESVHSGEF

SEQ ID NO: 53737 - protein, 11 aa, BK virus
IAAIGLTPQTY

SEQ ID NO: 53738 - protein, 11 aa, BK virus
IEVQIASLATV

SEQ ID NO: 53739 - protein, 11 aa, BK virus
DEYYDILFPGV

SEQ ID NO: 53740 - protein, 11 aa, BK virus
QELQRRTERFF

SEQ ID NO: 53741 - protein, 11 aa, BK virus
YDILFPGVNTF

SEQ ID NO: 53742 - protein, 11 aa, BK virus
RRTERFFRDSL

SEQ ID NO: 53743 - protein, 11 aa, BK virus
KRRVSRGSSQK

SEQ ID NO: 53744 - protein, 11 aa, BK virus
RRVSRGSSQKA

SEQ ID NO: 53745 - protein, 11 aa, BK virus
QRTAPQWMLPL

SEQ ID NO: 53746 - protein, 11 aa, BK virus
MALELFNPDEY

SEQ ID NO: 53747 - protein, 11 aa, BK virus
IAAIGLTPQTY

SEQ ID NO: 53748 - protein, 11 aa, BK virus
YAVIAGAPGAI

SEQ ID NO: 53749 - protein, 11 aa, BK virus
SVSEAAAATGF

SEQ ID NO: 53750 - protein, 11 aa, BK virus
WTIVNAPINFY

SEQ ID NO: 53751 - protein, 11 aa, BK virus
APGAIAGFAAL

SEQ ID NO: 53752 - protein, 11 aa, BK virus
YGTVTPALEAY

SEQ ID NO: 53753 - protein, 11 aa, BK virus
VASVSEAAAAT

SEQ ID NO: 53754 - protein, 11 aa, BK virus
YLDPRHWGPSL

SEQ ID NO: 53755 - protein, 11 aa, BK virus
YNYIQDYYSNL

SEQ ID NO: 53756 - protein, 11 aa, BK virus
GEAAAAIEVQI

SEQ ID NO: 53757 - protein, 11 aa, BK virus
SEAAAATGFSV

SEQ ID NO: 53758 - protein, 11 aa, BK virus
IEVQIASLATV

SEQ ID NO: 53759 - protein, 11 aa, BK virus
DEYYDILFPGV

SEQ ID NO: 53760 - protein, 11 aa, BK virus
QELQRRTERFF

SEQ ID NO: 53761 - protein, 11 aa, BK virus
AEIAAGEAAAA

SEQ ID NO: 53762 - protein, 11 aa, BK virus
AEIAAGEAAAA

SEQ ID NO: 53763 - protein, 11 aa, BK virus
AEIAAGEAAAA

SEQ ID NO: 53764 - protein, 11 aa, BK virus
LPLLLGLYGTV

SEQ ID NO: 53765 - protein, 11 aa, BK virus
FPGVNTFVNNI

SEQ ID NO: 53766 - protein, 11 aa, BK virus
FPGVNTFVNNI

SEQ ID NO: 53767 - protein, 11 aa, BK virus
LPLLLGLYGTV

SEQ ID NO: 53768 - protein, 11 aa, BK virus
MALELFNPDEY

SEQ ID NO: 53769 - protein, 11 aa, BK virus
LPLLLGLYGTV

SEQ ID NO: 53770 - protein, 11 aa, BK virus
FPGVNTFVNNI

SEQ ID NO: 53771 - protein, 11 aa, BK virus
TPQTYAVIAGA

SEQ ID NO: 53772 - protein, 11 aa, BK virus
FAALIQTVTGI

SEQ ID NO: 53773 - protein, 11 aa, BK virus
SPIRPSMVRQV

SEQ ID NO: 53774 - protein, 11 aa, BK virus
ISSLAQVGYRF

SEQ ID NO: 53775 - protein, 11 aa, BK virus
SLARFLEETTW

SEQ ID NO: 53776 - protein, 11 aa, BK virus
SLFATISQALW

SEQ ID NO: 53777 - protein, 11 aa, BK virus
IAAIGLTPQTY

SEQ ID NO: 53778 - protein, 11 aa, BK virus
GGANQRTAPQW

SEQ ID NO: 53779 - protein, 11 aa, BK virus
RTAPQWMLPLL

SEQ ID NO: 53780 - protein, 8 aa, BK Virus
YLDKNNAY

SEQ ID NO: 53781 - protein, 8 aa, BK Virus
LMWEAVTV

SEQ ID NO: 53782 - protein, 8 aa, BK Virus
VLLDEQGV

SEQ ID NO: 53783 - protein, 8 aa, BK Virus
KMLPCYST

SEQ ID NO: 53784 - protein, 8 aa, BK Virus
GVDAITEV

SEQ ID NO: 53785 - protein, 8 aa, BK Virus
GLARYFKI

SEQ ID NO: 53786 - protein, 8 aa, BK Virus
NLLMWEAV

SEQ ID NO: 53787 - protein, 8 aa, BK Virus
MLPCYSTA

SEQ ID NO: 53788 - protein, 8 aa, BK Virus
LLMWEAVT

SEQ ID NO: 53789 - protein, 8 aa, BK Virus
GLARYFKI

SEQ ID NO: 53790 - protein, 8 aa, BK Virus
LMWEAVTV

SEQ ID NO: 53791 - protein, 8 aa, BK Virus
MLPCYSTA

SEQ ID NO: 53792 - protein, 8 aa, BK Virus
VLLDEQGV

SEQ ID NO: 53793 - protein, 8 aa, BK Virus
SAADICGL

SEQ ID NO: 53794 - protein, 8 aa, BK Virus
GVDAITEV

SEQ ID NO: 53795 - protein, 8 aa, BK Virus
VLEVKTGV

SEQ ID NO: 53796 - protein, 8 aa, BK Virus
FAVGGDPL

SEQ ID NO: 53797 - protein, 8 aa, BK Virus
GITSMLNL

SEQ ID NO: 53798 - protein, 8 aa, BK Virus
MLNLHAGS

SEQ ID NO: 53799 - protein, 8 aa, BK Virus
KLLIKGGV

SEQ ID NO: 53800 - protein, 8 aa, BK Virus
LLMWEAVT

SEQ ID NO: 53801 - protein, 8 aa, BK Virus
NTATTVLL

SEQ ID NO: 53802 - protein, 8 aa, BK Virus
MLPCYSTA

SEQ ID NO: 53803 - protein, 8 aa, BK Virus
LMWEAVTV

SEQ ID NO: 53804 - protein, 8 aa, BK Virus
LIKGGVEV

SEQ ID NO: 53805 - protein, 8 aa, BK Virus
GLARYFKI

SEQ ID NO: 53806 - protein, 8 aa, BK Virus
VLLDEQGV

SEQ ID NO: 53807 - protein, 8 aa, BK Virus
VTNTATTV

SEQ ID NO: 53808 - protein, 8 aa, BK Virus
KLLIKGGV

SEQ ID NO: 53809 - protein, 8 aa, BK Virus
NLLMWEAV

SEQ ID NO: 53810 - protein, 8 aa, BK Virus
VLEVKTGV

SEQ ID NO: 53811 - protein, 8 aa, BK Virus
VLHVTNTA

SEQ ID NO: 53812 - protein, 8 aa, BK Virus
LLMWEAVT

SEQ ID NO: 53813 - protein, 8 aa, BK Virus
SAADICGL

SEQ ID NO: 53814 - protein, 8 aa, BK Virus
VMNTDHKA

SEQ ID NO: 53815 - protein, 8 aa, BK Virus
KMLPCYST

SEQ ID NO: 53816 - protein, 8 aa, BK Virus
MLNLHAGS

SEQ ID NO: 53817 - protein, 8 aa, BK Virus
SQVEEVRV

SEQ ID NO: 53818 - protein, 8 aa, BK Virus
NVPPVLHV

SEQ ID NO: 53819 - protein, 8 aa, BK Virus
GITSMLNL

SEQ ID NO: 53820 - protein, 8 aa, BK Virus
GVDAITEV

SEQ ID NO: 53821 - protein, 8 aa, BK Virus
SVKNPYPI

SEQ ID NO: 53822 - protein, 8 aa, BK Virus
AVTVKTEV

SEQ ID NO: 53823 - protein, 8 aa, BK Virus
VIGITSML

SEQ ID NO: 53824 - protein, 8 aa, BK Virus
LMWEAVTV

SEQ ID NO: 53825 - protein, 8 aa, BK Virus
VLLDEQGV

SEQ ID NO: 53826 - protein, 8 aa, BK Virus
KLLIKGGV

SEQ ID NO: 53827 - protein, 8 aa, BK Virus
GLARYFKI

SEQ ID NO: 53828 - protein, 8 aa, BK Virus
VLEVKTGV

SEQ ID NO: 53829 - protein, 8 aa, BK Virus
VTNTATTV

SEQ ID NO: 53830 - protein, 8 aa, BK Virus
SQVEEVRV

SEQ ID NO: 53831 - protein, 8 aa, BK Virus
NLLMWEAV

SEQ ID NO: 53832 - protein, 8 aa, BK Virus
LIKGGVEV

SEQ ID NO: 53833 - protein, 8 aa, BK Virus
GVDAITEV

SEQ ID NO: 53834 - protein, 8 aa, BK Virus
LMWEAVTV

SEQ ID NO: 53835 - protein, 8 aa, BK Virus
SQVEEVRV

SEQ ID NO: 53836 - protein, 8 aa, BK Virus
NLLMWEAV

SEQ ID NO: 53837 - protein, 8 aa, BK Virus
FAVGGDPL

SEQ ID NO: 53838 - protein, 8 aa, BK Virus
VLLDEQGV

SEQ ID NO: 53839 - protein, 8 aa, BK Virus
GVDAITEV

SEQ ID NO: 53840 - protein, 8 aa, BK Virus
VQVPKLLI

SEQ ID NO: 53841 - protein, 8 aa, BK Virus
MLPCYSTA

SEQ ID NO: 53842 - protein, 8 aa, BK Virus
KMLPCYST

SEQ ID NO: 53843 - protein, 8 aa, BK Virus
GQLQTKMV

SEQ ID NO: 53844 - protein, 8 aa, BK Virus
NVPPVLHV

SEQ ID NO: 53845 - protein, 8 aa, BK Virus
KLLIKGGV

SEQ ID NO: 53846 - protein, 8 aa, BK Virus
SAADICGL

SEQ ID NO: 53847 - protein, 8 aa, BK Virus
VTNTATTV

SEQ ID NO: 53848 - protein, 8 aa, BK Virus
GLARYFKI

SEQ ID NO: 53849 - protein, 8 aa, BK Virus
VQGSNFHF

SEQ ID NO: 53850 - protein, 8 aa, BK Virus
AVTVKTEV

SEQ ID NO: 53851 - protein, 8 aa, BK Virus
TQQWRGLA

SEQ ID NO: 53852 - protein, 8 aa, BK Virus
AQSQVMNT

SEQ ID NO: 53853 - protein, 8 aa, BK Virus
SNFHFFAV

SEQ ID NO: 53854 - protein, 8 aa, BK Virus
LMWEAVTV

SEQ ID NO: 53855 - protein, 8 aa, BK Virus
VLLDEQGV

SEQ ID NO: 53856 - protein, 8 aa, BK Virus
NLLMWEAV

SEQ ID NO: 53857 - protein, 8 aa, BK Virus
GVDAITEV

SEQ ID NO: 53858 - protein, 8 aa, BK Virus
LIKGGVEV

SEQ ID NO: 53859 - protein, 8 aa, BK Virus
NVPPVLHV

SEQ ID NO: 53860 - protein, 8 aa, BK Virus
KLLIKGGV

SEQ ID NO: 53861 - protein, 8 aa, BK Virus
YIDRQGQL

SEQ ID NO: 53862 - protein, 8 aa, BK Virus
GLARYFKI

SEQ ID NO: 53863 - protein, 8 aa, BK Virus
MLPCYSTA

SEQ ID NO: 53864 - protein, 8 aa, BK Virus
YLDKNNAY

SEQ ID NO: 53865 - protein, 8 aa, BK Virus
KMLPCYST

SEQ ID NO: 53866 - protein, 8 aa, BK Virus
VLEVKTGV

SEQ ID NO: 53867 - protein, 8 aa, BK Virus
DLTCGNLL

SEQ ID NO: 53868 - protein, 8 aa, BK Virus
SAADICGL

SEQ ID NO: 53869 - protein, 8 aa, BK Virus
NLNEDLTC

SEQ ID NO: 53870 - protein, 8 aa, BK Virus
VMNTDHKA

SEQ ID NO: 53871 - protein, 8 aa, BK Virus
VLHVTNTA

SEQ ID NO: 53872 - protein, 8 aa, BK Virus
AVTVKTEV

SEQ ID NO: 53873 - protein, 8 aa, BK Virus
PMYGMESQ

SEQ ID NO: 53874 - protein, 8 aa, BK Virus
SQVEEVRV

SEQ ID NO: 53875 - protein, 8 aa, BK Virus
RVFDGTEQ

SEQ ID NO: 53876 - protein, 8 aa, BK Virus
VFDGTEQL

SEQ ID NO: 53877 - protein, 8 aa, BK Virus
CKADSLYV

SEQ ID NO: 53878 - protein, 8 aa, BK Virus
VTNTATTV

SEQ ID NO: 53879 - protein, 8 aa, BK Virus
SMLNLHAG

SEQ ID NO: 53880 - protein, 8 aa, BK Virus
GITSMLNL

SEQ ID NO: 53881 - protein, 8 aa, BK Virus
SNFHFFAV

SEQ ID NO: 53882 - protein, 8 aa, BK Virus
LLMWEAVT

SEQ ID NO: 53883 - protein, 8 aa, BK Virus
PLCKADSL

SEQ ID NO: 53884 - protein, 8 aa, BK Virus
TYTGGENV

SEQ ID NO: 53885 - protein, 8 aa, BK Virus
QLPGDPDM

SEQ ID NO: 53886 - protein, 8 aa, BK Virus
VIGITSML

SEQ ID NO: 53887 - protein, 8 aa, BK Virus
VLLDEQGV

SEQ ID NO: 53888 - protein, 8 aa, BK Virus
LMWEAVTV

SEQ ID NO: 53889 - protein, 8 aa, BK Virus
NLLMWEAV

SEQ ID NO: 53890 - protein, 8 aa, BK Virus
LIKGGVEV

SEQ ID NO: 53891 - protein, 8 aa, BK Virus
GLARYFKI

SEQ ID NO: 53892 - protein, 8 aa, BK Virus
VLEVKTGV

SEQ ID NO: 53893 - protein, 8 aa, BK Virus
YLDKNNAY

SEQ ID NO: 53894 - protein, 8 aa, BK Virus
KLLIKGGV

SEQ ID NO: 53895 - protein, 8 aa, BK Virus
YIDRQGQL

SEQ ID NO: 53896 - protein, 8 aa, BK Virus
MLPCYSTA

SEQ ID NO: 53897 - protein, 8 aa, BK Virus
GVDAITEV

SEQ ID NO: 53898 - protein, 8 aa, BK Virus
NVPPVLHV

SEQ ID NO: 53899 - protein, 8 aa, BK Virus
PMYGMESQ

SEQ ID NO: 53900 - protein, 8 aa, BK Virus
VMNTDHKA

SEQ ID NO: 53901 - protein, 8 aa, BK Virus
VLHVTNTA

SEQ ID NO: 53902 - protein, 8 aa, BK Virus
KMLPCYST

SEQ ID NO: 53903 - protein, 8 aa, BK Virus
QLPGDPDM

SEQ ID NO: 53904 - protein, 8 aa, BK Virus
LLMWEAVT

SEQ ID NO: 53905 - protein, 8 aa, BK Virus
SMLNLHAG

SEQ ID NO: 53906 - protein, 8 aa, BK Virus
FLNPEMGD

SEQ ID NO: 53907 - protein, 8 aa, BK Virus
VTNTATTV

SEQ ID NO: 53908 - protein, 8 aa, BK Virus
NLNEDLTC

SEQ ID NO: 53909 - protein, 8 aa, BK Virus
SQVEEVRV

SEQ ID NO: 53910 - protein, 8 aa, BK Virus
LMWEAVTV

SEQ ID NO: 53911 - protein, 8 aa, BK Virus
VLLDEQGV

SEQ ID NO: 53912 - protein, 8 aa, BK Virus
NLLMWEAV

SEQ ID NO: 53913 - protein, 8 aa, BK Virus
LIKGGVEV

SEQ ID NO: 53914 - protein, 8 aa, BK Virus
NVPPVLHV

SEQ ID NO: 53915 - protein, 8 aa, BK Virus
GVDAITEV

SEQ ID NO: 53916 - protein, 8 aa, BK Virus
GLARYFKI

SEQ ID NO: 53917 - protein, 8 aa, BK Virus
VLEVKTGV

SEQ ID NO: 53918 - protein, 8 aa, BK Virus
MLPCYSTA

SEQ ID NO: 53919 - protein, 8 aa, BK Virus
YIDRQGQL

SEQ ID NO: 53920 - protein, 8 aa, BK Virus
KLLIKGGV

SEQ ID NO: 53921 - protein, 8 aa, BK Virus
AVTVKTEV

SEQ ID NO: 53922 - protein, 8 aa, BK Virus
PLCKADSL

SEQ ID NO: 53923 - protein, 8 aa, BK Virus
DLTCGNLL

SEQ ID NO: 53924 - protein, 8 aa, BK Virus
VLHVTNTA

SEQ ID NO: 53925 - protein, 8 aa, BK Virus
VIGITSML

SEQ ID NO: 53926 - protein, 8 aa, BK Virus
KMLPCYST

SEQ ID NO: 53927 - protein, 8 aa, BK Virus
PMYGMESQ

SEQ ID NO: 53928 - protein, 8 aa, BK Virus
VTNTATTV

SEQ ID NO: 53929 - protein, 8 aa, BK Virus
YLDKNNAY

SEQ ID NO: 53930 - protein, 8 aa, BK Virus
MYGMESQV

SEQ ID NO: 53931 - protein, 8 aa, BK Virus
FAVGGDPL

SEQ ID NO: 53932 - protein, 8 aa, BK Virus
TYTGGENV

SEQ ID NO: 53933 - protein, 8 aa, BK Virus
LMWEAVTV

SEQ ID NO: 53934 - protein, 8 aa, BK Virus
VLLDEQGV

SEQ ID NO: 53935 - protein, 8 aa, BK Virus
NLLMWEAV

SEQ ID NO: 53936 - protein, 8 aa, BK Virus
GVDAITEV

SEQ ID NO: 53937 - protein, 8 aa, BK Virus
NVPPVLHV

SEQ ID NO: 53938 - protein, 8 aa, BK Virus
LIKGGVEV

SEQ ID NO: 53939 - protein, 8 aa, BK Virus
YIDRQGQL

SEQ ID NO: 53940 - protein, 8 aa, BK Virus
VLEVKTGV

SEQ ID NO: 53941 - protein, 8 aa, BK Virus
CKADSLYV

SEQ ID NO: 53942 - protein, 8 aa, BK Virus
YLDKNNAY

SEQ ID NO: 53943 - protein, 8 aa, BK Virus
VTNTATTV

SEQ ID NO: 53944 - protein, 8 aa, BK Virus
VFDGTEQL

SEQ ID NO: 53945 - protein, 8 aa, BK Virus
GLARYFKI

SEQ ID NO: 53946 - protein, 8 aa, BK Virus
DLTCGNLL

SEQ ID NO: 53947 - protein, 8 aa, BK Virus
RLRKRSVK

SEQ ID NO: 53948 - protein, 8 aa, BK Virus
LINRRTQK

SEQ ID NO: 53949 - protein, 8 aa, BK Virus
VLMNYRTK

SEQ ID NO: 53950 - protein, 8 aa, BK Virus
NLHAGSQK

SEQ ID NO: 53951 - protein, 8 aa, BK Virus
LMNYRTKY

SEQ ID NO: 53952 - protein, 8 aa, BK Virus
RGLARYFK

SEQ ID NO: 53953 - protein, 8 aa, BK Virus
RQGQLQTK

SEQ ID NO: 53954 - protein, 8 aa, BK Virus
QVMNTDHK

SEQ ID NO: 53955 - protein, 8 aa, BK Virus
VLMNYRTK

SEQ ID NO: 53956 - protein, 8 aa, BK Virus
LINRRTQK

SEQ ID NO: 53957 - protein, 8 aa, BK Virus
RGLARYFK

SEQ ID NO: 53958 - protein, 8 aa, BK Virus
QVPKLLIK

SEQ ID NO: 53959 - protein, 8 aa, BK Virus
GVEVLEVK

SEQ ID NO: 53960 - protein, 8 aa, BK Virus
GAAPKKPK

SEQ ID NO: 53961 - protein, 8 aa, BK Virus
RQGQLQTK

SEQ ID NO: 53962 - protein, 8 aa, BK Virus
PYPISFLL

SEQ ID NO: 53963 - protein, 8 aa, BK Virus
LYVSAADI

SEQ ID NO: 53964 - protein, 8 aa, BK Virus
VQGSNFHF

SEQ ID NO: 53965 - protein, 8 aa, BK Virus
MWEAVTVK

SEQ ID NO: 53966 - protein, 8 aa, BK Virus
RYFKIRLR

SEQ ID NO: 53967 - protein, 8 aa, BK Virus
PYPISFLL

SEQ ID NO: 53968 - protein, 8 aa, BK Virus
AYPVECWI

SEQ ID NO: 53969 - protein, 8 aa, BK Virus
LYVSAADI

SEQ ID NO: 53970 - protein, 8 aa, BK Virus
SFLLSDLI

SEQ ID NO: 53971 - protein, 8 aa, BK Virus
VQGSNFHF

SEQ ID NO: 53972 - protein, 8 aa, BK Virus
AYPVECWI

SEQ ID NO: 53973 - protein, 8 aa, BK Virus
PYPISFLL

SEQ ID NO: 53974 - protein, 8 aa, BK Virus
LYVSAADI

SEQ ID NO: 53975 - protein, 8 aa, BK Virus
EVIGITSM

SEQ ID NO: 53976 - protein, 8 aa, BK Virus
EVIGITSM

SEQ ID NO: 53977 - protein, 8 aa, BK Virus
KVDGQPMY

SEQ ID NO: 53978 - protein, 8 aa, BK Virus
YLDKNNAY

SEQ ID NO: 53979 - protein, 8 aa, BK Virus
PTAQSQVM

SEQ ID NO: 53980 - protein, 8 aa, BK Virus
NTRYFGTY

SEQ ID NO: 53981 - protein, 8 aa, BK Virus
YIDRQGQL

SEQ ID NO: 53982 - protein, 8 aa, BK Virus
QVEEVRVF

SEQ ID NO: 53983 - protein, 8 aa, BK Virus
NTDHKAYL

SEQ ID NO: 53984 - protein, 8 aa, BK Virus
NTATTVLL

SEQ ID NO: 53985 - protein, 8 aa, BK Virus
YLDKNNAY

SEQ ID NO: 53986 - protein, 8 aa, BK Virus
LMNYRTKY

SEQ ID NO: 53987 - protein, 8 aa, BK Virus
RLRKRSVK

SEQ ID NO: 53988 - protein, 8 aa, BK Virus
RGLARYFK

SEQ ID NO: 53989 - protein, 8 aa, BK Virus
QVMNTDHK

SEQ ID NO: 53990 - protein, 8 aa, BK Virus
LINRRTQK

SEQ ID NO: 53991 - protein, 8 aa, BK Virus
VLMNYRTK

SEQ ID NO: 53992 - protein, 8 aa, BK Virus
YFKIRLRK

SEQ ID NO: 53993 - protein, 8 aa, BK Virus
RYFKIRLR

SEQ ID NO: 53994 - protein, 8 aa, BK Virus
NLHAGSQK

SEQ ID NO: 53995 - protein, 8 aa, BK Virus
KVDGQPMY

SEQ ID NO: 53996 - protein, 8 aa, BK Virus
LMNYRTKY

SEQ ID NO: 53997 - protein, 8 aa, BK Virus
RYFKIRLR

SEQ ID NO: 53998 - protein, 8 aa, BK Virus
RGLARYFK

SEQ ID NO: 53999 - protein, 8 aa, BK Virus
RLRKRSVK

SEQ ID NO: 54000 - protein, 8 aa, BK Virus
LARYFKIR

SEQ ID NO: 54001 - protein, 8 aa, BK Virus
QQWRGLAR

SEQ ID NO: 54002 - protein, 8 aa, BK Virus
YFKIRLRK

SEQ ID NO: 54003 - protein, 8 aa, BK Virus
LLSDLINR

SEQ ID NO: 54004 - protein, 8 aa, BK Virus
LINRRTQK

SEQ ID NO: 54005 - protein, 8 aa, BK Virus
SSGTQQWR

SEQ ID NO: 54006 - protein, 8 aa, BK Virus
VLMNYRTK

SEQ ID NO: 54007 - protein, 8 aa, BK Virus
DMIRYIDR

SEQ ID NO: 54008 - protein, 8 aa, BK Virus
RYFKIRLR

SEQ ID NO: 54009 - protein, 8 aa, BK Virus
LARYFKIR

SEQ ID NO: 54010 - protein, 8 aa, BK Virus
YFKIRLRK

SEQ ID NO: 54011 - protein, 8 aa, BK Virus
QQWRGLAR

SEQ ID NO: 54012 - protein, 8 aa, BK Virus
QVMNTDHK

SEQ ID NO: 54013 - protein, 8 aa, BK Virus
DMIRYIDR

SEQ ID NO: 54014 - protein, 8 aa, BK Virus
ESQVEEVR

SEQ ID NO: 54015 - protein, 8 aa, BK Virus
LPCYSTAR

SEQ ID NO: 54016 - protein, 8 aa, BK Virus
NLHAGSQK

SEQ ID NO: 54017 - protein, 8 aa, BK Virus
LLSDLINR

SEQ ID NO: 54018 - protein, 8 aa, BK Virus
LINRRTQK

SEQ ID NO: 54019 - protein, 8 aa, BK Virus
RYFKIRLR

SEQ ID NO: 54020 - protein, 8 aa, BK Virus
QGVLMNYR

SEQ ID NO: 54021 - protein, 8 aa, BK Virus
LSDLINRR

SEQ ID NO: 54022 - protein, 8 aa, BK Virus
LARYFKIR

SEQ ID NO: 54023 - protein, 8 aa, BK Virus
NTATTVLL

SEQ ID NO: 54024 - protein, 8 aa, BK Virus
SAADICGL

SEQ ID NO: 54025 - protein, 8 aa, BK Virus
EVIGITSM

SEQ ID NO: 54026 - protein, 8 aa, BK Virus
SNFHFFAV

SEQ ID NO: 54027 - protein, 8 aa, BK Virus
NVPPVLHV

SEQ ID NO: 54028 - protein, 8 aa, BK Virus
NPYPISFL

SEQ ID NO: 54029 - protein, 8 aa, BK Virus
FAVGGDPL

SEQ ID NO: 54030 - protein, 8 aa, BK Virus
YSTARIPL

SEQ ID NO: 54031 - protein, 8 aa, BK Virus
SVKNPYPI

SEQ ID NO: 54032 - protein, 8 aa, BK Virus
CKADSLYV

SEQ ID NO: 54033 - protein, 8 aa, BK Virus
LMWEAVTV

SEQ ID NO: 54034 - protein, 8 aa, BK Virus
NTATTVLL

SEQ ID NO: 54035 - protein, 8 aa, BK Virus
DPLEMQGV

SEQ ID NO: 54036 - protein, 8 aa, BK Virus
NPYPISFL

SEQ ID NO: 54037 - protein, 8 aa, BK Virus
EVIGITSM

SEQ ID NO: 54038 - protein, 8 aa, BK Virus
NVPPVLHV

SEQ ID NO: 54039 - protein, 8 aa, BK Virus
NLLMWEAV

SEQ ID NO: 54040 - protein, 8 aa, BK Virus
SAADICGL

SEQ ID NO: 54041 - protein, 8 aa, BK Virus
EPVQVPKL

SEQ ID NO: 54042 - protein, 8 aa, BK Virus
KPVQGSNF

SEQ ID NO: 54043 - protein, 8 aa, BK Virus
NPYPISFL

SEQ ID NO: 54044 - protein, 8 aa, BK Virus
KPKEPVQV

SEQ ID NO: 54045 - protein, 8 aa, BK Virus
LPNLNEDL

SEQ ID NO: 54046 - protein, 8 aa, BK Virus
HLSAENAF

SEQ ID NO: 54047 - protein, 8 aa, BK Virus
LMNYRTKY

SEQ ID NO: 54048 - protein, 8 aa, BK Virus
MQGVLMNY

SEQ ID NO: 54049 - protein, 8 aa, BK Virus
VQGSNFHF

SEQ ID NO: 54050 - protein, 8 aa, BK Virus
YLDKNNAY

SEQ ID NO: 54051 - protein, 8 aa, BK Virus
DEQGVGPL

SEQ ID NO: 54052 - protein, 8 aa, BK Virus
MESQVEEV

SEQ ID NO: 54053 - protein, 8 aa, BK Virus
LEMQGVLM

SEQ ID NO: 54054 - protein, 8 aa, BK Virus
ARYFKIRL

SEQ ID NO: 54055 - protein, 8 aa, BK Virus
KRSVKNPY

SEQ ID NO: 54056 - protein, 8 aa, BK Virus
WRGLARYF

SEQ ID NO: 54057 - protein, 8 aa, BK Virus
FAVGGDPL

SEQ ID NO: 54058 - protein, 8 aa, BK Virus
KPVQGSNF

SEQ ID NO: 54059 - protein, 8 aa, BK Virus
EPVQVPKL

SEQ ID NO: 54060 - protein, 8 aa, BK Virus
YLDKNNAY

SEQ ID NO: 54061 - protein, 8 aa, BK Virus
EVIGITSM

SEQ ID NO: 54062 - protein, 8 aa, BK Virus
LPNLNEDL

SEQ ID NO: 54063 - protein, 8 aa, BK Virus
YPISFLLS

SEQ ID NO: 54064 - protein, 8 aa, BK Virus
HLSAENAF

SEQ ID NO: 54065 - protein, 8 aa, BK Virus
NPYPISFL

SEQ ID NO: 54066 - protein, 8 aa, BK Virus
GENVPPVL

SEQ ID NO: 54067 - protein, 8 aa, BK Virus
LEMQGVLM

SEQ ID NO: 54068 - protein, 8 aa, BK Virus
MESQVEEV

SEQ ID NO: 54069 - protein, 8 aa, BK Virus
DEQGVGPL

SEQ ID NO: 54070 - protein, 8 aa, BK Virus
GENVPPVL

SEQ ID NO: 54071 - protein, 8 aa, BK Virus
AENAFESD

SEQ ID NO: 54072 - protein, 8 aa, BK Virus
LPGDPDMI

SEQ ID NO: 54073 - protein, 8 aa, BK Virus
VPPVLHVT

SEQ ID NO: 54074 - protein, 8 aa, BK Virus
YPVECWIP

SEQ ID NO: 54075 - protein, 8 aa, BK Virus
NPYPISFL

SEQ ID NO: 54076 - protein, 8 aa, BK Virus
KPVQGSNF

SEQ ID NO: 54077 - protein, 8 aa, BK Virus
EPVQVPKL

SEQ ID NO: 54078 - protein, 8 aa, BK Virus
LPGDPDMI

SEQ ID NO: 54079 - protein, 8 aa, BK Virus
LPNLNEDL

SEQ ID NO: 54080 - protein, 8 aa, BK Virus
YPISFLLS

SEQ ID NO: 54081 - protein, 8 aa, BK Virus
YPVECWIP

SEQ ID NO: 54082 - protein, 8 aa, BK Virus
VPPVLHVT

SEQ ID NO: 54083 - protein, 8 aa, BK Virus
LPCYSTAR

SEQ ID NO: 54084 - protein, 8 aa, BK Virus
LPGDPDMI

SEQ ID NO: 54085 - protein, 8 aa, BK Virus
NSSGTQQW

SEQ ID NO: 54086 - protein, 8 aa, BK Virus
NAYPVECW

SEQ ID NO: 54087 - protein, 8 aa, BK Virus
NAYPVECW

SEQ ID NO: 54088 - protein, 8 aa, BK Virus
NSSGTQQW

SEQ ID NO: 54089 - protein, 9 aa, BK Virus
LLMWEAVTV

SEQ ID NO: 54090 - protein, 9 aa, BK Virus
KMLPCYSTA

SEQ ID NO: 54091 - protein, 9 aa, BK Virus
LLIKGGVEV

SEQ ID NO: 54092 - protein, 9 aa, BK Virus
GMESQVEEV

SEQ ID NO: 54093 - protein, 9 aa, BK Virus
RVFDGTEQL

SEQ ID NO: 54094 - protein, 9 aa, BK Virus
LLMWEAVTV

SEQ ID NO: 54095 - protein, 9 aa, BK Virus
RVFDGTEQL

SEQ ID NO: 54096 - protein, 9 aa, BK Virus
GMESQVEEV

SEQ ID NO: 54097 - protein, 9 aa, BK Virus
LLIKGGVEV

SEQ ID NO: 54098 - protein, 9 aa, BK Virus
KMLPCYSTA

SEQ ID NO: 54099 - protein, 9 aa, BK Virus
LINRRTQKV

SEQ ID NO: 54100 - protein, 9 aa, BK Virus
NLRGYSQHL

SEQ ID NO: 54101 - protein, 9 aa, BK Virus
NLHAGSQKV

SEQ ID NO: 54102 - protein, 9 aa, BK Virus
AITEVECFL

SEQ ID NO: 54103 - protein, 9 aa, BK Virus
EVIGITSML

SEQ ID NO: 54104 - protein, 9 aa, BK Virus
LLSDLINRR

SEQ ID NO: 54105 - protein, 9 aa, BK Virus
GLFTNSSGT

SEQ ID NO: 54106 - protein, 9 aa, BK Virus
QLPGDPDMI

SEQ ID NO: 54107 - protein, 9 aa, BK Virus
GSNFHFFAV

SEQ ID NO: 54108 - protein, 9 aa, BK Virus
VTNTATTVL

SEQ ID NO: 54109 - protein, 9 aa, BK Virus
LLMWEAVTV

SEQ ID NO: 54110 - protein, 9 aa, BK Virus
LINRRTQKV

SEQ ID NO: 54111 - protein, 9 aa, BK Virus
LLIKGGVEV

SEQ ID NO: 54112 - protein, 9 aa, BK Virus
NLHAGSQKV

SEQ ID NO: 54113 - protein, 9 aa, BK Virus
KMLPCYSTA

SEQ ID NO: 54114 - protein, 9 aa, BK Virus
LIKGGVEVL

SEQ ID NO: 54115 - protein, 9 aa, BK Virus
NLRGYSQHL

SEQ ID NO: 54116 - protein, 9 aa, BK Virus
RVFDGTEQL

SEQ ID NO: 54117 - protein, 9 aa, BK Virus
GMESQVEEV

SEQ ID NO: 54118 - protein, 9 aa, BK Virus
GTYTGGENV

SEQ ID NO: 54119 - protein, 9 aa, BK Virus
SLYVSAADI

SEQ ID NO: 54120 - protein, 9 aa, BK Virus
GLFTNSSGT

SEQ ID NO: 54121 - protein, 9 aa, BK Virus
HVTNTATTV

SEQ ID NO: 54122 - protein, 9 aa, BK Virus
PMYGMESQV

SEQ ID NO: 54123 - protein, 9 aa, BK Virus
MLNLHAGSQ

SEQ ID NO: 54124 - protein, 9 aa, BK Virus
TVKTEVIGI

SEQ ID NO: 54125 - protein, 9 aa, BK Virus
KIRLRKRSV

SEQ ID NO: 54126 - protein, 9 aa, BK Virus
VTNTATTVL

SEQ ID NO: 54127 - protein, 9 aa, BK Virus
LLMWEAVTV

SEQ ID NO: 54128 - protein, 9 aa, BK Virus
LLIKGGVEV

SEQ ID NO: 54129 - protein, 9 aa, BK Virus
GMESQVEEV

SEQ ID NO: 54130 - protein, 9 aa, BK Virus
NLHAGSQKV

SEQ ID NO: 54131 - protein, 9 aa, BK Virus
LINRRTQKV

SEQ ID NO: 54132 - protein, 9 aa, BK Virus
KMLPCYSTA

SEQ ID NO: 54133 - protein, 9 aa, BK Virus
EVLEVKTGV

SEQ ID NO: 54134 - protein, 9 aa, BK Virus
AITEVECFL

SEQ ID NO: 54135 - protein, 9 aa, BK Virus
LLMWEAVTV

SEQ ID NO: 54136 - protein, 9 aa, BK Virus
LLIKGGVEV

SEQ ID NO: 54137 - protein, 9 aa, BK Virus
RVFDGTEQL

SEQ ID NO: 54138 - protein, 9 aa, BK Virus
KMLPCYSTA

SEQ ID NO: 54139 - protein, 9 aa, BK Virus
HVTNTATTV

SEQ ID NO: 54140 - protein, 9 aa, BK Virus
VQGSNFHFF

SEQ ID NO: 54141 - protein, 9 aa, BK Virus
GSNFHFFAV

SEQ ID NO: 54142 - protein, 9 aa, BK Virus
AITEVECFL

SEQ ID NO: 54143 - protein, 9 aa, BK Virus
SQVEEVRVF

SEQ ID NO: 54144 - protein, 9 aa, BK Virus
TGVDAITEV

SEQ ID NO: 54145 - protein, 9 aa, BK Virus
NLHAGSQKV

SEQ ID NO: 54146 - protein, 9 aa, BK Virus
LLMWEAVTV

SEQ ID NO: 54147 - protein, 9 aa, BK Virus
LLIKGGVEV

SEQ ID NO: 54148 - protein, 9 aa, BK Virus
NLHAGSQKV

SEQ ID NO: 54149 - protein, 9 aa, BK Virus
PMYGMESQV

SEQ ID NO: 54150 - protein, 9 aa, BK Virus
RVFDGTEQL

SEQ ID NO: 54151 - protein, 9 aa, BK Virus
KMLPCYSTA

SEQ ID NO: 54152 - protein, 9 aa, BK Virus
AITEVECFL

SEQ ID NO: 54153 - protein, 9 aa, BK Virus
EVLEVKTGV

SEQ ID NO: 54154 - protein, 9 aa, BK Virus
NLRGYSQHL

SEQ ID NO: 54155 - protein, 9 aa, BK Virus
GMESQVEEV

SEQ ID NO: 54156 - protein, 9 aa, BK Virus
LINRRTQKV

SEQ ID NO: 54157 - protein, 9 aa, BK Virus
HVTNTATTV

SEQ ID NO: 54158 - protein, 9 aa, BK Virus
TVLLDEQGV

SEQ ID NO: 54159 - protein, 9 aa, BK Virus
YLDKNNAYP

SEQ ID NO: 54160 - protein, 9 aa, BK Virus
QLPGDPDMI

SEQ ID NO: 54161 - protein, 9 aa, BK Virus
DLTCGNLLM

SEQ ID NO: 54162 - protein, 9 aa, BK Virus
EMGDPDDNL

SEQ ID NO: 54163 - protein, 9 aa, BK Virus
LIKGGVEVL

SEQ ID NO: 54164 - protein, 9 aa, BK Virus
SLYVSAADI

SEQ ID NO: 54165 - protein, 9 aa, BK Virus
TITPKNPTA

SEQ ID NO: 54166 - protein, 9 aa, BK Virus
YIDRQGQLQ

SEQ ID NO: 54167 - protein, 9 aa, BK Virus
GTYTGGENV

SEQ ID NO: 54168 - protein, 9 aa, BK Virus
SMLNLHAGS

SEQ ID NO: 54169 - protein, 9 aa, BK Virus
LMWEAVTVK

SEQ ID NO: 54170 - protein, 9 aa, BK Virus
TGVDAITEV

SEQ ID NO: 54171 - protein, 9 aa, BK Virus
PLPNLNEDL

SEQ ID NO: 54172 - protein, 9 aa, BK Virus
KADSLYVSA

SEQ ID NO: 54173 - protein, 9 aa, BK Virus
EVIGITSML

SEQ ID NO: 54174 - protein, 9 aa, BK Virus
NAYPVECWI

SEQ ID NO: 54175 - protein, 9 aa, BK Virus
NLLMWEAVT

SEQ ID NO: 54176 - protein, 9 aa, BK Virus
GLFTNSSGT

SEQ ID NO: 54177 - protein, 9 aa, BK Virus
LLDEQGVGP

SEQ ID NO: 54178 - protein, 9 aa, BK Virus
LLIKGGVEV

SEQ ID NO: 54179 - protein, 9 aa, BK Virus
LLMWEAVTV

SEQ ID NO: 54180 - protein, 9 aa, BK Virus
NLHAGSQKV

SEQ ID NO: 54181 - protein, 9 aa, BK Virus
PMYGMESQV

SEQ ID NO: 54182 - protein, 9 aa, BK Virus
NLRGYSQHL

SEQ ID NO: 54183 - protein, 9 aa, BK Virus
EVLEVKTGV

SEQ ID NO: 54184 - protein, 9 aa, BK Virus
RVFDGTEQL

SEQ ID NO: 54185 - protein, 9 aa, BK Virus
LINRRTQKV

SEQ ID NO: 54186 - protein, 9 aa, BK Virus
AITEVECFL

SEQ ID NO: 54187 - protein, 9 aa, BK Virus
GMESQVEEV

SEQ ID NO: 54188 - protein, 9 aa, BK Virus
TVLLDEQGV

SEQ ID NO: 54189 - protein, 9 aa, BK Virus
YLDKNNAYP

SEQ ID NO: 54190 - protein, 9 aa, BK Virus
EMGDPDDNL

SEQ ID NO: 54191 - protein, 9 aa, BK Virus
KMLPCYSTA

SEQ ID NO: 54192 - protein, 9 aa, BK Virus
QLPGDPDMI

SEQ ID NO: 54193 - protein, 9 aa, BK Virus
LMWEAVTVK

SEQ ID NO: 54194 - protein, 9 aa, BK Virus
GLFTNSSGT

SEQ ID NO: 54195 - protein, 9 aa, BK Virus
GTYTGGENV

SEQ ID NO: 54196 - protein, 9 aa, BK Virus
LIKGGVEVL

SEQ ID NO: 54197 - protein, 9 aa, BK Virus
SMLNLHAGS

SEQ ID NO: 54198 - protein, 9 aa, BK Virus
LLDEQGVGP

SEQ ID NO: 54199 - protein, 9 aa, BK Virus
VLMNYRTKY

SEQ ID NO: 54200 - protein, 9 aa, BK Virus
PLPNLNEDL

SEQ ID NO: 54201 - protein, 9 aa, BK Virus
HVTNTATTV

SEQ ID NO: 54202 - protein, 9 aa, BK Virus
LLSDLINRR

SEQ ID NO: 54203 - protein, 9 aa, BK Virus
SLYVSAADI

SEQ ID NO: 54204 - protein, 9 aa, BK Virus
YIDRQGQLQ

SEQ ID NO: 54205 - protein, 9 aa, BK Virus
NAYPVECWI

SEQ ID NO: 54206 - protein, 9 aa, BK Virus
LLIKGGVEV

SEQ ID NO: 54207 - protein, 9 aa, BK Virus
PMYGMESQV

SEQ ID NO: 54208 - protein, 9 aa, BK Virus
NLHAGSQKV

SEQ ID NO: 54209 - protein, 9 aa, BK Virus
LLMWEAVTV

SEQ ID NO: 54210 - protein, 9 aa, BK Virus
RVFDGTEQL

SEQ ID NO: 54211 - protein, 9 aa, BK Virus
NLRGYSQHL

SEQ ID NO: 54212 - protein, 9 aa, BK Virus
AITEVECFL

SEQ ID NO: 54213 - protein, 9 aa, BK Virus
GMESQVEEV

SEQ ID NO: 54214 - protein, 9 aa, BK Virus
HVTNTATTV

SEQ ID NO: 54215 - protein, 9 aa, BK Virus
EVLEVKTGV

SEQ ID NO: 54216 - protein, 9 aa, BK Virus
LINRRTQKV

SEQ ID NO: 54217 - protein, 9 aa, BK Virus
KMLPCYSTA

SEQ ID NO: 54218 - protein, 9 aa, BK Virus
EMGDPDDNL

SEQ ID NO: 54219 - protein, 9 aa, BK Virus
NAYPVECWI

SEQ ID NO: 54220 - protein, 9 aa, BK Virus
EAVTVKTEV

SEQ ID NO: 54221 - protein, 9 aa, BK Virus
TGVDAITEV

SEQ ID NO: 54222 - protein, 9 aa, BK Virus
EVIGITSML

SEQ ID NO: 54223 - protein, 9 aa, BK Virus
YLDKNNAYP

SEQ ID NO: 54224 - protein, 9 aa, BK Virus
QLPGDPDMI

SEQ ID NO: 54225 - protein, 9 aa, BK Virus
GTYTGGENV

SEQ ID NO: 54226 - protein, 9 aa, BK Virus
LIKGGVEVL

SEQ ID NO: 54227 - protein, 9 aa, BK Virus
TITPKNPTA

SEQ ID NO: 54228 - protein, 9 aa, BK Virus
PLPNLNEDL

SEQ ID NO: 54229 - protein, 9 aa, BK Virus
NLHAGSQKV

SEQ ID NO: 54230 - protein, 9 aa, BK Virus
LLMWEAVTV

SEQ ID NO: 54231 - protein, 9 aa, BK Virus
PMYGMESQV

SEQ ID NO: 54232 - protein, 9 aa, BK Virus
LLIKGGVEV

SEQ ID NO: 54233 - protein, 9 aa, BK Virus
RVFDGTEQL

SEQ ID NO: 54234 - protein, 9 aa, BK Virus
GMESQVEEV

SEQ ID NO: 54235 - protein, 9 aa, BK Virus
NLRGYSQHL

SEQ ID NO: 54236 - protein, 9 aa, BK Virus
EMGDPDDNL

SEQ ID NO: 54237 - protein, 9 aa, BK Virus
HVTNTATTV

SEQ ID NO: 54238 - protein, 9 aa, BK Virus
EVLEVKTGV

SEQ ID NO: 54239 - protein, 9 aa, BK Virus
LINRRTQKV

SEQ ID NO: 54240 - protein, 9 aa, BK Virus
TGVDAITEV

SEQ ID NO: 54241 - protein, 9 aa, BK Virus
LMWEAVTVK

SEQ ID NO: 54242 - protein, 9 aa, BK Virus
LIKGGVEVL

SEQ ID NO: 54243 - protein, 9 aa, BK Virus
RYFKIRLRK

SEQ ID NO: 54244 - protein, 9 aa, BK Virus
LMWEAVTVK

SEQ ID NO: 54245 - protein, 9 aa, BK Virus
KVHENGGGK

SEQ ID NO: 54246 - protein, 9 aa, BK Virus
VLMNYRTKY

SEQ ID NO: 54247 - protein, 9 aa, BK Virus
GVLMNYRTK

SEQ ID NO: 54248 - protein, 9 aa, BK Virus
GVLMNYRTK

SEQ ID NO: 54249 - protein, 9 aa, BK Virus
SQVMNTDHK

SEQ ID NO: 54250 - protein, 9 aa, BK Virus
RYFKIRLRK

SEQ ID NO: 54251 - protein, 9 aa, BK Virus
TQQWRGLAR

SEQ ID NO: 54252 - protein, 9 aa, BK Virus
KVHENGGGK

SEQ ID NO: 54253 - protein, 9 aa, BK Virus
RYFKIRLRK

SEQ ID NO: 54254 - protein, 9 aa, BK Virus
CYSTARIPL

SEQ ID NO: 54255 - protein, 9 aa, BK Virus
PVQGSNFHF

SEQ ID NO: 54256 - protein, 9 aa, BK Virus
RYIDRQGQL

SEQ ID NO: 54257 - protein, 9 aa, BK Virus
VQGSNFHFF

SEQ ID NO: 54258 - protein, 9 aa, BK Virus
VQGSNFHFF

SEQ ID NO: 54259 - protein, 9 aa, BK Virus
RYIDRQGQL

SEQ ID NO: 54260 - protein, 9 aa, BK Virus
RYIDRQGQL

SEQ ID NO: 54261 - protein, 9 aa, BK Virus
AYLDKNNAY

SEQ ID NO: 54262 - protein, 9 aa, BK Virus
QWRGLARYF

SEQ ID NO: 54263 - protein, 9 aa, BK Virus
EVIGITSML

SEQ ID NO: 54264 - protein, 9 aa, BK Virus
EMQGVLMNY

SEQ ID NO: 54265 - protein, 9 aa, BK Virus
EVIGITSML

SEQ ID NO: 54266 - protein, 9 aa, BK Virus
EMQGVLMNY

SEQ ID NO: 54267 - protein, 9 aa, BK Virus
EVKTGVDAI

SEQ ID NO: 54268 - protein, 9 aa, BK Virus
VLMNYRTKY

SEQ ID NO: 54269 - protein, 9 aa, BK Virus
VMNTDHKAY

SEQ ID NO: 54270 - protein, 9 aa, BK Virus
AYLDKNNAY

SEQ ID NO: 54271 - protein, 9 aa, BK Virus
RYFKIRLRK

SEQ ID NO: 54272 - protein, 9 aa, BK Virus
KVHENGGGK

SEQ ID NO: 54273 - protein, 9 aa, BK Virus
GVLMNYRTK

SEQ ID NO: 54274 - protein, 9 aa, BK Virus
RKRSVKNPY

SEQ ID NO: 54275 - protein, 9 aa, BK Virus
RTKYPQGTI

SEQ ID NO: 54276 - protein, 9 aa, BK Virus
TDHKAYLDK

SEQ ID NO: 54277 - protein, 9 aa, BK Virus
KIRLRKRSV

SEQ ID NO: 54278 - protein, 9 aa, BK Virus
RLRKRSVKN

SEQ ID NO: 54279 - protein, 9 aa, BK Virus
SQVMNTDHK

SEQ ID NO: 54280 - protein, 9 aa, BK Virus
MQGVLMNYR

SEQ ID NO: 54281 - protein, 9 aa, BK Virus
YFKIRLRKR

SEQ ID NO: 54282 - protein, 9 aa, BK Virus
RYFKIRLRK

SEQ ID NO: 54283 - protein, 9 aa, BK Virus
TQQWRGLAR

SEQ ID NO: 54284 - protein, 9 aa, BK Virus
MLPCYSTAR

SEQ ID NO: 54285 - protein, 9 aa, BK Virus
LLSDLINRR

SEQ ID NO: 54286 - protein, 9 aa, BK Virus
GLARYFKIR

SEQ ID NO: 54287 - protein, 9 aa, BK Virus
LMWEAVTVK

SEQ ID NO: 54288 - protein, 9 aa, BK Virus
FLLSDLINR

SEQ ID NO: 54289 - protein, 9 aa, BK Virus
YFKIRLRKR

SEQ ID NO: 54290 - protein, 9 aa, BK Virus
DLINRRTQK

SEQ ID NO: 54291 - protein, 9 aa, BK Virus
NSSGTQQWR

SEQ ID NO: 54292 - protein, 9 aa, BK Virus
MLPCYSTAR

SEQ ID NO: 54293 - protein, 9 aa, BK Virus
DLINRRTQK

SEQ ID NO: 54294 - protein, 9 aa, BK Virus
MESQVEEVR

SEQ ID NO: 54295 - protein, 9 aa, BK Virus
LLSDLINRR

SEQ ID NO: 54296 - protein, 9 aa, BK Virus
EVIGITSML

SEQ ID NO: 54297 - protein, 9 aa, BK Virus
MQGVLMNYR

SEQ ID NO: 54298 - protein, 9 aa, BK Virus
RYFKIRLRK

SEQ ID NO: 54299 - protein, 9 aa, BK Virus
EVIGITSML

SEQ ID NO: 54300 - protein, 9 aa, BK Virus
EAVTVKTEV

SEQ ID NO: 54301 - protein, 9 aa, BK Virus
EVLEVKTGV

SEQ ID NO: 54302 - protein, 9 aa, BK Virus
TGVDAITEV

SEQ ID NO: 54303 - protein, 9 aa, BK Virus
NPYPISFLL

SEQ ID NO: 54304 - protein, 9 aa, BK Virus
RVFDGTEQL

SEQ ID NO: 54305 - protein, 9 aa, BK Virus
QGSNFHFFA

SEQ ID NO: 54306 - protein, 9 aa, BK Virus
NAYPVECWI

SEQ ID NO: 54307 - protein, 9 aa, BK Virus
QVMNTDHKA

SEQ ID NO: 54308 - protein, 9 aa, BK Virus
GSNFHFFAV

SEQ ID NO: 54309 - protein, 9 aa, BK Virus
RSVKNPYPI

SEQ ID NO: 54310 - protein, 9 aa, BK Virus
VSAADICGL

SEQ ID NO: 54311 - protein, 9 aa, BK Virus
HVTNTATTV

SEQ ID NO: 54312 - protein, 9 aa, BK Virus
NVPPVLHVT

SEQ ID NO: 54313 - protein, 9 aa, BK Virus
NPYPISFLL

SEQ ID NO: 54314 - protein, 9 aa, BK Virus
EVIGITSML

SEQ ID NO: 54315 - protein, 9 aa, BK Virus
HVTNTATTV

SEQ ID NO: 54316 - protein, 9 aa, BK Virus
LLMWEAVTV

SEQ ID NO: 54317 - protein, 9 aa, BK Virus
NAYPVECWI

SEQ ID NO: 54318 - protein, 9 aa, BK Virus
EAVTVKTEV

SEQ ID NO: 54319 - protein, 9 aa, BK Virus
TGGENVPPV

SEQ ID NO: 54320 - protein, 9 aa, BK Virus
GTYTGGENV

SEQ ID NO: 54321 - protein, 9 aa, BK Virus
NLHAGSQKV

SEQ ID NO: 54322 - protein, 9 aa, BK Virus
RVFDGTEQL

SEQ ID NO: 54323 - protein, 9 aa, BK Virus
LPCYSTARI

SEQ ID NO: 54324 - protein, 9 aa, BK Virus
APKKPKEPV

SEQ ID NO: 54325 - protein, 9 aa, BK Virus
APTKRKGEC

SEQ ID NO: 54326 - protein, 9 aa, BK Virus
LARYFKIRL

SEQ ID NO: 54327 - protein, 9 aa, BK Virus
KIRLRKRSV

SEQ ID NO: 54328 - protein, 9 aa, BK Virus
NPTAQSQVM

SEQ ID NO: 54329 - protein, 9 aa, BK Virus
SPDRKMLPC

SEQ ID NO: 54330 - protein, 9 aa, BK Virus
EPVQVPKLL

SEQ ID NO: 54331 - protein, 9 aa, BK Virus
GPLCKADSL

SEQ ID NO: 54332 - protein, 9 aa, BK Virus
KIRLRKRSV

SEQ ID NO: 54333 - protein, 9 aa, BK Virus
SQVEEVRVF

SEQ ID NO: 54334 - protein, 9 aa, BK Virus
VMNTDHKAY

SEQ ID NO: 54335 - protein, 9 aa, BK Virus
TQKVDGQPM

SEQ ID NO: 54336 - protein, 9 aa, BK Virus
QQWRGLARY

SEQ ID NO: 54337 - protein, 9 aa, BK Virus
EMQGVLMNY

SEQ ID NO: 54338 - protein, 9 aa, BK Virus
VKNPYPISF

SEQ ID NO: 54339 - protein, 9 aa, BK Virus
TEVIGITSM

SEQ ID NO: 54340 - protein, 9 aa, BK Virus
IRLRKRSVK

SEQ ID NO: 54341 - protein, 9 aa, BK Virus
WRGLARYFK

SEQ ID NO: 54342 - protein, 9 aa, BK Virus
NPTAQSQVM

SEQ ID NO: 54343 - protein, 9 aa, BK Virus
DPDDNLRGY

SEQ ID NO: 54344 - protein, 9 aa, BK Virus
DPLEMQGVL

SEQ ID NO: 54345 - protein, 9 aa, BK Virus
KPVQGSNFH

SEQ ID NO: 54346 - protein, 9 aa, BK Virus
NPYPISFLL

SEQ ID NO: 54347 - protein, 9 aa, BK Virus
FFAVGGDPL

SEQ ID NO: 54348 - protein, 9 aa, BK Virus
QHLSAENAF

SEQ ID NO: 54349 - protein, 9 aa, BK Virus
YPVECWIPD

SEQ ID NO: 54350 - protein, 9 aa, BK Virus
EPVQVPKLL

SEQ ID NO: 54351 - protein, 9 aa, BK Virus
DAITEVECF

SEQ ID NO: 54352 - protein, 9 aa, BK Virus
LPNLNEDLT

SEQ ID NO: 54353 - protein, 9 aa, BK Virus
HENGGGKPV

SEQ ID NO: 54354 - protein, 9 aa, BK Virus
VECFLNPEM

SEQ ID NO: 54355 - protein, 9 aa, BK Virus
AENAFESDS

SEQ ID NO: 54356 - protein, 9 aa, BK Virus
LPCYSTARI

SEQ ID NO: 54357 - protein, 9 aa, BK Virus
EPVQVPKLL

SEQ ID NO: 54358 - protein, 9 aa, BK Virus
NPYPISFLL

SEQ ID NO: 54359 - protein, 9 aa, BK Virus
LPCYSTARI

SEQ ID NO: 54360 - protein, 9 aa, BK Virus
NPYPISFLL

SEQ ID NO: 54361 - protein, 9 aa, BK Virus
EPVQVPKLL

SEQ ID NO: 54362 - protein, 9 aa, BK Virus
LPNLNEDLT

SEQ ID NO: 54363 - protein, 9 aa, BK Virus
LPCYSTARI

SEQ ID NO: 54364 - protein, 9 aa, BK Virus
YPVECWIPD

SEQ ID NO: 54365 - protein, 9 aa, BK Virus
YPISFLLSD

SEQ ID NO: 54366 - protein, 9 aa, BK Virus
LTCGNLLMW

SEQ ID NO: 54367 - protein, 9 aa, BK Virus
LTCGNLLMW

SEQ ID NO: 54368 - protein, 10 aa, BK Virus
YLDKNNAYPV

SEQ ID NO: 54369 - protein, 10 aa, BK Virus
LMWEAVTVKT

SEQ ID NO: 54370 - protein, 10 aa, BK Virus
MLPCYSTARI

SEQ ID NO: 54371 - protein, 10 aa, BK Virus
NLLMWEAVTV

SEQ ID NO: 54372 - protein, 10 aa, BK Virus
YTGGENVPPV

SEQ ID NO: 54373 - protein, 10 aa, BK Virus
YVSAADICGL

SEQ ID NO: 54374 - protein, 10 aa, BK Virus
LLDEQGVGPL

SEQ ID NO: 54375 - protein, 10 aa, BK Virus
KLLIKGGVEV

SEQ ID NO: 54376 - protein, 10 aa, BK Virus
VMNTDHKAYL

SEQ ID NO: 54377 - protein, 10 aa, BK Virus
GLARYFKIRL

SEQ ID NO: 54378 - protein, 10 aa, BK Virus
YGMESQVEEV

SEQ ID NO: 54379 - protein, 10 aa, BK Virus
LLIKGGVEVL

SEQ ID NO: 54380 - protein, 10 aa, BK Virus
YLDKNNAYPV

SEQ ID NO: 54381 - protein, 10 aa, BK Virus
YVSAADICGL

SEQ ID NO: 54382 - protein, 10 aa, BK Virus
LLDEQGVGPL

SEQ ID NO: 54383 - protein, 10 aa, BK Virus
LLIKGGVEVL

SEQ ID NO: 54384 - protein, 10 aa, BK Virus
VMNTDHKAYL

SEQ ID NO: 54385 - protein, 10 aa, BK Virus
MLPCYSTARI

SEQ ID NO: 54386 - protein, 10 aa, BK Virus
NLLMWEAVTV

SEQ ID NO: 54387 - protein, 10 aa, BK Virus
YTGGENVPPV

SEQ ID NO: 54388 - protein, 10 aa, BK Virus
GLARYFKIRL

SEQ ID NO: 54389 - protein, 10 aa, BK Virus
FLLSDLINRR

SEQ ID NO: 54390 - protein, 10 aa, BK Virus
LLSDLINRRT

SEQ ID NO: 54391 - protein, 10 aa, BK Virus
YGMESQVEEV

SEQ ID NO: 54392 - protein, 10 aa, BK Virus
KLLIKGGVEV

SEQ ID NO: 54393 - protein, 10 aa, BK Virus
KTGVDAITEV

SEQ ID NO: 54394 - protein, 10 aa, BK Virus
KADSLYVSAA

SEQ ID NO: 54395 - protein, 10 aa, BK Virus
MLPCYSTARI

SEQ ID NO: 54396 - protein, 10 aa, BK Virus
YLDKNNAYPV

SEQ ID NO: 54397 - protein, 10 aa, BK Virus
LLDEQGVGPL

SEQ ID NO: 54398 - protein, 10 aa, BK Virus
VMNTDHKAYL

SEQ ID NO: 54399 - protein, 10 aa, BK Virus
LLIKGGVEVL

SEQ ID NO: 54400 - protein, 10 aa, BK Virus
NLLMWEAVTV

SEQ ID NO: 54401 - protein, 10 aa, BK Virus
YTGGENVPPV

SEQ ID NO: 54402 - protein, 10 aa, BK Virus
YVSAADICGL

SEQ ID NO: 54403 - protein, 10 aa, BK Virus
KLLIKGGVEV

SEQ ID NO: 54404 - protein, 10 aa, BK Virus
GLARYFKIRL

SEQ ID NO: 54405 - protein, 10 aa, BK Virus
LLSDLINRRT

SEQ ID NO: 54406 - protein, 10 aa, BK Virus
LMWEAVTVKT

SEQ ID NO: 54407 - protein, 10 aa, BK Virus
VLHVTNTATT

SEQ ID NO: 54408 - protein, 10 aa, BK Virus
RQGQLQTKMV

SEQ ID NO: 54409 - protein, 10 aa, BK Virus
VTNTATTVLL

SEQ ID NO: 54410 - protein, 10 aa, BK Virus
KTGVDAITEV

SEQ ID NO: 54411 - protein, 10 aa, BK Virus
DLINRRTQKV

SEQ ID NO: 54412 - protein, 10 aa, BK Virus
YLDKNNAYPV

SEQ ID NO: 54413 - protein, 10 aa, BK Virus
KLLIKGGVEV

SEQ ID NO: 54414 - protein, 10 aa, BK Virus
LLDEQGVGPL

SEQ ID NO: 54415 - protein, 10 aa, BK Virus
YTGGENVPPV

SEQ ID NO: 54416 - protein, 10 aa, BK Virus
LMWEAVTVKT

SEQ ID NO: 54417 - protein, 10 aa, BK Virus
NLLMWEAVTV

SEQ ID NO: 54418 - protein, 10 aa, BK Virus
KTGVDAITEV

SEQ ID NO: 54419 - protein, 10 aa, BK Virus
YGMESQVEEV

SEQ ID NO: 54420 - protein, 10 aa, BK Virus
VMNTDHKAYL

SEQ ID NO: 54421 - protein, 10 aa, BK Virus
LLIKGGVEVL

SEQ ID NO: 54422 - protein, 10 aa, BK Virus
STARIPLPNL

SEQ ID NO: 54423 - protein, 10 aa, BK Virus
YLDKNNAYPV

SEQ ID NO: 54424 - protein, 10 aa, BK Virus
VQGSNFHFFA

SEQ ID NO: 54425 - protein, 10 aa, BK Virus
NLLMWEAVTV

SEQ ID NO: 54426 - protein, 10 aa, BK Virus
YVSAADICGL

SEQ ID NO: 54427 - protein, 10 aa, BK Virus
MLPCYSTARI

SEQ ID NO: 54428 - protein, 10 aa, BK Virus
LLDEQGVGPL

SEQ ID NO: 54429 - protein, 10 aa, BK Virus
YTGGENVPPV

SEQ ID NO: 54430 - protein, 10 aa, BK Virus
KTGVDAITEV

SEQ ID NO: 54431 - protein, 10 aa, BK Virus
KLLIKGGVEV

SEQ ID NO: 54432 - protein, 10 aa, BK Virus
SQVMNTDHKA

SEQ ID NO: 54433 - protein, 10 aa, BK Virus
RQGQLQTKMV

SEQ ID NO: 54434 - protein, 10 aa, BK Virus
FAVGGDPLEM

SEQ ID NO: 54435 - protein, 10 aa, BK Virus
LLIKGGVEVL

SEQ ID NO: 54436 - protein, 10 aa, BK Virus
YGMESQVEEV

SEQ ID NO: 54437 - protein, 10 aa, BK Virus
QQWRGLARYF

SEQ ID NO: 54438 - protein, 10 aa, BK Virus
LMWEAVTVKT

SEQ ID NO: 54439 - protein, 10 aa, BK Virus
MQGVLMNYRT

SEQ ID NO: 54440 - protein, 10 aa, BK Virus
YLDKNNAYPV

SEQ ID NO: 54441 - protein, 10 aa, BK Virus
NLLMWEAVTV

SEQ ID NO: 54442 - protein, 10 aa, BK Virus
LLDEQGVGPL

SEQ ID NO: 54443 - protein, 10 aa, BK Virus
KLLIKGGVEV

SEQ ID NO: 54444 - protein, 10 aa, BK Virus
LLIKGGVEVL

SEQ ID NO: 54445 - protein, 10 aa, BK Virus
YTGGENVPPV

SEQ ID NO: 54446 - protein, 10 aa, BK Virus
GLARYFKIRL

SEQ ID NO: 54447 - protein, 10 aa, BK Virus
PLCKADSLYV

SEQ ID NO: 54448 - protein, 10 aa, BK Virus
VMNTDHKAYL

SEQ ID NO: 54449 - protein, 10 aa, BK Virus
MLPCYSTARI

SEQ ID NO: 54450 - protein, 10 aa, BK Virus
DLINRRTQKV

SEQ ID NO: 54451 - protein, 10 aa, BK Virus
LMWEAVTVKT

SEQ ID NO: 54452 - protein, 10 aa, BK Virus
YVSAADICGL

SEQ ID NO: 54453 - protein, 10 aa, BK Virus
YIDRQGQLQT

SEQ ID NO: 54454 - protein, 10 aa, BK Virus
LLSDLINRRT

SEQ ID NO: 54455 - protein, 10 aa, BK Virus
YGMESQVEEV

SEQ ID NO: 54456 - protein, 10 aa, BK Virus
GGDPLEMQGV

SEQ ID NO: 54457 - protein, 10 aa, BK Virus
KVDGQPMYGM

SEQ ID NO: 54458 - protein, 10 aa, BK Virus
SMLNLHAGSQ

SEQ ID NO: 54459 - protein, 10 aa, BK Virus
KTGVDAITEV

SEQ ID NO: 54460 - protein, 10 aa, BK Virus
GLFTNSSGTQ

SEQ ID NO: 54461 - protein, 10 aa, BK Virus
VLLDEQGVGP

SEQ ID NO: 54462 - protein, 10 aa, BK Virus
YLDKNNAYPV

SEQ ID NO: 54463 - protein, 10 aa, BK Virus
NLLMWEAVTV

SEQ ID NO: 54464 - protein, 10 aa, BK Virus
LLIKGGVEVL

SEQ ID NO: 54465 - protein, 10 aa, BK Virus
LLDEQGVGPL

SEQ ID NO: 54466 - protein, 10 aa, BK Virus
GLARYFKIRL

SEQ ID NO: 54467 - protein, 10 aa, BK Virus
YTGGENVPPV

SEQ ID NO: 54468 - protein, 10 aa, BK Virus
VMNTDHKAYL

SEQ ID NO: 54469 - protein, 10 aa, BK Virus
LMWEAVTVKT

SEQ ID NO: 54470 - protein, 10 aa, BK Virus
KLLIKGGVEV

SEQ ID NO: 54471 - protein, 10 aa, BK Virus
MLPCYSTARI

SEQ ID NO: 54472 - protein, 10 aa, BK Virus
YVSAADICGL

SEQ ID NO: 54473 - protein, 10 aa, BK Virus
DLINRRTQKV

SEQ ID NO: 54474 - protein, 10 aa, BK Virus
PLCKADSLYV

SEQ ID NO: 54475 - protein, 10 aa, BK Virus
LLSDLINRRT

SEQ ID NO: 54476 - protein, 10 aa, BK Virus
YIDRQGQLQT

SEQ ID NO: 54477 - protein, 10 aa, BK Virus
GGDPLEMQGV

SEQ ID NO: 54478 - protein, 10 aa, BK Virus
VLLDEQGVGP

SEQ ID NO: 54479 - protein, 10 aa, BK Virus
FLLSDLINRR

SEQ ID NO: 54480 - protein, 10 aa, BK Virus
YGMESQVEEV

SEQ ID NO: 54481 - protein, 10 aa, BK Virus
SMLNLHAGSQ

SEQ ID NO: 54482 - protein, 10 aa, BK Virus
YLDKNNAYPV

SEQ ID NO: 54483 - protein, 10 aa, BK Virus
NLLMWEAVTV

SEQ ID NO: 54484 - protein, 10 aa, BK Virus
PLCKADSLYV

SEQ ID NO: 54485 - protein, 10 aa, BK Virus
GLARYFKIRL

SEQ ID NO: 54486 - protein, 10 aa, BK Virus
DLINRRTQKV

SEQ ID NO: 54487 - protein, 10 aa, BK Virus
LLIKGGVEVL

SEQ ID NO: 54488 - protein, 10 aa, BK Virus
KLLIKGGVEV

SEQ ID NO: 54489 - protein, 10 aa, BK Virus
LLDEQGVGPL

SEQ ID NO: 54490 - protein, 10 aa, BK Virus
YTGGENVPPV

SEQ ID NO: 54491 - protein, 10 aa, BK Virus
MLPCYSTARI

SEQ ID NO: 54492 - protein, 10 aa, BK Virus
VMNTDHKAYL

SEQ ID NO: 54493 - protein, 10 aa, BK Virus
LMWEAVTVKT

SEQ ID NO: 54494 - protein, 10 aa, BK Virus
YVSAADICGL

SEQ ID NO: 54495 - protein, 10 aa, BK Virus
KTGVDAITEV

SEQ ID NO: 54496 - protein, 10 aa, BK Virus
LLSDLINRRT

SEQ ID NO: 54497 - protein, 10 aa, BK Virus
YIDRQGQLQT

SEQ ID NO: 54498 - protein, 10 aa, BK Virus
IKGGVEVLEV

SEQ ID NO: 54499 - protein, 10 aa, BK Virus
YLDKNNAYPV

SEQ ID NO: 54500 - protein, 10 aa, BK Virus
NLLMWEAVTV

SEQ ID NO: 54501 - protein, 10 aa, BK Virus
YTGGENVPPV

SEQ ID NO: 54502 - protein, 10 aa, BK Virus
LLIKGGVEVL

SEQ ID NO: 54503 - protein, 10 aa, BK Virus
YVSAADICGL

SEQ ID NO: 54504 - protein, 10 aa, BK Virus
LLDEQGVGPL

SEQ ID NO: 54505 - protein, 10 aa, BK Virus
LMWEAVTVKT

SEQ ID NO: 54506 - protein, 10 aa, BK Virus
VMNTDHKAYL

SEQ ID NO: 54507 - protein, 10 aa, BK Virus
MLPCYSTARI

SEQ ID NO: 54508 - protein, 10 aa, BK Virus
YGMESQVEEV

SEQ ID NO: 54509 - protein, 10 aa, BK Virus
PLCKADSLYV

SEQ ID NO: 54510 - protein, 10 aa, BK Virus
DLINRRTQKV

SEQ ID NO: 54511 - protein, 10 aa, BK Virus
KLLIKGGVEV

SEQ ID NO: 54512 - protein, 10 aa, BK Virus
LLMWEAVTVK

SEQ ID NO: 54513 - protein, 10 aa, BK Virus
ARYFKIRLRK

SEQ ID NO: 54514 - protein, 10 aa, BK Virus
KIRLRKRSVK

SEQ ID NO: 54515 - protein, 10 aa, BK Virus
KMLPCYSTAR

SEQ ID NO: 54516 - protein, 10 aa, BK Virus
KYPQGTITPK

SEQ ID NO: 54517 - protein, 10 aa, BK Virus
QWRGLARYFK

SEQ ID NO: 54518 - protein, 10 aa, BK Virus
NTDHKAYLDK

SEQ ID NO: 54519 - protein, 10 aa, BK Virus
MLNLHAGSQK

SEQ ID NO: 54520 - protein, 10 aa, BK Virus
GTQQWRGLAR

SEQ ID NO: 54521 - protein, 10 aa, BK Virus
LLMWEAVTVK

SEQ ID NO: 54522 - protein, 10 aa, BK Virus
QSQVMNTDHK

SEQ ID NO: 54523 - protein, 10 aa, BK Virus
PVQVPKLLIK

SEQ ID NO: 54524 - protein, 10 aa, BK Virus
NTDHKAYLDK

SEQ ID NO: 54525 - protein, 10 aa, BK Virus
KMLPCYSTAR

SEQ ID NO: 54526 - protein, 10 aa, BK Virus
PVQGSNFHFF

SEQ ID NO: 54527 - protein, 10 aa, BK Virus
KYPQGTITPK

SEQ ID NO: 54528 - protein, 10 aa, BK Virus
RYFKIRLRKR

SEQ ID NO: 54529 - protein, 10 aa, BK Virus
QVMNTDHKAY

SEQ ID NO: 54530 - protein, 10 aa, BK Virus
EVECFLNPEM

SEQ ID NO: 54531 - protein, 10 aa, BK Virus
KVDGQPMYGM

SEQ ID NO: 54532 - protein, 10 aa, BK Virus
SVKNPYPISF

SEQ ID NO: 54533 - protein, 10 aa, BK Virus
STARIPLPNL

SEQ ID NO: 54534 - protein, 10 aa, BK Virus
PVQGSNFHFF

SEQ ID NO: 54535 - protein, 10 aa, BK Virus
YVSAADICGL

SEQ ID NO: 54536 - protein, 10 aa, BK Virus
KTEVIGITSM

SEQ ID NO: 54537 - protein, 10 aa, BK Virus
QVMNTDHKAY

SEQ ID NO: 54538 - protein, 10 aa, BK Virus
GVLMNYRTKY

SEQ ID NO: 54539 - protein, 10 aa, BK Virus
KIRLRKRSVK

SEQ ID NO: 54540 - protein, 10 aa, BK Virus
QWRGLARYFK

SEQ ID NO: 54541 - protein, 10 aa, BK Virus
KGECPGAAPK

SEQ ID NO: 54542 - protein, 10 aa, BK Virus
KPKEPVQVPK

SEQ ID NO: 54543 - protein, 10 aa, BK Virus
KYPQGTITPK

SEQ ID NO: 54544 - protein, 10 aa, BK Virus
MLNLHAGSQK

SEQ ID NO: 54545 - protein, 10 aa, BK Virus
QSQVMNTDHK

SEQ ID NO: 54546 - protein, 10 aa, BK Virus
KMLPCYSTAR

SEQ ID NO: 54547 - protein, 10 aa, BK Virus
LARYFKIRLR

SEQ ID NO: 54548 - protein, 10 aa, BK Virus
RYFKIRLRKR

SEQ ID NO: 54549 - protein, 10 aa, BK Virus
KMLPCYSTAR

SEQ ID NO: 54550 - protein, 10 aa, BK Virus
LARYFKIRLR

SEQ ID NO: 54551 - protein, 10 aa, BK Virus
KIRLRKRSVK

SEQ ID NO: 54552 - protein, 10 aa, BK Virus
EMQGVLMNYR

SEQ ID NO: 54553 - protein, 10 aa, BK Virus
QWRGLARYFK

SEQ ID NO: 54554 - protein, 10 aa, BK Virus
GTQQWRGLAR

SEQ ID NO: 54555 - protein, 10 aa, BK Virus
ARYFKIRLRK

SEQ ID NO: 54556 - protein, 10 aa, BK Virus
SFLLSDLINR

SEQ ID NO: 54557 - protein, 10 aa, BK Virus
EMQGVLMNYR

SEQ ID NO: 54558 - protein, 10 aa, BK Virus
SFLLSDLINR

SEQ ID NO: 54559 - protein, 10 aa, BK Virus
LARYFKIRLR

SEQ ID NO: 54560 - protein, 10 aa, BK Virus
RYFKIRLRKR

SEQ ID NO: 54561 - protein, 10 aa, BK Virus
NAFESDSPDR

SEQ ID NO: 54562 - protein, 10 aa, BK Virus
EMQGVLMNYR

SEQ ID NO: 54563 - protein, 10 aa, BK Virus
MLNLHAGSQK

SEQ ID NO: 54564 - protein, 10 aa, BK Virus
LARYFKIRLR

SEQ ID NO: 54565 - protein, 10 aa, BK Virus
TNSSGTQQWR

SEQ ID NO: 54566 - protein, 10 aa, BK Virus
LLMWEAVTVK

SEQ ID NO: 54567 - protein, 10 aa, BK Virus
EVIGITSMLN

SEQ ID NO: 54568 - protein, 10 aa, BK Virus
EMGDPDDNLR

SEQ ID NO: 54569 - protein, 10 aa, BK Virus
QSQVMNTDHK

SEQ ID NO: 54570 - protein, 10 aa, BK Virus
FLLSDLINRR

SEQ ID NO: 54571 - protein, 10 aa, BK Virus
GTQQWRGLAR

SEQ ID NO: 54572 - protein, 10 aa, BK Virus
QGSNFHFFAV

SEQ ID NO: 54573 - protein, 10 aa, BK Virus
TTVLLDEQGV

SEQ ID NO: 54574 - protein, 10 aa, BK Virus
YVSAADICGL

SEQ ID NO: 54575 - protein, 10 aa, BK Virus
MLPCYSTARI

SEQ ID NO: 54576 - protein, 10 aa, BK Virus
STARIPLPNL

SEQ ID NO: 54577 - protein, 10 aa, BK Virus
EAVTVKTEVI

SEQ ID NO: 54578 - protein, 10 aa, BK Virus
YGMESQVEEV

SEQ ID NO: 54579 - protein, 10 aa, BK Virus
YTGGENVPPV

SEQ ID NO: 54580 - protein, 10 aa, BK Virus
CGNLLMWEAV

SEQ ID NO: 54581 - protein, 10 aa, BK Virus
NNAYPVECWI

SEQ ID NO: 54582 - protein, 10 aa, BK Virus
DAITEVECFL

SEQ ID NO: 54583 - protein, 10 aa, BK Virus
QPMYGMESQV

SEQ ID NO: 54584 - protein, 10 aa, BK Virus
YTGGENVPPV

SEQ ID NO: 54585 - protein, 10 aa, BK Virus
YLDKNNAYPV

SEQ ID NO: 54586 - protein, 10 aa, BK Virus
STARIPLPNL

SEQ ID NO: 54587 - protein, 10 aa, BK Virus
NLLMWEAVTV

SEQ ID NO: 54588 - protein, 10 aa, BK Virus
YGMESQVEEV

SEQ ID NO: 54589 - protein, 10 aa, BK Virus
EVECFLNPEM

SEQ ID NO: 54590 - protein, 10 aa, BK Virus
EPVQVPKLLI

SEQ ID NO: 54591 - protein, 10 aa, BK Virus
QPMYGMESQV

SEQ ID NO: 54592 - protein, 10 aa, BK Virus
DPLEMQGVLM

SEQ ID NO: 54593 - protein, 10 aa, BK Virus
KPVQGSNFHF

SEQ ID NO: 54594 - protein, 10 aa, BK Virus
YPISFLLSDL

SEQ ID NO: 54595 - protein, 10 aa, BK Virus
HVTNTATTVL

SEQ ID NO: 54596 - protein, 10 aa, BK Virus
QPMYGMESQV

SEQ ID NO: 54597 - protein, 10 aa, BK Virus
IPLPNLNEDL

SEQ ID NO: 54598 - protein, 10 aa, BK Virus
SQHLSAENAF

SEQ ID NO: 54599 - protein, 10 aa, BK Virus
TQKVDGQPMY

SEQ ID NO: 54600 - protein, 10 aa, BK Virus
QVMNTDHKAY

SEQ ID NO: 54601 - protein, 10 aa, BK Virus
QQWRGLARYF

SEQ ID NO: 54602 - protein, 10 aa, BK Virus
TQQWRGLARY

SEQ ID NO: 54603 - protein, 10 aa, BK Virus
SVKNPYPISF

SEQ ID NO: 54604 - protein, 10 aa, BK Virus
KAYLDKNNAY

SEQ ID NO: 54605 - protein, 10 aa, BK Virus
VSAADICGLF

SEQ ID NO: 54606 - protein, 10 aa, BK Virus
LLIKGGVEVL

SEQ ID NO: 54607 - protein, 10 aa, BK Virus
LEMQGVLMNY

SEQ ID NO: 54608 - protein, 10 aa, BK Virus
TEVIGITSML

SEQ ID NO: 54609 - protein, 10 aa, BK Virus
NENTRYFGTY

SEQ ID NO: 54610 - protein, 10 aa, BK Virus
WEAVTVKTEV

SEQ ID NO: 54611 - protein, 10 aa, BK Virus
VEVLEVKTGV

SEQ ID NO: 54612 - protein, 10 aa, BK Virus
ARYFKIRLRK

SEQ ID NO: 54613 - protein, 10 aa, BK Virus
FAVGGDPLEM

SEQ ID NO: 54614 - protein, 10 aa, BK Virus
DPLEMQGVLM

SEQ ID NO: 54615 - protein, 10 aa, BK Virus
DPSRNENTRY

SEQ ID NO: 54616 - protein, 10 aa, BK Virus
LPGDPDMIRY

SEQ ID NO: 54617 - protein, 10 aa, BK Virus
KPVQGSNFHF

SEQ ID NO: 54618 - protein, 10 aa, BK Virus
QVMNTDHKAY

SEQ ID NO: 54619 - protein, 10 aa, BK Virus
KAYLDKNNAY

SEQ ID NO: 54620 - protein, 10 aa, BK Virus
YPISFLLSDL

SEQ ID NO: 54621 - protein, 10 aa, BK Virus
EVECFLNPEM

SEQ ID NO: 54622 - protein, 10 aa, BK Virus
SPDRKMLPCY

SEQ ID NO: 54623 - protein, 10 aa, BK Virus
LPNLNEDLTC

SEQ ID NO: 54624 - protein, 10 aa, BK Virus
GPLCKADSLY

SEQ ID NO: 54625 - protein, 10 aa, BK Virus
TEVIGITSML

SEQ ID NO: 54626 - protein, 10 aa, BK Virus
MESQVEEVRV

SEQ ID NO: 54627 - protein, 10 aa, BK Virus
PEMGDPDDNL

SEQ ID NO: 54628 - protein, 10 aa, BK Virus
NEDLTCGNLL

SEQ ID NO: 54629 - protein, 10 aa, BK Virus
WEAVTVKTEV

SEQ ID NO: 54630 - protein, 10 aa, BK Virus
NENTRYFGTY

SEQ ID NO: 54631 - protein, 10 aa, BK Virus
AENAFESDSP

SEQ ID NO: 54632 - protein, 10 aa, BK Virus
EPVQVPKLLI

SEQ ID NO: 54633 - protein, 10 aa, BK Virus
YPISFLLSDL

SEQ ID NO: 54634 - protein, 10 aa, BK Virus
EPVQVPKLLI

SEQ ID NO: 54635 - protein, 10 aa, BK Virus
YPISFLLSDL

SEQ ID NO: 54636 - protein, 10 aa, BK Virus
KPVQGSNFHF

SEQ ID NO: 54637 - protein, 10 aa, BK Virus
LPGDPDMIRY

SEQ ID NO: 54638 - protein, 10 aa, BK Virus
SPDRKMLPCY

SEQ ID NO: 54639 - protein, 10 aa, BK Virus
DPSRNENTRY

SEQ ID NO: 54640 - protein, 10 aa, BK Virus
VPKLLIKGGV

SEQ ID NO: 54641 - protein, 10 aa, BK Virus
PPVLHVTNTA

SEQ ID NO: 54642 - protein, 10 aa, BK Virus
LPCYSTARIP

SEQ ID NO: 54643 - protein, 10 aa, BK Virus
EPVQVPKLLI

SEQ ID NO: 54644 - protein, 10 aa, BK Virus
YPVECWIPDP

SEQ ID NO: 54645 - protein, 10 aa, BK Virus
FTNSSGTQQW

SEQ ID NO: 54646 - protein, 10 aa, BK Virus
FTNSSGTQQW

SEQ ID NO: 54647 - protein, 10 aa, BK Virus
KNNAYPVECW

SEQ ID NO: 54648 - protein, 10 aa, BK Virus
VSAADICGLF

SEQ ID NO: 54649 - protein, 11 aa, BK Virus
KMLPCYSTARI

SEQ ID NO: 54650 - protein, 11 aa, BK Virus
LLMWEAVTVKT

SEQ ID NO: 54651 - protein, 11 aa, BK Virus
VLLDEQGVGPL

SEQ ID NO: 54652 - protein, 11 aa, BK Virus
FLLSDLINRRT

SEQ ID NO: 54653 - protein, 11 aa, BK Virus
VLHVTNTATTV

SEQ ID NO: 54654 - protein, 11 aa, BK Virus
VQGSNFHFFAV

SEQ ID NO: 54655 - protein, 11 aa, BK Virus
MLNLHAGSQKV

SEQ ID NO: 54656 - protein, 11 aa, BK Virus
QVMNTDHKAYL

SEQ ID NO: 54657 - protein, 11 aa, BK Virus
GMESQVEEVRV

SEQ ID NO: 54658 - protein, 11 aa, BK Virus
MLNLHAGSQKV

SEQ ID NO: 54659 - protein, 11 aa, BK Virus
NLNEDLTCGNL

SEQ ID NO: 54660 - protein, 11 aa, BK Virus
VLLDEQGVGPL

SEQ ID NO: 54661 - protein, 11 aa, BK Virus
KMLPCYSTARI

SEQ ID NO: 54662 - protein, 11 aa, BK Virus
LLMWEAVTVKT

SEQ ID NO: 54663 - protein, 11 aa, BK Virus
GMESQVEEVRV

SEQ ID NO: 54664 - protein, 11 aa, BK Virus
VQGSNFHFFAV

SEQ ID NO: 54665 - protein, 11 aa, BK Virus
VLHVTNTATTV

SEQ ID NO: 54666 - protein, 11 aa, BK Virus
QVMNTDHKAYL

SEQ ID NO: 54667 - protein, 11 aa, BK Virus
FLLSDLINRRT

SEQ ID NO: 54668 - protein, 11 aa, BK Virus
MLNLHAGSQKV

SEQ ID NO: 54669 - protein, 11 aa, BK Virus
LIKGGVEVLEV

SEQ ID NO: 54670 - protein, 11 aa, BK Virus
KMLPCYSTARI

SEQ ID NO: 54671 - protein, 11 aa, BK Virus
VLHVTNTATTV

SEQ ID NO: 54672 - protein, 11 aa, BK Virus
NLNEDLTCGNL

SEQ ID NO: 54673 - protein, 11 aa, BK Virus
VLLDEQGVGPL

SEQ ID NO: 54674 - protein, 11 aa, BK Virus
NLRGYSQHLSA

SEQ ID NO: 54675 - protein, 11 aa, BK Virus
LLMWEAVTVKT

SEQ ID NO: 54676 - protein, 11 aa, BK Virus
KVHENGGGKPV

SEQ ID NO: 54677 - protein, 11 aa, BK Virus
VQGSNFHFFAV

SEQ ID NO: 54678 - protein, 11 aa, BK Virus
SVKNPYPISFL

SEQ ID NO: 54679 - protein, 11 aa, BK Virus
MIRYIDRQGQL

SEQ ID NO: 54680 - protein, 11 aa, BK Virus
GMESQVEEVRV

SEQ ID NO: 54681 - protein, 11 aa, BK Virus
FLLSDLINRRT

SEQ ID NO: 54682 - protein, 11 aa, BK Virus
MLNLHAGSQKV

SEQ ID NO: 54683 - protein, 11 aa, BK Virus
VLHVTNTATTV

SEQ ID NO: 54684 - protein, 11 aa, BK Virus
VLLDEQGVGPL

SEQ ID NO: 54685 - protein, 11 aa, BK Virus
KVHENGGGKPV

SEQ ID NO: 54686 - protein, 11 aa, BK Virus
GMESQVEEVRV

SEQ ID NO: 54687 - protein, 11 aa, BK Virus
KMLPCYSTARI

SEQ ID NO: 54688 - protein, 11 aa, BK Virus
VQGSNFHFFAV

SEQ ID NO: 54689 - protein, 11 aa, BK Virus
LLMWEAVTVKT

SEQ ID NO: 54690 - protein, 11 aa, BK Virus
AYLDKNNAYPV

SEQ ID NO: 54691 - protein, 11 aa, BK Virus
KLLIKGGVEVL

SEQ ID NO: 54692 - protein, 11 aa, BK Virus
YTGGENVPPVL

SEQ ID NO: 54693 - protein, 11 aa, BK Virus
VQGSNFHFFAV

SEQ ID NO: 54694 - protein, 11 aa, BK Virus
KMLPCYSTARI

SEQ ID NO: 54695 - protein, 11 aa, BK Virus
MLNLHAGSQKV

SEQ ID NO: 54696 - protein, 11 aa, BK Virus
VLLDEQGVGPL

SEQ ID NO: 54697 - protein, 11 aa, BK Virus
GQPMYGMESQV

SEQ ID NO: 54698 - protein, 11 aa, BK Virus
LLMWEAVTVKT

SEQ ID NO: 54699 - protein, 11 aa, BK Virus
QVMNTDHKAYL

SEQ ID NO: 54700 - protein, 11 aa, BK Virus
VLHVTNTATTV

SEQ ID NO: 54701 - protein, 11 aa, BK Virus
FLLSDLINRRT

SEQ ID NO: 54702 - protein, 11 aa, BK Virus
VLLDEQGVGPL

SEQ ID NO: 54703 - protein, 11 aa, BK Virus
VLHVTNTATTV

SEQ ID NO: 54704 - protein, 11 aa, BK Virus
MLNLHAGSQKV

SEQ ID NO: 54705 - protein, 11 aa, BK Virus
KMLPCYSTARI

SEQ ID NO: 54706 - protein, 11 aa, BK Virus
LIKGGVEVLEV

SEQ ID NO: 54707 - protein, 11 aa, BK Virus
GMESQVEEVRV

SEQ ID NO: 54708 - protein, 11 aa, BK Virus
LLDEQGVGPLC

SEQ ID NO: 54709 - protein, 11 aa, BK Virus
NLRGYSQHLSA

SEQ ID NO: 54710 - protein, 11 aa, BK Virus
LLSDLINRRTQ

SEQ ID NO: 54711 - protein, 11 aa, BK Virus
KLLIKGGVEVL

SEQ ID NO: 54712 - protein, 11 aa, BK Virus
KVHENGGGKPV

SEQ ID NO: 54713 - protein, 11 aa, BK Virus
NLNEDLTCGNL

SEQ ID NO: 54714 - protein, 11 aa, BK Virus
AYLDKNNAYPV

SEQ ID NO: 54715 - protein, 11 aa, BK Virus
FLLSDLINRRT

SEQ ID NO: 54716 - protein, 11 aa, BK Virus
VLMNYRTKYPQ

SEQ ID NO: 54717 - protein, 11 aa, BK Virus
TYTGGENVPPV

SEQ ID NO: 54718 - protein, 11 aa, BK Virus
YLDKNNAYPVE

SEQ ID NO: 54719 - protein, 11 aa, BK Virus
LLMWEAVTVKT

SEQ ID NO: 54720 - protein, 11 aa, BK Virus
HVTNTATTVLL

SEQ ID NO: 54721 - protein, 11 aa, BK Virus
QVPKLLIKGGV

SEQ ID NO: 54722 - protein, 11 aa, BK Virus
GLFTNSSGTQQ

SEQ ID NO: 54723 - protein, 11 aa, BK Virus
QLPGDPDMIRY

SEQ ID NO: 54724 - protein, 11 aa, BK Virus
VQGSNFHFFAV

SEQ ID NO: 54725 - protein, 11 aa, BK Virus
QVMNTDHKAYL

SEQ ID NO: 54726 - protein, 11 aa, BK Virus
GAAPKKPKEPV

SEQ ID NO: 54727 - protein, 11 aa, BK Virus
YTGGENVPPVL

SEQ ID NO: 54728 - protein, 11 aa, BK Virus
EMQGVLMNYRT

SEQ ID NO: 54729 - protein, 11 aa, BK Virus
YIDRQGQLQTK

SEQ ID NO: 54730 - protein, 11 aa, BK Virus
ATTVLLDEQGV

SEQ ID NO: 54731 - protein, 11 aa, BK Virus
VLHVTNTATTV

SEQ ID NO: 54732 - protein, 11 aa, BK Virus
VLLDEQGVGPL

SEQ ID NO: 54733 - protein, 11 aa, BK Virus
MLNLHAGSQKV

SEQ ID NO: 54734 - protein, 11 aa, BK Virus
GMESQVEEVRV

SEQ ID NO: 54735 - protein, 11 aa, BK Virus
LIKGGVEVLEV

SEQ ID NO: 54736 - protein, 11 aa, BK Virus
NLRGYSQHLSA

SEQ ID NO: 54737 - protein, 11 aa, BK Virus
VQGSNFHFFAV

SEQ ID NO: 54738 - protein, 11 aa, BK Virus
LLDEQGVGPLC

SEQ ID NO: 54739 - protein, 11 aa, BK Virus
LLSDLINRRTQ

SEQ ID NO: 54740 - protein, 11 aa, BK Virus
KMLPCYSTARI

SEQ ID NO: 54741 - protein, 11 aa, BK Virus
VLMNYRTKYPQ

SEQ ID NO: 54742 - protein, 11 aa, BK Virus
YLDKNNAYPVE

SEQ ID NO: 54743 - protein, 11 aa, BK Virus
FLLSDLINRRT

SEQ ID NO: 54744 - protein, 11 aa, BK Virus
YTGGENVPPVL

SEQ ID NO: 54745 - protein, 11 aa, BK Virus
KLLIKGGVEVL

SEQ ID NO: 54746 - protein, 11 aa, BK Virus
LLMWEAVTVKT

SEQ ID NO: 54747 - protein, 11 aa, BK Virus
NLNEDLTCGNL

SEQ ID NO: 54748 - protein, 11 aa, BK Virus
AYLDKNNAYPV

SEQ ID NO: 54749 - protein, 11 aa, BK Virus
YIDRQGQLQTK

SEQ ID NO: 54750 - protein, 11 aa, BK Virus
VGGDPLEMQGV

SEQ ID NO: 54751 - protein, 11 aa, BK Virus
EMQGVLMNYRT

SEQ ID NO: 54752 - protein, 11 aa, BK Virus
LMWEAVTVKTE

SEQ ID NO: 54753 - protein, 11 aa, BK Virus
VLHVTNTATTV

SEQ ID NO: 54754 - protein, 11 aa, BK Virus
MLNLHAGSQKV

SEQ ID NO: 54755 - protein, 11 aa, BK Virus
GMESQVEEVRV

SEQ ID NO: 54756 - protein, 11 aa, BK Virus
LIKGGVEVLEV

SEQ ID NO: 54757 - protein, 11 aa, BK Virus
VLLDEQGVGPL

SEQ ID NO: 54758 - protein, 11 aa, BK Virus
KMLPCYSTARI

SEQ ID NO: 54759 - protein, 11 aa, BK Virus
NLRGYSQHLSA

SEQ ID NO: 54760 - protein, 11 aa, BK Virus
QVMNTDHKAYL

SEQ ID NO: 54761 - protein, 11 aa, BK Virus
VLMNYRTKYPQ

SEQ ID NO: 54762 - protein, 11 aa, BK Virus
AYLDKNNAYPV

SEQ ID NO: 54763 - protein, 11 aa, BK Virus
GAAPKKPKEPV

SEQ ID NO: 54764 - protein, 11 aa, BK Virus
SVKNPYPISFL

SEQ ID NO: 54765 - protein, 11 aa, BK Virus
GQPMYGMESQV

SEQ ID NO: 54766 - protein, 11 aa, BK Virus
KLLIKGGVEVL

SEQ ID NO: 54767 - protein, 11 aa, BK Virus
TYTGGENVPPV

SEQ ID NO: 54768 - protein, 11 aa, BK Virus
GLFTNSSGTQQ

SEQ ID NO: 54769 - protein, 11 aa, BK Virus
NLNEDLTCGNL

SEQ ID NO: 54770 - protein, 11 aa, BK Virus
QVPKLLIKGGV

SEQ ID NO: 54771 - protein, 11 aa, BK Virus
LLSDLINRRTQ

SEQ ID NO: 54772 - protein, 11 aa, BK Virus
EMQGVLMNYRT

SEQ ID NO: 54773 - protein, 11 aa, BK Virus
GVEVLEVKTGV

SEQ ID NO: 54774 - protein, 11 aa, BK Virus
VQGSNFHFFAV

SEQ ID NO: 54775 - protein, 11 aa, BK Virus
HVTNTATTVLL

SEQ ID NO: 54776 - protein, 11 aa, BK Virus
FLLSDLINRRT

SEQ ID NO: 54777 - protein, 11 aa, BK Virus
GVGPLCKADSL

SEQ ID NO: 54778 - protein, 11 aa, BK Virus
YFGTYTGGENV

SEQ ID NO: 54779 - protein, 11 aa, BK Virus
VKTGVDAITEV

SEQ ID NO: 54780 - protein, 11 aa, BK Virus
KVHENGGGKPV

SEQ ID NO: 54781 - protein, 11 aa, BK Virus
VLHVTNTATTV

SEQ ID NO: 54782 - protein, 11 aa, BK Virus
MLNLHAGSQKV

SEQ ID NO: 54783 - protein, 11 aa, BK Virus
VLLDEQGVGPL

SEQ ID NO: 54784 - protein, 11 aa, BK Virus
LIKGGVEVLEV

SEQ ID NO: 54785 - protein, 11 aa, BK Virus
VQGSNFHFFAV

SEQ ID NO: 54786 - protein, 11 aa, BK Virus
GMESQVEEVRV

SEQ ID NO: 54787 - protein, 11 aa, BK Virus
KMLPCYSTARI

SEQ ID NO: 54788 - protein, 11 aa, BK Virus
TYTGGENVPPV

SEQ ID NO: 54789 - protein, 11 aa, BK Virus
VGGDPLEMQGV

SEQ ID NO: 54790 - protein, 11 aa, BK Virus
YTGGENVPPVL

SEQ ID NO: 54791 - protein, 11 aa, BK Virus
SMLNLHAGSQK

SEQ ID NO: 54792 - protein, 11 aa, BK Virus
RLRKRSVKNPY

SEQ ID NO: 54793 - protein, 11 aa, BK Virus
GLARYFKIRLR

SEQ ID NO: 54794 - protein, 11 aa, BK Virus
NLLMWEAVTVK

SEQ ID NO: 54795 - protein, 11 aa, BK Virus
FTNSSGTQQWR

SEQ ID NO: 54796 - protein, 11 aa, BK Virus
SMLNLHAGSQK

SEQ ID NO: 54797 - protein, 11 aa, BK Virus
AQSQVMNTDHK

SEQ ID NO: 54798 - protein, 11 aa, BK Virus
ISFLLSDLINR

SEQ ID NO: 54799 - protein, 11 aa, BK Virus
QQWRGLARYFK

SEQ ID NO: 54800 - protein, 11 aa, BK Virus
NAFESDSPDRK

SEQ ID NO: 54801 - protein, 11 aa, BK Virus
GTQQWRGLARY

SEQ ID NO: 54802 - protein, 11 aa, BK Virus
NLLMWEAVTVK

SEQ ID NO: 54803 - protein, 11 aa, BK Virus
MQGVLMNYRTK

SEQ ID NO: 54804 - protein, 11 aa, BK Virus
RTQKVDGQPMY

SEQ ID NO: 54805 - protein, 11 aa, BK Virus
LARYFKIRLRK

SEQ ID NO: 54806 - protein, 11 aa, BK Virus
LSDLINRRTQK

SEQ ID NO: 54807 - protein, 11 aa, BK Virus
LYVSAADICGL

SEQ ID NO: 54808 - protein, 11 aa, BK Virus
PYPISFLLSDL

SEQ ID NO: 54809 - protein, 11 aa, BK Virus
PYPISFLLSDL

SEQ ID NO: 54810 - protein, 11 aa, BK Virus
NYRTKYPQGTI

SEQ ID NO: 54811 - protein, 11 aa, BK Virus
QWRGLARYFKI

SEQ ID NO: 54812 - protein, 11 aa, BK Virus
YSQHLSAENAF

SEQ ID NO: 54813 - protein, 11 aa, BK Virus
PYPISFLLSDL

SEQ ID NO: 54814 - protein, 11 aa, BK Virus
LYVSAADICGL

SEQ ID NO: 54815 - protein, 11 aa, BK Virus
LFTNSSGTQQW

SEQ ID NO: 54816 - protein, 11 aa, BK Virus
EVIGITSMLNL

SEQ ID NO: 54817 - protein, 11 aa, BK Virus
DSPDRKMLPCY

SEQ ID NO: 54818 - protein, 11 aa, BK Virus
EVIGITSMLNL

SEQ ID NO: 54819 - protein, 11 aa, BK Virus
SVKNPYPISFL

SEQ ID NO: 54820 - protein, 11 aa, BK Virus
DSPDRKMLPCY

SEQ ID NO: 54821 - protein, 11 aa, BK Virus
YVSAADICGLF

SEQ ID NO: 54822 - protein, 11 aa, BK Virus
QLPGDPDMIRY

SEQ ID NO: 54823 - protein, 11 aa, BK Virus
QVMNTDHKAYL

SEQ ID NO: 54824 - protein, 11 aa, BK Virus
GTQQWRGLARY

SEQ ID NO: 54825 - protein, 11 aa, BK Virus
RTQKVDGQPMY

SEQ ID NO: 54826 - protein, 11 aa, BK Virus
RLRKRSVKNPY

SEQ ID NO: 54827 - protein, 11 aa, BK Virus
LARYFKIRLRK

SEQ ID NO: 54828 - protein, 11 aa, BK Virus
KGECPGAAPKK

SEQ ID NO: 54829 - protein, 11 aa, BK Virus
KVHENGGGKPV

SEQ ID NO: 54830 - protein, 11 aa, BK Virus
SQKVHENGGGK

SEQ ID NO: 54831 - protein, 11 aa, BK Virus
RTQKVDGQPMY

SEQ ID NO: 54832 - protein, 11 aa, BK Virus
QQWRGLARYFK

SEQ ID NO: 54833 - protein, 11 aa, BK Virus
MQGVLMNYRTK

SEQ ID NO: 54834 - protein, 11 aa, BK Virus
RKRSVKNPYPI

SEQ ID NO: 54835 - protein, 11 aa, BK Virus
RTQKVDGQPMY

SEQ ID NO: 54836 - protein, 11 aa, BK Virus
QQWRGLARYFK

SEQ ID NO: 54837 - protein, 11 aa, BK Virus
ISFLLSDLINR

SEQ ID NO: 54838 - protein, 11 aa, BK Virus
SFLLSDLINRR

SEQ ID NO: 54839 - protein, 11 aa, BK Virus
FTNSSGTQQWR

SEQ ID NO: 54840 - protein, 11 aa, BK Virus
SMLNLHAGSQK

SEQ ID NO: 54841 - protein, 11 aa, BK Virus
GLARYFKIRLR

SEQ ID NO: 54842 - protein, 11 aa, BK Virus
LARYFKIRLRK

SEQ ID NO: 54843 - protein, 11 aa, BK Virus
MQGVLMNYRTK

SEQ ID NO: 54844 - protein, 11 aa, BK Virus
RKMLPCYSTAR

SEQ ID NO: 54845 - protein, 11 aa, BK Virus
ISFLLSDLINR

SEQ ID NO: 54846 - protein, 11 aa, BK Virus
SFLLSDLINRR

SEQ ID NO: 54847 - protein, 11 aa, BK Virus
FTNSSGTQQWR

SEQ ID NO: 54848 - protein, 11 aa, BK Virus
ISFLLSDLINR

SEQ ID NO: 54849 - protein, 11 aa, BK Virus
NAFESDSPDRK

SEQ ID NO: 54850 - protein, 11 aa, BK Virus
ENAFESDSPDR

SEQ ID NO: 54851 - protein, 11 aa, BK Virus
YGMESQVEEVR

SEQ ID NO: 54852 - protein, 11 aa, BK Virus
LARYFKIRLRK

SEQ ID NO: 54853 - protein, 11 aa, BK Virus
EVIGITSMLNL

SEQ ID NO: 54854 - protein, 11 aa, BK Virus
QVMNTDHKAYL

SEQ ID NO: 54855 - protein, 11 aa, BK Virus
QVPKLLIKGGV

SEQ ID NO: 54856 - protein, 11 aa, BK Virus
HVTNTATTVLL

SEQ ID NO: 54857 - protein, 11 aa, BK Virus
EVRVFDGTEQL

SEQ ID NO: 54858 - protein, 11 aa, BK Virus
TCGNLLMWEAV

SEQ ID NO: 54859 - protein, 11 aa, BK Virus
EVIGITSMLNL

SEQ ID NO: 54860 - protein, 11 aa, BK Virus
EVLEVKTGVDA

SEQ ID NO: 54861 - protein, 11 aa, BK Virus
QVMNTDHKAYL

SEQ ID NO: 54862 - protein, 11 aa, BK Virus
YPISFLLSDLI

SEQ ID NO: 54863 - protein, 11 aa, BK Virus
YTGGENVPPVL

SEQ ID NO: 54864 - protein, 11 aa, BK Virus
HVTNTATTVLL

SEQ ID NO: 54865 - protein, 11 aa, BK Virus
LPCYSTARIPL

SEQ ID NO: 54866 - protein, 11 aa, BK Virus
KPVQGSNFHFF

SEQ ID NO: 54867 - protein, 11 aa, BK Virus
APKKPKEPVQV

SEQ ID NO: 54868 - protein, 11 aa, BK Virus
APTKRKGECPG

SEQ ID NO: 54869 - protein, 11 aa, BK Virus
KPKEPVQVPKL

SEQ ID NO: 54870 - protein, 11 aa, BK Virus
TPKNPTAQSQV

SEQ ID NO: 54871 - protein, 11 aa, BK Virus
YPISFLLSDLI

SEQ ID NO: 54872 - protein, 11 aa, BK Virus
YFKIRLRKRSV

SEQ ID NO: 54873 - protein, 11 aa, BK Virus
TQQWRGLARYF

SEQ ID NO: 54874 - protein, 11 aa, BK Virus
RLRKRSVKNPY

SEQ ID NO: 54875 - protein, 11 aa, BK Virus
SQVMNTDHKAY

SEQ ID NO: 54876 - protein, 11 aa, BK Virus
YSQHLSAENAF

SEQ ID NO: 54877 - protein, 11 aa, BK Virus
YVSAADICGLF

SEQ ID NO: 54878 - protein, 11 aa, BK Virus
RTQKVDGQPMY

SEQ ID NO: 54879 - protein, 11 aa, BK Virus
MESQVEEVRVF

SEQ ID NO: 54880 - protein, 11 aa, BK Virus
TEVECFLNPEM

SEQ ID NO: 54881 - protein, 11 aa, BK Virus
FESDSPDRKML

SEQ ID NO: 54882 - protein, 11 aa, BK Virus
WEAVTVKTEVI

SEQ ID NO: 54883 - protein, 11 aa, BK Virus
RRTQKVDGQPM

SEQ ID NO: 54884 - protein, 11 aa, BK Virus
QQWRGLARYFK

SEQ ID NO: 54885 - protein, 11 aa, BK Virus
KPVQGSNFHFF

SEQ ID NO: 54886 - protein, 11 aa, BK Virus
YPVECWIPDPS

SEQ ID NO: 54887 - protein, 11 aa, BK Virus
LPCYSTARIPL

SEQ ID NO: 54888 - protein, 11 aa, BK Virus
DPSRNENTRYF

SEQ ID NO: 54889 - protein, 11 aa, BK Virus
YSQHLSAENAF

SEQ ID NO: 54890 - protein, 11 aa, BK Virus
FFAVGGDPLEM

SEQ ID NO: 54891 - protein, 11 aa, BK Virus
YVSAADICGLF

SEQ ID NO: 54892 - protein, 11 aa, BK Virus
YPISFLLSDLI

SEQ ID NO: 54893 - protein, 11 aa, BK Virus
NPEMGDPDDNL

SEQ ID NO: 54894 - protein, 11 aa, BK Virus
HKAYLDKNNAY

SEQ ID NO: 54895 - protein, 11 aa, BK Virus
FHFFAVGGDPL

SEQ ID NO: 54896 - protein, 11 aa, BK Virus
LHVTNTATTVL

SEQ ID NO: 54897 - protein, 11 aa, BK Virus
YTGGENVPPVL

SEQ ID NO: 54898 - protein, 11 aa, BK Virus
FESDSPDRKML

SEQ ID NO: 54899 - protein, 11 aa, BK Virus
TEVECFLNPEM

SEQ ID NO: 54900 - protein, 11 aa, BK Virus
TEVECFLNPEM

SEQ ID NO: 54901 - protein, 11 aa, BK Virus
TEVECFLNPEM

SEQ ID NO: 54902 - protein, 11 aa, BK Virus
AENAFESDSPD

SEQ ID NO: 54903 - protein, 11 aa, BK Virus
YPISFLLSDLI

SEQ ID NO: 54904 - protein, 11 aa, BK Virus
LPGDPDMIRYI

SEQ ID NO: 54905 - protein, 11 aa, BK Virus
VPPVLHVTNTA

SEQ ID NO: 54906 - protein, 11 aa, BK Virus
LPCYSTARIPL

SEQ ID NO: 54907 - protein, 11 aa, BK Virus
YPISFLLSDLI

SEQ ID NO: 54908 - protein, 11 aa, BK Virus
LPGDPDMIRYI

SEQ ID NO: 54909 - protein, 11 aa, BK Virus
KPVQGSNFHFF

SEQ ID NO: 54910 - protein, 11 aa, BK Virus
LPCYSTARIPL

SEQ ID NO: 54911 - protein, 11 aa, BK Virus
YPISFLLSDLI

SEQ ID NO: 54912 - protein, 11 aa, BK Virus
VPPVLHVTNTA

SEQ ID NO: 54913 - protein, 11 aa, BK Virus
YPVECWIPDPS

SEQ ID NO: 54914 - protein, 11 aa, BK Virus
IPLPNLNEDLT

SEQ ID NO: 54915 - protein, 11 aa, BK Virus
LPCYSTARIPL

SEQ ID NO: 54916 - protein, 11 aa, BK Virus
LPGDPDMIRYI

SEQ ID NO: 54917 - protein, 11 aa, BK Virus
RSVKNPYPISF

SEQ ID NO: 54918 - protein, 8 aa, BK Virus
FLRKEPLV

SEQ ID NO: 54919 - protein, 8 aa, BK Virus
ELMDLLGL

SEQ ID NO: 54920 - protein, 8 aa, BK Virus
TLQWWVQI

SEQ ID NO: 54921 - protein, 8 aa, BK Virus
GTWNSSEV

SEQ ID NO: 54922 - protein, 8 aa, BK Virus
LQWWVQII

SEQ ID NO: 54923 - protein, 8 aa, BK Virus
CMLCQLRL

SEQ ID NO: 54924 - protein, 8 aa, BK Virus
AAWGNLPL

SEQ ID NO: 54925 - protein, 8 aa, BK Virus
KMEQDVKV

SEQ ID NO: 54926 - protein, 8 aa, BK Virus
ELMDLLGL

SEQ ID NO: 54927 - protein, 8 aa, BK Virus
FLRKEPLV

SEQ ID NO: 54928 - protein, 8 aa, BK Virus
SMELMDLL

SEQ ID NO: 54929 - protein, 8 aa, BK Virus
KMKRMNTL

SEQ ID NO: 54930 - protein, 8 aa, BK Virus
KMEQDVKV

SEQ ID NO: 54931 - protein, 8 aa, BK Virus
PLMRKAYL

SEQ ID NO: 54932 - protein, 8 aa, BK Virus
CMLCQLRL

SEQ ID NO: 54933 - protein, 8 aa, BK Virus
FLRKEPLV

SEQ ID NO: 54934 - protein, 8 aa, BK Virus
KMKRMNTL

SEQ ID NO: 54935 - protein, 8 aa, BK Virus
ELMDLLGL

SEQ ID NO: 54936 - protein, 8 aa, BK Virus
TLQWWVQI

SEQ ID NO: 54937 - protein, 8 aa, BK Virus
CMLCQLRL

SEQ ID NO: 54938 - protein, 8 aa, BK Virus
SVHCPCML

SEQ ID NO: 54939 - protein, 8 aa, BK Virus
KMEQDVKV

SEQ ID NO: 54940 - protein, 8 aa, BK Virus
KMEQDVKV

SEQ ID NO: 54941 - protein, 8 aa, BK Virus
FLRKEPLV

SEQ ID NO: 54942 - protein, 8 aa, BK Virus
TLQWWVQI

SEQ ID NO: 54943 - protein, 8 aa, BK Virus
ELMDLLGL

SEQ ID NO: 54944 - protein, 8 aa, BK Virus
KMKRMNTL

SEQ ID NO: 54945 - protein, 8 aa, BK Virus
LQWWVQII

SEQ ID NO: 54946 - protein, 8 aa, BK Virus
GTWNSSEV

SEQ ID NO: 54947 - protein, 8 aa, BK Virus
ELMDLLGL

SEQ ID NO: 54948 - protein, 8 aa, BK Virus
FLRKEPLV

SEQ ID NO: 54949 - protein, 8 aa, BK Virus
AAWGNLPL

SEQ ID NO: 54950 - protein, 8 aa, BK Virus
CMLCQLRL

SEQ ID NO: 54951 - protein, 8 aa, BK Virus
TQWFGLDL

SEQ ID NO: 54952 - protein, 8 aa, BK Virus
TLQWWVQI

SEQ ID NO: 54953 - protein, 8 aa, BK Virus
KMEQDVKV

SEQ ID NO: 54954 - protein, 8 aa, BK Virus
ELMDLLGL

SEQ ID NO: 54955 - protein, 8 aa, BK Virus
FLRKEPLV

SEQ ID NO: 54956 - protein, 8 aa, BK Virus
TLQWWVQI

SEQ ID NO: 54957 - protein, 8 aa, BK Virus
KMEQDVKV

SEQ ID NO: 54958 - protein, 8 aa, BK Virus
DLLGLERA

SEQ ID NO: 54959 - protein, 8 aa, BK Virus
GTWNSSEV

SEQ ID NO: 54960 - protein, 8 aa, BK Virus
CMLCQLRL

SEQ ID NO: 54961 - protein, 8 aa, BK Virus
PLMRKAYL

SEQ ID NO: 54962 - protein, 8 aa, BK Virus
AAWGNLPL

SEQ ID NO: 54963 - protein, 8 aa, BK Virus
SMELMDLL

SEQ ID NO: 54964 - protein, 8 aa, BK Virus
TLYKKMEQ

SEQ ID NO: 54965 - protein, 8 aa, BK Virus
KMKRMNTL

SEQ ID NO: 54966 - protein, 8 aa, BK Virus
GLDLTEET

SEQ ID NO: 54967 - protein, 8 aa, BK Virus
VLNREESM

SEQ ID NO: 54968 - protein, 8 aa, BK Virus
SVHCPCML

SEQ ID NO: 54969 - protein, 8 aa, BK Virus
DLTEETLQ

SEQ ID NO: 54970 - protein, 8 aa, BK Virus
FLRKEPLV

SEQ ID NO: 54971 - protein, 8 aa, BK Virus
ELMDLLGL

SEQ ID NO: 54972 - protein, 8 aa, BK Virus
TLQWWVQI

SEQ ID NO: 54973 - protein, 8 aa, BK Virus
KMEQDVKV

SEQ ID NO: 54974 - protein, 8 aa, BK Virus
VLNREESM

SEQ ID NO: 54975 - protein, 8 aa, BK Virus
PLMRKAYL

SEQ ID NO: 54976 - protein, 8 aa, BK Virus
CMLCQLRL

SEQ ID NO: 54977 - protein, 8 aa, BK Virus
KMKRMNTL

SEQ ID NO: 54978 - protein, 8 aa, BK Virus
DLLGLERA

SEQ ID NO: 54979 - protein, 8 aa, BK Virus
GTWNSSEV

SEQ ID NO: 54980 - protein, 8 aa, BK Virus
TLYKKMEQ

SEQ ID NO: 54981 - protein, 8 aa, BK Virus
AAWGNLPL

SEQ ID NO: 54982 - protein, 8 aa, BK Virus
SMELMDLL

SEQ ID NO: 54983 - protein, 8 aa, BK Virus
FLRKEPLV

SEQ ID NO: 54984 - protein, 8 aa, BK Virus
PLMRKAYL

SEQ ID NO: 54985 - protein, 8 aa, BK Virus
ELMDLLGL

SEQ ID NO: 54986 - protein, 8 aa, BK Virus
GTWNSSEV

SEQ ID NO: 54987 - protein, 8 aa, BK Virus
KMEQDVKV

SEQ ID NO: 54988 - protein, 8 aa, BK Virus
TLQWWVQI

SEQ ID NO: 54989 - protein, 8 aa, BK Virus
TLYKKMEQ

SEQ ID NO: 54990 - protein, 8 aa, BK Virus
KMKRMNTL

SEQ ID NO: 54991 - protein, 8 aa, BK Virus
AAWGNLPL

SEQ ID NO: 54992 - protein, 8 aa, BK Virus
CMLCQLRL

SEQ ID NO: 54993 - protein, 8 aa, BK Virus
DLLGLERA

SEQ ID NO: 54994 - protein, 8 aa, BK Virus
SMELMDLL

SEQ ID NO: 54995 - protein, 8 aa, BK Virus
GLDLTEET

SEQ ID NO: 54996 - protein, 8 aa, BK Virus
VLNREESM

SEQ ID NO: 54997 - protein, 8 aa, BK Virus
ELMDLLGL

SEQ ID NO: 54998 - protein, 8 aa, BK Virus
FLRKEPLV

SEQ ID NO: 54999 - protein, 8 aa, BK Virus
AAWGNLPL

SEQ ID NO: 55000 - protein, 8 aa, BK Virus
TLQWWVQI

SEQ ID NO: 55001 - protein, 8 aa, BK Virus
PLMRKAYL

SEQ ID NO: 55002 - protein, 8 aa, BK Virus
CMLCQLRL

SEQ ID NO: 55003 - protein, 8 aa, BK Virus
GTWNSSEV

SEQ ID NO: 55004 - protein, 8 aa, BK Virus
RLRHLNRK

SEQ ID NO: 55005 - protein, 8 aa, BK Virus
RMNTLYKK

SEQ ID NO: 55006 - protein, 8 aa, BK Virus
HLNRKFLR

SEQ ID NO: 55007 - protein, 8 aa, BK Virus
LMRKAYLK

SEQ ID NO: 55008 - protein, 8 aa, BK Virus
KAYLKKCK

SEQ ID NO: 55009 - protein, 8 aa, BK Virus
RMNTLYKK

SEQ ID NO: 55010 - protein, 8 aa, BK Virus
KAYLKKCK

SEQ ID NO: 55011 - protein, 8 aa, BK Virus
KRMNTLYK

SEQ ID NO: 55012 - protein, 8 aa, BK Virus
HLNRKFLR

SEQ ID NO: 55013 - protein, 8 aa, BK Virus
IIGETPFR

SEQ ID NO: 55014 - protein, 8 aa, BK Virus
LMRKAYLK

SEQ ID NO: 55015 - protein, 8 aa, BK Virus
VWIDCYCI

SEQ ID NO: 55016 - protein, 8 aa, BK Virus
LYCKEWPI

SEQ ID NO: 55017 - protein, 8 aa, BK Virus
VWIDCYCI

SEQ ID NO: 55018 - protein, 8 aa, BK Virus
LYCKEWPI

SEQ ID NO: 55019 - protein, 8 aa, BK Virus
ELMDLLGL

SEQ ID NO: 55020 - protein, 8 aa, BK Virus
QIIGETPF

SEQ ID NO: 55021 - protein, 8 aa, BK Virus
EVCADFPL

SEQ ID NO: 55022 - protein, 8 aa, BK Virus
KVAHQPDF

SEQ ID NO: 55023 - protein, 8 aa, BK Virus
ELMDLLGL

SEQ ID NO: 55024 - protein, 8 aa, BK Virus
PLCPDTLY

SEQ ID NO: 55025 - protein, 8 aa, BK Virus
RLRHLNRK

SEQ ID NO: 55026 - protein, 8 aa, BK Virus
LMRKAYLK

SEQ ID NO: 55027 - protein, 8 aa, BK Virus
RMNTLYKK

SEQ ID NO: 55028 - protein, 8 aa, BK Virus
KAYLKKCK

SEQ ID NO: 55029 - protein, 8 aa, BK Virus
KRMNTLYK

SEQ ID NO: 55030 - protein, 8 aa, BK Virus
MRKAYLKK

SEQ ID NO: 55031 - protein, 8 aa, BK Virus
LNRKFLRK

SEQ ID NO: 55032 - protein, 8 aa, BK Virus
HLNRKFLR

SEQ ID NO: 55033 - protein, 8 aa, BK Virus
RMNTLYKK

SEQ ID NO: 55034 - protein, 8 aa, BK Virus
MLCQLRLR

SEQ ID NO: 55035 - protein, 8 aa, BK Virus
LMRKAYLK

SEQ ID NO: 55036 - protein, 8 aa, BK Virus
RLRHLNRK

SEQ ID NO: 55037 - protein, 8 aa, BK Virus
IIGETPFR

SEQ ID NO: 55038 - protein, 8 aa, BK Virus
KAYLKKCK

SEQ ID NO: 55039 - protein, 8 aa, BK Virus
HLNRKFLR

SEQ ID NO: 55040 - protein, 8 aa, BK Virus
MLCQLRLR

SEQ ID NO: 55041 - protein, 8 aa, BK Virus
IIGETPFR

SEQ ID NO: 55042 - protein, 8 aa, BK Virus
ETPFRDLK

SEQ ID NO: 55043 - protein, 8 aa, BK Virus
MLCQLRLR

SEQ ID NO: 55044 - protein, 8 aa, BK Virus
HLNRKFLR

SEQ ID NO: 55045 - protein, 8 aa, BK Virus
IIGETPFR

SEQ ID NO: 55046 - protein, 8 aa, BK Virus
EVCADFPL

SEQ ID NO: 55047 - protein, 8 aa, BK Virus
ELMDLLGL

SEQ ID NO: 55048 - protein, 8 aa, BK Virus
ESMELMDL

SEQ ID NO: 55049 - protein, 8 aa, BK Virus
SVHCPCML

SEQ ID NO: 55050 - protein, 8 aa, BK Virus
ERAAWGNL

SEQ ID NO: 55051 - protein, 8 aa, BK Virus
ELMDLLGL

SEQ ID NO: 55052 - protein, 8 aa, BK Virus
EVCADFPL

SEQ ID NO: 55053 - protein, 8 aa, BK Virus
GTWNSSEV

SEQ ID NO: 55054 - protein, 8 aa, BK Virus
FPLCPDTL

SEQ ID NO: 55055 - protein, 8 aa, BK Virus
AAWGNLPL

SEQ ID NO: 55056 - protein, 8 aa, BK Virus
ESMELMDL

SEQ ID NO: 55057 - protein, 8 aa, BK Virus
KPSVHCPC

SEQ ID NO: 55058 - protein, 8 aa, BK Virus
AAWGNLPL

SEQ ID NO: 55059 - protein, 8 aa, BK Virus
LPLMRKAY

SEQ ID NO: 55060 - protein, 8 aa, BK Virus
KMKRMNTL

SEQ ID NO: 55061 - protein, 8 aa, BK Virus
YLKKCKEF

SEQ ID NO: 55062 - protein, 8 aa, BK Virus
QIIGETPF

SEQ ID NO: 55063 - protein, 8 aa, BK Virus
YLKKCKEF

SEQ ID NO: 55064 - protein, 8 aa, BK Virus
KMKRMNTL

SEQ ID NO: 55065 - protein, 8 aa, BK Virus
KRMNTLYK

SEQ ID NO: 55066 - protein, 8 aa, BK Virus
MRKAYLKK

SEQ ID NO: 55067 - protein, 8 aa, BK Virus
LPLMRKAY

SEQ ID NO: 55068 - protein, 8 aa, BK Virus
FPLCPDTL

SEQ ID NO: 55069 - protein, 8 aa, BK Virus
AAWGNLPL

SEQ ID NO: 55070 - protein, 8 aa, BK Virus
QIIGETPF

SEQ ID NO: 55071 - protein, 8 aa, BK Virus
NREESMEL

SEQ ID NO: 55072 - protein, 8 aa, BK Virus
GETPFRDL

SEQ ID NO: 55073 - protein, 8 aa, BK Virus
REESMELM

SEQ ID NO: 55074 - protein, 8 aa, BK Virus
REESMELM

SEQ ID NO: 55075 - protein, 8 aa, BK Virus
EETLQWWV

SEQ ID NO: 55076 - protein, 8 aa, BK Virus
TEETLQWW

SEQ ID NO: 55077 - protein, 8 aa, BK Virus
EETLQWWV

SEQ ID NO: 55078 - protein, 8 aa, BK Virus
EETLQWWV

SEQ ID NO: 55079 - protein, 8 aa, BK Virus
FPLCPDTL

SEQ ID NO: 55080 - protein, 8 aa, BK Virus
CPCMLCQL

SEQ ID NO: 55081 - protein, 8 aa, BK Virus
LPLMRKAY

SEQ ID NO: 55082 - protein, 8 aa, BK Virus
FPLCPDTL

SEQ ID NO: 55083 - protein, 8 aa, BK Virus
LPLMRKAY

SEQ ID NO: 55084 - protein, 8 aa, BK Virus
LTEETLQW

SEQ ID NO: 55085 - protein, 8 aa, BK Virus
LTEETLQW

SEQ ID NO: 55086 - protein, 8 aa, BK Virus
KVAHQPDF

SEQ ID NO: 55087 - protein, 8 aa, BK Virus
LGLERAAW

SEQ ID NO: 55088 - protein, 9 aa, BK Virus
TLYCKEWPI

SEQ ID NO: 55089 - protein, 9 aa, BK Virus
TLQWWVQII

SEQ ID NO: 55090 - protein, 9 aa, BK Virus
LVWIDCYCI

SEQ ID NO: 55091 - protein, 9 aa, BK Virus
TLYCKEWPI

SEQ ID NO: 55092 - protein, 9 aa, BK Virus
GLDLTEETL

SEQ ID NO: 55093 - protein, 9 aa, BK Virus
TLQWWVQII

SEQ ID NO: 55094 - protein, 9 aa, BK Virus
TLYCKEWPI

SEQ ID NO: 55095 - protein, 9 aa, BK Virus
RAAWGNLPL

SEQ ID NO: 55096 - protein, 9 aa, BK Virus
RMNTLYKKM

SEQ ID NO: 55097 - protein, 9 aa, BK Virus
TLQWWVQII

SEQ ID NO: 55098 - protein, 9 aa, BK Virus
TLYCKEWPI

SEQ ID NO: 55099 - protein, 9 aa, BK Virus
KKMEQDVKV

SEQ ID NO: 55100 - protein, 9 aa, BK Virus
VQIIGETPF

SEQ ID NO: 55101 - protein, 9 aa, BK Virus
TQWFGLDLT

SEQ ID NO: 55102 - protein, 9 aa, BK Virus
TLYCKEWPI

SEQ ID NO: 55103 - protein, 9 aa, BK Virus
RAAWGNLPL

SEQ ID NO: 55104 - protein, 9 aa, BK Virus
SEVCADFPL

SEQ ID NO: 55105 - protein, 9 aa, BK Virus
MELMDLLGL

SEQ ID NO: 55106 - protein, 9 aa, BK Virus
AAWGNLPLM

SEQ ID NO: 55107 - protein, 9 aa, BK Virus
GLDLTEETL

SEQ ID NO: 55108 - protein, 9 aa, BK Virus
TLYCKEWPI

SEQ ID NO: 55109 - protein, 9 aa, BK Virus
TLQWWVQII

SEQ ID NO: 55110 - protein, 9 aa, BK Virus
RAAWGNLPL

SEQ ID NO: 55111 - protein, 9 aa, BK Virus
DLLGLERAA

SEQ ID NO: 55112 - protein, 9 aa, BK Virus
PLCPDTLYC

SEQ ID NO: 55113 - protein, 9 aa, BK Virus
LVWIDCYCI

SEQ ID NO: 55114 - protein, 9 aa, BK Virus
FGTWNSSEV

SEQ ID NO: 55115 - protein, 9 aa, BK Virus
AAWGNLPLM

SEQ ID NO: 55116 - protein, 9 aa, BK Virus
ETLQWWVQI

SEQ ID NO: 55117 - protein, 9 aa, BK Virus
PICSKKPSV

SEQ ID NO: 55118 - protein, 9 aa, BK Virus
PLVWIDCYC

SEQ ID NO: 55119 - protein, 9 aa, BK Virus
GLDLTEETL

SEQ ID NO: 55120 - protein, 9 aa, BK Virus
TLYCKEWPI

SEQ ID NO: 55121 - protein, 9 aa, BK Virus
TLQWWVQII

SEQ ID NO: 55122 - protein, 9 aa, BK Virus
DLLGLERAA

SEQ ID NO: 55123 - protein, 9 aa, BK Virus
FTQWFGLDL

SEQ ID NO: 55124 - protein, 9 aa, BK Virus
PICSKKPSV

SEQ ID NO: 55125 - protein, 9 aa, BK Virus
GLDLTEETL

SEQ ID NO: 55126 - protein, 9 aa, BK Virus
TLYCKEWPI

SEQ ID NO: 55127 - protein, 9 aa, BK Virus
PICSKKPSV

SEQ ID NO: 55128 - protein, 9 aa, BK Virus
TLQWWVQII

SEQ ID NO: 55129 - protein, 9 aa, BK Virus
PLVWIDCYC

SEQ ID NO: 55130 - protein, 9 aa, BK Virus
GLDLTEETL

SEQ ID NO: 55131 - protein, 9 aa, BK Virus
TLQWWVQII

SEQ ID NO: 55132 - protein, 9 aa, BK Virus
AAWGNLPLM

SEQ ID NO: 55133 - protein, 9 aa, BK Virus
TLYCKEWPI

SEQ ID NO: 55134 - protein, 9 aa, BK Virus
HLNRKFLRK

SEQ ID NO: 55135 - protein, 9 aa, BK Virus
LMRKAYLKK

SEQ ID NO: 55136 - protein, 9 aa, BK Virus
KMKRMNTLY

SEQ ID NO: 55137 - protein, 9 aa, BK Virus
PLMRKAYLK

SEQ ID NO: 55138 - protein, 9 aa, BK Virus
QLRLRHLNR

SEQ ID NO: 55139 - protein, 9 aa, BK Virus
HLNRKFLRK

SEQ ID NO: 55140 - protein, 9 aa, BK Virus
PLMRKAYLK

SEQ ID NO: 55141 - protein, 9 aa, BK Virus
QIIGETPFR

SEQ ID NO: 55142 - protein, 9 aa, BK Virus
AYLKKCKEF

SEQ ID NO: 55143 - protein, 9 aa, BK Virus
AYLKKCKEF

SEQ ID NO: 55144 - protein, 9 aa, BK Virus
AYLKKCKEF

SEQ ID NO: 55145 - protein, 9 aa, BK Virus
AHQPDFGTW

SEQ ID NO: 55146 - protein, 9 aa, BK Virus
ESMELMDLL

SEQ ID NO: 55147 - protein, 9 aa, BK Virus
ETPFRDLKL

SEQ ID NO: 55148 - protein, 9 aa, BK Virus
ETLQWWVQI

SEQ ID NO: 55149 - protein, 9 aa, BK Virus
ESMELMDLL

SEQ ID NO: 55150 - protein, 9 aa, BK Virus
KMKRMNTLY

SEQ ID NO: 55151 - protein, 9 aa, BK Virus
FPLCPDTLY

SEQ ID NO: 55152 - protein, 9 aa, BK Virus
LMRKAYLKK

SEQ ID NO: 55153 - protein, 9 aa, BK Virus
MKRMNTLYK

SEQ ID NO: 55154 - protein, 9 aa, BK Virus
KCKEFHPDK

SEQ ID NO: 55155 - protein, 9 aa, BK Virus
QLRLRHLNR

SEQ ID NO: 55156 - protein, 9 aa, BK Virus
KMKRMNTLY

SEQ ID NO: 55157 - protein, 9 aa, BK Virus
HLNRKFLRK

SEQ ID NO: 55158 - protein, 9 aa, BK Virus
PLMRKAYLK

SEQ ID NO: 55159 - protein, 9 aa, BK Virus
KRMNTLYKK

SEQ ID NO: 55160 - protein, 9 aa, BK Virus
KMKRMNTLY

SEQ ID NO: 55161 - protein, 9 aa, BK Virus
RHLNRKFLR

SEQ ID NO: 55162 - protein, 9 aa, BK Virus
CMLCQLRLR

SEQ ID NO: 55163 - protein, 9 aa, BK Virus
QLRLRHLNR

SEQ ID NO: 55164 - protein, 9 aa, BK Virus
KMKRMNTLY

SEQ ID NO: 55165 - protein, 9 aa, BK Virus
HLNRKFLRK

SEQ ID NO: 55166 - protein, 9 aa, BK Virus
LMRKAYLKK

SEQ ID NO: 55167 - protein, 9 aa, BK Virus
QLRLRHLNR

SEQ ID NO: 55168 - protein, 9 aa, BK Virus
QIIGETPFR

SEQ ID NO: 55169 - protein, 9 aa, BK Virus
CPCMLCQLR

SEQ ID NO: 55170 - protein, 9 aa, BK Virus
ESMELMDLL

SEQ ID NO: 55171 - protein, 9 aa, BK Virus
DCFTQWFGL

SEQ ID NO: 55172 - protein, 9 aa, BK Virus
FGTWNSSEV

SEQ ID NO: 55173 - protein, 9 aa, BK Virus
ETLQWWVQI

SEQ ID NO: 55174 - protein, 9 aa, BK Virus
DCYCIDCFT

SEQ ID NO: 55175 - protein, 9 aa, BK Virus
ETPFRDLKL

SEQ ID NO: 55176 - protein, 9 aa, BK Virus
ETLQWWVQI

SEQ ID NO: 55177 - protein, 9 aa, BK Virus
ESMELMDLL

SEQ ID NO: 55178 - protein, 9 aa, BK Virus
TLYCKEWPI

SEQ ID NO: 55179 - protein, 9 aa, BK Virus
LVWIDCYCI

SEQ ID NO: 55180 - protein, 9 aa, BK Virus
AAWGNLPLM

SEQ ID NO: 55181 - protein, 9 aa, BK Virus
RAAWGNLPL

SEQ ID NO: 55182 - protein, 9 aa, BK Virus
LPLMRKAYL

SEQ ID NO: 55183 - protein, 9 aa, BK Virus
KPSVHCPCM

SEQ ID NO: 55184 - protein, 9 aa, BK Virus
VQIIGETPF

SEQ ID NO: 55185 - protein, 9 aa, BK Virus
KMKRMNTLY

SEQ ID NO: 55186 - protein, 9 aa, BK Virus
RLRHLNRKF

SEQ ID NO: 55187 - protein, 9 aa, BK Virus
RAAWGNLPL

SEQ ID NO: 55188 - protein, 9 aa, BK Virus
MELMDLLGL

SEQ ID NO: 55189 - protein, 9 aa, BK Virus
TEETLQWWV

SEQ ID NO: 55190 - protein, 9 aa, BK Virus
SEVCADFPL

SEQ ID NO: 55191 - protein, 9 aa, BK Virus
KRMNTLYKK

SEQ ID NO: 55192 - protein, 9 aa, BK Virus
FPLCPDTLY

SEQ ID NO: 55193 - protein, 9 aa, BK Virus
EPLVWIDCY

SEQ ID NO: 55194 - protein, 9 aa, BK Virus
RAAWGNLPL

SEQ ID NO: 55195 - protein, 9 aa, BK Virus
AAWGNLPLM

SEQ ID NO: 55196 - protein, 9 aa, BK Virus
KPSVHCPCM

SEQ ID NO: 55197 - protein, 9 aa, BK Virus
MELMDLLGL

SEQ ID NO: 55198 - protein, 9 aa, BK Virus
SEVCADFPL

SEQ ID NO: 55199 - protein, 9 aa, BK Virus
EESMELMDL

SEQ ID NO: 55200 - protein, 9 aa, BK Virus
LERAAWGNL

SEQ ID NO: 55201 - protein, 9 aa, BK Virus
SEVCADFPL

SEQ ID NO: 55202 - protein, 9 aa, BK Virus
SEVCADFPL

SEQ ID NO: 55203 - protein, 9 aa, BK Virus
EETLQWWVQ

SEQ ID NO: 55204 - protein, 9 aa, BK Virus
FPLCPDTLY

SEQ ID NO: 55205 - protein, 9 aa, BK Virus
EPLVWIDCY

SEQ ID NO: 55206 - protein, 9 aa, BK Virus
LPLMRKAYL

SEQ ID NO: 55207 - protein, 9 aa, BK Virus
WPICSKKPS

SEQ ID NO: 55208 - protein, 9 aa, BK Virus
LTEETLQWW

SEQ ID NO: 55209 - protein, 9 aa, BK Virus
FLRKEPLVW

SEQ ID NO: 55210 - protein, 9 aa, BK Virus
RAAWGNLPL

SEQ ID NO: 55211 - protein, 10 aa, BK Virus
FLRKEPLVWI

SEQ ID NO: 55212 - protein, 10 aa, BK Virus
TLYKKMEQDV

SEQ ID NO: 55213 - protein, 10 aa, BK Virus
LMDLLGLERA

SEQ ID NO: 55214 - protein, 10 aa, BK Virus
VLNREESMEL

SEQ ID NO: 55215 - protein, 10 aa, BK Virus
MLCQLRLRHL

SEQ ID NO: 55216 - protein, 10 aa, BK Virus
FLRKEPLVWI

SEQ ID NO: 55217 - protein, 10 aa, BK Virus
LMDLLGLERA

SEQ ID NO: 55218 - protein, 10 aa, BK Virus
VLNREESMEL

SEQ ID NO: 55219 - protein, 10 aa, BK Virus
TLYKKMEQDV

SEQ ID NO: 55220 - protein, 10 aa, BK Virus
FGLDLTEETL

SEQ ID NO: 55221 - protein, 10 aa, BK Virus
SMELMDLLGL

SEQ ID NO: 55222 - protein, 10 aa, BK Virus
NLPLMRKAYL

SEQ ID NO: 55223 - protein, 10 aa, BK Virus
FLRKEPLVWI

SEQ ID NO: 55224 - protein, 10 aa, BK Virus
TLYKKMEQDV

SEQ ID NO: 55225 - protein, 10 aa, BK Virus
VLNREESMEL

SEQ ID NO: 55226 - protein, 10 aa, BK Virus
MLCQLRLRHL

SEQ ID NO: 55227 - protein, 10 aa, BK Virus
LMDLLGLERA

SEQ ID NO: 55228 - protein, 10 aa, BK Virus
SMELMDLLGL

SEQ ID NO: 55229 - protein, 10 aa, BK Virus
RLRHLNRKFL

SEQ ID NO: 55230 - protein, 10 aa, BK Virus
LTEETLQWWV

SEQ ID NO: 55231 - protein, 10 aa, BK Virus
VLNREESMEL

SEQ ID NO: 55232 - protein, 10 aa, BK Virus
FLRKEPLVWI

SEQ ID NO: 55233 - protein, 10 aa, BK Virus
LTEETLQWWV

SEQ ID NO: 55234 - protein, 10 aa, BK Virus
LQWWVQIIGE

SEQ ID NO: 55235 - protein, 10 aa, BK Virus
RAAWGNLPLM

SEQ ID NO: 55236 - protein, 10 aa, BK Virus
TQWFGLDLTE

SEQ ID NO: 55237 - protein, 10 aa, BK Virus
FLRKEPLVWI

SEQ ID NO: 55238 - protein, 10 aa, BK Virus
TLYKKMEQDV

SEQ ID NO: 55239 - protein, 10 aa, BK Virus
VLNREESMEL

SEQ ID NO: 55240 - protein, 10 aa, BK Virus
LTEETLQWWV

SEQ ID NO: 55241 - protein, 10 aa, BK Virus
LMDLLGLERA

SEQ ID NO: 55242 - protein, 10 aa, BK Virus
FLRKEPLVWI

SEQ ID NO: 55243 - protein, 10 aa, BK Virus
SMELMDLLGL

SEQ ID NO: 55244 - protein, 10 aa, BK Virus
MLCQLRLRHL

SEQ ID NO: 55245 - protein, 10 aa, BK Virus
NLPLMRKAYL

SEQ ID NO: 55246 - protein, 10 aa, BK Virus
PLVWIDCYCI

SEQ ID NO: 55247 - protein, 10 aa, BK Virus
RLRHLNRKFL

SEQ ID NO: 55248 - protein, 10 aa, BK Virus
GLDLTEETLQ

SEQ ID NO: 55249 - protein, 10 aa, BK Virus
GLERAAWGNL

SEQ ID NO: 55250 - protein, 10 aa, BK Virus
FGLDLTEETL

SEQ ID NO: 55251 - protein, 10 aa, BK Virus
TLYKKMEQDV

SEQ ID NO: 55252 - protein, 10 aa, BK Virus
VLNREESMEL

SEQ ID NO: 55253 - protein, 10 aa, BK Virus
FLRKEPLVWI

SEQ ID NO: 55254 - protein, 10 aa, BK Virus
LTEETLQWWV

SEQ ID NO: 55255 - protein, 10 aa, BK Virus
LMDLLGLERA

SEQ ID NO: 55256 - protein, 10 aa, BK Virus
MLCQLRLRHL

SEQ ID NO: 55257 - protein, 10 aa, BK Virus
SMELMDLLGL

SEQ ID NO: 55258 - protein, 10 aa, BK Virus
FGLDLTEETL

SEQ ID NO: 55259 - protein, 10 aa, BK Virus
NLPLMRKAYL

SEQ ID NO: 55260 - protein, 10 aa, BK Virus
RLRHLNRKFL

SEQ ID NO: 55261 - protein, 10 aa, BK Virus
GLERAAWGNL

SEQ ID NO: 55262 - protein, 10 aa, BK Virus
TLYKKMEQDV

SEQ ID NO: 55263 - protein, 10 aa, BK Virus
VLNREESMEL

SEQ ID NO: 55264 - protein, 10 aa, BK Virus
NLPLMRKAYL

SEQ ID NO: 55265 - protein, 10 aa, BK Virus
FLRKEPLVWI

SEQ ID NO: 55266 - protein, 10 aa, BK Virus
LTEETLQWWV

SEQ ID NO: 55267 - protein, 10 aa, BK Virus
MLCQLRLRHL

SEQ ID NO: 55268 - protein, 10 aa, BK Virus
RLRHLNRKFL

SEQ ID NO: 55269 - protein, 10 aa, BK Virus
GLERAAWGNL

SEQ ID NO: 55270 - protein, 10 aa, BK Virus
PLVWIDCYCI

SEQ ID NO: 55271 - protein, 10 aa, BK Virus
LMDLLGLERA

SEQ ID NO: 55272 - protein, 10 aa, BK Virus
SMELMDLLGL

SEQ ID NO: 55273 - protein, 10 aa, BK Virus
LTEETLQWWV

SEQ ID NO: 55274 - protein, 10 aa, BK Virus
VLNREESMEL

SEQ ID NO: 55275 - protein, 10 aa, BK Virus
TLYKKMEQDV

SEQ ID NO: 55276 - protein, 10 aa, BK Virus
FLRKEPLVWI

SEQ ID NO: 55277 - protein, 10 aa, BK Virus
LMDLLGLERA

SEQ ID NO: 55278 - protein, 10 aa, BK Virus
KMKRMNTLYK

SEQ ID NO: 55279 - protein, 10 aa, BK Virus
RHLNRKFLRK

SEQ ID NO: 55280 - protein, 10 aa, BK Virus
PLMRKAYLKK

SEQ ID NO: 55281 - protein, 10 aa, BK Virus
QLRLRHLNRK

SEQ ID NO: 55282 - protein, 10 aa, BK Virus
AWGNLPLMRK

SEQ ID NO: 55283 - protein, 10 aa, BK Virus
LPLMRKAYLK

SEQ ID NO: 55284 - protein, 10 aa, BK Virus
KMKRMNTLYK

SEQ ID NO: 55285 - protein, 10 aa, BK Virus
PLMRKAYLKK

SEQ ID NO: 55286 - protein, 10 aa, BK Virus
AAWGNLPLMR

SEQ ID NO: 55287 - protein, 10 aa, BK Virus
AWGNLPLMRK

SEQ ID NO: 55288 - protein, 10 aa, BK Virus
PLCPDTLYCK

SEQ ID NO: 55289 - protein, 10 aa, BK Virus
CYCIDCFTQW

SEQ ID NO: 55290 - protein, 10 aa, BK Virus
LYKKMEQDVK

SEQ ID NO: 55291 - protein, 10 aa, BK Virus
YCIDCFTQWF

SEQ ID NO: 55292 - protein, 10 aa, BK Virus
CYCIDCFTQW

SEQ ID NO: 55293 - protein, 10 aa, BK Virus
KFLRKEPLVW

SEQ ID NO: 55294 - protein, 10 aa, BK Virus
DVKVAHQPDF

SEQ ID NO: 55295 - protein, 10 aa, BK Virus
ETLQWWVQII

SEQ ID NO: 55296 - protein, 10 aa, BK Virus
DFPLCPDTLY

SEQ ID NO: 55297 - protein, 10 aa, BK Virus
KMKRMNTLYK

SEQ ID NO: 55298 - protein, 10 aa, BK Virus
QLRLRHLNRK

SEQ ID NO: 55299 - protein, 10 aa, BK Virus
MKRMNTLYKK

SEQ ID NO: 55300 - protein, 10 aa, BK Virus
PLMRKAYLKK

SEQ ID NO: 55301 - protein, 10 aa, BK Virus
RLRHLNRKFL

SEQ ID NO: 55302 - protein, 10 aa, BK Virus
MRKAYLKKCK

SEQ ID NO: 55303 - protein, 10 aa, BK Virus
LRHLNRKFLR

SEQ ID NO: 55304 - protein, 10 aa, BK Virus
CQLRLRHLNR

SEQ ID NO: 55305 - protein, 10 aa, BK Virus
KMKRMNTLYK

SEQ ID NO: 55306 - protein, 10 aa, BK Virus
MKRMNTLYKK

SEQ ID NO: 55307 - protein, 10 aa, BK Virus
RHLNRKFLRK

SEQ ID NO: 55308 - protein, 10 aa, BK Virus
ELMDLLGLER

SEQ ID NO: 55309 - protein, 10 aa, BK Virus
LRHLNRKFLR

SEQ ID NO: 55310 - protein, 10 aa, BK Virus
ELMDLLGLER

SEQ ID NO: 55311 - protein, 10 aa, BK Virus
DTLYCKEWPI

SEQ ID NO: 55312 - protein, 10 aa, BK Virus
ETLQWWVQII

SEQ ID NO: 55313 - protein, 10 aa, BK Virus
ERAAWGNLPL

SEQ ID NO: 55314 - protein, 10 aa, BK Virus
ETLQWWVQII

SEQ ID NO: 55315 - protein, 10 aa, BK Virus
DTLYCKEWPI

SEQ ID NO: 55316 - protein, 10 aa, BK Virus
LTEETLQWWV

SEQ ID NO: 55317 - protein, 10 aa, BK Virus
WPICSKKPSV

SEQ ID NO: 55318 - protein, 10 aa, BK Virus
KPSVHCPCML

SEQ ID NO: 55319 - protein, 10 aa, BK Virus
WPICSKKPSV

SEQ ID NO: 55320 - protein, 10 aa, BK Virus
RLRHLNRKFL

SEQ ID NO: 55321 - protein, 10 aa, BK Virus
WVQIIGETPF

SEQ ID NO: 55322 - protein, 10 aa, BK Virus
KRMNTLYKKM

SEQ ID NO: 55323 - protein, 10 aa, BK Virus
WVQIIGETPF

SEQ ID NO: 55324 - protein, 10 aa, BK Virus
RAAWGNLPLM

SEQ ID NO: 55325 - protein, 10 aa, BK Virus
YCIDCFTQWF

SEQ ID NO: 55326 - protein, 10 aa, BK Virus
ERAAWGNLPL

SEQ ID NO: 55327 - protein, 10 aa, BK Virus
REESMELMDL

SEQ ID NO: 55328 - protein, 10 aa, BK Virus
GETPFRDLKL

SEQ ID NO: 55329 - protein, 10 aa, BK Virus
EESMELMDLL

SEQ ID NO: 55330 - protein, 10 aa, BK Virus
EESMELMDLL

SEQ ID NO: 55331 - protein, 10 aa, BK Virus
KEPLVWIDCY

SEQ ID NO: 55332 - protein, 10 aa, BK Virus
EETLQWWVQI

SEQ ID NO: 55333 - protein, 10 aa, BK Virus
KEPLVWIDCY

SEQ ID NO: 55334 - protein, 10 aa, BK Virus
WPICSKKPSV

SEQ ID NO: 55335 - protein, 10 aa, BK Virus
WPICSKKPSV

SEQ ID NO: 55336 - protein, 10 aa, BK Virus
LPLMRKAYLK

SEQ ID NO: 55337 - protein, 10 aa, BK Virus
VAHQPDFGTW

SEQ ID NO: 55338 - protein, 10 aa, BK Virus
KFLRKEPLVW

SEQ ID NO: 55339 - protein, 10 aa, BK Virus
VAHQPDFGTW

SEQ ID NO: 55340 - protein, 10 aa, BK Virus
RAAWGNLPLM

SEQ ID NO: 55341 - protein, 10 aa, BK Virus
KAYLKKCKEF

SEQ ID NO: 55342 - protein, 11 aa, BK Virus
ELMDLLGLERA

SEQ ID NO: 55343 - protein, 11 aa, BK Virus
KVLNREESMEL

SEQ ID NO: 55344 - protein, 11 aa, BK Virus
ELMDLLGLERA

SEQ ID NO: 55345 - protein, 11 aa, BK Virus
CIDCFTQWFGL

SEQ ID NO: 55346 - protein, 11 aa, BK Virus
VLNREESMELM

SEQ ID NO: 55347 - protein, 11 aa, BK Virus
DLTEETLQWWV

SEQ ID NO: 55348 - protein, 11 aa, BK Virus
ELMDLLGLERA

SEQ ID NO: 55349 - protein, 11 aa, BK Virus
CMLCQLRLRHL

SEQ ID NO: 55350 - protein, 11 aa, BK Virus
VLNREESMELM

SEQ ID NO: 55351 - protein, 11 aa, BK Virus
SVHCPCMLCQL

SEQ ID NO: 55352 - protein, 11 aa, BK Virus
KVLNREESMEL

SEQ ID NO: 55353 - protein, 11 aa, BK Virus
DLTEETLQWWV

SEQ ID NO: 55354 - protein, 11 aa, BK Virus
SVHCPCMLCQL

SEQ ID NO: 55355 - protein, 11 aa, BK Virus
KVLNREESMEL

SEQ ID NO: 55356 - protein, 11 aa, BK Virus
LQWWVQIIGET

SEQ ID NO: 55357 - protein, 11 aa, BK Virus
CIDCFTQWFGL

SEQ ID NO: 55358 - protein, 11 aa, BK Virus
TQWFGLDLTEE

SEQ ID NO: 55359 - protein, 11 aa, BK Virus
WIDCYCIDCFT

SEQ ID NO: 55360 - protein, 11 aa, BK Virus
DLTEETLQWWV

SEQ ID NO: 55361 - protein, 11 aa, BK Virus
ELMDLLGLERA

SEQ ID NO: 55362 - protein, 11 aa, BK Virus
CIDCFTQWFGL

SEQ ID NO: 55363 - protein, 11 aa, BK Virus
LMDLLGLERAA

SEQ ID NO: 55364 - protein, 11 aa, BK Virus
KVLNREESMEL

SEQ ID NO: 55365 - protein, 11 aa, BK Virus
SVHCPCMLCQL

SEQ ID NO: 55366 - protein, 11 aa, BK Virus
VLNREESMELM

SEQ ID NO: 55367 - protein, 11 aa, BK Virus
DLTEETLQWWV

SEQ ID NO: 55368 - protein, 11 aa, BK Virus
ELMDLLGLERA

SEQ ID NO: 55369 - protein, 11 aa, BK Virus
LMDLLGLERAA

SEQ ID NO: 55370 - protein, 11 aa, BK Virus
CIDCFTQWFGL

SEQ ID NO: 55371 - protein, 11 aa, BK Virus
VLNREESMELM

SEQ ID NO: 55372 - protein, 11 aa, BK Virus
KVLNREESMEL

SEQ ID NO: 55373 - protein, 11 aa, BK Virus
DLTEETLQWWV

SEQ ID NO: 55374 - protein, 11 aa, BK Virus
ELMDLLGLERA

SEQ ID NO: 55375 - protein, 11 aa, BK Virus
KVLNREESMEL

SEQ ID NO: 55376 - protein, 11 aa, BK Virus
SVHCPCMLCQL

SEQ ID NO: 55377 - protein, 11 aa, BK Virus
CIDCFTQWFGL

SEQ ID NO: 55378 - protein, 11 aa, BK Virus
DLTEETLQWWV

SEQ ID NO: 55379 - protein, 11 aa, BK Virus
ELMDLLGLERA

SEQ ID NO: 55380 - protein, 11 aa, BK Virus
CIDCFTQWFGL

SEQ ID NO: 55381 - protein, 11 aa, BK Virus
KMKRMNTLYKK

SEQ ID NO: 55382 - protein, 11 aa, BK Virus
RLRHLNRKFLR

SEQ ID NO: 55383 - protein, 11 aa, BK Virus
TLYKKMEQDVK

SEQ ID NO: 55384 - protein, 11 aa, BK Virus
AAWGNLPLMRK

SEQ ID NO: 55385 - protein, 11 aa, BK Virus
LMRKAYLKKCK

SEQ ID NO: 55386 - protein, 11 aa, BK Virus
IIGETPFRDLK

SEQ ID NO: 55387 - protein, 11 aa, BK Virus
AAWGNLPLMRK

SEQ ID NO: 55388 - protein, 11 aa, BK Virus
TLYKKMEQDVK

SEQ ID NO: 55389 - protein, 11 aa, BK Virus
KMKRMNTLYKK

SEQ ID NO: 55390 - protein, 11 aa, BK Virus
IIGETPFRDLK

SEQ ID NO: 55391 - protein, 11 aa, BK Virus
CQLRLRHLNRK

SEQ ID NO: 55392 - protein, 11 aa, BK Virus
RAAWGNLPLMR

SEQ ID NO: 55393 - protein, 11 aa, BK Virus
CYCIDCFTQWF

SEQ ID NO: 55394 - protein, 11 aa, BK Virus
VWIDCYCIDCF

SEQ ID NO: 55395 - protein, 11 aa, BK Virus
LYCKEWPICSK

SEQ ID NO: 55396 - protein, 11 aa, BK Virus
WWVQIIGETPF

SEQ ID NO: 55397 - protein, 11 aa, BK Virus
TWNSSEVCADF

SEQ ID NO: 55398 - protein, 11 aa, BK Virus
VWIDCYCIDCF

SEQ ID NO: 55399 - protein, 11 aa, BK Virus
CYCIDCFTQWF

SEQ ID NO: 55400 - protein, 11 aa, BK Virus
WWVQIIGETPF

SEQ ID NO: 55401 - protein, 11 aa, BK Virus
KFLRKEPLVWI

SEQ ID NO: 55402 - protein, 11 aa, BK Virus
TWNSSEVCADF

SEQ ID NO: 55403 - protein, 11 aa, BK Virus
CYCIDCFTQWF

SEQ ID NO: 55404 - protein, 11 aa, BK Virus
KFLRKEPLVWI

SEQ ID NO: 55405 - protein, 11 aa, BK Virus
TWNSSEVCADF

SEQ ID NO: 55406 - protein, 11 aa, BK Virus
ESMELMDLLGL

SEQ ID NO: 55407 - protein, 11 aa, BK Virus
QIIGETPFRDL

SEQ ID NO: 55408 - protein, 11 aa, BK Virus
ESMELMDLLGL

SEQ ID NO: 55409 - protein, 11 aa, BK Virus
KMKRMNTLYKK

SEQ ID NO: 55410 - protein, 11 aa, BK Virus
LMRKAYLKKCK

SEQ ID NO: 55411 - protein, 11 aa, BK Virus
RLRHLNRKFLR

SEQ ID NO: 55412 - protein, 11 aa, BK Virus
LRHLNRKFLRK

SEQ ID NO: 55413 - protein, 11 aa, BK Virus
LKKCKEFHPDK

SEQ ID NO: 55414 - protein, 11 aa, BK Virus
RLRHLNRKFLR

SEQ ID NO: 55415 - protein, 11 aa, BK Virus
KMKRMNTLYKK

SEQ ID NO: 55416 - protein, 11 aa, BK Virus
RAAWGNLPLMR

SEQ ID NO: 55417 - protein, 11 aa, BK Virus
WVQIIGETPFR

SEQ ID NO: 55418 - protein, 11 aa, BK Virus
LCQLRLRHLNR

SEQ ID NO: 55419 - protein, 11 aa, BK Virus
KAYLKKCKEFH

SEQ ID NO: 55420 - protein, 11 aa, BK Virus
CQLRLRHLNRK

SEQ ID NO: 55421 - protein, 11 aa, BK Virus
LMRKAYLKKCK

SEQ ID NO: 55422 - protein, 11 aa, BK Virus
RLRHLNRKFLR

SEQ ID NO: 55423 - protein, 11 aa, BK Virus
WVQIIGETPFR

SEQ ID NO: 55424 - protein, 11 aa, BK Virus
RAAWGNLPLMR

SEQ ID NO: 55425 - protein, 11 aa, BK Virus
TLYKKMEQDVK

SEQ ID NO: 55426 - protein, 11 aa, BK Virus
NLPLMRKAYLK

SEQ ID NO: 55427 - protein, 11 aa, BK Virus
CPCMLCQLRLR

SEQ ID NO: 55428 - protein, 11 aa, BK Virus
ESMELMDLLGL

SEQ ID NO: 55429 - protein, 11 aa, BK Virus
NSSEVCADFPL

SEQ ID NO: 55430 - protein, 11 aa, BK Virus
ELMDLLGLERA

SEQ ID NO: 55431 - protein, 11 aa, BK Virus
SVHCPCMLCQL

SEQ ID NO: 55432 - protein, 11 aa, BK Virus
CIDCFTQWFGL

SEQ ID NO: 55433 - protein, 11 aa, BK Virus
EPLVWIDCYCI

SEQ ID NO: 55434 - protein, 11 aa, BK Virus
ESMELMDLLGL

SEQ ID NO: 55435 - protein, 11 aa, BK Virus
ELMDLLGLERA

SEQ ID NO: 55436 - protein, 11 aa, BK Virus
DLTEETLQWWV

SEQ ID NO: 55437 - protein, 11 aa, BK Virus
NTLYKKMEQDV

SEQ ID NO: 55438 - protein, 11 aa, BK Virus
QLRLRHLNRKF

SEQ ID NO: 55439 - protein, 11 aa, BK Virus
QLRLRHLNRKF

SEQ ID NO: 55440 - protein, 11 aa, BK Virus
LERAAWGNLPL

SEQ ID NO: 55441 - protein, 11 aa, BK Virus
HPDKGGDEDKM

SEQ ID NO: 55442 - protein, 11 aa, BK Virus
WPICSKKPSVH

SEQ ID NO: 55443 - protein, 11 aa, BK Virus
WWVQIIGETPF

SEQ ID NO: 55444 - protein, 11 aa, BK Virus
REESMELMDLL

SEQ ID NO: 55445 - protein, 11 aa, BK Virus
LERAAWGNLPL

SEQ ID NO: 55446 - protein, 11 aa, BK Virus
DEDKMKRMNTL

SEQ ID NO: 55447 - protein, 11 aa, BK Virus
REESMELMDLL

SEQ ID NO: 55448 - protein, 11 aa, BK Virus
EETLQWWVQII

SEQ ID NO: 55449 - protein, 11 aa, BK Virus
EPLVWIDCYCI

SEQ ID NO: 55450 - protein, 11 aa, BK Virus
EPLVWIDCYCI

SEQ ID NO: 55451 - protein, 11 aa, BK Virus
FPLCPDTLYCK

SEQ ID NO: 55452 - protein, 11 aa, BK Virus
KVAHQPDFGTW

SEQ ID NO: 55453 - protein, 11 aa, BK Virus
RKFLRKEPLVW

SEQ ID NO: 55454 - protein, 8 aa, BK Virus
NSSEVPTY

SEQ ID NO: 55455 - protein, 8 aa, BK Virus
YTFSRMKY

SEQ ID NO: 55456 - protein, 8 aa, BK Virus
KLMEKYSV

SEQ ID NO: 55457 - protein, 8 aa, BK Virus
YMAGVAWL

SEQ ID NO: 55458 - protein, 8 aa, BK Virus
FLLLGMYL

SEQ ID NO: 55459 - protein, 8 aa, BK Virus
YLDGSVKV

SEQ ID NO: 55460 - protein, 8 aa, BK Virus
KLITEYAV

SEQ ID NO: 55461 - protein, 8 aa, BK Virus
YMVVFEDV

SEQ ID NO: 55462 - protein, 8 aa, BK Virus
LLIWFRPV

SEQ ID NO: 55463 - protein, 8 aa, BK Virus
KMDLIFGA

SEQ ID NO: 55464 - protein, 8 aa, BK Virus
RTLACFAV

SEQ ID NO: 55465 - protein, 8 aa, BK Virus
YLEFQYNV

SEQ ID NO: 55466 - protein, 8 aa, BK Virus
VTMNEYPV

SEQ ID NO: 55467 - protein, 8 aa, BK Virus
FLLEKRIL

SEQ ID NO: 55468 - protein, 8 aa, BK Virus
FANAIIFA

SEQ ID NO: 55469 - protein, 8 aa, BK Virus
YLLYSALT

SEQ ID NO: 55470 - protein, 8 aa, BK Virus
SLQNSEFL

SEQ ID NO: 55471 - protein, 8 aa, BK Virus
ELMDLLGL

SEQ ID NO: 55472 - protein, 8 aa, BK Virus
KLCTFSFL

SEQ ID NO: 55473 - protein, 8 aa, BK Virus
RLTFELGV

SEQ ID NO: 55474 - protein, 8 aa, BK Virus
LLPKMDSV

SEQ ID NO: 55475 - protein, 8 aa, BK Virus
AIDQYMVV

SEQ ID NO: 55476 - protein, 8 aa, BK Virus
ILDKMDLI

SEQ ID NO: 55477 - protein, 8 aa, BK Virus
GTWNSSEV

SEQ ID NO: 55478 - protein, 8 aa, BK Virus
RLDSEISM

SEQ ID NO: 55479 - protein, 8 aa, BK Virus
ILQSGMTL

SEQ ID NO: 55480 - protein, 8 aa, BK Virus
GMTLLLLL

SEQ ID NO: 55481 - protein, 8 aa, BK Virus
FLSQAVFS

SEQ ID NO: 55482 - protein, 8 aa, BK Virus
AAWGNLPL

SEQ ID NO: 55483 - protein, 8 aa, BK Virus
ALNVNLPM

SEQ ID NO: 55484 - protein, 8 aa, BK Virus
SMYTFSRM

SEQ ID NO: 55485 - protein, 8 aa, BK Virus
MTLLLLLI

SEQ ID NO: 55486 - protein, 8 aa, BK Virus
KMEQDVKV

SEQ ID NO: 55487 - protein, 8 aa, BK Virus
YMAGVAWL

SEQ ID NO: 55488 - protein, 8 aa, BK Virus
KLMEKYSV

SEQ ID NO: 55489 - protein, 8 aa, BK Virus
YLEFQYNV

SEQ ID NO: 55490 - protein, 8 aa, BK Virus
FLLLGMYL

SEQ ID NO: 55491 - protein, 8 aa, BK Virus
KLITEYAV

SEQ ID NO: 55492 - protein, 8 aa, BK Virus
ELMDLLGL

SEQ ID NO: 55493 - protein, 8 aa, BK Virus
FLSQAVFS

SEQ ID NO: 55494 - protein, 8 aa, BK Virus
FANAIIFA

SEQ ID NO: 55495 - protein, 8 aa, BK Virus
KLCTFSFL

SEQ ID NO: 55496 - protein, 8 aa, BK Virus
LLPKMDSV

SEQ ID NO: 55497 - protein, 8 aa, BK Virus
YLDGSVKV

SEQ ID NO: 55498 - protein, 8 aa, BK Virus
SLQNSEFL

SEQ ID NO: 55499 - protein, 8 aa, BK Virus
LQSGMTLL

SEQ ID NO: 55500 - protein, 8 aa, BK Virus
KMDLIFGA

SEQ ID NO: 55501 - protein, 8 aa, BK Virus
RLTFELGV

SEQ ID NO: 55502 - protein, 8 aa, BK Virus
GMTLLLLL

SEQ ID NO: 55503 - protein, 8 aa, BK Virus
LLIWFRPV

SEQ ID NO: 55504 - protein, 8 aa, BK Virus
SMELMDLL

SEQ ID NO: 55505 - protein, 8 aa, BK Virus
YMVVFEDV

SEQ ID NO: 55506 - protein, 8 aa, BK Virus
LQNSEFLL

SEQ ID NO: 55507 - protein, 8 aa, BK Virus
FLLEKRIL

SEQ ID NO: 55508 - protein, 8 aa, BK Virus
KMKRMNTL

SEQ ID NO: 55509 - protein, 8 aa, BK Virus
ILDKMDLI

SEQ ID NO: 55510 - protein, 8 aa, BK Virus
GVAWLHCL

SEQ ID NO: 55511 - protein, 8 aa, BK Virus
GINNLDSL

SEQ ID NO: 55512 - protein, 8 aa, BK Virus
FISRHMCA

SEQ ID NO: 55513 - protein, 8 aa, BK Virus
HLNKRTQI

SEQ ID NO: 55514 - protein, 8 aa, BK Virus
FGAHGNAV

SEQ ID NO: 55515 - protein, 8 aa, BK Virus
ILQSGMTL

SEQ ID NO: 55516 - protein, 8 aa, BK Virus
VTMNEYPV

SEQ ID NO: 55517 - protein, 8 aa, BK Virus
GVNKEYLL

SEQ ID NO: 55518 - protein, 8 aa, BK Virus
ALNVNLPM

SEQ ID NO: 55519 - protein, 8 aa, BK Virus
HMTREEML

SEQ ID NO: 55520 - protein, 8 aa, BK Virus
KMEQDVKV

SEQ ID NO: 55521 - protein, 8 aa, BK Virus
PLMRKAYL

SEQ ID NO: 55522 - protein, 8 aa, BK Virus
RLDSEISM

SEQ ID NO: 55523 - protein, 8 aa, BK Virus
HQFLSQAV

SEQ ID NO: 55524 - protein, 8 aa, BK Virus
AIDQYMVV

SEQ ID NO: 55525 - protein, 8 aa, BK Virus
RTLACFAV

SEQ ID NO: 55526 - protein, 8 aa, BK Virus
SMYTFSRM

SEQ ID NO: 55527 - protein, 8 aa, BK Virus
VAIDQYMV

SEQ ID NO: 55528 - protein, 8 aa, BK Virus
YMAGVAWL

SEQ ID NO: 55529 - protein, 8 aa, BK Virus
LLIWFRPV

SEQ ID NO: 55530 - protein, 8 aa, BK Virus
KLMEKYSV

SEQ ID NO: 55531 - protein, 8 aa, BK Virus
YLDGSVKV

SEQ ID NO: 55532 - protein, 8 aa, BK Virus
RLTFELGV

SEQ ID NO: 55533 - protein, 8 aa, BK Virus
FLLLGMYL

SEQ ID NO: 55534 - protein, 8 aa, BK Virus
KLITEYAV

SEQ ID NO: 55535 - protein, 8 aa, BK Virus
LLPKMDSV

SEQ ID NO: 55536 - protein, 8 aa, BK Virus
YLEFQYNV

SEQ ID NO: 55537 - protein, 8 aa, BK Virus
KMKRMNTL

SEQ ID NO: 55538 - protein, 8 aa, BK Virus
YMVVFEDV

SEQ ID NO: 55539 - protein, 8 aa, BK Virus
ELMDLLGL

SEQ ID NO: 55540 - protein, 8 aa, BK Virus
ILQSGMTL

SEQ ID NO: 55541 - protein, 8 aa, BK Virus
FANAIIFA

SEQ ID NO: 55542 - protein, 8 aa, BK Virus
FISRHMCA

SEQ ID NO: 55543 - protein, 8 aa, BK Virus
HLNKRTQI

SEQ ID NO: 55544 - protein, 8 aa, BK Virus
SMYTFSRM

SEQ ID NO: 55545 - protein, 8 aa, BK Virus
FLLEKRIL

SEQ ID NO: 55546 - protein, 8 aa, BK Virus
KMDLIFGA

SEQ ID NO: 55547 - protein, 8 aa, BK Virus
LQSGMTLL

SEQ ID NO: 55548 - protein, 8 aa, BK Virus
KLCTFSFL

SEQ ID NO: 55549 - protein, 8 aa, BK Virus
GVAWLHCL

SEQ ID NO: 55550 - protein, 8 aa, BK Virus
ALNVNLPM

SEQ ID NO: 55551 - protein, 8 aa, BK Virus
HMCAGHNI

SEQ ID NO: 55552 - protein, 8 aa, BK Virus
VTMNEYPV

SEQ ID NO: 55553 - protein, 8 aa, BK Virus
GMTLLLLL

SEQ ID NO: 55554 - protein, 8 aa, BK Virus
QIFPPGLV

SEQ ID NO: 55555 - protein, 8 aa, BK Virus
FLSQAVFS

SEQ ID NO: 55556 - protein, 8 aa, BK Virus
HQFLSQAV

SEQ ID NO: 55557 - protein, 8 aa, BK Virus
GINNLDSL

SEQ ID NO: 55558 - protein, 8 aa, BK Virus
SLQNSEFL

SEQ ID NO: 55559 - protein, 8 aa, BK Virus
AIDQYMVV

SEQ ID NO: 55560 - protein, 8 aa, BK Virus
RTLACFAV

SEQ ID NO: 55561 - protein, 8 aa, BK Virus
VAIDQYMV

SEQ ID NO: 55562 - protein, 8 aa, BK Virus
KIYLRKSL

SEQ ID NO: 55563 - protein, 8 aa, BK Virus
ILDKMDLI

SEQ ID NO: 55564 - protein, 8 aa, BK Virus
SQVSDTSA

SEQ ID NO: 55565 - protein, 8 aa, BK Virus
YLLYSALT

SEQ ID NO: 55566 - protein, 8 aa, BK Virus
LTPHRHRV

SEQ ID NO: 55567 - protein, 8 aa, BK Virus
KMEQDVKV

SEQ ID NO: 55568 - protein, 8 aa, BK Virus
RMKYNICM

SEQ ID NO: 55569 - protein, 8 aa, BK Virus
KLMEKYSV

SEQ ID NO: 55570 - protein, 8 aa, BK Virus
YMAGVAWL

SEQ ID NO: 55571 - protein, 8 aa, BK Virus
KLITEYAV

SEQ ID NO: 55572 - protein, 8 aa, BK Virus
VTMNEYPV

SEQ ID NO: 55573 - protein, 8 aa, BK Virus
LLIWFRPV

SEQ ID NO: 55574 - protein, 8 aa, BK Virus
KMEQDVKV

SEQ ID NO: 55575 - protein, 8 aa, BK Virus
FLLLGMYL

SEQ ID NO: 55576 - protein, 8 aa, BK Virus
ILQSGMTL

SEQ ID NO: 55577 - protein, 8 aa, BK Virus
YLDGSVKV

SEQ ID NO: 55578 - protein, 8 aa, BK Virus
SLQNSEFL

SEQ ID NO: 55579 - protein, 8 aa, BK Virus
FLLEKRIL

SEQ ID NO: 55580 - protein, 8 aa, BK Virus
YLEFQYNV

SEQ ID NO: 55581 - protein, 8 aa, BK Virus
KLCTFSFL

SEQ ID NO: 55582 - protein, 8 aa, BK Virus
ELMDLLGL

SEQ ID NO: 55583 - protein, 8 aa, BK Virus
YMVVFEDV

SEQ ID NO: 55584 - protein, 8 aa, BK Virus
VAIDQYMV

SEQ ID NO: 55585 - protein, 8 aa, BK Virus
KTLQARFV

SEQ ID NO: 55586 - protein, 8 aa, BK Virus
RTLACFAV

SEQ ID NO: 55587 - protein, 8 aa, BK Virus
LLPKMDSV

SEQ ID NO: 55588 - protein, 8 aa, BK Virus
AIDQYMVV

SEQ ID NO: 55589 - protein, 8 aa, BK Virus
RLTFELGV

SEQ ID NO: 55590 - protein, 8 aa, BK Virus
KMKRMNTL

SEQ ID NO: 55591 - protein, 8 aa, BK Virus
KLMEKYSV

SEQ ID NO: 55592 - protein, 8 aa, BK Virus
RTLACFAV

SEQ ID NO: 55593 - protein, 8 aa, BK Virus
KLITEYAV

SEQ ID NO: 55594 - protein, 8 aa, BK Virus
LLIWFRPV

SEQ ID NO: 55595 - protein, 8 aa, BK Virus
FLLLGMYL

SEQ ID NO: 55596 - protein, 8 aa, BK Virus
SQVSDTSA

SEQ ID NO: 55597 - protein, 8 aa, BK Virus
YLDGSVKV

SEQ ID NO: 55598 - protein, 8 aa, BK Virus
YMAGVAWL

SEQ ID NO: 55599 - protein, 8 aa, BK Virus
YMVVFEDV

SEQ ID NO: 55600 - protein, 8 aa, BK Virus
KQVSWKLI

SEQ ID NO: 55601 - protein, 8 aa, BK Virus
HQFLSQAV

SEQ ID NO: 55602 - protein, 8 aa, BK Virus
KMDLIFGA

SEQ ID NO: 55603 - protein, 8 aa, BK Virus
LQSGMTLL

SEQ ID NO: 55604 - protein, 8 aa, BK Virus
FQYNVEEC

SEQ ID NO: 55605 - protein, 8 aa, BK Virus
RLTFELGV

SEQ ID NO: 55606 - protein, 8 aa, BK Virus
LLPKMDSV

SEQ ID NO: 55607 - protein, 8 aa, BK Virus
LQNSEFLL

SEQ ID NO: 55608 - protein, 8 aa, BK Virus
CQQAVDTV

SEQ ID NO: 55609 - protein, 8 aa, BK Virus
FANAIIFA

SEQ ID NO: 55610 - protein, 8 aa, BK Virus
AIDQYMVV

SEQ ID NO: 55611 - protein, 8 aa, BK Virus
GTWNSSEV

SEQ ID NO: 55612 - protein, 8 aa, BK Virus
VTMNEYPV

SEQ ID NO: 55613 - protein, 8 aa, BK Virus
YLEFQYNV

SEQ ID NO: 55614 - protein, 8 aa, BK Virus
ELMDLLGL

SEQ ID NO: 55615 - protein, 8 aa, BK Virus
KTLQARFV

SEQ ID NO: 55616 - protein, 8 aa, BK Virus
VAIDQYMV

SEQ ID NO: 55617 - protein, 8 aa, BK Virus
AAWGNLPL

SEQ ID NO: 55618 - protein, 8 aa, BK Virus
AVLEQYMA

SEQ ID NO: 55619 - protein, 8 aa, BK Virus
FLLEKRIL

SEQ ID NO: 55620 - protein, 8 aa, BK Virus
MTLLLLLI

SEQ ID NO: 55621 - protein, 8 aa, BK Virus
KLCTFSFL

SEQ ID NO: 55622 - protein, 8 aa, BK Virus
FISRHMCA

SEQ ID NO: 55623 - protein, 8 aa, BK Virus
TQIFPPGL

SEQ ID NO: 55624 - protein, 8 aa, BK Virus
FGAHGNAV

SEQ ID NO: 55625 - protein, 8 aa, BK Virus
KSICQQAV

SEQ ID NO: 55626 - protein, 8 aa, BK Virus
ILDKMDLI

SEQ ID NO: 55627 - protein, 8 aa, BK Virus
QIFPPGLV

SEQ ID NO: 55628 - protein, 8 aa, BK Virus
GVAWLHCL

SEQ ID NO: 55629 - protein, 8 aa, BK Virus
YLLYSALT

SEQ ID NO: 55630 - protein, 8 aa, BK Virus
ILQSGMTL

SEQ ID NO: 55631 - protein, 8 aa, BK Virus
QQAVDTVL

SEQ ID NO: 55632 - protein, 8 aa, BK Virus
FLSQAVFS

SEQ ID NO: 55633 - protein, 8 aa, BK Virus
AQILYKKL

SEQ ID NO: 55634 - protein, 8 aa, BK Virus
KMEQDVKV

SEQ ID NO: 55635 - protein, 8 aa, BK Virus
YLDGSVKV

SEQ ID NO: 55636 - protein, 8 aa, BK Virus
YMAGVAWL

SEQ ID NO: 55637 - protein, 8 aa, BK Virus
KLMEKYSV

SEQ ID NO: 55638 - protein, 8 aa, BK Virus
FLLLGMYL

SEQ ID NO: 55639 - protein, 8 aa, BK Virus
LLIWFRPV

SEQ ID NO: 55640 - protein, 8 aa, BK Virus
AIDQYMVV

SEQ ID NO: 55641 - protein, 8 aa, BK Virus
KLITEYAV

SEQ ID NO: 55642 - protein, 8 aa, BK Virus
ELMDLLGL

SEQ ID NO: 55643 - protein, 8 aa, BK Virus
LLPKMDSV

SEQ ID NO: 55644 - protein, 8 aa, BK Virus
RLTFELGV

SEQ ID NO: 55645 - protein, 8 aa, BK Virus
YLEFQYNV

SEQ ID NO: 55646 - protein, 8 aa, BK Virus
SLQNSEFL

SEQ ID NO: 55647 - protein, 8 aa, BK Virus
ILQSGMTL

SEQ ID NO: 55648 - protein, 8 aa, BK Virus
YMVVFEDV

SEQ ID NO: 55649 - protein, 8 aa, BK Virus
FLLEKRIL

SEQ ID NO: 55650 - protein, 8 aa, BK Virus
RLDSEISM

SEQ ID NO: 55651 - protein, 8 aa, BK Virus
KMEQDVKV

SEQ ID NO: 55652 - protein, 8 aa, BK Virus
ILDKMDLI

SEQ ID NO: 55653 - protein, 8 aa, BK Virus
GMTLLLLL

SEQ ID NO: 55654 - protein, 8 aa, BK Virus
KLCTFSFL

SEQ ID NO: 55655 - protein, 8 aa, BK Virus
QIFPPGLV

SEQ ID NO: 55656 - protein, 8 aa, BK Virus
SMYTFSRM

SEQ ID NO: 55657 - protein, 8 aa, BK Virus
KMDLIFGA

SEQ ID NO: 55658 - protein, 8 aa, BK Virus
VAIDQYMV

SEQ ID NO: 55659 - protein, 8 aa, BK Virus
DLLGLERA

SEQ ID NO: 55660 - protein, 8 aa, BK Virus
GTWNSSEV

SEQ ID NO: 55661 - protein, 8 aa, BK Virus
GVAWLHCL

SEQ ID NO: 55662 - protein, 8 aa, BK Virus
DLPSGHGI

SEQ ID NO: 55663 - protein, 8 aa, BK Virus
RTLACFAV

SEQ ID NO: 55664 - protein, 8 aa, BK Virus
DLCGGKAL

SEQ ID NO: 55665 - protein, 8 aa, BK Virus
YLLYSALT

SEQ ID NO: 55666 - protein, 8 aa, BK Virus
KTLQARFV

SEQ ID NO: 55667 - protein, 8 aa, BK Virus
HMTREEML

SEQ ID NO: 55668 - protein, 8 aa, BK Virus
PLMRKAYL

SEQ ID NO: 55669 - protein, 8 aa, BK Virus
IFDFLHCV

SEQ ID NO: 55670 - protein, 8 aa, BK Virus
HLNKRTQI

SEQ ID NO: 55671 - protein, 8 aa, BK Virus
AAWGNLPL

SEQ ID NO: 55672 - protein, 8 aa, BK Virus
SMELMDLL

SEQ ID NO: 55673 - protein, 8 aa, BK Virus
TLYKKMEQ

SEQ ID NO: 55674 - protein, 8 aa, BK Virus
HMCAGHNI

SEQ ID NO: 55675 - protein, 8 aa, BK Virus
LLLLLIWF

SEQ ID NO: 55676 - protein, 8 aa, BK Virus
FLSQAVFS

SEQ ID NO: 55677 - protein, 8 aa, BK Virus
AVLEQYMA

SEQ ID NO: 55678 - protein, 8 aa, BK Virus
VIFDFLHC

SEQ ID NO: 55679 - protein, 8 aa, BK Virus
TVLAKKRV

SEQ ID NO: 55680 - protein, 8 aa, BK Virus
KMKRMNTL

SEQ ID NO: 55681 - protein, 8 aa, BK Virus
LLLGMYLE

SEQ ID NO: 55682 - protein, 8 aa, BK Virus
ALNVNLPM

SEQ ID NO: 55683 - protein, 8 aa, BK Virus
HILDKMDL

SEQ ID NO: 55684 - protein, 8 aa, BK Virus
VTMNEYPV

SEQ ID NO: 55685 - protein, 8 aa, BK Virus
AVFSNRTL

SEQ ID NO: 55686 - protein, 8 aa, BK Virus
FISRHMCA

SEQ ID NO: 55687 - protein, 8 aa, BK Virus
LTPHRHRV

SEQ ID NO: 55688 - protein, 8 aa, BK Virus
KIYLRKSL

SEQ ID NO: 55689 - protein, 8 aa, BK Virus
VLNREESM

SEQ ID NO: 55690 - protein, 8 aa, BK Virus
GINNLDSL

SEQ ID NO: 55691 - protein, 8 aa, BK Virus
GMYLEFQY

SEQ ID NO: 55692 - protein, 8 aa, BK Virus
RVDTLHMT

SEQ ID NO: 55693 - protein, 8 aa, BK Virus
DLHQFLSQ

SEQ ID NO: 55694 - protein, 8 aa, BK Virus
KMDSVIFD

SEQ ID NO: 55695 - protein, 8 aa, BK Virus
HLCKGFQC

SEQ ID NO: 55696 - protein, 8 aa, BK Virus
LLGMYLEF

SEQ ID NO: 55697 - protein, 8 aa, BK Virus
LLLLIWFR

SEQ ID NO: 55698 - protein, 8 aa, BK Virus
GLLDLCGG

SEQ ID NO: 55699 - protein, 8 aa, BK Virus
YLDGSVKV

SEQ ID NO: 55700 - protein, 8 aa, BK Virus
YMAGVAWL

SEQ ID NO: 55701 - protein, 8 aa, BK Virus
KLMEKYSV

SEQ ID NO: 55702 - protein, 8 aa, BK Virus
FLLLGMYL

SEQ ID NO: 55703 - protein, 8 aa, BK Virus
LLPKMDSV

SEQ ID NO: 55704 - protein, 8 aa, BK Virus
YMVVFEDV

SEQ ID NO: 55705 - protein, 8 aa, BK Virus
YLEFQYNV

SEQ ID NO: 55706 - protein, 8 aa, BK Virus
LLIWFRPV

SEQ ID NO: 55707 - protein, 8 aa, BK Virus
FLLEKRIL

SEQ ID NO: 55708 - protein, 8 aa, BK Virus
KLITEYAV

SEQ ID NO: 55709 - protein, 8 aa, BK Virus
AIDQYMVV

SEQ ID NO: 55710 - protein, 8 aa, BK Virus
ELMDLLGL

SEQ ID NO: 55711 - protein, 8 aa, BK Virus
ILQSGMTL

SEQ ID NO: 55712 - protein, 8 aa, BK Virus
RLTFELGV

SEQ ID NO: 55713 - protein, 8 aa, BK Virus
SLQNSEFL

SEQ ID NO: 55714 - protein, 8 aa, BK Virus
SMYTFSRM

SEQ ID NO: 55715 - protein, 8 aa, BK Virus
VAIDQYMV

SEQ ID NO: 55716 - protein, 8 aa, BK Virus
KMEQDVKV

SEQ ID NO: 55717 - protein, 8 aa, BK Virus
HMTREEML

SEQ ID NO: 55718 - protein, 8 aa, BK Virus
RLDSEISM

SEQ ID NO: 55719 - protein, 8 aa, BK Virus
HILDKMDL

SEQ ID NO: 55720 - protein, 8 aa, BK Virus
VLNREESM

SEQ ID NO: 55721 - protein, 8 aa, BK Virus
FISRHMCA

SEQ ID NO: 55722 - protein, 8 aa, BK Virus
VIFDFLHC

SEQ ID NO: 55723 - protein, 8 aa, BK Virus
KLCTFSFL

SEQ ID NO: 55724 - protein, 8 aa, BK Virus
ILDKMDLI

SEQ ID NO: 55725 - protein, 8 aa, BK Virus
PLMRKAYL

SEQ ID NO: 55726 - protein, 8 aa, BK Virus
KMDLIFGA

SEQ ID NO: 55727 - protein, 8 aa, BK Virus
KMKRMNTL

SEQ ID NO: 55728 - protein, 8 aa, BK Virus
QIFPPGLV

SEQ ID NO: 55729 - protein, 8 aa, BK Virus
GMTLLLLL

SEQ ID NO: 55730 - protein, 8 aa, BK Virus
VTMNEYPV

SEQ ID NO: 55731 - protein, 8 aa, BK Virus
HMCAGHNI

SEQ ID NO: 55732 - protein, 8 aa, BK Virus
DLLGLERA

SEQ ID NO: 55733 - protein, 8 aa, BK Virus
DLCGGKAL

SEQ ID NO: 55734 - protein, 8 aa, BK Virus
GTWNSSEV

SEQ ID NO: 55735 - protein, 8 aa, BK Virus
TLYKKMEQ

SEQ ID NO: 55736 - protein, 8 aa, BK Virus
DLPSGHGI

SEQ ID NO: 55737 - protein, 8 aa, BK Virus
AAWGNLPL

SEQ ID NO: 55738 - protein, 8 aa, BK Virus
GVAWLHCL

SEQ ID NO: 55739 - protein, 8 aa, BK Virus
YLLYSALT

SEQ ID NO: 55740 - protein, 8 aa, BK Virus
LLLGMYLE

SEQ ID NO: 55741 - protein, 8 aa, BK Virus
HLNKRTQI

SEQ ID NO: 55742 - protein, 8 aa, BK Virus
LTPHRHRV

SEQ ID NO: 55743 - protein, 8 aa, BK Virus
RTLACFAV

SEQ ID NO: 55744 - protein, 8 aa, BK Virus
FGAHGNAV

SEQ ID NO: 55745 - protein, 8 aa, BK Virus
FLSQAVFS

SEQ ID NO: 55746 - protein, 8 aa, BK Virus
SMELMDLL

SEQ ID NO: 55747 - protein, 8 aa, BK Virus
YLDGSVKV

SEQ ID NO: 55748 - protein, 8 aa, BK Virus
YMAGVAWL

SEQ ID NO: 55749 - protein, 8 aa, BK Virus
KLMEKYSV

SEQ ID NO: 55750 - protein, 8 aa, BK Virus
LLPKMDSV

SEQ ID NO: 55751 - protein, 8 aa, BK Virus
FLLLGMYL

SEQ ID NO: 55752 - protein, 8 aa, BK Virus
YLEFQYNV

SEQ ID NO: 55753 - protein, 8 aa, BK Virus
SLQNSEFL

SEQ ID NO: 55754 - protein, 8 aa, BK Virus
ILQSGMTL

SEQ ID NO: 55755 - protein, 8 aa, BK Virus
KLITEYAV

SEQ ID NO: 55756 - protein, 8 aa, BK Virus
AIDQYMVV

SEQ ID NO: 55757 - protein, 8 aa, BK Virus
PLMRKAYL

SEQ ID NO: 55758 - protein, 8 aa, BK Virus
LLIWFRPV

SEQ ID NO: 55759 - protein, 8 aa, BK Virus
KLCTFSFL

SEQ ID NO: 55760 - protein, 8 aa, BK Virus
ELMDLLGL

SEQ ID NO: 55761 - protein, 8 aa, BK Virus
GTWNSSEV

SEQ ID NO: 55762 - protein, 8 aa, BK Virus
KMEQDVKV

SEQ ID NO: 55763 - protein, 8 aa, BK Virus
RLTFELGV

SEQ ID NO: 55764 - protein, 8 aa, BK Virus
YMVVFEDV

SEQ ID NO: 55765 - protein, 8 aa, BK Virus
FLLEKRIL

SEQ ID NO: 55766 - protein, 8 aa, BK Virus
QIFPPGLV

SEQ ID NO: 55767 - protein, 8 aa, BK Virus
HLNKRTQI

SEQ ID NO: 55768 - protein, 8 aa, BK Virus
ILDKMDLI

SEQ ID NO: 55769 - protein, 8 aa, BK Virus
TLYKKMEQ

SEQ ID NO: 55770 - protein, 8 aa, BK Virus
KMKRMNTL

SEQ ID NO: 55771 - protein, 8 aa, BK Virus
SMYTFSRM

SEQ ID NO: 55772 - protein, 8 aa, BK Virus
RLDSEISM

SEQ ID NO: 55773 - protein, 8 aa, BK Virus
HMTREEML

SEQ ID NO: 55774 - protein, 8 aa, BK Virus
AAWGNLPL

SEQ ID NO: 55775 - protein, 8 aa, BK Virus
DLCGGKAL

SEQ ID NO: 55776 - protein, 8 aa, BK Virus
GMTLLLLL

SEQ ID NO: 55777 - protein, 8 aa, BK Virus
VAIDQYMV

SEQ ID NO: 55778 - protein, 8 aa, BK Virus
TVLAKKRV

SEQ ID NO: 55779 - protein, 8 aa, BK Virus
LTPHRHRV

SEQ ID NO: 55780 - protein, 8 aa, BK Virus
DLLGLERA

SEQ ID NO: 55781 - protein, 8 aa, BK Virus
DLPSGHGI

SEQ ID NO: 55782 - protein, 8 aa, BK Virus
KTLQARFV

SEQ ID NO: 55783 - protein, 8 aa, BK Virus
SMELMDLL

SEQ ID NO: 55784 - protein, 8 aa, BK Virus
GVAWLHCL

SEQ ID NO: 55785 - protein, 8 aa, BK Virus
AVFSNRTL

SEQ ID NO: 55786 - protein, 8 aa, BK Virus
HMCAGHNI

SEQ ID NO: 55787 - protein, 8 aa, BK Virus
VTMNEYPV

SEQ ID NO: 55788 - protein, 8 aa, BK Virus
FLSQAVFS

SEQ ID NO: 55789 - protein, 8 aa, BK Virus
YLLYSALT

SEQ ID NO: 55790 - protein, 8 aa, BK Virus
GINNLDSL

SEQ ID NO: 55791 - protein, 8 aa, BK Virus
FISRHMCA

SEQ ID NO: 55792 - protein, 8 aa, BK Virus
KIYLRKSL

SEQ ID NO: 55793 - protein, 8 aa, BK Virus
RTLACFAV

SEQ ID NO: 55794 - protein, 8 aa, BK Virus
HLCKGFQC

SEQ ID NO: 55795 - protein, 8 aa, BK Virus
ALNVNLPM

SEQ ID NO: 55796 - protein, 8 aa, BK Virus
KMDLIFGA

SEQ ID NO: 55797 - protein, 8 aa, BK Virus
IFDFLHCV

SEQ ID NO: 55798 - protein, 8 aa, BK Virus
VLNREESM

SEQ ID NO: 55799 - protein, 8 aa, BK Virus
YLDGSVKV

SEQ ID NO: 55800 - protein, 8 aa, BK Virus
YMAGVAWL

SEQ ID NO: 55801 - protein, 8 aa, BK Virus
FLLLGMYL

SEQ ID NO: 55802 - protein, 8 aa, BK Virus
ELMDLLGL

SEQ ID NO: 55803 - protein, 8 aa, BK Virus
KLMEKYSV

SEQ ID NO: 55804 - protein, 8 aa, BK Virus
ILQSGMTL

SEQ ID NO: 55805 - protein, 8 aa, BK Virus
LLPKMDSV

SEQ ID NO: 55806 - protein, 8 aa, BK Virus
YLEFQYNV

SEQ ID NO: 55807 - protein, 8 aa, BK Virus
SLQNSEFL

SEQ ID NO: 55808 - protein, 8 aa, BK Virus
AIDQYMVV

SEQ ID NO: 55809 - protein, 8 aa, BK Virus
KLITEYAV

SEQ ID NO: 55810 - protein, 8 aa, BK Virus
AAWGNLPL

SEQ ID NO: 55811 - protein, 8 aa, BK Virus
RLTFELGV

SEQ ID NO: 55812 - protein, 8 aa, BK Virus
PLMRKAYL

SEQ ID NO: 55813 - protein, 8 aa, BK Virus
RLDSEISM

SEQ ID NO: 55814 - protein, 8 aa, BK Virus
ILDKMDLI

SEQ ID NO: 55815 - protein, 8 aa, BK Virus
YMVVFEDV

SEQ ID NO: 55816 - protein, 8 aa, BK Virus
LLIWFRPV

SEQ ID NO: 55817 - protein, 8 aa, BK Virus
FLLEKRIL

SEQ ID NO: 55818 - protein, 8 aa, BK Virus
DLPSGHGI

SEQ ID NO: 55819 - protein, 8 aa, BK Virus
GTWNSSEV

SEQ ID NO: 55820 - protein, 8 aa, BK Virus
VAIDQYMV

SEQ ID NO: 55821 - protein, 8 aa, BK Virus
HMTREEML

SEQ ID NO: 55822 - protein, 8 aa, BK Virus
KMDLIFGA

SEQ ID NO: 55823 - protein, 8 aa, BK Virus
IFDFLHCV

SEQ ID NO: 55824 - protein, 8 aa, BK Virus
GMTLLLLL

SEQ ID NO: 55825 - protein, 8 aa, BK Virus
RMNTLYKK

SEQ ID NO: 55826 - protein, 8 aa, BK Virus
LLYSALTR

SEQ ID NO: 55827 - protein, 8 aa, BK Virus
LMRKAYLK

SEQ ID NO: 55828 - protein, 8 aa, BK Virus
WLHCLLPK

SEQ ID NO: 55829 - protein, 8 aa, BK Virus
AINNFCQK

SEQ ID NO: 55830 - protein, 8 aa, BK Virus
AVYTTKEK

SEQ ID NO: 55831 - protein, 8 aa, BK Virus
LLLLIWFR

SEQ ID NO: 55832 - protein, 8 aa, BK Virus
RFNHILDK

SEQ ID NO: 55833 - protein, 8 aa, BK Virus
GMYLEFQY

SEQ ID NO: 55834 - protein, 8 aa, BK Virus
KAYLKKCK

SEQ ID NO: 55835 - protein, 8 aa, BK Virus
ISMYTFSR

SEQ ID NO: 55836 - protein, 8 aa, BK Virus
VVFNVPKR

SEQ ID NO: 55837 - protein, 8 aa, BK Virus
SQHSTPPK

SEQ ID NO: 55838 - protein, 8 aa, BK Virus
TLACFAVY

SEQ ID NO: 55839 - protein, 8 aa, BK Virus
LICKGVNK

SEQ ID NO: 55840 - protein, 8 aa, BK Virus
IIFFLTPH

SEQ ID NO: 55841 - protein, 8 aa, BK Virus
CVVFNVPK

SEQ ID NO: 55842 - protein, 8 aa, BK Virus
AINNFCQK

SEQ ID NO: 55843 - protein, 8 aa, BK Virus
AVYTTKEK

SEQ ID NO: 55844 - protein, 8 aa, BK Virus
SQHSTPPK

SEQ ID NO: 55845 - protein, 8 aa, BK Virus
AIIFAESK

SEQ ID NO: 55846 - protein, 8 aa, BK Virus
AVDTVLAK

SEQ ID NO: 55847 - protein, 8 aa, BK Virus
RMNTLYKK

SEQ ID NO: 55848 - protein, 8 aa, BK Virus
ISMYTFSR

SEQ ID NO: 55849 - protein, 8 aa, BK Virus
RQIDFRPK

SEQ ID NO: 55850 - protein, 8 aa, BK Virus
SVKVNLEK

SEQ ID NO: 55851 - protein, 8 aa, BK Virus
KAQILYKK

SEQ ID NO: 55852 - protein, 8 aa, BK Virus
CVVFNVPK

SEQ ID NO: 55853 - protein, 8 aa, BK Virus
SQELHLCK

SEQ ID NO: 55854 - protein, 8 aa, BK Virus
KAYLKKCK

SEQ ID NO: 55855 - protein, 8 aa, BK Virus
TFSFLICK

SEQ ID NO: 55856 - protein, 8 aa, BK Virus
VVFNVPKR

SEQ ID NO: 55857 - protein, 8 aa, BK Virus
TLQARFVR

SEQ ID NO: 55858 - protein, 8 aa, BK Virus
MVVFEDVK

SEQ ID NO: 55859 - protein, 8 aa, BK Virus
SVIFDFLH

SEQ ID NO: 55860 - protein, 8 aa, BK Virus
LICKGVNK

SEQ ID NO: 55861 - protein, 8 aa, BK Virus
NSEFLLEK

SEQ ID NO: 55862 - protein, 8 aa, BK Virus
YTFSRMKY

SEQ ID NO: 55863 - protein, 8 aa, BK Virus
SQAVFSNR

SEQ ID NO: 55864 - protein, 8 aa, BK Virus
NVNLPMER

SEQ ID NO: 55865 - protein, 8 aa, BK Virus
WLHCLLPK

SEQ ID NO: 55866 - protein, 8 aa, BK Virus
GMYLEFQY

SEQ ID NO: 55867 - protein, 8 aa, BK Virus
KYNICMGK

SEQ ID NO: 55868 - protein, 8 aa, BK Virus
ESIQGGLK

SEQ ID NO: 55869 - protein, 8 aa, BK Virus
LLLLIWFR

SEQ ID NO: 55870 - protein, 8 aa, BK Virus
KRMNTLYK

SEQ ID NO: 55871 - protein, 8 aa, BK Virus
FQCFKRPK

SEQ ID NO: 55872 - protein, 8 aa, BK Virus
LMRKAYLK

SEQ ID NO: 55873 - protein, 8 aa, BK Virus
RFNHILDK

SEQ ID NO: 55874 - protein, 8 aa, BK Virus
DFLHCVVF

SEQ ID NO: 55875 - protein, 8 aa, BK Virus
RFVRQIDF

SEQ ID NO: 55876 - protein, 8 aa, BK Virus
MYTFSRMK

SEQ ID NO: 55877 - protein, 8 aa, BK Virus
HFANAIIF

SEQ ID NO: 55878 - protein, 8 aa, BK Virus
LYKKLMEK

SEQ ID NO: 55879 - protein, 8 aa, BK Virus
LFCHEDMF

SEQ ID NO: 55880 - protein, 8 aa, BK Virus
DYLDGSVK

SEQ ID NO: 55881 - protein, 8 aa, BK Virus
WFRPVADF

SEQ ID NO: 55882 - protein, 8 aa, BK Virus
EYLLYSAL

SEQ ID NO: 55883 - protein, 8 aa, BK Virus
KYNICMGK

SEQ ID NO: 55884 - protein, 8 aa, BK Virus
RVSAINNF

SEQ ID NO: 55885 - protein, 8 aa, BK Virus
QYMAGVAW

SEQ ID NO: 55886 - protein, 8 aa, BK Virus
LLLLLIWF

SEQ ID NO: 55887 - protein, 8 aa, BK Virus
WWSSFNEK

SEQ ID NO: 55888 - protein, 8 aa, BK Virus
QFLSQAVF

SEQ ID NO: 55889 - protein, 8 aa, BK Virus
RFNHILDK

SEQ ID NO: 55890 - protein, 8 aa, BK Virus
KSLQNSEF

SEQ ID NO: 55891 - protein, 8 aa, BK Virus
CFAVYTTK

SEQ ID NO: 55892 - protein, 8 aa, BK Virus
EYLLYSAL

SEQ ID NO: 55893 - protein, 8 aa, BK Virus
QFLSQAVF

SEQ ID NO: 55894 - protein, 8 aa, BK Virus
DFLHCVVF

SEQ ID NO: 55895 - protein, 8 aa, BK Virus
EYPVPKTL

SEQ ID NO: 55896 - protein, 8 aa, BK Virus
HFANAIIF

SEQ ID NO: 55897 - protein, 8 aa, BK Virus
YWLFKGPI

SEQ ID NO: 55898 - protein, 8 aa, BK Virus
RFVRQIDF

SEQ ID NO: 55899 - protein, 8 aa, BK Virus
QYMAGVAW

SEQ ID NO: 55900 - protein, 8 aa, BK Virus
QYMAGVAW

SEQ ID NO: 55901 - protein, 8 aa, BK Virus
WFRPVADF

SEQ ID NO: 55902 - protein, 8 aa, BK Virus
QFLSQAVF

SEQ ID NO: 55903 - protein, 8 aa, BK Virus
RFVRQIDF

SEQ ID NO: 55904 - protein, 8 aa, BK Virus
HFANAIIF

SEQ ID NO: 55905 - protein, 8 aa, BK Virus
EYLLYSAL

SEQ ID NO: 55906 - protein, 8 aa, BK Virus
DFLHCVVF

SEQ ID NO: 55907 - protein, 8 aa, BK Virus
KSLQNSEF

SEQ ID NO: 55908 - protein, 8 aa, BK Virus
LFCHEDMF

SEQ ID NO: 55909 - protein, 8 aa, BK Virus
EYPVPKTL

SEQ ID NO: 55910 - protein, 8 aa, BK Virus
YTFSRMKY

SEQ ID NO: 55911 - protein, 8 aa, BK Virus
DVFLLLGM

SEQ ID NO: 55912 - protein, 8 aa, BK Virus
ELMDLLGL

SEQ ID NO: 55913 - protein, 8 aa, BK Virus
YTFSRMKY

SEQ ID NO: 55914 - protein, 8 aa, BK Virus
DVFLLLGM

SEQ ID NO: 55915 - protein, 8 aa, BK Virus
ETKCEDVF

SEQ ID NO: 55916 - protein, 8 aa, BK Virus
KVAHQPDF

SEQ ID NO: 55917 - protein, 8 aa, BK Virus
ELMDLLGL

SEQ ID NO: 55918 - protein, 8 aa, BK Virus
GVAIDQYM

SEQ ID NO: 55919 - protein, 8 aa, BK Virus
EVPTYGTE

SEQ ID NO: 55920 - protein, 8 aa, BK Virus
GMYLEFQY

SEQ ID NO: 55921 - protein, 8 aa, BK Virus
VFLLLGMY

SEQ ID NO: 55922 - protein, 8 aa, BK Virus
YTFSRMKY

SEQ ID NO: 55923 - protein, 8 aa, BK Virus
TLACFAVY

SEQ ID NO: 55924 - protein, 8 aa, BK Virus
SWKLITEY

SEQ ID NO: 55925 - protein, 8 aa, BK Virus
SQHSTPPK

SEQ ID NO: 55926 - protein, 8 aa, BK Virus
KRRYWLFK

SEQ ID NO: 55927 - protein, 8 aa, BK Virus
LMRKAYLK

SEQ ID NO: 55928 - protein, 8 aa, BK Virus
RQIDFRPK

SEQ ID NO: 55929 - protein, 8 aa, BK Virus
RPKTPPPK

SEQ ID NO: 55930 - protein, 8 aa, BK Virus
SVKVNLEK

SEQ ID NO: 55931 - protein, 8 aa, BK Virus
RMNTLYKK

SEQ ID NO: 55932 - protein, 8 aa, BK Virus
WLHCLLPK

SEQ ID NO: 55933 - protein, 8 aa, BK Virus
KDQPYHFK

SEQ ID NO: 55934 - protein, 8 aa, BK Virus
KAYLKKCK

SEQ ID NO: 55935 - protein, 8 aa, BK Virus
KRMNTLYK

SEQ ID NO: 55936 - protein, 8 aa, BK Virus
AVYTTKEK

SEQ ID NO: 55937 - protein, 8 aa, BK Virus
MRKAYLKK

SEQ ID NO: 55938 - protein, 8 aa, BK Virus
QSRIVEWK

SEQ ID NO: 55939 - protein, 8 aa, BK Virus
KAQILYKK

SEQ ID NO: 55940 - protein, 8 aa, BK Virus
RPKIYLRK

SEQ ID NO: 55941 - protein, 8 aa, BK Virus
LYKKLMEK

SEQ ID NO: 55942 - protein, 8 aa, BK Virus
KRKVEDPK

SEQ ID NO: 55943 - protein, 8 aa, BK Virus
KYNICMGK

SEQ ID NO: 55944 - protein, 8 aa, BK Virus
MYTFSRMK

SEQ ID NO: 55945 - protein, 8 aa, BK Virus
RFNHILDK

SEQ ID NO: 55946 - protein, 8 aa, BK Virus
IFFLTPHR

SEQ ID NO: 55947 - protein, 8 aa, BK Virus
AINNFCQK

SEQ ID NO: 55948 - protein, 8 aa, BK Virus
LTRDPYHI

SEQ ID NO: 55949 - protein, 8 aa, BK Virus
RVSAINNF

SEQ ID NO: 55950 - protein, 8 aa, BK Virus
YTFSRMKY

SEQ ID NO: 55951 - protein, 8 aa, BK Virus
LLLLIWFR

SEQ ID NO: 55952 - protein, 8 aa, BK Virus
RMNTLYKK

SEQ ID NO: 55953 - protein, 8 aa, BK Virus
ISMYTFSR

SEQ ID NO: 55954 - protein, 8 aa, BK Virus
TLQARFVR

SEQ ID NO: 55955 - protein, 8 aa, BK Virus
IFFLTPHR

SEQ ID NO: 55956 - protein, 8 aa, BK Virus
VFNVPKRR

SEQ ID NO: 55957 - protein, 8 aa, BK Virus
SQAVFSNR

SEQ ID NO: 55958 - protein, 8 aa, BK Virus
YSVTFISR

SEQ ID NO: 55959 - protein, 8 aa, BK Virus
KGFQCFKR

SEQ ID NO: 55960 - protein, 8 aa, BK Virus
VVFNVPKR

SEQ ID NO: 55961 - protein, 8 aa, BK Virus
KYNICMGK

SEQ ID NO: 55962 - protein, 8 aa, BK Virus
LMRKAYLK

SEQ ID NO: 55963 - protein, 8 aa, BK Virus
RQIDFRPK

SEQ ID NO: 55964 - protein, 8 aa, BK Virus
LLYSALTR

SEQ ID NO: 55965 - protein, 8 aa, BK Virus
KAQILYKK

SEQ ID NO: 55966 - protein, 8 aa, BK Virus
FVRQIDFR

SEQ ID NO: 55967 - protein, 8 aa, BK Virus
FSKDIQSR

SEQ ID NO: 55968 - protein, 8 aa, BK Virus
RIVEWKER

SEQ ID NO: 55969 - protein, 8 aa, BK Virus
FLTPHRHR

SEQ ID NO: 55970 - protein, 8 aa, BK Virus
LYKKLMEK

SEQ ID NO: 55971 - protein, 8 aa, BK Virus
RFNHILDK

SEQ ID NO: 55972 - protein, 8 aa, BK Virus
MYTFSRMK

SEQ ID NO: 55973 - protein, 8 aa, BK Virus
NVNLPMER

SEQ ID NO: 55974 - protein, 8 aa, BK Virus
KAYLKKCK

SEQ ID NO: 55975 - protein, 8 aa, BK Virus
AINNFCQK

SEQ ID NO: 55976 - protein, 8 aa, BK Virus
RTLACFAV

SEQ ID NO: 55977 - protein, 8 aa, BK Virus
SQHSTPPK

SEQ ID NO: 55978 - protein, 8 aa, BK Virus
LLLLIWFR

SEQ ID NO: 55979 - protein, 8 aa, BK Virus
IFFLTPHR

SEQ ID NO: 55980 - protein, 8 aa, BK Virus
ISMYTFSR

SEQ ID NO: 55981 - protein, 8 aa, BK Virus
NVNLPMER

SEQ ID NO: 55982 - protein, 8 aa, BK Virus
FVRQIDFR

SEQ ID NO: 55983 - protein, 8 aa, BK Virus
TLQARFVR

SEQ ID NO: 55984 - protein, 8 aa, BK Virus
DTVLAKKR

SEQ ID NO: 55985 - protein, 8 aa, BK Virus
YSVTFISR

SEQ ID NO: 55986 - protein, 8 aa, BK Virus
FSKDIQSR

SEQ ID NO: 55987 - protein, 8 aa, BK Virus
DFRPKIYL

SEQ ID NO: 55988 - protein, 8 aa, BK Virus
DYLDGSVK

SEQ ID NO: 55989 - protein, 8 aa, BK Virus
FLTPHRHR

SEQ ID NO: 55990 - protein, 8 aa, BK Virus
ETKQVSWK

SEQ ID NO: 55991 - protein, 8 aa, BK Virus
ETKQVSWK

SEQ ID NO: 55992 - protein, 8 aa, BK Virus
ISMYTFSR

SEQ ID NO: 55993 - protein, 8 aa, BK Virus
MVVFEDVK

SEQ ID NO: 55994 - protein, 8 aa, BK Virus
YSVTFISR

SEQ ID NO: 55995 - protein, 8 aa, BK Virus
DTVLAKKR

SEQ ID NO: 55996 - protein, 8 aa, BK Virus
CVVFNVPK

SEQ ID NO: 55997 - protein, 8 aa, BK Virus
NVNLPMER

SEQ ID NO: 55998 - protein, 8 aa, BK Virus
FVRQIDFR

SEQ ID NO: 55999 - protein, 8 aa, BK Virus
YTFSRMKY

SEQ ID NO: 56000 - protein, 8 aa, BK Virus
MYTFSRMK

SEQ ID NO: 56001 - protein, 8 aa, BK Virus
VVFNVPKR

SEQ ID NO: 56002 - protein, 8 aa, BK Virus
ESIQGGLK

SEQ ID NO: 56003 - protein, 8 aa, BK Virus
LLYSALTR

SEQ ID NO: 56004 - protein, 8 aa, BK Virus
FSKDIQSR

SEQ ID NO: 56005 - protein, 8 aa, BK Virus
TLQARFVR

SEQ ID NO: 56006 - protein, 8 aa, BK Virus
IFFLTPHR

SEQ ID NO: 56007 - protein, 8 aa, BK Virus
LLLLIWFR

SEQ ID NO: 56008 - protein, 8 aa, BK Virus
TFSFLICK

SEQ ID NO: 56009 - protein, 8 aa, BK Virus
NSEFLLEK

SEQ ID NO: 56010 - protein, 8 aa, BK Virus
AIIFAESK

SEQ ID NO: 56011 - protein, 8 aa, BK Virus
FLTPHRHR

SEQ ID NO: 56012 - protein, 8 aa, BK Virus
SVKVNLEK

SEQ ID NO: 56013 - protein, 8 aa, BK Virus
EKAQILYK

SEQ ID NO: 56014 - protein, 8 aa, BK Virus
SQAVFSNR

SEQ ID NO: 56015 - protein, 8 aa, BK Virus
CFAVYTTK

SEQ ID NO: 56016 - protein, 8 aa, BK Virus
AVYTTKEK

SEQ ID NO: 56017 - protein, 8 aa, BK Virus
AINNFCQK

SEQ ID NO: 56018 - protein, 8 aa, BK Virus
FAESKNQK

SEQ ID NO: 56019 - protein, 8 aa, BK Virus
RIVEWKER

SEQ ID NO: 56020 - protein, 8 aa, BK Virus
INNLDSLR

SEQ ID NO: 56021 - protein, 8 aa, BK Virus
TLACFAVY

SEQ ID NO: 56022 - protein, 8 aa, BK Virus
STPPKKKR

SEQ ID NO: 56023 - protein, 8 aa, BK Virus
TEYAVETK

SEQ ID NO: 56024 - protein, 8 aa, BK Virus
HSTPPKKK

SEQ ID NO: 56025 - protein, 8 aa, BK Virus
SVIFDFLH

SEQ ID NO: 56026 - protein, 8 aa, BK Virus
YHFKYHEK

SEQ ID NO: 56027 - protein, 8 aa, BK Virus
FANAIIFA

SEQ ID NO: 56028 - protein, 8 aa, BK Virus
QIFPPGLV

SEQ ID NO: 56029 - protein, 8 aa, BK Virus
RTLACFAV

SEQ ID NO: 56030 - protein, 8 aa, BK Virus
FGAHGNAV

SEQ ID NO: 56031 - protein, 8 aa, BK Virus
VTMNEYPV

SEQ ID NO: 56032 - protein, 8 aa, BK Virus
DSVIFDFL

SEQ ID NO: 56033 - protein, 8 aa, BK Virus
ELMDLLGL

SEQ ID NO: 56034 - protein, 8 aa, BK Virus
MCAGHNII

SEQ ID NO: 56035 - protein, 8 aa, BK Virus
ESMELMDL

SEQ ID NO: 56036 - protein, 8 aa, BK Virus
LTPHRHRV

SEQ ID NO: 56037 - protein, 8 aa, BK Virus
EKYSVTFI

SEQ ID NO: 56038 - protein, 8 aa, BK Virus
YMAGVAWL

SEQ ID NO: 56039 - protein, 8 aa, BK Virus
MTLLLLLI

SEQ ID NO: 56040 - protein, 8 aa, BK Virus
VAIDQYMV

SEQ ID NO: 56041 - protein, 8 aa, BK Virus
LLIWFRPV

SEQ ID NO: 56042 - protein, 8 aa, BK Virus
QSQCSSQV

SEQ ID NO: 56043 - protein, 8 aa, BK Virus
ERAAWGNL

SEQ ID NO: 56044 - protein, 8 aa, BK Virus
TTLAAGLL

SEQ ID NO: 56045 - protein, 8 aa, BK Virus
LCTFSFLI

SEQ ID NO: 56046 - protein, 8 aa, BK Virus
QIFPPGLV

SEQ ID NO: 56047 - protein, 8 aa, BK Virus
ELMDLLGL

SEQ ID NO: 56048 - protein, 8 aa, BK Virus
RTLACFAV

SEQ ID NO: 56049 - protein, 8 aa, BK Virus
MTLLLLLI

SEQ ID NO: 56050 - protein, 8 aa, BK Virus
VTMNEYPV

SEQ ID NO: 56051 - protein, 8 aa, BK Virus
TTLAAGLL

SEQ ID NO: 56052 - protein, 8 aa, BK Virus
YLDGSVKV

SEQ ID NO: 56053 - protein, 8 aa, BK Virus
GTWNSSEV

SEQ ID NO: 56054 - protein, 8 aa, BK Virus
VAIDQYMV

SEQ ID NO: 56055 - protein, 8 aa, BK Virus
FANAIIFA

SEQ ID NO: 56056 - protein, 8 aa, BK Virus
AAWGNLPL

SEQ ID NO: 56057 - protein, 8 aa, BK Virus
LLIWFRPV

SEQ ID NO: 56058 - protein, 8 aa, BK Virus
FLLLGMYL

SEQ ID NO: 56059 - protein, 8 aa, BK Virus
YMAGVAWL

SEQ ID NO: 56060 - protein, 8 aa, BK Virus
QAVDTVLA

SEQ ID NO: 56061 - protein, 8 aa, BK Virus
ESMELMDL

SEQ ID NO: 56062 - protein, 8 aa, BK Virus
LTFELGVA

SEQ ID NO: 56063 - protein, 8 aa, BK Virus
FGAHGNAV

SEQ ID NO: 56064 - protein, 8 aa, BK Virus
AVLEQYMA

SEQ ID NO: 56065 - protein, 8 aa, BK Virus
LPMERLTF

SEQ ID NO: 56066 - protein, 8 aa, BK Virus
VPKRRYWL

SEQ ID NO: 56067 - protein, 8 aa, BK Virus
LPKMDSVI

SEQ ID NO: 56068 - protein, 8 aa, BK Virus
AAWGNLPL

SEQ ID NO: 56069 - protein, 8 aa, BK Virus
FPSDLHQF

SEQ ID NO: 56070 - protein, 8 aa, BK Virus
LPLMRKAY

SEQ ID NO: 56071 - protein, 8 aa, BK Virus
VPKRRYWL

SEQ ID NO: 56072 - protein, 8 aa, BK Virus
KMKRMNTL

SEQ ID NO: 56073 - protein, 8 aa, BK Virus
YLKKCKEF

SEQ ID NO: 56074 - protein, 8 aa, BK Virus
RVSAINNF

SEQ ID NO: 56075 - protein, 8 aa, BK Virus
CQKKDQPY

SEQ ID NO: 56076 - protein, 8 aa, BK Virus
QQAVDTVL

SEQ ID NO: 56077 - protein, 8 aa, BK Virus
RMKYNICM

SEQ ID NO: 56078 - protein, 8 aa, BK Virus
YLKKCKEF

SEQ ID NO: 56079 - protein, 8 aa, BK Virus
YMAGVAWL

SEQ ID NO: 56080 - protein, 8 aa, BK Virus
YTFSRMKY

SEQ ID NO: 56081 - protein, 8 aa, BK Virus
GMYLEFQY

SEQ ID NO: 56082 - protein, 8 aa, BK Virus
HQFLSQAV

SEQ ID NO: 56083 - protein, 8 aa, BK Virus
KMKRMNTL

SEQ ID NO: 56084 - protein, 8 aa, BK Virus
TLACFAVY

SEQ ID NO: 56085 - protein, 8 aa, BK Virus
LQSGMTLL

SEQ ID NO: 56086 - protein, 8 aa, BK Virus
WESWWSSF

SEQ ID NO: 56087 - protein, 8 aa, BK Virus
MERLTFEL

SEQ ID NO: 56088 - protein, 8 aa, BK Virus
SEISMYTF

SEQ ID NO: 56089 - protein, 8 aa, BK Virus
MEKYSVTF

SEQ ID NO: 56090 - protein, 8 aa, BK Virus
TERFNHIL

SEQ ID NO: 56091 - protein, 8 aa, BK Virus
TEEWESWW

SEQ ID NO: 56092 - protein, 8 aa, BK Virus
KRMNTLYK

SEQ ID NO: 56093 - protein, 8 aa, BK Virus
KRILQSGM

SEQ ID NO: 56094 - protein, 8 aa, BK Virus
RQIDFRPK

SEQ ID NO: 56095 - protein, 8 aa, BK Virus
KRRYWLFK

SEQ ID NO: 56096 - protein, 8 aa, BK Virus
KRVDTLHM

SEQ ID NO: 56097 - protein, 8 aa, BK Virus
MRKAYLKK

SEQ ID NO: 56098 - protein, 8 aa, BK Virus
FPSDLHQF

SEQ ID NO: 56099 - protein, 8 aa, BK Virus
FPPGLVTM

SEQ ID NO: 56100 - protein, 8 aa, BK Virus
LPMERLTF

SEQ ID NO: 56101 - protein, 8 aa, BK Virus
LPLMRKAY

SEQ ID NO: 56102 - protein, 8 aa, BK Virus
SALTRDPY

SEQ ID NO: 56103 - protein, 8 aa, BK Virus
NAVLEQYM

SEQ ID NO: 56104 - protein, 8 aa, BK Virus
FASDEEAT

SEQ ID NO: 56105 - protein, 8 aa, BK Virus
TLACFAVY

SEQ ID NO: 56106 - protein, 8 aa, BK Virus
HFANAIIF

SEQ ID NO: 56107 - protein, 8 aa, BK Virus
AAWGNLPL

SEQ ID NO: 56108 - protein, 8 aa, BK Virus
NSSEVPTY

SEQ ID NO: 56109 - protein, 8 aa, BK Virus
EKWDEDLF

SEQ ID NO: 56110 - protein, 8 aa, BK Virus
QFLSQAVF

SEQ ID NO: 56111 - protein, 8 aa, BK Virus
WESWWSSF

SEQ ID NO: 56112 - protein, 8 aa, BK Virus
NREESMEL

SEQ ID NO: 56113 - protein, 8 aa, BK Virus
QQAVDTVL

SEQ ID NO: 56114 - protein, 8 aa, BK Virus
YMAGVAWL

SEQ ID NO: 56115 - protein, 8 aa, BK Virus
MERLTFEL

SEQ ID NO: 56116 - protein, 8 aa, BK Virus
TERFNHIL

SEQ ID NO: 56117 - protein, 8 aa, BK Virus
CEDVFLLL

SEQ ID NO: 56118 - protein, 8 aa, BK Virus
SEISMYTF

SEQ ID NO: 56119 - protein, 8 aa, BK Virus
REESMELM

SEQ ID NO: 56120 - protein, 8 aa, BK Virus
MEKYSVTF

SEQ ID NO: 56121 - protein, 8 aa, BK Virus
EESIQGGL

SEQ ID NO: 56122 - protein, 8 aa, BK Virus
SEISMYTF

SEQ ID NO: 56123 - protein, 8 aa, BK Virus
WESWWSSF

SEQ ID NO: 56124 - protein, 8 aa, BK Virus
KEKAQILY

SEQ ID NO: 56125 - protein, 8 aa, BK Virus
EEMLTERF

SEQ ID NO: 56126 - protein, 8 aa, BK Virus
EESIQGGL

SEQ ID NO: 56127 - protein, 8 aa, BK Virus
MEKYSVTF

SEQ ID NO: 56128 - protein, 8 aa, BK Virus
EETKQVSW

SEQ ID NO: 56129 - protein, 8 aa, BK Virus
REESMELM

SEQ ID NO: 56130 - protein, 8 aa, BK Virus
EETKQVSW

SEQ ID NO: 56131 - protein, 8 aa, BK Virus
SEISMYTF

SEQ ID NO: 56132 - protein, 8 aa, BK Virus
TEEWESWW

SEQ ID NO: 56133 - protein, 8 aa, BK Virus
KEKAQILY

SEQ ID NO: 56134 - protein, 8 aa, BK Virus
EEMLTERF

SEQ ID NO: 56135 - protein, 8 aa, BK Virus
SEISMYTF

SEQ ID NO: 56136 - protein, 8 aa, BK Virus
EEMLTERF

SEQ ID NO: 56137 - protein, 8 aa, BK Virus
EEMLTERF

SEQ ID NO: 56138 - protein, 8 aa, BK Virus
AESKNQKS

SEQ ID NO: 56139 - protein, 8 aa, BK Virus
EESIQGGL

SEQ ID NO: 56140 - protein, 8 aa, BK Virus
AESKDLPS

SEQ ID NO: 56141 - protein, 8 aa, BK Virus
FPPGLVTM

SEQ ID NO: 56142 - protein, 8 aa, BK Virus
LPMERLTF

SEQ ID NO: 56143 - protein, 8 aa, BK Virus
LPKMDSVI

SEQ ID NO: 56144 - protein, 8 aa, BK Virus
LPMERLTF

SEQ ID NO: 56145 - protein, 8 aa, BK Virus
FPSDLHQF

SEQ ID NO: 56146 - protein, 8 aa, BK Virus
LPLMRKAY

SEQ ID NO: 56147 - protein, 8 aa, BK Virus
LPKMDSVI

SEQ ID NO: 56148 - protein, 8 aa, BK Virus
FPPGLVTM

SEQ ID NO: 56149 - protein, 8 aa, BK Virus
FPPGLVTM

SEQ ID NO: 56150 - protein, 8 aa, BK Virus
FANAIIFA

SEQ ID NO: 56151 - protein, 8 aa, BK Virus
LPLMRKAY

SEQ ID NO: 56152 - protein, 8 aa, BK Virus
PTYGTEEW

SEQ ID NO: 56153 - protein, 8 aa, BK Virus
WSSFNEKW

SEQ ID NO: 56154 - protein, 8 aa, BK Virus
KSLQNSEF

SEQ ID NO: 56155 - protein, 8 aa, BK Virus
IQSRIVEW

SEQ ID NO: 56156 - protein, 8 aa, BK Virus
RVSAINNF

SEQ ID NO: 56157 - protein, 8 aa, BK Virus
PTYGTEEW

SEQ ID NO: 56158 - protein, 8 aa, BK Virus
KVAHQPDF

SEQ ID NO: 56159 - protein, 8 aa, BK Virus
LGLERAAW

SEQ ID NO: 56160 - protein, 8 aa, BK Virus
NSSEVPTY

SEQ ID NO: 56161 - protein, 9 aa, BK Virus
RLDSEISMY

SEQ ID NO: 56162 - protein, 9 aa, BK Virus
GVNKEYLLY

SEQ ID NO: 56163 - protein, 9 aa, BK Virus
YSALTRDPY

SEQ ID NO: 56164 - protein, 9 aa, BK Virus
FLHCVVFNV

SEQ ID NO: 56165 - protein, 9 aa, BK Virus
VIFDFLHCV

SEQ ID NO: 56166 - protein, 9 aa, BK Virus
KLCTFSFLI

SEQ ID NO: 56167 - protein, 9 aa, BK Virus
FLTPHRHRV

SEQ ID NO: 56168 - protein, 9 aa, BK Virus
LLLIWFRPV

SEQ ID NO: 56169 - protein, 9 aa, BK Virus
VLEQYMAGV

SEQ ID NO: 56170 - protein, 9 aa, BK Virus
SLQNSEFLL

SEQ ID NO: 56171 - protein, 9 aa, BK Virus
CLLPKMDSV

SEQ ID NO: 56172 - protein, 9 aa, BK Virus
ILQSGMTLL

SEQ ID NO: 56173 - protein, 9 aa, BK Virus
KLMEKYSVT

SEQ ID NO: 56174 - protein, 9 aa, BK Virus
TLAAGLLDL

SEQ ID NO: 56175 - protein, 9 aa, BK Virus
MLTERFNHI

SEQ ID NO: 56176 - protein, 9 aa, BK Virus
LLIWFRPVA

SEQ ID NO: 56177 - protein, 9 aa, BK Virus
GMTLLLLLI

SEQ ID NO: 56178 - protein, 9 aa, BK Virus
HILDKMDLI

SEQ ID NO: 56179 - protein, 9 aa, BK Virus
CMGKCILDI

SEQ ID NO: 56180 - protein, 9 aa, BK Virus
WLHCLLPKM

SEQ ID NO: 56181 - protein, 9 aa, BK Virus
TLACFAVYT

SEQ ID NO: 56182 - protein, 9 aa, BK Virus
FLHCVVFNV

SEQ ID NO: 56183 - protein, 9 aa, BK Virus
FLTPHRHRV

SEQ ID NO: 56184 - protein, 9 aa, BK Virus
MLTERFNHI

SEQ ID NO: 56185 - protein, 9 aa, BK Virus
ILQSGMTLL

SEQ ID NO: 56186 - protein, 9 aa, BK Virus
VIFDFLHCV

SEQ ID NO: 56187 - protein, 9 aa, BK Virus
VLEQYMAGV

SEQ ID NO: 56188 - protein, 9 aa, BK Virus
NLDSLRDYL

SEQ ID NO: 56189 - protein, 9 aa, BK Virus
SLQNSEFLL

SEQ ID NO: 56190 - protein, 9 aa, BK Virus
LQSGMTLLL

SEQ ID NO: 56191 - protein, 9 aa, BK Virus
CLLPKMDSV

SEQ ID NO: 56192 - protein, 9 aa, BK Virus
MDSVIFDFL

SEQ ID NO: 56193 - protein, 9 aa, BK Virus
KLCTFSFLI

SEQ ID NO: 56194 - protein, 9 aa, BK Virus
SLRDYLDGS

SEQ ID NO: 56195 - protein, 9 aa, BK Virus
GVAIDQYMV

SEQ ID NO: 56196 - protein, 9 aa, BK Virus
TLAAGLLDL

SEQ ID NO: 56197 - protein, 9 aa, BK Virus
KLMEKYSVT

SEQ ID NO: 56198 - protein, 9 aa, BK Virus
GMTLLLLLI

SEQ ID NO: 56199 - protein, 9 aa, BK Virus
TLACFAVYT

SEQ ID NO: 56200 - protein, 9 aa, BK Virus
LLGMYLEFQ

SEQ ID NO: 56201 - protein, 9 aa, BK Virus
SQSQCSSQV

SEQ ID NO: 56202 - protein, 9 aa, BK Virus
GVAWLHCLL

SEQ ID NO: 56203 - protein, 9 aa, BK Virus
FSFLICKGV

SEQ ID NO: 56204 - protein, 9 aa, BK Virus
AINNFCQKL

SEQ ID NO: 56205 - protein, 9 aa, BK Virus
AGHNIIFFL

SEQ ID NO: 56206 - protein, 9 aa, BK Virus
FASDEEATA

SEQ ID NO: 56207 - protein, 9 aa, BK Virus
FPSDLHQFL

SEQ ID NO: 56208 - protein, 9 aa, BK Virus
ALTRDPYHI

SEQ ID NO: 56209 - protein, 9 aa, BK Virus
FSKDIQSRI

SEQ ID NO: 56210 - protein, 9 aa, BK Virus
LVTMNEYPV

SEQ ID NO: 56211 - protein, 9 aa, BK Virus
FLSQAVFSN

SEQ ID NO: 56212 - protein, 9 aa, BK Virus
LLLIWFRPV

SEQ ID NO: 56213 - protein, 9 aa, BK Virus
FGAHGNAVL

SEQ ID NO: 56214 - protein, 9 aa, BK Virus
LTFELGVAI

SEQ ID NO: 56215 - protein, 9 aa, BK Virus
SGMTLLLLL

SEQ ID NO: 56216 - protein, 9 aa, BK Virus
LLPKMDSVI

SEQ ID NO: 56217 - protein, 9 aa, BK Virus
HILDKMDLI

SEQ ID NO: 56218 - protein, 9 aa, BK Virus
FLHCVVFNV

SEQ ID NO: 56219 - protein, 9 aa, BK Virus
FLTPHRHRV

SEQ ID NO: 56220 - protein, 9 aa, BK Virus
MLTERFNHI

SEQ ID NO: 56221 - protein, 9 aa, BK Virus
VLEQYMAGV

SEQ ID NO: 56222 - protein, 9 aa, BK Virus
LLLIWFRPV

SEQ ID NO: 56223 - protein, 9 aa, BK Virus
CLLPKMDSV

SEQ ID NO: 56224 - protein, 9 aa, BK Virus
ILQSGMTLL

SEQ ID NO: 56225 - protein, 9 aa, BK Virus
VIFDFLHCV

SEQ ID NO: 56226 - protein, 9 aa, BK Virus
TLAAGLLDL

SEQ ID NO: 56227 - protein, 9 aa, BK Virus
KLMEKYSVT

SEQ ID NO: 56228 - protein, 9 aa, BK Virus
RLTFELGVA

SEQ ID NO: 56229 - protein, 9 aa, BK Virus
SLRDYLDGS

SEQ ID NO: 56230 - protein, 9 aa, BK Virus
LLIWFRPVA

SEQ ID NO: 56231 - protein, 9 aa, BK Virus
YLRKSLQNS

SEQ ID NO: 56232 - protein, 9 aa, BK Virus
KLCTFSFLI

SEQ ID NO: 56233 - protein, 9 aa, BK Virus
ALTRDPYHI

SEQ ID NO: 56234 - protein, 9 aa, BK Virus
LIFGAHGNA

SEQ ID NO: 56235 - protein, 9 aa, BK Virus
GMTLLLLLI

SEQ ID NO: 56236 - protein, 9 aa, BK Virus
LQSGMTLLL

SEQ ID NO: 56237 - protein, 9 aa, BK Virus
TLACFAVYT

SEQ ID NO: 56238 - protein, 9 aa, BK Virus
SQSQCSSQV

SEQ ID NO: 56239 - protein, 9 aa, BK Virus
GVAWLHCLL

SEQ ID NO: 56240 - protein, 9 aa, BK Virus
LLPKMDSVI

SEQ ID NO: 56241 - protein, 9 aa, BK Virus
WLHCLLPKM

SEQ ID NO: 56242 - protein, 9 aa, BK Virus
VAIDQYMVV

SEQ ID NO: 56243 - protein, 9 aa, BK Virus
HMCAGHNII

SEQ ID NO: 56244 - protein, 9 aa, BK Virus
TQIFPPGLV

SEQ ID NO: 56245 - protein, 9 aa, BK Virus
AINNFCQKL

SEQ ID NO: 56246 - protein, 9 aa, BK Virus
HILDKMDLI

SEQ ID NO: 56247 - protein, 9 aa, BK Virus
RAAWGNLPL

SEQ ID NO: 56248 - protein, 9 aa, BK Virus
RMNTLYKKM

SEQ ID NO: 56249 - protein, 9 aa, BK Virus
RILQSGMTL

SEQ ID NO: 56250 - protein, 9 aa, BK Virus
LQARFVRQI

SEQ ID NO: 56251 - protein, 9 aa, BK Virus
LLGMYLEFQ

SEQ ID NO: 56252 - protein, 9 aa, BK Virus
SLQNSEFLL

SEQ ID NO: 56253 - protein, 9 aa, BK Virus
RIVEWKERL

SEQ ID NO: 56254 - protein, 9 aa, BK Virus
GVAIDQYMV

SEQ ID NO: 56255 - protein, 9 aa, BK Virus
FLTPHRHRV

SEQ ID NO: 56256 - protein, 9 aa, BK Virus
FLHCVVFNV

SEQ ID NO: 56257 - protein, 9 aa, BK Virus
VIFDFLHCV

SEQ ID NO: 56258 - protein, 9 aa, BK Virus
LLLIWFRPV

SEQ ID NO: 56259 - protein, 9 aa, BK Virus
VLEQYMAGV

SEQ ID NO: 56260 - protein, 9 aa, BK Virus
VAIDQYMVV

SEQ ID NO: 56261 - protein, 9 aa, BK Virus
SLQNSEFLL

SEQ ID NO: 56262 - protein, 9 aa, BK Virus
KKMEQDVKV

SEQ ID NO: 56263 - protein, 9 aa, BK Virus
LVTMNEYPV

SEQ ID NO: 56264 - protein, 9 aa, BK Virus
TLAAGLLDL

SEQ ID NO: 56265 - protein, 9 aa, BK Virus
MYLEFQYNV

SEQ ID NO: 56266 - protein, 9 aa, BK Virus
ILQSGMTLL

SEQ ID NO: 56267 - protein, 9 aa, BK Virus
AINNFCQKL

SEQ ID NO: 56268 - protein, 9 aa, BK Virus
CLLPKMDSV

SEQ ID NO: 56269 - protein, 9 aa, BK Virus
KLMEKYSVT

SEQ ID NO: 56270 - protein, 9 aa, BK Virus
MLTERFNHI

SEQ ID NO: 56271 - protein, 9 aa, BK Virus
ALTRDPYHI

SEQ ID NO: 56272 - protein, 9 aa, BK Virus
KLCTFSFLI

SEQ ID NO: 56273 - protein, 9 aa, BK Virus
MLTERFNHI

SEQ ID NO: 56274 - protein, 9 aa, BK Virus
CLLPKMDSV

SEQ ID NO: 56275 - protein, 9 aa, BK Virus
FLHCVVFNV

SEQ ID NO: 56276 - protein, 9 aa, BK Virus
LLLIWFRPV

SEQ ID NO: 56277 - protein, 9 aa, BK Virus
FLTPHRHRV

SEQ ID NO: 56278 - protein, 9 aa, BK Virus
VIFDFLHCV

SEQ ID NO: 56279 - protein, 9 aa, BK Virus
RQIDFRPKI

SEQ ID NO: 56280 - protein, 9 aa, BK Virus
SQSQCSSQV

SEQ ID NO: 56281 - protein, 9 aa, BK Virus
VLEQYMAGV

SEQ ID NO: 56282 - protein, 9 aa, BK Virus
LQSGMTLLL

SEQ ID NO: 56283 - protein, 9 aa, BK Virus
RIVEWKERL

SEQ ID NO: 56284 - protein, 9 aa, BK Virus
RILQSGMTL

SEQ ID NO: 56285 - protein, 9 aa, BK Virus
RAAWGNLPL

SEQ ID NO: 56286 - protein, 9 aa, BK Virus
TLAAGLLDL

SEQ ID NO: 56287 - protein, 9 aa, BK Virus
KLCTFSFLI

SEQ ID NO: 56288 - protein, 9 aa, BK Virus
VAIDQYMVV

SEQ ID NO: 56289 - protein, 9 aa, BK Virus
HILDKMDLI

SEQ ID NO: 56290 - protein, 9 aa, BK Virus
QQAVDTVLA

SEQ ID NO: 56291 - protein, 9 aa, BK Virus
ILQSGMTLL

SEQ ID NO: 56292 - protein, 9 aa, BK Virus
FASDEEATA

SEQ ID NO: 56293 - protein, 9 aa, BK Virus
KQVSWKLIT

SEQ ID NO: 56294 - protein, 9 aa, BK Virus
LLIWFRPVA

SEQ ID NO: 56295 - protein, 9 aa, BK Virus
LTFELGVAI

SEQ ID NO: 56296 - protein, 9 aa, BK Virus
MELMDLLGL

SEQ ID NO: 56297 - protein, 9 aa, BK Virus
GVAWLHCLL

SEQ ID NO: 56298 - protein, 9 aa, BK Virus
FLLLGMYLE

SEQ ID NO: 56299 - protein, 9 aa, BK Virus
TQIFPPGLV

SEQ ID NO: 56300 - protein, 9 aa, BK Virus
LLLGMYLEF

SEQ ID NO: 56301 - protein, 9 aa, BK Virus
KALNVNLPM

SEQ ID NO: 56302 - protein, 9 aa, BK Virus
AAWGNLPLM

SEQ ID NO: 56303 - protein, 9 aa, BK Virus
WLHCLLPKM

SEQ ID NO: 56304 - protein, 9 aa, BK Virus
LVTMNEYPV

SEQ ID NO: 56305 - protein, 9 aa, BK Virus
KLMEKYSVT

SEQ ID NO: 56306 - protein, 9 aa, BK Virus
SQAVFSNRT

SEQ ID NO: 56307 - protein, 9 aa, BK Virus
FLTPHRHRV

SEQ ID NO: 56308 - protein, 9 aa, BK Virus
VIFDFLHCV

SEQ ID NO: 56309 - protein, 9 aa, BK Virus
FLHCVVFNV

SEQ ID NO: 56310 - protein, 9 aa, BK Virus
CLLPKMDSV

SEQ ID NO: 56311 - protein, 9 aa, BK Virus
VLEQYMAGV

SEQ ID NO: 56312 - protein, 9 aa, BK Virus
SLQNSEFLL

SEQ ID NO: 56313 - protein, 9 aa, BK Virus
NLDSLRDYL

SEQ ID NO: 56314 - protein, 9 aa, BK Virus
ILQSGMTLL

SEQ ID NO: 56315 - protein, 9 aa, BK Virus
TLAAGLLDL

SEQ ID NO: 56316 - protein, 9 aa, BK Virus
KLCTFSFLI

SEQ ID NO: 56317 - protein, 9 aa, BK Virus
LLLIWFRPV

SEQ ID NO: 56318 - protein, 9 aa, BK Virus
FLLEKRILQ

SEQ ID NO: 56319 - protein, 9 aa, BK Virus
LLIWFRPVA

SEQ ID NO: 56320 - protein, 9 aa, BK Virus
MYLEFQYNV

SEQ ID NO: 56321 - protein, 9 aa, BK Virus
YMAGVAWLH

SEQ ID NO: 56322 - protein, 9 aa, BK Virus
GVAIDQYMV

SEQ ID NO: 56323 - protein, 9 aa, BK Virus
PIDSGKTTL

SEQ ID NO: 56324 - protein, 9 aa, BK Virus
GMTLLLLLI

SEQ ID NO: 56325 - protein, 9 aa, BK Virus
DYLDGSVKV

SEQ ID NO: 56326 - protein, 9 aa, BK Virus
PMERLTFEL

SEQ ID NO: 56327 - protein, 9 aa, BK Virus
LLLGMYLEF

SEQ ID NO: 56328 - protein, 9 aa, BK Virus
LVTMNEYPV

SEQ ID NO: 56329 - protein, 9 aa, BK Virus
GVAWLHCLL

SEQ ID NO: 56330 - protein, 9 aa, BK Virus
VAIDQYMVV

SEQ ID NO: 56331 - protein, 9 aa, BK Virus
RILQSGMTL

SEQ ID NO: 56332 - protein, 9 aa, BK Virus
DLHQFLSQA

SEQ ID NO: 56333 - protein, 9 aa, BK Virus
MLTERFNHI

SEQ ID NO: 56334 - protein, 9 aa, BK Virus
ALTRDPYHI

SEQ ID NO: 56335 - protein, 9 aa, BK Virus
RIVEWKERL

SEQ ID NO: 56336 - protein, 9 aa, BK Virus
TLACFAVYT

SEQ ID NO: 56337 - protein, 9 aa, BK Virus
FLLLGMYLE

SEQ ID NO: 56338 - protein, 9 aa, BK Virus
AINNFCQKL

SEQ ID NO: 56339 - protein, 9 aa, BK Virus
TLLLLLIWF

SEQ ID NO: 56340 - protein, 9 aa, BK Virus
RAAWGNLPL

SEQ ID NO: 56341 - protein, 9 aa, BK Virus
DLLGLERAA

SEQ ID NO: 56342 - protein, 9 aa, BK Virus
LLGMYLEFQ

SEQ ID NO: 56343 - protein, 9 aa, BK Virus
RLDSEISMY

SEQ ID NO: 56344 - protein, 9 aa, BK Virus
HILDKMDLI

SEQ ID NO: 56345 - protein, 9 aa, BK Virus
LLLLLIWFR

SEQ ID NO: 56346 - protein, 9 aa, BK Virus
WLHCLLPKM

SEQ ID NO: 56347 - protein, 9 aa, BK Virus
TLHMTREEM

SEQ ID NO: 56348 - protein, 9 aa, BK Virus
LITEYAVET

SEQ ID NO: 56349 - protein, 9 aa, BK Virus
LLPKMDSVI

SEQ ID NO: 56350 - protein, 9 aa, BK Virus
KMDSVIFDF

SEQ ID NO: 56351 - protein, 9 aa, BK Virus
FLSQAVFSN

SEQ ID NO: 56352 - protein, 9 aa, BK Virus
HMCAGHNII

SEQ ID NO: 56353 - protein, 9 aa, BK Virus
IFDFLHCVV

SEQ ID NO: 56354 - protein, 9 aa, BK Virus
SQSQCSSQV

SEQ ID NO: 56355 - protein, 9 aa, BK Virus
LTFELGVAI

SEQ ID NO: 56356 - protein, 9 aa, BK Virus
SLRDYLDGS

SEQ ID NO: 56357 - protein, 9 aa, BK Virus
YLDGSVKVN

SEQ ID NO: 56358 - protein, 9 aa, BK Virus
ILYKKLMEK

SEQ ID NO: 56359 - protein, 9 aa, BK Virus
FGTWNSSEV

SEQ ID NO: 56360 - protein, 9 aa, BK Virus
SMYTFSRMK

SEQ ID NO: 56361 - protein, 9 aa, BK Virus
NVPKRRYWL

SEQ ID NO: 56362 - protein, 9 aa, BK Virus
DMFASDEEA

SEQ ID NO: 56363 - protein, 9 aa, BK Virus
FPSDLHQFL

SEQ ID NO: 56364 - protein, 9 aa, BK Virus
GLLDLCGGK

SEQ ID NO: 56365 - protein, 9 aa, BK Virus
AIDQYMVVF

SEQ ID NO: 56366 - protein, 9 aa, BK Virus
AAWGNLPLM

SEQ ID NO: 56367 - protein, 9 aa, BK Virus
IFPPGLVTM

SEQ ID NO: 56368 - protein, 9 aa, BK Virus
KLMEKYSVT

SEQ ID NO: 56369 - protein, 9 aa, BK Virus
RLTFELGVA

SEQ ID NO: 56370 - protein, 9 aa, BK Virus
AVFSNRTLA

SEQ ID NO: 56371 - protein, 9 aa, BK Virus
FLTPHRHRV

SEQ ID NO: 56372 - protein, 9 aa, BK Virus
VIFDFLHCV

SEQ ID NO: 56373 - protein, 9 aa, BK Virus
VLEQYMAGV

SEQ ID NO: 56374 - protein, 9 aa, BK Virus
CLLPKMDSV

SEQ ID NO: 56375 - protein, 9 aa, BK Virus
FLHCVVFNV

SEQ ID NO: 56376 - protein, 9 aa, BK Virus
TLAAGLLDL

SEQ ID NO: 56377 - protein, 9 aa, BK Virus
ILQSGMTLL

SEQ ID NO: 56378 - protein, 9 aa, BK Virus
MYLEFQYNV

SEQ ID NO: 56379 - protein, 9 aa, BK Virus
LLLIWFRPV

SEQ ID NO: 56380 - protein, 9 aa, BK Virus
SLQNSEFLL

SEQ ID NO: 56381 - protein, 9 aa, BK Virus
FLLEKRILQ

SEQ ID NO: 56382 - protein, 9 aa, BK Virus
VAIDQYMVV

SEQ ID NO: 56383 - protein, 9 aa, BK Virus
NLDSLRDYL

SEQ ID NO: 56384 - protein, 9 aa, BK Virus
MLTERFNHI

SEQ ID NO: 56385 - protein, 9 aa, BK Virus
LLIWFRPVA

SEQ ID NO: 56386 - protein, 9 aa, BK Virus
LLLGMYLEF

SEQ ID NO: 56387 - protein, 9 aa, BK Virus
SLRDYLDGS

SEQ ID NO: 56388 - protein, 9 aa, BK Virus
KLCTFSFLI

SEQ ID NO: 56389 - protein, 9 aa, BK Virus
RIVEWKERL

SEQ ID NO: 56390 - protein, 9 aa, BK Virus
YMAGVAWLH

SEQ ID NO: 56391 - protein, 9 aa, BK Virus
FLLLGMYLE

SEQ ID NO: 56392 - protein, 9 aa, BK Virus
PIDSGKTTL

SEQ ID NO: 56393 - protein, 9 aa, BK Virus
DLLGLERAA

SEQ ID NO: 56394 - protein, 9 aa, BK Virus
PMERLTFEL

SEQ ID NO: 56395 - protein, 9 aa, BK Virus
LVTMNEYPV

SEQ ID NO: 56396 - protein, 9 aa, BK Virus
LTFELGVAI

SEQ ID NO: 56397 - protein, 9 aa, BK Virus
ALTRDPYHI

SEQ ID NO: 56398 - protein, 9 aa, BK Virus
AINNFCQKL

SEQ ID NO: 56399 - protein, 9 aa, BK Virus
DYLDGSVKV

SEQ ID NO: 56400 - protein, 9 aa, BK Virus
FASDEEATA

SEQ ID NO: 56401 - protein, 9 aa, BK Virus
LLGMYLEFQ

SEQ ID NO: 56402 - protein, 9 aa, BK Virus
HMCAGHNII

SEQ ID NO: 56403 - protein, 9 aa, BK Virus
HILDKMDLI

SEQ ID NO: 56404 - protein, 9 aa, BK Virus
LLPKMDSVI

SEQ ID NO: 56405 - protein, 9 aa, BK Virus
GVAIDQYMV

SEQ ID NO: 56406 - protein, 9 aa, BK Virus
KMDSVIFDF

SEQ ID NO: 56407 - protein, 9 aa, BK Virus
ILYKKLMEK

SEQ ID NO: 56408 - protein, 9 aa, BK Virus
RILQSGMTL

SEQ ID NO: 56409 - protein, 9 aa, BK Virus
FPSDLHQFL

SEQ ID NO: 56410 - protein, 9 aa, BK Virus
WLHCLLPKM

SEQ ID NO: 56411 - protein, 9 aa, BK Virus
FLTPHRHRV

SEQ ID NO: 56412 - protein, 9 aa, BK Virus
VIFDFLHCV

SEQ ID NO: 56413 - protein, 9 aa, BK Virus
VLEQYMAGV

SEQ ID NO: 56414 - protein, 9 aa, BK Virus
CLLPKMDSV

SEQ ID NO: 56415 - protein, 9 aa, BK Virus
FLHCVVFNV

SEQ ID NO: 56416 - protein, 9 aa, BK Virus
ILQSGMTLL

SEQ ID NO: 56417 - protein, 9 aa, BK Virus
NLDSLRDYL

SEQ ID NO: 56418 - protein, 9 aa, BK Virus
SLQNSEFLL

SEQ ID NO: 56419 - protein, 9 aa, BK Virus
PMERLTFEL

SEQ ID NO: 56420 - protein, 9 aa, BK Virus
PIDSGKTTL

SEQ ID NO: 56421 - protein, 9 aa, BK Virus
LLLIWFRPV

SEQ ID NO: 56422 - protein, 9 aa, BK Virus
TLAAGLLDL

SEQ ID NO: 56423 - protein, 9 aa, BK Virus
LVTMNEYPV

SEQ ID NO: 56424 - protein, 9 aa, BK Virus
LLGMYLEFQ

SEQ ID NO: 56425 - protein, 9 aa, BK Virus
KLCTFSFLI

SEQ ID NO: 56426 - protein, 9 aa, BK Virus
DLHQFLSQA

SEQ ID NO: 56427 - protein, 9 aa, BK Virus
MYLEFQYNV

SEQ ID NO: 56428 - protein, 9 aa, BK Virus
FLLEKRILQ

SEQ ID NO: 56429 - protein, 9 aa, BK Virus
RIVEWKERL

SEQ ID NO: 56430 - protein, 9 aa, BK Virus
ALTRDPYHI

SEQ ID NO: 56431 - protein, 9 aa, BK Virus
NVPKRRYWL

SEQ ID NO: 56432 - protein, 9 aa, BK Virus
GVAIDQYMV

SEQ ID NO: 56433 - protein, 9 aa, BK Virus
MLTERFNHI

SEQ ID NO: 56434 - protein, 9 aa, BK Virus
TLACFAVYT

SEQ ID NO: 56435 - protein, 9 aa, BK Virus
AINNFCQKL

SEQ ID NO: 56436 - protein, 9 aa, BK Virus
RILQSGMTL

SEQ ID NO: 56437 - protein, 9 aa, BK Virus
DYLDGSVKV

SEQ ID NO: 56438 - protein, 9 aa, BK Virus
LLPKMDSVI

SEQ ID NO: 56439 - protein, 9 aa, BK Virus
LLIWFRPVA

SEQ ID NO: 56440 - protein, 9 aa, BK Virus
GVAWLHCLL

SEQ ID NO: 56441 - protein, 9 aa, BK Virus
TLHMTREEM

SEQ ID NO: 56442 - protein, 9 aa, BK Virus
NICMGKCIL

SEQ ID NO: 56443 - protein, 9 aa, BK Virus
SQSQCSSQV

SEQ ID NO: 56444 - protein, 9 aa, BK Virus
ILYKKLMEK

SEQ ID NO: 56445 - protein, 9 aa, BK Virus
VAIDQYMVV

SEQ ID NO: 56446 - protein, 9 aa, BK Virus
HMCAGHNII

SEQ ID NO: 56447 - protein, 9 aa, BK Virus
HILDKMDLI

SEQ ID NO: 56448 - protein, 9 aa, BK Virus
FLTPHRHRV

SEQ ID NO: 56449 - protein, 9 aa, BK Virus
VIFDFLHCV

SEQ ID NO: 56450 - protein, 9 aa, BK Virus
FLHCVVFNV

SEQ ID NO: 56451 - protein, 9 aa, BK Virus
CLLPKMDSV

SEQ ID NO: 56452 - protein, 9 aa, BK Virus
ILQSGMTLL

SEQ ID NO: 56453 - protein, 9 aa, BK Virus
TLAAGLLDL

SEQ ID NO: 56454 - protein, 9 aa, BK Virus
VLEQYMAGV

SEQ ID NO: 56455 - protein, 9 aa, BK Virus
NLDSLRDYL

SEQ ID NO: 56456 - protein, 9 aa, BK Virus
PIDSGKTTL

SEQ ID NO: 56457 - protein, 9 aa, BK Virus
SLQNSEFLL

SEQ ID NO: 56458 - protein, 9 aa, BK Virus
LLLIWFRPV

SEQ ID NO: 56459 - protein, 9 aa, BK Virus
MYLEFQYNV

SEQ ID NO: 56460 - protein, 9 aa, BK Virus
LVTMNEYPV

SEQ ID NO: 56461 - protein, 9 aa, BK Virus
MLTERFNHI

SEQ ID NO: 56462 - protein, 9 aa, BK Virus
DYLDGSVKV

SEQ ID NO: 56463 - protein, 9 aa, BK Virus
AAWGNLPLM

SEQ ID NO: 56464 - protein, 9 aa, BK Virus
PMERLTFEL

SEQ ID NO: 56465 - protein, 9 aa, BK Virus
ALTRDPYHI

SEQ ID NO: 56466 - protein, 9 aa, BK Virus
FLSQAVFSN

SEQ ID NO: 56467 - protein, 9 aa, BK Virus
ILYKKLMEK

SEQ ID NO: 56468 - protein, 9 aa, BK Virus
SMYTFSRMK

SEQ ID NO: 56469 - protein, 9 aa, BK Virus
LMRKAYLKK

SEQ ID NO: 56470 - protein, 9 aa, BK Virus
IIFFLTPHR

SEQ ID NO: 56471 - protein, 9 aa, BK Virus
KMKRMNTLY

SEQ ID NO: 56472 - protein, 9 aa, BK Virus
CTFSFLICK

SEQ ID NO: 56473 - protein, 9 aa, BK Virus
FLICKGVNK

SEQ ID NO: 56474 - protein, 9 aa, BK Virus
TMNEYPVPK

SEQ ID NO: 56475 - protein, 9 aa, BK Virus
RTLACFAVY

SEQ ID NO: 56476 - protein, 9 aa, BK Virus
PLMRKAYLK

SEQ ID NO: 56477 - protein, 9 aa, BK Virus
GVNKEYLLY

SEQ ID NO: 56478 - protein, 9 aa, BK Virus
SQHSTPPKK

SEQ ID NO: 56479 - protein, 9 aa, BK Virus
YLLYSALTR

SEQ ID NO: 56480 - protein, 9 aa, BK Virus
AVDTVLAKK

SEQ ID NO: 56481 - protein, 9 aa, BK Virus
LLLLLIWFR

SEQ ID NO: 56482 - protein, 9 aa, BK Virus
HSQELHLCK

SEQ ID NO: 56483 - protein, 9 aa, BK Virus
GSVKVNLEK

SEQ ID NO: 56484 - protein, 9 aa, BK Virus
NLEKKHLNK

SEQ ID NO: 56485 - protein, 9 aa, BK Virus
RVDTLHMTR

SEQ ID NO: 56486 - protein, 9 aa, BK Virus
RLDSEISMY

SEQ ID NO: 56487 - protein, 9 aa, BK Virus
CTFSFLICK

SEQ ID NO: 56488 - protein, 9 aa, BK Virus
TMNEYPVPK

SEQ ID NO: 56489 - protein, 9 aa, BK Virus
SMYTFSRMK

SEQ ID NO: 56490 - protein, 9 aa, BK Virus
SAINNFCQK

SEQ ID NO: 56491 - protein, 9 aa, BK Virus
ILYKKLMEK

SEQ ID NO: 56492 - protein, 9 aa, BK Virus
HSQELHLCK

SEQ ID NO: 56493 - protein, 9 aa, BK Virus
AVDTVLAKK

SEQ ID NO: 56494 - protein, 9 aa, BK Virus
IIFFLTPHR

SEQ ID NO: 56495 - protein, 9 aa, BK Virus
GSVKVNLEK

SEQ ID NO: 56496 - protein, 9 aa, BK Virus
SQHSTPPKK

SEQ ID NO: 56497 - protein, 9 aa, BK Virus
LSQAVFSNR

SEQ ID NO: 56498 - protein, 9 aa, BK Virus
KTLQARFVR

SEQ ID NO: 56499 - protein, 9 aa, BK Virus
RTLACFAVY

SEQ ID NO: 56500 - protein, 9 aa, BK Virus
QAVDTVLAK

SEQ ID NO: 56501 - protein, 9 aa, BK Virus
SVKVNLEKK

SEQ ID NO: 56502 - protein, 9 aa, BK Virus
PLMRKAYLK

SEQ ID NO: 56503 - protein, 9 aa, BK Virus
DSQHSTPPK

SEQ ID NO: 56504 - protein, 9 aa, BK Virus
AWLHCLLPK

SEQ ID NO: 56505 - protein, 9 aa, BK Virus
VVFNVPKRR

SEQ ID NO: 56506 - protein, 9 aa, BK Virus
GLLDLCGGK

SEQ ID NO: 56507 - protein, 9 aa, BK Virus
NAIIFAESK

SEQ ID NO: 56508 - protein, 9 aa, BK Virus
RVDTLHMTR

SEQ ID NO: 56509 - protein, 9 aa, BK Virus
GVNKEYLLY

SEQ ID NO: 56510 - protein, 9 aa, BK Virus
EISMYTFSR

SEQ ID NO: 56511 - protein, 9 aa, BK Virus
ITEYAVETK

SEQ ID NO: 56512 - protein, 9 aa, BK Virus
IQSRIVEWK

SEQ ID NO: 56513 - protein, 9 aa, BK Virus
GINNLDSLR

SEQ ID NO: 56514 - protein, 9 aa, BK Virus
FQYNVEECK

SEQ ID NO: 56515 - protein, 9 aa, BK Virus
LLLLLIWFR

SEQ ID NO: 56516 - protein, 9 aa, BK Virus
SWWSSFNEK

SEQ ID NO: 56517 - protein, 9 aa, BK Virus
ACFAVYTTK

SEQ ID NO: 56518 - protein, 9 aa, BK Virus
FLICKGVNK

SEQ ID NO: 56519 - protein, 9 aa, BK Virus
AYLKKCKEF

SEQ ID NO: 56520 - protein, 9 aa, BK Virus
IWFRPVADF

SEQ ID NO: 56521 - protein, 9 aa, BK Virus
PYHFKYHEK

SEQ ID NO: 56522 - protein, 9 aa, BK Virus
SWWSSFNEK

SEQ ID NO: 56523 - protein, 9 aa, BK Virus
QYMAGVAWL

SEQ ID NO: 56524 - protein, 9 aa, BK Virus
CAGHNIIFF

SEQ ID NO: 56525 - protein, 9 aa, BK Virus
KMDSVIFDF

SEQ ID NO: 56526 - protein, 9 aa, BK Virus
VFLLLGMYL

SEQ ID NO: 56527 - protein, 9 aa, BK Virus
MYLEFQYNV

SEQ ID NO: 56528 - protein, 9 aa, BK Virus
DFPSDLHQF

SEQ ID NO: 56529 - protein, 9 aa, BK Virus
HFKYHEKHF

SEQ ID NO: 56530 - protein, 9 aa, BK Virus
TLLLLLIWF

SEQ ID NO: 56531 - protein, 9 aa, BK Virus
CQKLCTFSF

SEQ ID NO: 56532 - protein, 9 aa, BK Virus
AWLHCLLPK

SEQ ID NO: 56533 - protein, 9 aa, BK Virus
LLLGMYLEF

SEQ ID NO: 56534 - protein, 9 aa, BK Virus
KHFANAIIF

SEQ ID NO: 56535 - protein, 9 aa, BK Virus
IFAESKNQK

SEQ ID NO: 56536 - protein, 9 aa, BK Virus
MYTFSRMKY

SEQ ID NO: 56537 - protein, 9 aa, BK Virus
NFCQKLCTF

SEQ ID NO: 56538 - protein, 9 aa, BK Virus
TFSRMKYNI

SEQ ID NO: 56539 - protein, 9 aa, BK Virus
EWESWWSSF

SEQ ID NO: 56540 - protein, 9 aa, BK Virus
QYMAGVAWL

SEQ ID NO: 56541 - protein, 9 aa, BK Virus
DFPSDLHQF

SEQ ID NO: 56542 - protein, 9 aa, BK Virus
PYHIIEESI

SEQ ID NO: 56543 - protein, 9 aa, BK Virus
AYLKKCKEF

SEQ ID NO: 56544 - protein, 9 aa, BK Virus
IWFRPVADF

SEQ ID NO: 56545 - protein, 9 aa, BK Virus
QYMVVFEDV

SEQ ID NO: 56546 - protein, 9 aa, BK Virus
TFSRMKYNI

SEQ ID NO: 56547 - protein, 9 aa, BK Virus
VFLLLGMYL

SEQ ID NO: 56548 - protein, 9 aa, BK Virus
VPKRRYWLF

SEQ ID NO: 56549 - protein, 9 aa, BK Virus
AYLKKCKEF

SEQ ID NO: 56550 - protein, 9 aa, BK Virus
QYMAGVAWL

SEQ ID NO: 56551 - protein, 9 aa, BK Virus
DFPSDLHQF

SEQ ID NO: 56552 - protein, 9 aa, BK Virus
KHFANAIIF

SEQ ID NO: 56553 - protein, 9 aa, BK Virus
IFPPGLVTM

SEQ ID NO: 56554 - protein, 9 aa, BK Virus
AHQPDFGTW

SEQ ID NO: 56555 - protein, 9 aa, BK Virus
VFLLLGMYL

SEQ ID NO: 56556 - protein, 9 aa, BK Virus
IWFRPVADF

SEQ ID NO: 56557 - protein, 9 aa, BK Virus
KMDSVIFDF

SEQ ID NO: 56558 - protein, 9 aa, BK Virus
CAGHNIIFF

SEQ ID NO: 56559 - protein, 9 aa, BK Virus
QYMVVFEDV

SEQ ID NO: 56560 - protein, 9 aa, BK Virus
NFCQKLCTF

SEQ ID NO: 56561 - protein, 9 aa, BK Virus
DVFLLLGMY

SEQ ID NO: 56562 - protein, 9 aa, BK Virus
ETKQVSWKL

SEQ ID NO: 56563 - protein, 9 aa, BK Virus
ESMELMDLL

SEQ ID NO: 56564 - protein, 9 aa, BK Virus
DVFLLLGMY

SEQ ID NO: 56565 - protein, 9 aa, BK Virus
AIDQYMVVF

SEQ ID NO: 56566 - protein, 9 aa, BK Virus
ETKCEDVFL

SEQ ID NO: 56567 - protein, 9 aa, BK Virus
QIDFRPKIY

SEQ ID NO: 56568 - protein, 9 aa, BK Virus
DFPSDLHQF

SEQ ID NO: 56569 - protein, 9 aa, BK Virus
GVNKEYLLY

SEQ ID NO: 56570 - protein, 9 aa, BK Virus
RTLACFAVY

SEQ ID NO: 56571 - protein, 9 aa, BK Virus
FSNRTLACF

SEQ ID NO: 56572 - protein, 9 aa, BK Virus
ETKQVSWKL

SEQ ID NO: 56573 - protein, 9 aa, BK Virus
ESMELMDLL

SEQ ID NO: 56574 - protein, 9 aa, BK Virus
DLFCHEDMF

SEQ ID NO: 56575 - protein, 9 aa, BK Virus
NVNLPMERL

SEQ ID NO: 56576 - protein, 9 aa, BK Virus
TTKEKAQIL

SEQ ID NO: 56577 - protein, 9 aa, BK Virus
LGMYLEFQY

SEQ ID NO: 56578 - protein, 9 aa, BK Virus
KMKRMNTLY

SEQ ID NO: 56579 - protein, 9 aa, BK Virus
VSWKLITEY

SEQ ID NO: 56580 - protein, 9 aa, BK Virus
DVFLLLGMY

SEQ ID NO: 56581 - protein, 9 aa, BK Virus
GVNKEYLLY

SEQ ID NO: 56582 - protein, 9 aa, BK Virus
MYTFSRMKY

SEQ ID NO: 56583 - protein, 9 aa, BK Virus
VFNVPKRRY

SEQ ID NO: 56584 - protein, 9 aa, BK Virus
LMRKAYLKK

SEQ ID NO: 56585 - protein, 9 aa, BK Virus
MKRMNTLYK

SEQ ID NO: 56586 - protein, 9 aa, BK Virus
KCKEFHPDK

SEQ ID NO: 56587 - protein, 9 aa, BK Virus
PKRRYWLFK

SEQ ID NO: 56588 - protein, 9 aa, BK Virus
SQHSTPPKK

SEQ ID NO: 56589 - protein, 9 aa, BK Virus
KRPKTPPPK

SEQ ID NO: 56590 - protein, 9 aa, BK Virus
TMNEYPVPK

SEQ ID NO: 56591 - protein, 9 aa, BK Virus
GFQCFKRPK

SEQ ID NO: 56592 - protein, 9 aa, BK Virus
DSQHSTPPK

SEQ ID NO: 56593 - protein, 9 aa, BK Virus
LCKGFQCFK

SEQ ID NO: 56594 - protein, 9 aa, BK Virus
KKRKVEDPK

SEQ ID NO: 56595 - protein, 9 aa, BK Virus
ACFAVYTTK

SEQ ID NO: 56596 - protein, 9 aa, BK Virus
KTLQARFVR

SEQ ID NO: 56597 - protein, 9 aa, BK Virus
SVKVNLEKK

SEQ ID NO: 56598 - protein, 9 aa, BK Virus
SMYTFSRMK

SEQ ID NO: 56599 - protein, 9 aa, BK Virus
KEKAQILYK

SEQ ID NO: 56600 - protein, 9 aa, BK Virus
PYHFKYHEK

SEQ ID NO: 56601 - protein, 9 aa, BK Virus
IIFFLTPHR

SEQ ID NO: 56602 - protein, 9 aa, BK Virus
AWLHCLLPK

SEQ ID NO: 56603 - protein, 9 aa, BK Virus
KMKRMNTLY

SEQ ID NO: 56604 - protein, 9 aa, BK Virus
QAVDTVLAK

SEQ ID NO: 56605 - protein, 9 aa, BK Virus
ITEYAVETK

SEQ ID NO: 56606 - protein, 9 aa, BK Virus
STPPKKKRK

SEQ ID NO: 56607 - protein, 9 aa, BK Virus
ILYKKLMEK

SEQ ID NO: 56608 - protein, 9 aa, BK Virus
HCVVFNVPK

SEQ ID NO: 56609 - protein, 9 aa, BK Virus
PLMRKAYLK

SEQ ID NO: 56610 - protein, 9 aa, BK Virus
RQIDFRPKI

SEQ ID NO: 56611 - protein, 9 aa, BK Virus
HSQELHLCK

SEQ ID NO: 56612 - protein, 9 aa, BK Virus
KRMNTLYKK

SEQ ID NO: 56613 - protein, 9 aa, BK Virus
KMKRMNTLY

SEQ ID NO: 56614 - protein, 9 aa, BK Virus
KMDSVIFDF

SEQ ID NO: 56615 - protein, 9 aa, BK Virus
LYKKLMEKY

SEQ ID NO: 56616 - protein, 9 aa, BK Virus
DVFLLLGMY

SEQ ID NO: 56617 - protein, 9 aa, BK Virus
MYTFSRMKY

SEQ ID NO: 56618 - protein, 9 aa, BK Virus
GVNKEYLLY

SEQ ID NO: 56619 - protein, 9 aa, BK Virus
RLDSEISMY

SEQ ID NO: 56620 - protein, 9 aa, BK Virus
KTLQARFVR

SEQ ID NO: 56621 - protein, 9 aa, BK Virus
LLLLLIWFR

SEQ ID NO: 56622 - protein, 9 aa, BK Virus
KYSVTFISR

SEQ ID NO: 56623 - protein, 9 aa, BK Virus
RFVRQIDFR

SEQ ID NO: 56624 - protein, 9 aa, BK Virus
LSQAVFSNR

SEQ ID NO: 56625 - protein, 9 aa, BK Virus
DFRPKIYLR

SEQ ID NO: 56626 - protein, 9 aa, BK Virus
IIFFLTPHR

SEQ ID NO: 56627 - protein, 9 aa, BK Virus
TMNEYPVPK

SEQ ID NO: 56628 - protein, 9 aa, BK Virus
RVDTLHMTR

SEQ ID NO: 56629 - protein, 9 aa, BK Virus
FFLTPHRHR

SEQ ID NO: 56630 - protein, 9 aa, BK Virus
GINNLDSLR

SEQ ID NO: 56631 - protein, 9 aa, BK Virus
VVFNVPKRR

SEQ ID NO: 56632 - protein, 9 aa, BK Virus
EISMYTFSR

SEQ ID NO: 56633 - protein, 9 aa, BK Virus
RTLACFAVY

SEQ ID NO: 56634 - protein, 9 aa, BK Virus
SMYTFSRMK

SEQ ID NO: 56635 - protein, 9 aa, BK Virus
CTFSFLICK

SEQ ID NO: 56636 - protein, 9 aa, BK Virus
KMKRMNTLY

SEQ ID NO: 56637 - protein, 9 aa, BK Virus
SWWSSFNEK

SEQ ID NO: 56638 - protein, 9 aa, BK Virus
HSTPPKKKR

SEQ ID NO: 56639 - protein, 9 aa, BK Virus
MYLEFQYNV

SEQ ID NO: 56640 - protein, 9 aa, BK Virus
GFQCFKRPK

SEQ ID NO: 56641 - protein, 9 aa, BK Virus
YLLYSALTR

SEQ ID NO: 56642 - protein, 9 aa, BK Virus
LMRKAYLKK

SEQ ID NO: 56643 - protein, 9 aa, BK Virus
DFRPKIYLR

SEQ ID NO: 56644 - protein, 9 aa, BK Virus
LLLLLIWFR

SEQ ID NO: 56645 - protein, 9 aa, BK Virus
EISMYTFSR

SEQ ID NO: 56646 - protein, 9 aa, BK Virus
IIFFLTPHR

SEQ ID NO: 56647 - protein, 9 aa, BK Virus
DFSKDIQSR

SEQ ID NO: 56648 - protein, 9 aa, BK Virus
FFLTPHRHR

SEQ ID NO: 56649 - protein, 9 aa, BK Virus
LSQAVFSNR

SEQ ID NO: 56650 - protein, 9 aa, BK Virus
YLLYSALTR

SEQ ID NO: 56651 - protein, 9 aa, BK Virus
EISMYTFSR

SEQ ID NO: 56652 - protein, 9 aa, BK Virus
CVVFNVPKR

SEQ ID NO: 56653 - protein, 9 aa, BK Virus
IIFFLTPHR

SEQ ID NO: 56654 - protein, 9 aa, BK Virus
CTFSFLICK

SEQ ID NO: 56655 - protein, 9 aa, BK Virus
NAIIFAESK

SEQ ID NO: 56656 - protein, 9 aa, BK Virus
SAINNFCQK

SEQ ID NO: 56657 - protein, 9 aa, BK Virus
FAVYTTKEK

SEQ ID NO: 56658 - protein, 9 aa, BK Virus
ITEYAVETK

SEQ ID NO: 56659 - protein, 9 aa, BK Virus
LSQAVFSNR

SEQ ID NO: 56660 - protein, 9 aa, BK Virus
KTLQARFVR

SEQ ID NO: 56661 - protein, 9 aa, BK Virus
YLLYSALTR

SEQ ID NO: 56662 - protein, 9 aa, BK Virus
MKYNICMGK

SEQ ID NO: 56663 - protein, 9 aa, BK Virus
GINNLDSLR

SEQ ID NO: 56664 - protein, 9 aa, BK Virus
VVFNVPKRR

SEQ ID NO: 56665 - protein, 9 aa, BK Virus
NSEFLLEKR

SEQ ID NO: 56666 - protein, 9 aa, BK Virus
SMYTFSRMK

SEQ ID NO: 56667 - protein, 9 aa, BK Virus
EKAQILYKK

SEQ ID NO: 56668 - protein, 9 aa, BK Virus
MYTFSRMKY

SEQ ID NO: 56669 - protein, 9 aa, BK Virus
LLLLLIWFR

SEQ ID NO: 56670 - protein, 9 aa, BK Virus
YMVVFEDVK

SEQ ID NO: 56671 - protein, 9 aa, BK Virus
FQYNVEECK

SEQ ID NO: 56672 - protein, 9 aa, BK Virus
HSTPPKKKR

SEQ ID NO: 56673 - protein, 9 aa, BK Virus
QAVDTVLAK

SEQ ID NO: 56674 - protein, 9 aa, BK Virus
HSQELHLCK

SEQ ID NO: 56675 - protein, 9 aa, BK Virus
SVKVNLEKK

SEQ ID NO: 56676 - protein, 9 aa, BK Virus
DSQHSTPPK

SEQ ID NO: 56677 - protein, 9 aa, BK Virus
TMNEYPVPK

SEQ ID NO: 56678 - protein, 9 aa, BK Virus
ILYKKLMEK

SEQ ID NO: 56679 - protein, 9 aa, BK Virus
GSVKVNLEK

SEQ ID NO: 56680 - protein, 9 aa, BK Virus
DVFLLLGMY

SEQ ID NO: 56681 - protein, 9 aa, BK Virus
LNVNLPMER

SEQ ID NO: 56682 - protein, 9 aa, BK Virus
RVDTLHMTR

SEQ ID NO: 56683 - protein, 9 aa, BK Virus
DSVIFDFLH

SEQ ID NO: 56684 - protein, 9 aa, BK Virus
YMAGVAWLH

SEQ ID NO: 56685 - protein, 9 aa, BK Virus
DFSKDIQSR

SEQ ID NO: 56686 - protein, 9 aa, BK Virus
DFRPKIYLR

SEQ ID NO: 56687 - protein, 9 aa, BK Virus
ESMELMDLL

SEQ ID NO: 56688 - protein, 9 aa, BK Virus
FLHCVVFNV

SEQ ID NO: 56689 - protein, 9 aa, BK Virus
MDSVIFDFL

SEQ ID NO: 56690 - protein, 9 aa, BK Virus
NVNLPMERL

SEQ ID NO: 56691 - protein, 9 aa, BK Virus
FSFLICKGV

SEQ ID NO: 56692 - protein, 9 aa, BK Virus
ETKQVSWKL

SEQ ID NO: 56693 - protein, 9 aa, BK Virus
ETKCEDVFL

SEQ ID NO: 56694 - protein, 9 aa, BK Virus
NVPKRRYWL

SEQ ID NO: 56695 - protein, 9 aa, BK Virus
LVTMNEYPV

SEQ ID NO: 56696 - protein, 9 aa, BK Virus
VIFDFLHCV

SEQ ID NO: 56697 - protein, 9 aa, BK Virus
FGTWNSSEV

SEQ ID NO: 56698 - protein, 9 aa, BK Virus
LTFELGVAI

SEQ ID NO: 56699 - protein, 9 aa, BK Virus
DKMDLIFGA

SEQ ID NO: 56700 - protein, 9 aa, BK Virus
FSKDIQSRI

SEQ ID NO: 56701 - protein, 9 aa, BK Virus
FLTPHRHRV

SEQ ID NO: 56702 - protein, 9 aa, BK Virus
TQIFPPGLV

SEQ ID NO: 56703 - protein, 9 aa, BK Virus
FGAHGNAVL

SEQ ID NO: 56704 - protein, 9 aa, BK Virus
TLACFAVYT

SEQ ID NO: 56705 - protein, 9 aa, BK Virus
VAIDQYMVV

SEQ ID NO: 56706 - protein, 9 aa, BK Virus
QYMVVFEDV

SEQ ID NO: 56707 - protein, 9 aa, BK Virus
ISMYTFSRM

SEQ ID NO: 56708 - protein, 9 aa, BK Virus
DTVLAKKRV

SEQ ID NO: 56709 - protein, 9 aa, BK Virus
MLTERFNHI

SEQ ID NO: 56710 - protein, 9 aa, BK Virus
AGHNIIFFL

SEQ ID NO: 56711 - protein, 9 aa, BK Virus
NRTLACFAV

SEQ ID NO: 56712 - protein, 9 aa, BK Virus
LTFELGVAI

SEQ ID NO: 56713 - protein, 9 aa, BK Virus
VIFDFLHCV

SEQ ID NO: 56714 - protein, 9 aa, BK Virus
FLHCVVFNV

SEQ ID NO: 56715 - protein, 9 aa, BK Virus
LLLIWFRPV

SEQ ID NO: 56716 - protein, 9 aa, BK Virus
ESMELMDLL

SEQ ID NO: 56717 - protein, 9 aa, BK Virus
HILDKMDLI

SEQ ID NO: 56718 - protein, 9 aa, BK Virus
FPSDLHQFL

SEQ ID NO: 56719 - protein, 9 aa, BK Virus
MYLEFQYNV

SEQ ID NO: 56720 - protein, 9 aa, BK Virus
AAWGNLPLM

SEQ ID NO: 56721 - protein, 9 aa, BK Virus
FLTPHRHRV

SEQ ID NO: 56722 - protein, 9 aa, BK Virus
ETKQVSWKL

SEQ ID NO: 56723 - protein, 9 aa, BK Virus
DYLDGSVKV

SEQ ID NO: 56724 - protein, 9 aa, BK Virus
VAIDQYMVV

SEQ ID NO: 56725 - protein, 9 aa, BK Virus
RAAWGNLPL

SEQ ID NO: 56726 - protein, 9 aa, BK Virus
LPLMRKAYL

SEQ ID NO: 56727 - protein, 9 aa, BK Virus
TPHRHRVSA

SEQ ID NO: 56728 - protein, 9 aa, BK Virus
YPVPKTLQA

SEQ ID NO: 56729 - protein, 9 aa, BK Virus
LPKMDSVIF

SEQ ID NO: 56730 - protein, 9 aa, BK Virus
RILQSGMTL

SEQ ID NO: 56731 - protein, 9 aa, BK Virus
VPTYGTEEW

SEQ ID NO: 56732 - protein, 9 aa, BK Virus
FPSDLHQFL

SEQ ID NO: 56733 - protein, 9 aa, BK Virus
VPKRRYWLF

SEQ ID NO: 56734 - protein, 9 aa, BK Virus
VPKRRYWLF

SEQ ID NO: 56735 - protein, 9 aa, BK Virus
HQFLSQAVF

SEQ ID NO: 56736 - protein, 9 aa, BK Virus
YSALTRDPY

SEQ ID NO: 56737 - protein, 9 aa, BK Virus
KMKRMNTLY

SEQ ID NO: 56738 - protein, 9 aa, BK Virus
CQKLCTFSF

SEQ ID NO: 56739 - protein, 9 aa, BK Virus
RTLACFAVY

SEQ ID NO: 56740 - protein, 9 aa, BK Virus
HLNKRTQIF

SEQ ID NO: 56741 - protein, 9 aa, BK Virus
LLLGMYLEF

SEQ ID NO: 56742 - protein, 9 aa, BK Virus
LQSGMTLLL

SEQ ID NO: 56743 - protein, 9 aa, BK Virus
FSNRTLACF

SEQ ID NO: 56744 - protein, 9 aa, BK Virus
LMEKYSVTF

SEQ ID NO: 56745 - protein, 9 aa, BK Virus
RAAWGNLPL

SEQ ID NO: 56746 - protein, 9 aa, BK Virus
YMAGVAWLH

SEQ ID NO: 56747 - protein, 9 aa, BK Virus
MELMDLLGL

SEQ ID NO: 56748 - protein, 9 aa, BK Virus
NEYPVPKTL

SEQ ID NO: 56749 - protein, 9 aa, BK Virus
QELHLCKGF

SEQ ID NO: 56750 - protein, 9 aa, BK Virus
KEYLLYSAL

SEQ ID NO: 56751 - protein, 9 aa, BK Virus
SENPHSQEL

SEQ ID NO: 56752 - protein, 9 aa, BK Virus
KRMNTLYKK

SEQ ID NO: 56753 - protein, 9 aa, BK Virus
FRPKIYLRK

SEQ ID NO: 56754 - protein, 9 aa, BK Virus
RRYWLFKGP

SEQ ID NO: 56755 - protein, 9 aa, BK Virus
ERFNHILDK

SEQ ID NO: 56756 - protein, 9 aa, BK Virus
SRMKYNICM

SEQ ID NO: 56757 - protein, 9 aa, BK Virus
ARFVRQIDF

SEQ ID NO: 56758 - protein, 9 aa, BK Virus
KRPKTPPPK

SEQ ID NO: 56759 - protein, 9 aa, BK Virus
LPKMDSVIF

SEQ ID NO: 56760 - protein, 9 aa, BK Virus
FPSDLHQFL

SEQ ID NO: 56761 - protein, 9 aa, BK Virus
RAAWGNLPL

SEQ ID NO: 56762 - protein, 9 aa, BK Virus
YSALTRDPY

SEQ ID NO: 56763 - protein, 9 aa, BK Virus
KALNVNLPM

SEQ ID NO: 56764 - protein, 9 aa, BK Virus
AAWGNLPLM

SEQ ID NO: 56765 - protein, 9 aa, BK Virus
MCAGHNIIF

SEQ ID NO: 56766 - protein, 9 aa, BK Virus
FASDEEATA

SEQ ID NO: 56767 - protein, 9 aa, BK Virus
VPKTLQARF

SEQ ID NO: 56768 - protein, 9 aa, BK Virus
VPTYGTEEW

SEQ ID NO: 56769 - protein, 9 aa, BK Virus
VSWKLITEY

SEQ ID NO: 56770 - protein, 9 aa, BK Virus
DVFLLLGMY

SEQ ID NO: 56771 - protein, 9 aa, BK Virus
YPVPKTLQA

SEQ ID NO: 56772 - protein, 9 aa, BK Virus
LMEKYSVTF

SEQ ID NO: 56773 - protein, 9 aa, BK Virus
RTLACFAVY

SEQ ID NO: 56774 - protein, 9 aa, BK Virus
NPHSQELHL

SEQ ID NO: 56775 - protein, 9 aa, BK Virus
FGAHGNAVL

SEQ ID NO: 56776 - protein, 9 aa, BK Virus
MELMDLLGL

SEQ ID NO: 56777 - protein, 9 aa, BK Virus
KEYLLYSAL

SEQ ID NO: 56778 - protein, 9 aa, BK Virus
SENPHSQEL

SEQ ID NO: 56779 - protein, 9 aa, BK Virus
NEYPVPKTL

SEQ ID NO: 56780 - protein, 9 aa, BK Virus
EESMELMDL

SEQ ID NO: 56781 - protein, 9 aa, BK Virus
IEESIQGGL

SEQ ID NO: 56782 - protein, 9 aa, BK Virus
SEFLLEKRI

SEQ ID NO: 56783 - protein, 9 aa, BK Virus
LERAAWGNL

SEQ ID NO: 56784 - protein, 9 aa, BK Virus
REEMLTERF

SEQ ID NO: 56785 - protein, 9 aa, BK Virus
SENPHSQEL

SEQ ID NO: 56786 - protein, 9 aa, BK Virus
KEYLLYSAL

SEQ ID NO: 56787 - protein, 9 aa, BK Virus
SEISMYTFS

SEQ ID NO: 56788 - protein, 9 aa, BK Virus
VETKCEDVF

SEQ ID NO: 56789 - protein, 9 aa, BK Virus
MEKYSVTFI

SEQ ID NO: 56790 - protein, 9 aa, BK Virus
SEISMYTFS

SEQ ID NO: 56791 - protein, 9 aa, BK Virus
SEFLLEKRI

SEQ ID NO: 56792 - protein, 9 aa, BK Virus
SENPHSQEL

SEQ ID NO: 56793 - protein, 9 aa, BK Virus
AESKNQKSI

SEQ ID NO: 56794 - protein, 9 aa, BK Virus
LPMERLTFE

SEQ ID NO: 56795 - protein, 9 aa, BK Virus
FPSDLHQFL

SEQ ID NO: 56796 - protein, 9 aa, BK Virus
VPTYGTEEW

SEQ ID NO: 56797 - protein, 9 aa, BK Virus
LPKMDSVIF

SEQ ID NO: 56798 - protein, 9 aa, BK Virus
LPLMRKAYL

SEQ ID NO: 56799 - protein, 9 aa, BK Virus
NPHSQELHL

SEQ ID NO: 56800 - protein, 9 aa, BK Virus
FPSDLHQFL

SEQ ID NO: 56801 - protein, 9 aa, BK Virus
MTLLLLLIW

SEQ ID NO: 56802 - protein, 9 aa, BK Virus
FPPGLVTMN

SEQ ID NO: 56803 - protein, 9 aa, BK Virus
TPHRHRVSA

SEQ ID NO: 56804 - protein, 9 aa, BK Virus
FSFLICKGV

SEQ ID NO: 56805 - protein, 9 aa, BK Virus
LPMERLTFE

SEQ ID NO: 56806 - protein, 9 aa, BK Virus
MTLLLLLIW

SEQ ID NO: 56807 - protein, 9 aa, BK Virus
KMDSVIFDF

SEQ ID NO: 56808 - protein, 9 aa, BK Virus
MTLLLLLIW

SEQ ID NO: 56809 - protein, 9 aa, BK Virus
FSNRTLACF

SEQ ID NO: 56810 - protein, 9 aa, BK Virus
YGTEEWESW

SEQ ID NO: 56811 - protein, 9 aa, BK Virus
RAAWGNLPL

SEQ ID NO: 56812 - protein, 9 aa, BK Virus
KALNVNLPM

SEQ ID NO: 56813 - protein, 9 aa, BK Virus
VSWKLITEY

SEQ ID NO: 56814 - protein, 10 aa, BK Virus
TTKEKAQILY

SEQ ID NO: 56815 - protein, 10 aa, BK Virus
KMDSVIFDFL

SEQ ID NO: 56816 - protein, 10 aa, BK Virus
GMYLEFQYNV

SEQ ID NO: 56817 - protein, 10 aa, BK Virus
VIFDFLHCVV

SEQ ID NO: 56818 - protein, 10 aa, BK Virus
GLVTMNEYPV

SEQ ID NO: 56819 - protein, 10 aa, BK Virus
YLDGSVKVNL

SEQ ID NO: 56820 - protein, 10 aa, BK Virus
ILQSGMTLLL

SEQ ID NO: 56821 - protein, 10 aa, BK Virus
LLLLIWFRPV

SEQ ID NO: 56822 - protein, 10 aa, BK Virus
AVLEQYMAGV

SEQ ID NO: 56823 - protein, 10 aa, BK Virus
MLTERFNHIL

SEQ ID NO: 56824 - protein, 10 aa, BK Virus
LMEKYSVTFI

SEQ ID NO: 56825 - protein, 10 aa, BK Virus
SVIFDFLHCV

SEQ ID NO: 56826 - protein, 10 aa, BK Virus
RLDSEISMYT

SEQ ID NO: 56827 - protein, 10 aa, BK Virus
SLRDYLDGSV

SEQ ID NO: 56828 - protein, 10 aa, BK Virus
KLITEYAVET

SEQ ID NO: 56829 - protein, 10 aa, BK Virus
LLLIWFRPVA

SEQ ID NO: 56830 - protein, 10 aa, BK Virus
FLLEKRILQS

SEQ ID NO: 56831 - protein, 10 aa, BK Virus
TLYKKMEQDV

SEQ ID NO: 56832 - protein, 10 aa, BK Virus
TMNEYPVPKT

SEQ ID NO: 56833 - protein, 10 aa, BK Virus
LMDLLGLERA

SEQ ID NO: 56834 - protein, 10 aa, BK Virus
RILQSGMTLL

SEQ ID NO: 56835 - protein, 10 aa, BK Virus
LLLGMYLEFQ

SEQ ID NO: 56836 - protein, 10 aa, BK Virus
VLNREESMEL

SEQ ID NO: 56837 - protein, 10 aa, BK Virus
KMDSVIFDFL

SEQ ID NO: 56838 - protein, 10 aa, BK Virus
RLDSEISMYT

SEQ ID NO: 56839 - protein, 10 aa, BK Virus
ILQSGMTLLL

SEQ ID NO: 56840 - protein, 10 aa, BK Virus
GMYLEFQYNV

SEQ ID NO: 56841 - protein, 10 aa, BK Virus
GLVTMNEYPV

SEQ ID NO: 56842 - protein, 10 aa, BK Virus
SLRDYLDGSV

SEQ ID NO: 56843 - protein, 10 aa, BK Virus
VIFDFLHCVV

SEQ ID NO: 56844 - protein, 10 aa, BK Virus
YLDGSVKVNL

SEQ ID NO: 56845 - protein, 10 aa, BK Virus
LLLGMYLEFQ

SEQ ID NO: 56846 - protein, 10 aa, BK Virus
LLLLIWFRPV

SEQ ID NO: 56847 - protein, 10 aa, BK Virus
FLLLGMYLEF

SEQ ID NO: 56848 - protein, 10 aa, BK Virus
LQSGMTLLLL

SEQ ID NO: 56849 - protein, 10 aa, BK Virus
LMDLLGLERA

SEQ ID NO: 56850 - protein, 10 aa, BK Virus
YMAGVAWLHC

SEQ ID NO: 56851 - protein, 10 aa, BK Virus
TLACFAVYTT

SEQ ID NO: 56852 - protein, 10 aa, BK Virus
KLMEKYSVTF

SEQ ID NO: 56853 - protein, 10 aa, BK Virus
VLNREESMEL

SEQ ID NO: 56854 - protein, 10 aa, BK Virus
CLLPKMDSVI

SEQ ID NO: 56855 - protein, 10 aa, BK Virus
DVFLLLGMYL

SEQ ID NO: 56856 - protein, 10 aa, BK Virus
TLAAGLLDLC

SEQ ID NO: 56857 - protein, 10 aa, BK Virus
MLTERFNHIL

SEQ ID NO: 56858 - protein, 10 aa, BK Virus
AVLEQYMAGV

SEQ ID NO: 56859 - protein, 10 aa, BK Virus
TLHMTREEML

SEQ ID NO: 56860 - protein, 10 aa, BK Virus
ELGVAIDQYM

SEQ ID NO: 56861 - protein, 10 aa, BK Virus
TLYKKMEQDV

SEQ ID NO: 56862 - protein, 10 aa, BK Virus
DLFCHEDMFA

SEQ ID NO: 56863 - protein, 10 aa, BK Virus
GVAIDQYMVV

SEQ ID NO: 56864 - protein, 10 aa, BK Virus
SMELMDLLGL

SEQ ID NO: 56865 - protein, 10 aa, BK Virus
DLHQFLSQAV

SEQ ID NO: 56866 - protein, 10 aa, BK Virus
YTFSRMKYNI

SEQ ID NO: 56867 - protein, 10 aa, BK Virus
KLITEYAVET

SEQ ID NO: 56868 - protein, 10 aa, BK Virus
LIFGAHGNAV

SEQ ID NO: 56869 - protein, 10 aa, BK Virus
FLLEKRILQS

SEQ ID NO: 56870 - protein, 10 aa, BK Virus
LLDLCGGKAL

SEQ ID NO: 56871 - protein, 10 aa, BK Virus
NLPLMRKAYL

SEQ ID NO: 56872 - protein, 10 aa, BK Virus
RILQSGMTLL

SEQ ID NO: 56873 - protein, 10 aa, BK Virus
LMEKYSVTFI

SEQ ID NO: 56874 - protein, 10 aa, BK Virus
ALTRDPYHII

SEQ ID NO: 56875 - protein, 10 aa, BK Virus
NNLDSLRDYL

SEQ ID NO: 56876 - protein, 10 aa, BK Virus
SGMTLLLLLI

SEQ ID NO: 56877 - protein, 10 aa, BK Virus
SQAVFSNRTL

SEQ ID NO: 56878 - protein, 10 aa, BK Virus
GLLDLCGGKA

SEQ ID NO: 56879 - protein, 10 aa, BK Virus
SMYTFSRMKY

SEQ ID NO: 56880 - protein, 10 aa, BK Virus
VLAKKRVDTL

SEQ ID NO: 56881 - protein, 10 aa, BK Virus
EMLTERFNHI

SEQ ID NO: 56882 - protein, 10 aa, BK Virus
LLLIWFRPVA

SEQ ID NO: 56883 - protein, 10 aa, BK Virus
KSLQNSEFLL

SEQ ID NO: 56884 - protein, 10 aa, BK Virus
CQKLCTFSFL

SEQ ID NO: 56885 - protein, 10 aa, BK Virus
SLRDYLDGSV

SEQ ID NO: 56886 - protein, 10 aa, BK Virus
MLTERFNHIL

SEQ ID NO: 56887 - protein, 10 aa, BK Virus
GMYLEFQYNV

SEQ ID NO: 56888 - protein, 10 aa, BK Virus
GLVTMNEYPV

SEQ ID NO: 56889 - protein, 10 aa, BK Virus
AVLEQYMAGV

SEQ ID NO: 56890 - protein, 10 aa, BK Virus
ILQSGMTLLL

SEQ ID NO: 56891 - protein, 10 aa, BK Virus
LIFGAHGNAV

SEQ ID NO: 56892 - protein, 10 aa, BK Virus
LLLLIWFRPV

SEQ ID NO: 56893 - protein, 10 aa, BK Virus
TLYKKMEQDV

SEQ ID NO: 56894 - protein, 10 aa, BK Virus
VIFDFLHCVV

SEQ ID NO: 56895 - protein, 10 aa, BK Virus
VLNREESMEL

SEQ ID NO: 56896 - protein, 10 aa, BK Virus
RLTFELGVAI

SEQ ID NO: 56897 - protein, 10 aa, BK Virus
SVIFDFLHCV

SEQ ID NO: 56898 - protein, 10 aa, BK Virus
YLDGSVKVNL

SEQ ID NO: 56899 - protein, 10 aa, BK Virus
VLAKKRVDTL

SEQ ID NO: 56900 - protein, 10 aa, BK Virus
LMEKYSVTFI

SEQ ID NO: 56901 - protein, 10 aa, BK Virus
TLACFAVYTT

SEQ ID NO: 56902 - protein, 10 aa, BK Virus
ALTRDPYHII

SEQ ID NO: 56903 - protein, 10 aa, BK Virus
KMDSVIFDFL

SEQ ID NO: 56904 - protein, 10 aa, BK Virus
TLQARFVRQI

SEQ ID NO: 56905 - protein, 10 aa, BK Virus
GLLDLCGGKA

SEQ ID NO: 56906 - protein, 10 aa, BK Virus
LQSGMTLLLL

SEQ ID NO: 56907 - protein, 10 aa, BK Virus
RILQSGMTLL

SEQ ID NO: 56908 - protein, 10 aa, BK Virus
CLLPKMDSVI

SEQ ID NO: 56909 - protein, 10 aa, BK Virus
YTFSRMKYNI

SEQ ID NO: 56910 - protein, 10 aa, BK Virus
DLHQFLSQAV

SEQ ID NO: 56911 - protein, 10 aa, BK Virus
RLDSEISMYT

SEQ ID NO: 56912 - protein, 10 aa, BK Virus
LLLIWFRPVA

SEQ ID NO: 56913 - protein, 10 aa, BK Virus
KLITEYAVET

SEQ ID NO: 56914 - protein, 10 aa, BK Virus
CQKLCTFSFL

SEQ ID NO: 56915 - protein, 10 aa, BK Virus
GVAIDQYMVV

SEQ ID NO: 56916 - protein, 10 aa, BK Virus
LMDLLGLERA

SEQ ID NO: 56917 - protein, 10 aa, BK Virus
TMNEYPVPKT

SEQ ID NO: 56918 - protein, 10 aa, BK Virus
SMELMDLLGL

SEQ ID NO: 56919 - protein, 10 aa, BK Virus
NQKSICQQAV

SEQ ID NO: 56920 - protein, 10 aa, BK Virus
SICQQAVDTV

SEQ ID NO: 56921 - protein, 10 aa, BK Virus
AVLEQYMAGV

SEQ ID NO: 56922 - protein, 10 aa, BK Virus
GLVTMNEYPV

SEQ ID NO: 56923 - protein, 10 aa, BK Virus
LLLLIWFRPV

SEQ ID NO: 56924 - protein, 10 aa, BK Virus
MLTERFNHIL

SEQ ID NO: 56925 - protein, 10 aa, BK Virus
SLRDYLDGSV

SEQ ID NO: 56926 - protein, 10 aa, BK Virus
SICQQAVDTV

SEQ ID NO: 56927 - protein, 10 aa, BK Virus
VLNREESMEL

SEQ ID NO: 56928 - protein, 10 aa, BK Virus
GMYLEFQYNV

SEQ ID NO: 56929 - protein, 10 aa, BK Virus
VIFDFLHCVV

SEQ ID NO: 56930 - protein, 10 aa, BK Virus
LIFGAHGNAV

SEQ ID NO: 56931 - protein, 10 aa, BK Virus
TLQARFVRQI

SEQ ID NO: 56932 - protein, 10 aa, BK Virus
ALTRDPYHII

SEQ ID NO: 56933 - protein, 10 aa, BK Virus
KMDSVIFDFL

SEQ ID NO: 56934 - protein, 10 aa, BK Virus
TMNEYPVPKT

SEQ ID NO: 56935 - protein, 10 aa, BK Virus
VLAKKRVDTL

SEQ ID NO: 56936 - protein, 10 aa, BK Virus
KLMEKYSVTF

SEQ ID NO: 56937 - protein, 10 aa, BK Virus
ILQSGMTLLL

SEQ ID NO: 56938 - protein, 10 aa, BK Virus
LMEKYSVTFI

SEQ ID NO: 56939 - protein, 10 aa, BK Virus
GVAIDQYMVV

SEQ ID NO: 56940 - protein, 10 aa, BK Virus
RTQIFPPGLV

SEQ ID NO: 56941 - protein, 10 aa, BK Virus
AVLEQYMAGV

SEQ ID NO: 56942 - protein, 10 aa, BK Virus
SVIFDFLHCV

SEQ ID NO: 56943 - protein, 10 aa, BK Virus
KMDSVIFDFL

SEQ ID NO: 56944 - protein, 10 aa, BK Virus
LLLLIWFRPV

SEQ ID NO: 56945 - protein, 10 aa, BK Virus
LQSGMTLLLL

SEQ ID NO: 56946 - protein, 10 aa, BK Virus
GLVTMNEYPV

SEQ ID NO: 56947 - protein, 10 aa, BK Virus
GMYLEFQYNV

SEQ ID NO: 56948 - protein, 10 aa, BK Virus
VIFDFLHCVV

SEQ ID NO: 56949 - protein, 10 aa, BK Virus
RILQSGMTLL

SEQ ID NO: 56950 - protein, 10 aa, BK Virus
MLTERFNHIL

SEQ ID NO: 56951 - protein, 10 aa, BK Virus
LIFGAHGNAV

SEQ ID NO: 56952 - protein, 10 aa, BK Virus
FLLLGMYLEF

SEQ ID NO: 56953 - protein, 10 aa, BK Virus
SLRDYLDGSV

SEQ ID NO: 56954 - protein, 10 aa, BK Virus
KQVSWKLITE

SEQ ID NO: 56955 - protein, 10 aa, BK Virus
KLMEKYSVTF

SEQ ID NO: 56956 - protein, 10 aa, BK Virus
SQAVFSNRTL

SEQ ID NO: 56957 - protein, 10 aa, BK Virus
RAAWGNLPLM

SEQ ID NO: 56958 - protein, 10 aa, BK Virus
YMAGVAWLHC

SEQ ID NO: 56959 - protein, 10 aa, BK Virus
CQKLCTFSFL

SEQ ID NO: 56960 - protein, 10 aa, BK Virus
KLITEYAVET

SEQ ID NO: 56961 - protein, 10 aa, BK Virus
LLLIWFRPVA

SEQ ID NO: 56962 - protein, 10 aa, BK Virus
SICQQAVDTV

SEQ ID NO: 56963 - protein, 10 aa, BK Virus
YLDGSVKVNL

SEQ ID NO: 56964 - protein, 10 aa, BK Virus
ILQSGMTLLL

SEQ ID NO: 56965 - protein, 10 aa, BK Virus
QIFPPGLVTM

SEQ ID NO: 56966 - protein, 10 aa, BK Virus
CQQAVDTVLA

SEQ ID NO: 56967 - protein, 10 aa, BK Virus
YAVETKCEDV

SEQ ID NO: 56968 - protein, 10 aa, BK Virus
RTLACFAVYT

SEQ ID NO: 56969 - protein, 10 aa, BK Virus
FLLEKRILQS

SEQ ID NO: 56970 - protein, 10 aa, BK Virus
RLDSEISMYT

SEQ ID NO: 56971 - protein, 10 aa, BK Virus
CLLPKMDSVI

SEQ ID NO: 56972 - protein, 10 aa, BK Virus
RLTFELGVAI

SEQ ID NO: 56973 - protein, 10 aa, BK Virus
SAINNFCQKL

SEQ ID NO: 56974 - protein, 10 aa, BK Virus
GVAIDQYMVV

SEQ ID NO: 56975 - protein, 10 aa, BK Virus
YLDGSVKVNL

SEQ ID NO: 56976 - protein, 10 aa, BK Virus
VIFDFLHCVV

SEQ ID NO: 56977 - protein, 10 aa, BK Virus
GLVTMNEYPV

SEQ ID NO: 56978 - protein, 10 aa, BK Virus
GMYLEFQYNV

SEQ ID NO: 56979 - protein, 10 aa, BK Virus
ILQSGMTLLL

SEQ ID NO: 56980 - protein, 10 aa, BK Virus
DLHQFLSQAV

SEQ ID NO: 56981 - protein, 10 aa, BK Virus
SLRDYLDGSV

SEQ ID NO: 56982 - protein, 10 aa, BK Virus
KMDSVIFDFL

SEQ ID NO: 56983 - protein, 10 aa, BK Virus
LLLLIWFRPV

SEQ ID NO: 56984 - protein, 10 aa, BK Virus
TLYKKMEQDV

SEQ ID NO: 56985 - protein, 10 aa, BK Virus
MLTERFNHIL

SEQ ID NO: 56986 - protein, 10 aa, BK Virus
AVLEQYMAGV

SEQ ID NO: 56987 - protein, 10 aa, BK Virus
DLCGGKALNV

SEQ ID NO: 56988 - protein, 10 aa, BK Virus
LIFGAHGNAV

SEQ ID NO: 56989 - protein, 10 aa, BK Virus
VLNREESMEL

SEQ ID NO: 56990 - protein, 10 aa, BK Virus
LLLGMYLEFQ

SEQ ID NO: 56991 - protein, 10 aa, BK Virus
RLDSEISMYT

SEQ ID NO: 56992 - protein, 10 aa, BK Virus
SVIFDFLHCV

SEQ ID NO: 56993 - protein, 10 aa, BK Virus
ALTRDPYHII

SEQ ID NO: 56994 - protein, 10 aa, BK Virus
YMAGVAWLHC

SEQ ID NO: 56995 - protein, 10 aa, BK Virus
LMDLLGLERA

SEQ ID NO: 56996 - protein, 10 aa, BK Virus
FLLLGMYLEF

SEQ ID NO: 56997 - protein, 10 aa, BK Virus
GVAIDQYMVV

SEQ ID NO: 56998 - protein, 10 aa, BK Virus
SICQQAVDTV

SEQ ID NO: 56999 - protein, 10 aa, BK Virus
VLAKKRVDTL

SEQ ID NO: 57000 - protein, 10 aa, BK Virus
TLHMTREEML

SEQ ID NO: 57001 - protein, 10 aa, BK Virus
RILQSGMTLL

SEQ ID NO: 57002 - protein, 10 aa, BK Virus
LLDLCGGKAL

SEQ ID NO: 57003 - protein, 10 aa, BK Virus
LLLIWFRPVA

SEQ ID NO: 57004 - protein, 10 aa, BK Virus
FLLEKRILQS

SEQ ID NO: 57005 - protein, 10 aa, BK Virus
SMELMDLLGL

SEQ ID NO: 57006 - protein, 10 aa, BK Virus
GLLDLCGGKA

SEQ ID NO: 57007 - protein, 10 aa, BK Virus
QIFPPGLVTM

SEQ ID NO: 57008 - protein, 10 aa, BK Virus
NLPLMRKAYL

SEQ ID NO: 57009 - protein, 10 aa, BK Virus
RLTFELGVAI

SEQ ID NO: 57010 - protein, 10 aa, BK Virus
TLACFAVYTT

SEQ ID NO: 57011 - protein, 10 aa, BK Virus
TLAAGLLDLC

SEQ ID NO: 57012 - protein, 10 aa, BK Virus
CLLPKMDSVI

SEQ ID NO: 57013 - protein, 10 aa, BK Virus
FFLTPHRHRV

SEQ ID NO: 57014 - protein, 10 aa, BK Virus
TLQARFVRQI

SEQ ID NO: 57015 - protein, 10 aa, BK Virus
SMYTFSRMKY

SEQ ID NO: 57016 - protein, 10 aa, BK Virus
LMEKYSVTFI

SEQ ID NO: 57017 - protein, 10 aa, BK Virus
KLMEKYSVTF

SEQ ID NO: 57018 - protein, 10 aa, BK Virus
DLFCHEDMFA

SEQ ID NO: 57019 - protein, 10 aa, BK Virus
LLGMYLEFQY

SEQ ID NO: 57020 - protein, 10 aa, BK Virus
PIDSGKTTLA

SEQ ID NO: 57021 - protein, 10 aa, BK Virus
KLITEYAVET

SEQ ID NO: 57022 - protein, 10 aa, BK Virus
QIDFRPKIYL

SEQ ID NO: 57023 - protein, 10 aa, BK Virus
TLLLLLIWFR

SEQ ID NO: 57024 - protein, 10 aa, BK Virus
FLTPHRHRVS

SEQ ID NO: 57025 - protein, 10 aa, BK Virus
TMNEYPVPKT

SEQ ID NO: 57026 - protein, 10 aa, BK Virus
GLERAAWGNL

SEQ ID NO: 57027 - protein, 10 aa, BK Virus
VLEQYMAGVA

SEQ ID NO: 57028 - protein, 10 aa, BK Virus
YAVETKCEDV

SEQ ID NO: 57029 - protein, 10 aa, BK Virus
STPPKKKRKV

SEQ ID NO: 57030 - protein, 10 aa, BK Virus
EMLTERFNHI

SEQ ID NO: 57031 - protein, 10 aa, BK Virus
ILYKKLMEKY

SEQ ID NO: 57032 - protein, 10 aa, BK Virus
ILDKMDLIFG

SEQ ID NO: 57033 - protein, 10 aa, BK Virus
KLCTFSFLIC

SEQ ID NO: 57034 - protein, 10 aa, BK Virus
ELGVAIDQYM

SEQ ID NO: 57035 - protein, 10 aa, BK Virus
YLDGSVKVNL

SEQ ID NO: 57036 - protein, 10 aa, BK Virus
VIFDFLHCVV

SEQ ID NO: 57037 - protein, 10 aa, BK Virus
TLYKKMEQDV

SEQ ID NO: 57038 - protein, 10 aa, BK Virus
GMYLEFQYNV

SEQ ID NO: 57039 - protein, 10 aa, BK Virus
SLRDYLDGSV

SEQ ID NO: 57040 - protein, 10 aa, BK Virus
AVLEQYMAGV

SEQ ID NO: 57041 - protein, 10 aa, BK Virus
GLVTMNEYPV

SEQ ID NO: 57042 - protein, 10 aa, BK Virus
MLTERFNHIL

SEQ ID NO: 57043 - protein, 10 aa, BK Virus
LIFGAHGNAV

SEQ ID NO: 57044 - protein, 10 aa, BK Virus
DLHQFLSQAV

SEQ ID NO: 57045 - protein, 10 aa, BK Virus
VLNREESMEL

SEQ ID NO: 57046 - protein, 10 aa, BK Virus
KMDSVIFDFL

SEQ ID NO: 57047 - protein, 10 aa, BK Virus
ILQSGMTLLL

SEQ ID NO: 57048 - protein, 10 aa, BK Virus
LLLLIWFRPV

SEQ ID NO: 57049 - protein, 10 aa, BK Virus
YMAGVAWLHC

SEQ ID NO: 57050 - protein, 10 aa, BK Virus
VLAKKRVDTL

SEQ ID NO: 57051 - protein, 10 aa, BK Virus
LLLGMYLEFQ

SEQ ID NO: 57052 - protein, 10 aa, BK Virus
FLLLGMYLEF

SEQ ID NO: 57053 - protein, 10 aa, BK Virus
FLLEKRILQS

SEQ ID NO: 57054 - protein, 10 aa, BK Virus
DLCGGKALNV

SEQ ID NO: 57055 - protein, 10 aa, BK Virus
CLLPKMDSVI

SEQ ID NO: 57056 - protein, 10 aa, BK Virus
LMDLLGLERA

SEQ ID NO: 57057 - protein, 10 aa, BK Virus
SVIFDFLHCV

SEQ ID NO: 57058 - protein, 10 aa, BK Virus
SMELMDLLGL

SEQ ID NO: 57059 - protein, 10 aa, BK Virus
RLDSEISMYT

SEQ ID NO: 57060 - protein, 10 aa, BK Virus
ALTRDPYHII

SEQ ID NO: 57061 - protein, 10 aa, BK Virus
YAVETKCEDV

SEQ ID NO: 57062 - protein, 10 aa, BK Virus
LLLIWFRPVA

SEQ ID NO: 57063 - protein, 10 aa, BK Virus
TLHMTREEML

SEQ ID NO: 57064 - protein, 10 aa, BK Virus
FFLTPHRHRV

SEQ ID NO: 57065 - protein, 10 aa, BK Virus
QIFPPGLVTM

SEQ ID NO: 57066 - protein, 10 aa, BK Virus
LMEKYSVTFI

SEQ ID NO: 57067 - protein, 10 aa, BK Virus
KLMEKYSVTF

SEQ ID NO: 57068 - protein, 10 aa, BK Virus
GVAIDQYMVV

SEQ ID NO: 57069 - protein, 10 aa, BK Virus
SICQQAVDTV

SEQ ID NO: 57070 - protein, 10 aa, BK Virus
RLTFELGVAI

SEQ ID NO: 57071 - protein, 10 aa, BK Virus
FLTPHRHRVS

SEQ ID NO: 57072 - protein, 10 aa, BK Virus
SMYTFSRMKY

SEQ ID NO: 57073 - protein, 10 aa, BK Virus
ILYKKLMEKY

SEQ ID NO: 57074 - protein, 10 aa, BK Virus
NLPLMRKAYL

SEQ ID NO: 57075 - protein, 10 aa, BK Virus
GLLDLCGGKA

SEQ ID NO: 57076 - protein, 10 aa, BK Virus
YTFSRMKYNI

SEQ ID NO: 57077 - protein, 10 aa, BK Virus
TLAAGLLDLC

SEQ ID NO: 57078 - protein, 10 aa, BK Virus
LLDLCGGKAL

SEQ ID NO: 57079 - protein, 10 aa, BK Virus
RILQSGMTLL

SEQ ID NO: 57080 - protein, 10 aa, BK Virus
EMLTERFNHI

SEQ ID NO: 57081 - protein, 10 aa, BK Virus
TLQARFVRQI

SEQ ID NO: 57082 - protein, 10 aa, BK Virus
GLERAAWGNL

SEQ ID NO: 57083 - protein, 10 aa, BK Virus
TMNEYPVPKT

SEQ ID NO: 57084 - protein, 10 aa, BK Virus
GLVTMNEYPV

SEQ ID NO: 57085 - protein, 10 aa, BK Virus
VIFDFLHCVV

SEQ ID NO: 57086 - protein, 10 aa, BK Virus
SLRDYLDGSV

SEQ ID NO: 57087 - protein, 10 aa, BK Virus
TLYKKMEQDV

SEQ ID NO: 57088 - protein, 10 aa, BK Virus
GMYLEFQYNV

SEQ ID NO: 57089 - protein, 10 aa, BK Virus
ILQSGMTLLL

SEQ ID NO: 57090 - protein, 10 aa, BK Virus
YLDGSVKVNL

SEQ ID NO: 57091 - protein, 10 aa, BK Virus
MLTERFNHIL

SEQ ID NO: 57092 - protein, 10 aa, BK Virus
DLHQFLSQAV

SEQ ID NO: 57093 - protein, 10 aa, BK Virus
KMDSVIFDFL

SEQ ID NO: 57094 - protein, 10 aa, BK Virus
DLCGGKALNV

SEQ ID NO: 57095 - protein, 10 aa, BK Virus
LIFGAHGNAV

SEQ ID NO: 57096 - protein, 10 aa, BK Virus
VLNREESMEL

SEQ ID NO: 57097 - protein, 10 aa, BK Virus
VLAKKRVDTL

SEQ ID NO: 57098 - protein, 10 aa, BK Virus
LLLLIWFRPV

SEQ ID NO: 57099 - protein, 10 aa, BK Virus
AVLEQYMAGV

SEQ ID NO: 57100 - protein, 10 aa, BK Virus
SICQQAVDTV

SEQ ID NO: 57101 - protein, 10 aa, BK Virus
NLPLMRKAYL

SEQ ID NO: 57102 - protein, 10 aa, BK Virus
LLLGMYLEFQ

SEQ ID NO: 57103 - protein, 10 aa, BK Virus
LMEKYSVTFI

SEQ ID NO: 57104 - protein, 10 aa, BK Virus
ALTRDPYHII

SEQ ID NO: 57105 - protein, 10 aa, BK Virus
TLHMTREEML

SEQ ID NO: 57106 - protein, 10 aa, BK Virus
SVIFDFLHCV

SEQ ID NO: 57107 - protein, 10 aa, BK Virus
RLDSEISMYT

SEQ ID NO: 57108 - protein, 10 aa, BK Virus
FFLTPHRHRV

SEQ ID NO: 57109 - protein, 10 aa, BK Virus
YMAGVAWLHC

SEQ ID NO: 57110 - protein, 10 aa, BK Virus
RILQSGMTLL

SEQ ID NO: 57111 - protein, 10 aa, BK Virus
TLACFAVYTT

SEQ ID NO: 57112 - protein, 10 aa, BK Virus
CLLPKMDSVI

SEQ ID NO: 57113 - protein, 10 aa, BK Virus
ELGVAIDQYM

SEQ ID NO: 57114 - protein, 10 aa, BK Virus
GLERAAWGNL

SEQ ID NO: 57115 - protein, 10 aa, BK Virus
DLFCHEDMFA

SEQ ID NO: 57116 - protein, 10 aa, BK Virus
GVAIDQYMVV

SEQ ID NO: 57117 - protein, 10 aa, BK Virus
TLQARFVRQI

SEQ ID NO: 57118 - protein, 10 aa, BK Virus
FLLEKRILQS

SEQ ID NO: 57119 - protein, 10 aa, BK Virus
QIDFRPKIYL

SEQ ID NO: 57120 - protein, 10 aa, BK Virus
LMDLLGLERA

SEQ ID NO: 57121 - protein, 10 aa, BK Virus
FLLLGMYLEF

SEQ ID NO: 57122 - protein, 10 aa, BK Virus
LLGMYLEFQY

SEQ ID NO: 57123 - protein, 10 aa, BK Virus
GLLDLCGGKA

SEQ ID NO: 57124 - protein, 10 aa, BK Virus
SMELMDLLGL

SEQ ID NO: 57125 - protein, 10 aa, BK Virus
HLCKGFQCFK

SEQ ID NO: 57126 - protein, 10 aa, BK Virus
QIFPPGLVTM

SEQ ID NO: 57127 - protein, 10 aa, BK Virus
CAGHNIIFFL

SEQ ID NO: 57128 - protein, 10 aa, BK Virus
LLDLCGGKAL

SEQ ID NO: 57129 - protein, 10 aa, BK Virus
STPPKKKRKV

SEQ ID NO: 57130 - protein, 10 aa, BK Virus
LLLIWFRPVA

SEQ ID NO: 57131 - protein, 10 aa, BK Virus
YLDGSVKVNL

SEQ ID NO: 57132 - protein, 10 aa, BK Virus
ILQSGMTLLL

SEQ ID NO: 57133 - protein, 10 aa, BK Virus
KMDSVIFDFL

SEQ ID NO: 57134 - protein, 10 aa, BK Virus
MLTERFNHIL

SEQ ID NO: 57135 - protein, 10 aa, BK Virus
VIFDFLHCVV

SEQ ID NO: 57136 - protein, 10 aa, BK Virus
GMYLEFQYNV

SEQ ID NO: 57137 - protein, 10 aa, BK Virus
DLHQFLSQAV

SEQ ID NO: 57138 - protein, 10 aa, BK Virus
LLLLIWFRPV

SEQ ID NO: 57139 - protein, 10 aa, BK Virus
GLVTMNEYPV

SEQ ID NO: 57140 - protein, 10 aa, BK Virus
SLRDYLDGSV

SEQ ID NO: 57141 - protein, 10 aa, BK Virus
YMAGVAWLHC

SEQ ID NO: 57142 - protein, 10 aa, BK Virus
VLNREESMEL

SEQ ID NO: 57143 - protein, 10 aa, BK Virus
LLLGMYLEFQ

SEQ ID NO: 57144 - protein, 10 aa, BK Virus
TLYKKMEQDV

SEQ ID NO: 57145 - protein, 10 aa, BK Virus
LIFGAHGNAV

SEQ ID NO: 57146 - protein, 10 aa, BK Virus
DLCGGKALNV

SEQ ID NO: 57147 - protein, 10 aa, BK Virus
AVLEQYMAGV

SEQ ID NO: 57148 - protein, 10 aa, BK Virus
ALTRDPYHII

SEQ ID NO: 57149 - protein, 10 aa, BK Virus
VLAKKRVDTL

SEQ ID NO: 57150 - protein, 10 aa, BK Virus
RLDSEISMYT

SEQ ID NO: 57151 - protein, 10 aa, BK Virus
LMDLLGLERA

SEQ ID NO: 57152 - protein, 10 aa, BK Virus
CLLPKMDSVI

SEQ ID NO: 57153 - protein, 10 aa, BK Virus
SVIFDFLHCV

SEQ ID NO: 57154 - protein, 10 aa, BK Virus
TLAAGLLDLC

SEQ ID NO: 57155 - protein, 10 aa, BK Virus
FFLTPHRHRV

SEQ ID NO: 57156 - protein, 10 aa, BK Virus
TLHMTREEML

SEQ ID NO: 57157 - protein, 10 aa, BK Virus
TLQARFVRQI

SEQ ID NO: 57158 - protein, 10 aa, BK Virus
QILYKKLMEK

SEQ ID NO: 57159 - protein, 10 aa, BK Virus
KMKRMNTLYK

SEQ ID NO: 57160 - protein, 10 aa, BK Virus
RMKYNICMGK

SEQ ID NO: 57161 - protein, 10 aa, BK Virus
ISMYTFSRMK

SEQ ID NO: 57162 - protein, 10 aa, BK Virus
SMYTFSRMKY

SEQ ID NO: 57163 - protein, 10 aa, BK Virus
VTMNEYPVPK

SEQ ID NO: 57164 - protein, 10 aa, BK Virus
HLCKGFQCFK

SEQ ID NO: 57165 - protein, 10 aa, BK Virus
PLMRKAYLKK

SEQ ID NO: 57166 - protein, 10 aa, BK Virus
LACFAVYTTK

SEQ ID NO: 57167 - protein, 10 aa, BK Virus
VAWLHCLLPK

SEQ ID NO: 57168 - protein, 10 aa, BK Virus
TLLLLLIWFR

SEQ ID NO: 57169 - protein, 10 aa, BK Virus
SFLICKGVNK

SEQ ID NO: 57170 - protein, 10 aa, BK Virus
AWGNLPLMRK

SEQ ID NO: 57171 - protein, 10 aa, BK Virus
IIFAESKNQK

SEQ ID NO: 57172 - protein, 10 aa, BK Virus
LPLMRKAYLK

SEQ ID NO: 57173 - protein, 10 aa, BK Virus
LQNSEFLLEK

SEQ ID NO: 57174 - protein, 10 aa, BK Virus
QPYHFKYHEK

SEQ ID NO: 57175 - protein, 10 aa, BK Virus
VPKRRYWLFK

SEQ ID NO: 57176 - protein, 10 aa, BK Virus
VSAINNFCQK

SEQ ID NO: 57177 - protein, 10 aa, BK Virus
ALNVNLPMER

SEQ ID NO: 57178 - protein, 10 aa, BK Virus
LITEYAVETK

SEQ ID NO: 57179 - protein, 10 aa, BK Virus
ILYKKLMEKY

SEQ ID NO: 57180 - protein, 10 aa, BK Virus
VTMNEYPVPK

SEQ ID NO: 57181 - protein, 10 aa, BK Virus
ISMYTFSRMK

SEQ ID NO: 57182 - protein, 10 aa, BK Virus
VAWLHCLLPK

SEQ ID NO: 57183 - protein, 10 aa, BK Virus
LQNSEFLLEK

SEQ ID NO: 57184 - protein, 10 aa, BK Virus
KMKRMNTLYK

SEQ ID NO: 57185 - protein, 10 aa, BK Virus
IIFAESKNQK

SEQ ID NO: 57186 - protein, 10 aa, BK Virus
VSAINNFCQK

SEQ ID NO: 57187 - protein, 10 aa, BK Virus
SMYTFSRMKY

SEQ ID NO: 57188 - protein, 10 aa, BK Virus
TLLLLLIWFR

SEQ ID NO: 57189 - protein, 10 aa, BK Virus
QILYKKLMEK

SEQ ID NO: 57190 - protein, 10 aa, BK Virus
LACFAVYTTK

SEQ ID NO: 57191 - protein, 10 aa, BK Virus
HLCKGFQCFK

SEQ ID NO: 57192 - protein, 10 aa, BK Virus
ESWWSSFNEK

SEQ ID NO: 57193 - protein, 10 aa, BK Virus
RMKYNICMGK

SEQ ID NO: 57194 - protein, 10 aa, BK Virus
SQHSTPPKKK

SEQ ID NO: 57195 - protein, 10 aa, BK Virus
GSVKVNLEKK

SEQ ID NO: 57196 - protein, 10 aa, BK Virus
QQAVDTVLAK

SEQ ID NO: 57197 - protein, 10 aa, BK Virus
QAVDTVLAKK

SEQ ID NO: 57198 - protein, 10 aa, BK Virus
ALNVNLPMER

SEQ ID NO: 57199 - protein, 10 aa, BK Virus
NIIFFLTPHR

SEQ ID NO: 57200 - protein, 10 aa, BK Virus
PLMRKAYLKK

SEQ ID NO: 57201 - protein, 10 aa, BK Virus
AAWGNLPLMR

SEQ ID NO: 57202 - protein, 10 aa, BK Virus
LITEYAVETK

SEQ ID NO: 57203 - protein, 10 aa, BK Virus
DSQHSTPPKK

SEQ ID NO: 57204 - protein, 10 aa, BK Virus
AWGNLPLMRK

SEQ ID NO: 57205 - protein, 10 aa, BK Virus
SFLICKGVNK

SEQ ID NO: 57206 - protein, 10 aa, BK Virus
QYMVVFEDVK

SEQ ID NO: 57207 - protein, 10 aa, BK Virus
VFSNRTLACF

SEQ ID NO: 57208 - protein, 10 aa, BK Virus
FLLLGMYLEF

SEQ ID NO: 57209 - protein, 10 aa, BK Virus
WFRPVADFSK

SEQ ID NO: 57210 - protein, 10 aa, BK Virus
LYKKMEQDVK

SEQ ID NO: 57211 - protein, 10 aa, BK Virus
MTLLLLLIWF

SEQ ID NO: 57212 - protein, 10 aa, BK Virus
TYGTEEWESW

SEQ ID NO: 57213 - protein, 10 aa, BK Virus
IFDFLHCVVF

SEQ ID NO: 57214 - protein, 10 aa, BK Virus
NVPKRRYWLF

SEQ ID NO: 57215 - protein, 10 aa, BK Virus
SFLICKGVNK

SEQ ID NO: 57216 - protein, 10 aa, BK Virus
CFAVYTTKEK

SEQ ID NO: 57217 - protein, 10 aa, BK Virus
RHRVSAINNF

SEQ ID NO: 57218 - protein, 10 aa, BK Virus
EFQYNVEECK

SEQ ID NO: 57219 - protein, 10 aa, BK Virus
KLMEKYSVTF

SEQ ID NO: 57220 - protein, 10 aa, BK Virus
SWWSSFNEKW

SEQ ID NO: 57221 - protein, 10 aa, BK Virus
VAIDQYMVVF

SEQ ID NO: 57222 - protein, 10 aa, BK Virus
FCQKLCTFSF

SEQ ID NO: 57223 - protein, 10 aa, BK Virus
VFSNRTLACF

SEQ ID NO: 57224 - protein, 10 aa, BK Virus
VYTTKEKAQI

SEQ ID NO: 57225 - protein, 10 aa, BK Virus
KYNICMGKCI

SEQ ID NO: 57226 - protein, 10 aa, BK Virus
NVPKRRYWLF

SEQ ID NO: 57227 - protein, 10 aa, BK Virus
IFDFLHCVVF

SEQ ID NO: 57228 - protein, 10 aa, BK Virus
TYGTEEWESW

SEQ ID NO: 57229 - protein, 10 aa, BK Virus
DFPSDLHQFL

SEQ ID NO: 57230 - protein, 10 aa, BK Virus
TYGTEEWESW

SEQ ID NO: 57231 - protein, 10 aa, BK Virus
KHLNKRTQIF

SEQ ID NO: 57232 - protein, 10 aa, BK Virus
FLLLGMYLEF

SEQ ID NO: 57233 - protein, 10 aa, BK Virus
FCQKLCTFSF

SEQ ID NO: 57234 - protein, 10 aa, BK Virus
VYTTKEKAQI

SEQ ID NO: 57235 - protein, 10 aa, BK Virus
KLMEKYSVTF

SEQ ID NO: 57236 - protein, 10 aa, BK Virus
VFSNRTLACF

SEQ ID NO: 57237 - protein, 10 aa, BK Virus
YHFKYHEKHF

SEQ ID NO: 57238 - protein, 10 aa, BK Virus
IFDFLHCVVF

SEQ ID NO: 57239 - protein, 10 aa, BK Virus
NVPKRRYWLF

SEQ ID NO: 57240 - protein, 10 aa, BK Virus
RHRVSAINNF

SEQ ID NO: 57241 - protein, 10 aa, BK Virus
MTLLLLLIWF

SEQ ID NO: 57242 - protein, 10 aa, BK Virus
TTKEKAQILY

SEQ ID NO: 57243 - protein, 10 aa, BK Virus
EISMYTFSRM

SEQ ID NO: 57244 - protein, 10 aa, BK Virus
EISMYTFSRM

SEQ ID NO: 57245 - protein, 10 aa, BK Virus
QIFPPGLVTM

SEQ ID NO: 57246 - protein, 10 aa, BK Virus
QVSWKLITEY

SEQ ID NO: 57247 - protein, 10 aa, BK Virus
TTKEKAQILY

SEQ ID NO: 57248 - protein, 10 aa, BK Virus
NVPKRRYWLF

SEQ ID NO: 57249 - protein, 10 aa, BK Virus
PVPKTLQARF

SEQ ID NO: 57250 - protein, 10 aa, BK Virus
DVKVAHQPDF

SEQ ID NO: 57251 - protein, 10 aa, BK Virus
ETKCEDVFLL

SEQ ID NO: 57252 - protein, 10 aa, BK Virus
DVFLLLGMYL

SEQ ID NO: 57253 - protein, 10 aa, BK Virus
HILDKMDLIF

SEQ ID NO: 57254 - protein, 10 aa, BK Virus
EVPTYGTEEW

SEQ ID NO: 57255 - protein, 10 aa, BK Virus
FISRHMCAGH

SEQ ID NO: 57256 - protein, 10 aa, BK Virus
YTTKEKAQIL

SEQ ID NO: 57257 - protein, 10 aa, BK Virus
EDVFLLLGMY

SEQ ID NO: 57258 - protein, 10 aa, BK Virus
DFPSDLHQFL

SEQ ID NO: 57259 - protein, 10 aa, BK Virus
YTFSRMKYNI

SEQ ID NO: 57260 - protein, 10 aa, BK Virus
MTLLLLLIWF

SEQ ID NO: 57261 - protein, 10 aa, BK Virus
VAIDQYMVVF

SEQ ID NO: 57262 - protein, 10 aa, BK Virus
SVIFDFLHCV

SEQ ID NO: 57263 - protein, 10 aa, BK Virus
SMYTFSRMKY

SEQ ID NO: 57264 - protein, 10 aa, BK Virus
VVFNVPKRRY

SEQ ID NO: 57265 - protein, 10 aa, BK Virus
ILYKKLMEKY

SEQ ID NO: 57266 - protein, 10 aa, BK Virus
LLGMYLEFQY

SEQ ID NO: 57267 - protein, 10 aa, BK Virus
TWNSSEVPTY

SEQ ID NO: 57268 - protein, 10 aa, BK Virus
QVSWKLITEY

SEQ ID NO: 57269 - protein, 10 aa, BK Virus
KMKRMNTLYK

SEQ ID NO: 57270 - protein, 10 aa, BK Virus
KGFQCFKRPK

SEQ ID NO: 57271 - protein, 10 aa, BK Virus
FKRPKTPPPK

SEQ ID NO: 57272 - protein, 10 aa, BK Virus
MKRMNTLYKK

SEQ ID NO: 57273 - protein, 10 aa, BK Virus
RMKYNICMGK

SEQ ID NO: 57274 - protein, 10 aa, BK Virus
VTMNEYPVPK

SEQ ID NO: 57275 - protein, 10 aa, BK Virus
VPKRRYWLFK

SEQ ID NO: 57276 - protein, 10 aa, BK Virus
SQHSTPPKKK

SEQ ID NO: 57277 - protein, 10 aa, BK Virus
WFRPVADFSK

SEQ ID NO: 57278 - protein, 10 aa, BK Virus
FVRQIDFRPK

SEQ ID NO: 57279 - protein, 10 aa, BK Virus
ISMYTFSRMK

SEQ ID NO: 57280 - protein, 10 aa, BK Virus
KKKRKVEDPK

SEQ ID NO: 57281 - protein, 10 aa, BK Virus
DFRPKIYLRK

SEQ ID NO: 57282 - protein, 10 aa, BK Virus
QKKDQPYHFK

SEQ ID NO: 57283 - protein, 10 aa, BK Virus
PLMRKAYLKK

SEQ ID NO: 57284 - protein, 10 aa, BK Virus
MTREEMLTER

SEQ ID NO: 57285 - protein, 10 aa, BK Virus
MRKAYLKKCK

SEQ ID NO: 57286 - protein, 10 aa, BK Virus
ADSQHSTPPK

SEQ ID NO: 57287 - protein, 10 aa, BK Virus
TERFNHILDK

SEQ ID NO: 57288 - protein, 10 aa, BK Virus
KEKAQILYKK

SEQ ID NO: 57289 - protein, 10 aa, BK Virus
TTKEKAQILY

SEQ ID NO: 57290 - protein, 10 aa, BK Virus
DSQHSTPPKK

SEQ ID NO: 57291 - protein, 10 aa, BK Virus
LYSALTRDPY

SEQ ID NO: 57292 - protein, 10 aa, BK Virus
SMYTFSRMKY

SEQ ID NO: 57293 - protein, 10 aa, BK Virus
QVSWKLITEY

SEQ ID NO: 57294 - protein, 10 aa, BK Virus
TWNSSEVPTY

SEQ ID NO: 57295 - protein, 10 aa, BK Virus
TLLLLLIWFR

SEQ ID NO: 57296 - protein, 10 aa, BK Virus
EYLLYSALTR

SEQ ID NO: 57297 - protein, 10 aa, BK Virus
KMKRMNTLYK

SEQ ID NO: 57298 - protein, 10 aa, BK Virus
LCKGFQCFKR

SEQ ID NO: 57299 - protein, 10 aa, BK Virus
SMYTFSRMKY

SEQ ID NO: 57300 - protein, 10 aa, BK Virus
RMKYNICMGK

SEQ ID NO: 57301 - protein, 10 aa, BK Virus
NIIFFLTPHR

SEQ ID NO: 57302 - protein, 10 aa, BK Virus
ALNVNLPMER

SEQ ID NO: 57303 - protein, 10 aa, BK Virus
HLCKGFQCFK

SEQ ID NO: 57304 - protein, 10 aa, BK Virus
FLSQAVFSNR

SEQ ID NO: 57305 - protein, 10 aa, BK Virus
CVVFNVPKRR

SEQ ID NO: 57306 - protein, 10 aa, BK Virus
IFFLTPHRHR

SEQ ID NO: 57307 - protein, 10 aa, BK Virus
MTREEMLTER

SEQ ID NO: 57308 - protein, 10 aa, BK Virus
KRVDTLHMTR

SEQ ID NO: 57309 - protein, 10 aa, BK Virus
SFLICKGVNK

SEQ ID NO: 57310 - protein, 10 aa, BK Virus
MKRMNTLYKK

SEQ ID NO: 57311 - protein, 10 aa, BK Virus
LACFAVYTTK

SEQ ID NO: 57312 - protein, 10 aa, BK Virus
PKTLQARFVR

SEQ ID NO: 57313 - protein, 10 aa, BK Virus
SEISMYTFSR

SEQ ID NO: 57314 - protein, 10 aa, BK Virus
QSRIVEWKER

SEQ ID NO: 57315 - protein, 10 aa, BK Virus
RVSAINNFCQ

SEQ ID NO: 57316 - protein, 10 aa, BK Virus
EYLLYSALTR

SEQ ID NO: 57317 - protein, 10 aa, BK Virus
TLLLLLIWFR

SEQ ID NO: 57318 - protein, 10 aa, BK Virus
LCKGFQCFKR

SEQ ID NO: 57319 - protein, 10 aa, BK Virus
IFFLTPHRHR

SEQ ID NO: 57320 - protein, 10 aa, BK Virus
NIIFFLTPHR

SEQ ID NO: 57321 - protein, 10 aa, BK Virus
ELMDLLGLER

SEQ ID NO: 57322 - protein, 10 aa, BK Virus
FLSQAVFSNR

SEQ ID NO: 57323 - protein, 10 aa, BK Virus
EKYSVTFISR

SEQ ID NO: 57324 - protein, 10 aa, BK Virus
DFRPKIYLRK

SEQ ID NO: 57325 - protein, 10 aa, BK Virus
NIIFFLTPHR

SEQ ID NO: 57326 - protein, 10 aa, BK Virus
CVVFNVPKRR

SEQ ID NO: 57327 - protein, 10 aa, BK Virus
MTREEMLTER

SEQ ID NO: 57328 - protein, 10 aa, BK Virus
ESWWSSFNEK

SEQ ID NO: 57329 - protein, 10 aa, BK Virus
FLSQAVFSNR

SEQ ID NO: 57330 - protein, 10 aa, BK Virus
ELMDLLGLER

SEQ ID NO: 57331 - protein, 10 aa, BK Virus
EKYSVTFISR

SEQ ID NO: 57332 - protein, 10 aa, BK Virus
LACFAVYTTK

SEQ ID NO: 57333 - protein, 10 aa, BK Virus
ISMYTFSRMK

SEQ ID NO: 57334 - protein, 10 aa, BK Virus
HLCKGFQCFK

SEQ ID NO: 57335 - protein, 10 aa, BK Virus
EYLLYSALTR

SEQ ID NO: 57336 - protein, 10 aa, BK Virus
TLLLLLIWFR

SEQ ID NO: 57337 - protein, 10 aa, BK Virus
IIFAESKNQK

SEQ ID NO: 57338 - protein, 10 aa, BK Virus
LITEYAVETK

SEQ ID NO: 57339 - protein, 10 aa, BK Virus
VSAINNFCQK

SEQ ID NO: 57340 - protein, 10 aa, BK Virus
QAVDTVLAKK

SEQ ID NO: 57341 - protein, 10 aa, BK Virus
HGINNLDSLR

SEQ ID NO: 57342 - protein, 10 aa, BK Virus
DVKGTGAESK

SEQ ID NO: 57343 - protein, 10 aa, BK Virus
SEISMYTFSR

SEQ ID NO: 57344 - protein, 10 aa, BK Virus
DIQSRIVEWK

SEQ ID NO: 57345 - protein, 10 aa, BK Virus
QPYHFKYHEK

SEQ ID NO: 57346 - protein, 10 aa, BK Virus
VTMNEYPVPK

SEQ ID NO: 57347 - protein, 10 aa, BK Virus
EFQYNVEECK

SEQ ID NO: 57348 - protein, 10 aa, BK Virus
NVEECKKCQK

SEQ ID NO: 57349 - protein, 10 aa, BK Virus
CFAVYTTKEK

SEQ ID NO: 57350 - protein, 10 aa, BK Virus
FQYNVEECKK

SEQ ID NO: 57351 - protein, 10 aa, BK Virus
IFFLTPHRHR

SEQ ID NO: 57352 - protein, 10 aa, BK Virus
MGKCILDITR

SEQ ID NO: 57353 - protein, 10 aa, BK Virus
FVRQIDFRPK

SEQ ID NO: 57354 - protein, 10 aa, BK Virus
HCVVFNVPKR

SEQ ID NO: 57355 - protein, 10 aa, BK Virus
DSQHSTPPKK

SEQ ID NO: 57356 - protein, 10 aa, BK Virus
IDFRPKIYLR

SEQ ID NO: 57357 - protein, 10 aa, BK Virus
TTKEKAQILY

SEQ ID NO: 57358 - protein, 10 aa, BK Virus
SVIFDFLHCV

SEQ ID NO: 57359 - protein, 10 aa, BK Virus
YTFSRMKYNI

SEQ ID NO: 57360 - protein, 10 aa, BK Virus
DVFLLLGMYL

SEQ ID NO: 57361 - protein, 10 aa, BK Virus
FANAIIFAES

SEQ ID NO: 57362 - protein, 10 aa, BK Virus
ETKCEDVFLL

SEQ ID NO: 57363 - protein, 10 aa, BK Virus
LGVAIDQYMV

SEQ ID NO: 57364 - protein, 10 aa, BK Virus
EISMYTFSRM

SEQ ID NO: 57365 - protein, 10 aa, BK Virus
LIFGAHGNAV

SEQ ID NO: 57366 - protein, 10 aa, BK Virus
VIFDFLHCVV

SEQ ID NO: 57367 - protein, 10 aa, BK Virus
ESQSQCSSQV

SEQ ID NO: 57368 - protein, 10 aa, BK Virus
CAGHNIIFFL

SEQ ID NO: 57369 - protein, 10 aa, BK Virus
AVLEQYMAGV

SEQ ID NO: 57370 - protein, 10 aa, BK Virus
NSSEVPTYGT

SEQ ID NO: 57371 - protein, 10 aa, BK Virus
ERAAWGNLPL

SEQ ID NO: 57372 - protein, 10 aa, BK Virus
EDMFASDEEA

SEQ ID NO: 57373 - protein, 10 aa, BK Virus
ETKQVSWKLI

SEQ ID NO: 57374 - protein, 10 aa, BK Virus
SAINNFCQKL

SEQ ID NO: 57375 - protein, 10 aa, BK Virus
GVAIDQYMVV

SEQ ID NO: 57376 - protein, 10 aa, BK Virus
TLACFAVYTT

SEQ ID NO: 57377 - protein, 10 aa, BK Virus
AVLEQYMAGV

SEQ ID NO: 57378 - protein, 10 aa, BK Virus
SVIFDFLHCV

SEQ ID NO: 57379 - protein, 10 aa, BK Virus
YTFSRMKYNI

SEQ ID NO: 57380 - protein, 10 aa, BK Virus
LIFGAHGNAV

SEQ ID NO: 57381 - protein, 10 aa, BK Virus
VIFDFLHCVV

SEQ ID NO: 57382 - protein, 10 aa, BK Virus
EMLTERFNHI

SEQ ID NO: 57383 - protein, 10 aa, BK Virus
QIFPPGLVTM

SEQ ID NO: 57384 - protein, 10 aa, BK Virus
LPMERLTFEL

SEQ ID NO: 57385 - protein, 10 aa, BK Virus
TTLAAGLLDL

SEQ ID NO: 57386 - protein, 10 aa, BK Virus
YAVETKCEDV

SEQ ID NO: 57387 - protein, 10 aa, BK Virus
FFLTPHRHRV

SEQ ID NO: 57388 - protein, 10 aa, BK Virus
LLLLIWFRPV

SEQ ID NO: 57389 - protein, 10 aa, BK Virus
DVFLLLGMYL

SEQ ID NO: 57390 - protein, 10 aa, BK Virus
RPKIYLRKSL

SEQ ID NO: 57391 - protein, 10 aa, BK Virus
TPHRHRVSAI

SEQ ID NO: 57392 - protein, 10 aa, BK Virus
LPMERLTFEL

SEQ ID NO: 57393 - protein, 10 aa, BK Virus
GPIDSGKTTL

SEQ ID NO: 57394 - protein, 10 aa, BK Virus
LPSGHGINNL

SEQ ID NO: 57395 - protein, 10 aa, BK Virus
RPVADFSKDI

SEQ ID NO: 57396 - protein, 10 aa, BK Virus
RPKIYLRKSL

SEQ ID NO: 57397 - protein, 10 aa, BK Virus
TPHRHRVSAI

SEQ ID NO: 57398 - protein, 10 aa, BK Virus
RQIDFRPKIY

SEQ ID NO: 57399 - protein, 10 aa, BK Virus
HMCAGHNIIF

SEQ ID NO: 57400 - protein, 10 aa, BK Virus
KLMEKYSVTF

SEQ ID NO: 57401 - protein, 10 aa, BK Virus
SMYTFSRMKY

SEQ ID NO: 57402 - protein, 10 aa, BK Virus
SQAVFSNRTL

SEQ ID NO: 57403 - protein, 10 aa, BK Virus
QVSWKLITEY

SEQ ID NO: 57404 - protein, 10 aa, BK Virus
FLLLGMYLEF

SEQ ID NO: 57405 - protein, 10 aa, BK Virus
IQGGLKEHDF

SEQ ID NO: 57406 - protein, 10 aa, BK Virus
VAIDQYMVVF

SEQ ID NO: 57407 - protein, 10 aa, BK Virus
LQSGMTLLLL

SEQ ID NO: 57408 - protein, 10 aa, BK Virus
FELGVAIDQY

SEQ ID NO: 57409 - protein, 10 aa, BK Virus
EEWESWWSSF

SEQ ID NO: 57410 - protein, 10 aa, BK Virus
MERLTFELGV

SEQ ID NO: 57411 - protein, 10 aa, BK Virus
MTLLLLLIWF

SEQ ID NO: 57412 - protein, 10 aa, BK Virus
RRYWLFKGPI

SEQ ID NO: 57413 - protein, 10 aa, BK Virus
KRMNTLYKKM

SEQ ID NO: 57414 - protein, 10 aa, BK Virus
KRILQSGMTL

SEQ ID NO: 57415 - protein, 10 aa, BK Virus
KRVDTLHMTR

SEQ ID NO: 57416 - protein, 10 aa, BK Virus
KRTQIFPPGL

SEQ ID NO: 57417 - protein, 10 aa, BK Virus
VAIDQYMVVF

SEQ ID NO: 57418 - protein, 10 aa, BK Virus
LPMERLTFEL

SEQ ID NO: 57419 - protein, 10 aa, BK Virus
RAAWGNLPLM

SEQ ID NO: 57420 - protein, 10 aa, BK Virus
QVSWKLITEY

SEQ ID NO: 57421 - protein, 10 aa, BK Virus
LPSGHGINNL

SEQ ID NO: 57422 - protein, 10 aa, BK Virus
FLLLGMYLEF

SEQ ID NO: 57423 - protein, 10 aa, BK Virus
PPGLVTMNEY

SEQ ID NO: 57424 - protein, 10 aa, BK Virus
YPVPKTLQAR

SEQ ID NO: 57425 - protein, 10 aa, BK Virus
FPSDLHQFLS

SEQ ID NO: 57426 - protein, 10 aa, BK Virus
MCAGHNIIFF

SEQ ID NO: 57427 - protein, 10 aa, BK Virus
MAGVAWLHCL

SEQ ID NO: 57428 - protein, 10 aa, BK Virus
EPEETKQVSW

SEQ ID NO: 57429 - protein, 10 aa, BK Virus
YHEKHFANAI

SEQ ID NO: 57430 - protein, 10 aa, BK Virus
SQAVFSNRTL

SEQ ID NO: 57431 - protein, 10 aa, BK Virus
ERAAWGNLPL

SEQ ID NO: 57432 - protein, 10 aa, BK Virus
YLDGSVKVNL

SEQ ID NO: 57433 - protein, 10 aa, BK Virus
REESMELMDL

SEQ ID NO: 57434 - protein, 10 aa, BK Virus
SEFLLEKRIL

SEQ ID NO: 57435 - protein, 10 aa, BK Virus
VETKCEDVFL

SEQ ID NO: 57436 - protein, 10 aa, BK Virus
EETKQVSWKL

SEQ ID NO: 57437 - protein, 10 aa, BK Virus
EESMELMDLL

SEQ ID NO: 57438 - protein, 10 aa, BK Virus
MERLTFELGV

SEQ ID NO: 57439 - protein, 10 aa, BK Virus
SEFLLEKRIL

SEQ ID NO: 57440 - protein, 10 aa, BK Virus
EESMELMDLL

SEQ ID NO: 57441 - protein, 10 aa, BK Virus
KEYLLYSALT

SEQ ID NO: 57442 - protein, 10 aa, BK Virus
VETKCEDVFL

SEQ ID NO: 57443 - protein, 10 aa, BK Virus
EEWESWWSSF

SEQ ID NO: 57444 - protein, 10 aa, BK Virus
SEFLLEKRIL

SEQ ID NO: 57445 - protein, 10 aa, BK Virus
SEISMYTFSR

SEQ ID NO: 57446 - protein, 10 aa, BK Virus
LPMERLTFEL

SEQ ID NO: 57447 - protein, 10 aa, BK Virus
DPYHIIEESI

SEQ ID NO: 57448 - protein, 10 aa, BK Virus
LPSGHGINNL

SEQ ID NO: 57449 - protein, 10 aa, BK Virus
LPMERLTFEL

SEQ ID NO: 57450 - protein, 10 aa, BK Virus
EPEETKQVSW

SEQ ID NO: 57451 - protein, 10 aa, BK Virus
LPSGHGINNL

SEQ ID NO: 57452 - protein, 10 aa, BK Virus
GPIDSGKTTL

SEQ ID NO: 57453 - protein, 10 aa, BK Virus
TPHRHRVSAI

SEQ ID NO: 57454 - protein, 10 aa, BK Virus
FPSDLHQFLS

SEQ ID NO: 57455 - protein, 10 aa, BK Virus
LPLMRKAYLK

SEQ ID NO: 57456 - protein, 10 aa, BK Virus
FAVYTTKEKA

SEQ ID NO: 57457 - protein, 10 aa, BK Virus
LPMERLTFEL

SEQ ID NO: 57458 - protein, 10 aa, BK Virus
VAHQPDFGTW

SEQ ID NO: 57459 - protein, 10 aa, BK Virus
VAHQPDFGTW

SEQ ID NO: 57460 - protein, 10 aa, BK Virus
VAIDQYMVVF

SEQ ID NO: 57461 - protein, 10 aa, BK Virus
RAAWGNLPLM

SEQ ID NO: 57462 - protein, 10 aa, BK Virus
KSLQNSEFLL

SEQ ID NO: 57463 - protein, 10 aa, BK Virus
KLMEKYSVTF

SEQ ID NO: 57464 - protein, 10 aa, BK Virus
KAYLKKCKEF

SEQ ID NO: 57465 - protein, 10 aa, BK Virus
KDIQSRIVEW

SEQ ID NO: 57466 - protein, 11 aa, BK Virus
YTTKEKAQILY

SEQ ID NO: 57467 - protein, 11 aa, BK Virus
YMAGVAWLHCL

SEQ ID NO: 57468 - protein, 11 aa, BK Virus
KLMEKYSVTFI

SEQ ID NO: 57469 - protein, 11 aa, BK Virus
LLLLLIWFRPV

SEQ ID NO: 57470 - protein, 11 aa, BK Virus
ILDKMDLIFGA

SEQ ID NO: 57471 - protein, 11 aa, BK Virus
ILQSGMTLLLL

SEQ ID NO: 57472 - protein, 11 aa, BK Virus
FLSQAVFSNRT

SEQ ID NO: 57473 - protein, 11 aa, BK Virus
FLTPHRHRVSA

SEQ ID NO: 57474 - protein, 11 aa, BK Virus
FLLLGMYLEFQ

SEQ ID NO: 57475 - protein, 11 aa, BK Virus
RILQSGMTLLL

SEQ ID NO: 57476 - protein, 11 aa, BK Virus
TMNEYPVPKTL

SEQ ID NO: 57477 - protein, 11 aa, BK Virus
GLLDLCGGKAL

SEQ ID NO: 57478 - protein, 11 aa, BK Virus
ALNVNLPMERL

SEQ ID NO: 57479 - protein, 11 aa, BK Virus
LLLLIWFRPVA

SEQ ID NO: 57480 - protein, 11 aa, BK Virus
ELMDLLGLERA

SEQ ID NO: 57481 - protein, 11 aa, BK Virus
CTFSFLICKGV

SEQ ID NO: 57482 - protein, 11 aa, BK Virus
FSNRTLACFAV

SEQ ID NO: 57483 - protein, 11 aa, BK Virus
VSWKLITEYAV

SEQ ID NO: 57484 - protein, 11 aa, BK Virus
LQSGMTLLLLL

SEQ ID NO: 57485 - protein, 11 aa, BK Virus
KVLNREESMEL

SEQ ID NO: 57486 - protein, 11 aa, BK Virus
YMAGVAWLHCL

SEQ ID NO: 57487 - protein, 11 aa, BK Virus
KLMEKYSVTFI

SEQ ID NO: 57488 - protein, 11 aa, BK Virus
MCAGHNIIFFL

SEQ ID NO: 57489 - protein, 11 aa, BK Virus
FLTPHRHRVSA

SEQ ID NO: 57490 - protein, 11 aa, BK Virus
FLSQAVFSNRT

SEQ ID NO: 57491 - protein, 11 aa, BK Virus
LQSGMTLLLLL

SEQ ID NO: 57492 - protein, 11 aa, BK Virus
ILQSGMTLLLL

SEQ ID NO: 57493 - protein, 11 aa, BK Virus
ALNVNLPMERL

SEQ ID NO: 57494 - protein, 11 aa, BK Virus
LLLLLIWFRPV

SEQ ID NO: 57495 - protein, 11 aa, BK Virus
FSNRTLACFAV

SEQ ID NO: 57496 - protein, 11 aa, BK Virus
FLLLGMYLEFQ

SEQ ID NO: 57497 - protein, 11 aa, BK Virus
TMNEYPVPKTL

SEQ ID NO: 57498 - protein, 11 aa, BK Virus
ELMDLLGLERA

SEQ ID NO: 57499 - protein, 11 aa, BK Virus
HIIEESIQGGL

SEQ ID NO: 57500 - protein, 11 aa, BK Virus
ILDKMDLIFGA

SEQ ID NO: 57501 - protein, 11 aa, BK Virus
FCQKLCTFSFL

SEQ ID NO: 57502 - protein, 11 aa, BK Virus
LIFGAHGNAVL

SEQ ID NO: 57503 - protein, 11 aa, BK Virus
ELGVAIDQYMV

SEQ ID NO: 57504 - protein, 11 aa, BK Virus
FLHCVVFNVPK

SEQ ID NO: 57505 - protein, 11 aa, BK Virus
GLLDLCGGKAL

SEQ ID NO: 57506 - protein, 11 aa, BK Virus
NLPMERLTFEL

SEQ ID NO: 57507 - protein, 11 aa, BK Virus
FDFLHCVVFNV

SEQ ID NO: 57508 - protein, 11 aa, BK Virus
VLNREESMELM

SEQ ID NO: 57509 - protein, 11 aa, BK Virus
QVSWKLITEYA

SEQ ID NO: 57510 - protein, 11 aa, BK Virus
LGMYLEFQYNV

SEQ ID NO: 57511 - protein, 11 aa, BK Virus
CTFSFLICKGV

SEQ ID NO: 57512 - protein, 11 aa, BK Virus
LLEKRILQSGM

SEQ ID NO: 57513 - protein, 11 aa, BK Virus
LICKGVNKEYL

SEQ ID NO: 57514 - protein, 11 aa, BK Virus
GVNKEYLLYSA

SEQ ID NO: 57515 - protein, 11 aa, BK Virus
YMAGVAWLHCL

SEQ ID NO: 57516 - protein, 11 aa, BK Virus
KLMEKYSVTFI

SEQ ID NO: 57517 - protein, 11 aa, BK Virus
FLTPHRHRVSA

SEQ ID NO: 57518 - protein, 11 aa, BK Virus
TMNEYPVPKTL

SEQ ID NO: 57519 - protein, 11 aa, BK Virus
LLLLLIWFRPV

SEQ ID NO: 57520 - protein, 11 aa, BK Virus
ILQSGMTLLLL

SEQ ID NO: 57521 - protein, 11 aa, BK Virus
FLSQAVFSNRT

SEQ ID NO: 57522 - protein, 11 aa, BK Virus
ALNVNLPMERL

SEQ ID NO: 57523 - protein, 11 aa, BK Virus
ELMDLLGLERA

SEQ ID NO: 57524 - protein, 11 aa, BK Virus
GLLDLCGGKAL

SEQ ID NO: 57525 - protein, 11 aa, BK Virus
QVSWKLITEYA

SEQ ID NO: 57526 - protein, 11 aa, BK Virus
LQSGMTLLLLL

SEQ ID NO: 57527 - protein, 11 aa, BK Virus
GVNKEYLLYSA

SEQ ID NO: 57528 - protein, 11 aa, BK Virus
HIIEESIQGGL

SEQ ID NO: 57529 - protein, 11 aa, BK Virus
LIFGAHGNAVL

SEQ ID NO: 57530 - protein, 11 aa, BK Virus
NAVLEQYMAGV

SEQ ID NO: 57531 - protein, 11 aa, BK Virus
CTFSFLICKGV

SEQ ID NO: 57532 - protein, 11 aa, BK Virus
DLIFGAHGNAV

SEQ ID NO: 57533 - protein, 11 aa, BK Virus
SVIFDFLHCVV

SEQ ID NO: 57534 - protein, 11 aa, BK Virus
FSNRTLACFAV

SEQ ID NO: 57535 - protein, 11 aa, BK Virus
VLNREESMELM

SEQ ID NO: 57536 - protein, 11 aa, BK Virus
FLLLGMYLEFQ

SEQ ID NO: 57537 - protein, 11 aa, BK Virus
NLPMERLTFEL

SEQ ID NO: 57538 - protein, 11 aa, BK Virus
ILDKMDLIFGA

SEQ ID NO: 57539 - protein, 11 aa, BK Virus
RILQSGMTLLL

SEQ ID NO: 57540 - protein, 11 aa, BK Virus
LTPHRHRVSAI

SEQ ID NO: 57541 - protein, 11 aa, BK Virus
VVFEDVKGTGA

SEQ ID NO: 57542 - protein, 11 aa, BK Virus
YMVVFEDVKGT

SEQ ID NO: 57543 - protein, 11 aa, BK Virus
YMAGVAWLHCL

SEQ ID NO: 57544 - protein, 11 aa, BK Virus
TMNEYPVPKTL

SEQ ID NO: 57545 - protein, 11 aa, BK Virus
KLMEKYSVTFI

SEQ ID NO: 57546 - protein, 11 aa, BK Virus
LLLLLIWFRPV

SEQ ID NO: 57547 - protein, 11 aa, BK Virus
FLTPHRHRVSA

SEQ ID NO: 57548 - protein, 11 aa, BK Virus
KVLNREESMEL

SEQ ID NO: 57549 - protein, 11 aa, BK Virus
ILQSGMTLLLL

SEQ ID NO: 57550 - protein, 11 aa, BK Virus
SICQQAVDTVL

SEQ ID NO: 57551 - protein, 11 aa, BK Virus
RQIDFRPKIYL

SEQ ID NO: 57552 - protein, 11 aa, BK Virus
YMAGVAWLHCL

SEQ ID NO: 57553 - protein, 11 aa, BK Virus
KLMEKYSVTFI

SEQ ID NO: 57554 - protein, 11 aa, BK Virus
LLLLLIWFRPV

SEQ ID NO: 57555 - protein, 11 aa, BK Virus
LQSGMTLLLLL

SEQ ID NO: 57556 - protein, 11 aa, BK Virus
FLTPHRHRVSA

SEQ ID NO: 57557 - protein, 11 aa, BK Virus
SVIFDFLHCVV

SEQ ID NO: 57558 - protein, 11 aa, BK Virus
FSNRTLACFAV

SEQ ID NO: 57559 - protein, 11 aa, BK Virus
RILQSGMTLLL

SEQ ID NO: 57560 - protein, 11 aa, BK Virus
ILDKMDLIFGA

SEQ ID NO: 57561 - protein, 11 aa, BK Virus
KVLNREESMEL

SEQ ID NO: 57562 - protein, 11 aa, BK Virus
SQAVFSNRTLA

SEQ ID NO: 57563 - protein, 11 aa, BK Virus
KSICQQAVDTV

SEQ ID NO: 57564 - protein, 11 aa, BK Virus
NAVLEQYMAGV

SEQ ID NO: 57565 - protein, 11 aa, BK Virus
TQIFPPGLVTM

SEQ ID NO: 57566 - protein, 11 aa, BK Virus
HIIEESIQGGL

SEQ ID NO: 57567 - protein, 11 aa, BK Virus
FLLLGMYLEFQ

SEQ ID NO: 57568 - protein, 11 aa, BK Virus
FLSQAVFSNRT

SEQ ID NO: 57569 - protein, 11 aa, BK Virus
ILQSGMTLLLL

SEQ ID NO: 57570 - protein, 11 aa, BK Virus
GLLDLCGGKAL

SEQ ID NO: 57571 - protein, 11 aa, BK Virus
CQKLCTFSFLI

SEQ ID NO: 57572 - protein, 11 aa, BK Virus
FVRQIDFRPKI

SEQ ID NO: 57573 - protein, 11 aa, BK Virus
KQVSWKLITEY

SEQ ID NO: 57574 - protein, 11 aa, BK Virus
VVFEDVKGTGA

SEQ ID NO: 57575 - protein, 11 aa, BK Virus
AVLEQYMAGVA

SEQ ID NO: 57576 - protein, 11 aa, BK Virus
LLLLIWFRPVA

SEQ ID NO: 57577 - protein, 11 aa, BK Virus
RTLACFAVYTT

SEQ ID NO: 57578 - protein, 11 aa, BK Virus
QVSWKLITEYA

SEQ ID NO: 57579 - protein, 11 aa, BK Virus
LIFGAHGNAVL

SEQ ID NO: 57580 - protein, 11 aa, BK Virus
NLPMERLTFEL

SEQ ID NO: 57581 - protein, 11 aa, BK Virus
FQYNVEECKKC

SEQ ID NO: 57582 - protein, 11 aa, BK Virus
YMAGVAWLHCL

SEQ ID NO: 57583 - protein, 11 aa, BK Virus
FLTPHRHRVSA

SEQ ID NO: 57584 - protein, 11 aa, BK Virus
LLLLLIWFRPV

SEQ ID NO: 57585 - protein, 11 aa, BK Virus
ILQSGMTLLLL

SEQ ID NO: 57586 - protein, 11 aa, BK Virus
GLLDLCGGKAL

SEQ ID NO: 57587 - protein, 11 aa, BK Virus
NLPMERLTFEL

SEQ ID NO: 57588 - protein, 11 aa, BK Virus
ILDKMDLIFGA

SEQ ID NO: 57589 - protein, 11 aa, BK Virus
TMNEYPVPKTL

SEQ ID NO: 57590 - protein, 11 aa, BK Virus
ELGVAIDQYMV

SEQ ID NO: 57591 - protein, 11 aa, BK Virus
FLLLGMYLEFQ

SEQ ID NO: 57592 - protein, 11 aa, BK Virus
PMERLTFELGV

SEQ ID NO: 57593 - protein, 11 aa, BK Virus
ELMDLLGLERA

SEQ ID NO: 57594 - protein, 11 aa, BK Virus
EMLTERFNHIL

SEQ ID NO: 57595 - protein, 11 aa, BK Virus
DLIFGAHGNAV

SEQ ID NO: 57596 - protein, 11 aa, BK Virus
KLMEKYSVTFI

SEQ ID NO: 57597 - protein, 11 aa, BK Virus
LLLLIWFRPVA

SEQ ID NO: 57598 - protein, 11 aa, BK Virus
RILQSGMTLLL

SEQ ID NO: 57599 - protein, 11 aa, BK Virus
LLLGMYLEFQY

SEQ ID NO: 57600 - protein, 11 aa, BK Virus
AVDTVLAKKRV

SEQ ID NO: 57601 - protein, 11 aa, BK Virus
ALNVNLPMERL

SEQ ID NO: 57602 - protein, 11 aa, BK Virus
LIFGAHGNAVL

SEQ ID NO: 57603 - protein, 11 aa, BK Virus
RLDSEISMYTF

SEQ ID NO: 57604 - protein, 11 aa, BK Virus
SVIFDFLHCVV

SEQ ID NO: 57605 - protein, 11 aa, BK Virus
LMDLLGLERAA

SEQ ID NO: 57606 - protein, 11 aa, BK Virus
FLSQAVFSNRT

SEQ ID NO: 57607 - protein, 11 aa, BK Virus
DLPSGHGINNL

SEQ ID NO: 57608 - protein, 11 aa, BK Virus
FLLEKRILQSG

SEQ ID NO: 57609 - protein, 11 aa, BK Virus
KVLNREESMEL

SEQ ID NO: 57610 - protein, 11 aa, BK Virus
YLDGSVKVNLE

SEQ ID NO: 57611 - protein, 11 aa, BK Virus
MCAGHNIIFFL

SEQ ID NO: 57612 - protein, 11 aa, BK Virus
PIDSGKTTLAA

SEQ ID NO: 57613 - protein, 11 aa, BK Virus
VIFDFLHCVVF

SEQ ID NO: 57614 - protein, 11 aa, BK Virus
IFFLTPHRHRV

SEQ ID NO: 57615 - protein, 11 aa, BK Virus
CTFSFLICKGV

SEQ ID NO: 57616 - protein, 11 aa, BK Virus
VSWKLITEYAV

SEQ ID NO: 57617 - protein, 11 aa, BK Virus
DMFASDEEATA

SEQ ID NO: 57618 - protein, 11 aa, BK Virus
RQIDFRPKIYL

SEQ ID NO: 57619 - protein, 11 aa, BK Virus
VLNREESMELM

SEQ ID NO: 57620 - protein, 11 aa, BK Virus
SLQNSEFLLEK

SEQ ID NO: 57621 - protein, 11 aa, BK Virus
PVPKTLQARFV

SEQ ID NO: 57622 - protein, 11 aa, BK Virus
HIIEESIQGGL

SEQ ID NO: 57623 - protein, 11 aa, BK Virus
KMDSVIFDFLH

SEQ ID NO: 57624 - protein, 11 aa, BK Virus
LICKGVNKEYL

SEQ ID NO: 57625 - protein, 11 aa, BK Virus
TLHMTREEMLT

SEQ ID NO: 57626 - protein, 11 aa, BK Virus
LLYSALTRDPY

SEQ ID NO: 57627 - protein, 11 aa, BK Virus
KLCTFSFLICK

SEQ ID NO: 57628 - protein, 11 aa, BK Virus
GMTLLLLLIWF

SEQ ID NO: 57629 - protein, 11 aa, BK Virus
WLFKGPIDSGK

SEQ ID NO: 57630 - protein, 11 aa, BK Virus
YMAGVAWLHCL

SEQ ID NO: 57631 - protein, 11 aa, BK Virus
FLTPHRHRVSA

SEQ ID NO: 57632 - protein, 11 aa, BK Virus
GLLDLCGGKAL

SEQ ID NO: 57633 - protein, 11 aa, BK Virus
TMNEYPVPKTL

SEQ ID NO: 57634 - protein, 11 aa, BK Virus
LLLLLIWFRPV

SEQ ID NO: 57635 - protein, 11 aa, BK Virus
PMERLTFELGV

SEQ ID NO: 57636 - protein, 11 aa, BK Virus
ILQSGMTLLLL

SEQ ID NO: 57637 - protein, 11 aa, BK Virus
FLLLGMYLEFQ

SEQ ID NO: 57638 - protein, 11 aa, BK Virus
ILDKMDLIFGA

SEQ ID NO: 57639 - protein, 11 aa, BK Virus
DLIFGAHGNAV

SEQ ID NO: 57640 - protein, 11 aa, BK Virus
EMLTERFNHIL

SEQ ID NO: 57641 - protein, 11 aa, BK Virus
ELGVAIDQYMV

SEQ ID NO: 57642 - protein, 11 aa, BK Virus
LLLGMYLEFQY

SEQ ID NO: 57643 - protein, 11 aa, BK Virus
ELMDLLGLERA

SEQ ID NO: 57644 - protein, 11 aa, BK Virus
NLPMERLTFEL

SEQ ID NO: 57645 - protein, 11 aa, BK Virus
FLLEKRILQSG

SEQ ID NO: 57646 - protein, 11 aa, BK Virus
LIFGAHGNAVL

SEQ ID NO: 57647 - protein, 11 aa, BK Virus
KLMEKYSVTFI

SEQ ID NO: 57648 - protein, 11 aa, BK Virus
LLLLIWFRPVA

SEQ ID NO: 57649 - protein, 11 aa, BK Virus
VSWKLITEYAV

SEQ ID NO: 57650 - protein, 11 aa, BK Virus
LMDLLGLERAA

SEQ ID NO: 57651 - protein, 11 aa, BK Virus
FLSQAVFSNRT

SEQ ID NO: 57652 - protein, 11 aa, BK Virus
ALNVNLPMERL

SEQ ID NO: 57653 - protein, 11 aa, BK Virus
AVDTVLAKKRV

SEQ ID NO: 57654 - protein, 11 aa, BK Virus
DLPSGHGINNL

SEQ ID NO: 57655 - protein, 11 aa, BK Virus
VIFDFLHCVVF

SEQ ID NO: 57656 - protein, 11 aa, BK Virus
VLNREESMELM

SEQ ID NO: 57657 - protein, 11 aa, BK Virus
WLFKGPIDSGK

SEQ ID NO: 57658 - protein, 11 aa, BK Virus
KVLNREESMEL

SEQ ID NO: 57659 - protein, 11 aa, BK Virus
SVIFDFLHCVV

SEQ ID NO: 57660 - protein, 11 aa, BK Virus
LLEKRILQSGM

SEQ ID NO: 57661 - protein, 11 aa, BK Virus
YMVVFEDVKGT

SEQ ID NO: 57662 - protein, 11 aa, BK Virus
HIIEESIQGGL

SEQ ID NO: 57663 - protein, 11 aa, BK Virus
LICKGVNKEYL

SEQ ID NO: 57664 - protein, 11 aa, BK Virus
CTFSFLICKGV

SEQ ID NO: 57665 - protein, 11 aa, BK Virus
IFFLTPHRHRV

SEQ ID NO: 57666 - protein, 11 aa, BK Virus
MCAGHNIIFFL

SEQ ID NO: 57667 - protein, 11 aa, BK Virus
VVFEDVKGTGA

SEQ ID NO: 57668 - protein, 11 aa, BK Virus
YMAGVAWLHCL

SEQ ID NO: 57669 - protein, 11 aa, BK Virus
FLTPHRHRVSA

SEQ ID NO: 57670 - protein, 11 aa, BK Virus
ELGVAIDQYMV

SEQ ID NO: 57671 - protein, 11 aa, BK Virus
ILQSGMTLLLL

SEQ ID NO: 57672 - protein, 11 aa, BK Virus
NLPMERLTFEL

SEQ ID NO: 57673 - protein, 11 aa, BK Virus
PMERLTFELGV

SEQ ID NO: 57674 - protein, 11 aa, BK Virus
LLLLLIWFRPV

SEQ ID NO: 57675 - protein, 11 aa, BK Virus
TMNEYPVPKTL

SEQ ID NO: 57676 - protein, 11 aa, BK Virus
DLIFGAHGNAV

SEQ ID NO: 57677 - protein, 11 aa, BK Virus
FLLLGMYLEFQ

SEQ ID NO: 57678 - protein, 11 aa, BK Virus
AVDTVLAKKRV

SEQ ID NO: 57679 - protein, 11 aa, BK Virus
ILDKMDLIFGA

SEQ ID NO: 57680 - protein, 11 aa, BK Virus
ALNVNLPMERL

SEQ ID NO: 57681 - protein, 11 aa, BK Virus
KLMEKYSVTFI

SEQ ID NO: 57682 - protein, 11 aa, BK Virus
GLLDLCGGKAL

SEQ ID NO: 57683 - protein, 11 aa, BK Virus
FLSQAVFSNRT

SEQ ID NO: 57684 - protein, 11 aa, BK Virus
ELMDLLGLERA

SEQ ID NO: 57685 - protein, 11 aa, BK Virus
DLPSGHGINNL

SEQ ID NO: 57686 - protein, 11 aa, BK Virus
LIFGAHGNAVL

SEQ ID NO: 57687 - protein, 11 aa, BK Virus
EMLTERFNHIL

SEQ ID NO: 57688 - protein, 11 aa, BK Virus
LICKGVNKEYL

SEQ ID NO: 57689 - protein, 11 aa, BK Virus
RILQSGMTLLL

SEQ ID NO: 57690 - protein, 11 aa, BK Virus
IFFLTPHRHRV

SEQ ID NO: 57691 - protein, 11 aa, BK Virus
PVPKTLQARFV

SEQ ID NO: 57692 - protein, 11 aa, BK Virus
SVIFDFLHCVV

SEQ ID NO: 57693 - protein, 11 aa, BK Virus
MCAGHNIIFFL

SEQ ID NO: 57694 - protein, 11 aa, BK Virus
LLLGMYLEFQY

SEQ ID NO: 57695 - protein, 11 aa, BK Virus
KVLNREESMEL

SEQ ID NO: 57696 - protein, 11 aa, BK Virus
LLLLIWFRPVA

SEQ ID NO: 57697 - protein, 11 aa, BK Virus
RQIDFRPKIYL

SEQ ID NO: 57698 - protein, 11 aa, BK Virus
VSWKLITEYAV

SEQ ID NO: 57699 - protein, 11 aa, BK Virus
AVYTTKEKAQI

SEQ ID NO: 57700 - protein, 11 aa, BK Virus
DMFASDEEATA

SEQ ID NO: 57701 - protein, 11 aa, BK Virus
YMAGVAWLHCL

SEQ ID NO: 57702 - protein, 11 aa, BK Virus
ILQSGMTLLLL

SEQ ID NO: 57703 - protein, 11 aa, BK Virus
FLTPHRHRVSA

SEQ ID NO: 57704 - protein, 11 aa, BK Virus
LLLLLIWFRPV

SEQ ID NO: 57705 - protein, 11 aa, BK Virus
FLLLGMYLEFQ

SEQ ID NO: 57706 - protein, 11 aa, BK Virus
ELGVAIDQYMV

SEQ ID NO: 57707 - protein, 11 aa, BK Virus
ILDKMDLIFGA

SEQ ID NO: 57708 - protein, 11 aa, BK Virus
ELMDLLGLERA

SEQ ID NO: 57709 - protein, 11 aa, BK Virus
PMERLTFELGV

SEQ ID NO: 57710 - protein, 11 aa, BK Virus
ALNVNLPMERL

SEQ ID NO: 57711 - protein, 11 aa, BK Virus
FLSQAVFSNRT

SEQ ID NO: 57712 - protein, 11 aa, BK Virus
DLIFGAHGNAV

SEQ ID NO: 57713 - protein, 11 aa, BK Virus
EMLTERFNHIL

SEQ ID NO: 57714 - protein, 11 aa, BK Virus
TMNEYPVPKTL

SEQ ID NO: 57715 - protein, 11 aa, BK Virus
DLPSGHGINNL

SEQ ID NO: 57716 - protein, 11 aa, BK Virus
NLPMERLTFEL

SEQ ID NO: 57717 - protein, 11 aa, BK Virus
AVDTVLAKKRV

SEQ ID NO: 57718 - protein, 11 aa, BK Virus
GLLDLCGGKAL

SEQ ID NO: 57719 - protein, 11 aa, BK Virus
MCAGHNIIFFL

SEQ ID NO: 57720 - protein, 11 aa, BK Virus
KLMEKYSVTFI

SEQ ID NO: 57721 - protein, 11 aa, BK Virus
VSWKLITEYAV

SEQ ID NO: 57722 - protein, 11 aa, BK Virus
TLACFAVYTTK

SEQ ID NO: 57723 - protein, 11 aa, BK Virus
FLHCVVFNVPK

SEQ ID NO: 57724 - protein, 11 aa, BK Virus
KLCTFSFLICK

SEQ ID NO: 57725 - protein, 11 aa, BK Virus
KMKRMNTLYKK

SEQ ID NO: 57726 - protein, 11 aa, BK Virus
GVAWLHCLLPK

SEQ ID NO: 57727 - protein, 11 aa, BK Virus
RVSAINNFCQK

SEQ ID NO: 57728 - protein, 11 aa, BK Virus
TLYKKMEQDVK

SEQ ID NO: 57729 - protein, 11 aa, BK Virus
KVNLEKKHLNK

SEQ ID NO: 57730 - protein, 11 aa, BK Virus
FSFLICKGVNK

SEQ ID NO: 57731 - protein, 11 aa, BK Virus
IIFFLTPHRHR

SEQ ID NO: 57732 - protein, 11 aa, BK Virus
TTKEKAQILYK

SEQ ID NO: 57733 - protein, 11 aa, BK Virus
SLQNSEFLLEK

SEQ ID NO: 57734 - protein, 11 aa, BK Virus
KLITEYAVETK

SEQ ID NO: 57735 - protein, 11 aa, BK Virus
AAWGNLPLMRK

SEQ ID NO: 57736 - protein, 11 aa, BK Virus
NVPKRRYWLFK

SEQ ID NO: 57737 - protein, 11 aa, BK Virus
ISMYTFSRMKY

SEQ ID NO: 57738 - protein, 11 aa, BK Virus
MTLLLLLIWFR

SEQ ID NO: 57739 - protein, 11 aa, BK Virus
HLCKGFQCFKR

SEQ ID NO: 57740 - protein, 11 aa, BK Virus
LMRKAYLKKCK

SEQ ID NO: 57741 - protein, 11 aa, BK Virus
IIEESIQGGLK

SEQ ID NO: 57742 - protein, 11 aa, BK Virus
SLRDYLDGSVK

SEQ ID NO: 57743 - protein, 11 aa, BK Virus
WLFKGPIDSGK

SEQ ID NO: 57744 - protein, 11 aa, BK Virus
KMDSVIFDFLH

SEQ ID NO: 57745 - protein, 11 aa, BK Virus
GVAWLHCLLPK

SEQ ID NO: 57746 - protein, 11 aa, BK Virus
KLCTFSFLICK

SEQ ID NO: 57747 - protein, 11 aa, BK Virus
SLQNSEFLLEK

SEQ ID NO: 57748 - protein, 11 aa, BK Virus
RVSAINNFCQK

SEQ ID NO: 57749 - protein, 11 aa, BK Virus
MTLLLLLIWFR

SEQ ID NO: 57750 - protein, 11 aa, BK Virus
AAWGNLPLMRK

SEQ ID NO: 57751 - protein, 11 aa, BK Virus
TTKEKAQILYK

SEQ ID NO: 57752 - protein, 11 aa, BK Virus
TLACFAVYTTK

SEQ ID NO: 57753 - protein, 11 aa, BK Virus
LVTMNEYPVPK

SEQ ID NO: 57754 - protein, 11 aa, BK Virus
KVNLEKKHLNK

SEQ ID NO: 57755 - protein, 11 aa, BK Virus
AIIFAESKNQK

SEQ ID NO: 57756 - protein, 11 aa, BK Virus
AQILYKKLMEK

SEQ ID NO: 57757 - protein, 11 aa, BK Virus
TADSQHSTPPK

SEQ ID NO: 57758 - protein, 11 aa, BK Virus
NVPKRRYWLFK

SEQ ID NO: 57759 - protein, 11 aa, BK Virus
TLYKKMEQDVK

SEQ ID NO: 57760 - protein, 11 aa, BK Virus
KMKRMNTLYKK

SEQ ID NO: 57761 - protein, 11 aa, BK Virus
KALNVNLPMER

SEQ ID NO: 57762 - protein, 11 aa, BK Virus
FANAIIFAESK

SEQ ID NO: 57763 - protein, 11 aa, BK Virus
ISMYTFSRMKY

SEQ ID NO: 57764 - protein, 11 aa, BK Virus
FSFLICKGVNK

SEQ ID NO: 57765 - protein, 11 aa, BK Virus
CQQAVDTVLAK

SEQ ID NO: 57766 - protein, 11 aa, BK Virus
LTERFNHILDK

SEQ ID NO: 57767 - protein, 11 aa, BK Virus
FLHCVVFNVPK

SEQ ID NO: 57768 - protein, 11 aa, BK Virus
IIFFLTPHRHR

SEQ ID NO: 57769 - protein, 11 aa, BK Virus
AAGLLDLCGGK

SEQ ID NO: 57770 - protein, 11 aa, BK Virus
RAAWGNLPLMR

SEQ ID NO: 57771 - protein, 11 aa, BK Virus
KLITEYAVETK

SEQ ID NO: 57772 - protein, 11 aa, BK Virus
EISMYTFSRMK

SEQ ID NO: 57773 - protein, 11 aa, BK Virus
IIEESIQGGLK

SEQ ID NO: 57774 - protein, 11 aa, BK Virus
QQAVDTVLAKK

SEQ ID NO: 57775 - protein, 11 aa, BK Virus
DQYMVVFEDVK

SEQ ID NO: 57776 - protein, 11 aa, BK Virus
SLRDYLDGSVK

SEQ ID NO: 57777 - protein, 11 aa, BK Virus
IWFRPVADFSK

SEQ ID NO: 57778 - protein, 11 aa, BK Virus
PYHFKYHEKHF

SEQ ID NO: 57779 - protein, 11 aa, BK Virus
VFLLLGMYLEF

SEQ ID NO: 57780 - protein, 11 aa, BK Virus
MYTFSRMKYNI

SEQ ID NO: 57781 - protein, 11 aa, BK Virus
IWFRPVADFSK

SEQ ID NO: 57782 - protein, 11 aa, BK Virus
DYLDGSVKVNL

SEQ ID NO: 57783 - protein, 11 aa, BK Virus
NFCQKLCTFSF

SEQ ID NO: 57784 - protein, 11 aa, BK Virus
TYGTEEWESWW

SEQ ID NO: 57785 - protein, 11 aa, BK Virus
RHMCAGHNIIF

SEQ ID NO: 57786 - protein, 11 aa, BK Virus
KYSVTFISRHM

SEQ ID NO: 57787 - protein, 11 aa, BK Virus
KYHEKHFANAI

SEQ ID NO: 57788 - protein, 11 aa, BK Virus
EFQYNVEECKK

SEQ ID NO: 57789 - protein, 11 aa, BK Virus
KYNICMGKCIL

SEQ ID NO: 57790 - protein, 11 aa, BK Virus
SFNEKWDEDLF

SEQ ID NO: 57791 - protein, 11 aa, BK Virus
YLRKSLQNSEF

SEQ ID NO: 57792 - protein, 11 aa, BK Virus
VYTTKEKAQIL

SEQ ID NO: 57793 - protein, 11 aa, BK Virus
VIFDFLHCVVF

SEQ ID NO: 57794 - protein, 11 aa, BK Virus
KYHEKHFANAI

SEQ ID NO: 57795 - protein, 11 aa, BK Virus
VFLLLGMYLEF

SEQ ID NO: 57796 - protein, 11 aa, BK Virus
PYHFKYHEKHF

SEQ ID NO: 57797 - protein, 11 aa, BK Virus
MYTFSRMKYNI

SEQ ID NO: 57798 - protein, 11 aa, BK Virus
TYGTEEWESWW

SEQ ID NO: 57799 - protein, 11 aa, BK Virus
KYSVTFISRHM

SEQ ID NO: 57800 - protein, 11 aa, BK Virus
VYTTKEKAQIL

SEQ ID NO: 57801 - protein, 11 aa, BK Virus
NFCQKLCTFSF

SEQ ID NO: 57802 - protein, 11 aa, BK Virus
VFLLLGMYLEF

SEQ ID NO: 57803 - protein, 11 aa, BK Virus
KYHEKHFANAI

SEQ ID NO: 57804 - protein, 11 aa, BK Virus
TYGTEEWESWW

SEQ ID NO: 57805 - protein, 11 aa, BK Virus
PYHFKYHEKHF

SEQ ID NO: 57806 - protein, 11 aa, BK Virus
CLLPKMDSVIF

SEQ ID NO: 57807 - protein, 11 aa, BK Virus
VYTTKEKAQIL

SEQ ID NO: 57808 - protein, 11 aa, BK Virus
RFNHILDKMDL

SEQ ID NO: 57809 - protein, 11 aa, BK Virus
YLRKSLQNSEF

SEQ ID NO: 57810 - protein, 11 aa, BK Virus
KYNICMGKCIL

SEQ ID NO: 57811 - protein, 11 aa, BK Virus
NFCQKLCTFSF

SEQ ID NO: 57812 - protein, 11 aa, BK Virus
SFNEKWDEDLF

SEQ ID NO: 57813 - protein, 11 aa, BK Virus
RHMCAGHNIIF

SEQ ID NO: 57814 - protein, 11 aa, BK Virus
YTTKEKAQILY

SEQ ID NO: 57815 - protein, 11 aa, BK Virus
ESMELMDLLGL

SEQ ID NO: 57816 - protein, 11 aa, BK Virus
YTTKEKAQILY

SEQ ID NO: 57817 - protein, 11 aa, BK Virus
AVFSNRTLACF

SEQ ID NO: 57818 - protein, 11 aa, BK Virus
QILYKKLMEKY

SEQ ID NO: 57819 - protein, 11 aa, BK Virus
VIFDFLHCVVF

SEQ ID NO: 57820 - protein, 11 aa, BK Virus
ETKCEDVFLLL

SEQ ID NO: 57821 - protein, 11 aa, BK Virus
GVAIDQYMVVF

SEQ ID NO: 57822 - protein, 11 aa, BK Virus
HIIEESIQGGL

SEQ ID NO: 57823 - protein, 11 aa, BK Virus
MTREEMLTERF

SEQ ID NO: 57824 - protein, 11 aa, BK Virus
DLHQFLSQAVF

SEQ ID NO: 57825 - protein, 11 aa, BK Virus
NVNLPMERLTF

SEQ ID NO: 57826 - protein, 11 aa, BK Virus
YLRKSLQNSEF

SEQ ID NO: 57827 - protein, 11 aa, BK Virus
GTWNSSEVPTY

SEQ ID NO: 57828 - protein, 11 aa, BK Virus
ESMELMDLLGL

SEQ ID NO: 57829 - protein, 11 aa, BK Virus
FLICKGVNKEY

SEQ ID NO: 57830 - protein, 11 aa, BK Virus
LLLGMYLEFQY

SEQ ID NO: 57831 - protein, 11 aa, BK Virus
YTTKEKAQILY

SEQ ID NO: 57832 - protein, 11 aa, BK Virus
VFLLLGMYLEF

SEQ ID NO: 57833 - protein, 11 aa, BK Virus
QILYKKLMEKY

SEQ ID NO: 57834 - protein, 11 aa, BK Virus
VIFDFLHCVVF

SEQ ID NO: 57835 - protein, 11 aa, BK Virus
KMKRMNTLYKK

SEQ ID NO: 57836 - protein, 11 aa, BK Virus
LMRKAYLKKCK

SEQ ID NO: 57837 - protein, 11 aa, BK Virus
TTKEKAQILYK

SEQ ID NO: 57838 - protein, 11 aa, BK Virus
KVNLEKKHLNK

SEQ ID NO: 57839 - protein, 11 aa, BK Virus
CFKRPKTPPPK

SEQ ID NO: 57840 - protein, 11 aa, BK Virus
FLHCVVFNVPK

SEQ ID NO: 57841 - protein, 11 aa, BK Virus
SLRDYLDGSVK

SEQ ID NO: 57842 - protein, 11 aa, BK Virus
ACFAVYTTKEK

SEQ ID NO: 57843 - protein, 11 aa, BK Virus
NVPKRRYWLFK

SEQ ID NO: 57844 - protein, 11 aa, BK Virus
RFVRQIDFRPK

SEQ ID NO: 57845 - protein, 11 aa, BK Virus
KLCTFSFLICK

SEQ ID NO: 57846 - protein, 11 aa, BK Virus
KKRVDTLHMTR

SEQ ID NO: 57847 - protein, 11 aa, BK Virus
RVSAINNFCQK

SEQ ID NO: 57848 - protein, 11 aa, BK Virus
LVTMNEYPVPK

SEQ ID NO: 57849 - protein, 11 aa, BK Virus
CQKKDQPYHFK

SEQ ID NO: 57850 - protein, 11 aa, BK Virus
TADSQHSTPPK

SEQ ID NO: 57851 - protein, 11 aa, BK Virus
KLITEYAVETK

SEQ ID NO: 57852 - protein, 11 aa, BK Virus
TLACFAVYTTK

SEQ ID NO: 57853 - protein, 11 aa, BK Virus
SLQNSEFLLEK

SEQ ID NO: 57854 - protein, 11 aa, BK Virus
AQILYKKLMEK

SEQ ID NO: 57855 - protein, 11 aa, BK Virus
QARFVRQIDFR

SEQ ID NO: 57856 - protein, 11 aa, BK Virus
IWFRPVADFSK

SEQ ID NO: 57857 - protein, 11 aa, BK Virus
MTLLLLLIWFR

SEQ ID NO: 57858 - protein, 11 aa, BK Virus
LKKCKEFHPDK

SEQ ID NO: 57859 - protein, 11 aa, BK Virus
KQVSWKLITEY

SEQ ID NO: 57860 - protein, 11 aa, BK Virus
QILYKKLMEKY

SEQ ID NO: 57861 - protein, 11 aa, BK Virus
MTLLLLLIWFR

SEQ ID NO: 57862 - protein, 11 aa, BK Virus
KMKRMNTLYKK

SEQ ID NO: 57863 - protein, 11 aa, BK Virus
KALNVNLPMER

SEQ ID NO: 57864 - protein, 11 aa, BK Virus
QFLSQAVFSNR

SEQ ID NO: 57865 - protein, 11 aa, BK Virus
IIFFLTPHRHR

SEQ ID NO: 57866 - protein, 11 aa, BK Virus
HLCKGFQCFKR

SEQ ID NO: 57867 - protein, 11 aa, BK Virus
QARFVRQIDFR

SEQ ID NO: 57868 - protein, 11 aa, BK Virus
HMTREEMLTER

SEQ ID NO: 57869 - protein, 11 aa, BK Virus
RVSAINNFCQK

SEQ ID NO: 57870 - protein, 11 aa, BK Virus
LQNSEFLLEKR

SEQ ID NO: 57871 - protein, 11 aa, BK Virus
RFVRQIDFRPK

SEQ ID NO: 57872 - protein, 11 aa, BK Virus
RAAWGNLPLMR

SEQ ID NO: 57873 - protein, 11 aa, BK Virus
SQHSTPPKKKR

SEQ ID NO: 57874 - protein, 11 aa, BK Virus
CMGKCILDITR

SEQ ID NO: 57875 - protein, 11 aa, BK Virus
MEKYSVTFISR

SEQ ID NO: 57876 - protein, 11 aa, BK Virus
KLCTFSFLICK

SEQ ID NO: 57877 - protein, 11 aa, BK Virus
TTKEKAQILYK

SEQ ID NO: 57878 - protein, 11 aa, BK Virus
CFKRPKTPPPK

SEQ ID NO: 57879 - protein, 11 aa, BK Virus
VPKTLQARFVR

SEQ ID NO: 57880 - protein, 11 aa, BK Virus
HNIIFFLTPHR

SEQ ID NO: 57881 - protein, 11 aa, BK Virus
KVNLEKKHLNK

SEQ ID NO: 57882 - protein, 11 aa, BK Virus
CQKKDQPYHFK

SEQ ID NO: 57883 - protein, 11 aa, BK Virus
LVTMNEYPVPK

SEQ ID NO: 57884 - protein, 11 aa, BK Virus
KEYLLYSALTR

SEQ ID NO: 57885 - protein, 11 aa, BK Virus
IQSRIVEWKER

SEQ ID NO: 57886 - protein, 11 aa, BK Virus
KAYLKKCKEFH

SEQ ID NO: 57887 - protein, 11 aa, BK Virus
QIDFRPKIYLR

SEQ ID NO: 57888 - protein, 11 aa, BK Virus
KMDSVIFDFLH

SEQ ID NO: 57889 - protein, 11 aa, BK Virus
DSEISMYTFSR

SEQ ID NO: 57890 - protein, 11 aa, BK Virus
LMRKAYLKKCK

SEQ ID NO: 57891 - protein, 11 aa, BK Virus
MTLLLLLIWFR

SEQ ID NO: 57892 - protein, 11 aa, BK Virus
IIFFLTPHRHR

SEQ ID NO: 57893 - protein, 11 aa, BK Virus
DSEISMYTFSR

SEQ ID NO: 57894 - protein, 11 aa, BK Virus
QARFVRQIDFR

SEQ ID NO: 57895 - protein, 11 aa, BK Virus
QFLSQAVFSNR

SEQ ID NO: 57896 - protein, 11 aa, BK Virus
HMTREEMLTER

SEQ ID NO: 57897 - protein, 11 aa, BK Virus
HLCKGFQCFKR

SEQ ID NO: 57898 - protein, 11 aa, BK Virus
EYPVPKTLQAR

SEQ ID NO: 57899 - protein, 11 aa, BK Virus
QIDFRPKIYLR

SEQ ID NO: 57900 - protein, 11 aa, BK Virus
DVFLLLGMYLE

SEQ ID NO: 57901 - protein, 11 aa, BK Virus
NVPKRRYWLFK

SEQ ID NO: 57902 - protein, 11 aa, BK Virus
MEKYSVTFISR

SEQ ID NO: 57903 - protein, 11 aa, BK Virus
MTLLLLLIWFR

SEQ ID NO: 57904 - protein, 11 aa, BK Virus
EISMYTFSRMK

SEQ ID NO: 57905 - protein, 11 aa, BK Virus
FANAIIFAESK

SEQ ID NO: 57906 - protein, 11 aa, BK Virus
DSEISMYTFSR

SEQ ID NO: 57907 - protein, 11 aa, BK Virus
IIFFLTPHRHR

SEQ ID NO: 57908 - protein, 11 aa, BK Virus
TLACFAVYTTK

SEQ ID NO: 57909 - protein, 11 aa, BK Virus
RVSAINNFCQK

SEQ ID NO: 57910 - protein, 11 aa, BK Virus
QARFVRQIDFR

SEQ ID NO: 57911 - protein, 11 aa, BK Virus
FSFLICKGVNK

SEQ ID NO: 57912 - protein, 11 aa, BK Virus
HNIIFFLTPHR

SEQ ID NO: 57913 - protein, 11 aa, BK Virus
HLCKGFQCFKR

SEQ ID NO: 57914 - protein, 11 aa, BK Virus
TTKEKAQILYK

SEQ ID NO: 57915 - protein, 11 aa, BK Virus
HMTREEMLTER

SEQ ID NO: 57916 - protein, 11 aa, BK Virus
LVTMNEYPVPK

SEQ ID NO: 57917 - protein, 11 aa, BK Virus
NVPKRRYWLFK

SEQ ID NO: 57918 - protein, 11 aa, BK Virus
QAVDTVLAKKR

SEQ ID NO: 57919 - protein, 11 aa, BK Virus
FLHCVVFNVPK

SEQ ID NO: 57920 - protein, 11 aa, BK Virus
RAAWGNLPLMR

SEQ ID NO: 57921 - protein, 11 aa, BK Virus
AIIFAESKNQK

SEQ ID NO: 57922 - protein, 11 aa, BK Virus
TLYKKMEQDVK

SEQ ID NO: 57923 - protein, 11 aa, BK Virus
YTTKEKAQILY

SEQ ID NO: 57924 - protein, 11 aa, BK Virus
DQYMVVFEDVK

SEQ ID NO: 57925 - protein, 11 aa, BK Virus
GVAWLHCLLPK

SEQ ID NO: 57926 - protein, 11 aa, BK Virus
ISMYTFSRMKY

SEQ ID NO: 57927 - protein, 11 aa, BK Virus
EFQYNVEECKK

SEQ ID NO: 57928 - protein, 11 aa, BK Virus
NLPLMRKAYLK

SEQ ID NO: 57929 - protein, 11 aa, BK Virus
KALNVNLPMER

SEQ ID NO: 57930 - protein, 11 aa, BK Virus
QIDFRPKIYLR

SEQ ID NO: 57931 - protein, 11 aa, BK Virus
LTERFNHILDK

SEQ ID NO: 57932 - protein, 11 aa, BK Virus
MEKYSVTFISR

SEQ ID NO: 57933 - protein, 11 aa, BK Virus
QFLSQAVFSNR

SEQ ID NO: 57934 - protein, 11 aa, BK Virus
WLFKGPIDSGK

SEQ ID NO: 57935 - protein, 11 aa, BK Virus
TADSQHSTPPK

SEQ ID NO: 57936 - protein, 11 aa, BK Virus
SLQNSEFLLEK

SEQ ID NO: 57937 - protein, 11 aa, BK Virus
MCAGHNIIFFL

SEQ ID NO: 57938 - protein, 11 aa, BK Virus
CTFSFLICKGV

SEQ ID NO: 57939 - protein, 11 aa, BK Virus
SVIFDFLHCVV

SEQ ID NO: 57940 - protein, 11 aa, BK Virus
NAVLEQYMAGV

SEQ ID NO: 57941 - protein, 11 aa, BK Virus
DSVIFDFLHCV

SEQ ID NO: 57942 - protein, 11 aa, BK Virus
ESMELMDLLGL

SEQ ID NO: 57943 - protein, 11 aa, BK Virus
FSNRTLACFAV

SEQ ID NO: 57944 - protein, 11 aa, BK Virus
LGMYLEFQYNV

SEQ ID NO: 57945 - protein, 11 aa, BK Virus
LGVAIDQYMVV

SEQ ID NO: 57946 - protein, 11 aa, BK Virus
QVSWKLITEYA

SEQ ID NO: 57947 - protein, 11 aa, BK Virus
ETKCEDVFLLL

SEQ ID NO: 57948 - protein, 11 aa, BK Virus
ELMDLLGLERA

SEQ ID NO: 57949 - protein, 11 aa, BK Virus
YSALTRDPYHI

SEQ ID NO: 57950 - protein, 11 aa, BK Virus
YMAGVAWLHCL

SEQ ID NO: 57951 - protein, 11 aa, BK Virus
HIIEESIQGGL

SEQ ID NO: 57952 - protein, 11 aa, BK Virus
SVTFISRHMCA

SEQ ID NO: 57953 - protein, 11 aa, BK Virus
FDFLHCVVFNV

SEQ ID NO: 57954 - protein, 11 aa, BK Virus
DLIFGAHGNAV

SEQ ID NO: 57955 - protein, 11 aa, BK Virus
FVRQIDFRPKI

SEQ ID NO: 57956 - protein, 11 aa, BK Virus
FCQKLCTFSFL

SEQ ID NO: 57957 - protein, 11 aa, BK Virus
ELGVAIDQYMV

SEQ ID NO: 57958 - protein, 11 aa, BK Virus
YMAGVAWLHCL

SEQ ID NO: 57959 - protein, 11 aa, BK Virus
ELGVAIDQYMV

SEQ ID NO: 57960 - protein, 11 aa, BK Virus
DLIFGAHGNAV

SEQ ID NO: 57961 - protein, 11 aa, BK Virus
ESMELMDLLGL

SEQ ID NO: 57962 - protein, 11 aa, BK Virus
FSNRTLACFAV

SEQ ID NO: 57963 - protein, 11 aa, BK Virus
ELMDLLGLERA

SEQ ID NO: 57964 - protein, 11 aa, BK Virus
LLLLLIWFRPV

SEQ ID NO: 57965 - protein, 11 aa, BK Virus
SVIFDFLHCVV

SEQ ID NO: 57966 - protein, 11 aa, BK Virus
EMLTERFNHIL

SEQ ID NO: 57967 - protein, 11 aa, BK Virus
MCAGHNIIFFL

SEQ ID NO: 57968 - protein, 11 aa, BK Virus
HIIEESIQGGL

SEQ ID NO: 57969 - protein, 11 aa, BK Virus
NAVLEQYMAGV

SEQ ID NO: 57970 - protein, 11 aa, BK Virus
CTFSFLICKGV

SEQ ID NO: 57971 - protein, 11 aa, BK Virus
VSWKLITEYAV

SEQ ID NO: 57972 - protein, 11 aa, BK Virus
NTLYKKMEQDV

SEQ ID NO: 57973 - protein, 11 aa, BK Virus
YPVPKTLQARF

SEQ ID NO: 57974 - protein, 11 aa, BK Virus
YLRKSLQNSEF

SEQ ID NO: 57975 - protein, 11 aa, BK Virus
KQVSWKLITEY

SEQ ID NO: 57976 - protein, 11 aa, BK Virus
LQARFVRQIDF

SEQ ID NO: 57977 - protein, 11 aa, BK Virus
YLRKSLQNSEF

SEQ ID NO: 57978 - protein, 11 aa, BK Virus
HMCAGHNIIFF

SEQ ID NO: 57979 - protein, 11 aa, BK Virus
YMAGVAWLHCL

SEQ ID NO: 57980 - protein, 11 aa, BK Virus
FLICKGVNKEY

SEQ ID NO: 57981 - protein, 11 aa, BK Virus
RQIDFRPKIYL

SEQ ID NO: 57982 - protein, 11 aa, BK Virus
LLIWFRPVADF

SEQ ID NO: 57983 - protein, 11 aa, BK Virus
TQIFPPGLVTM

SEQ ID NO: 57984 - protein, 11 aa, BK Virus
LLYSALTRDPY

SEQ ID NO: 57985 - protein, 11 aa, BK Virus
VIFDFLHCVVF

SEQ ID NO: 57986 - protein, 11 aa, BK Virus
ISMYTFSRMKY

SEQ ID NO: 57987 - protein, 11 aa, BK Virus
AVFSNRTLACF

SEQ ID NO: 57988 - protein, 11 aa, BK Virus
LQSGMTLLLLL

SEQ ID NO: 57989 - protein, 11 aa, BK Virus
HSQELHLCKGF

SEQ ID NO: 57990 - protein, 11 aa, BK Virus
TEEWESWWSSF

SEQ ID NO: 57991 - protein, 11 aa, BK Virus
FELGVAIDQYM

SEQ ID NO: 57992 - protein, 11 aa, BK Virus
HEKHFANAIIF

SEQ ID NO: 57993 - protein, 11 aa, BK Virus
LERAAWGNLPL

SEQ ID NO: 57994 - protein, 11 aa, BK Virus
SEVPTYGTEEW

SEQ ID NO: 57995 - protein, 11 aa, BK Virus
KERLDSEISMY

SEQ ID NO: 57996 - protein, 11 aa, BK Virus
SENPHSQELHL

SEQ ID NO: 57997 - protein, 11 aa, BK Virus
YPVPKTLQARF

SEQ ID NO: 57998 - protein, 11 aa, BK Virus
SRMKYNICMGK

SEQ ID NO: 57999 - protein, 11 aa, BK Virus
KRILQSGMTLL

SEQ ID NO: 58000 - protein, 11 aa, BK Virus
RQIDFRPKIYL

SEQ ID NO: 58001 - protein, 11 aa, BK Virus
FRPKIYLRKSL

SEQ ID NO: 58002 - protein, 11 aa, BK Virus
FPPGLVTMNEY

SEQ ID NO: 58003 - protein, 11 aa, BK Virus
YPVPKTLQARF

SEQ ID NO: 58004 - protein, 11 aa, BK Virus
YAVETKCEDVF

SEQ ID NO: 58005 - protein, 11 aa, BK Virus
LPKMDSVIFDF

SEQ ID NO: 58006 - protein, 11 aa, BK Virus
HPDKGGDEDKM

SEQ ID NO: 58007 - protein, 11 aa, BK Virus
VAWLHCLLPKM

SEQ ID NO: 58008 - protein, 11 aa, BK Virus
FPSDLHQFLSQ

SEQ ID NO: 58009 - protein, 11 aa, BK Virus
LLYSALTRDPY

SEQ ID NO: 58010 - protein, 11 aa, BK Virus
TFELGVAIDQY

SEQ ID NO: 58011 - protein, 11 aa, BK Virus
YHEKHFANAII

SEQ ID NO: 58012 - protein, 11 aa, BK Virus
YMAGVAWLHCL

SEQ ID NO: 58013 - protein, 11 aa, BK Virus
REESMELMDLL

SEQ ID NO: 58014 - protein, 11 aa, BK Virus
SENPHSQELHL

SEQ ID NO: 58015 - protein, 11 aa, BK Virus
LERAAWGNLPL

SEQ ID NO: 58016 - protein, 11 aa, BK Virus
LEQYMAGVAWL

SEQ ID NO: 58017 - protein, 11 aa, BK Virus
FELGVAIDQYM

SEQ ID NO: 58018 - protein, 11 aa, BK Virus
VETKCEDVFLL

SEQ ID NO: 58019 - protein, 11 aa, BK Virus
SEISMYTFSRM

SEQ ID NO: 58020 - protein, 11 aa, BK Virus
VEDPKDFPSDL

SEQ ID NO: 58021 - protein, 11 aa, BK Virus
KEKAQILYKKL

SEQ ID NO: 58022 - protein, 11 aa, BK Virus
DEDKMKRMNTL

SEQ ID NO: 58023 - protein, 11 aa, BK Virus
SENPHSQELHL

SEQ ID NO: 58024 - protein, 11 aa, BK Virus
REESMELMDLL

SEQ ID NO: 58025 - protein, 11 aa, BK Virus
EETKQVSWKLI

SEQ ID NO: 58026 - protein, 11 aa, BK Virus
HEKHFANAIIF

SEQ ID NO: 58027 - protein, 11 aa, BK Virus
EEMLTERFNHI

SEQ ID NO: 58028 - protein, 11 aa, BK Virus
VETKCEDVFLL

SEQ ID NO: 58029 - protein, 11 aa, BK Virus
SEVPTYGTEEW

SEQ ID NO: 58030 - protein, 11 aa, BK Virus
EEPEETKQVSW

SEQ ID NO: 58031 - protein, 11 aa, BK Virus
SEFLLEKRILQ

SEQ ID NO: 58032 - protein, 11 aa, BK Virus
SENPHSQELHL

SEQ ID NO: 58033 - protein, 11 aa, BK Virus
SEISMYTFSRM

SEQ ID NO: 58034 - protein, 11 aa, BK Virus
SEVPTYGTEEW

SEQ ID NO: 58035 - protein, 11 aa, BK Virus
EEPEETKQVSW

SEQ ID NO: 58036 - protein, 11 aa, BK Virus
EEMLTERFNHI

SEQ ID NO: 58037 - protein, 11 aa, BK Virus
EEATADSQHST

SEQ ID NO: 58038 - protein, 11 aa, BK Virus
LPMERLTFELG

SEQ ID NO: 58039 - protein, 11 aa, BK Virus
YPVPKTLQARF

SEQ ID NO: 58040 - protein, 11 aa, BK Virus
FPPGLVTMNEY

SEQ ID NO: 58041 - protein, 11 aa, BK Virus
YPVPKTLQARF

SEQ ID NO: 58042 - protein, 11 aa, BK Virus
LPKMDSVIFDF

SEQ ID NO: 58043 - protein, 11 aa, BK Virus
YAVETKCEDVF

SEQ ID NO: 58044 - protein, 11 aa, BK Virus
LPMERLTFELG

SEQ ID NO: 58045 - protein, 11 aa, BK Virus
FPPGLVTMNEY

SEQ ID NO: 58046 - protein, 11 aa, BK Virus
GPIDSGKTTLA

SEQ ID NO: 58047 - protein, 11 aa, BK Virus
PTYGTEEWESW

SEQ ID NO: 58048 - protein, 11 aa, BK Virus
ESWWSSFNEKW

SEQ ID NO: 58049 - protein, 11 aa, BK Virus
KVAHQPDFGTW

SEQ ID NO: 58050 - protein, 11 aa, BK Virus
SGMTLLLLLIW

SEQ ID NO: 58051 - protein, 11 aa, BK Virus
VVFNVPKRRYW

SEQ ID NO: 58052 - protein, 11 aa, BK Virus
YAVETKCEDVF

SEQ ID NO: 58053 - protein, 11 aa, BK Virus
ISMYTFSRMKY

SEQ ID NO: 58054 - protein, 11 aa, BK Virus
PTYGTEEWESW

SEQ ID NO: 58055 - protein, 8 aa, BK Virus
FIFILELL

SEQ ID NO: 58056 - protein, 8 aa, BK Virus
STTALPAV

SEQ ID NO: 58057 - protein, 8 aa, BK Virus
FIFILELL

SEQ ID NO: 58058 - protein, 8 aa, BK Virus
QLSRQASV

SEQ ID NO: 58059 - protein, 8 aa, BK Virus
QLSRQASV

SEQ ID NO: 58060 - protein, 8 aa, BK Virus
STTALPAV

SEQ ID NO: 58061 - protein, 8 aa, BK Virus
FIFILELL

SEQ ID NO: 58062 - protein, 8 aa, BK Virus
AQRIFIFI

SEQ ID NO: 58063 - protein, 8 aa, BK Virus
NLVVLRQL

SEQ ID NO: 58064 - protein, 8 aa, BK Virus
QLSRQASV

SEQ ID NO: 58065 - protein, 8 aa, BK Virus
STTALPAV

SEQ ID NO: 58066 - protein, 8 aa, BK Virus
AQRIFIFI

SEQ ID NO: 58067 - protein, 8 aa, BK Virus
FIFILELL

SEQ ID NO: 58068 - protein, 8 aa, BK Virus
STTALPAV

SEQ ID NO: 58069 - protein, 8 aa, BK Virus
QLSRQASV

SEQ ID NO: 58070 - protein, 8 aa, BK Virus
FILELLLE

SEQ ID NO: 58071 - protein, 8 aa, BK Virus
QLSRQASV

SEQ ID NO: 58072 - protein, 8 aa, BK Virus
FIFILELL

SEQ ID NO: 58073 - protein, 8 aa, BK Virus
STTALPAV

SEQ ID NO: 58074 - protein, 8 aa, BK Virus
NLVVLRQL

SEQ ID NO: 58075 - protein, 8 aa, BK Virus
QLSRQASV

SEQ ID NO: 58076 - protein, 8 aa, BK Virus
FIFILELL

SEQ ID NO: 58077 - protein, 8 aa, BK Virus
STTALPAV

SEQ ID NO: 58078 - protein, 8 aa, BK Virus
FCRGEDSV

SEQ ID NO: 58079 - protein, 8 aa, BK Virus
QLSRQASV

SEQ ID NO: 58080 - protein, 8 aa, BK Virus
FIFILELL

SEQ ID NO: 58081 - protein, 8 aa, BK Virus
NLVVLRQL

SEQ ID NO: 58082 - protein, 8 aa, BK Virus
STTALPAV

SEQ ID NO: 58083 - protein, 8 aa, BK Virus
FCEPKNLV

SEQ ID NO: 58084 - protein, 8 aa, BK Virus
QLSRQASV

SEQ ID NO: 58085 - protein, 8 aa, BK Virus
STTALPAV

SEQ ID NO: 58086 - protein, 8 aa, BK Virus
KTWTGTKK

SEQ ID NO: 58087 - protein, 8 aa, BK Virus
TTALPAVK

SEQ ID NO: 58088 - protein, 8 aa, BK Virus
VVLRQLSR

SEQ ID NO: 58089 - protein, 8 aa, BK Virus
LSRQASVK

SEQ ID NO: 58090 - protein, 8 aa, BK Virus
TTALPAVK

SEQ ID NO: 58091 - protein, 8 aa, BK Virus
KTWTGTKK

SEQ ID NO: 58092 - protein, 8 aa, BK Virus
VVLRQLSR

SEQ ID NO: 58093 - protein, 8 aa, BK Virus
QASVKVGK

SEQ ID NO: 58094 - protein, 8 aa, BK Virus
IFIFILEL

SEQ ID NO: 58095 - protein, 8 aa, BK Virus
RAQRIFIF

SEQ ID NO: 58096 - protein, 8 aa, BK Virus
IFILELLL

SEQ ID NO: 58097 - protein, 8 aa, BK Virus
IFILELLL

SEQ ID NO: 58098 - protein, 8 aa, BK Virus
IFIFILEL

SEQ ID NO: 58099 - protein, 8 aa, BK Virus
RAQRIFIF

SEQ ID NO: 58100 - protein, 8 aa, BK Virus
RAQRIFIF

SEQ ID NO: 58101 - protein, 8 aa, BK Virus
LSRQASVK

SEQ ID NO: 58102 - protein, 8 aa, BK Virus
KTWTGTKK

SEQ ID NO: 58103 - protein, 8 aa, BK Virus
GTKKRAQR

SEQ ID NO: 58104 - protein, 8 aa, BK Virus
KTWTGTKK

SEQ ID NO: 58105 - protein, 8 aa, BK Virus
VVLRQLSR

SEQ ID NO: 58106 - protein, 8 aa, BK Virus
ELLLEFCR

SEQ ID NO: 58107 - protein, 8 aa, BK Virus
GTKKRAQR

SEQ ID NO: 58108 - protein, 8 aa, BK Virus
VVLRQLSR

SEQ ID NO: 58109 - protein, 8 aa, BK Virus
TTALPAVK

SEQ ID NO: 58110 - protein, 8 aa, BK Virus
ELLLEFCR

SEQ ID NO: 58111 - protein, 8 aa, BK Virus
GTKKRAQR

SEQ ID NO: 58112 - protein, 8 aa, BK Virus
QASVKVGK

SEQ ID NO: 58113 - protein, 8 aa, BK Virus
DSVDGKNK

SEQ ID NO: 58114 - protein, 8 aa, BK Virus
STTALPAV

SEQ ID NO: 58115 - protein, 8 aa, BK Virus
QRIFIFIL

SEQ ID NO: 58116 - protein, 8 aa, BK Virus
FIFILELL

SEQ ID NO: 58117 - protein, 8 aa, BK Virus
STTALPAV

SEQ ID NO: 58118 - protein, 8 aa, BK Virus
FIFILELL

SEQ ID NO: 58119 - protein, 8 aa, BK Virus
LPAVKDSV

SEQ ID NO: 58120 - protein, 8 aa, BK Virus
EPKNLVVL

SEQ ID NO: 58121 - protein, 8 aa, BK Virus
QRIFIFIL

SEQ ID NO: 58122 - protein, 8 aa, BK Virus
EPKNLVVL

SEQ ID NO: 58123 - protein, 8 aa, BK Virus
LPAVKDSV

SEQ ID NO: 58124 - protein, 8 aa, BK Virus
EPKNLVVL

SEQ ID NO: 58125 - protein, 8 aa, BK Virus
LPAVKDSV

SEQ ID NO: 58126 - protein, 8 aa, BK Virus
RAQRIFIF

SEQ ID NO: 58127 - protein, 9 aa, BK Virus
RIFIFILEL

SEQ ID NO: 58128 - protein, 9 aa, BK Virus
FIFILELLL

SEQ ID NO: 58129 - protein, 9 aa, BK Virus
RQLSRQASV

SEQ ID NO: 58130 - protein, 9 aa, BK Virus
ALPAVKDSV

SEQ ID NO: 58131 - protein, 9 aa, BK Virus
FILELLLEF

SEQ ID NO: 58132 - protein, 9 aa, BK Virus
FIFILELLL

SEQ ID NO: 58133 - protein, 9 aa, BK Virus
ALPAVKDSV

SEQ ID NO: 58134 - protein, 9 aa, BK Virus
RIFIFILEL

SEQ ID NO: 58135 - protein, 9 aa, BK Virus
RQLSRQASV

SEQ ID NO: 58136 - protein, 9 aa, BK Virus
ALPAVKDSV

SEQ ID NO: 58137 - protein, 9 aa, BK Virus
VLRQLSRQA

SEQ ID NO: 58138 - protein, 9 aa, BK Virus
RIFIFILEL

SEQ ID NO: 58139 - protein, 9 aa, BK Virus
ALPAVKDSV

SEQ ID NO: 58140 - protein, 9 aa, BK Virus
RQLSRQASV

SEQ ID NO: 58141 - protein, 9 aa, BK Virus
FILELLLEF

SEQ ID NO: 58142 - protein, 9 aa, BK Virus
ALPAVKDSV

SEQ ID NO: 58143 - protein, 9 aa, BK Virus
AQRIFIFIL

SEQ ID NO: 58144 - protein, 9 aa, BK Virus
KSTTALPAV

SEQ ID NO: 58145 - protein, 9 aa, BK Virus
RIFIFILEL

SEQ ID NO: 58146 - protein, 9 aa, BK Virus
RAQRIFIFI

SEQ ID NO: 58147 - protein, 9 aa, BK Virus
FIFILELLL

SEQ ID NO: 58148 - protein, 9 aa, BK Virus
ALPAVKDSV

SEQ ID NO: 58149 - protein, 9 aa, BK Virus
RIFIFILEL

SEQ ID NO: 58150 - protein, 9 aa, BK Virus
FIFILELLL

SEQ ID NO: 58151 - protein, 9 aa, BK Virus
FILELLLEF

SEQ ID NO: 58152 - protein, 9 aa, BK Virus
VLRQLSRQA

SEQ ID NO: 58153 - protein, 9 aa, BK Virus
RQLSRQASV

SEQ ID NO: 58154 - protein, 9 aa, BK Virus
ALPAVKDSV

SEQ ID NO: 58155 - protein, 9 aa, BK Virus
FIFILELLL

SEQ ID NO: 58156 - protein, 9 aa, BK Virus
RIFIFILEL

SEQ ID NO: 58157 - protein, 9 aa, BK Virus
FILELLLEF

SEQ ID NO: 58158 - protein, 9 aa, BK Virus
RQLSRQASV

SEQ ID NO: 58159 - protein, 9 aa, BK Virus
FCEPKNLVV

SEQ ID NO: 58160 - protein, 9 aa, BK Virus
LLLEFCRGE

SEQ ID NO: 58161 - protein, 9 aa, BK Virus
VLRQLSRQA

SEQ ID NO: 58162 - protein, 9 aa, BK Virus
ALPAVKDSV

SEQ ID NO: 58163 - protein, 9 aa, BK Virus
RIFIFILEL

SEQ ID NO: 58164 - protein, 9 aa, BK Virus
FIFILELLL

SEQ ID NO: 58165 - protein, 9 aa, BK Virus
RQLSRQASV

SEQ ID NO: 58166 - protein, 9 aa, BK Virus
ALPAVKDSV

SEQ ID NO: 58167 - protein, 9 aa, BK Virus
QLSRQASVK

SEQ ID NO: 58168 - protein, 9 aa, BK Virus
RQASVKVGK

SEQ ID NO: 58169 - protein, 9 aa, BK Virus
STTALPAVK

SEQ ID NO: 58170 - protein, 9 aa, BK Virus
STTALPAVK

SEQ ID NO: 58171 - protein, 9 aa, BK Virus
RQASVKVGK

SEQ ID NO: 58172 - protein, 9 aa, BK Virus
LVVLRQLSR

SEQ ID NO: 58173 - protein, 9 aa, BK Virus
IFIFILELL

SEQ ID NO: 58174 - protein, 9 aa, BK Virus
FILELLLEF

SEQ ID NO: 58175 - protein, 9 aa, BK Virus
IFIFILELL

SEQ ID NO: 58176 - protein, 9 aa, BK Virus
FILELLLEF

SEQ ID NO: 58177 - protein, 9 aa, BK Virus
FILELLLEF

SEQ ID NO: 58178 - protein, 9 aa, BK Virus
FILELLLEF

SEQ ID NO: 58179 - protein, 9 aa, BK Virus
VGKTWTGTK

SEQ ID NO: 58180 - protein, 9 aa, BK Virus
STTALPAVK

SEQ ID NO: 58181 - protein, 9 aa, BK Virus
KKRAQRIFI

SEQ ID NO: 58182 - protein, 9 aa, BK Virus
KTWTGTKKR

SEQ ID NO: 58183 - protein, 9 aa, BK Virus
RQASVKVGK

SEQ ID NO: 58184 - protein, 9 aa, BK Virus
TGTKKRAQR

SEQ ID NO: 58185 - protein, 9 aa, BK Virus
LVVLRQLSR

SEQ ID NO: 58186 - protein, 9 aa, BK Virus
STTALPAVK

SEQ ID NO: 58187 - protein, 9 aa, BK Virus
LVVLRQLSR

SEQ ID NO: 58188 - protein, 9 aa, BK Virus
EPKNLVVLR

SEQ ID NO: 58189 - protein, 9 aa, BK Virus
STTALPAVK

SEQ ID NO: 58190 - protein, 9 aa, BK Virus
EPKNLVVLR

SEQ ID NO: 58191 - protein, 9 aa, BK Virus
LVVLRQLSR

SEQ ID NO: 58192 - protein, 9 aa, BK Virus
RAQRIFIFI

SEQ ID NO: 58193 - protein, 9 aa, BK Virus
FILELLLEF

SEQ ID NO: 58194 - protein, 9 aa, BK Virus
RQASVKVGK

SEQ ID NO: 58195 - protein, 9 aa, BK Virus
KRAQRIFIF

SEQ ID NO: 58196 - protein, 9 aa, BK Virus
RQLSRQASV

SEQ ID NO: 58197 - protein, 9 aa, BK Virus
FILELLLEF

SEQ ID NO: 58198 - protein, 9 aa, BK Virus
CEPKNLVVL

SEQ ID NO: 58199 - protein, 9 aa, BK Virus
ASVKVGKTW

SEQ ID NO: 58200 - protein, 9 aa, BK Virus
ASVKVGKTW

SEQ ID NO: 58201 - protein, 10 aa, BK Virus
RIFIFILELL

SEQ ID NO: 58202 - protein, 10 aa, BK Virus
FILELLLEFC

SEQ ID NO: 58203 - protein, 10 aa, BK Virus
RIFIFILELL

SEQ ID NO: 58204 - protein, 10 aa, BK Virus
FILELLLEFC

SEQ ID NO: 58205 - protein, 10 aa, BK Virus
QLSRQASVKV

SEQ ID NO: 58206 - protein, 10 aa, BK Virus
QLSRQASVKV

SEQ ID NO: 58207 - protein, 10 aa, BK Virus
RIFIFILELL

SEQ ID NO: 58208 - protein, 10 aa, BK Virus
QLSRQASVKV

SEQ ID NO: 58209 - protein, 10 aa, BK Virus
FILELLLEFC

SEQ ID NO: 58210 - protein, 10 aa, BK Virus
RIFIFILELL

SEQ ID NO: 58211 - protein, 10 aa, BK Virus
TALPAVKDSV

SEQ ID NO: 58212 - protein, 10 aa, BK Virus
QLSRQASVKV

SEQ ID NO: 58213 - protein, 10 aa, BK Virus
RIFIFILELL

SEQ ID NO: 58214 - protein, 10 aa, BK Virus
FILELLLEFC

SEQ ID NO: 58215 - protein, 10 aa, BK Virus
TALPAVKDSV

SEQ ID NO: 58216 - protein, 10 aa, BK Virus
QLSRQASVKV

SEQ ID NO: 58217 - protein, 10 aa, BK Virus
FILELLLEFC

SEQ ID NO: 58218 - protein, 10 aa, BK Virus
RIFIFILELL

SEQ ID NO: 58219 - protein, 10 aa, BK Virus
TALPAVKDSV

SEQ ID NO: 58220 - protein, 10 aa, BK Virus
QLSRQASVKV

SEQ ID NO: 58221 - protein, 10 aa, BK Virus
RIFIFILELL

SEQ ID NO: 58222 - protein, 10 aa, BK Virus
TALPAVKDSV

SEQ ID NO: 58223 - protein, 10 aa, BK Virus
QLSRQASVKV

SEQ ID NO: 58224 - protein, 10 aa, BK Virus
TALPAVKDSV

SEQ ID NO: 58225 - protein, 10 aa, BK Virus
RQLSRQASVK

SEQ ID NO: 58226 - protein, 10 aa, BK Virus
KSTTALPAVK

SEQ ID NO: 58227 - protein, 10 aa, BK Virus
KVGKTWTGTK

SEQ ID NO: 58228 - protein, 10 aa, BK Virus
ALPAVKDSVK

SEQ ID NO: 58229 - protein, 10 aa, BK Virus
KSTTALPAVK

SEQ ID NO: 58230 - protein, 10 aa, BK Virus
KVGKTWTGTK

SEQ ID NO: 58231 - protein, 10 aa, BK Virus
RQLSRQASVK

SEQ ID NO: 58232 - protein, 10 aa, BK Virus
ALPAVKDSVK

SEQ ID NO: 58233 - protein, 10 aa, BK Virus
IFILELLLEF

SEQ ID NO: 58234 - protein, 10 aa, BK Virus
IFIFILELLL

SEQ ID NO: 58235 - protein, 10 aa, BK Virus
IFILELLLEF

SEQ ID NO: 58236 - protein, 10 aa, BK Virus
IFIFILELLL

SEQ ID NO: 58237 - protein, 10 aa, BK Virus
IFILELLLEF

SEQ ID NO: 58238 - protein, 10 aa, BK Virus
IFILELLLEF

SEQ ID NO: 58239 - protein, 10 aa, BK Virus
KVGKTWTGTK

SEQ ID NO: 58240 - protein, 10 aa, BK Virus
KSTTALPAVK

SEQ ID NO: 58241 - protein, 10 aa, BK Virus
RQLSRQASVK

SEQ ID NO: 58242 - protein, 10 aa, BK Virus
NLVVLRQLSR

SEQ ID NO: 58243 - protein, 10 aa, BK Virus
ILELLLEFCR

SEQ ID NO: 58244 - protein, 10 aa, BK Virus
WTGTKKRAQR

SEQ ID NO: 58245 - protein, 10 aa, BK Virus
ILELLLEFCR

SEQ ID NO: 58246 - protein, 10 aa, BK Virus
NLVVLRQLSR

SEQ ID NO: 58247 - protein, 10 aa, BK Virus
NLVVLRQLSR

SEQ ID NO: 58248 - protein, 10 aa, BK Virus
ILELLLEFCR

SEQ ID NO: 58249 - protein, 10 aa, BK Virus
WTGTKKRAQR

SEQ ID NO: 58250 - protein, 10 aa, BK Virus
QRIFIFILEL

SEQ ID NO: 58251 - protein, 10 aa, BK Virus
TALPAVKDSV

SEQ ID NO: 58252 - protein, 10 aa, BK Virus
RIFIFILELL

SEQ ID NO: 58253 - protein, 10 aa, BK Virus
TALPAVKDSV

SEQ ID NO: 58254 - protein, 10 aa, BK Virus
RQLSRQASVK

SEQ ID NO: 58255 - protein, 10 aa, BK Virus
SRQASVKVGK

SEQ ID NO: 58256 - protein, 10 aa, BK Virus
QRIFIFILEL

SEQ ID NO: 58257 - protein, 10 aa, BK Virus
QASVKVGKTW

SEQ ID NO: 58258 - protein, 11 aa, BK Virus
RIFIFILELLL

SEQ ID NO: 58259 - protein, 11 aa, BK Virus
RQLSRQASVKV

SEQ ID NO: 58260 - protein, 11 aa, BK Virus
LLEFCRGEDSV

SEQ ID NO: 58261 - protein, 11 aa, BK Virus
RIFIFILELLL

SEQ ID NO: 58262 - protein, 11 aa, BK Virus
VLRQLSRQASV

SEQ ID NO: 58263 - protein, 11 aa, BK Virus
VLRQLSRQASV

SEQ ID NO: 58264 - protein, 11 aa, BK Virus
RQLSRQASVKV

SEQ ID NO: 58265 - protein, 11 aa, BK Virus
LLEFCRGEDSV

SEQ ID NO: 58266 - protein, 11 aa, BK Virus
AQRIFIFILEL

SEQ ID NO: 58267 - protein, 11 aa, BK Virus
VLRQLSRQASV

SEQ ID NO: 58268 - protein, 11 aa, BK Virus
RQLSRQASVKV

SEQ ID NO: 58269 - protein, 11 aa, BK Virus
AQRIFIFILEL

SEQ ID NO: 58270 - protein, 11 aa, BK Virus
VLRQLSRQASV

SEQ ID NO: 58271 - protein, 11 aa, BK Virus
RIFIFILELLL

SEQ ID NO: 58272 - protein, 11 aa, BK Virus
LLEFCRGEDSV

SEQ ID NO: 58273 - protein, 11 aa, BK Virus
SVDGKNKSTTA

SEQ ID NO: 58274 - protein, 11 aa, BK Virus
RQLSRQASVKV

SEQ ID NO: 58275 - protein, 11 aa, BK Virus
FIFILELLLEF

SEQ ID NO: 58276 - protein, 11 aa, BK Virus
VLRQLSRQASV

SEQ ID NO: 58277 - protein, 11 aa, BK Virus
RIFIFILELLL

SEQ ID NO: 58278 - protein, 11 aa, BK Virus
LLEFCRGEDSV

SEQ ID NO: 58279 - protein, 11 aa, BK Virus
FILELLLEFCR

SEQ ID NO: 58280 - protein, 11 aa, BK Virus
RQLSRQASVKV

SEQ ID NO: 58281 - protein, 11 aa, BK Virus
VLRQLSRQASV

SEQ ID NO: 58282 - protein, 11 aa, BK Virus
LLEFCRGEDSV

SEQ ID NO: 58283 - protein, 11 aa, BK Virus
RIFIFILELLL

SEQ ID NO: 58284 - protein, 11 aa, BK Virus
TTALPAVKDSV

SEQ ID NO: 58285 - protein, 11 aa, BK Virus
SVDGKNKSTTA

SEQ ID NO: 58286 - protein, 11 aa, BK Virus
VLRQLSRQASV

SEQ ID NO: 58287 - protein, 11 aa, BK Virus
LLEFCRGEDSV

SEQ ID NO: 58288 - protein, 11 aa, BK Virus
KVGKTWTGTKK

SEQ ID NO: 58289 - protein, 11 aa, BK Virus
KVGKTWTGTKK

SEQ ID NO: 58290 - protein, 11 aa, BK Virus
TALPAVKDSVK

SEQ ID NO: 58291 - protein, 11 aa, BK Virus
FIFILELLLEF

SEQ ID NO: 58292 - protein, 11 aa, BK Virus
FIFILELLLEF

SEQ ID NO: 58293 - protein, 11 aa, BK Virus
LSRQASVKVGK

SEQ ID NO: 58294 - protein, 11 aa, BK Virus
KVGKTWTGTKK

SEQ ID NO: 58295 - protein, 11 aa, BK Virus
KNLVVLRQLSR

SEQ ID NO: 58296 - protein, 11 aa, BK Virus
TWTGTKKRAQR

SEQ ID NO: 58297 - protein, 11 aa, BK Virus
FILELLLEFCR

SEQ ID NO: 58298 - protein, 11 aa, BK Virus
FILELLLEFCR

SEQ ID NO: 58299 - protein, 11 aa, BK Virus
FILELLLEFCR

SEQ ID NO: 58300 - protein, 11 aa, BK Virus
TWTGTKKRAQR

SEQ ID NO: 58301 - protein, 11 aa, BK Virus
TALPAVKDSVK

SEQ ID NO: 58302 - protein, 11 aa, BK Virus
TTALPAVKDSV

SEQ ID NO: 58303 - protein, 11 aa, BK Virus
QRIFIFILELL

SEQ ID NO: 58304 - protein, 11 aa, BK Virus
TTALPAVKDSV

SEQ ID NO: 58305 - protein, 11 aa, BK Virus
AQRIFIFILEL

SEQ ID NO: 58306 - protein, 11 aa, BK Virus
FIFILELLLEF

SEQ ID NO: 58307 - protein, 11 aa, BK Virus
RQASVKVGKTW

SEQ ID NO: 58308 - protein, 11 aa, BK Virus
KRAQRIFIFIL

SEQ ID NO: 58309 - protein, 11 aa, BK Virus
FIFILELLLEF

SEQ ID NO: 58310 - protein, 11 aa, BK Virus
KRAQRIFIFIL

SEQ ID NO: 58311 - protein, 11 aa, BK Virus
RQASVKVGKTW

SEQ ID NO: 58312 - protein, 15 aa, BK virus
AAIEVQIASLATVEG

SEQ ID NO: 58313 - protein, 9 aa, BK virus
VQIASLATV

SEQ ID NO: 58314 - protein, 15 aa, BK virus
AIEVQIASLATVEGI

SEQ ID NO: 58315 - protein, 9 aa, BK virus
IASLATVEG

SEQ ID NO: 58316 - protein, 15 aa, BK virus
IEVQIASLATVEGIT

SEQ ID NO: 58317 - protein, 9 aa, BK virus
IASLATVEG

SEQ ID NO: 58318 - protein, 15 aa, BK virus
EVQIASLATVEGITT

SEQ ID NO: 58319 - protein, 9 aa, BK virus
IASLATVEG

SEQ ID NO: 58320 - protein, 15 aa, BK virus
QDYYSNLSPIRPSMV

SEQ ID NO: 58321 - protein, 9 aa, BK virus
YSNLSPIRP

SEQ ID NO: 58322 - protein, 15 aa, BK virus
VTQRMDLRNKESVHS

SEQ ID NO: 58323 - protein, 9 aa, BK virus
VTQRMDLRN

SEQ ID NO: 58324 - protein, 15 aa, BK virus
TQRMDLRNKESVHSG

SEQ ID NO: 58325 - protein, 9 aa, BK virus
LRNKESVHS

SEQ ID NO: 58326 - protein, 15 aa, BK virus
QRMDLRNKESVHSGE

SEQ ID NO: 58327 - protein, 9 aa, BK virus
LRNKESVHS

SEQ ID NO: 58328 - protein, 15 aa, BK virus
RMDLRNKESVHSGEF

SEQ ID NO: 58329 - protein, 9 aa, BK virus
LRNKESVHS

SEQ ID NO: 58330 - protein, 15 aa, BK virus
MDLRNKESVHSGEFI

SEQ ID NO: 58331 - protein, 9 aa, BK virus
LRNKESVHS

SEQ ID NO: 58332 - protein, 15 aa, BK virus
DYYSNLSPIRPSMVR

SEQ ID NO: 58333 - protein, 9 aa, BK virus
YSNLSPIRP

SEQ ID NO: 58334 - protein, 15 aa, BK virus
AALIQTVTGISSLAQ

SEQ ID NO: 58335 - protein, 9 aa, BK virus
IQTVTGISS

SEQ ID NO: 58336 - protein, 15 aa, BK virus
ALIQTVTGISSLAQV

SEQ ID NO: 58337 - protein, 9 aa, BK virus
VTGISSLAQ

SEQ ID NO: 58338 - protein, 15 aa, BK virus
VQIASLATVEGITTT

SEQ ID NO: 58339 - protein, 9 aa, BK virus
IASLATVEG

SEQ ID NO: 58340 - protein, 15 aa, BK virus
QTYAVIAGAPGAIAG

SEQ ID NO: 58341 - protein, 9 aa, BK virus
IAGAPGAIA

SEQ ID NO: 58342 - protein, 15 aa, BK virus
PQTYAVIAGAPGAIA

SEQ ID NO: 58343 - protein, 9 aa, BK virus
VIAGAPGAI

SEQ ID NO: 58344 - protein, 15 aa, BK virus
TYAVIAGAPGAIAGF

SEQ ID NO: 58345 - protein, 9 aa, BK virus
IAGAPGAIA

SEQ ID NO: 58346 - protein, 15 aa, BK virus
YAVIAGAPGAIAGFA

SEQ ID NO: 58347 - protein, 9 aa, BK virus
IAGAPGAIA

SEQ ID NO: 58348 - protein, 15 aa, BK virus
NYIQDYYSNLSPIRP

SEQ ID NO: 58349 - protein, 9 aa, BK virus
YYSNLSPIR

SEQ ID NO: 58350 - protein, 15 aa, BK virus
YIQDYYSNLSPIRPS

SEQ ID NO: 58351 - protein, 9 aa, BK virus
YSNLSPIRP

SEQ ID NO: 58352 - protein, 15 aa, BK virus
IQDYYSNLSPIRPSM

SEQ ID NO: 58353 - protein, 9 aa, BK virus
YSNLSPIRP

SEQ ID NO: 58354 - protein, 15 aa, BK virus
YSNLSPIRPSMVRQV

SEQ ID NO: 58355 - protein, 9 aa, BK virus
YSNLSPIRP

SEQ ID NO: 58356 - protein, 15 aa, BK virus
LIQTVTGISSLAQVG

SEQ ID NO: 58357 - protein, 9 aa, BK virus
VTGISSLAQ

SEQ ID NO: 58358 - protein, 15 aa, BK virus
AVIAGAPGAIAGFAA

SEQ ID NO: 58359 - protein, 9 aa, BK virus
IAGAPGAIA

SEQ ID NO: 58360 - protein, 15 aa, BK virus
IQTVTGISSLAQVGY

SEQ ID NO: 58361 - protein, 9 aa, BK virus
VTGISSLAQ

SEQ ID NO: 58362 - protein, 15 aa, BK virus
FSVAEIAAGEAAAAI

SEQ ID NO: 58363 - protein, 9 aa, BK virus
IAAGEAAAA

SEQ ID NO: 58364 - protein, 15 aa, BK virus
VAEIAAGEAAAAIEV

SEQ ID NO: 58365 - protein, 9 aa, BK virus
IAAGEAAAA

SEQ ID NO: 58366 - protein, 15 aa, BK virus
AEIAAGEAAAAIEVQ

SEQ ID NO: 58367 - protein, 9 aa, BK virus
IAAGEAAAA

SEQ ID NO: 58368 - protein, 15 aa, BK virus
SVAEIAAGEAAAAIE

SEQ ID NO: 58369 - protein, 9 aa, BK virus
IAAGEAAAA

SEQ ID NO: 58370 - protein, 15 aa, BK virus
AAAAIEVQIASLATV

SEQ ID NO: 58371 - protein, 9 aa, BK virus
EVQIASLAT

SEQ ID NO: 58372 - protein, 15 aa, BK virus
AAAIEVQIASLATVE

SEQ ID NO: 58373 - protein, 9 aa, BK virus
VQIASLATV

SEQ ID NO: 58374 - protein, 15 aa, BK virus
GFSVAEIAAGEAAAA

SEQ ID NO: 58375 - protein, 9 aa, BK virus
VAEIAAGEA

SEQ ID NO: 58376 - protein, 15 aa, BK virus
QWMLPLLLGLYGTVT

SEQ ID NO: 58377 - protein, 9 aa, BK virus
QWMLPLLLG

SEQ ID NO: 58378 - protein, 15 aa, BK virus
MGAALALLGDLVASV

SEQ ID NO: 58379 - protein, 9 aa, BK virus
MGAALALLG

SEQ ID NO: 58380 - protein, 15 aa, BK virus
PLLLGLYGTVTPALE

SEQ ID NO: 58381 - protein, 9 aa, BK virus
LLGLYGTVT

SEQ ID NO: 58382 - protein, 15 aa, BK virus
TAPQWMLPLLLGLYG

SEQ ID NO: 58383 - protein, 9 aa, BK virus
PQWMLPLLL

SEQ ID NO: 58384 - protein, 15 aa, BK virus
LPLLLGLYGTVTPAL

SEQ ID NO: 58385 - protein, 9 aa, BK virus
LLGLYGTVT

SEQ ID NO: 58386 - protein, 15 aa, BK virus
YYSNLSPIRPSMVRQ

SEQ ID NO: 58387 - protein, 9 aa, BK virus
YSNLSPIRP

SEQ ID NO: 58388 - protein, 15 aa, BK virus
WMLPLLLGLYGTVTP

SEQ ID NO: 58389 - protein, 9 aa, BK virus
LLGLYGTVT

SEQ ID NO: 58390 - protein, 15 aa, BK virus
MLPLLLGLYGTVTPA

SEQ ID NO: 58391 - protein, 9 aa, BK virus
LLGLYGTVT

SEQ ID NO: 58392 - protein, 15 aa, BK virus
SNLSPIRPSMVRQVA

SEQ ID NO: 58393 - protein, 9 aa, BK virus
IRPSMVRQV

SEQ ID NO: 58394 - protein, 15 aa, BK virus
RTAPQWMLPLLLGLY

SEQ ID NO: 58395 - protein, 9 aa, BK virus
PQWMLPLLL

SEQ ID NO: 58396 - protein, 15 aa, BK virus
QTVTGISSLAQVGYR

SEQ ID NO: 58397 - protein, 9 aa, BK virus
VTGISSLAQ

SEQ ID NO: 58398 - protein, 15 aa, BK virus
GDLVASVSEAAAATG

SEQ ID NO: 58399 - protein, 9 aa, BK virus
LVASVSEAA

SEQ ID NO: 58400 - protein, 15 aa, BK virus
QRTAPQWMLPLLLGL

SEQ ID NO: 58401 - protein, 9 aa, BK virus
PQWMLPLLL

SEQ ID NO: 58402 - protein, 15 aa, BK virus
APQWMLPLLLGLYGT

SEQ ID NO: 58403 - protein, 9 aa, BK virus
QWMLPLLLG

SEQ ID NO: 58404 - protein, 15 aa, BK virus
DLRNKESVHSGEFIE

SEQ ID NO: 58405 - protein, 9 aa, BK virus
LRNKESVHS

SEQ ID NO: 58406 - protein, 15 aa, BK virus
LRNKESVHSGEFIEK

SEQ ID NO: 58407 - protein, 9 aa, BK virus
LRNKESVHS

SEQ ID NO: 58408 - protein, 15 aa, BK virus
IASLATVEGITTTSE

SEQ ID NO: 58409 - protein, 9 aa, BK virus
IASLATVEG

SEQ ID NO: 58410 - protein, 15 aa, BK virus
LALLGDLVASVSEAA

SEQ ID NO: 58411 - protein, 9 aa, BK virus
LGDLVASVS

SEQ ID NO: 58412 - protein, 15 aa, BK virus
RDDIPAITSQELQRR

SEQ ID NO: 58413 - protein, 9 aa, BK virus
IPAITSQEL

SEQ ID NO: 58414 - protein, 15 aa, BK virus
DDIPAITSQELQRRT

SEQ ID NO: 58415 - protein, 9 aa, BK virus
IPAITSQEL

SEQ ID NO: 58416 - protein, 15 aa, BK virus
ERFFRDSLARFLEET

SEQ ID NO: 58417 - protein, 9 aa, BK virus
FRDSLARFL

SEQ ID NO: 58418 - protein, 15 aa, BK virus
RTERFFRDSLARFLE

SEQ ID NO: 58419 - protein, 9 aa, BK virus
FRDSLARFL

SEQ ID NO: 58420 - protein, 15 aa, BK virus
TERFFRDSLARFLEE

SEQ ID NO: 58421 - protein, 9 aa, BK virus
FRDSLARFL

SEQ ID NO: 58422 - protein, 15 aa, BK virus
RRTERFFRDSLARFL

SEQ ID NO: 58423 - protein, 9 aa, BK virus
FFRDSLARF

SEQ ID NO: 58424 - protein, 15 aa, BK virus
RFFRDSLARFLEETT

SEQ ID NO: 58425 - protein, 9 aa, BK virus
FRDSLARFL

SEQ ID NO: 58426 - protein, 15 aa, BK virus
VIAGAPGAIAGFAAL

SEQ ID NO: 58427 - protein, 9 aa, BK virus
IAGAPGAIA

SEQ ID NO: 58428 - protein, 15 aa, BK virus
PGAIAGFAALIQTVT

SEQ ID NO: 58429 - protein, 9 aa, BK virus
IAGFAALIQ

SEQ ID NO: 58430 - protein, 15 aa, BK virus
GAIAGFAALIQTVTG

SEQ ID NO: 58431 - protein, 9 aa, BK virus
FAALIQTVT

SEQ ID NO: 58432 - protein, 15 aa, BK virus
QIASLATVEGITTTS

SEQ ID NO: 58433 - protein, 9 aa, BK virus
IASLATVEG

SEQ ID NO: 58434 - protein, 15 aa, BK virus
ALLGDLVASVSEAAA

SEQ ID NO: 58435 - protein, 9 aa, BK virus
LVASVSEAA

SEQ ID NO: 58436 - protein, 15 aa, BK virus
NLSPIRPSMVRQVAE

SEQ ID NO: 58437 - protein, 9 aa, BK virus
IRPSMVRQV

SEQ ID NO: 58438 - protein, 15 aa, BK virus
LLLGLYGTVTPALEA

SEQ ID NO: 58439 - protein, 9 aa, BK virus
LLGLYGTVT

SEQ ID NO: 58440 - protein, 15 aa, BK virus
LSPIRPSMVRQVAER

SEQ ID NO: 58441 - protein, 9 aa, BK virus
IRPSMVRQV

SEQ ID NO: 58442 - protein, 15 aa, BK virus
PQWMLPLLLGLYGTV

SEQ ID NO: 58443 - protein, 9 aa, BK virus
PQWMLPLLL

SEQ ID NO: 58444 - protein, 15 aa, BK virus
LLGLYGTVTPALEAY

SEQ ID NO: 58445 - protein, 9 aa, BK virus
LLGLYGTVT

SEQ ID NO: 58446 - protein, 15 aa, BK virus
AGFAALIQTVTGISS

SEQ ID NO: 58447 - protein, 9 aa, BK virus
FAALIQTVT

SEQ ID NO: 58448 - protein, 15 aa, BK virus
LGDLVASVSEAAAAT

SEQ ID NO: 58449 - protein, 9 aa, BK virus
LVASVSEAA

SEQ ID NO: 58450 - protein, 15 aa, BK virus
PSLFATISQALWHVI

SEQ ID NO: 58451 - protein, 9 aa, BK virus
LFATISQAL

SEQ ID NO: 58452 - protein, 15 aa, BK virus
EIAAGEAAAAIEVQI

SEQ ID NO: 58453 - protein, 9 aa, BK virus
IAAGEAAAA

SEQ ID NO: 58454 - protein, 15 aa, BK virus
NQRTAPQWMLPLLLG

SEQ ID NO: 58455 - protein, 9 aa, BK virus
PQWMLPLLL

SEQ ID NO: 58456 - protein, 15 aa, BK virus
RHWGPSLFATISQAL

SEQ ID NO: 58457 - protein, 9 aa, BK virus
RHWGPSLFA

SEQ ID NO: 58458 - protein, 15 aa, BK virus
FIEKTIAPGGANQRT

SEQ ID NO: 58459 - protein, 9 aa, BK virus
IAPGGANQR

SEQ ID NO: 58460 - protein, 15 aa, BK virus
IAAGEAAAAIEVQIA

SEQ ID NO: 58461 - protein, 9 aa, BK virus
IAAGEAAAA

SEQ ID NO: 58462 - protein, 15 aa, BK virus
LLGDLVASVSEAAAA

SEQ ID NO: 58463 - protein, 9 aa, BK virus
LVASVSEAA

SEQ ID NO: 58464 - protein, 15 aa, BK virus
LVASVSEAAAATGFS

SEQ ID NO: 58465 - protein, 9 aa, BK virus
VSEAAAATG

SEQ ID NO: 58466 - protein, 15 aa, BK virus
HWGPSLFATISQALW

SEQ ID NO: 58467 - protein, 9 aa, BK virus
LFATISQAL

SEQ ID NO: 58468 - protein, 15 aa, BK virus
IEKTIAPGGANQRTA

SEQ ID NO: 58469 - protein, 9 aa, BK virus
IAPGGANQR

SEQ ID NO: 58470 - protein, 15 aa, BK virus
GPSLFATISQALWHV

SEQ ID NO: 58471 - protein, 9 aa, BK virus
LFATISQAL

SEQ ID NO: 58472 - protein, 15 aa, BK virus
TVGLYQQSGMALELF

SEQ ID NO: 58473 - protein, 9 aa, BK virus
LYQQSGMAL

SEQ ID NO: 58474 - protein, 15 aa, BK virus
DLVASVSEAAAATGF

SEQ ID NO: 58475 - protein, 9 aa, BK virus
VSEAAAATG

SEQ ID NO: 58476 - protein, 15 aa, BK virus
VGLYQQSGMALELFN

SEQ ID NO: 58477 - protein, 9 aa, BK virus
LYQQSGMAL

SEQ ID NO: 58478 - protein, 15 aa, BK virus
EKTIAPGGANQRTAP

SEQ ID NO: 58479 - protein, 9 aa, BK virus
IAPGGANQR

SEQ ID NO: 58480 - protein, 15 aa, BK virus
IAGAPGAIAGFAALI

SEQ ID NO: 58481 - protein, 9 aa, BK virus
IAGAPGAIA

SEQ ID NO: 58482 - protein, 15 aa, BK virus
WGPSLFATISQALWH

SEQ ID NO: 58483 - protein, 9 aa, BK virus
LFATISQAL

SEQ ID NO: 58484 - protein, 15 aa, BK virus
SPIRPSMVRQVAERE

SEQ ID NO: 58485 - protein, 9 aa, BK virus
IRPSMVRQV

SEQ ID NO: 58486 - protein, 15 aa, BK virus
STVGLYQQSGMALEL

SEQ ID NO: 58487 - protein, 9 aa, BK virus
LYQQSGMAL

SEQ ID NO: 58488 - protein, 15 aa, BK virus
IAGFAALIQTVTGIS

SEQ ID NO: 58489 - protein, 9 aa, BK virus
FAALIQTVT

SEQ ID NO: 58490 - protein, 15 aa, BK virus
AIAGFAALIQTVTGI

SEQ ID NO: 58491 - protein, 9 aa, BK virus
FAALIQTVT

SEQ ID NO: 58492 - protein, 15 aa, BK virus
KTIAPGGANQRTAPQ

SEQ ID NO: 58493 - protein, 9 aa, BK virus
IAPGGANQR

SEQ ID NO: 58494 - protein, 15 aa, BK virus
GAALALLGDLVASVS

SEQ ID NO: 58495 - protein, 9 aa, BK virus
LALLGDLVA

SEQ ID NO: 58496 - protein, 15 aa, BK virus
AALALLGDLVASVSE

SEQ ID NO: 58497 - protein, 9 aa, BK virus
LGDLVASVS

SEQ ID NO: 58498 - protein, 15 aa, BK virus
FAALIQTVTGISSLA

SEQ ID NO: 58499 - protein, 9 aa, BK virus
IQTVTGISS

SEQ ID NO: 58500 - protein, 15 aa, BK virus
IPAITSQELQRRTER

SEQ ID NO: 58501 - protein, 9 aa, BK virus
ITSQELQRR

SEQ ID NO: 58502 - protein, 15 aa, BK virus
DIPAITSQELQRRTE

SEQ ID NO: 58503 - protein, 9 aa, BK virus
ITSQELQRR

SEQ ID NO: 58504 - protein, 15 aa, BK virus
VTGISSLAQVGYRFF

SEQ ID NO: 58505 - protein, 9 aa, BK virus
VTGISSLAQ

SEQ ID NO: 58506 - protein, 15 aa, BK virus
GFAALIQTVTGISSL

SEQ ID NO: 58507 - protein, 9 aa, BK virus
IQTVTGISS

SEQ ID NO: 58508 - protein, 15 aa, BK virus
EFIEKTIAPGGANQR

SEQ ID NO: 58509 - protein, 9 aa, BK virus
IEKTIAPGG

SEQ ID NO: 58510 - protein, 15 aa, BK virus
KRRVSRGSSQKAKGT

SEQ ID NO: 58511 - protein, 9 aa, BK virus
VSRGSSQKA

SEQ ID NO: 58512 - protein, 15 aa, BK virus
HVIRDDIPAITSQEL

SEQ ID NO: 58513 - protein, 9 aa, BK virus
IRDDIPAIT

SEQ ID NO: 58514 - protein, 15 aa, BK virus
VSTVGLYQQSGMALE

SEQ ID NO: 58515 - protein, 9 aa, BK virus
LYQQSGMAL

SEQ ID NO: 58516 - protein, 15 aa, BK virus
TPQTYAVIAGAPGAI

SEQ ID NO: 58517 - protein, 9 aa, BK virus
YAVIAGAPG

SEQ ID NO: 58518 - protein, 15 aa, BK virus
RRVSRGSSQKAKGTR

SEQ ID NO: 58519 - protein, 9 aa, BK virus
VSRGSSQKA

SEQ ID NO: 58520 - protein, 15 aa, BK virus
VSRGSSQKAKGTRAS

SEQ ID NO: 58521 - protein, 9 aa, BK virus
VSRGSSQKA

SEQ ID NO: 58522 - protein, 15 aa, BK virus
KKRRVSRGSSQKAKG

SEQ ID NO: 58523 - protein, 9 aa, BK virus
VSRGSSQKA

SEQ ID NO: 58524 - protein, 15 aa, BK virus
QKKRRVSRGSSQKAK

SEQ ID NO: 58525 - protein, 9 aa, BK virus
VSRGSSQKA

SEQ ID NO: 58526 - protein, 15 aa, BK virus
TVTGISSLAQVGYRF

SEQ ID NO: 58527 - protein, 9 aa, BK virus
VTGISSLAQ

SEQ ID NO: 58528 - protein, 15 aa, BK virus
LGLYGTVTPALEAYE

SEQ ID NO: 58529 - protein, 9 aa, BK virus
LYGTVTPAL

SEQ ID NO: 58530 - protein, 15 aa, BK virus
ALALLGDLVASVSEA

SEQ ID NO: 58531 - protein, 9 aa, BK virus
LGDLVASVS

SEQ ID NO: 58532 - protein, 15 aa, BK virus
NQKKRRVSRGSSQKA

SEQ ID NO: 58533 - protein, 9 aa, BK virus
RVSRGSSQK

SEQ ID NO: 58534 - protein, 15 aa, BK virus
VASVSEAAAATGFSV

SEQ ID NO: 58535 - protein, 9 aa, BK virus
VSEAAAATG

SEQ ID NO: 58536 - protein, 15 aa, BK virus
IRDDIPAITSQELQR

SEQ ID NO: 58537 - protein, 9 aa, BK virus
IPAITSQEL

SEQ ID NO: 58538 - protein, 15 aa, BK virus
ANQRTAPQWMLPLLL

SEQ ID NO: 58539 - protein, 9 aa, BK virus
RTAPQWMLP

SEQ ID NO: 58540 - protein, 15 aa, BK virus
EAAAAIEVQIASLAT

SEQ ID NO: 58541 - protein, 9 aa, BK virus
IEVQIASLA

SEQ ID NO: 58542 - protein, 15 aa, BK virus
APGAIAGFAALIQTV

SEQ ID NO: 58543 - protein, 9 aa, BK virus
IAGFAALIQ

SEQ ID NO: 58544 - protein, 15 aa, BK virus
VIRDDIPAITSQELQ

SEQ ID NO: 58545 - protein, 9 aa, BK virus
IPAITSQEL

SEQ ID NO: 58546 - protein, 15 aa, BK virus
YNYIQDYYSNLSPIR

SEQ ID NO: 58547 - protein, 9 aa, BK virus
IQDYYSNLS

SEQ ID NO: 58548 - protein, 15 aa, BK virus
AGAPGAIAGFAALIQ

SEQ ID NO: 58549 - protein, 9 aa, BK virus
AIAGFAALI

SEQ ID NO: 58550 - protein, 15 aa, BK virus
GAPGAIAGFAALIQT

SEQ ID NO: 58551 - protein, 9 aa, BK virus
IAGFAALIQ

SEQ ID NO: 58552 - protein, 15 aa, BK virus
KVSTVGLYQQSGMAL

SEQ ID NO: 58553 - protein, 9 aa, BK virus
TVGLYQQSG

SEQ ID NO: 58554 - protein, 15 aa, BK virus
SLFATISQALWHVIR

SEQ ID NO: 58555 - protein, 9 aa, BK virus
LFATISQAL

SEQ ID NO: 58556 - protein, 15 aa, BK virus
ASVSEAAAATGFSVA

SEQ ID NO: 58557 - protein, 9 aa, BK virus
VSEAAAATG

SEQ ID NO: 58558 - protein, 15 aa, BK virus
GLYQQSGMALELFNP

SEQ ID NO: 58559 - protein, 9 aa, BK virus
LYQQSGMAL

SEQ ID NO: 58560 - protein, 15 aa, BK virus
LFATISQALWHVIRD

SEQ ID NO: 58561 - protein, 9 aa, BK virus
LFATISQAL

SEQ ID NO: 58562 - protein, 15 aa, BK virus
FFRDSLARFLEETTW

SEQ ID NO: 58563 - protein, 9 aa, BK virus
FRDSLARFL

SEQ ID NO: 58564 - protein, 15 aa, BK virus
ASLATVEGITTTSEA

SEQ ID NO: 58565 - protein, 9 aa, BK virus
LATVEGITT

SEQ ID NO: 58566 - protein, 15 aa, BK virus
DPRHWGPSLFATISQ

SEQ ID NO: 58567 - protein, 9 aa, BK virus
RHWGPSLFA

SEQ ID NO: 58568 - protein, 15 aa, BK virus
LDPRHWGPSLFATIS

SEQ ID NO: 58569 - protein, 9 aa, BK virus
RHWGPSLFA

SEQ ID NO: 58570 - protein, 15 aa, BK virus
AIAAIGLTPQTYAVI

SEQ ID NO: 58571 - protein, 9 aa, BK virus
IAAIGLTPQ

SEQ ID NO: 58572 - protein, 15 aa, BK virus
FRDSLARFLEETTWT

SEQ ID NO: 58573 - protein, 9 aa, BK virus
FRDSLARFL

SEQ ID NO: 58574 - protein, 15 aa, BK virus
TIAPGGANQRTAPQW

SEQ ID NO: 58575 - protein, 9 aa, BK virus
IAPGGANQR

SEQ ID NO: 58576 - protein, 15 aa, BK virus
PAITSQELQRRTERF

SEQ ID NO: 58577 - protein, 9 aa, BK virus
ITSQELQRR

SEQ ID NO: 58578 - protein, 15 aa, BK virus
LYQQSGMALELFNPD

SEQ ID NO: 58579 - protein, 9 aa, BK virus
LYQQSGMAL

SEQ ID NO: 58580 - protein, 15 aa, BK virus
ETTWTIVNAPINFYN

SEQ ID NO: 58581 - protein, 9 aa, BK virus
IVNAPINFY

SEQ ID NO: 58582 - protein, 15 aa, BK virus
IAAIGLTPQTYAVIA

SEQ ID NO: 58583 - protein, 9 aa, BK virus
LTPQTYAVI

SEQ ID NO: 58584 - protein, 15 aa, BK virus
YLDPRHWGPSLFATI

SEQ ID NO: 58585 - protein, 9 aa, BK virus
RHWGPSLFA

SEQ ID NO: 58586 - protein, 15 aa, BK virus
EAIAAIGLTPQTYAV

SEQ ID NO: 58587 - protein, 9 aa, BK virus
IAAIGLTPQ

SEQ ID NO: 58588 - protein, 15 aa, BK virus
TTWTIVNAPINFYNY

SEQ ID NO: 58589 - protein, 9 aa, BK virus
IVNAPINFY

SEQ ID NO: 58590 - protein, 15 aa, BK virus
EETTWTIVNAPINFY

SEQ ID NO: 58591 - protein, 9 aa, BK virus
WTIVNAPIN

SEQ ID NO: 58592 - protein, 15 aa, BK virus
PIRPSMVRQVAEREG

SEQ ID NO: 58593 - protein, 9 aa, BK virus
IRPSMVRQV

SEQ ID NO: 58594 - protein, 15 aa, BK virus
LTPQTYAVIAGAPGA

SEQ ID NO: 58595 - protein, 9 aa, BK virus
YAVIAGAPG

SEQ ID NO: 58596 - protein, 15 aa, BK virus
IRPSMVRQVAEREGT

SEQ ID NO: 58597 - protein, 9 aa, BK virus
IRPSMVRQV

SEQ ID NO: 58598 - protein, 15 aa, BK virus
INFYNYIQDYYSNLS

SEQ ID NO: 58599 - protein, 9 aa, BK virus
YNYIQDYYS

SEQ ID NO: 58600 - protein, 15 aa, BK virus
SEAIAAIGLTPQTYA

SEQ ID NO: 58601 - protein, 9 aa, BK virus
IAAIGLTPQ

SEQ ID NO: 58602 - protein, 15 aa, BK virus
NFYNYIQDYYSNLSP

SEQ ID NO: 58603 - protein, 9 aa, BK virus
IQDYYSNLS

SEQ ID NO: 58604 - protein, 15 aa, BK virus
IQYLDPRHWGPSLFA

SEQ ID NO: 58605 - protein, 9 aa, BK virus
IQYLDPRHW

SEQ ID NO: 58606 - protein, 15 aa, BK virus
GLYGTVTPALEAYED

SEQ ID NO: 58607 - protein, 9 aa, BK virus
LYGTVTPAL

SEQ ID NO: 58608 - protein, 15 aa, BK virus
RVSRGSSQKAKGTRA

SEQ ID NO: 58609 - protein, 9 aa, BK virus
VSRGSSQKA

SEQ ID NO: 58610 - protein, 15 aa, BK virus
TWTIVNAPINFYNYI

SEQ ID NO: 58611 - protein, 9 aa, BK virus
IVNAPINFY

SEQ ID NO: 58612 - protein, 15 aa, BK virus
WTIVNAPINFYNYIQ

SEQ ID NO: 58613 - protein, 9 aa, BK virus
IVNAPINFY

SEQ ID NO: 58614 - protein, 15 aa, BK virus
TFVNNIQYLDPRHWG

SEQ ID NO: 58615 - protein, 9 aa, BK virus
IQYLDPRHW

SEQ ID NO: 58616 - protein, 15 aa, BK virus
SSQKAKGTRASAKTT

SEQ ID NO: 58617 - protein, 9 aa, BK virus
QKAKGTRAS

SEQ ID NO: 58618 - protein, 15 aa, BK virus
NTFVNNIQYLDPRHW

SEQ ID NO: 58619 - protein, 9 aa, BK virus
VNNIQYLDP

SEQ ID NO: 58620 - protein, 15 aa, BK virus
LATVEGITTTSEAIA

SEQ ID NO: 58621 - protein, 9 aa, BK virus
VEGITTTSE

SEQ ID NO: 58622 - protein, 15 aa, BK virus
GLTPQTYAVIAGAPG

SEQ ID NO: 58623 - protein, 9 aa, BK virus
TPQTYAVIA

SEQ ID NO: 58624 - protein, 15 aa, BK virus
IAPGGANQRTAPQWM

SEQ ID NO: 58625 - protein, 9 aa, BK virus
IAPGGANQR

SEQ ID NO: 58626 - protein, 15 aa, BK virus
TSEAIAAIGLTPQTY

SEQ ID NO: 58627 - protein, 9 aa, BK virus
IAAIGLTPQ

SEQ ID NO: 58628 - protein, 15 aa, BK virus
VNNIQYLDPRHWGPS

SEQ ID NO: 58629 - protein, 9 aa, BK virus
IQYLDPRHW

SEQ ID NO: 58630 - protein, 15 aa, BK virus
FYNYIQDYYSNLSPI

SEQ ID NO: 58631 - protein, 9 aa, BK virus
IQDYYSNLS

SEQ ID NO: 58632 - protein, 15 aa, BK virus
TTSEAIAAIGLTPQT

SEQ ID NO: 58633 - protein, 9 aa, BK virus
IAAIGLTPQ

SEQ ID NO: 58634 - protein, 15 aa, BK virus
FVNNIQYLDPRHWGP

SEQ ID NO: 58635 - protein, 9 aa, BK virus
IQYLDPRHW

SEQ ID NO: 58636 - protein, 15 aa, BK virus
NNIQYLDPRHWGPSL

SEQ ID NO: 58637 - protein, 9 aa, BK virus
IQYLDPRHW

SEQ ID NO: 58638 - protein, 15 aa, BK virus
SLATVEGITTTSEAI

SEQ ID NO: 58639 - protein, 9 aa, BK virus
VEGITTTSE

SEQ ID NO: 58640 - protein, 15 aa, BK virus
AAIGLTPQTYAVIAG

SEQ ID NO: 58641 - protein, 9 aa, BK virus
LTPQTYAVI

SEQ ID NO: 58642 - protein, 15 aa, BK virus
GSSQKAKGTRASAKT

SEQ ID NO: 58643 - protein, 9 aa, BK virus
QKAKGTRAS

SEQ ID NO: 58644 - protein, 15 aa, BK virus
SVSEAAAATGFSVAE

SEQ ID NO: 58645 - protein, 9 aa, BK virus
VSEAAAATG

SEQ ID NO: 58646 - protein, 15 aa, BK virus
PRHWGPSLFATISQA

SEQ ID NO: 58647 - protein, 9 aa, BK virus
WGPSLFATI

SEQ ID NO: 58648 - protein, 15 aa, BK virus
LYGTVTPALEAYEDG

SEQ ID NO: 58649 - protein, 9 aa, BK virus
LYGTVTPAL

SEQ ID NO: 58650 - protein, 15 aa, BK virus
EYYDILFPGVNTFVN

SEQ ID NO: 58651 - protein, 9 aa, BK virus
LFPGVNTFV

SEQ ID NO: 58652 - protein, 15 aa, BK virus
AIGLTPQTYAVIAGA

SEQ ID NO: 58653 - protein, 9 aa, BK virus
LTPQTYAVI

SEQ ID NO: 58654 - protein, 15 aa, BK virus
QYLDPRHWGPSLFAT

SEQ ID NO: 58655 - protein, 9 aa, BK virus
RHWGPSLFA

SEQ ID NO: 58656 - protein, 15 aa, BK virus
TTTSEAIAAIGLTPQ

SEQ ID NO: 58657 - protein, 9 aa, BK virus
SEAIAAIGL

SEQ ID NO: 58658 - protein, 15 aa, BK virus
YYDILFPGVNTFVNN

SEQ ID NO: 58659 - protein, 9 aa, BK virus
LFPGVNTFV

SEQ ID NO: 58660 - protein, 15 aa, BK virus
DEYYDILFPGVNTFV

SEQ ID NO: 58661 - protein, 9 aa, BK virus
YYDILFPGV

SEQ ID NO: 58662 - protein, 15 aa, BK virus
RGSSQKAKGTRASAK

SEQ ID NO: 58663 - protein, 9 aa, BK virus
QKAKGTRAS

SEQ ID NO: 58664 - protein, 15 aa, BK virus
YDILFPGVNTFVNNI

SEQ ID NO: 58665 - protein, 9 aa, BK virus
LFPGVNTFV

SEQ ID NO: 58666 - protein, 15 aa, BK virus
ATVEGITTTSEAIAA

SEQ ID NO: 58667 - protein, 9 aa, BK virus
VEGITTTSE

SEQ ID NO: 58668 - protein, 15 aa, BK virus
VSEAAAATGFSVAEI

SEQ ID NO: 58669 - protein, 9 aa, BK virus
VSEAAAATG

SEQ ID NO: 58670 - protein, 15 aa, BK virus
SQKAKGTRASAKTTN

SEQ ID NO: 58671 - protein, 9 aa, BK virus
QKAKGTRAS

SEQ ID NO: 58672 - protein, 15 aa, BK virus
DILFPGVNTFVNNIQ

SEQ ID NO: 58673 - protein, 9 aa, BK virus
LFPGVNTFV

SEQ ID NO: 58674 - protein, 15 aa, BK virus
IGLTPQTYAVIAGAP

SEQ ID NO: 58675 - protein, 9 aa, BK virus
LTPQTYAVI

SEQ ID NO: 58676 - protein, 15 aa, BK virus
SRGSSQKAKGTRASA

SEQ ID NO: 58677 - protein, 9 aa, BK virus
QKAKGTRAS

SEQ ID NO: 58678 - protein, 15 aa, BK virus
QKAKGTRASAKTTNK

SEQ ID NO: 58679 - protein, 9 aa, BK virus
QKAKGTRAS

SEQ ID NO: 58680 - protein, 15 aa, BK virus
TGFSVAEIAAGEAAA

SEQ ID NO: 58681 - protein, 9 aa, BK virus
FSVAEIAAG

SEQ ID NO: 58682 - protein, 15 aa, BK virus
GEAAAAIEVQIASLA

SEQ ID NO: 58683 - protein, 9 aa, BK virus
AAAIEVQIA

SEQ ID NO: 58684 - protein, 15 aa, BK virus
ATGFSVAEIAAGEAA

SEQ ID NO: 58685 - protein, 9 aa, BK virus
FSVAEIAAG

SEQ ID NO: 58686 - protein, 15 aa, BK virus
AATGFSVAEIAAGEA

SEQ ID NO: 58687 - protein, 9 aa, BK virus
FSVAEIAAG

SEQ ID NO: 58688 - protein, 15 aa, BK virus
PSMVRQVAEREGTHV

SEQ ID NO: 58689 - protein, 9 aa, BK virus
MVRQVAERE

SEQ ID NO: 58690 - protein, 15 aa, BK virus
FFSDWDHKVSTVGLY

SEQ ID NO: 58691 - protein, 9 aa, BK virus
WDHKVSTVG

SEQ ID NO: 58692 - protein, 15 aa, BK virus
RFFSDWDHKVSTVGL

SEQ ID NO: 58693 - protein, 9 aa, BK virus
WDHKVSTVG

SEQ ID NO: 58694 - protein, 15 aa, BK virus
SDWDHKVSTVGLYQQ

SEQ ID NO: 58695 - protein, 9 aa, BK virus
WDHKVSTVG

SEQ ID NO: 58696 - protein, 15 aa, BK virus
FATISQALWHVIRDD

SEQ ID NO: 58697 - protein, 9 aa, BK virus
ISQALWHVI

SEQ ID NO: 58698 - protein, 15 aa, BK virus
AITSQELQRRTERFF

SEQ ID NO: 58699 - protein, 9 aa, BK virus
ITSQELQRR

SEQ ID NO: 58700 - protein, 15 aa, BK virus
EGITTTSEAIAAIGL

SEQ ID NO: 58701 - protein, 9 aa, BK virus
ITTTSEAIA

SEQ ID NO: 58702 - protein, 15 aa, BK virus
FSDWDHKVSTVGLYQ

SEQ ID NO: 58703 - protein, 9 aa, BK virus
WDHKVSTVG

SEQ ID NO: 58704 - protein, 15 aa, BK virus
QRRTERFFRDSLARF

SEQ ID NO: 58705 - protein, 9 aa, BK virus
RFFRDSLAR

SEQ ID NO: 58706 - protein, 15 aa, BK virus
RRTERFFRDSLARFL

SEQ ID NO: 58707 - protein, 9 aa, BK virus
FFRDSLARF

SEQ ID NO: 58708 - protein, 15 aa, BK virus
ERFFRDSLARFLEET

SEQ ID NO: 58709 - protein, 9 aa, BK virus
FFRDSLARF

SEQ ID NO: 58710 - protein, 15 aa, BK virus
RTERFFRDSLARFLE

SEQ ID NO: 58711 - protein, 9 aa, BK virus
FFRDSLARF

SEQ ID NO: 58712 - protein, 15 aa, BK virus
TERFFRDSLARFLEE

SEQ ID NO: 58713 - protein, 9 aa, BK virus
FFRDSLARF

SEQ ID NO: 58714 - protein, 15 aa, BK virus
NYIQDYYSNLSPIRP

SEQ ID NO: 58715 - protein, 9 aa, BK virus
YYSNLSPIR

SEQ ID NO: 58716 - protein, 15 aa, BK virus
YNYIQDYYSNLSPIR

SEQ ID NO: 58717 - protein, 9 aa, BK virus
IQDYYSNLS

SEQ ID NO: 58718 - protein, 15 aa, BK virus
YIQDYYSNLSPIRPS

SEQ ID NO: 58719 - protein, 9 aa, BK virus
YYSNLSPIR

SEQ ID NO: 58720 - protein, 15 aa, BK virus
IQDYYSNLSPIRPSM

SEQ ID NO: 58721 - protein, 9 aa, BK virus
YYSNLSPIR

SEQ ID NO: 58722 - protein, 15 aa, BK virus
QDYYSNLSPIRPSMV

SEQ ID NO: 58723 - protein, 9 aa, BK virus
YYSNLSPIR

SEQ ID NO: 58724 - protein, 15 aa, BK virus
VTQRMDLRNKESVHS

SEQ ID NO: 58725 - protein, 9 aa, BK virus
VTQRMDLRN

SEQ ID NO: 58726 - protein, 15 aa, BK virus
TQRMDLRNKESVHSG

SEQ ID NO: 58727 - protein, 9 aa, BK virus
LRNKESVHS

SEQ ID NO: 58728 - protein, 15 aa, BK virus
QRMDLRNKESVHSGE

SEQ ID NO: 58729 - protein, 9 aa, BK virus
LRNKESVHS

SEQ ID NO: 58730 - protein, 15 aa, BK virus
RMDLRNKESVHSGEF

SEQ ID NO: 58731 - protein, 9 aa, BK virus
LRNKESVHS

SEQ ID NO: 58732 - protein, 15 aa, BK virus
MDLRNKESVHSGEFI

SEQ ID NO: 58733 - protein, 9 aa, BK virus
LRNKESVHS

SEQ ID NO: 58734 - protein, 15 aa, BK virus
LALLGDLVASVSEAA

SEQ ID NO: 58735 - protein, 9 aa, BK virus
LLGDLVASV

SEQ ID NO: 58736 - protein, 15 aa, BK virus
ALLGDLVASVSEAAA

SEQ ID NO: 58737 - protein, 9 aa, BK virus
LVASVSEAA

SEQ ID NO: 58738 - protein, 15 aa, BK virus
LLGDLVASVSEAAAA

SEQ ID NO: 58739 - protein, 9 aa, BK virus
LVASVSEAA

SEQ ID NO: 58740 - protein, 15 aa, BK virus
LGDLVASVSEAAAAT

SEQ ID NO: 58741 - protein, 9 aa, BK virus
LVASVSEAA

SEQ ID NO: 58742 - protein, 15 aa, BK virus
GDLVASVSEAAAATG

SEQ ID NO: 58743 - protein, 9 aa, BK virus
LVASVSEAA

SEQ ID NO: 58744 - protein, 15 aa, BK virus
AALIQTVTGISSLAQ

SEQ ID NO: 58745 - protein, 9 aa, BK virus
LIQTVTGIS

SEQ ID NO: 58746 - protein, 15 aa, BK virus
DYYSNLSPIRPSMVR

SEQ ID NO: 58747 - protein, 9 aa, BK virus
YYSNLSPIR

SEQ ID NO: 58748 - protein, 15 aa, BK virus
ALIQTVTGISSLAQV

SEQ ID NO: 58749 - protein, 9 aa, BK virus
VTGISSLAQ

SEQ ID NO: 58750 - protein, 15 aa, BK virus
LIQTVTGISSLAQVG

SEQ ID NO: 58751 - protein, 9 aa, BK virus
VTGISSLAQ

SEQ ID NO: 58752 - protein, 15 aa, BK virus
YYSNLSPIRPSMVRQ

SEQ ID NO: 58753 - protein, 9 aa, BK virus
YYSNLSPIR

SEQ ID NO: 58754 - protein, 15 aa, BK virus
EETTWTIVNAPINFY

SEQ ID NO: 58755 - protein, 9 aa, BK virus
WTIVNAPIN

SEQ ID NO: 58756 - protein, 15 aa, BK virus
ETTWTIVNAPINFYN

SEQ ID NO: 58757 - protein, 9 aa, BK virus
IVNAPINFY

SEQ ID NO: 58758 - protein, 15 aa, BK virus
TTWTIVNAPINFYNY

SEQ ID NO: 58759 - protein, 9 aa, BK virus
IVNAPINFY

SEQ ID NO: 58760 - protein, 15 aa, BK virus
IQTVTGISSLAQVGY

SEQ ID NO: 58761 - protein, 9 aa, BK virus
VTGISSLAQ

SEQ ID NO: 58762 - protein, 15 aa, BK virus
WTIVNAPINFYNYIQ

SEQ ID NO: 58763 - protein, 9 aa, BK virus
IVNAPINFY

SEQ ID NO: 58764 - protein, 15 aa, BK virus
TWTIVNAPINFYNYI

SEQ ID NO: 58765 - protein, 9 aa, BK virus
IVNAPINFY

SEQ ID NO: 58766 - protein, 15 aa, BK virus
FAALIQTVTGISSLA

SEQ ID NO: 58767 - protein, 9 aa, BK virus
LIQTVTGIS

SEQ ID NO: 58768 - protein, 15 aa, BK virus
AAIEVQIASLATVEG

SEQ ID NO: 58769 - protein, 9 aa, BK virus
IEVQIASLA

SEQ ID NO: 58770 - protein, 15 aa, BK virus
DILFPGVNTFVNNIQ

SEQ ID NO: 58771 - protein, 9 aa, BK virus
GVNTFVNNI

SEQ ID NO: 58772 - protein, 15 aa, BK virus
NYIQDYYSNLSPIRP

SEQ ID NO: 58773 - protein, 9 aa, BK virus
IQDYYSNLS

SEQ ID NO: 58774 - protein, 15 aa, BK virus
AALIQTVTGISSLAQ

SEQ ID NO: 58775 - protein, 9 aa, BK virus
LIQTVTGIS

SEQ ID NO: 58776 - protein, 15 aa, BK virus
EETTWTIVNAPINFY

SEQ ID NO: 58777 - protein, 9 aa, BK virus
TTWTIVNAP

SEQ ID NO: 58778 - protein, 15 aa, BK virus
IQDYYSNLSPIRPSM

SEQ ID NO: 58779 - protein, 9 aa, BK virus
IQDYYSNLS

SEQ ID NO: 58780 - protein, 15 aa, BK virus
LPLLLGLYGTVTPAL

SEQ ID NO: 58781 - protein, 9 aa, BK virus
LLGLYGTVT

SEQ ID NO: 58782 - protein, 15 aa, BK virus
YIQDYYSNLSPIRPS

SEQ ID NO: 58783 - protein, 9 aa, BK virus
IQDYYSNLS

SEQ ID NO: 58784 - protein, 15 aa, BK virus
PLLLGLYGTVTPALE

SEQ ID NO: 58785 - protein, 9 aa, BK virus
LLGLYGTVT

SEQ ID NO: 58786 - protein, 15 aa, BK virus
WMLPLLLGLYGTVTP

SEQ ID NO: 58787 - protein, 9 aa, BK virus
LLGLYGTVT

SEQ ID NO: 58788 - protein, 15 aa, BK virus
MLPLLLGLYGTVTPA

SEQ ID NO: 58789 - protein, 9 aa, BK virus
LLGLYGTVT

SEQ ID NO: 58790 - protein, 15 aa, BK virus
AAIEVQIASLATVEG

SEQ ID NO: 58791 - protein, 9 aa, BK virus
IEVQIASLA

SEQ ID NO: 58792 - protein, 15 aa, BK virus
TTWTIVNAPINFYNY

SEQ ID NO: 58793 - protein, 9 aa, BK virus
IVNAPINFY

SEQ ID NO: 58794 - protein, 15 aa, BK virus
ARFLEETTWTIVNAP

SEQ ID NO: 58795 - protein, 9 aa, BK virus
FLEETTWTI

SEQ ID NO: 58796 - protein, 15 aa, BK virus
YNYIQDYYSNLSPIR

SEQ ID NO: 58797 - protein, 9 aa, BK virus
IQDYYSNLS

SEQ ID NO: 58798 - protein, 15 aa, BK virus
ETTWTIVNAPINFYN

SEQ ID NO: 58799 - protein, 9 aa, BK virus
IVNAPINFY

SEQ ID NO: 58800 - protein, 15 aa, BK virus
FAALIQTVTGISSLA

SEQ ID NO: 58801 - protein, 9 aa, BK virus
LIQTVTGIS

SEQ ID NO: 58802 - protein, 15 aa, BK virus
QWMLPLLLGLYGTVT

SEQ ID NO: 58803 - protein, 9 aa, BK virus
MLPLLLGLY

SEQ ID NO: 58804 - protein, 15 aa, BK virus
LLLGLYGTVTPALEA

SEQ ID NO: 58805 - protein, 9 aa, BK virus
LGLYGTVTP

SEQ ID NO: 58806 - protein, 15 aa, BK virus
LIQTVTGISSLAQVG

SEQ ID NO: 58807 - protein, 9 aa, BK virus
LIQTVTGIS

SEQ ID NO: 58808 - protein, 15 aa, BK virus
IEVQIASLATVEGIT

SEQ ID NO: 58809 - protein, 9 aa, BK virus
IASLATVEG

SEQ ID NO: 58810 - protein, 15 aa, BK virus
IAGFAALIQTVTGIS

SEQ ID NO: 58811 - protein, 9 aa, BK virus
AALIQTVTG

SEQ ID NO: 58812 - protein, 15 aa, BK virus
FLEETTWTIVNAPIN

SEQ ID NO: 58813 - protein, 9 aa, BK virus
TTWTIVNAP

SEQ ID NO: 58814 - protein, 15 aa, BK virus
NYIQDYYSNLSPIRP

SEQ ID NO: 58815 - protein, 9 aa, BK virus
IQDYYSNLS

SEQ ID NO: 58816 - protein, 15 aa, BK virus
YNYIQDYYSNLSPIR

SEQ ID NO: 58817 - protein, 9 aa, BK virus
IQDYYSNLS

SEQ ID NO: 58818 - protein, 15 aa, BK virus
INFYNYIQDYYSNLS

SEQ ID NO: 58819 - protein, 9 aa, BK virus
YNYIQDYYS

SEQ ID NO: 58820 - protein, 15 aa, BK virus
QVGYRFFSDWDHKVS

SEQ ID NO: 58821 - protein, 9 aa, BK virus
YRFFSDWDH

SEQ ID NO: 58822 - protein, 15 aa, BK virus
NFYNYIQDYYSNLSP

SEQ ID NO: 58823 - protein, 9 aa, BK virus
IQDYYSNLS

SEQ ID NO: 58824 - protein, 15 aa, BK virus
FLEETTWTIVNAPIN

SEQ ID NO: 58825 - protein, 9 aa, BK virus
EETTWTIVN

SEQ ID NO: 58826 - protein, 15 aa, BK virus
YIQDYYSNLSPIRPS

SEQ ID NO: 58827 - protein, 9 aa, BK virus
IQDYYSNLS

SEQ ID NO: 58828 - protein, 15 aa, BK virus
IQDYYSNLSPIRPSM

SEQ ID NO: 58829 - protein, 9 aa, BK virus
IQDYYSNLS

SEQ ID NO: 58830 - protein, 15 aa, BK virus
FPGVNTFVNNIQYLD

SEQ ID NO: 58831 - protein, 9 aa, BK virus
VNTFVNNIQ

SEQ ID NO: 58832 - protein, 15 aa, BK virus
FYNYIQDYYSNLSPI

SEQ ID NO: 58833 - protein, 9 aa, BK virus
IQDYYSNLS

SEQ ID NO: 58834 - protein, 15 aa, BK virus
EETTWTIVNAPINFY

SEQ ID NO: 58835 - protein, 9 aa, BK virus
WTIVNAPIN

SEQ ID NO: 58836 - protein, 15 aa, BK virus
PGVNTFVNNIQYLDP

SEQ ID NO: 58837 - protein, 9 aa, BK virus
VNTFVNNIQ

SEQ ID NO: 58838 - protein, 15 aa, BK virus
AQVGYRFFSDWDHKV

SEQ ID NO: 58839 - protein, 9 aa, BK virus
YRFFSDWDH

SEQ ID NO: 58840 - protein, 15 aa, BK virus
DILFPGVNTFVNNIQ

SEQ ID NO: 58841 - protein, 9 aa, BK virus
FPGVNTFVN

SEQ ID NO: 58842 - protein, 15 aa, BK virus
ILFPGVNTFVNNIQY

SEQ ID NO: 58843 - protein, 9 aa, BK virus
VNTFVNNIQ

SEQ ID NO: 58844 - protein, 15 aa, BK virus
VGYRFFSDWDHKVST

SEQ ID NO: 58845 - protein, 9 aa, BK virus
YRFFSDWDH

SEQ ID NO: 58846 - protein, 15 aa, BK virus
ARFLEETTWTIVNAP

SEQ ID NO: 58847 - protein, 9 aa, BK virus
EETTWTIVN

SEQ ID NO: 58848 - protein, 15 aa, BK virus
LEETTWTIVNAPINF

SEQ ID NO: 58849 - protein, 9 aa, BK virus
WTIVNAPIN

SEQ ID NO: 58850 - protein, 15 aa, BK virus
ETTWTIVNAPINFYN

SEQ ID NO: 58851 - protein, 9 aa, BK virus
WTIVNAPIN

SEQ ID NO: 58852 - protein, 15 aa, BK virus
RFLEETTWTIVNAPI

SEQ ID NO: 58853 - protein, 9 aa, BK virus
EETTWTIVN

SEQ ID NO: 58854 - protein, 15 aa, BK virus
LAQVGYRFFSDWDHK

SEQ ID NO: 58855 - protein, 9 aa, BK virus
GYRFFSDWD

SEQ ID NO: 58856 - protein, 15 aa, BK virus
SLAQVGYRFFSDWDH

SEQ ID NO: 58857 - protein, 9 aa, BK virus
GYRFFSDWD

SEQ ID NO: 58858 - protein, 15 aa, BK virus
LFPGVNTFVNNIQYL

SEQ ID NO: 58859 - protein, 9 aa, BK virus
VNTFVNNIQ

SEQ ID NO: 58860 - protein, 15 aa, BK virus
LARFLEETTWTIVNA

SEQ ID NO: 58861 - protein, 9 aa, BK virus
EETTWTIVN

SEQ ID NO: 58862 - protein, 15 aa, BK virus
FATISQALWHVIRDD

SEQ ID NO: 58863 - protein, 9 aa, BK virus
QALWHVIRD

SEQ ID NO: 58864 - protein, 15 aa, BK virus
LFATISQALWHVIRD

SEQ ID NO: 58865 - protein, 9 aa, BK virus
SQALWHVIR

SEQ ID NO: 58866 - protein, 15 aa, BK virus
TTWTIVNAPINFYNY

SEQ ID NO: 58867 - protein, 9 aa, BK virus
IVNAPINFY

SEQ ID NO: 58868 - protein, 15 aa, BK virus
GYRFFSDWDHKVSTV

SEQ ID NO: 58869 - protein, 9 aa, BK virus
YRFFSDWDH

SEQ ID NO: 58870 - protein, 15 aa, BK virus
SLARFLEETTWTIVN

SEQ ID NO: 58871 - protein, 9 aa, BK virus
FLEETTWTI

SEQ ID NO: 58872 - protein, 15 aa, BK virus
GVNTFVNNIQYLDPR

SEQ ID NO: 58873 - protein, 9 aa, BK virus
VNTFVNNIQ

SEQ ID NO: 58874 - protein, 15 aa, BK virus
VNTFVNNIQYLDPRH

SEQ ID NO: 58875 - protein, 9 aa, BK virus
VNTFVNNIQ

SEQ ID NO: 58876 - protein, 15 aa, BK virus
PSLFATISQALWHVI

SEQ ID NO: 58877 - protein, 9 aa, BK virus
LFATISQAL

SEQ ID NO: 58878 - protein, 15 aa, BK virus
GPSLFATISQALWHV

SEQ ID NO: 58879 - protein, 9 aa, BK virus
LFATISQAL

SEQ ID NO: 58880 - protein, 15 aa, BK virus
WGPSLFATISQALWH

SEQ ID NO: 58881 - protein, 9 aa, BK virus
LFATISQAL

SEQ ID NO: 58882 - protein, 15 aa, BK virus
HWGPSLFATISQALW

SEQ ID NO: 58883 - protein, 9 aa, BK virus
LFATISQAL

SEQ ID NO: 58884 - protein, 15 aa, BK virus
RHWGPSLFATISQAL

SEQ ID NO: 58885 - protein, 9 aa, BK virus
WGPSLFATI

SEQ ID NO: 58886 - protein, 15 aa, BK virus
YSNLSPIRPSMVRQV

SEQ ID NO: 58887 - protein, 9 aa, BK virus
LSPIRPSMV

SEQ ID NO: 58888 - protein, 15 aa, BK virus
SNLSPIRPSMVRQVA

SEQ ID NO: 58889 - protein, 9 aa, BK virus
LSPIRPSMV

SEQ ID NO: 58890 - protein, 15 aa, BK virus
QDYYSNLSPIRPSMV

SEQ ID NO: 58891 - protein, 9 aa, BK virus
YYSNLSPIR

SEQ ID NO: 58892 - protein, 15 aa, BK virus
DYYSNLSPIRPSMVR

SEQ ID NO: 58893 - protein, 9 aa, BK virus
LSPIRPSMV

SEQ ID NO: 58894 - protein, 15 aa, BK virus
YYSNLSPIRPSMVRQ

SEQ ID NO: 58895 - protein, 9 aa, BK virus
LSPIRPSMV

SEQ ID NO: 58896 - protein, 15 aa, BK virus
ARFLEETTWTIVNAP

SEQ ID NO: 58897 - protein, 9 aa, BK virus
FLEETTWTI

SEQ ID NO: 58898 - protein, 15 aa, BK virus
DSLARFLEETTWTIV

SEQ ID NO: 58899 - protein, 9 aa, BK virus
FLEETTWTI

SEQ ID NO: 58900 - protein, 15 aa, BK virus
LARFLEETTWTIVNA

SEQ ID NO: 58901 - protein, 9 aa, BK virus
FLEETTWTI

SEQ ID NO: 58902 - protein, 15 aa, BK virus
SLARFLEETTWTIVN

SEQ ID NO: 58903 - protein, 9 aa, BK virus
FLEETTWTI

SEQ ID NO: 58904 - protein, 15 aa, BK virus
SLFATISQALWHVIR

SEQ ID NO: 58905 - protein, 9 aa, BK virus
LFATISQAL

SEQ ID NO: 58906 - protein, 15 aa, BK virus
LFATISQALWHVIRD

SEQ ID NO: 58907 - protein, 9 aa, BK virus
LFATISQAL

SEQ ID NO: 58908 - protein, 15 aa, BK virus
RFLEETTWTIVNAPI

SEQ ID NO: 58909 - protein, 9 aa, BK virus
LEETTWTIV

SEQ ID NO: 58910 - protein, 15 aa, BK virus
NLSPIRPSMVRQVAE

SEQ ID NO: 58911 - protein, 9 aa, BK virus
LSPIRPSMV

SEQ ID NO: 58912 - protein, 15 aa, BK virus
LSPIRPSMVRQVAER

SEQ ID NO: 58913 - protein, 9 aa, BK virus
LSPIRPSMV

SEQ ID NO: 58914 - protein, 15 aa, BK virus
FLEETTWTIVNAPIN

SEQ ID NO: 58915 - protein, 9 aa, BK virus
FLEETTWTI

SEQ ID NO: 58916 - protein, 15 aa, BK virus
IAAIGLTPQTYAVIA

SEQ ID NO: 58917 - protein, 9 aa, BK virus
LTPQTYAVI

SEQ ID NO: 58918 - protein, 15 aa, BK virus
AIAAIGLTPQTYAVI

SEQ ID NO: 58919 - protein, 9 aa, BK virus
AIGLTPQTY

SEQ ID NO: 58920 - protein, 15 aa, BK virus
AAIGLTPQTYAVIAG

SEQ ID NO: 58921 - protein, 9 aa, BK virus
LTPQTYAVI

SEQ ID NO: 58922 - protein, 15 aa, BK virus
AIGLTPQTYAVIAGA

SEQ ID NO: 58923 - protein, 9 aa, BK virus
LTPQTYAVI

SEQ ID NO: 58924 - protein, 15 aa, BK virus
IGLTPQTYAVIAGAP

SEQ ID NO: 58925 - protein, 9 aa, BK virus
LTPQTYAVI

SEQ ID NO: 58926 - protein, 15 aa, BK virus
RDSLARFLEETTWTI

SEQ ID NO: 58927 - protein, 9 aa, BK virus
RDSLARFLE

SEQ ID NO: 58928 - protein, 15 aa, BK virus
HVIRDDIPAITSQEL

SEQ ID NO: 58929 - protein, 9 aa, BK virus
VIRDDIPAI

SEQ ID NO: 58930 - protein, 15 aa, BK virus
YDILFPGVNTFVNNI

SEQ ID NO: 58931 - protein, 9 aa, BK virus
LFPGVNTFV

SEQ ID NO: 58932 - protein, 15 aa, BK virus
VIRDDIPAITSQELQ

SEQ ID NO: 58933 - protein, 9 aa, BK virus
IPAITSQEL

SEQ ID NO: 58934 - protein, 15 aa, BK virus
DILFPGVNTFVNNIQ

SEQ ID NO: 58935 - protein, 9 aa, BK virus
LFPGVNTFV

SEQ ID NO: 58936 - protein, 15 aa, BK virus
IRDDIPAITSQELQR

SEQ ID NO: 58937 - protein, 9 aa, BK virus
IPAITSQEL

SEQ ID NO: 58938 - protein, 15 aa, BK virus
RDDIPAITSQELQRR

SEQ ID NO: 58939 - protein, 9 aa, BK virus
IPAITSQEL

SEQ ID NO: 58940 - protein, 15 aa, BK virus
DDIPAITSQELQRRT

SEQ ID NO: 58941 - protein, 9 aa, BK virus
IPAITSQEL

SEQ ID NO: 58942 - protein, 15 aa, BK virus
EYYDILFPGVNTFVN

SEQ ID NO: 58943 - protein, 9 aa, BK virus
LFPGVNTFV

SEQ ID NO: 58944 - protein, 15 aa, BK virus
YYDILFPGVNTFVNN

SEQ ID NO: 58945 - protein, 9 aa, BK virus
FPGVNTFVN

SEQ ID NO: 58946 - protein, 15 aa, BK virus
ILFPGVNTFVNNIQY

SEQ ID NO: 58947 - protein, 9 aa, BK virus
FPGVNTFVN

SEQ ID NO: 58948 - protein, 15 aa, BK virus
FATISQALWHVIRDD

SEQ ID NO: 58949 - protein, 9 aa, BK virus
ISQALWHVI

SEQ ID NO: 58950 - protein, 15 aa, BK virus
YIQDYYSNLSPIRPS

SEQ ID NO: 58951 - protein, 9 aa, BK virus
YSNLSPIRP

SEQ ID NO: 58952 - protein, 15 aa, BK virus
NYIQDYYSNLSPIRP

SEQ ID NO: 58953 - protein, 9 aa, BK virus
YYSNLSPIR

SEQ ID NO: 58954 - protein, 15 aa, BK virus
IQDYYSNLSPIRPSM

SEQ ID NO: 58955 - protein, 9 aa, BK virus
YSNLSPIRP

SEQ ID NO: 58956 - protein, 15 aa, BK virus
QDYYSNLSPIRPSMV

SEQ ID NO: 58957 - protein, 9 aa, BK virus
YSNLSPIRP

SEQ ID NO: 58958 - protein, 15 aa, BK virus
STVGLYQQSGMALEL

SEQ ID NO: 58959 - protein, 9 aa, BK virus
YQQSGMALE

SEQ ID NO: 58960 - protein, 15 aa, BK virus
TVGLYQQSGMALELF

SEQ ID NO: 58961 - protein, 9 aa, BK virus
YQQSGMALE

SEQ ID NO: 58962 - protein, 15 aa, BK virus
VGLYQQSGMALELFN

SEQ ID NO: 58963 - protein, 9 aa, BK virus
YQQSGMALE

SEQ ID NO: 58964 - protein, 15 aa, BK virus
VSTVGLYQQSGMALE

SEQ ID NO: 58965 - protein, 9 aa, BK virus
LYQQSGMAL

SEQ ID NO: 58966 - protein, 15 aa, BK virus
AAIEVQIASLATVEG

SEQ ID NO: 58967 - protein, 9 aa, BK virus
VQIASLATV

SEQ ID NO: 58968 - protein, 15 aa, BK virus
AAAIEVQIASLATVE

SEQ ID NO: 58969 - protein, 9 aa, BK virus
VQIASLATV

SEQ ID NO: 58970 - protein, 15 aa, BK virus
EETTWTIVNAPINFY

SEQ ID NO: 58971 - protein, 9 aa, BK virus
WTIVNAPIN

SEQ ID NO: 58972 - protein, 15 aa, BK virus
ETTWTIVNAPINFYN

SEQ ID NO: 58973 - protein, 9 aa, BK virus
WTIVNAPIN

SEQ ID NO: 58974 - protein, 15 aa, BK virus
AIEVQIASLATVEGI

SEQ ID NO: 58975 - protein, 9 aa, BK virus
VQIASLATV

SEQ ID NO: 58976 - protein, 15 aa, BK virus
AAAAIEVQIASLATV

SEQ ID NO: 58977 - protein, 9 aa, BK virus
IEVQIASLA

SEQ ID NO: 58978 - protein, 15 aa, BK virus
IEVQIASLATVEGIT

SEQ ID NO: 58979 - protein, 9 aa, BK virus
VQIASLATV

SEQ ID NO: 58980 - protein, 15 aa, BK virus
LLLGLYGTVTPALEA

SEQ ID NO: 58981 - protein, 9 aa, BK virus
LYGTVTPAL

SEQ ID NO: 58982 - protein, 15 aa, BK virus
TTWTIVNAPINFYNY

SEQ ID NO: 58983 - protein, 9 aa, BK virus
WTIVNAPIN

SEQ ID NO: 58984 - protein, 15 aa, BK virus
PLLLGLYGTVTPALE

SEQ ID NO: 58985 - protein, 9 aa, BK virus
LYGTVTPAL

SEQ ID NO: 58986 - protein, 15 aa, BK virus
LGLYGTVTPALEAYE

SEQ ID NO: 58987 - protein, 9 aa, BK virus
LYGTVTPAL

SEQ ID NO: 58988 - protein, 15 aa, BK virus
LLGLYGTVTPALEAY

SEQ ID NO: 58989 - protein, 9 aa, BK virus
LYGTVTPAL

SEQ ID NO: 58990 - protein, 15 aa, BK virus
GLYQQSGMALELFNP

SEQ ID NO: 58991 - protein, 9 aa, BK virus
YQQSGMALE

SEQ ID NO: 58992 - protein, 15 aa, BK virus
RRTERFFRDSLARFL

SEQ ID NO: 58993 - protein, 9 aa, BK virus
FFRDSLARF

SEQ ID NO: 58994 - protein, 15 aa, BK virus
RTERFFRDSLARFLE

SEQ ID NO: 58995 - protein, 9 aa, BK virus
FRDSLARFL

SEQ ID NO: 58996 - protein, 15 aa, BK virus
ERFFRDSLARFLEET

SEQ ID NO: 58997 - protein, 9 aa, BK virus
FRDSLARFL

SEQ ID NO: 58998 - protein, 15 aa, BK virus
TERFFRDSLARFLEE

SEQ ID NO: 58999 - protein, 9 aa, BK virus
FRDSLARFL

SEQ ID NO: 59000 - protein, 15 aa, BK virus
RFFRDSLARFLEETT

SEQ ID NO: 59001 - protein, 9 aa, BK virus
FRDSLARFL

SEQ ID NO: 59002 - protein, 15 aa, BK virus
LPLLLGLYGTVTPAL

SEQ ID NO: 59003 - protein, 9 aa, BK virus
LGLYGTVTP

SEQ ID NO: 59004 - protein, 15 aa, BK virus
PQTYAVIAGAPGAIA

SEQ ID NO: 59005 - protein, 9 aa, BK virus
VIAGAPGAI

SEQ ID NO: 59006 - protein, 15 aa, BK virus
QTYAVIAGAPGAIAG

SEQ ID NO: 59007 - protein, 9 aa, BK virus
VIAGAPGAI

SEQ ID NO: 59008 - protein, 15 aa, BK virus
TYAVIAGAPGAIAGF

SEQ ID NO: 59009 - protein, 9 aa, BK virus
VIAGAPGAI

SEQ ID NO: 59010 - protein, 15 aa, BK virus
FPGVNTFVNNIQYLD

SEQ ID NO: 59011 - protein, 9 aa, BK virus
VNTFVNNIQ

SEQ ID NO: 59012 - protein, 15 aa, BK virus
PGVNTFVNNIQYLDP

SEQ ID NO: 59013 - protein, 9 aa, BK virus
FVNNIQYLD

SEQ ID NO: 59014 - protein, 15 aa, BK virus
GVNTFVNNIQYLDPR

SEQ ID NO: 59015 - protein, 9 aa, BK virus
FVNNIQYLD

SEQ ID NO: 59016 - protein, 15 aa, BK virus
VNTFVNNIQYLDPRH

SEQ ID NO: 59017 - protein, 9 aa, BK virus
FVNNIQYLD

SEQ ID NO: 59018 - protein, 15 aa, BK virus
NTFVNNIQYLDPRHW

SEQ ID NO: 59019 - protein, 9 aa, BK virus
FVNNIQYLD

SEQ ID NO: 59020 - protein, 15 aa, BK virus
NYIQDYYSNLSPIRP

SEQ ID NO: 59021 - protein, 9 aa, BK virus
IQDYYSNLS

SEQ ID NO: 59022 - protein, 15 aa, BK virus
QDYYSNLSPIRPSMV

SEQ ID NO: 59023 - protein, 9 aa, BK virus
YSNLSPIRP

SEQ ID NO: 59024 - protein, 15 aa, BK virus
IQDYYSNLSPIRPSM

SEQ ID NO: 59025 - protein, 9 aa, BK virus
YSNLSPIRP

SEQ ID NO: 59026 - protein, 15 aa, BK virus
YIQDYYSNLSPIRPS

SEQ ID NO: 59027 - protein, 9 aa, BK virus
YSNLSPIRP

SEQ ID NO: 59028 - protein, 15 aa, BK virus
DYYSNLSPIRPSMVR

SEQ ID NO: 59029 - protein, 9 aa, BK virus
YSNLSPIRP

SEQ ID NO: 59030 - protein, 15 aa, BK virus
WMLPLLLGLYGTVTP

SEQ ID NO: 59031 - protein, 9 aa, BK virus
LLGLYGTVT

SEQ ID NO: 59032 - protein, 15 aa, BK virus
PLLLGLYGTVTPALE

SEQ ID NO: 59033 - protein, 9 aa, BK virus
LGLYGTVTP

SEQ ID NO: 59034 - protein, 15 aa, BK virus
MLPLLLGLYGTVTPA

SEQ ID NO: 59035 - protein, 9 aa, BK virus
LGLYGTVTP

SEQ ID NO: 59036 - protein, 15 aa, BK virus
LPLLLGLYGTVTPAL

SEQ ID NO: 59037 - protein, 9 aa, BK virus
LGLYGTVTP

SEQ ID NO: 59038 - protein, 15 aa, BK virus
LLLGLYGTVTPALEA

SEQ ID NO: 59039 - protein, 9 aa, BK virus
LGLYGTVTP

SEQ ID NO: 59040 - protein, 15 aa, BK virus
TFVNNIQYLDPRHWG

SEQ ID NO: 59041 - protein, 9 aa, BK virus
FVNNIQYLD

SEQ ID NO: 59042 - protein, 15 aa, BK virus
AAIEVQIASLATVEG

SEQ ID NO: 59043 - protein, 9 aa, BK virus
VQIASLATV

SEQ ID NO: 59044 - protein, 15 aa, BK virus
FVNNIQYLDPRHWGP

SEQ ID NO: 59045 - protein, 9 aa, BK virus
FVNNIQYLD

SEQ ID NO: 59046 - protein, 15 aa, BK virus
AIEVQIASLATVEGI

SEQ ID NO: 59047 - protein, 9 aa, BK virus
VQIASLATV

SEQ ID NO: 59048 - protein, 15 aa, BK virus
IEVQIASLATVEGIT

SEQ ID NO: 59049 - protein, 9 aa, BK virus
VQIASLATV

SEQ ID NO: 59050 - protein, 15 aa, BK virus
YYSNLSPIRPSMVRQ

SEQ ID NO: 59051 - protein, 9 aa, BK virus
YSNLSPIRP

SEQ ID NO: 59052 - protein, 15 aa, BK virus
ETTWTIVNAPINFYN

SEQ ID NO: 59053 - protein, 9 aa, BK virus
IVNAPINFY

SEQ ID NO: 59054 - protein, 15 aa, BK virus
TTWTIVNAPINFYNY

SEQ ID NO: 59055 - protein, 9 aa, BK virus
IVNAPINFY

SEQ ID NO: 59056 - protein, 15 aa, BK virus
EETTWTIVNAPINFY

SEQ ID NO: 59057 - protein, 9 aa, BK virus
WTIVNAPIN

SEQ ID NO: 59058 - protein, 15 aa, BK virus
LLGLYGTVTPALEAY

SEQ ID NO: 59059 - protein, 9 aa, BK virus
LGLYGTVTP

SEQ ID NO: 59060 - protein, 15 aa, BK virus
YSNLSPIRPSMVRQV

SEQ ID NO: 59061 - protein, 9 aa, BK virus
YSNLSPIRP

SEQ ID NO: 59062 - protein, 15 aa, BK virus
TWTIVNAPINFYNYI

SEQ ID NO: 59063 - protein, 9 aa, BK virus
IVNAPINFY

SEQ ID NO: 59064 - protein, 15 aa, BK virus
AGFAALIQTVTGISS

SEQ ID NO: 59065 - protein, 9 aa, BK virus
FAALIQTVT

SEQ ID NO: 59066 - protein, 15 aa, BK virus
AAAAIEVQIASLATV

SEQ ID NO: 59067 - protein, 9 aa, BK virus
IEVQIASLA

SEQ ID NO: 59068 - protein, 15 aa, BK virus
WTIVNAPINFYNYIQ

SEQ ID NO: 59069 - protein, 9 aa, BK virus
IVNAPINFY

SEQ ID NO: 59070 - protein, 15 aa, BK virus
AAAIEVQIASLATVE

SEQ ID NO: 59071 - protein, 9 aa, BK virus
VQIASLATV

SEQ ID NO: 59072 - protein, 15 aa, BK virus
LGLYGTVTPALEAYE

SEQ ID NO: 59073 - protein, 9 aa, BK virus
LGLYGTVTP

SEQ ID NO: 59074 - protein, 15 aa, BK virus
VQIASLATVEGITTT

SEQ ID NO: 59075 - protein, 9 aa, BK virus
IASLATVEG

SEQ ID NO: 59076 - protein, 15 aa, BK virus
GFAALIQTVTGISSL

SEQ ID NO: 59077 - protein, 9 aa, BK virus
IQTVTGISS

SEQ ID NO: 59078 - protein, 15 aa, BK virus
EVQIASLATVEGITT

SEQ ID NO: 59079 - protein, 9 aa, BK virus
IASLATVEG

SEQ ID NO: 59080 - protein, 15 aa, BK virus
FAALIQTVTGISSLA

SEQ ID NO: 59081 - protein, 9 aa, BK virus
IQTVTGISS

SEQ ID NO: 59082 - protein, 15 aa, BK virus
IAGFAALIQTVTGIS

SEQ ID NO: 59083 - protein, 9 aa, BK virus
FAALIQTVT

SEQ ID NO: 59084 - protein, 15 aa, BK virus
AALIQTVTGISSLAQ

SEQ ID NO: 59085 - protein, 9 aa, BK virus
IQTVTGISS

SEQ ID NO: 59086 - protein, 15 aa, BK virus
ALIQTVTGISSLAQV

SEQ ID NO: 59087 - protein, 9 aa, BK virus
IQTVTGISS

SEQ ID NO: 59088 - protein, 15 aa, BK virus
VSTVGLYQQSGMALE

SEQ ID NO: 59089 - protein, 9 aa, BK virus
VGLYQQSGM

SEQ ID NO: 59090 - protein, 15 aa, BK virus
DILFPGVNTFVNNIQ

SEQ ID NO: 59091 - protein, 9 aa, BK virus
FPGVNTFVN

SEQ ID NO: 59092 - protein, 15 aa, BK virus
ILFPGVNTFVNNIQY

SEQ ID NO: 59093 - protein, 9 aa, BK virus
VNTFVNNIQ

SEQ ID NO: 59094 - protein, 15 aa, BK virus
TIVNAPINFYNYIQD

SEQ ID NO: 59095 - protein, 9 aa, BK virus
IVNAPINFY

SEQ ID NO: 59096 - protein, 15 aa, BK virus
STVGLYQQSGMALEL

SEQ ID NO: 59097 - protein, 9 aa, BK virus
VGLYQQSGM

SEQ ID NO: 59098 - protein, 15 aa, BK virus
TQRMDLRNKESVHSG

SEQ ID NO: 59099 - protein, 9 aa, BK virus
LRNKESVHS

SEQ ID NO: 59100 - protein, 15 aa, BK virus
VTQRMDLRNKESVHS

SEQ ID NO: 59101 - protein, 9 aa, BK virus
TQRMDLRNK

SEQ ID NO: 59102 - protein, 15 aa, BK virus
QRMDLRNKESVHSGE

SEQ ID NO: 59103 - protein, 9 aa, BK virus
LRNKESVHS

SEQ ID NO: 59104 - protein, 15 aa, BK virus
RMDLRNKESVHSGEF

SEQ ID NO: 59105 - protein, 9 aa, BK virus
LRNKESVHS

SEQ ID NO: 59106 - protein, 15 aa, BK virus
QWMLPLLLGLYGTVT

SEQ ID NO: 59107 - protein, 9 aa, BK virus
MLPLLLGLY

SEQ ID NO: 59108 - protein, 15 aa, BK virus
WMLPLLLGLYGTVTP

SEQ ID NO: 59109 - protein, 9 aa, BK virus
LLGLYGTVT

SEQ ID NO: 59110 - protein, 15 aa, BK virus
MDLRNKESVHSGEFI

SEQ ID NO: 59111 - protein, 9 aa, BK virus
LRNKESVHS

SEQ ID NO: 59112 - protein, 15 aa, BK virus
MLPLLLGLYGTVTPA

SEQ ID NO: 59113 - protein, 9 aa, BK virus
LLGLYGTVT

SEQ ID NO: 59114 - protein, 15 aa, BK virus
LPLLLGLYGTVTPAL

SEQ ID NO: 59115 - protein, 9 aa, BK virus
LLGLYGTVT

SEQ ID NO: 59116 - protein, 15 aa, BK virus
PLLLGLYGTVTPALE

SEQ ID NO: 59117 - protein, 9 aa, BK virus
LLGLYGTVT

SEQ ID NO: 59118 - protein, 15 aa, BK virus
NYIQDYYSNLSPIRP

SEQ ID NO: 59119 - protein, 9 aa, BK virus
IQDYYSNLS

SEQ ID NO: 59120 - protein, 15 aa, BK virus
QDYYSNLSPIRPSMV

SEQ ID NO: 59121 - protein, 9 aa, BK virus
YYSNLSPIR

SEQ ID NO: 59122 - protein, 15 aa, BK virus
YIQDYYSNLSPIRPS

SEQ ID NO: 59123 - protein, 9 aa, BK virus
YSNLSPIRP

SEQ ID NO: 59124 - protein, 15 aa, BK virus
IQDYYSNLSPIRPSM

SEQ ID NO: 59125 - protein, 9 aa, BK virus
YSNLSPIRP

SEQ ID NO: 59126 - protein, 15 aa, BK virus
NYIQDYYSNLSPIRP

SEQ ID NO: 59127 - protein, 9 aa, BK virus
YYSNLSPIR

SEQ ID NO: 59128 - protein, 15 aa, BK virus
DYYSNLSPIRPSMVR

SEQ ID NO: 59129 - protein, 9 aa, BK virus
YSNLSPIRP

SEQ ID NO: 59130 - protein, 15 aa, BK virus
YYSNLSPIRPSMVRQ

SEQ ID NO: 59131 - protein, 9 aa, BK virus
YYSNLSPIR

SEQ ID NO: 59132 - protein, 15 aa, BK virus
PAITSQELQRRTERF

SEQ ID NO: 59133 - protein, 9 aa, BK virus
ITSQELQRR

SEQ ID NO: 59134 - protein, 15 aa, BK virus
IPAITSQELQRRTER

SEQ ID NO: 59135 - protein, 9 aa, BK virus
ITSQELQRR

SEQ ID NO: 59136 - protein, 15 aa, BK Virus
QGVLMNYRTKYPQGT

SEQ ID NO: 59137 - protein, 9 aa, BK Virus
LMNYRTKYP

SEQ ID NO: 59138 - protein, 15 aa, BK Virus
GVLMNYRTKYPQGTI

SEQ ID NO: 59139 - protein, 9 aa, BK Virus
YRTKYPQGT

SEQ ID NO: 59140 - protein, 15 aa, BK Virus
VLMNYRTKYPQGTIT

SEQ ID NO: 59141 - protein, 9 aa, BK Virus
YRTKYPQGT

SEQ ID NO: 59142 - protein, 15 aa, BK Virus
LMNYRTKYPQGTITP

SEQ ID NO: 59143 - protein, 9 aa, BK Virus
YRTKYPQGT

SEQ ID NO: 59144 - protein, 15 aa, BK Virus
MNYRTKYPQGTITPK

SEQ ID NO: 59145 - protein, 9 aa, BK Virus
YRTKYPQGT

SEQ ID NO: 59146 - protein, 15 aa, BK Virus
KTEVIGITSMLNLHA

SEQ ID NO: 59147 - protein, 9 aa, BK Virus
VIGITSMLN

SEQ ID NO: 59148 - protein, 15 aa, BK Virus
TEVIGITSMLNLHAG

SEQ ID NO: 59149 - protein, 9 aa, BK Virus
VIGITSMLN

SEQ ID NO: 59150 - protein, 15 aa, BK Virus
PPVLHVTNTATTVLL

SEQ ID NO: 59151 - protein, 9 aa, BK Virus
VTNTATTVL

SEQ ID NO: 59152 - protein, 15 aa, BK Virus
PVLHVTNTATTVLLD

SEQ ID NO: 59153 - protein, 9 aa, BK Virus
VTNTATTVL

SEQ ID NO: 59154 - protein, 15 aa, BK Virus
VLHVTNTATTVLLDE

SEQ ID NO: 59155 - protein, 9 aa, BK Virus
VTNTATTVL

SEQ ID NO: 59156 - protein, 15 aa, BK Virus
VPPVLHVTNTATTVL

SEQ ID NO: 59157 - protein, 9 aa, BK Virus
VLHVTNTAT

SEQ ID NO: 59158 - protein, 15 aa, BK Virus
LHVTNTATTVLLDEQ

SEQ ID NO: 59159 - protein, 9 aa, BK Virus
VTNTATTVL

SEQ ID NO: 59160 - protein, 15 aa, BK Virus
VIGITSMLNLHAGSQ

SEQ ID NO: 59161 - protein, 9 aa, BK Virus
VIGITSMLN

SEQ ID NO: 59162 - protein, 15 aa, BK Virus
EVIGITSMLNLHAGS

SEQ ID NO: 59163 - protein, 9 aa, BK Virus
VIGITSMLN

SEQ ID NO: 59164 - protein, 15 aa, BK Virus
ADICGLFTNSSGTQQ

SEQ ID NO: 59165 - protein, 9 aa, BK Virus
ICGLFTNSS

SEQ ID NO: 59166 - protein, 15 aa, BK Virus
YVSAADICGLFTNSS

SEQ ID NO: 59167 - protein, 9 aa, BK Virus
YVSAADICG

SEQ ID NO: 59168 - protein, 15 aa, BK Virus
VKTEVIGITSMLNLH

SEQ ID NO: 59169 - protein, 9 aa, BK Virus
VIGITSMLN

SEQ ID NO: 59170 - protein, 15 aa, BK Virus
TVKTEVIGITSMLNL

SEQ ID NO: 59171 - protein, 9 aa, BK Virus
VIGITSMLN

SEQ ID NO: 59172 - protein, 15 aa, BK Virus
VTVKTEVIGITSMLN

SEQ ID NO: 59173 - protein, 9 aa, BK Virus
EVIGITSML

SEQ ID NO: 59174 - protein, 15 aa, BK Virus
NYRTKYPQGTITPKN

SEQ ID NO: 59175 - protein, 9 aa, BK Virus
YRTKYPQGT

SEQ ID NO: 59176 - protein, 15 aa, BK Virus
AADICGLFTNSSGTQ

SEQ ID NO: 59177 - protein, 9 aa, BK Virus
ICGLFTNSS

SEQ ID NO: 59178 - protein, 15 aa, BK Virus
YRTKYPQGTITPKNP

SEQ ID NO: 59179 - protein, 9 aa, BK Virus
YRTKYPQGT

SEQ ID NO: 59180 - protein, 15 aa, BK Virus
SAADICGLFTNSSGT

SEQ ID NO: 59181 - protein, 9 aa, BK Virus
ICGLFTNSS

SEQ ID NO: 59182 - protein, 15 aa, BK Virus
VSAADICGLFTNSSG

SEQ ID NO: 59183 - protein, 9 aa, BK Virus
ICGLFTNSS

SEQ ID NO: 59184 - protein, 15 aa, BK Virus
FLLSDLINRRTQKVD

SEQ ID NO: 59185 - protein, 9 aa, BK Virus
LINRRTQKV

SEQ ID NO: 59186 - protein, 15 aa, BK Virus
SFLLSDLINRRTQKV

SEQ ID NO: 59187 - protein, 9 aa, BK Virus
LSDLINRRT

SEQ ID NO: 59188 - protein, 15 aa, BK Virus
TCGNLLMWEAVTVKT

SEQ ID NO: 59189 - protein, 9 aa, BK Virus
LLMWEAVTV

SEQ ID NO: 59190 - protein, 15 aa, BK Virus
CGNLLMWEAVTVKTE

SEQ ID NO: 59191 - protein, 9 aa, BK Virus
LLMWEAVTV

SEQ ID NO: 59192 - protein, 15 aa, BK Virus
GNLLMWEAVTVKTEV

SEQ ID NO: 59193 - protein, 9 aa, BK Virus
LLMWEAVTV

SEQ ID NO: 59194 - protein, 15 aa, BK Virus
LLSDLINRRTQKVDG

SEQ ID NO: 59195 - protein, 9 aa, BK Virus
LINRRTQKV

SEQ ID NO: 59196 - protein, 15 aa, BK Virus
LSDLINRRTQKVDGQ

SEQ ID NO: 59197 - protein, 9 aa, BK Virus
LINRRTQKV

SEQ ID NO: 59198 - protein, 15 aa, BK Virus
SDLINRRTQKVDGQP

SEQ ID NO: 59199 - protein, 9 aa, BK Virus
LINRRTQKV

SEQ ID NO: 59200 - protein, 15 aa, BK Virus
IGITSMLNLHAGSQK

SEQ ID NO: 59201 - protein, 9 aa, BK Virus
ITSMLNLHA

SEQ ID NO: 59202 - protein, 15 aa, BK Virus
NLLMWEAVTVKTEVI

SEQ ID NO: 59203 - protein, 9 aa, BK Virus
MWEAVTVKT

SEQ ID NO: 59204 - protein, 15 aa, BK Virus
HVTNTATTVLLDEQG

SEQ ID NO: 59205 - protein, 9 aa, BK Virus
VTNTATTVL

SEQ ID NO: 59206 - protein, 15 aa, BK Virus
DICGLFTNSSGTQQW

SEQ ID NO: 59207 - protein, 9 aa, BK Virus
ICGLFTNSS

SEQ ID NO: 59208 - protein, 15 aa, BK Virus
ICGLFTNSSGTQQWR

SEQ ID NO: 59209 - protein, 9 aa, BK Virus
ICGLFTNSS

SEQ ID NO: 59210 - protein, 15 aa, BK Virus
LTCGNLLMWEAVTVK

SEQ ID NO: 59211 - protein, 9 aa, BK Virus
LLMWEAVTV

SEQ ID NO: 59212 - protein, 15 aa, BK Virus
KVDGQPMYGMESQVE

SEQ ID NO: 59213 - protein, 9 aa, BK Virus
VDGQPMYGM

SEQ ID NO: 59214 - protein, 15 aa, BK Virus
VDGQPMYGMESQVEE

SEQ ID NO: 59215 - protein, 9 aa, BK Virus
MYGMESQVE

SEQ ID NO: 59216 - protein, 15 aa, BK Virus
VTNTATTVLLDEQGV

SEQ ID NO: 59217 - protein, 9 aa, BK Virus
VTNTATTVL

SEQ ID NO: 59218 - protein, 15 aa, BK Virus
VGPLCKADSLYVSAA

SEQ ID NO: 59219 - protein, 9 aa, BK Virus
LCKADSLYV

SEQ ID NO: 59220 - protein, 15 aa, BK Virus
GPLCKADSLYVSAAD

SEQ ID NO: 59221 - protein, 9 aa, BK Virus
LCKADSLYV

SEQ ID NO: 59222 - protein, 15 aa, BK Virus
QGVGPLCKADSLYVS

SEQ ID NO: 59223 - protein, 9 aa, BK Virus
LCKADSLYV

SEQ ID NO: 59224 - protein, 15 aa, BK Virus
GVGPLCKADSLYVSA

SEQ ID NO: 59225 - protein, 9 aa, BK Virus
LCKADSLYV

SEQ ID NO: 59226 - protein, 15 aa, BK Virus
LLMWEAVTVKTEVIG

SEQ ID NO: 59227 - protein, 9 aa, BK Virus
MWEAVTVKT

SEQ ID NO: 59228 - protein, 15 aa, BK Virus
EQGVGPLCKADSLYV

SEQ ID NO: 59229 - protein, 9 aa, BK Virus
VGPLCKADS

SEQ ID NO: 59230 - protein, 15 aa, BK Virus
GITSMLNLHAGSQKV

SEQ ID NO: 59231 - protein, 9 aa, BK Virus
ITSMLNLHA

SEQ ID NO: 59232 - protein, 15 aa, BK Virus
ITSMLNLHAGSQKVH

SEQ ID NO: 59233 - protein, 9 aa, BK Virus
ITSMLNLHA

SEQ ID NO: 59234 - protein, 15 aa, BK Virus
GQPMYGMESQVEEVR

SEQ ID NO: 59235 - protein, 9 aa, BK Virus
MYGMESQVE

SEQ ID NO: 59236 - protein, 15 aa, BK Virus
DLTCGNLLMWEAVTV

SEQ ID NO: 59237 - protein, 9 aa, BK Virus
LTCGNLLMW

SEQ ID NO: 59238 - protein, 15 aa, BK Virus
DGQPMYGMESQVEEV

SEQ ID NO: 59239 - protein, 9 aa, BK Virus
MYGMESQVE

SEQ ID NO: 59240 - protein, 15 aa, BK Virus
TQKVDGQPMYGMESQ

SEQ ID NO: 59241 - protein, 9 aa, BK Virus
VDGQPMYGM

SEQ ID NO: 59242 - protein, 15 aa, BK Virus
DLINRRTQKVDGQPM

SEQ ID NO: 59243 - protein, 9 aa, BK Virus
LINRRTQKV

SEQ ID NO: 59244 - protein, 15 aa, BK Virus
RTQKVDGQPMYGMES

SEQ ID NO: 59245 - protein, 9 aa, BK Virus
VDGQPMYGM

SEQ ID NO: 59246 - protein, 15 aa, BK Virus
QKVDGQPMYGMESQV

SEQ ID NO: 59247 - protein, 9 aa, BK Virus
VDGQPMYGM

SEQ ID NO: 59248 - protein, 15 aa, BK Virus
QPMYGMESQVEEVRV

SEQ ID NO: 59249 - protein, 9 aa, BK Virus
MYGMESQVE

SEQ ID NO: 59250 - protein, 15 aa, BK Virus
LINRRTQKVDGQPMY

SEQ ID NO: 59251 - protein, 9 aa, BK Virus
LINRRTQKV

SEQ ID NO: 59252 - protein, 15 aa, BK Virus
LEMQGVLMNYRTKYP

SEQ ID NO: 59253 - protein, 9 aa, BK Virus
MQGVLMNYR

SEQ ID NO: 59254 - protein, 15 aa, BK Virus
GDPLEMQGVLMNYRT

SEQ ID NO: 59255 - protein, 9 aa, BK Virus
MQGVLMNYR

SEQ ID NO: 59256 - protein, 15 aa, BK Virus
CKADSLYVSAADICG

SEQ ID NO: 59257 - protein, 9 aa, BK Virus
ADSLYVSAA

SEQ ID NO: 59258 - protein, 15 aa, BK Virus
KADSLYVSAADICGL

SEQ ID NO: 59259 - protein, 9 aa, BK Virus
YVSAADICG

SEQ ID NO: 59260 - protein, 15 aa, BK Virus
RKMLPCYSTARIPLP

SEQ ID NO: 59261 - protein, 9 aa, BK Virus
RKMLPCYST

SEQ ID NO: 59262 - protein, 15 aa, BK Virus
ADSLYVSAADICGLF

SEQ ID NO: 59263 - protein, 9 aa, BK Virus
YVSAADICG

SEQ ID NO: 59264 - protein, 15 aa, BK Virus
DSLYVSAADICGLFT

SEQ ID NO: 59265 - protein, 9 aa, BK Virus
YVSAADICG

SEQ ID NO: 59266 - protein, 15 aa, BK Virus
DPLEMQGVLMNYRTK

SEQ ID NO: 59267 - protein, 9 aa, BK Virus
MQGVLMNYR

SEQ ID NO: 59268 - protein, 15 aa, BK Virus
SLYVSAADICGLFTN

SEQ ID NO: 59269 - protein, 9 aa, BK Virus
YVSAADICG

SEQ ID NO: 59270 - protein, 15 aa, BK Virus
SPDRKMLPCYSTARI

SEQ ID NO: 59271 - protein, 9 aa, BK Virus
RKMLPCYST

SEQ ID NO: 59272 - protein, 15 aa, BK Virus
LMWEAVTVKTEVIGI

SEQ ID NO: 59273 - protein, 9 aa, BK Virus
MWEAVTVKT

SEQ ID NO: 59274 - protein, 15 aa, BK Virus
NVPPVLHVTNTATTV

SEQ ID NO: 59275 - protein, 9 aa, BK Virus
LHVTNTATT

SEQ ID NO: 59276 - protein, 15 aa, BK Virus
GTITPKNPTAQSQVM

SEQ ID NO: 59277 - protein, 9 aa, BK Virus
ITPKNPTAQ

SEQ ID NO: 59278 - protein, 15 aa, BK Virus
PDRKMLPCYSTARIP

SEQ ID NO: 59279 - protein, 9 aa, BK Virus
RKMLPCYST

SEQ ID NO: 59280 - protein, 15 aa, BK Virus
PLCKADSLYVSAADI

SEQ ID NO: 59281 - protein, 9 aa, BK Virus
LCKADSLYV

SEQ ID NO: 59282 - protein, 15 aa, BK Virus
EMQGVLMNYRTKYPQ

SEQ ID NO: 59283 - protein, 9 aa, BK Virus
LMNYRTKYP

SEQ ID NO: 59284 - protein, 15 aa, BK Virus
DSPDRKMLPCYSTAR

SEQ ID NO: 59285 - protein, 9 aa, BK Virus
RKMLPCYST

SEQ ID NO: 59286 - protein, 15 aa, BK Virus
LCKADSLYVSAADIC

SEQ ID NO: 59287 - protein, 9 aa, BK Virus
LCKADSLYV

SEQ ID NO: 59288 - protein, 15 aa, BK Virus
KRSVKNPYPISFLLS

SEQ ID NO: 59289 - protein, 9 aa, BK Virus
VKNPYPISF

SEQ ID NO: 59290 - protein, 15 aa, BK Virus
RRTQKVDGQPMYGME

SEQ ID NO: 59291 - protein, 9 aa, BK Virus
VDGQPMYGM

SEQ ID NO: 59292 - protein, 15 aa, BK Virus
GGDPLEMQGVLMNYR

SEQ ID NO: 59293 - protein, 9 aa, BK Virus
LEMQGVLMN

SEQ ID NO: 59294 - protein, 15 aa, BK Virus
RSVKNPYPISFLLSD

SEQ ID NO: 59295 - protein, 9 aa, BK Virus
VKNPYPISF

SEQ ID NO: 59296 - protein, 15 aa, BK Virus
NRRTQKVDGQPMYGM

SEQ ID NO: 59297 - protein, 9 aa, BK Virus
KVDGQPMYG

SEQ ID NO: 59298 - protein, 15 aa, BK Virus
PLEMQGVLMNYRTKY

SEQ ID NO: 59299 - protein, 9 aa, BK Virus
MQGVLMNYR

SEQ ID NO: 59300 - protein, 15 aa, BK Virus
CGLFTNSSGTQQWRG

SEQ ID NO: 59301 - protein, 9 aa, BK Virus
FTNSSGTQQ

SEQ ID NO: 59302 - protein, 15 aa, BK Virus
LRKRSVKNPYPISFL

SEQ ID NO: 59303 - protein, 9 aa, BK Virus
VKNPYPISF

SEQ ID NO: 59304 - protein, 15 aa, BK Virus
MQGVLMNYRTKYPQG

SEQ ID NO: 59305 - protein, 9 aa, BK Virus
LMNYRTKYP

SEQ ID NO: 59306 - protein, 15 aa, BK Virus
ENVPPVLHVTNTATT

SEQ ID NO: 59307 - protein, 9 aa, BK Virus
VLHVTNTAT

SEQ ID NO: 59308 - protein, 15 aa, BK Virus
RKRSVKNPYPISFLL

SEQ ID NO: 59309 - protein, 9 aa, BK Virus
VKNPYPISF

SEQ ID NO: 59310 - protein, 15 aa, BK Virus
GLFTNSSGTQQWRGL

SEQ ID NO: 59311 - protein, 9 aa, BK Virus
FTNSSGTQQ

SEQ ID NO: 59312 - protein, 15 aa, BK Virus
PQGTITPKNPTAQSQ

SEQ ID NO: 59313 - protein, 9 aa, BK Virus
ITPKNPTAQ

SEQ ID NO: 59314 - protein, 15 aa, BK Virus
QGTITPKNPTAQSQV

SEQ ID NO: 59315 - protein, 9 aa, BK Virus
ITPKNPTAQ

SEQ ID NO: 59316 - protein, 15 aa, BK Virus
RLRKRSVKNPYPISF

SEQ ID NO: 59317 - protein, 9 aa, BK Virus
LRKRSVKNP

SEQ ID NO: 59318 - protein, 15 aa, BK Virus
TSMLNLHAGSQKVHE

SEQ ID NO: 59319 - protein, 9 aa, BK Virus
MLNLHAGSQ

SEQ ID NO: 59320 - protein, 15 aa, BK Virus
DNLRGYSQHLSAENA

SEQ ID NO: 59321 - protein, 9 aa, BK Virus
LRGYSQHLS

SEQ ID NO: 59322 - protein, 15 aa, BK Virus
DRKMLPCYSTARIPL

SEQ ID NO: 59323 - protein, 9 aa, BK Virus
MLPCYSTAR

SEQ ID NO: 59324 - protein, 15 aa, BK Virus
LPCYSTARIPLPNLN

SEQ ID NO: 59325 - protein, 9 aa, BK Virus
YSTARIPLP

SEQ ID NO: 59326 - protein, 15 aa, BK Virus
KMLPCYSTARIPLPN

SEQ ID NO: 59327 - protein, 9 aa, BK Virus
YSTARIPLP

SEQ ID NO: 59328 - protein, 15 aa, BK Virus
IRYIDRQGQLQTKMV

SEQ ID NO: 59329 - protein, 9 aa, BK Virus
YIDRQGQLQ

SEQ ID NO: 59330 - protein, 15 aa, BK Virus
MWEAVTVKTEVIGIT

SEQ ID NO: 59331 - protein, 9 aa, BK Virus
MWEAVTVKT

SEQ ID NO: 59332 - protein, 15 aa, BK Virus
PCYSTARIPLPNLNE

SEQ ID NO: 59333 - protein, 9 aa, BK Virus
YSTARIPLP

SEQ ID NO: 59334 - protein, 15 aa, BK Virus
MLPCYSTARIPLPNL

SEQ ID NO: 59335 - protein, 9 aa, BK Virus
YSTARIPLP

SEQ ID NO: 59336 - protein, 15 aa, BK Virus
VQVPKLLIKGGVEVL

SEQ ID NO: 59337 - protein, 9 aa, BK Virus
LLIKGGVEV

SEQ ID NO: 59338 - protein, 15 aa, BK Virus
DDNLRGYSQHLSAEN

SEQ ID NO: 59339 - protein, 9 aa, BK Virus
LRGYSQHLS

SEQ ID NO: 59340 - protein, 15 aa, BK Virus
ITPKNPTAQSQVMNT

SEQ ID NO: 59341 - protein, 9 aa, BK Virus
ITPKNPTAQ

SEQ ID NO: 59342 - protein, 15 aa, BK Virus
ARYFKIRLRKRSVKN

SEQ ID NO: 59343 - protein, 9 aa, BK Virus
FKIRLRKRS

SEQ ID NO: 59344 - protein, 15 aa, BK Virus
AVGGDPLEMQGVLMN

SEQ ID NO: 59345 - protein, 9 aa, BK Virus
GDPLEMQGV

SEQ ID NO: 59346 - protein, 15 aa, BK Virus
LARYFKIRLRKRSVK

SEQ ID NO: 59347 - protein, 9 aa, BK Virus
FKIRLRKRS

SEQ ID NO: 59348 - protein, 15 aa, BK Virus
TITPKNPTAQSQVMN

SEQ ID NO: 59349 - protein, 9 aa, BK Virus
ITPKNPTAQ

SEQ ID NO: 59350 - protein, 15 aa, BK Virus
RGLARYFKIRLRKRS

SEQ ID NO: 59351 - protein, 9 aa, BK Virus
YFKIRLRKR

SEQ ID NO: 59352 - protein, 15 aa, BK Virus
GLARYFKIRLRKRSV

SEQ ID NO: 59353 - protein, 9 aa, BK Virus
FKIRLRKRS

SEQ ID NO: 59354 - protein, 15 aa, BK Virus
KYPQGTITPKNPTAQ

SEQ ID NO: 59355 - protein, 9 aa, BK Virus
PQGTITPKN

SEQ ID NO: 59356 - protein, 15 aa, BK Virus
YPQGTITPKNPTAQS

SEQ ID NO: 59357 - protein, 9 aa, BK Virus
ITPKNPTAQ

SEQ ID NO: 59358 - protein, 15 aa, BK Virus
GTYTGGENVPPVLHV

SEQ ID NO: 59359 - protein, 9 aa, BK Virus
YTGGENVPP

SEQ ID NO: 59360 - protein, 15 aa, BK Virus
PMYGMESQVEEVRVF

SEQ ID NO: 59361 - protein, 9 aa, BK Virus
MYGMESQVE

SEQ ID NO: 59362 - protein, 15 aa, BK Virus
VGGDPLEMQGVLMNY

SEQ ID NO: 59363 - protein, 9 aa, BK Virus
LEMQGVLMN

SEQ ID NO: 59364 - protein, 15 aa, BK Virus
VPKLLIKGGVEVLEV

SEQ ID NO: 59365 - protein, 9 aa, BK Virus
LLIKGGVEV

SEQ ID NO: 59366 - protein, 15 aa, BK Virus
QVPKLLIKGGVEVLE

SEQ ID NO: 59367 - protein, 9 aa, BK Virus
LLIKGGVEV

SEQ ID NO: 59368 - protein, 15 aa, BK Virus
PVQVPKLLIKGGVEV

SEQ ID NO: 59369 - protein, 9 aa, BK Virus
VPKLLIKGG

SEQ ID NO: 59370 - protein, 15 aa, BK Virus
LYVSAADICGLFTNS

SEQ ID NO: 59371 - protein, 9 aa, BK Virus
YVSAADICG

SEQ ID NO: 59372 - protein, 15 aa, BK Virus
PKLLIKGGVEVLEVK

SEQ ID NO: 59373 - protein, 9 aa, BK Virus
LLIKGGVEV

SEQ ID NO: 59374 - protein, 15 aa, BK Virus
FHFFAVGGDPLEMQG

SEQ ID NO: 59375 - protein, 9 aa, BK Virus
VGGDPLEMQ

SEQ ID NO: 59376 - protein, 15 aa, BK Virus
MYGMESQVEEVRVFD

SEQ ID NO: 59377 - protein, 9 aa, BK Virus
MYGMESQVE

SEQ ID NO: 59378 - protein, 15 aa, BK Virus
NFHFFAVGGDPLEMQ

SEQ ID NO: 59379 - protein, 9 aa, BK Virus
AVGGDPLEM

SEQ ID NO: 59380 - protein, 15 aa, BK Virus
FGTYTGGENVPPVLH

SEQ ID NO: 59381 - protein, 9 aa, BK Virus
YTGGENVPP

SEQ ID NO: 59382 - protein, 15 aa, BK Virus
VKNPYPISFLLSDLI

SEQ ID NO: 59383 - protein, 9 aa, BK Virus
VKNPYPISF

SEQ ID NO: 59384 - protein, 15 aa, BK Virus
NLRGYSQHLSAENAF

SEQ ID NO: 59385 - protein, 9 aa, BK Virus
YSQHLSAEN

SEQ ID NO: 59386 - protein, 15 aa, BK Virus
HFFAVGGDPLEMQGV

SEQ ID NO: 59387 - protein, 9 aa, BK Virus
VGGDPLEMQ

SEQ ID NO: 59388 - protein, 15 aa, BK Virus
RYFKIRLRKRSVKNP

SEQ ID NO: 59389 - protein, 9 aa, BK Virus
FKIRLRKRS

SEQ ID NO: 59390 - protein, 15 aa, BK Virus
LRGYSQHLSAENAFE

SEQ ID NO: 59391 - protein, 9 aa, BK Virus
YSQHLSAEN

SEQ ID NO: 59392 - protein, 15 aa, BK Virus
TRYFGTYTGGENVPP

SEQ ID NO: 59393 - protein, 9 aa, BK Virus
YFGTYTGGE

SEQ ID NO: 59394 - protein, 15 aa, BK Virus
YPISFLLSDLINRRT

SEQ ID NO: 59395 - protein, 9 aa, BK Virus
ISFLLSDLI

SEQ ID NO: 59396 - protein, 15 aa, BK Virus
SMLNLHAGSQKVHEN

SEQ ID NO: 59397 - protein, 9 aa, BK Virus
MLNLHAGSQ

SEQ ID NO: 59398 - protein, 15 aa, BK Virus
VEVLEVKTGVDAITE

SEQ ID NO: 59399 - protein, 9 aa, BK Virus
VKTGVDAIT

SEQ ID NO: 59400 - protein, 15 aa, BK Virus
GVEVLEVKTGVDAIT

SEQ ID NO: 59401 - protein, 9 aa, BK Virus
VEVLEVKTG

SEQ ID NO: 59402 - protein, 15 aa, BK Virus
YTGGENVPPVLHVTN

SEQ ID NO: 59403 - protein, 9 aa, BK Virus
YTGGENVPP

SEQ ID NO: 59404 - protein, 15 aa, BK Virus
ISFLLSDLINRRTQK

SEQ ID NO: 59405 - protein, 9 aa, BK Virus
LSDLINRRT

SEQ ID NO: 59406 - protein, 15 aa, BK Virus
FFAVGGDPLEMQGVL

SEQ ID NO: 59407 - protein, 9 aa, BK Virus
VGGDPLEMQ

SEQ ID NO: 59408 - protein, 15 aa, BK Virus
TYTGGENVPPVLHVT

SEQ ID NO: 59409 - protein, 9 aa, BK Virus
YTGGENVPP

SEQ ID NO: 59410 - protein, 15 aa, BK Virus
PISFLLSDLINRRTQ

SEQ ID NO: 59411 - protein, 9 aa, BK Virus
LSDLINRRT

SEQ ID NO: 59412 - protein, 15 aa, BK Virus
VLEVKTGVDAITEVE

SEQ ID NO: 59413 - protein, 9 aa, BK Virus
VKTGVDAIT

SEQ ID NO: 59414 - protein, 15 aa, BK Virus
EVLEVKTGVDAITEV

SEQ ID NO: 59415 - protein, 9 aa, BK Virus
VKTGVDAIT

SEQ ID NO: 59416 - protein, 15 aa, BK Virus
LEVKTGVDAITEVEC

SEQ ID NO: 59417 - protein, 9 aa, BK Virus
VKTGVDAIT

SEQ ID NO: 59418 - protein, 15 aa, BK Virus
MLNLHAGSQKVHENG

SEQ ID NO: 59419 - protein, 9 aa, BK Virus
MLNLHAGSQ

SEQ ID NO: 59420 - protein, 15 aa, BK Virus
GENVPPVLHVTNTAT

SEQ ID NO: 59421 - protein, 9 aa, BK Virus
NVPPVLHVT

SEQ ID NO: 59422 - protein, 15 aa, BK Virus
PDDNLRGYSQHLSAE

SEQ ID NO: 59423 - protein, 9 aa, BK Virus
LRGYSQHLS

SEQ ID NO: 59424 - protein, 15 aa, BK Virus
DPDDNLRGYSQHLSA

SEQ ID NO: 59425 - protein, 9 aa, BK Virus
LRGYSQHLS

SEQ ID NO: 59426 - protein, 15 aa, BK Virus
RGYSQHLSAENAFES

SEQ ID NO: 59427 - protein, 9 aa, BK Virus
YSQHLSAEN

SEQ ID NO: 59428 - protein, 15 aa, BK Virus
KLLIKGGVEVLEVKT

SEQ ID NO: 59429 - protein, 9 aa, BK Virus
LIKGGVEVL

SEQ ID NO: 59430 - protein, 15 aa, BK Virus
RYFGTYTGGENVPPV

SEQ ID NO: 59431 - protein, 9 aa, BK Virus
YTGGENVPP

SEQ ID NO: 59432 - protein, 15 aa, BK Virus
SVKNPYPISFLLSDL

SEQ ID NO: 59433 - protein, 9 aa, BK Virus
VKNPYPISF

SEQ ID NO: 59434 - protein, 15 aa, BK Virus
YFGTYTGGENVPPVL

SEQ ID NO: 59435 - protein, 9 aa, BK Virus
YTGGENVPP

SEQ ID NO: 59436 - protein, 15 aa, BK Virus
LFTNSSGTQQWRGLA

SEQ ID NO: 59437 - protein, 9 aa, BK Virus
FTNSSGTQQ

SEQ ID NO: 59438 - protein, 15 aa, BK Virus
GDPDDNLRGYSQHLS

SEQ ID NO: 59439 - protein, 9 aa, BK Virus
NLRGYSQHL

SEQ ID NO: 59440 - protein, 15 aa, BK Virus
WRGLARYFKIRLRKR

SEQ ID NO: 59441 - protein, 9 aa, BK Virus
WRGLARYFK

SEQ ID NO: 59442 - protein, 15 aa, BK Virus
SGTQQWRGLARYFKI

SEQ ID NO: 59443 - protein, 9 aa, BK Virus
WRGLARYFK

SEQ ID NO: 59444 - protein, 15 aa, BK Virus
FAVGGDPLEMQGVLM

SEQ ID NO: 59445 - protein, 9 aa, BK Virus
VGGDPLEMQ

SEQ ID NO: 59446 - protein, 15 aa, BK Virus
GTQQWRGLARYFKIR

SEQ ID NO: 59447 - protein, 9 aa, BK Virus
WRGLARYFK

SEQ ID NO: 59448 - protein, 15 aa, BK Virus
SSGTQQWRGLARYFK

SEQ ID NO: 59449 - protein, 9 aa, BK Virus
QQWRGLARY

SEQ ID NO: 59450 - protein, 15 aa, BK Virus
KTEVIGITSMLNLHA

SEQ ID NO: 59451 - protein, 9 aa, BK Virus
VIGITSMLN

SEQ ID NO: 59452 - protein, 15 aa, BK Virus
TEVIGITSMLNLHAG

SEQ ID NO: 59453 - protein, 9 aa, BK Virus
ITSMLNLHA

SEQ ID NO: 59454 - protein, 15 aa, BK Virus
ADICGLFTNSSGTQQ

SEQ ID NO: 59455 - protein, 9 aa, BK Virus
ICGLFTNSS

SEQ ID NO: 59456 - protein, 15 aa, BK Virus
AADICGLFTNSSGTQ

SEQ ID NO: 59457 - protein, 9 aa, BK Virus
ICGLFTNSS

SEQ ID NO: 59458 - protein, 15 aa, BK Virus
EVIGITSMLNLHAGS

SEQ ID NO: 59459 - protein, 9 aa, BK Virus
ITSMLNLHA

SEQ ID NO: 59460 - protein, 15 aa, BK Virus
VIGITSMLNLHAGSQ

SEQ ID NO: 59461 - protein, 9 aa, BK Virus
ITSMLNLHA

SEQ ID NO: 59462 - protein, 15 aa, BK Virus
YVSAADICGLFTNSS

SEQ ID NO: 59463 - protein, 9 aa, BK Virus
YVSAADICG

SEQ ID NO: 59464 - protein, 15 aa, BK Virus
SAADICGLFTNSSGT

SEQ ID NO: 59465 - protein, 9 aa, BK Virus
ICGLFTNSS

SEQ ID NO: 59466 - protein, 15 aa, BK Virus
VSAADICGLFTNSSG

SEQ ID NO: 59467 - protein, 9 aa, BK Virus
ICGLFTNSS

SEQ ID NO: 59468 - protein, 15 aa, BK Virus
YFKIRLRKRSVKNPY

SEQ ID NO: 59469 - protein, 9 aa, BK Virus
RLRKRSVKN

SEQ ID NO: 59470 - protein, 15 aa, BK Virus
SFLLSDLINRRTQKV

SEQ ID NO: 59471 - protein, 9 aa, BK Virus
LLSDLINRR

SEQ ID NO: 59472 - protein, 15 aa, BK Virus
FKIRLRKRSVKNPYP

SEQ ID NO: 59473 - protein, 9 aa, BK Virus
RKRSVKNPY

SEQ ID NO: 59474 - protein, 15 aa, BK Virus
IGITSMLNLHAGSQK

SEQ ID NO: 59475 - protein, 9 aa, BK Virus
ITSMLNLHA

SEQ ID NO: 59476 - protein, 15 aa, BK Virus
RLRKRSVKNPYPISF

SEQ ID NO: 59477 - protein, 9 aa, BK Virus
RKRSVKNPY

SEQ ID NO: 59478 - protein, 15 aa, BK Virus
VPPVLHVTNTATTVL

SEQ ID NO: 59479 - protein, 9 aa, BK Virus
PVLHVTNTA

SEQ ID NO: 59480 - protein, 15 aa, BK Virus
VTVKTEVIGITSMLN

SEQ ID NO: 59481 - protein, 9 aa, BK Virus
VKTEVIGIT

SEQ ID NO: 59482 - protein, 15 aa, BK Virus
KIRLRKRSVKNPYPI

SEQ ID NO: 59483 - protein, 9 aa, BK Virus
RKRSVKNPY

SEQ ID NO: 59484 - protein, 15 aa, BK Virus
VKTEVIGITSMLNLH

SEQ ID NO: 59485 - protein, 9 aa, BK Virus
VIGITSMLN

SEQ ID NO: 59486 - protein, 15 aa, BK Virus
ICGLFTNSSGTQQWR

SEQ ID NO: 59487 - protein, 9 aa, BK Virus
ICGLFTNSS

SEQ ID NO: 59488 - protein, 15 aa, BK Virus
DICGLFTNSSGTQQW

SEQ ID NO: 59489 - protein, 9 aa, BK Virus
ICGLFTNSS

SEQ ID NO: 59490 - protein, 15 aa, BK Virus
ENVPPVLHVTNTATT

SEQ ID NO: 59491 - protein, 9 aa, BK Virus
PVLHVTNTA

SEQ ID NO: 59492 - protein, 15 aa, BK Virus
IRLRKRSVKNPYPIS

SEQ ID NO: 59493 - protein, 9 aa, BK Virus
RKRSVKNPY

SEQ ID NO: 59494 - protein, 15 aa, BK Virus
NVPPVLHVTNTATTV

SEQ ID NO: 59495 - protein, 9 aa, BK Virus
PVLHVTNTA

SEQ ID NO: 59496 - protein, 15 aa, BK Virus
YPISFLLSDLINRRT

SEQ ID NO: 59497 - protein, 9 aa, BK Virus
LLSDLINRR

SEQ ID NO: 59498 - protein, 15 aa, BK Virus
TVKTEVIGITSMLNL

SEQ ID NO: 59499 - protein, 9 aa, BK Virus
VIGITSMLN

SEQ ID NO: 59500 - protein, 15 aa, BK Virus
PYPISFLLSDLINRR

SEQ ID NO: 59501 - protein, 9 aa, BK Virus
ISFLLSDLI

SEQ ID NO: 59502 - protein, 15 aa, BK Virus
VIGITSMLNLHAGSQ

SEQ ID NO: 59503 - protein, 9 aa, BK Virus
ITSMLNLHA

SEQ ID NO: 59504 - protein, 15 aa, BK Virus
IGITSMLNLHAGSQK

SEQ ID NO: 59505 - protein, 9 aa, BK Virus
MLNLHAGSQ

SEQ ID NO: 59506 - protein, 15 aa, BK Virus
ITSMLNLHAGSQKVH

SEQ ID NO: 59507 - protein, 9 aa, BK Virus
MLNLHAGSQ

SEQ ID NO: 59508 - protein, 15 aa, BK Virus
GITSMLNLHAGSQKV

SEQ ID NO: 59509 - protein, 9 aa, BK Virus
MLNLHAGSQ

SEQ ID NO: 59510 - protein, 15 aa, BK Virus
MQGVLMNYRTKYPQG

SEQ ID NO: 59511 - protein, 9 aa, BK Virus
LMNYRTKYP

SEQ ID NO: 59512 - protein, 15 aa, BK Virus
TSMLNLHAGSQKVHE

SEQ ID NO: 59513 - protein, 9 aa, BK Virus
MLNLHAGSQ

SEQ ID NO: 59514 - protein, 15 aa, BK Virus
LEMQGVLMNYRTKYP

SEQ ID NO: 59515 - protein, 9 aa, BK Virus
MQGVLMNYR

SEQ ID NO: 59516 - protein, 15 aa, BK Virus
QGVLMNYRTKYPQGT

SEQ ID NO: 59517 - protein, 9 aa, BK Virus
LMNYRTKYP

SEQ ID NO: 59518 - protein, 15 aa, BK Virus
EMQGVLMNYRTKYPQ

SEQ ID NO: 59519 - protein, 9 aa, BK Virus
LMNYRTKYP

SEQ ID NO: 59520 - protein, 15 aa, BK Virus
GVLMNYRTKYPQGTI

SEQ ID NO: 59521 - protein, 9 aa, BK Virus
LMNYRTKYP

SEQ ID NO: 59522 - protein, 15 aa, BK Virus
SMLNLHAGSQKVHEN

SEQ ID NO: 59523 - protein, 9 aa, BK Virus
MLNLHAGSQ

SEQ ID NO: 59524 - protein, 15 aa, BK Virus
MLNLHAGSQKVHENG

SEQ ID NO: 59525 - protein, 9 aa, BK Virus
MLNLHAGSQ

SEQ ID NO: 59526 - protein, 15 aa, BK Virus
VLMNYRTKYPQGTIT

SEQ ID NO: 59527 - protein, 9 aa, BK Virus
LMNYRTKYP

SEQ ID NO: 59528 - protein, 15 aa, BK Virus
ADICGLFTNSSGTQQ

SEQ ID NO: 59529 - protein, 9 aa, BK Virus
ICGLFTNSS

SEQ ID NO: 59530 - protein, 15 aa, BK Virus
AADICGLFTNSSGTQ

SEQ ID NO: 59531 - protein, 9 aa, BK Virus
ICGLFTNSS

SEQ ID NO: 59532 - protein, 15 aa, BK Virus
LMNYRTKYPQGTITP

SEQ ID NO: 59533 - protein, 9 aa, BK Virus
LMNYRTKYP

SEQ ID NO: 59534 - protein, 15 aa, BK Virus
SFLLSDLINRRTQKV

SEQ ID NO: 59535 - protein, 9 aa, BK Virus
LLSDLINRR

SEQ ID NO: 59536 - protein, 15 aa, BK Virus
YPISFLLSDLINRRT

SEQ ID NO: 59537 - protein, 9 aa, BK Virus
LLSDLINRR

SEQ ID NO: 59538 - protein, 15 aa, BK Virus
TEVIGITSMLNLHAG

SEQ ID NO: 59539 - protein, 9 aa, BK Virus
ITSMLNLHA

SEQ ID NO: 59540 - protein, 15 aa, BK Virus
PISFLLSDLINRRTQ

SEQ ID NO: 59541 - protein, 9 aa, BK Virus
LLSDLINRR

SEQ ID NO: 59542 - protein, 15 aa, BK Virus
ISFLLSDLINRRTQK

SEQ ID NO: 59543 - protein, 9 aa, BK Virus
LLSDLINRR

SEQ ID NO: 59544 - protein, 15 aa, BK Virus
KTEVIGITSMLNLHA

SEQ ID NO: 59545 - protein, 9 aa, BK Virus
VIGITSMLN

SEQ ID NO: 59546 - protein, 15 aa, BK Virus
ITEVECFLNPEMGDP

SEQ ID NO: 59547 - protein, 9 aa, BK Virus
TEVECFLNP

SEQ ID NO: 59548 - protein, 15 aa, BK Virus
TEVECFLNPEMGDPD

SEQ ID NO: 59549 - protein, 9 aa, BK Virus
FLNPEMGDP

SEQ ID NO: 59550 - protein, 15 aa, BK Virus
EVECFLNPEMGDPDD

SEQ ID NO: 59551 - protein, 9 aa, BK Virus
FLNPEMGDP

SEQ ID NO: 59552 - protein, 15 aa, BK Virus
ECFLNPEMGDPDDNL

SEQ ID NO: 59553 - protein, 9 aa, BK Virus
FLNPEMGDP

SEQ ID NO: 59554 - protein, 15 aa, BK Virus
VECFLNPEMGDPDDN

SEQ ID NO: 59555 - protein, 9 aa, BK Virus
FLNPEMGDP

SEQ ID NO: 59556 - protein, 15 aa, BK Virus
DICGLFTNSSGTQQW

SEQ ID NO: 59557 - protein, 9 aa, BK Virus
LFTNSSGTQ

SEQ ID NO: 59558 - protein, 15 aa, BK Virus
ICGLFTNSSGTQQWR

SEQ ID NO: 59559 - protein, 9 aa, BK Virus
LFTNSSGTQ

SEQ ID NO: 59560 - protein, 15 aa, BK Virus
RKMLPCYSTARIPLP

SEQ ID NO: 59561 - protein, 9 aa, BK Virus
MLPCYSTAR

SEQ ID NO: 59562 - protein, 15 aa, BK Virus
TCGNLLMWEAVTVKT

SEQ ID NO: 59563 - protein, 9 aa, BK Virus
LMWEAVTVK

SEQ ID NO: 59564 - protein, 15 aa, BK Virus
CGNLLMWEAVTVKTE

SEQ ID NO: 59565 - protein, 9 aa, BK Virus
LMWEAVTVK

SEQ ID NO: 59566 - protein, 15 aa, BK Virus
VPPVLHVTNTATTVL

SEQ ID NO: 59567 - protein, 9 aa, BK Virus
LHVTNTATT

SEQ ID NO: 59568 - protein, 15 aa, BK Virus
PYPISFLLSDLINRR

SEQ ID NO: 59569 - protein, 9 aa, BK Virus
FLLSDLINR

SEQ ID NO: 59570 - protein, 15 aa, BK Virus
EVIGITSMLNLHAGS

SEQ ID NO: 59571 - protein, 9 aa, BK Virus
ITSMLNLHA

SEQ ID NO: 59572 - protein, 15 aa, BK Virus
GNLLMWEAVTVKTEV

SEQ ID NO: 59573 - protein, 9 aa, BK Virus
LMWEAVTVK

SEQ ID NO: 59574 - protein, 15 aa, BK Virus
PPVLHVTNTATTVLL

SEQ ID NO: 59575 - protein, 9 aa, BK Virus
LHVTNTATT

SEQ ID NO: 59576 - protein, 15 aa, BK Virus
ENVPPVLHVTNTATT

SEQ ID NO: 59577 - protein, 9 aa, BK Virus
VLHVTNTAT

SEQ ID NO: 59578 - protein, 15 aa, BK Virus
NLLMWEAVTVKTEVI

SEQ ID NO: 59579 - protein, 9 aa, BK Virus
LMWEAVTVK

SEQ ID NO: 59580 - protein, 15 aa, BK Virus
FLLSDLINRRTQKVD

SEQ ID NO: 59581 - protein, 9 aa, BK Virus
LLSDLINRR

SEQ ID NO: 59582 - protein, 15 aa, BK Virus
NTDHKAYLDKNNAYP

SEQ ID NO: 59583 - protein, 9 aa, BK Virus
KAYLDKNNA

SEQ ID NO: 59584 - protein, 15 aa, BK Virus
TDHKAYLDKNNAYPV

SEQ ID NO: 59585 - protein, 9 aa, BK Virus
YLDKNNAYP

SEQ ID NO: 59586 - protein, 15 aa, BK Virus
NVPPVLHVTNTATTV

SEQ ID NO: 59587 - protein, 9 aa, BK Virus
LHVTNTATT

SEQ ID NO: 59588 - protein, 15 aa, BK Virus
DHKAYLDKNNAYPVE

SEQ ID NO: 59589 - protein, 9 aa, BK Virus
YLDKNNAYP

SEQ ID NO: 59590 - protein, 15 aa, BK Virus
KMLPCYSTARIPLPN

SEQ ID NO: 59591 - protein, 9 aa, BK Virus
YSTARIPLP

SEQ ID NO: 59592 - protein, 15 aa, BK Virus
PVLHVTNTATTVLLD

SEQ ID NO: 59593 - protein, 9 aa, BK Virus
LHVTNTATT

SEQ ID NO: 59594 - protein, 15 aa, BK Virus
HKAYLDKNNAYPVEC

SEQ ID NO: 59595 - protein, 9 aa, BK Virus
YLDKNNAYP

SEQ ID NO: 59596 - protein, 15 aa, BK Virus
KAYLDKNNAYPVECW

SEQ ID NO: 59597 - protein, 9 aa, BK Virus
YLDKNNAYP

SEQ ID NO: 59598 - protein, 15 aa, BK Virus
LTCGNLLMWEAVTVK

SEQ ID NO: 59599 - protein, 9 aa, BK Virus
LLMWEAVTV

SEQ ID NO: 59600 - protein, 15 aa, BK Virus
YPVECWIPDPSRNEN

SEQ ID NO: 59601 - protein, 9 aa, BK Virus
WIPDPSRNE

SEQ ID NO: 59602 - protein, 15 aa, BK Virus
AYPVECWIPDPSRNE

SEQ ID NO: 59603 - protein, 9 aa, BK Virus
ECWIPDPSR

SEQ ID NO: 59604 - protein, 15 aa, BK Virus
KTEVIGITSMLNLHA

SEQ ID NO: 59605 - protein, 9 aa, BK Virus
VIGITSMLN

SEQ ID NO: 59606 - protein, 15 aa, BK Virus
TEVIGITSMLNLHAG

SEQ ID NO: 59607 - protein, 9 aa, BK Virus
VIGITSMLN

SEQ ID NO: 59608 - protein, 15 aa, BK Virus
PCYSTARIPLPNLNE

SEQ ID NO: 59609 - protein, 9 aa, BK Virus
YSTARIPLP

SEQ ID NO: 59610 - protein, 15 aa, BK Virus
PVECWIPDPSRNENT

SEQ ID NO: 59611 - protein, 9 aa, BK Virus
WIPDPSRNE

SEQ ID NO: 59612 - protein, 15 aa, BK Virus
VTVKTEVIGITSMLN

SEQ ID NO: 59613 - protein, 9 aa, BK Virus
TVKTEVIGI

SEQ ID NO: 59614 - protein, 15 aa, BK Virus
VPPVLHVTNTATTVL

SEQ ID NO: 59615 - protein, 9 aa, BK Virus
VLHVTNTAT

SEQ ID NO: 59616 - protein, 15 aa, BK Virus
PPVLHVTNTATTVLL

SEQ ID NO: 59617 - protein, 9 aa, BK Virus
VTNTATTVL

SEQ ID NO: 59618 - protein, 15 aa, BK Virus
PVLHVTNTATTVLLD

SEQ ID NO: 59619 - protein, 9 aa, BK Virus
VTNTATTVL

SEQ ID NO: 59620 - protein, 15 aa, BK Virus
VLHVTNTATTVLLDE

SEQ ID NO: 59621 - protein, 9 aa, BK Virus
VTNTATTVL

SEQ ID NO: 59622 - protein, 15 aa, BK Virus
LHVTNTATTVLLDEQ

SEQ ID NO: 59623 - protein, 9 aa, BK Virus
VTNTATTVL

SEQ ID NO: 59624 - protein, 15 aa, BK Virus
HVTNTATTVLLDEQG

SEQ ID NO: 59625 - protein, 9 aa, BK Virus
VTNTATTVL

SEQ ID NO: 59626 - protein, 15 aa, BK Virus
VTNTATTVLLDEQGV

SEQ ID NO: 59627 - protein, 9 aa, BK Virus
VTNTATTVL

SEQ ID NO: 59628 - protein, 15 aa, BK Virus
SFLLSDLINRRTQKV

SEQ ID NO: 59629 - protein, 9 aa, BK Virus
LSDLINRRT

SEQ ID NO: 59630 - protein, 15 aa, BK Virus
SDLINRRTQKVDGQP

SEQ ID NO: 59631 - protein, 9 aa, BK Virus
LINRRTQKV

SEQ ID NO: 59632 - protein, 15 aa, BK Virus
FLLSDLINRRTQKVD

SEQ ID NO: 59633 - protein, 9 aa, BK Virus
LINRRTQKV

SEQ ID NO: 59634 - protein, 15 aa, BK Virus
LLSDLINRRTQKVDG

SEQ ID NO: 59635 - protein, 9 aa, BK Virus
LINRRTQKV

SEQ ID NO: 59636 - protein, 15 aa, BK Virus
LSDLINRRTQKVDGQ

SEQ ID NO: 59637 - protein, 9 aa, BK Virus
LINRRTQKV

SEQ ID NO: 59638 - protein, 15 aa, BK Virus
NVPPVLHVTNTATTV

SEQ ID NO: 59639 - protein, 9 aa, BK Virus
VLHVTNTAT

SEQ ID NO: 59640 - protein, 15 aa, BK Virus
GNLLMWEAVTVKTEV

SEQ ID NO: 59641 - protein, 9 aa, BK Virus
LLMWEAVTV

SEQ ID NO: 59642 - protein, 15 aa, BK Virus
TCGNLLMWEAVTVKT

SEQ ID NO: 59643 - protein, 9 aa, BK Virus
LLMWEAVTV

SEQ ID NO: 59644 - protein, 15 aa, BK Virus
CGNLLMWEAVTVKTE

SEQ ID NO: 59645 - protein, 9 aa, BK Virus
LLMWEAVTV

SEQ ID NO: 59646 - protein, 15 aa, BK Virus
LTCGNLLMWEAVTVK

SEQ ID NO: 59647 - protein, 9 aa, BK Virus
LLMWEAVTV

SEQ ID NO: 59648 - protein, 15 aa, BK Virus
DLTCGNLLMWEAVTV

SEQ ID NO: 59649 - protein, 9 aa, BK Virus
LTCGNLLMW

SEQ ID NO: 59650 - protein, 15 aa, BK Virus
ENVPPVLHVTNTATT

SEQ ID NO: 59651 - protein, 9 aa, BK Virus
VLHVTNTAT

SEQ ID NO: 59652 - protein, 15 aa, BK Virus
DLINRRTQKVDGQPM

SEQ ID NO: 59653 - protein, 9 aa, BK Virus
LINRRTQKV

SEQ ID NO: 59654 - protein, 15 aa, BK Virus
LINRRTQKVDGQPMY

SEQ ID NO: 59655 - protein, 9 aa, BK Virus
LINRRTQKV

SEQ ID NO: 59656 - protein, 15 aa, BK Virus
ARYFKIRLRKRSVKN

SEQ ID NO: 59657 - protein, 9 aa, BK Virus
YFKIRLRKR

SEQ ID NO: 59658 - protein, 15 aa, BK Virus
EQGVGPLCKADSLYV

SEQ ID NO: 59659 - protein, 9 aa, BK Virus
PLCKADSLY

SEQ ID NO: 59660 - protein, 15 aa, BK Virus
RGLARYFKIRLRKRS

SEQ ID NO: 59661 - protein, 9 aa, BK Virus
RGLARYFKI

SEQ ID NO: 59662 - protein, 15 aa, BK Virus
GLARYFKIRLRKRSV

SEQ ID NO: 59663 - protein, 9 aa, BK Virus
FKIRLRKRS

SEQ ID NO: 59664 - protein, 15 aa, BK Virus
LARYFKIRLRKRSVK

SEQ ID NO: 59665 - protein, 9 aa, BK Virus
FKIRLRKRS

SEQ ID NO: 59666 - protein, 15 aa, BK Virus
ARYFKIRLRKRSVKN

SEQ ID NO: 59667 - protein, 9 aa, BK Virus
FKIRLRKRS

SEQ ID NO: 59668 - protein, 15 aa, BK Virus
RYFKIRLRKRSVKNP

SEQ ID NO: 59669 - protein, 9 aa, BK Virus
FKIRLRKRS

SEQ ID NO: 59670 - protein, 15 aa, BK Virus
YFKIRLRKRSVKNPY

SEQ ID NO: 59671 - protein, 9 aa, BK Virus
FKIRLRKRS

SEQ ID NO: 59672 - protein, 15 aa, BK Virus
FKIRLRKRSVKNPYP

SEQ ID NO: 59673 - protein, 9 aa, BK Virus
FKIRLRKRS

SEQ ID NO: 59674 - protein, 15 aa, BK Virus
RKMLPCYSTARIPLP

SEQ ID NO: 59675 - protein, 9 aa, BK Virus
LPCYSTARI

SEQ ID NO: 59676 - protein, 15 aa, BK Virus
KMLPCYSTARIPLPN

SEQ ID NO: 59677 - protein, 9 aa, BK Virus
YSTARIPLP

SEQ ID NO: 59678 - protein, 15 aa, BK Virus
MLPCYSTARIPLPNL

SEQ ID NO: 59679 - protein, 9 aa, BK Virus
YSTARIPLP

SEQ ID NO: 59680 - protein, 15 aa, BK Virus
LPCYSTARIPLPNLN

SEQ ID NO: 59681 - protein, 9 aa, BK Virus
YSTARIPLP

SEQ ID NO: 59682 - protein, 15 aa, BK Virus
PCYSTARIPLPNLNE

SEQ ID NO: 59683 - protein, 9 aa, BK Virus
YSTARIPLP

SEQ ID NO: 59684 - protein, 15 aa, BK Virus
SGTQQWRGLARYFKI

SEQ ID NO: 59685 - protein, 9 aa, BK Virus
WRGLARYFK

SEQ ID NO: 59686 - protein, 15 aa, BK Virus
GTQQWRGLARYFKIR

SEQ ID NO: 59687 - protein, 9 aa, BK Virus
WRGLARYFK

SEQ ID NO: 59688 - protein, 15 aa, BK Virus
TQQWRGLARYFKIRL

SEQ ID NO: 59689 - protein, 9 aa, BK Virus
WRGLARYFK

SEQ ID NO: 59690 - protein, 15 aa, BK Virus
SSGTQQWRGLARYFK

SEQ ID NO: 59691 - protein, 9 aa, BK Virus
QQWRGLARY

SEQ ID NO: 59692 - protein, 15 aa, BK Virus
QQWRGLARYFKIRLR

SEQ ID NO: 59693 - protein, 9 aa, BK Virus
WRGLARYFK

SEQ ID NO: 59694 - protein, 15 aa, BK Virus
WRGLARYFKIRLRKR

SEQ ID NO: 59695 - protein, 9 aa, BK Virus
WRGLARYFK

SEQ ID NO: 59696 - protein, 15 aa, BK Virus
QWRGLARYFKIRLRK

SEQ ID NO: 59697 - protein, 9 aa, BK Virus
WRGLARYFK

SEQ ID NO: 59698 - protein, 15 aa, BK Virus
LEMQGVLMNYRTKYP

SEQ ID NO: 59699 - protein, 9 aa, BK Virus
VLMNYRTKY

SEQ ID NO: 59700 - protein, 15 aa, BK Virus
EMQGVLMNYRTKYPQ

SEQ ID NO: 59701 - protein, 9 aa, BK Virus
VLMNYRTKY

SEQ ID NO: 59702 - protein, 15 aa, BK Virus
MQGVLMNYRTKYPQG

SEQ ID NO: 59703 - protein, 9 aa, BK Virus
VLMNYRTKY

SEQ ID NO: 59704 - protein, 15 aa, BK Virus
QGVLMNYRTKYPQGT

SEQ ID NO: 59705 - protein, 9 aa, BK Virus
VLMNYRTKY

SEQ ID NO: 59706 - protein, 15 aa, BK Virus
PLEMQGVLMNYRTKY

SEQ ID NO: 59707 - protein, 9 aa, BK Virus
QGVLMNYRT

SEQ ID NO: 59708 - protein, 15 aa, BK Virus
PPVLHVTNTATTVLL

SEQ ID NO: 59709 - protein, 9 aa, BK Virus
VTNTATTVL

SEQ ID NO: 59710 - protein, 15 aa, BK Virus
PVLHVTNTATTVLLD

SEQ ID NO: 59711 - protein, 9 aa, BK Virus
VTNTATTVL

SEQ ID NO: 59712 - protein, 15 aa, BK Virus
VPPVLHVTNTATTVL

SEQ ID NO: 59713 - protein, 9 aa, BK Virus
VLHVTNTAT

SEQ ID NO: 59714 - protein, 15 aa, BK Virus
VLHVTNTATTVLLDE

SEQ ID NO: 59715 - protein, 9 aa, BK Virus
VTNTATTVL

SEQ ID NO: 59716 - protein, 15 aa, BK Virus
LARYFKIRLRKRSVK

SEQ ID NO: 59717 - protein, 9 aa, BK Virus
FKIRLRKRS

SEQ ID NO: 59718 - protein, 15 aa, BK Virus
GVLMNYRTKYPQGTI

SEQ ID NO: 59719 - protein, 9 aa, BK Virus
VLMNYRTKY

SEQ ID NO: 59720 - protein, 15 aa, BK Virus
ARYFKIRLRKRSVKN

SEQ ID NO: 59721 - protein, 9 aa, BK Virus
FKIRLRKRS

SEQ ID NO: 59722 - protein, 15 aa, BK Virus
RYFKIRLRKRSVKNP

SEQ ID NO: 59723 - protein, 9 aa, BK Virus
FKIRLRKRS

SEQ ID NO: 59724 - protein, 15 aa, BK Virus
YFKIRLRKRSVKNPY

SEQ ID NO: 59725 - protein, 9 aa, BK Virus
IRLRKRSVK

SEQ ID NO: 59726 - protein, 15 aa, BK Virus
LHVTNTATTVLLDEQ

SEQ ID NO: 59727 - protein, 9 aa, BK Virus
VTNTATTVL

SEQ ID NO: 59728 - protein, 15 aa, BK Virus
FKIRLRKRSVKNPYP

SEQ ID NO: 59729 - protein, 9 aa, BK Virus
IRLRKRSVK

SEQ ID NO: 59730 - protein, 15 aa, BK Virus
VKTEVIGITSMLNLH

SEQ ID NO: 59731 - protein, 9 aa, BK Virus
IGITSMLNL

SEQ ID NO: 59732 - protein, 15 aa, BK Virus
VLMNYRTKYPQGTIT

SEQ ID NO: 59733 - protein, 9 aa, BK Virus
VLMNYRTKY

SEQ ID NO: 59734 - protein, 15 aa, BK Virus
TVKTEVIGITSMLNL

SEQ ID NO: 59735 - protein, 9 aa, BK Virus
EVIGITSML

SEQ ID NO: 59736 - protein, 15 aa, BK Virus
RGLARYFKIRLRKRS

SEQ ID NO: 59737 - protein, 9 aa, BK Virus
LARYFKIRL

SEQ ID NO: 59738 - protein, 15 aa, BK Virus
KTEVIGITSMLNLHA

SEQ ID NO: 59739 - protein, 9 aa, BK Virus
IGITSMLNL

SEQ ID NO: 59740 - protein, 15 aa, BK Virus
GLARYFKIRLRKRSV

SEQ ID NO: 59741 - protein, 9 aa, BK Virus
FKIRLRKRS

SEQ ID NO: 59742 - protein, 15 aa, BK Virus
SFLLSDLINRRTQKV

SEQ ID NO: 59743 - protein, 9 aa, BK Virus
LLSDLINRR

SEQ ID NO: 59744 - protein, 15 aa, BK Virus
FLLSDLINRRTQKVD

SEQ ID NO: 59745 - protein, 9 aa, BK Virus
LINRRTQKV

SEQ ID NO: 59746 - protein, 15 aa, BK Virus
TEVIGITSMLNLHAG

SEQ ID NO: 59747 - protein, 9 aa, BK Virus
IGITSMLNL

SEQ ID NO: 59748 - protein, 15 aa, BK Virus
EVIGITSMLNLHAGS

SEQ ID NO: 59749 - protein, 9 aa, BK Virus
IGITSMLNL

SEQ ID NO: 59750 - protein, 15 aa, BK Virus
STARIPLPNLNEDLT

SEQ ID NO: 59751 - protein, 9 aa, BK Virus
ARIPLPNLN

SEQ ID NO: 59752 - protein, 15 aa, BK Virus
HVTNTATTVLLDEQG

SEQ ID NO: 59753 - protein, 9 aa, BK Virus
VTNTATTVL

SEQ ID NO: 59754 - protein, 15 aa, BK Virus
IPLPNLNEDLTCGNL

SEQ ID NO: 59755 - protein, 9 aa, BK Virus
LPNLNEDLT

SEQ ID NO: 59756 - protein, 15 aa, BK Virus
ARIPLPNLNEDLTCG

SEQ ID NO: 59757 - protein, 9 aa, BK Virus
LPNLNEDLT

SEQ ID NO: 59758 - protein, 15 aa, BK Virus
RIPLPNLNEDLTCGN

SEQ ID NO: 59759 - protein, 9 aa, BK Virus
LPNLNEDLT

SEQ ID NO: 59760 - protein, 15 aa, BK Virus
DPLEMQGVLMNYRTK

SEQ ID NO: 59761 - protein, 9 aa, BK Virus
QGVLMNYRT

SEQ ID NO: 59762 - protein, 15 aa, BK Virus
TARIPLPNLNEDLTC

SEQ ID NO: 59763 - protein, 9 aa, BK Virus
LPNLNEDLT

SEQ ID NO: 59764 - protein, 15 aa, BK Virus
GDPLEMQGVLMNYRT

SEQ ID NO: 59765 - protein, 9 aa, BK Virus
LEMQGVLMN

SEQ ID NO: 59766 - protein, 15 aa, BK Virus
KIRLRKRSVKNPYPI

SEQ ID NO: 59767 - protein, 9 aa, BK Virus
RKRSVKNPY

SEQ ID NO: 59768 - protein, 15 aa, BK Virus
IRLRKRSVKNPYPIS

SEQ ID NO: 59769 - protein, 9 aa, BK Virus
RKRSVKNPY

SEQ ID NO: 59770 - protein, 15 aa, BK Virus
LLSDLINRRTQKVDG

SEQ ID NO: 59771 - protein, 9 aa, BK Virus
LINRRTQKV

SEQ ID NO: 59772 - protein, 15 aa, BK Virus
IGITSMLNLHAGSQK

SEQ ID NO: 59773 - protein, 9 aa, BK Virus
IGITSMLNL

SEQ ID NO: 59774 - protein, 15 aa, BK Virus
VTVKTEVIGITSMLN

SEQ ID NO: 59775 - protein, 9 aa, BK Virus
VKTEVIGIT

SEQ ID NO: 59776 - protein, 15 aa, BK Virus
AVTVKTEVIGITSML

SEQ ID NO: 59777 - protein, 9 aa, BK Virus
VKTEVIGIT

SEQ ID NO: 59778 - protein, 15 aa, BK Virus
VTNTATTVLLDEQGV

SEQ ID NO: 59779 - protein, 9 aa, BK Virus
VTNTATTVL

SEQ ID NO: 59780 - protein, 15 aa, BK Virus
LSDLINRRTQKVDGQ

SEQ ID NO: 59781 - protein, 9 aa, BK Virus
LINRRTQKV

SEQ ID NO: 59782 - protein, 15 aa, BK Virus
VQVPKLLIKGGVEVL

SEQ ID NO: 59783 - protein, 9 aa, BK Virus
LLIKGGVEV

SEQ ID NO: 59784 - protein, 15 aa, BK Virus
ADICGLFTNSSGTQQ

SEQ ID NO: 59785 - protein, 9 aa, BK Virus
LFTNSSGTQ

SEQ ID NO: 59786 - protein, 15 aa, BK Virus
DICGLFTNSSGTQQW

SEQ ID NO: 59787 - protein, 9 aa, BK Virus
FTNSSGTQQ

SEQ ID NO: 59788 - protein, 15 aa, BK Virus
GLARYFKIRLRKRSV

SEQ ID NO: 59789 - protein, 9 aa, BK Virus
YFKIRLRKR

SEQ ID NO: 59790 - protein, 15 aa, BK Virus
RGLARYFKIRLRKRS

SEQ ID NO: 59791 - protein, 9 aa, BK Virus
YFKIRLRKR

SEQ ID NO: 59792 - protein, 15 aa, BK Virus
LARYFKIRLRKRSVK

SEQ ID NO: 59793 - protein, 9 aa, BK Virus
YFKIRLRKR

SEQ ID NO: 59794 - protein, 15 aa, BK Virus
ARYFKIRLRKRSVKN

SEQ ID NO: 59795 - protein, 9 aa, BK Virus
YFKIRLRKR

SEQ ID NO: 59796 - protein, 15 aa, BK Virus
WRGLARYFKIRLRKR

SEQ ID NO: 59797 - protein, 9 aa, BK Virus
ARYFKIRLR

SEQ ID NO: 59798 - protein, 15 aa, BK Virus
RYFKIRLRKRSVKNP

SEQ ID NO: 59799 - protein, 9 aa, BK Virus
YFKIRLRKR

SEQ ID NO: 59800 - protein, 15 aa, BK Virus
QQWRGLARYFKIRLR

SEQ ID NO: 59801 - protein, 9 aa, BK Virus
WRGLARYFK

SEQ ID NO: 59802 - protein, 15 aa, BK Virus
YFKIRLRKRSVKNPY

SEQ ID NO: 59803 - protein, 9 aa, BK Virus
YFKIRLRKR

SEQ ID NO: 59804 - protein, 15 aa, BK Virus
YPISFLLSDLINRRT

SEQ ID NO: 59805 - protein, 9 aa, BK Virus
FLLSDLINR

SEQ ID NO: 59806 - protein, 15 aa, BK Virus
QWRGLARYFKIRLRK

SEQ ID NO: 59807 - protein, 9 aa, BK Virus
ARYFKIRLR

SEQ ID NO: 59808 - protein, 15 aa, BK Virus
PISFLLSDLINRRTQ

SEQ ID NO: 59809 - protein, 9 aa, BK Virus
FLLSDLINR

SEQ ID NO: 59810 - protein, 15 aa, BK Virus
ISFLLSDLINRRTQK

SEQ ID NO: 59811 - protein, 9 aa, BK Virus
FLLSDLINR

SEQ ID NO: 59812 - protein, 15 aa, BK Virus
SFLLSDLINRRTQKV

SEQ ID NO: 59813 - protein, 9 aa, BK Virus
LLSDLINRR

SEQ ID NO: 59814 - protein, 15 aa, BK Virus
PYPISFLLSDLINRR

SEQ ID NO: 59815 - protein, 9 aa, BK Virus
FLLSDLINR

SEQ ID NO: 59816 - protein, 15 aa, BK Virus
FLLSDLINRRTQKVD

SEQ ID NO: 59817 - protein, 9 aa, BK Virus
FLLSDLINR

SEQ ID NO: 59818 - protein, 15 aa, BK Virus
LTCGNLLMWEAVTVK

SEQ ID NO: 59819 - protein, 9 aa, BK Virus
LLMWEAVTV

SEQ ID NO: 59820 - protein, 15 aa, BK Virus
TCGNLLMWEAVTVKT

SEQ ID NO: 59821 - protein, 9 aa, BK Virus
LLMWEAVTV

SEQ ID NO: 59822 - protein, 15 aa, BK Virus
GNLLMWEAVTVKTEV

SEQ ID NO: 59823 - protein, 9 aa, BK Virus
LLMWEAVTV

SEQ ID NO: 59824 - protein, 15 aa, BK Virus
CGNLLMWEAVTVKTE

SEQ ID NO: 59825 - protein, 9 aa, BK Virus
LLMWEAVTV

SEQ ID NO: 59826 - protein, 15 aa, BK Virus
LEMQGVLMNYRTKYP

SEQ ID NO: 59827 - protein, 9 aa, BK Virus
MQGVLMNYR

SEQ ID NO: 59828 - protein, 15 aa, BK Virus
TQQWRGLARYFKIRL

SEQ ID NO: 59829 - protein, 9 aa, BK Virus
WRGLARYFK

SEQ ID NO: 59830 - protein, 15 aa, BK Virus
SSGTQQWRGLARYFK

SEQ ID NO: 59831 - protein, 9 aa, BK Virus
TQQWRGLAR

SEQ ID NO: 59832 - protein, 15 aa, BK Virus
SGTQQWRGLARYFKI

SEQ ID NO: 59833 - protein, 9 aa, BK Virus
TQQWRGLAR

SEQ ID NO: 59834 - protein, 15 aa, BK Virus
MQGVLMNYRTKYPQG

SEQ ID NO: 59835 - protein, 9 aa, BK Virus
MQGVLMNYR

SEQ ID NO: 59836 - protein, 15 aa, BK Virus
NPYPISFLLSDLINR

SEQ ID NO: 59837 - protein, 9 aa, BK Virus
ISFLLSDLI

SEQ ID NO: 59838 - protein, 15 aa, BK Virus
EMQGVLMNYRTKYPQ

SEQ ID NO: 59839 - protein, 9 aa, BK Virus
MQGVLMNYR

SEQ ID NO: 59840 - protein, 15 aa, BK Virus
FKIRLRKRSVKNPYP

SEQ ID NO: 59841 - protein, 9 aa, BK Virus
IRLRKRSVK

SEQ ID NO: 59842 - protein, 15 aa, BK Virus
GTQQWRGLARYFKIR

SEQ ID NO: 59843 - protein, 9 aa, BK Virus
WRGLARYFK

SEQ ID NO: 59844 - protein, 15 aa, BK Virus
NLLMWEAVTVKTEVI

SEQ ID NO: 59845 - protein, 9 aa, BK Virus
LLMWEAVTV

SEQ ID NO: 59846 - protein, 15 aa, BK Virus
PLEMQGVLMNYRTKY

SEQ ID NO: 59847 - protein, 9 aa, BK Virus
MQGVLMNYR

SEQ ID NO: 59848 - protein, 15 aa, BK Virus
IGITSMLNLHAGSQK

SEQ ID NO: 59849 - protein, 9 aa, BK Virus
ITSMLNLHA

SEQ ID NO: 59850 - protein, 15 aa, BK Virus
YPVECWIPDPSRNEN

SEQ ID NO: 59851 - protein, 9 aa, BK Virus
VECWIPDPS

SEQ ID NO: 59852 - protein, 15 aa, BK Virus
NAYPVECWIPDPSRN

SEQ ID NO: 59853 - protein, 9 aa, BK Virus
VECWIPDPS

SEQ ID NO: 59854 - protein, 15 aa, BK Virus
AYPVECWIPDPSRNE

SEQ ID NO: 59855 - protein, 9 aa, BK Virus
VECWIPDPS

SEQ ID NO: 59856 - protein, 15 aa, BK Virus
NNAYPVECWIPDPSR

SEQ ID NO: 59857 - protein, 9 aa, BK Virus
VECWIPDPS

SEQ ID NO: 59858 - protein, 15 aa, BK Virus
KNNAYPVECWIPDPS

SEQ ID NO: 59859 - protein, 9 aa, BK Virus
YPVECWIPD

SEQ ID NO: 59860 - protein, 15 aa, BK Virus
PVECWIPDPSRNENT

SEQ ID NO: 59861 - protein, 9 aa, BK Virus
VECWIPDPS

SEQ ID NO: 59862 - protein, 15 aa, BK Virus
VECWIPDPSRNENTR

SEQ ID NO: 59863 - protein, 9 aa, BK Virus
VECWIPDPS

SEQ ID NO: 59864 - protein, 15 aa, BK Virus
ARYFKIRLRKRSVKN

SEQ ID NO: 59865 - protein, 9 aa, BK Virus
FKIRLRKRS

SEQ ID NO: 59866 - protein, 15 aa, BK Virus
LARYFKIRLRKRSVK

SEQ ID NO: 59867 - protein, 9 aa, BK Virus
FKIRLRKRS

SEQ ID NO: 59868 - protein, 15 aa, BK Virus
RGLARYFKIRLRKRS

SEQ ID NO: 59869 - protein, 9 aa, BK Virus
YFKIRLRKR

SEQ ID NO: 59870 - protein, 15 aa, BK Virus
GLARYFKIRLRKRSV

SEQ ID NO: 59871 - protein, 9 aa, BK Virus
FKIRLRKRS

SEQ ID NO: 59872 - protein, 15 aa, BK Virus
RYFKIRLRKRSVKNP

SEQ ID NO: 59873 - protein, 9 aa, BK Virus
FKIRLRKRS

SEQ ID NO: 59874 - protein, 15 aa, BK Virus
YFKIRLRKRSVKNPY

SEQ ID NO: 59875 - protein, 9 aa, BK Virus
FKIRLRKRS

SEQ ID NO: 59876 - protein, 15 aa, BK Virus
WRGLARYFKIRLRKR

SEQ ID NO: 59877 - protein, 9 aa, BK Virus
WRGLARYFK

SEQ ID NO: 59878 - protein, 15 aa, BK Virus
FKIRLRKRSVKNPYP

SEQ ID NO: 59879 - protein, 9 aa, BK Virus
FKIRLRKRS

SEQ ID NO: 59880 - protein, 15 aa, BK Virus
QGVLMNYRTKYPQGT

SEQ ID NO: 59881 - protein, 9 aa, BK Virus
LMNYRTKYP

SEQ ID NO: 59882 - protein, 15 aa, BK Virus
GVLMNYRTKYPQGTI

SEQ ID NO: 59883 - protein, 9 aa, BK Virus
YRTKYPQGT

SEQ ID NO: 59884 - protein, 15 aa, BK Virus
GTITPKNPTAQSQVM

SEQ ID NO: 59885 - protein, 9 aa, BK Virus
ITPKNPTAQ

SEQ ID NO: 59886 - protein, 15 aa, BK Virus
LSAENAFESDSPDRK

SEQ ID NO: 59887 - protein, 9 aa, BK Virus
AFESDSPDR

SEQ ID NO: 59888 - protein, 15 aa, BK Virus
SAENAFESDSPDRKM

SEQ ID NO: 59889 - protein, 9 aa, BK Virus
FESDSPDRK

SEQ ID NO: 59890 - protein, 15 aa, BK Virus
AENAFESDSPDRKML

SEQ ID NO: 59891 - protein, 9 aa, BK Virus
FESDSPDRK

SEQ ID NO: 59892 - protein, 15 aa, BK Virus
KYPQGTITPKNPTAQ

SEQ ID NO: 59893 - protein, 9 aa, BK Virus
QGTITPKNP

SEQ ID NO: 59894 - protein, 15 aa, BK Virus
ENAFESDSPDRKMLP

SEQ ID NO: 59895 - protein, 9 aa, BK Virus
FESDSPDRK

SEQ ID NO: 59896 - protein, 15 aa, BK Virus
SSGTQQWRGLARYFK

SEQ ID NO: 59897 - protein, 9 aa, BK Virus
TQQWRGLAR

SEQ ID NO: 59898 - protein, 15 aa, BK Virus
YPQGTITPKNPTAQS

SEQ ID NO: 59899 - protein, 9 aa, BK Virus
ITPKNPTAQ

SEQ ID NO: 59900 - protein, 15 aa, BK Virus
SGTQQWRGLARYFKI

SEQ ID NO: 59901 - protein, 9 aa, BK Virus
WRGLARYFK

SEQ ID NO: 59902 - protein, 15 aa, BK Virus
QQWRGLARYFKIRLR

SEQ ID NO: 59903 - protein, 9 aa, BK Virus
WRGLARYFK

SEQ ID NO: 59904 - protein, 15 aa, BK Virus
GTQQWRGLARYFKIR

SEQ ID NO: 59905 - protein, 9 aa, BK Virus
WRGLARYFK

SEQ ID NO: 59906 - protein, 15 aa, BK Virus
TQQWRGLARYFKIRL

SEQ ID NO: 59907 - protein, 9 aa, BK Virus
WRGLARYFK

SEQ ID NO: 59908 - protein, 15 aa, BK Virus
QGTITPKNPTAQSQV

SEQ ID NO: 59909 - protein, 9 aa, BK Virus
ITPKNPTAQ

SEQ ID NO: 59910 - protein, 15 aa, BK Virus
PQGTITPKNPTAQSQ

SEQ ID NO: 59911 - protein, 9 aa, BK Virus
ITPKNPTAQ

SEQ ID NO: 59912 - protein, 15 aa, BK Virus
VLMNYRTKYPQGTIT

SEQ ID NO: 59913 - protein, 9 aa, BK Virus
YRTKYPQGT

SEQ ID NO: 59914 - protein, 15 aa, BK Virus
MNYRTKYPQGTITPK

SEQ ID NO: 59915 - protein, 9 aa, BK Virus
YRTKYPQGT

SEQ ID NO: 59916 - protein, 15 aa, BK Virus
NAFESDSPDRKMLPC

SEQ ID NO: 59917 - protein, 9 aa, BK Virus
FESDSPDRK

SEQ ID NO: 59918 - protein, 15 aa, BK Virus
RAAWGNLPLMRKAYL

SEQ ID NO: 59919 - protein, 9 aa, BK Virus
WGNLPLMRK

SEQ ID NO: 59920 - protein, 15 aa, BK Virus
LERAAWGNLPLMRKA

SEQ ID NO: 59921 - protein, 9 aa, BK Virus
WGNLPLMRK

SEQ ID NO: 59922 - protein, 15 aa, BK Virus
ERAAWGNLPLMRKAY

SEQ ID NO: 59923 - protein, 9 aa, BK Virus
WGNLPLMRK

SEQ ID NO: 59924 - protein, 15 aa, BK Virus
AAWGNLPLMRKAYLK

SEQ ID NO: 59925 - protein, 9 aa, BK Virus
WGNLPLMRK

SEQ ID NO: 59926 - protein, 15 aa, BK Virus
GLERAAWGNLPLMRK

SEQ ID NO: 59927 - protein, 9 aa, BK Virus
ERAAWGNLP

SEQ ID NO: 59928 - protein, 15 aa, BK Virus
WGNLPLMRKAYLKKC

SEQ ID NO: 59929 - protein, 9 aa, BK Virus
WGNLPLMRK

SEQ ID NO: 59930 - protein, 15 aa, BK Virus
AWGNLPLMRKAYLKK

SEQ ID NO: 59931 - protein, 9 aa, BK Virus
WGNLPLMRK

SEQ ID NO: 59932 - protein, 15 aa, BK Virus
PCMLCQLRLRHLNRK

SEQ ID NO: 59933 - protein, 9 aa, BK Virus
LCQLRLRHL

SEQ ID NO: 59934 - protein, 15 aa, BK Virus
CMLCQLRLRHLNRKF

SEQ ID NO: 59935 - protein, 9 aa, BK Virus
LCQLRLRHL

SEQ ID NO: 59936 - protein, 15 aa, BK Virus
HCPCMLCQLRLRHLN

SEQ ID NO: 59937 - protein, 9 aa, BK Virus
LCQLRLRHL

SEQ ID NO: 59938 - protein, 15 aa, BK Virus
VHCPCMLCQLRLRHL

SEQ ID NO: 59939 - protein, 9 aa, BK Virus
PCMLCQLRL

SEQ ID NO: 59940 - protein, 15 aa, BK Virus
CPCMLCQLRLRHLNR

SEQ ID NO: 59941 - protein, 9 aa, BK Virus
LCQLRLRHL

SEQ ID NO: 59942 - protein, 15 aa, BK Virus
MELMDLLGLERAAWG

SEQ ID NO: 59943 - protein, 9 aa, BK Virus
MDLLGLERA

SEQ ID NO: 59944 - protein, 15 aa, BK Virus
LCQLRLRHLNRKFLR

SEQ ID NO: 59945 - protein, 9 aa, BK Virus
LCQLRLRHL

SEQ ID NO: 59946 - protein, 15 aa, BK Virus
MLCQLRLRHLNRKFL

SEQ ID NO: 59947 - protein, 9 aa, BK Virus
LCQLRLRHL

SEQ ID NO: 59948 - protein, 15 aa, BK Virus
LNRKFLRKEPLVWID

SEQ ID NO: 59949 - protein, 9 aa, BK Virus
LRKEPLVWI

SEQ ID NO: 59950 - protein, 15 aa, BK Virus
HLNRKFLRKEPLVWI

SEQ ID NO: 59951 - protein, 9 aa, BK Virus
FLRKEPLVW

SEQ ID NO: 59952 - protein, 15 aa, BK Virus
ELMDLLGLERAAWGN

SEQ ID NO: 59953 - protein, 9 aa, BK Virus
MDLLGLERA

SEQ ID NO: 59954 - protein, 15 aa, BK Virus
NRKFLRKEPLVWIDC

SEQ ID NO: 59955 - protein, 9 aa, BK Virus
LRKEPLVWI

SEQ ID NO: 59956 - protein, 15 aa, BK Virus
EESMELMDLLGLERA

SEQ ID NO: 59957 - protein, 9 aa, BK Virus
LMDLLGLER

SEQ ID NO: 59958 - protein, 15 aa, BK Virus
RKFLRKEPLVWIDCY

SEQ ID NO: 59959 - protein, 9 aa, BK Virus
LRKEPLVWI

SEQ ID NO: 59960 - protein, 15 aa, BK Virus
ESMELMDLLGLERAA

SEQ ID NO: 59961 - protein, 9 aa, BK Virus
LMDLLGLER

SEQ ID NO: 59962 - protein, 15 aa, BK Virus
DEDKMKRMNTLYKKM

SEQ ID NO: 59963 - protein, 9 aa, BK Virus
MKRMNTLYK

SEQ ID NO: 59964 - protein, 15 aa, BK Virus
GDEDKMKRMNTLYKK

SEQ ID NO: 59965 - protein, 9 aa, BK Virus
MKRMNTLYK

SEQ ID NO: 59966 - protein, 15 aa, BK Virus
SMELMDLLGLERAAW

SEQ ID NO: 59967 - protein, 9 aa, BK Virus
MDLLGLERA

SEQ ID NO: 59968 - protein, 15 aa, BK Virus
EDKMKRMNTLYKKME

SEQ ID NO: 59969 - protein, 9 aa, BK Virus
MKRMNTLYK

SEQ ID NO: 59970 - protein, 15 aa, BK Virus
DKMKRMNTLYKKMEQ

SEQ ID NO: 59971 - protein, 9 aa, BK Virus
MKRMNTLYK

SEQ ID NO: 59972 - protein, 15 aa, BK Virus
GGDEDKMKRMNTLYK

SEQ ID NO: 59973 - protein, 9 aa, BK Virus
DKMKRMNTL

SEQ ID NO: 59974 - protein, 15 aa, BK Virus
DKVLNREESMELMDL

SEQ ID NO: 59975 - protein, 9 aa, BK Virus
LNREESMEL

SEQ ID NO: 59976 - protein, 15 aa, BK Virus
KVLNREESMELMDLL

SEQ ID NO: 59977 - protein, 9 aa, BK Virus
LNREESMEL

SEQ ID NO: 59978 - protein, 15 aa, BK Virus
FLRKEPLVWIDCYCI

SEQ ID NO: 59979 - protein, 9 aa, BK Virus
LRKEPLVWI

SEQ ID NO: 59980 - protein, 15 aa, BK Virus
LMDLLGLERAAWGNL

SEQ ID NO: 59981 - protein, 9 aa, BK Virus
LGLERAAWG

SEQ ID NO: 59982 - protein, 15 aa, BK Virus
MDKVLNREESMELMD

SEQ ID NO: 59983 - protein, 9 aa, BK Virus
LNREESMEL

SEQ ID NO: 59984 - protein, 15 aa, BK Virus
KFLRKEPLVWIDCYC

SEQ ID NO: 59985 - protein, 9 aa, BK Virus
LRKEPLVWI

SEQ ID NO: 59986 - protein, 15 aa, BK Virus
MDLLGLERAAWGNLP

SEQ ID NO: 59987 - protein, 9 aa, BK Virus
LGLERAAWG

SEQ ID NO: 59988 - protein, 15 aa, BK Virus
LNREESMELMDLLGL

SEQ ID NO: 59989 - protein, 9 aa, BK Virus
LNREESMEL

SEQ ID NO: 59990 - protein, 15 aa, BK Virus
LRKEPLVWIDCYCID

SEQ ID NO: 59991 - protein, 9 aa, BK Virus
LRKEPLVWI

SEQ ID NO: 59992 - protein, 15 aa, BK Virus
REESMELMDLLGLER

SEQ ID NO: 59993 - protein, 9 aa, BK Virus
MELMDLLGL

SEQ ID NO: 59994 - protein, 15 aa, BK Virus
DTLYCKEWPICSKKP

SEQ ID NO: 59995 - protein, 9 aa, BK Virus
YCKEWPICS

SEQ ID NO: 59996 - protein, 15 aa, BK Virus
TLYCKEWPICSKKPS

SEQ ID NO: 59997 - protein, 9 aa, BK Virus
YCKEWPICS

SEQ ID NO: 59998 - protein, 15 aa, BK Virus
DCFTQWFGLDLTEET

SEQ ID NO: 59999 - protein, 9 aa, BK Virus
FTQWFGLDL

SEQ ID NO: 60000 - protein, 15 aa, BK Virus
TLYCKEWPICSKKPS

SEQ ID NO: 60001 - protein, 9 aa, BK Virus
YCKEWPICS

SEQ ID NO: 60002 - protein, 15 aa, BK Virus
DTLYCKEWPICSKKP

SEQ ID NO: 60003 - protein, 9 aa, BK Virus
YCKEWPICS

SEQ ID NO: 60004 - protein, 15 aa, BK Virus
PDTLYCKEWPICSKK

SEQ ID NO: 60005 - protein, 9 aa, BK Virus
YCKEWPICS

SEQ ID NO: 60006 - protein, 15 aa, BK Virus
CPDTLYCKEWPICSK

SEQ ID NO: 60007 - protein, 9 aa, BK Virus
YCKEWPICS

SEQ ID NO: 60008 - protein, 15 aa, BK Virus
LCPDTLYCKEWPICS

SEQ ID NO: 60009 - protein, 9 aa, BK Virus
LYCKEWPIC

SEQ ID NO: 60010 - protein, 15 aa, BK Virus
GDEDKMKRMNTLYKK

SEQ ID NO: 60011 - protein, 9 aa, BK Virus
MKRMNTLYK

SEQ ID NO: 60012 - protein, 15 aa, BK Virus
DEDKMKRMNTLYKKM

SEQ ID NO: 60013 - protein, 9 aa, BK Virus
MKRMNTLYK

SEQ ID NO: 60014 - protein, 15 aa, BK Virus
GGDEDKMKRMNTLYK

SEQ ID NO: 60015 - protein, 9 aa, BK Virus
KMKRMNTLY

SEQ ID NO: 60016 - protein, 15 aa, BK Virus
EDKMKRMNTLYKKME

SEQ ID NO: 60017 - protein, 9 aa, BK Virus
MKRMNTLYK

SEQ ID NO: 60018 - protein, 15 aa, BK Virus
DKMKRMNTLYKKMEQ

SEQ ID NO: 60019 - protein, 9 aa, BK Virus
MKRMNTLYK

SEQ ID NO: 60020 - protein, 15 aa, BK Virus
YCKEWPICSKKPSVH

SEQ ID NO: 60021 - protein, 9 aa, BK Virus
YCKEWPICS

SEQ ID NO: 60022 - protein, 15 aa, BK Virus
LYCKEWPICSKKPSV

SEQ ID NO: 60023 - protein, 9 aa, BK Virus
YCKEWPICS

SEQ ID NO: 60024 - protein, 15 aa, BK Virus
EDKMKRMNTLYKKME

SEQ ID NO: 60025 - protein, 9 aa, BK Virus
MKRMNTLYK

SEQ ID NO: 60026 - protein, 15 aa, BK Virus
DKMKRMNTLYKKMEQ

SEQ ID NO: 60027 - protein, 9 aa, BK Virus
MKRMNTLYK

SEQ ID NO: 60028 - protein, 15 aa, BK Virus
GDEDKMKRMNTLYKK

SEQ ID NO: 60029 - protein, 9 aa, BK Virus
MKRMNTLYK

SEQ ID NO: 60030 - protein, 15 aa, BK Virus
GGDEDKMKRMNTLYK

SEQ ID NO: 60031 - protein, 9 aa, BK Virus
DKMKRMNTL

SEQ ID NO: 60032 - protein, 15 aa, BK Virus
DEDKMKRMNTLYKKM

SEQ ID NO: 60033 - protein, 9 aa, BK Virus
MKRMNTLYK

SEQ ID NO: 60034 - protein, 15 aa, BK Virus
EETLQWWVQIIGETP

SEQ ID NO: 60035 - protein, 9 aa, BK Virus
LQWWVQIIG

SEQ ID NO: 60036 - protein, 15 aa, BK Virus
TEETLQWWVQIIGET

SEQ ID NO: 60037 - protein, 9 aa, BK Virus
LQWWVQIIG

SEQ ID NO: 60038 - protein, 15 aa, BK Virus
LTEETLQWWVQIIGE

SEQ ID NO: 60039 - protein, 9 aa, BK Virus
LQWWVQIIG

SEQ ID NO: 60040 - protein, 15 aa, BK Virus
ETLQWWVQIIGETPF

SEQ ID NO: 60041 - protein, 9 aa, BK Virus
LQWWVQIIG

SEQ ID NO: 60042 - protein, 15 aa, BK Virus
DLTEETLQWWVQIIG

SEQ ID NO: 60043 - protein, 9 aa, BK Virus
TLQWWVQII

SEQ ID NO: 60044 - protein, 15 aa, BK Virus
GLERAAWGNLPLMRK

SEQ ID NO: 60045 - protein, 9 aa, BK Virus
RAAWGNLPL

SEQ ID NO: 60046 - protein, 15 aa, BK Virus
LERAAWGNLPLMRKA

SEQ ID NO: 60047 - protein, 9 aa, BK Virus
RAAWGNLPL

SEQ ID NO: 60048 - protein, 15 aa, BK Virus
YCIDCFTQWFGLDLT

SEQ ID NO: 60049 - protein, 9 aa, BK Virus
FTQWFGLDL

SEQ ID NO: 60050 - protein, 15 aa, BK Virus
IDCFTQWFGLDLTEE

SEQ ID NO: 60051 - protein, 9 aa, BK Virus
TQWFGLDLT

SEQ ID NO: 60052 - protein, 15 aa, BK Virus
KMKRMNTLYKKMEQD

SEQ ID NO: 60053 - protein, 9 aa, BK Virus
MKRMNTLYK

SEQ ID NO: 60054 - protein, 15 aa, BK Virus
MKRMNTLYKKMEQDV

SEQ ID NO: 60055 - protein, 9 aa, BK Virus
MKRMNTLYK

SEQ ID NO: 60056 - protein, 15 aa, BK Virus
CIDCFTQWFGLDLTE

SEQ ID NO: 60057 - protein, 9 aa, BK Virus
TQWFGLDLT

SEQ ID NO: 60058 - protein, 15 aa, BK Virus
LQWWVQIIGETPFRD

SEQ ID NO: 60059 - protein, 9 aa, BK Virus
LQWWVQIIG

SEQ ID NO: 60060 - protein, 15 aa, BK Virus
DCFTQWFGLDLTEET

SEQ ID NO: 60061 - protein, 9 aa, BK Virus
TQWFGLDLT

SEQ ID NO: 60062 - protein, 15 aa, BK Virus
AHQPDFGTWNSSEVC

SEQ ID NO: 60063 - protein, 9 aa, BK Virus
FGTWNSSEV

SEQ ID NO: 60064 - protein, 15 aa, BK Virus
VAHQPDFGTWNSSEV

SEQ ID NO: 60065 - protein, 9 aa, BK Virus
QPDFGTWNS

SEQ ID NO: 60066 - protein, 15 aa, BK Virus
ERAAWGNLPLMRKAY

SEQ ID NO: 60067 - protein, 9 aa, BK Virus
WGNLPLMRK

SEQ ID NO: 60068 - protein, 15 aa, BK Virus
QPDFGTWNSSEVCAD

SEQ ID NO: 60069 - protein, 9 aa, BK Virus
FGTWNSSEV

SEQ ID NO: 60070 - protein, 15 aa, BK Virus
LGLERAAWGNLPLMR

SEQ ID NO: 60071 - protein, 9 aa, BK Virus
RAAWGNLPL

SEQ ID NO: 60072 - protein, 15 aa, BK Virus
HQPDFGTWNSSEVCA

SEQ ID NO: 60073 - protein, 9 aa, BK Virus
FGTWNSSEV

SEQ ID NO: 60074 - protein, 15 aa, BK Virus
TLQWWVQIIGETPFR

SEQ ID NO: 60075 - protein, 9 aa, BK Virus
LQWWVQIIG

SEQ ID NO: 60076 - protein, 15 aa, BK Virus
LLGLERAAWGNLPLM

SEQ ID NO: 60077 - protein, 9 aa, BK Virus
RAAWGNLPL

SEQ ID NO: 60078 - protein, 15 aa, BK Virus
DLLGLERAAWGNLPL

SEQ ID NO: 60079 - protein, 9 aa, BK Virus
ERAAWGNLP

SEQ ID NO: 60080 - protein, 15 aa, BK Virus
CYCIDCFTQWFGLDL

SEQ ID NO: 60081 - protein, 9 aa, BK Virus
IDCFTQWFG

SEQ ID NO: 60082 - protein, 15 aa, BK Virus
CFTQWFGLDLTEETL

SEQ ID NO: 60083 - protein, 9 aa, BK Virus
TQWFGLDLT

SEQ ID NO: 60084 - protein, 15 aa, BK Virus
PDFGTWNSSEVCADF

SEQ ID NO: 60085 - protein, 9 aa, BK Virus
FGTWNSSEV

SEQ ID NO: 60086 - protein, 15 aa, BK Virus
CKEWPICSKKPSVHC

SEQ ID NO: 60087 - protein, 9 aa, BK Virus
ICSKKPSVH

SEQ ID NO: 60088 - protein, 15 aa, BK Virus
KEWPICSKKPSVHCP

SEQ ID NO: 60089 - protein, 9 aa, BK Virus
ICSKKPSVH

SEQ ID NO: 60090 - protein, 15 aa, BK Virus
EWPICSKKPSVHCPC

SEQ ID NO: 60091 - protein, 9 aa, BK Virus
ICSKKPSVH

SEQ ID NO: 60092 - protein, 15 aa, BK Virus
WPICSKKPSVHCPCM

SEQ ID NO: 60093 - protein, 9 aa, BK Virus
ICSKKPSVH

SEQ ID NO: 60094 - protein, 15 aa, BK Virus
YCKEWPICSKKPSVH

SEQ ID NO: 60095 - protein, 9 aa, BK Virus
PICSKKPSV

SEQ ID NO: 60096 - protein, 15 aa, BK Virus
HQPDFGTWNSSEVCA

SEQ ID NO: 60097 - protein, 9 aa, BK Virus
FGTWNSSEV

SEQ ID NO: 60098 - protein, 15 aa, BK Virus
QPDFGTWNSSEVCAD

SEQ ID NO: 60099 - protein, 9 aa, BK Virus
FGTWNSSEV

SEQ ID NO: 60100 - protein, 15 aa, BK Virus
VAHQPDFGTWNSSEV

SEQ ID NO: 60101 - protein, 9 aa, BK Virus
DFGTWNSSE

SEQ ID NO: 60102 - protein, 15 aa, BK Virus
AHQPDFGTWNSSEVC

SEQ ID NO: 60103 - protein, 9 aa, BK Virus
FGTWNSSEV

SEQ ID NO: 60104 - protein, 15 aa, BK Virus
PDFGTWNSSEVCADF

SEQ ID NO: 60105 - protein, 9 aa, BK Virus
FGTWNSSEV

SEQ ID NO: 60106 - protein, 15 aa, BK Virus
GDEDKMKRMNTLYKK

SEQ ID NO: 60107 - protein, 9 aa, BK Virus
MKRMNTLYK

SEQ ID NO: 60108 - protein, 15 aa, BK Virus
EDKMKRMNTLYKKME

SEQ ID NO: 60109 - protein, 9 aa, BK Virus
MKRMNTLYK

SEQ ID NO: 60110 - protein, 15 aa, BK Virus
DEDKMKRMNTLYKKM

SEQ ID NO: 60111 - protein, 9 aa, BK Virus
MKRMNTLYK

SEQ ID NO: 60112 - protein, 15 aa, BK Virus
DKMKRMNTLYKKMEQ

SEQ ID NO: 60113 - protein, 9 aa, BK Virus
MKRMNTLYK

SEQ ID NO: 60114 - protein, 15 aa, BK Virus
GGDEDKMKRMNTLYK

SEQ ID NO: 60115 - protein, 9 aa, BK Virus
EDKMKRMNT

SEQ ID NO: 60116 - protein, 15 aa, BK Virus
GLERAAWGNLPLMRK

SEQ ID NO: 60117 - protein, 9 aa, BK Virus
AWGNLPLMR

SEQ ID NO: 60118 - protein, 15 aa, BK Virus
LERAAWGNLPLMRKA

SEQ ID NO: 60119 - protein, 9 aa, BK Virus
WGNLPLMRK

SEQ ID NO: 60120 - protein, 15 aa, BK Virus
RAAWGNLPLMRKAYL

SEQ ID NO: 60121 - protein, 9 aa, BK Virus
WGNLPLMRK

SEQ ID NO: 60122 - protein, 15 aa, BK Virus
ERAAWGNLPLMRKAY

SEQ ID NO: 60123 - protein, 9 aa, BK Virus
WGNLPLMRK

SEQ ID NO: 60124 - protein, 15 aa, BK Virus
GLERAAWGNLPLMRK

SEQ ID NO: 60125 - protein, 9 aa, BK Virus
LERAAWGNL

SEQ ID NO: 60126 - protein, 15 aa, BK Virus
RAAWGNLPLMRKAYL

SEQ ID NO: 60127 - protein, 9 aa, BK Virus
WGNLPLMRK

SEQ ID NO: 60128 - protein, 15 aa, BK Virus
AAWGNLPLMRKAYLK

SEQ ID NO: 60129 - protein, 9 aa, BK Virus
WGNLPLMRK

SEQ ID NO: 60130 - protein, 15 aa, BK Virus
LERAAWGNLPLMRKA

SEQ ID NO: 60131 - protein, 9 aa, BK Virus
WGNLPLMRK

SEQ ID NO: 60132 - protein, 15 aa, BK Virus
ERAAWGNLPLMRKAY

SEQ ID NO: 60133 - protein, 9 aa, BK Virus
WGNLPLMRK

SEQ ID NO: 60134 - protein, 15 aa, BK Virus
DEDKMKRMNTLYKKM

SEQ ID NO: 60135 - protein, 9 aa, BK Virus
MKRMNTLYK

SEQ ID NO: 60136 - protein, 15 aa, BK Virus
EDKMKRMNTLYKKME

SEQ ID NO: 60137 - protein, 9 aa, BK Virus
MKRMNTLYK

SEQ ID NO: 60138 - protein, 15 aa, BK Virus
DKMKRMNTLYKKMEQ

SEQ ID NO: 60139 - protein, 9 aa, BK Virus
MKRMNTLYK

SEQ ID NO: 60140 - protein, 15 aa, BK Virus
GDEDKMKRMNTLYKK

SEQ ID NO: 60141 - protein, 9 aa, BK Virus
MKRMNTLYK

SEQ ID NO: 60142 - protein, 15 aa, BK Virus
WGNLPLMRKAYLKKC

SEQ ID NO: 60143 - protein, 9 aa, BK Virus
WGNLPLMRK

SEQ ID NO: 60144 - protein, 15 aa, BK Virus
AWGNLPLMRKAYLKK

SEQ ID NO: 60145 - protein, 9 aa, BK Virus
WGNLPLMRK

SEQ ID NO: 60146 - protein, 15 aa, BK Virus
ETLQWWVQIIGETPF

SEQ ID NO: 60147 - protein, 9 aa, BK Virus
WWVQIIGET

SEQ ID NO: 60148 - protein, 15 aa, BK Virus
GGDEDKMKRMNTLYK

SEQ ID NO: 60149 - protein, 9 aa, BK Virus
DKMKRMNTL

SEQ ID NO: 60150 - protein, 15 aa, BK Virus
LQWWVQIIGETPFRD

SEQ ID NO: 60151 - protein, 9 aa, BK Virus
VQIIGETPF

SEQ ID NO: 60152 - protein, 15 aa, BK Virus
TLQWWVQIIGETPFR

SEQ ID NO: 60153 - protein, 9 aa, BK Virus
VQIIGETPF

SEQ ID NO: 60154 - protein, 15 aa, BK Virus
LCQLRLRHLNRKFLR

SEQ ID NO: 60155 - protein, 9 aa, BK Virus
LRLRHLNRK

SEQ ID NO: 60156 - protein, 15 aa, BK Virus
MLCQLRLRHLNRKFL

SEQ ID NO: 60157 - protein, 9 aa, BK Virus
LRLRHLNRK

SEQ ID NO: 60158 - protein, 15 aa, BK Virus
CQLRLRHLNRKFLRK

SEQ ID NO: 60159 - protein, 9 aa, BK Virus
LRLRHLNRK

SEQ ID NO: 60160 - protein, 15 aa, BK Virus
QWWVQIIGETPFRDL

SEQ ID NO: 60161 - protein, 9 aa, BK Virus
VQIIGETPF

SEQ ID NO: 60162 - protein, 15 aa, BK Virus
KMKRMNTLYKKMEQD

SEQ ID NO: 60163 - protein, 9 aa, BK Virus
MKRMNTLYK

SEQ ID NO: 60164 - protein, 15 aa, BK Virus
CMLCQLRLRHLNRKF

SEQ ID NO: 60165 - protein, 9 aa, BK Virus
LRLRHLNRK

SEQ ID NO: 60166 - protein, 15 aa, BK Virus
PCMLCQLRLRHLNRK

SEQ ID NO: 60167 - protein, 9 aa, BK Virus
QLRLRHLNR

SEQ ID NO: 60168 - protein, 15 aa, BK Virus
DEDKMKRMNTLYKKM

SEQ ID NO: 60169 - protein, 9 aa, BK Virus
MKRMNTLYK

SEQ ID NO: 60170 - protein, 15 aa, BK Virus
EDKMKRMNTLYKKME

SEQ ID NO: 60171 - protein, 9 aa, BK Virus
MKRMNTLYK

SEQ ID NO: 60172 - protein, 15 aa, BK Virus
WGNLPLMRKAYLKKC

SEQ ID NO: 60173 - protein, 9 aa, BK Virus
LMRKAYLKK

SEQ ID NO: 60174 - protein, 15 aa, BK Virus
LCQLRLRHLNRKFLR

SEQ ID NO: 60175 - protein, 9 aa, BK Virus
LRLRHLNRK

SEQ ID NO: 60176 - protein, 15 aa, BK Virus
DKMKRMNTLYKKMEQ

SEQ ID NO: 60177 - protein, 9 aa, BK Virus
MKRMNTLYK

SEQ ID NO: 60178 - protein, 15 aa, BK Virus
GDEDKMKRMNTLYKK

SEQ ID NO: 60179 - protein, 9 aa, BK Virus
MKRMNTLYK

SEQ ID NO: 60180 - protein, 15 aa, BK Virus
MLCQLRLRHLNRKFL

SEQ ID NO: 60181 - protein, 9 aa, BK Virus
LRLRHLNRK

SEQ ID NO: 60182 - protein, 15 aa, BK Virus
AWGNLPLMRKAYLKK

SEQ ID NO: 60183 - protein, 9 aa, BK Virus
LPLMRKAYL

SEQ ID NO: 60184 - protein, 15 aa, BK Virus
GNLPLMRKAYLKKCK

SEQ ID NO: 60185 - protein, 9 aa, BK Virus
LMRKAYLKK

SEQ ID NO: 60186 - protein, 15 aa, BK Virus
GGDEDKMKRMNTLYK

SEQ ID NO: 60187 - protein, 9 aa, BK Virus
DKMKRMNTL

SEQ ID NO: 60188 - protein, 15 aa, BK Virus
NLPLMRKAYLKKCKE

SEQ ID NO: 60189 - protein, 9 aa, BK Virus
LMRKAYLKK

SEQ ID NO: 60190 - protein, 15 aa, BK Virus
CQLRLRHLNRKFLRK

SEQ ID NO: 60191 - protein, 9 aa, BK Virus
LRLRHLNRK

SEQ ID NO: 60192 - protein, 15 aa, BK Virus
LPLMRKAYLKKCKEF

SEQ ID NO: 60193 - protein, 9 aa, BK Virus
LMRKAYLKK

SEQ ID NO: 60194 - protein, 15 aa, BK Virus
LMDLLGLERAAWGNL

SEQ ID NO: 60195 - protein, 9 aa, BK Virus
LMDLLGLER

SEQ ID NO: 60196 - protein, 15 aa, BK Virus
MELMDLLGLERAAWG

SEQ ID NO: 60197 - protein, 9 aa, BK Virus
LMDLLGLER

SEQ ID NO: 60198 - protein, 15 aa, BK Virus
QLRLRHLNRKFLRKE

SEQ ID NO: 60199 - protein, 9 aa, BK Virus
LRLRHLNRK

SEQ ID NO: 60200 - protein, 15 aa, BK Virus
HLNRKFLRKEPLVWI

SEQ ID NO: 60201 - protein, 9 aa, BK Virus
FLRKEPLVW

SEQ ID NO: 60202 - protein, 15 aa, BK Virus
LNRKFLRKEPLVWID

SEQ ID NO: 60203 - protein, 9 aa, BK Virus
FLRKEPLVW

SEQ ID NO: 60204 - protein, 15 aa, BK Virus
PLMRKAYLKKCKEFH

SEQ ID NO: 60205 - protein, 9 aa, BK Virus
LMRKAYLKK

SEQ ID NO: 60206 - protein, 15 aa, BK Virus
KMKRMNTLYKKMEQD

SEQ ID NO: 60207 - protein, 9 aa, BK Virus
MKRMNTLYK

SEQ ID NO: 60208 - protein, 15 aa, BK Virus
RKFLRKEPLVWIDCY

SEQ ID NO: 60209 - protein, 9 aa, BK Virus
FLRKEPLVW

SEQ ID NO: 60210 - protein, 15 aa, BK Virus
SMELMDLLGLERAAW

SEQ ID NO: 60211 - protein, 9 aa, BK Virus
LMDLLGLER

SEQ ID NO: 60212 - protein, 15 aa, BK Virus
YCKEWPICSKKPSVH

SEQ ID NO: 60213 - protein, 9 aa, BK Virus
YCKEWPICS

SEQ ID NO: 60214 - protein, 15 aa, BK Virus
MLCQLRLRHLNRKFL

SEQ ID NO: 60215 - protein, 9 aa, BK Virus
LRLRHLNRK

SEQ ID NO: 60216 - protein, 15 aa, BK Virus
LCQLRLRHLNRKFLR

SEQ ID NO: 60217 - protein, 9 aa, BK Virus
LRLRHLNRK

SEQ ID NO: 60218 - protein, 15 aa, BK Virus
CMLCQLRLRHLNRKF

SEQ ID NO: 60219 - protein, 9 aa, BK Virus
LRLRHLNRK

SEQ ID NO: 60220 - protein, 15 aa, BK Virus
PCMLCQLRLRHLNRK

SEQ ID NO: 60221 - protein, 9 aa, BK Virus
LCQLRLRHL

SEQ ID NO: 60222 - protein, 15 aa, BK Virus
CKEWPICSKKPSVHC

SEQ ID NO: 60223 - protein, 9 aa, BK Virus
ICSKKPSVH

SEQ ID NO: 60224 - protein, 15 aa, BK Virus
CQLRLRHLNRKFLRK

SEQ ID NO: 60225 - protein, 9 aa, BK Virus
LRLRHLNRK

SEQ ID NO: 60226 - protein, 15 aa, BK Virus
KEWPICSKKPSVHCP

SEQ ID NO: 60227 - protein, 9 aa, BK Virus
ICSKKPSVH

SEQ ID NO: 60228 - protein, 15 aa, BK Virus
EWPICSKKPSVHCPC

SEQ ID NO: 60229 - protein, 9 aa, BK Virus
ICSKKPSVH

SEQ ID NO: 60230 - protein, 15 aa, BK Virus
WPICSKKPSVHCPCM

SEQ ID NO: 60231 - protein, 9 aa, BK Virus
ICSKKPSVH

SEQ ID NO: 60232 - protein, 15 aa, BK Virus
QLRLRHLNRKFLRKE

SEQ ID NO: 60233 - protein, 9 aa, BK Virus
LRLRHLNRK

SEQ ID NO: 60234 - protein, 15 aa, BK Virus
LRLRHLNRKFLRKEP

SEQ ID NO: 60235 - protein, 9 aa, BK Virus
LRLRHLNRK

SEQ ID NO: 60236 - protein, 15 aa, BK Virus
ICSKKPSVHCPCMLC

SEQ ID NO: 60237 - protein, 9 aa, BK Virus
ICSKKPSVH

SEQ ID NO: 60238 - protein, 15 aa, BK Virus
PICSKKPSVHCPCML

SEQ ID NO: 60239 - protein, 9 aa, BK Virus
ICSKKPSVH

SEQ ID NO: 60240 - protein, 15 aa, BK Virus
EDKMKRMNTLYKKME

SEQ ID NO: 60241 - protein, 9 aa, BK Virus
MKRMNTLYK

SEQ ID NO: 60242 - protein, 15 aa, BK Virus
DKMKRMNTLYKKMEQ

SEQ ID NO: 60243 - protein, 9 aa, BK Virus
MKRMNTLYK

SEQ ID NO: 60244 - protein, 15 aa, BK Virus
DEDKMKRMNTLYKKM

SEQ ID NO: 60245 - protein, 9 aa, BK Virus
MKRMNTLYK

SEQ ID NO: 60246 - protein, 15 aa, BK Virus
GDEDKMKRMNTLYKK

SEQ ID NO: 60247 - protein, 9 aa, BK Virus
MKRMNTLYK

SEQ ID NO: 60248 - protein, 15 aa, BK Virus
GGDEDKMKRMNTLYK

SEQ ID NO: 60249 - protein, 9 aa, BK Virus
DKMKRMNTL

SEQ ID NO: 60250 - protein, 15 aa, BK Virus
MLCQLRLRHLNRKFL

SEQ ID NO: 60251 - protein, 9 aa, BK Virus
LRLRHLNRK

SEQ ID NO: 60252 - protein, 15 aa, BK Virus
CQLRLRHLNRKFLRK

SEQ ID NO: 60253 - protein, 9 aa, BK Virus
LRHLNRKFL

SEQ ID NO: 60254 - protein, 15 aa, BK Virus
KRMNTLYKKMEQDVK

SEQ ID NO: 60255 - protein, 9 aa, BK Virus
KRMNTLYKK

SEQ ID NO: 60256 - protein, 15 aa, BK Virus
AAWGNLPLMRKAYLK

SEQ ID NO: 60257 - protein, 9 aa, BK Virus
WGNLPLMRK

SEQ ID NO: 60258 - protein, 15 aa, BK Virus
LEKRILQSGMTLLLL

SEQ ID NO: 60259 - protein, 9 aa, BK Virus
LQSGMTLLL

SEQ ID NO: 60260 - protein, 15 aa, BK Virus
EKRILQSGMTLLLLL

SEQ ID NO: 60261 - protein, 9 aa, BK Virus
LQSGMTLLL

SEQ ID NO: 60262 - protein, 15 aa, BK Virus
KRILQSGMTLLLLLI

SEQ ID NO: 60263 - protein, 9 aa, BK Virus
LQSGMTLLL

SEQ ID NO: 60264 - protein, 15 aa, BK Virus
RILQSGMTLLLLLIW

SEQ ID NO: 60265 - protein, 9 aa, BK Virus
LQSGMTLLL

SEQ ID NO: 60266 - protein, 15 aa, BK Virus
LLEKRILQSGMTLLL

SEQ ID NO: 60267 - protein, 9 aa, BK Virus
KRILQSGMT

SEQ ID NO: 60268 - protein, 15 aa, BK Virus
RAAWGNLPLMRKAYL

SEQ ID NO: 60269 - protein, 9 aa, BK Virus
WGNLPLMRK

SEQ ID NO: 60270 - protein, 15 aa, BK Virus
LERAAWGNLPLMRKA

SEQ ID NO: 60271 - protein, 9 aa, BK Virus
WGNLPLMRK

SEQ ID NO: 60272 - protein, 15 aa, BK Virus
ERAAWGNLPLMRKAY

SEQ ID NO: 60273 - protein, 9 aa, BK Virus
WGNLPLMRK

SEQ ID NO: 60274 - protein, 15 aa, BK Virus
AAWGNLPLMRKAYLK

SEQ ID NO: 60275 - protein, 9 aa, BK Virus
WGNLPLMRK

SEQ ID NO: 60276 - protein, 15 aa, BK Virus
GLERAAWGNLPLMRK

SEQ ID NO: 60277 - protein, 9 aa, BK Virus
ERAAWGNLP

SEQ ID NO: 60278 - protein, 15 aa, BK Virus
ILQSGMTLLLLLIWF

SEQ ID NO: 60279 - protein, 9 aa, BK Virus
LQSGMTLLL

SEQ ID NO: 60280 - protein, 15 aa, BK Virus
LQSGMTLLLLLIWFR

SEQ ID NO: 60281 - protein, 9 aa, BK Virus
LQSGMTLLL

SEQ ID NO: 60282 - protein, 15 aa, BK Virus
NAVLEQYMAGVAWLH

SEQ ID NO: 60283 - protein, 9 aa, BK Virus
EQYMAGVAW

SEQ ID NO: 60284 - protein, 15 aa, BK Virus
EQYMAGVAWLHCLLP

SEQ ID NO: 60285 - protein, 9 aa, BK Virus
YMAGVAWLH

SEQ ID NO: 60286 - protein, 15 aa, BK Virus
VLEQYMAGVAWLHCL

SEQ ID NO: 60287 - protein, 9 aa, BK Virus
YMAGVAWLH

SEQ ID NO: 60288 - protein, 15 aa, BK Virus
AVLEQYMAGVAWLHC

SEQ ID NO: 60289 - protein, 9 aa, BK Virus
YMAGVAWLH

SEQ ID NO: 60290 - protein, 15 aa, BK Virus
LEQYMAGVAWLHCLL

SEQ ID NO: 60291 - protein, 9 aa, BK Virus
YMAGVAWLH

SEQ ID NO: 60292 - protein, 15 aa, BK Virus
LLDLCGGKALNVNLP

SEQ ID NO: 60293 - protein, 9 aa, BK Virus
LCGGKALNV

SEQ ID NO: 60294 - protein, 15 aa, BK Virus
LHQFLSQAVFSNRTL

SEQ ID NO: 60295 - protein, 9 aa, BK Virus
LHQFLSQAV

SEQ ID NO: 60296 - protein, 15 aa, BK Virus
DLHQFLSQAVFSNRT

SEQ ID NO: 60297 - protein, 9 aa, BK Virus
LHQFLSQAV

SEQ ID NO: 60298 - protein, 15 aa, BK Virus
LDLCGGKALNVNLPM

SEQ ID NO: 60299 - protein, 9 aa, BK Virus
LCGGKALNV

SEQ ID NO: 60300 - protein, 15 aa, BK Virus
AGLLDLCGGKALNVN

SEQ ID NO: 60301 - protein, 9 aa, BK Virus
LCGGKALNV

SEQ ID NO: 60302 - protein, 15 aa, BK Virus
GLLDLCGGKALNVNL

SEQ ID NO: 60303 - protein, 9 aa, BK Virus
LCGGKALNV

SEQ ID NO: 60304 - protein, 15 aa, BK Virus
AAGLLDLCGGKALNV

SEQ ID NO: 60305 - protein, 9 aa, BK Virus
LLDLCGGKA

SEQ ID NO: 60306 - protein, 15 aa, BK Virus
SDLHQFLSQAVFSNR

SEQ ID NO: 60307 - protein, 9 aa, BK Virus
LHQFLSQAV

SEQ ID NO: 60308 - protein, 15 aa, BK Virus
PSDLHQFLSQAVFSN

SEQ ID NO: 60309 - protein, 9 aa, BK Virus
LHQFLSQAV

SEQ ID NO: 60310 - protein, 15 aa, BK Virus
YPVPKTLQARFVRQI

SEQ ID NO: 60311 - protein, 9 aa, BK Virus
PKTLQARFV

SEQ ID NO: 60312 - protein, 15 aa, BK Virus
PVPKTLQARFVRQID

SEQ ID NO: 60313 - protein, 9 aa, BK Virus
LQARFVRQI

SEQ ID NO: 60314 - protein, 15 aa, BK Virus
FPSDLHQFLSQAVFS

SEQ ID NO: 60315 - protein, 9 aa, BK Virus
LHQFLSQAV

SEQ ID NO: 60316 - protein, 15 aa, BK Virus
KDFPSDLHQFLSQAV

SEQ ID NO: 60317 - protein, 9 aa, BK Virus
FPSDLHQFL

SEQ ID NO: 60318 - protein, 15 aa, BK Virus
DFPSDLHQFLSQAVF

SEQ ID NO: 60319 - protein, 9 aa, BK Virus
LHQFLSQAV

SEQ ID NO: 60320 - protein, 15 aa, BK Virus
WGNLPLMRKAYLKKC

SEQ ID NO: 60321 - protein, 9 aa, BK Virus
WGNLPLMRK

SEQ ID NO: 60322 - protein, 15 aa, BK Virus
AWGNLPLMRKAYLKK

SEQ ID NO: 60323 - protein, 9 aa, BK Virus
WGNLPLMRK

SEQ ID NO: 60324 - protein, 15 aa, BK Virus
NKRTQIFPPGLVTMN

SEQ ID NO: 60325 - protein, 9 aa, BK Virus
IFPPGLVTM

SEQ ID NO: 60326 - protein, 15 aa, BK Virus
KRTQIFPPGLVTMNE

SEQ ID NO: 60327 - protein, 9 aa, BK Virus
IFPPGLVTM

SEQ ID NO: 60328 - protein, 15 aa, BK Virus
GPIDSGKTTLAAGLL

SEQ ID NO: 60329 - protein, 9 aa, BK Virus
IDSGKTTLA

SEQ ID NO: 60330 - protein, 15 aa, BK Virus
RTQIFPPGLVTMNEY

SEQ ID NO: 60331 - protein, 9 aa, BK Virus
IFPPGLVTM

SEQ ID NO: 60332 - protein, 15 aa, BK Virus
TQIFPPGLVTMNEYP

SEQ ID NO: 60333 - protein, 9 aa, BK Virus
IFPPGLVTM

SEQ ID NO: 60334 - protein, 15 aa, BK Virus
KQVSWKLITEYAVET

SEQ ID NO: 60335 - protein, 9 aa, BK Virus
WKLITEYAV

SEQ ID NO: 60336 - protein, 15 aa, BK Virus
QVSWKLITEYAVETK

SEQ ID NO: 60337 - protein, 9 aa, BK Virus
LITEYAVET

SEQ ID NO: 60338 - protein, 15 aa, BK Virus
CEDVFLLLGMYLEFQ

SEQ ID NO: 60339 - protein, 9 aa, BK Virus
VFLLLGMYL

SEQ ID NO: 60340 - protein, 15 aa, BK Virus
EDVFLLLGMYLEFQY

SEQ ID NO: 60341 - protein, 9 aa, BK Virus
VFLLLGMYL

SEQ ID NO: 60342 - protein, 15 aa, BK Virus
VPKTLQARFVRQIDF

SEQ ID NO: 60343 - protein, 9 aa, BK Virus
LQARFVRQI

SEQ ID NO: 60344 - protein, 15 aa, BK Virus
PKTLQARFVRQIDFR

SEQ ID NO: 60345 - protein, 9 aa, BK Virus
LQARFVRQI

SEQ ID NO: 60346 - protein, 15 aa, BK Virus
VSWKLITEYAVETKC

SEQ ID NO: 60347 - protein, 9 aa, BK Virus
LITEYAVET

SEQ ID NO: 60348 - protein, 15 aa, BK Virus
FLSQAVFSNRTLACF

SEQ ID NO: 60349 - protein, 9 aa, BK Virus
SQAVFSNRT

SEQ ID NO: 60350 - protein, 15 aa, BK Virus
QYMAGVAWLHCLLPK

SEQ ID NO: 60351 - protein, 9 aa, BK Virus
YMAGVAWLH

SEQ ID NO: 60352 - protein, 15 aa, BK Virus
ERLDSEISMYTFSRM

SEQ ID NO: 60353 - protein, 9 aa, BK Virus
LDSEISMYT

SEQ ID NO: 60354 - protein, 15 aa, BK Virus
YMAGVAWLHCLLPKM

SEQ ID NO: 60355 - protein, 9 aa, BK Virus
YMAGVAWLH

SEQ ID NO: 60356 - protein, 15 aa, BK Virus
KALNVNLPMERLTFE

SEQ ID NO: 60357 - protein, 9 aa, BK Virus
LNVNLPMER

SEQ ID NO: 60358 - protein, 15 aa, BK Virus
LCGGKALNVNLPMER

SEQ ID NO: 60359 - protein, 9 aa, BK Virus
LCGGKALNV

SEQ ID NO: 60360 - protein, 15 aa, BK Virus
GGKALNVNLPMERLT

SEQ ID NO: 60361 - protein, 9 aa, BK Virus
LNVNLPMER

SEQ ID NO: 60362 - protein, 15 aa, BK Virus
LFKGPIDSGKTTLAA

SEQ ID NO: 60363 - protein, 9 aa, BK Virus
IDSGKTTLA

SEQ ID NO: 60364 - protein, 15 aa, BK Virus
GKALNVNLPMERLTF

SEQ ID NO: 60365 - protein, 9 aa, BK Virus
LNVNLPMER

SEQ ID NO: 60366 - protein, 15 aa, BK Virus
KGPIDSGKTTLAAGL

SEQ ID NO: 60367 - protein, 9 aa, BK Virus
IDSGKTTLA

SEQ ID NO: 60368 - protein, 15 aa, BK Virus
VEWKERLDSEISMYT

SEQ ID NO: 60369 - protein, 9 aa, BK Virus
KERLDSEIS

SEQ ID NO: 60370 - protein, 15 aa, BK Virus
CGGKALNVNLPMERL

SEQ ID NO: 60371 - protein, 9 aa, BK Virus
LNVNLPMER

SEQ ID NO: 60372 - protein, 15 aa, BK Virus
GHGINNLDSLRDYLD

SEQ ID NO: 60373 - protein, 9 aa, BK Virus
INNLDSLRD

SEQ ID NO: 60374 - protein, 15 aa, BK Virus
SWKLITEYAVETKCE

SEQ ID NO: 60375 - protein, 9 aa, BK Virus
LITEYAVET

SEQ ID NO: 60376 - protein, 15 aa, BK Virus
SGHGINNLDSLRDYL

SEQ ID NO: 60377 - protein, 9 aa, BK Virus
INNLDSLRD

SEQ ID NO: 60378 - protein, 15 aa, BK Virus
HGINNLDSLRDYLDG

SEQ ID NO: 60379 - protein, 9 aa, BK Virus
INNLDSLRD

SEQ ID NO: 60380 - protein, 15 aa, BK Virus
WLFKGPIDSGKTTLA

SEQ ID NO: 60381 - protein, 9 aa, BK Virus
KGPIDSGKT

SEQ ID NO: 60382 - protein, 15 aa, BK Virus
LPSGHGINNLDSLRD

SEQ ID NO: 60383 - protein, 9 aa, BK Virus
LPSGHGINN

SEQ ID NO: 60384 - protein, 15 aa, BK Virus
MNEYPVPKTLQARFV

SEQ ID NO: 60385 - protein, 9 aa, BK Virus
YPVPKTLQA

SEQ ID NO: 60386 - protein, 15 aa, BK Virus
FKGPIDSGKTTLAAG

SEQ ID NO: 60387 - protein, 9 aa, BK Virus
IDSGKTTLA

SEQ ID NO: 60388 - protein, 15 aa, BK Virus
EWKERLDSEISMYTF

SEQ ID NO: 60389 - protein, 9 aa, BK Virus
LDSEISMYT

SEQ ID NO: 60390 - protein, 15 aa, BK Virus
KERLDSEISMYTFSR

SEQ ID NO: 60391 - protein, 9 aa, BK Virus
LDSEISMYT

SEQ ID NO: 60392 - protein, 15 aa, BK Virus
PSGHGINNLDSLRDY

SEQ ID NO: 60393 - protein, 9 aa, BK Virus
INNLDSLRD

SEQ ID NO: 60394 - protein, 15 aa, BK Virus
WKERLDSEISMYTFS

SEQ ID NO: 60395 - protein, 9 aa, BK Virus
LDSEISMYT

SEQ ID NO: 60396 - protein, 15 aa, BK Virus
WKLITEYAVETKCED

SEQ ID NO: 60397 - protein, 9 aa, BK Virus
LITEYAVET

SEQ ID NO: 60398 - protein, 15 aa, BK Virus
NEYPVPKTLQARFVR

SEQ ID NO: 60399 - protein, 9 aa, BK Virus
PKTLQARFV

SEQ ID NO: 60400 - protein, 15 aa, BK Virus
QIFPPGLVTMNEYPV

SEQ ID NO: 60401 - protein, 9 aa, BK Virus
FPPGLVTMN

SEQ ID NO: 60402 - protein, 15 aa, BK Virus
DLCGGKALNVNLPME

SEQ ID NO: 60403 - protein, 9 aa, BK Virus
LCGGKALNV

SEQ ID NO: 60404 - protein, 15 aa, BK Virus
VNKEYLLYSALTRDP

SEQ ID NO: 60405 - protein, 9 aa, BK Virus
YLLYSALTR

SEQ ID NO: 60406 - protein, 15 aa, BK Virus
HQFLSQAVFSNRTLA

SEQ ID NO: 60407 - protein, 9 aa, BK Virus
SQAVFSNRT

SEQ ID NO: 60408 - protein, 15 aa, BK Virus
MDLIFGAHGNAVLEQ

SEQ ID NO: 60409 - protein, 9 aa, BK Virus
IFGAHGNAV

SEQ ID NO: 60410 - protein, 15 aa, BK Virus
DLIFGAHGNAVLEQY

SEQ ID NO: 60411 - protein, 9 aa, BK Virus
IFGAHGNAV

SEQ ID NO: 60412 - protein, 15 aa, BK Virus
NKEYLLYSALTRDPY

SEQ ID NO: 60413 - protein, 9 aa, BK Virus
LYSALTRDP

SEQ ID NO: 60414 - protein, 15 aa, BK Virus
QFLSQAVFSNRTLAC

SEQ ID NO: 60415 - protein, 9 aa, BK Virus
SQAVFSNRT

SEQ ID NO: 60416 - protein, 15 aa, BK Virus
KMDLIFGAHGNAVLE

SEQ ID NO: 60417 - protein, 9 aa, BK Virus
IFGAHGNAV

SEQ ID NO: 60418 - protein, 15 aa, BK Virus
FLLEKRILQSGMTLL

SEQ ID NO: 60419 - protein, 9 aa, BK Virus
KRILQSGMT

SEQ ID NO: 60420 - protein, 15 aa, BK Virus
DKMDLIFGAHGNAVL

SEQ ID NO: 60421 - protein, 9 aa, BK Virus
IFGAHGNAV

SEQ ID NO: 60422 - protein, 15 aa, BK Virus
KEYLLYSALTRDPYH

SEQ ID NO: 60423 - protein, 9 aa, BK Virus
LYSALTRDP

SEQ ID NO: 60424 - protein, 15 aa, BK Virus
ALNVNLPMERLTFEL

SEQ ID NO: 60425 - protein, 9 aa, BK Virus
NVNLPMERL

SEQ ID NO: 60426 - protein, 15 aa, BK Virus
DVFLLLGMYLEFQYN

SEQ ID NO: 60427 - protein, 9 aa, BK Virus
LLGMYLEFQ

SEQ ID NO: 60428 - protein, 15 aa, BK Virus
YLLYSALTRDPYHII

SEQ ID NO: 60429 - protein, 9 aa, BK Virus
LYSALTRDP

SEQ ID NO: 60430 - protein, 15 aa, BK Virus
ICQQAVDTVLAKKRV

SEQ ID NO: 60431 - protein, 9 aa, BK Virus
QQAVDTVLA

SEQ ID NO: 60432 - protein, 15 aa, BK Virus
IDSGKTTLAAGLLDL

SEQ ID NO: 60433 - protein, 9 aa, BK Virus
IDSGKTTLA

SEQ ID NO: 60434 - protein, 15 aa, BK Virus
SQAVFSNRTLACFAV

SEQ ID NO: 60435 - protein, 9 aa, BK Virus
FSNRTLACF

SEQ ID NO: 60436 - protein, 15 aa, BK Virus
SICQQAVDTVLAKKR

SEQ ID NO: 60437 - protein, 9 aa, BK Virus
QQAVDTVLA

SEQ ID NO: 60438 - protein, 15 aa, BK Virus
LSQAVFSNRTLACFA

SEQ ID NO: 60439 - protein, 9 aa, BK Virus
FSNRTLACF

SEQ ID NO: 60440 - protein, 15 aa, BK Virus
EYLLYSALTRDPYHI

SEQ ID NO: 60441 - protein, 9 aa, BK Virus
LYSALTRDP

SEQ ID NO: 60442 - protein, 15 aa, BK Virus
IFPPGLVTMNEYPVP

SEQ ID NO: 60443 - protein, 9 aa, BK Virus
IFPPGLVTM

SEQ ID NO: 60444 - protein, 15 aa, BK Virus
EYPVPKTLQARFVRQ

SEQ ID NO: 60445 - protein, 9 aa, BK Virus
PKTLQARFV

SEQ ID NO: 60446 - protein, 15 aa, BK Virus
PIDSGKTTLAAGLLD

SEQ ID NO: 60447 - protein, 9 aa, BK Virus
IDSGKTTLA

SEQ ID NO: 60448 - protein, 15 aa, BK Virus
LNKRTQIFPPGLVTM

SEQ ID NO: 60449 - protein, 9 aa, BK Virus
RTQIFPPGL

SEQ ID NO: 60450 - protein, 15 aa, BK Virus
VFLLLGMYLEFQYNV

SEQ ID NO: 60451 - protein, 9 aa, BK Virus
VFLLLGMYL

SEQ ID NO: 60452 - protein, 15 aa, BK Virus
MELMDLLGLERAAWG

SEQ ID NO: 60453 - protein, 9 aa, BK Virus
MDLLGLERA

SEQ ID NO: 60454 - protein, 15 aa, BK Virus
VFEDVKGTGAESKDL

SEQ ID NO: 60455 - protein, 9 aa, BK Virus
VKGTGAESK

SEQ ID NO: 60456 - protein, 15 aa, BK Virus
FEDVKGTGAESKDLP

SEQ ID NO: 60457 - protein, 9 aa, BK Virus
VKGTGAESK

SEQ ID NO: 60458 - protein, 15 aa, BK Virus
KTLQARFVRQIDFRP

SEQ ID NO: 60459 - protein, 9 aa, BK Virus
LQARFVRQI

SEQ ID NO: 60460 - protein, 15 aa, BK Virus
EDVKGTGAESKDLPS

SEQ ID NO: 60461 - protein, 9 aa, BK Virus
VKGTGAESK

SEQ ID NO: 60462 - protein, 15 aa, BK Virus
NIIFFLTPHRHRVSA

SEQ ID NO: 60463 - protein, 9 aa, BK Virus
IFFLTPHRH

SEQ ID NO: 60464 - protein, 15 aa, BK Virus
QKSICQQAVDTVLAK

SEQ ID NO: 60465 - protein, 9 aa, BK Virus
ICQQAVDTV

SEQ ID NO: 60466 - protein, 15 aa, BK Virus
HNIIFFLTPHRHRVS

SEQ ID NO: 60467 - protein, 9 aa, BK Virus
IFFLTPHRH

SEQ ID NO: 60468 - protein, 15 aa, BK Virus
KSICQQAVDTVLAKK

SEQ ID NO: 60469 - protein, 9 aa, BK Virus
ICQQAVDTV

SEQ ID NO: 60470 - protein, 15 aa, BK Virus
NQKSICQQAVDTVLA

SEQ ID NO: 60471 - protein, 9 aa, BK Virus
ICQQAVDTV

SEQ ID NO: 60472 - protein, 15 aa, BK Virus
LNVNLPMERLTFELG

SEQ ID NO: 60473 - protein, 9 aa, BK Virus
NVNLPMERL

SEQ ID NO: 60474 - protein, 15 aa, BK Virus
LVTMNEYPVPKTLQA

SEQ ID NO: 60475 - protein, 9 aa, BK Virus
MNEYPVPKT

SEQ ID NO: 60476 - protein, 15 aa, BK Virus
VTMNEYPVPKTLQAR

SEQ ID NO: 60477 - protein, 9 aa, BK Virus
YPVPKTLQA

SEQ ID NO: 60478 - protein, 15 aa, BK Virus
LDKMDLIFGAHGNAV

SEQ ID NO: 60479 - protein, 9 aa, BK Virus
LDKMDLIFG

SEQ ID NO: 60480 - protein, 15 aa, BK Virus
QSGMTLLLLLIWFRP

SEQ ID NO: 60481 - protein, 9 aa, BK Virus
MTLLLLLIW

SEQ ID NO: 60482 - protein, 15 aa, BK Virus
TKCEDVFLLLGMYLE

SEQ ID NO: 60483 - protein, 9 aa, BK Virus
VFLLLGMYL

SEQ ID NO: 60484 - protein, 15 aa, BK Virus
KCEDVFLLLGMYLEF

SEQ ID NO: 60485 - protein, 9 aa, BK Virus
VFLLLGMYL

SEQ ID NO: 60486 - protein, 15 aa, BK Virus
LIFGAHGNAVLEQYM

SEQ ID NO: 60487 - protein, 9 aa, BK Virus
FGAHGNAVL

SEQ ID NO: 60488 - protein, 15 aa, BK Virus
AWLHCLLPKMDSVIF

SEQ ID NO: 60489 - protein, 9 aa, BK Virus
LLPKMDSVI

SEQ ID NO: 60490 - protein, 15 aa, BK Virus
RLDSEISMYTFSRMK

SEQ ID NO: 60491 - protein, 9 aa, BK Virus
LDSEISMYT

SEQ ID NO: 60492 - protein, 15 aa, BK Virus
LDSEISMYTFSRMKY

SEQ ID NO: 60493 - protein, 9 aa, BK Virus
LDSEISMYT

SEQ ID NO: 60494 - protein, 15 aa, BK Virus
ELMDLLGLERAAWGN

SEQ ID NO: 60495 - protein, 9 aa, BK Virus
MDLLGLERA

SEQ ID NO: 60496 - protein, 15 aa, BK Virus
VVFEDVKGTGAESKD

SEQ ID NO: 60497 - protein, 9 aa, BK Virus
VKGTGAESK

SEQ ID NO: 60498 - protein, 15 aa, BK Virus
MVVFEDVKGTGAESK

SEQ ID NO: 60499 - protein, 9 aa, BK Virus
FEDVKGTGA

SEQ ID NO: 60500 - protein, 15 aa, BK Virus
QQAVDTVLAKKRVDT

SEQ ID NO: 60501 - protein, 9 aa, BK Virus
VDTVLAKKR

SEQ ID NO: 60502 - protein, 15 aa, BK Virus
ILYKKLMEKYSVTFI

SEQ ID NO: 60503 - protein, 9 aa, BK Virus
YKKLMEKYS

SEQ ID NO: 60504 - protein, 15 aa, BK Virus
CQQAVDTVLAKKRVD

SEQ ID NO: 60505 - protein, 9 aa, BK Virus
VDTVLAKKR

SEQ ID NO: 60506 - protein, 15 aa, BK Virus
EESMELMDLLGLERA

SEQ ID NO: 60507 - protein, 9 aa, BK Virus
LMDLLGLER

SEQ ID NO: 60508 - protein, 15 aa, BK Virus
ESMELMDLLGLERAA

SEQ ID NO: 60509 - protein, 9 aa, BK Virus
LMDLLGLER

SEQ ID NO: 60510 - protein, 15 aa, BK Virus
WLHCLLPKMDSVIFD

SEQ ID NO: 60511 - protein, 9 aa, BK Virus
LPKMDSVIF

SEQ ID NO: 60512 - protein, 15 aa, BK Virus
EHDFNPEEPEETKQV

SEQ ID NO: 60513 - protein, 9 aa, BK Virus
FNPEEPEET

SEQ ID NO: 60514 - protein, 15 aa, BK Virus
VFSNRTLACFAVYTT

SEQ ID NO: 60515 - protein, 9 aa, BK Virus
TLACFAVYT

SEQ ID NO: 60516 - protein, 15 aa, BK Virus
HDFNPEEPEETKQVS

SEQ ID NO: 60517 - protein, 9 aa, BK Virus
FNPEEPEET

SEQ ID NO: 60518 - protein, 15 aa, BK Virus
DEDKMKRMNTLYKKM

SEQ ID NO: 60519 - protein, 9 aa, BK Virus
MKRMNTLYK

SEQ ID NO: 60520 - protein, 15 aa, BK Virus
KEHDFNPEEPEETKQ

SEQ ID NO: 60521 - protein, 9 aa, BK Virus
FNPEEPEET

SEQ ID NO: 60522 - protein, 15 aa, BK Virus
LHCLLPKMDSVIFDF

SEQ ID NO: 60523 - protein, 9 aa, BK Virus
LPKMDSVIF

SEQ ID NO: 60524 - protein, 15 aa, BK Virus
LKEHDFNPEEPEETK

SEQ ID NO: 60525 - protein, 9 aa, BK Virus
FNPEEPEET

SEQ ID NO: 60526 - protein, 15 aa, BK Virus
QAVFSNRTLACFAVY

SEQ ID NO: 60527 - protein, 9 aa, BK Virus
FSNRTLACF

SEQ ID NO: 60528 - protein, 15 aa, BK Virus
EFLLEKRILQSGMTL

SEQ ID NO: 60529 - protein, 9 aa, BK Virus
KRILQSGMT

SEQ ID NO: 60530 - protein, 15 aa, BK Virus
KGVNKEYLLYSALTR

SEQ ID NO: 60531 - protein, 9 aa, BK Virus
EYLLYSALT

SEQ ID NO: 60532 - protein, 15 aa, BK Virus
DFRPKIYLRKSLQNS

SEQ ID NO: 60533 - protein, 9 aa, BK Virus
FRPKIYLRK

SEQ ID NO: 60534 - protein, 15 aa, BK Virus
GDEDKMKRMNTLYKK

SEQ ID NO: 60535 - protein, 9 aa, BK Virus
MKRMNTLYK

SEQ ID NO: 60536 - protein, 15 aa, BK Virus
FRPKIYLRKSLQNSE

SEQ ID NO: 60537 - protein, 9 aa, BK Virus
YLRKSLQNS

SEQ ID NO: 60538 - protein, 15 aa, BK Virus
QILYKKLMEKYSVTF

SEQ ID NO: 60539 - protein, 9 aa, BK Virus
YKKLMEKYS

SEQ ID NO: 60540 - protein, 15 aa, BK Virus
GLKEHDFNPEEPEET

SEQ ID NO: 60541 - protein, 9 aa, BK Virus
GLKEHDFNP

SEQ ID NO: 60542 - protein, 15 aa, BK Virus
IIFFLTPHRHRVSAI

SEQ ID NO: 60543 - protein, 9 aa, BK Virus
LTPHRHRVS

SEQ ID NO: 60544 - protein, 15 aa, BK Virus
HCLLPKMDSVIFDFL

SEQ ID NO: 60545 - protein, 9 aa, BK Virus
LPKMDSVIF

SEQ ID NO: 60546 - protein, 15 aa, BK Virus
SMELMDLLGLERAAW

SEQ ID NO: 60547 - protein, 9 aa, BK Virus
MDLLGLERA

SEQ ID NO: 60548 - protein, 15 aa, BK Virus
LLLLIWFRPVADFSK

SEQ ID NO: 60549 - protein, 9 aa, BK Virus
LIWFRPVAD

SEQ ID NO: 60550 - protein, 15 aa, BK Virus
EDKMKRMNTLYKKME

SEQ ID NO: 60551 - protein, 9 aa, BK Virus
MKRMNTLYK

SEQ ID NO: 60552 - protein, 15 aa, BK Virus
SEFLLEKRILQSGMT

SEQ ID NO: 60553 - protein, 9 aa, BK Virus
LEKRILQSG

SEQ ID NO: 60554 - protein, 15 aa, BK Virus
LLLIWFRPVADFSKD

SEQ ID NO: 60555 - protein, 9 aa, BK Virus
LIWFRPVAD

SEQ ID NO: 60556 - protein, 15 aa, BK Virus
PKIYLRKSLQNSEFL

SEQ ID NO: 60557 - protein, 9 aa, BK Virus
YLRKSLQNS

SEQ ID NO: 60558 - protein, 15 aa, BK Virus
FPPGLVTMNEYPVPK

SEQ ID NO: 60559 - protein, 9 aa, BK Virus
FPPGLVTMN

SEQ ID NO: 60560 - protein, 15 aa, BK Virus
IFFLTPHRHRVSAIN

SEQ ID NO: 60561 - protein, 9 aa, BK Virus
LTPHRHRVS

SEQ ID NO: 60562 - protein, 15 aa, BK Virus
DKMKRMNTLYKKMEQ

SEQ ID NO: 60563 - protein, 9 aa, BK Virus
MKRMNTLYK

SEQ ID NO: 60564 - protein, 15 aa, BK Virus
RPKIYLRKSLQNSEF

SEQ ID NO: 60565 - protein, 9 aa, BK Virus
YLRKSLQNS

SEQ ID NO: 60566 - protein, 15 aa, BK Virus
GGDEDKMKRMNTLYK

SEQ ID NO: 60567 - protein, 9 aa, BK Virus
DKMKRMNTL

SEQ ID NO: 60568 - protein, 15 aa, BK Virus
DKVLNREESMELMDL

SEQ ID NO: 60569 - protein, 9 aa, BK Virus
LNREESMEL

SEQ ID NO: 60570 - protein, 15 aa, BK Virus
LLLLLIWFRPVADFS

SEQ ID NO: 60571 - protein, 9 aa, BK Virus
LIWFRPVAD

SEQ ID NO: 60572 - protein, 15 aa, BK Virus
FSNRTLACFAVYTTK

SEQ ID NO: 60573 - protein, 9 aa, BK Virus
LACFAVYTT

SEQ ID NO: 60574 - protein, 15 aa, BK Virus
KVLNREESMELMDLL

SEQ ID NO: 60575 - protein, 9 aa, BK Virus
LNREESMEL

SEQ ID NO: 60576 - protein, 15 aa, BK Virus
ETKCEDVFLLLGMYL

SEQ ID NO: 60577 - protein, 9 aa, BK Virus
EDVFLLLGM

SEQ ID NO: 60578 - protein, 15 aa, BK Virus
SGMTLLLLLIWFRPV

SEQ ID NO: 60579 - protein, 9 aa, BK Virus
MTLLLLLIW

SEQ ID NO: 60580 - protein, 15 aa, BK Virus
INNLDSLRDYLDGSV

SEQ ID NO: 60581 - protein, 9 aa, BK Virus
INNLDSLRD

SEQ ID NO: 60582 - protein, 15 aa, BK Virus
PPGLVTMNEYPVPKT

SEQ ID NO: 60583 - protein, 9 aa, BK Virus
LVTMNEYPV

SEQ ID NO: 60584 - protein, 15 aa, BK Virus
PGLVTMNEYPVPKTL

SEQ ID NO: 60585 - protein, 9 aa, BK Virus
MNEYPVPKT

SEQ ID NO: 60586 - protein, 15 aa, BK Virus
AVFSNRTLACFAVYT

SEQ ID NO: 60587 - protein, 9 aa, BK Virus
FSNRTLACF

SEQ ID NO: 60588 - protein, 15 aa, BK Virus
GINNLDSLRDYLDGS

SEQ ID NO: 60589 - protein, 9 aa, BK Virus
INNLDSLRD

SEQ ID NO: 60590 - protein, 15 aa, BK Virus
GVNKEYLLYSALTRD

SEQ ID NO: 60591 - protein, 9 aa, BK Virus
YLLYSALTR

SEQ ID NO: 60592 - protein, 15 aa, BK Virus
TMNEYPVPKTLQARF

SEQ ID NO: 60593 - protein, 9 aa, BK Virus
YPVPKTLQA

SEQ ID NO: 60594 - protein, 15 aa, BK Virus
LTFELGVAIDQYMVV

SEQ ID NO: 60595 - protein, 9 aa, BK Virus
LGVAIDQYM

SEQ ID NO: 60596 - protein, 15 aa, BK Virus
ERLTFELGVAIDQYM

SEQ ID NO: 60597 - protein, 9 aa, BK Virus
LTFELGVAI

SEQ ID NO: 60598 - protein, 15 aa, BK Virus
CLLPKMDSVIFDFLH

SEQ ID NO: 60599 - protein, 9 aa, BK Virus
LPKMDSVIF

SEQ ID NO: 60600 - protein, 15 aa, BK Virus
KIYLRKSLQNSEFLL

SEQ ID NO: 60601 - protein, 9 aa, BK Virus
YLRKSLQNS

SEQ ID NO: 60602 - protein, 15 aa, BK Virus
LMDLLGLERAAWGNL

SEQ ID NO: 60603 - protein, 9 aa, BK Virus
LGLERAAWG

SEQ ID NO: 60604 - protein, 15 aa, BK Virus
MTLLLLLIWFRPVAD

SEQ ID NO: 60605 - protein, 9 aa, BK Virus
MTLLLLLIW

SEQ ID NO: 60606 - protein, 15 aa, BK Virus
NVNLPMERLTFELGV

SEQ ID NO: 60607 - protein, 9 aa, BK Virus
NVNLPMERL

SEQ ID NO: 60608 - protein, 15 aa, BK Virus
GHNIIFFLTPHRHRV

SEQ ID NO: 60609 - protein, 9 aa, BK Virus
IFFLTPHRH

SEQ ID NO: 60610 - protein, 15 aa, BK Virus
MDKVLNREESMELMD

SEQ ID NO: 60611 - protein, 9 aa, BK Virus
LNREESMEL

SEQ ID NO: 60612 - protein, 15 aa, BK Virus
SGKTTLAAGLLDLCG

SEQ ID NO: 60613 - protein, 9 aa, BK Virus
KTTLAAGLL

SEQ ID NO: 60614 - protein, 15 aa, BK Virus
LLYSALTRDPYHIIE

SEQ ID NO: 60615 - protein, 9 aa, BK Virus
LYSALTRDP

SEQ ID NO: 60616 - protein, 15 aa, BK Virus
IFGAHGNAVLEQYMA

SEQ ID NO: 60617 - protein, 9 aa, BK Virus
IFGAHGNAV

SEQ ID NO: 60618 - protein, 15 aa, BK Virus
KLITEYAVETKCEDV

SEQ ID NO: 60619 - protein, 9 aa, BK Virus
LITEYAVET

SEQ ID NO: 60620 - protein, 15 aa, BK Virus
RLTFELGVAIDQYMV

SEQ ID NO: 60621 - protein, 9 aa, BK Virus
LGVAIDQYM

SEQ ID NO: 60622 - protein, 15 aa, BK Virus
LYSALTRDPYHIIEE

SEQ ID NO: 60623 - protein, 9 aa, BK Virus
LYSALTRDP

SEQ ID NO: 60624 - protein, 15 aa, BK Virus
RYWLFKGPIDSGKTT

SEQ ID NO: 60625 - protein, 9 aa, BK Virus
WLFKGPIDS

SEQ ID NO: 60626 - protein, 15 aa, BK Virus
RRYWLFKGPIDSGKT

SEQ ID NO: 60627 - protein, 9 aa, BK Virus
WLFKGPIDS

SEQ ID NO: 60628 - protein, 15 aa, BK Virus
LITEYAVETKCEDVF

SEQ ID NO: 60629 - protein, 9 aa, BK Virus
LITEYAVET

SEQ ID NO: 60630 - protein, 15 aa, BK Virus
MDLLGLERAAWGNLP

SEQ ID NO: 60631 - protein, 9 aa, BK Virus
LGLERAAWG

SEQ ID NO: 60632 - protein, 15 aa, BK Virus
DVKGTGAESKDLPSG

SEQ ID NO: 60633 - protein, 9 aa, BK Virus
VKGTGAESK

SEQ ID NO: 60634 - protein, 15 aa, BK Virus
VKGTGAESKDLPSGH

SEQ ID NO: 60635 - protein, 9 aa, BK Virus
VKGTGAESK

SEQ ID NO: 60636 - protein, 15 aa, BK Virus
GLVTMNEYPVPKTLQ

SEQ ID NO: 60637 - protein, 9 aa, BK Virus
MNEYPVPKT

SEQ ID NO: 60638 - protein, 15 aa, BK Virus
YKKLMEKYSVTFISR

SEQ ID NO: 60639 - protein, 9 aa, BK Virus
LMEKYSVTF

SEQ ID NO: 60640 - protein, 15 aa, BK Virus
MAGVAWLHCLLPKMD

SEQ ID NO: 60641 - protein, 9 aa, BK Virus
VAWLHCLLP

SEQ ID NO: 60642 - protein, 15 aa, BK Virus
LYKKLMEKYSVTFIS

SEQ ID NO: 60643 - protein, 9 aa, BK Virus
LMEKYSVTF

SEQ ID NO: 60644 - protein, 15 aa, BK Virus
LNREESMELMDLLGL

SEQ ID NO: 60645 - protein, 9 aa, BK Virus
LNREESMEL

SEQ ID NO: 60646 - protein, 15 aa, BK Virus
LLIWFRPVADFSKDI

SEQ ID NO: 60647 - protein, 9 aa, BK Virus
WFRPVADFS

SEQ ID NO: 60648 - protein, 15 aa, BK Virus
AGVAWLHCLLPKMDS

SEQ ID NO: 60649 - protein, 9 aa, BK Virus
VAWLHCLLP

SEQ ID NO: 60650 - protein, 15 aa, BK Virus
REESMELMDLLGLER

SEQ ID NO: 60651 - protein, 9 aa, BK Virus
MELMDLLGL

SEQ ID NO: 60652 - protein, 15 aa, BK Virus
QAVDTVLAKKRVDTL

SEQ ID NO: 60653 - protein, 9 aa, BK Virus
VDTVLAKKR

SEQ ID NO: 60654 - protein, 15 aa, BK Virus
DSGKTTLAAGLLDLC

SEQ ID NO: 60655 - protein, 9 aa, BK Virus
KTTLAAGLL

SEQ ID NO: 60656 - protein, 15 aa, BK Virus
NRTLACFAVYTTKEK

SEQ ID NO: 60657 - protein, 9 aa, BK Virus
LACFAVYTT

SEQ ID NO: 60658 - protein, 15 aa, BK Virus
AGHNIIFFLTPHRHR

SEQ ID NO: 60659 - protein, 9 aa, BK Virus
IFFLTPHRH

SEQ ID NO: 60660 - protein, 15 aa, BK Virus
TLQARFVRQIDFRPK

SEQ ID NO: 60661 - protein, 9 aa, BK Virus
LQARFVRQI

SEQ ID NO: 60662 - protein, 15 aa, BK Virus
ETKQVSWKLITEYAV

SEQ ID NO: 60663 - protein, 9 aa, BK Virus
VSWKLITEY

SEQ ID NO: 60664 - protein, 15 aa, BK Virus
TKQVSWKLITEYAVE

SEQ ID NO: 60665 - protein, 9 aa, BK Virus
WKLITEYAV

SEQ ID NO: 60666 - protein, 15 aa, BK Virus
LQARFVRQIDFRPKI

SEQ ID NO: 60667 - protein, 9 aa, BK Virus
LQARFVRQI

SEQ ID NO: 60668 - protein, 15 aa, BK Virus
CKGVNKEYLLYSALT

SEQ ID NO: 60669 - protein, 9 aa, BK Virus
VNKEYLLYS

SEQ ID NO: 60670 - protein, 15 aa, BK Virus
KGFQCFKRPKTPPPK

SEQ ID NO: 60671 - protein, 9 aa, BK Virus
FKRPKTPPP

SEQ ID NO: 60672 - protein, 15 aa, BK Virus
KNQKSICQQAVDTVL

SEQ ID NO: 60673 - protein, 9 aa, BK Virus
ICQQAVDTV

SEQ ID NO: 60674 - protein, 15 aa, BK Virus
PDFGTWNSSEVPTYG

SEQ ID NO: 60675 - protein, 9 aa, BK Virus
FGTWNSSEV

SEQ ID NO: 60676 - protein, 15 aa, BK Virus
GDEDKMKRMNTLYKK

SEQ ID NO: 60677 - protein, 9 aa, BK Virus
MKRMNTLYK

SEQ ID NO: 60678 - protein, 15 aa, BK Virus
DEDKMKRMNTLYKKM

SEQ ID NO: 60679 - protein, 9 aa, BK Virus
MKRMNTLYK

SEQ ID NO: 60680 - protein, 15 aa, BK Virus
GGDEDKMKRMNTLYK

SEQ ID NO: 60681 - protein, 9 aa, BK Virus
KMKRMNTLY

SEQ ID NO: 60682 - protein, 15 aa, BK Virus
EDKMKRMNTLYKKME

SEQ ID NO: 60683 - protein, 9 aa, BK Virus
MKRMNTLYK

SEQ ID NO: 60684 - protein, 15 aa, BK Virus
DKMKRMNTLYKKMEQ

SEQ ID NO: 60685 - protein, 9 aa, BK Virus
MKRMNTLYK

SEQ ID NO: 60686 - protein, 15 aa, BK Virus
AGHNIIFFLTPHRHR

SEQ ID NO: 60687 - protein, 9 aa, BK Virus
IIFFLTPHR

SEQ ID NO: 60688 - protein, 15 aa, BK Virus
HNIIFFLTPHRHRVS

SEQ ID NO: 60689 - protein, 9 aa, BK Virus
IIFFLTPHR

SEQ ID NO: 60690 - protein, 15 aa, BK Virus
GHNIIFFLTPHRHRV

SEQ ID NO: 60691 - protein, 9 aa, BK Virus
IIFFLTPHR

SEQ ID NO: 60692 - protein, 15 aa, BK Virus
CAGHNIIFFLTPHRH

SEQ ID NO: 60693 - protein, 9 aa, BK Virus
IIFFLTPHR

SEQ ID NO: 60694 - protein, 15 aa, BK Virus
MCAGHNIIFFLTPHR

SEQ ID NO: 60695 - protein, 9 aa, BK Virus
MCAGHNIIF

SEQ ID NO: 60696 - protein, 15 aa, BK Virus
HNIIFFLTPHRHRVS

SEQ ID NO: 60697 - protein, 9 aa, BK Virus
IIFFLTPHR

SEQ ID NO: 60698 - protein, 15 aa, BK Virus
GHNIIFFLTPHRHRV

SEQ ID NO: 60699 - protein, 9 aa, BK Virus
IIFFLTPHR

SEQ ID NO: 60700 - protein, 15 aa, BK Virus
CEDVFLLLGMYLEFQ

SEQ ID NO: 60701 - protein, 9 aa, BK Virus
FLLLGMYLE

SEQ ID NO: 60702 - protein, 15 aa, BK Virus
DVFLLLGMYLEFQYN

SEQ ID NO: 60703 - protein, 9 aa, BK Virus
LLGMYLEFQ

SEQ ID NO: 60704 - protein, 15 aa, BK Virus
EDVFLLLGMYLEFQY

SEQ ID NO: 60705 - protein, 9 aa, BK Virus
LLGMYLEFQ

SEQ ID NO: 60706 - protein, 15 aa, BK Virus
FLLLGMYLEFQYNVE

SEQ ID NO: 60707 - protein, 9 aa, BK Virus
LLGMYLEFQ

SEQ ID NO: 60708 - protein, 15 aa, BK Virus
VFLLLGMYLEFQYNV

SEQ ID NO: 60709 - protein, 9 aa, BK Virus
LLGMYLEFQ

SEQ ID NO: 60710 - protein, 15 aa, BK Virus
AGHNIIFFLTPHRHR

SEQ ID NO: 60711 - protein, 9 aa, BK Virus
IIFFLTPHR

SEQ ID NO: 60712 - protein, 15 aa, BK Virus
CAGHNIIFFLTPHRH

SEQ ID NO: 60713 - protein, 9 aa, BK Virus
IIFFLTPHR

SEQ ID NO: 60714 - protein, 15 aa, BK Virus
MTLLLLLIWFRPVAD

SEQ ID NO: 60715 - protein, 9 aa, BK Virus
LLLLIWFRP

SEQ ID NO: 60716 - protein, 15 aa, BK Virus
YMAGVAWLHCLLPKM

SEQ ID NO: 60717 - protein, 9 aa, BK Virus
VAWLHCLLP

SEQ ID NO: 60718 - protein, 15 aa, BK Virus
EQYMAGVAWLHCLLP

SEQ ID NO: 60719 - protein, 9 aa, BK Virus
YMAGVAWLH

SEQ ID NO: 60720 - protein, 15 aa, BK Virus
TLLLLLIWFRPVADF

SEQ ID NO: 60721 - protein, 9 aa, BK Virus
LLLLIWFRP

SEQ ID NO: 60722 - protein, 15 aa, BK Virus
MCAGHNIIFFLTPHR

SEQ ID NO: 60723 - protein, 9 aa, BK Virus
HNIIFFLTP

SEQ ID NO: 60724 - protein, 15 aa, BK Virus
MAGVAWLHCLLPKMD

SEQ ID NO: 60725 - protein, 9 aa, BK Virus
VAWLHCLLP

SEQ ID NO: 60726 - protein, 15 aa, BK Virus
KKLMEKYSVTFISRH

SEQ ID NO: 60727 - protein, 9 aa, BK Virus
LMEKYSVTF

SEQ ID NO: 60728 - protein, 15 aa, BK Virus
AGVAWLHCLLPKMDS

SEQ ID NO: 60729 - protein, 9 aa, BK Virus
VAWLHCLLP

SEQ ID NO: 60730 - protein, 15 aa, BK Virus
LLLLLIWFRPVADFS

SEQ ID NO: 60731 - protein, 9 aa, BK Virus
LLIWFRPVA

SEQ ID NO: 60732 - protein, 15 aa, BK Virus
QYMAGVAWLHCLLPK

SEQ ID NO: 60733 - protein, 9 aa, BK Virus
VAWLHCLLP

SEQ ID NO: 60734 - protein, 15 aa, BK Virus
NIIFFLTPHRHRVSA

SEQ ID NO: 60735 - protein, 9 aa, BK Virus
IIFFLTPHR

SEQ ID NO: 60736 - protein, 15 aa, BK Virus
EKYSVTFISRHMCAG

SEQ ID NO: 60737 - protein, 9 aa, BK Virus
YSVTFISRH

SEQ ID NO: 60738 - protein, 15 aa, BK Virus
LMEKYSVTFISRHMC

SEQ ID NO: 60739 - protein, 9 aa, BK Virus
YSVTFISRH

SEQ ID NO: 60740 - protein, 15 aa, BK Virus
KLMEKYSVTFISRHM

SEQ ID NO: 60741 - protein, 9 aa, BK Virus
YSVTFISRH

SEQ ID NO: 60742 - protein, 15 aa, BK Virus
MEKYSVTFISRHMCA

SEQ ID NO: 60743 - protein, 9 aa, BK Virus
YSVTFISRH

SEQ ID NO: 60744 - protein, 15 aa, BK Virus
LLLLIWFRPVADFSK

SEQ ID NO: 60745 - protein, 9 aa, BK Virus
LLIWFRPVA

SEQ ID NO: 60746 - protein, 15 aa, BK Virus
IIFFLTPHRHRVSAI

SEQ ID NO: 60747 - protein, 9 aa, BK Virus
IIFFLTPHR

SEQ ID NO: 60748 - protein, 15 aa, BK Virus
GMTLLLLLIWFRPVA

SEQ ID NO: 60749 - protein, 9 aa, BK Virus
LLLLIWFRP

SEQ ID NO: 60750 - protein, 15 aa, BK Virus
LDKMDLIFGAHGNAV

SEQ ID NO: 60751 - protein, 9 aa, BK Virus
MDLIFGAHG

SEQ ID NO: 60752 - protein, 15 aa, BK Virus
LLGMYLEFQYNVEEC

SEQ ID NO: 60753 - protein, 9 aa, BK Virus
LLGMYLEFQ

SEQ ID NO: 60754 - protein, 15 aa, BK Virus
LLLGMYLEFQYNVEE

SEQ ID NO: 60755 - protein, 9 aa, BK Virus
LLGMYLEFQ

SEQ ID NO: 60756 - protein, 15 aa, BK Virus
DKMDLIFGAHGNAVL

SEQ ID NO: 60757 - protein, 9 aa, BK Virus
IFGAHGNAV

SEQ ID NO: 60758 - protein, 15 aa, BK Virus
MTLLLLLIWFRPVAD

SEQ ID NO: 60759 - protein, 9 aa, BK Virus
LLIWFRPVA

SEQ ID NO: 60760 - protein, 15 aa, BK Virus
TLLLLLIWFRPVADF

SEQ ID NO: 60761 - protein, 9 aa, BK Virus
LIWFRPVAD

SEQ ID NO: 60762 - protein, 15 aa, BK Virus
LLLLLIWFRPVADFS

SEQ ID NO: 60763 - protein, 9 aa, BK Virus
LIWFRPVAD

SEQ ID NO: 60764 - protein, 15 aa, BK Virus
LLLLIWFRPVADFSK

SEQ ID NO: 60765 - protein, 9 aa, BK Virus
LIWFRPVAD

SEQ ID NO: 60766 - protein, 15 aa, BK Virus
LLLIWFRPVADFSKD

SEQ ID NO: 60767 - protein, 9 aa, BK Virus
LIWFRPVAD

SEQ ID NO: 60768 - protein, 15 aa, BK Virus
YGTEEWESWWSSFNE

SEQ ID NO: 60769 - protein, 9 aa, BK Virus
WESWWSSFN

SEQ ID NO: 60770 - protein, 15 aa, BK Virus
TEEWESWWSSFNEKW

SEQ ID NO: 60771 - protein, 9 aa, BK Virus
WESWWSSFN

SEQ ID NO: 60772 - protein, 15 aa, BK Virus
GTEEWESWWSSFNEK

SEQ ID NO: 60773 - protein, 9 aa, BK Virus
WESWWSSFN

SEQ ID NO: 60774 - protein, 15 aa, BK Virus
EEWESWWSSFNEKWD

SEQ ID NO: 60775 - protein, 9 aa, BK Virus
WESWWSSFN

SEQ ID NO: 60776 - protein, 15 aa, BK Virus
TYGTEEWESWWSSFN

SEQ ID NO: 60777 - protein, 9 aa, BK Virus
TEEWESWWS

SEQ ID NO: 60778 - protein, 15 aa, BK Virus
LLIWFRPVADFSKDI

SEQ ID NO: 60779 - protein, 9 aa, BK Virus
LIWFRPVAD

SEQ ID NO: 60780 - protein, 15 aa, BK Virus
LIWFRPVADFSKDIQ

SEQ ID NO: 60781 - protein, 9 aa, BK Virus
LIWFRPVAD

SEQ ID NO: 60782 - protein, 15 aa, BK Virus
EWESWWSSFNEKWDE

SEQ ID NO: 60783 - protein, 9 aa, BK Virus
WESWWSSFN

SEQ ID NO: 60784 - protein, 15 aa, BK Virus
WESWWSSFNEKWDED

SEQ ID NO: 60785 - protein, 9 aa, BK Virus
WESWWSSFN

SEQ ID NO: 60786 - protein, 15 aa, BK Virus
EDKMKRMNTLYKKME

SEQ ID NO: 60787 - protein, 9 aa, BK Virus
MKRMNTLYK

SEQ ID NO: 60788 - protein, 15 aa, BK Virus
DKMKRMNTLYKKMEQ

SEQ ID NO: 60789 - protein, 9 aa, BK Virus
MKRMNTLYK

SEQ ID NO: 60790 - protein, 15 aa, BK Virus
GDEDKMKRMNTLYKK

SEQ ID NO: 60791 - protein, 9 aa, BK Virus
MKRMNTLYK

SEQ ID NO: 60792 - protein, 15 aa, BK Virus
GGDEDKMKRMNTLYK

SEQ ID NO: 60793 - protein, 9 aa, BK Virus
DKMKRMNTL

SEQ ID NO: 60794 - protein, 15 aa, BK Virus
DEDKMKRMNTLYKKM

SEQ ID NO: 60795 - protein, 9 aa, BK Virus
MKRMNTLYK

SEQ ID NO: 60796 - protein, 15 aa, BK Virus
GHGINNLDSLRDYLD

SEQ ID NO: 60797 - protein, 9 aa, BK Virus
INNLDSLRD

SEQ ID NO: 60798 - protein, 15 aa, BK Virus
HGINNLDSLRDYLDG

SEQ ID NO: 60799 - protein, 9 aa, BK Virus
INNLDSLRD

SEQ ID NO: 60800 - protein, 15 aa, BK Virus
GLERAAWGNLPLMRK

SEQ ID NO: 60801 - protein, 9 aa, BK Virus
RAAWGNLPL

SEQ ID NO: 60802 - protein, 15 aa, BK Virus
LPSGHGINNLDSLRD

SEQ ID NO: 60803 - protein, 9 aa, BK Virus
GHGINNLDS

SEQ ID NO: 60804 - protein, 15 aa, BK Virus
LERAAWGNLPLMRKA

SEQ ID NO: 60805 - protein, 9 aa, BK Virus
RAAWGNLPL

SEQ ID NO: 60806 - protein, 15 aa, BK Virus
PSGHGINNLDSLRDY

SEQ ID NO: 60807 - protein, 9 aa, BK Virus
INNLDSLRD

SEQ ID NO: 60808 - protein, 15 aa, BK Virus
SGHGINNLDSLRDYL

SEQ ID NO: 60809 - protein, 9 aa, BK Virus
INNLDSLRD

SEQ ID NO: 60810 - protein, 15 aa, BK Virus
KMKRMNTLYKKMEQD

SEQ ID NO: 60811 - protein, 9 aa, BK Virus
MKRMNTLYK

SEQ ID NO: 60812 - protein, 15 aa, BK Virus
MKRMNTLYKKMEQDV

SEQ ID NO: 60813 - protein, 9 aa, BK Virus
MKRMNTLYK

SEQ ID NO: 60814 - protein, 15 aa, BK Virus
AGVAWLHCLLPKMDS

SEQ ID NO: 60815 - protein, 9 aa, BK Virus
VAWLHCLLP

SEQ ID NO: 60816 - protein, 15 aa, BK Virus
ESWWSSFNEKWDEDL

SEQ ID NO: 60817 - protein, 9 aa, BK Virus
WSSFNEKWD

SEQ ID NO: 60818 - protein, 15 aa, BK Virus
MAGVAWLHCLLPKMD

SEQ ID NO: 60819 - protein, 9 aa, BK Virus
VAWLHCLLP

SEQ ID NO: 60820 - protein, 15 aa, BK Virus
EQYMAGVAWLHCLLP

SEQ ID NO: 60821 - protein, 9 aa, BK Virus
YMAGVAWLH

SEQ ID NO: 60822 - protein, 15 aa, BK Virus
VAHQPDFGTWNSSEV

SEQ ID NO: 60823 - protein, 9 aa, BK Virus
QPDFGTWNS

SEQ ID NO: 60824 - protein, 15 aa, BK Virus
VPKRRYWLFKGPIDS

SEQ ID NO: 60825 - protein, 9 aa, BK Virus
YWLFKGPID

SEQ ID NO: 60826 - protein, 15 aa, BK Virus
QYMAGVAWLHCLLPK

SEQ ID NO: 60827 - protein, 9 aa, BK Virus
VAWLHCLLP

SEQ ID NO: 60828 - protein, 15 aa, BK Virus
KRRYWLFKGPIDSGK

SEQ ID NO: 60829 - protein, 9 aa, BK Virus
YWLFKGPID

SEQ ID NO: 60830 - protein, 15 aa, BK Virus
PKRRYWLFKGPIDSG

SEQ ID NO: 60831 - protein, 9 aa, BK Virus
YWLFKGPID

SEQ ID NO: 60832 - protein, 15 aa, BK Virus
ERAAWGNLPLMRKAY

SEQ ID NO: 60833 - protein, 9 aa, BK Virus
WGNLPLMRK

SEQ ID NO: 60834 - protein, 15 aa, BK Virus
AHQPDFGTWNSSEVP

SEQ ID NO: 60835 - protein, 9 aa, BK Virus
FGTWNSSEV

SEQ ID NO: 60836 - protein, 15 aa, BK Virus
YMAGVAWLHCLLPKM

SEQ ID NO: 60837 - protein, 9 aa, BK Virus
VAWLHCLLP

SEQ ID NO: 60838 - protein, 15 aa, BK Virus
RRYWLFKGPIDSGKT

SEQ ID NO: 60839 - protein, 9 aa, BK Virus
YWLFKGPID

SEQ ID NO: 60840 - protein, 15 aa, BK Virus
NVPKRRYWLFKGPID

SEQ ID NO: 60841 - protein, 9 aa, BK Virus
RYWLFKGPI

SEQ ID NO: 60842 - protein, 15 aa, BK Virus
LGLERAAWGNLPLMR

SEQ ID NO: 60843 - protein, 9 aa, BK Virus
RAAWGNLPL

SEQ ID NO: 60844 - protein, 15 aa, BK Virus
LLGLERAAWGNLPLM

SEQ ID NO: 60845 - protein, 9 aa, BK Virus
RAAWGNLPL

SEQ ID NO: 60846 - protein, 15 aa, BK Virus
INNLDSLRDYLDGSV

SEQ ID NO: 60847 - protein, 9 aa, BK Virus
INNLDSLRD

SEQ ID NO: 60848 - protein, 15 aa, BK Virus
GINNLDSLRDYLDGS

SEQ ID NO: 60849 - protein, 9 aa, BK Virus
INNLDSLRD

SEQ ID NO: 60850 - protein, 15 aa, BK Virus
DLLGLERAAWGNLPL

SEQ ID NO: 60851 - protein, 9 aa, BK Virus
ERAAWGNLP

SEQ ID NO: 60852 - protein, 15 aa, BK Virus
HQPDFGTWNSSEVPT

SEQ ID NO: 60853 - protein, 9 aa, BK Virus
FGTWNSSEV

SEQ ID NO: 60854 - protein, 15 aa, BK Virus
CSSQVSDTSAPDSEN

SEQ ID NO: 60855 - protein, 9 aa, BK Virus
QVSDTSAPD

SEQ ID NO: 60856 - protein, 15 aa, BK Virus
SSQVSDTSAPDSENP

SEQ ID NO: 60857 - protein, 9 aa, BK Virus
QVSDTSAPD

SEQ ID NO: 60858 - protein, 15 aa, BK Virus
HCVVFNVPKRRYWLF

SEQ ID NO: 60859 - protein, 9 aa, BK Virus
VFNVPKRRY

SEQ ID NO: 60860 - protein, 15 aa, BK Virus
CVVFNVPKRRYWLFK

SEQ ID NO: 60861 - protein, 9 aa, BK Virus
VPKRRYWLF

SEQ ID NO: 60862 - protein, 15 aa, BK Virus
VVFNVPKRRYWLFKG

SEQ ID NO: 60863 - protein, 9 aa, BK Virus
VPKRRYWLF

SEQ ID NO: 60864 - protein, 15 aa, BK Virus
VFNVPKRRYWLFKGP

SEQ ID NO: 60865 - protein, 9 aa, BK Virus
VPKRRYWLF

SEQ ID NO: 60866 - protein, 15 aa, BK Virus
QPDFGTWNSSEVPTY

SEQ ID NO: 60867 - protein, 9 aa, BK Virus
FGTWNSSEV

SEQ ID NO: 60868 - protein, 15 aa, BK Virus
PDFGTWNSSEVPTYG

SEQ ID NO: 60869 - protein, 9 aa, BK Virus
FGTWNSSEV

SEQ ID NO: 60870 - protein, 15 aa, BK Virus
VAHQPDFGTWNSSEV

SEQ ID NO: 60871 - protein, 9 aa, BK Virus
DFGTWNSSE

SEQ ID NO: 60872 - protein, 15 aa, BK Virus
AHQPDFGTWNSSEVP

SEQ ID NO: 60873 - protein, 9 aa, BK Virus
FGTWNSSEV

SEQ ID NO: 60874 - protein, 15 aa, BK Virus
HQPDFGTWNSSEVPT

SEQ ID NO: 60875 - protein, 9 aa, BK Virus
FGTWNSSEV

SEQ ID NO: 60876 - protein, 15 aa, BK Virus
FNVPKRRYWLFKGPI

SEQ ID NO: 60877 - protein, 9 aa, BK Virus
VPKRRYWLF

SEQ ID NO: 60878 - protein, 15 aa, BK Virus
HNIIFFLTPHRHRVS

SEQ ID NO: 60879 - protein, 9 aa, BK Virus
IFFLTPHRH

SEQ ID NO: 60880 - protein, 15 aa, BK Virus
NIIFFLTPHRHRVSA

SEQ ID NO: 60881 - protein, 9 aa, BK Virus
IFFLTPHRH

SEQ ID NO: 60882 - protein, 15 aa, BK Virus
GHNIIFFLTPHRHRV
